United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 196

SEQ ID NO: 8151523 - DNA, 22 bp, Homo sapiens
tccaggagggattgggctgtgg

SEQ ID NO: 8151524 - DNA, 22 bp, Homo sapiens
tccaggaggggtaggcagtatg

SEQ ID NO: 8151525 - DNA, 22 bp, Homo sapiens
tccaggaggggtaggcagtatg

SEQ ID NO: 8151526 - DNA, 22 bp, Homo sapiens
tccaggaggtatgagtggcccc

SEQ ID NO: 8151527 - DNA, 22 bp, Homo sapiens
tccaggagggttttctgccttc

SEQ ID NO: 8151528 - DNA, 22 bp, Homo sapiens
tccaggaggttgagactgcagt

SEQ ID NO: 8151529 - DNA, 22 bp, Homo sapiens
tccaggaggttgagactgcagt

SEQ ID NO: 8151530 - DNA, 20 bp, Homo sapiens
tccaggaggttagtgtggct

SEQ ID NO: 8151531 - DNA, 22 bp, Homo sapiens
tccaggaggttgagactgcagt

SEQ ID NO: 8151532 - DNA, 20 bp, Homo sapiens
tccaggaggttagtgtggct

SEQ ID NO: 8151533 - DNA, 22 bp, Homo sapiens
tccaggagtcagacagatggtg

SEQ ID NO: 8151534 - DNA, 22 bp, Homo sapiens
tccaggaggttgagtgagttcc

SEQ ID NO: 8151535 - DNA, 22 bp, Homo sapiens
tccaggagtcctgggtggcccc

SEQ ID NO: 8151536 - DNA, 22 bp, Homo sapiens
tccaggagtcctgggtggcccc

SEQ ID NO: 8151537 - DNA, 22 bp, Homo sapiens
tccaggagtcctgggagtgatt

SEQ ID NO: 8151538 - DNA, 22 bp, Homo sapiens
tccaggagtcctgggagtgatt

SEQ ID NO: 8151539 - DNA, 22 bp, Homo sapiens
tccaggagtctagcctcaggcc

SEQ ID NO: 8151540 - DNA, 22 bp, Homo sapiens
tccaggagtgataaggccactg

SEQ ID NO: 8151541 - DNA, 22 bp, Homo sapiens
tccaggagtctagcctcaggcc

SEQ ID NO: 8151542 - DNA, 22 bp, Homo sapiens
tccccaggagttttactttgca

SEQ ID NO: 8151543 - DNA, 22 bp, Homo sapiens
tccccaggagttttactttgca

SEQ ID NO: 8151544 - DNA, 20 bp, Homo sapiens
tccccagggcatcaggagca

SEQ ID NO: 8151545 - DNA, 20 bp, Homo sapiens
tccccagggcatcaggagca

SEQ ID NO: 8151546 - DNA, 22 bp, Homo sapiens
tccccaggggcatctctctgct

SEQ ID NO: 8151547 - DNA, 22 bp, Homo sapiens
tccccaggggcatctctctgct

SEQ ID NO: 8151548 - DNA, 22 bp, Homo sapiens
tccccagggctgcagagggtgt

SEQ ID NO: 8151549 - DNA, 22 bp, Homo sapiens
tccccagggctgcagagggtgt

SEQ ID NO: 8151550 - DNA, 22 bp, Homo sapiens
tccccaggggcatctctctgct

SEQ ID NO: 8151551 - DNA, 22 bp, Homo sapiens
tccccaggggcatctctctgct

SEQ ID NO: 8151552 - DNA, 22 bp, Homo sapiens
tccccaggggcatctctctgct

SEQ ID NO: 8151553 - DNA, 22 bp, Homo sapiens
tccccaggggcctgggcacagt

SEQ ID NO: 8151554 - DNA, 22 bp, Homo sapiens
tccccagggtccctgcttccat

SEQ ID NO: 8151555 - DNA, 22 bp, Homo sapiens
tccccagggtccctgcttccat

SEQ ID NO: 8151556 - DNA, 22 bp, Homo sapiens
tccccagggtccctgcttccat

SEQ ID NO: 8151557 - DNA, 22 bp, Homo sapiens
tccccacctacacactgctcct

SEQ ID NO: 8151558 - DNA, 22 bp, Homo sapiens
tccccacctacacactgctcct

SEQ ID NO: 8151559 - DNA, 22 bp, Homo sapiens
tccccacctaagatacccatct

SEQ ID NO: 8151560 - DNA, 22 bp, Homo sapiens
tccccaccccagaactactagg

SEQ ID NO: 8151561 - DNA, 22 bp, Homo sapiens
tccccaggaaggcccttcctgg

SEQ ID NO: 8151562 - DNA, 22 bp, Homo sapiens
tccccaggagcaatgattcagt

SEQ ID NO: 8151563 - DNA, 22 bp, Homo sapiens
tccccacagcagaagatctgag

SEQ ID NO: 8151564 - DNA, 22 bp, Homo sapiens
tccccacatctctgcatcaggc

SEQ ID NO: 8151565 - DNA, 22 bp, Homo sapiens
tccccacactttcactcctggc

SEQ ID NO: 8151566 - DNA, 22 bp, Homo sapiens
tccccacatctctgcatcaggc

SEQ ID NO: 8151567 - DNA, 21 bp, Homo sapiens
tccccacatttctaaacagac

SEQ ID NO: 8151568 - DNA, 19 bp, Homo sapiens
tccccaagagttctagctc

SEQ ID NO: 8151569 - DNA, 22 bp, Homo sapiens
tccccacacagatacagagtag

SEQ ID NO: 8151570 - DNA, 22 bp, Homo sapiens
tccccaatttgagtcacctctg

SEQ ID NO: 8151571 - DNA, 22 bp, Homo sapiens
tccccaagcaggcaatctcccg

SEQ ID NO: 8151572 - DNA, 22 bp, Homo sapiens
tcccatcacatggagagtgaag

SEQ ID NO: 8151573 - DNA, 22 bp, Homo sapiens
tcccatcaatgtctgcagaaga

SEQ ID NO: 8151574 - DNA, 22 bp, Homo sapiens
tcccagtgtggcaggccatgga

SEQ ID NO: 8151575 - DNA, 22 bp, Homo sapiens
tcccagtggtcctggccctggg

SEQ ID NO: 8151576 - DNA, 22 bp, Homo sapiens
tcccagtggtcttgaaacaggg

SEQ ID NO: 8151577 - DNA, 22 bp, Homo sapiens
tcccagtggtcctggccctggg

SEQ ID NO: 8151578 - DNA, 22 bp, Homo sapiens
tcccagtgtggcaggccatgga

SEQ ID NO: 8151579 - DNA, 22 bp, Homo sapiens
tcccagtgtggcaggccatgga

SEQ ID NO: 8151580 - DNA, 22 bp, Homo sapiens
tcccagtgctgctaaagaggta

SEQ ID NO: 8151581 - DNA, 22 bp, Homo sapiens
tcccagtgaggtcctggctgtc

SEQ ID NO: 8151582 - DNA, 22 bp, Homo sapiens
tcccagtgaggtcctggctgtc

SEQ ID NO: 8151583 - DNA, 22 bp, Homo sapiens
tcccagtgaggtcctggctgtc

SEQ ID NO: 8151584 - DNA, 22 bp, Homo sapiens
tcccagtgagatgaaacaggta

SEQ ID NO: 8151585 - DNA, 22 bp, Homo sapiens
tcccaggttccaccatccaggg

SEQ ID NO: 8151586 - DNA, 23 bp, Homo sapiens
tcccattgccctatagtgcctca

SEQ ID NO: 8151587 - DNA, 22 bp, Homo sapiens
tcccatttattaattagtttgc

SEQ ID NO: 8151588 - DNA, 22 bp, Homo sapiens
tcccatgttaccaaggagtcac

SEQ ID NO: 8151589 - DNA, 22 bp, Homo sapiens
tcccatgtaagaaggagacagg

SEQ ID NO: 8151590 - DNA, 22 bp, Homo sapiens
tcccatggatagtgaccttgtt

SEQ ID NO: 8151591 - DNA, 23 bp, Homo sapiens
tcccatgggctcactgccctgca

SEQ ID NO: 8151592 - DNA, 23 bp, Homo sapiens
tcccatgggctcactgccctgca

SEQ ID NO: 8151593 - DNA, 23 bp, Homo sapiens
tcccatgggctcactgccctgca

SEQ ID NO: 8151594 - DNA, 22 bp, Homo sapiens
tcccatggtctatatagaggca

SEQ ID NO: 8151595 - DNA, 22 bp, Homo sapiens
tcccacagcttcgtgcttcccc

SEQ ID NO: 8151596 - DNA, 22 bp, Homo sapiens
tcccacaggagcctgagtccca

SEQ ID NO: 8151597 - DNA, 22 bp, Homo sapiens
tcccacaggagcctgagtccca

SEQ ID NO: 8151598 - DNA, 22 bp, Homo sapiens
tcccacaggcccagggcggaaa

SEQ ID NO: 8151599 - DNA, 22 bp, Homo sapiens
tcccacaggcccagggcggaaa

SEQ ID NO: 8151600 - DNA, 22 bp, Homo sapiens
tcccacagtgaagttcatgata

SEQ ID NO: 8151601 - DNA, 22 bp, Homo sapiens
tcccacaggtggagcttgcagt

SEQ ID NO: 8151602 - DNA, 22 bp, Homo sapiens
tcccacaggtggagcttgcagt

SEQ ID NO: 8151603 - DNA, 22 bp, Homo sapiens
tcccacagggcttctctgtaca

SEQ ID NO: 8151604 - DNA, 22 bp, Homo sapiens
tcccacaggggctctgtgggtt

SEQ ID NO: 8151605 - DNA, 22 bp, Homo sapiens
tcccagggactgggctaggctt

SEQ ID NO: 8151606 - DNA, 22 bp, Homo sapiens
tcccagggactgggctaggctt

SEQ ID NO: 8151607 - DNA, 22 bp, Homo sapiens
tcccagggatcctccgggtcgc

SEQ ID NO: 8151608 - DNA, 22 bp, Homo sapiens
tcccagggtgaaatgcagtagg

SEQ ID NO: 8151609 - DNA, 22 bp, Homo sapiens
tcccagggtgaaatgcagtagg

SEQ ID NO: 8151610 - DNA, 22 bp, Homo sapiens
tcccagggtgcgcctgccctcg

SEQ ID NO: 8151611 - DNA, 22 bp, Homo sapiens
tcccagggtgcgcctgccctcg

SEQ ID NO: 8151612 - DNA, 22 bp, Homo sapiens
tcccagggttacagccagggca

SEQ ID NO: 8151613 - DNA, 22 bp, Homo sapiens
tcccagggttacagccagggca

SEQ ID NO: 8151614 - DNA, 22 bp, Homo sapiens
tcccaggttccaccatccaggg

SEQ ID NO: 8151615 - DNA, 22 bp, Homo sapiens
tcccaggtgatgctgaggccac

SEQ ID NO: 8151616 - DNA, 22 bp, Homo sapiens
tcccaggtgatgctgaggccac

SEQ ID NO: 8151617 - DNA, 22 bp, Homo sapiens
tcccaggtctttgggttcctca

SEQ ID NO: 8151618 - DNA, 22 bp, Homo sapiens
gttttcattactgctgtgattt

SEQ ID NO: 8151619 - DNA, 22 bp, Homo sapiens
gttttcttcctgcaattggcat

SEQ ID NO: 8151620 - DNA, 22 bp, Homo sapiens
gttttcattactgctgtgattt

SEQ ID NO: 8151621 - DNA, 22 bp, Homo sapiens
gttttcattactgctgtgattt

SEQ ID NO: 8151622 - DNA, 22 bp, Homo sapiens
gttttcttcctgcaattggcat

SEQ ID NO: 8151623 - DNA, 22 bp, Homo sapiens
gttttgaaatgaaagaaccaag

SEQ ID NO: 8151624 - DNA, 18 bp, Homo sapiens
gttttgtggctagtagtg

SEQ ID NO: 8151625 - DNA, 22 bp, Homo sapiens
gttttgttgctgcagagctcaa

SEQ ID NO: 8151626 - DNA, 19 bp, Homo sapiens
gttttgcaggcagagggga

SEQ ID NO: 8151627 - DNA, 19 bp, Homo sapiens
gttttgcaggcagagggga

SEQ ID NO: 8151628 - DNA, 22 bp, Homo sapiens
gttttgatatatgcatacatta

SEQ ID NO: 8151629 - DNA, 22 bp, Homo sapiens
gttttgcagagtgcaataaatc

SEQ ID NO: 8151630 - DNA, 22 bp, Homo sapiens
gttttgatatatgcatacatta

SEQ ID NO: 8151631 - DNA, 18 bp, Homo sapiens
gttttgaattgtcttaca

SEQ ID NO: 8151632 - DNA, 22 bp, Homo sapiens
gtttcccaggctgtggggccct

SEQ ID NO: 8151633 - DNA, 22 bp, Homo sapiens
gttttcatgtctattgggcata

SEQ ID NO: 8151634 - DNA, 22 bp, Homo sapiens
gtttccatggtgtttcttgggt

SEQ ID NO: 8151635 - DNA, 22 bp, Homo sapiens
gtttccatgggagaagacagtg

SEQ ID NO: 8151636 - DNA, 22 bp, Homo sapiens
gtttccagggctctcttcatga

SEQ ID NO: 8151637 - DNA, 22 bp, Homo sapiens
gtttccagtcaacttgtgtgtg

SEQ ID NO: 8151638 - DNA, 22 bp, Homo sapiens
gtttccagtcaacttgtgtgtg

SEQ ID NO: 8151639 - DNA, 22 bp, Homo sapiens
gtttccagtcaacttgtgtgtg

SEQ ID NO: 8151640 - DNA, 22 bp, Homo sapiens
gtttccaggctttggtatggtt

SEQ ID NO: 8151641 - DNA, 22 bp, Homo sapiens
gtttccagggctctcttcatga

SEQ ID NO: 8151642 - DNA, 22 bp, Homo sapiens
gtttccaggctttggtatggtt

SEQ ID NO: 8151643 - DNA, 22 bp, Homo sapiens
gtttccaggcagggtgattctc

SEQ ID NO: 8151644 - DNA, 22 bp, Homo sapiens
gtttccaggcactttttctgct

SEQ ID NO: 8151645 - DNA, 22 bp, Homo sapiens
gtttccaggcagggtgattctc

SEQ ID NO: 8151646 - DNA, 22 bp, Homo sapiens
gtttccaggcagggtgattctc

SEQ ID NO: 8151647 - DNA, 22 bp, Homo sapiens
gtttccaggcccctccctagac

SEQ ID NO: 8151648 - DNA, 22 bp, Homo sapiens
gtttccaggcccctccctagac

SEQ ID NO: 8151649 - DNA, 22 bp, Homo sapiens
gtttccaggctttggtatggtt

SEQ ID NO: 8151650 - DNA, 22 bp, Homo sapiens
gtttccaggctgggcagcgagc

SEQ ID NO: 8151651 - DNA, 22 bp, Homo sapiens
gtttccaggctgggcagcgagc

SEQ ID NO: 8151652 - DNA, 22 bp, Homo sapiens
gtttccaggcgatatcagctgc

SEQ ID NO: 8151653 - DNA, 22 bp, Homo sapiens
gtttccaggcgatatcagctgc

SEQ ID NO: 8151654 - DNA, 22 bp, Homo sapiens
gtttccagccctgcaggtttaa

SEQ ID NO: 8151655 - DNA, 22 bp, Homo sapiens
gtttccagcctagagatggtga

SEQ ID NO: 8151656 - DNA, 22 bp, Homo sapiens
gtttccagcctagagatggtga

SEQ ID NO: 8151657 - DNA, 22 bp, Homo sapiens
gtttccagcctcctgggtaaag

SEQ ID NO: 8151658 - DNA, 22 bp, Homo sapiens
gtttccagcctagagatggtga

SEQ ID NO: 8151659 - DNA, 22 bp, Homo sapiens
gtttccagccctgcaggtttaa

SEQ ID NO: 8151660 - DNA, 22 bp, Homo sapiens
gtttccagccaatcccctcagg

SEQ ID NO: 8151661 - DNA, 22 bp, Homo sapiens
gtttccagccaatcccctcagg

SEQ ID NO: 8151662 - DNA, 22 bp, Homo sapiens
gtttccagagtgagggcacttg

SEQ ID NO: 8151663 - DNA, 22 bp, Homo sapiens
gtttccagagggaatatttgct

SEQ ID NO: 8151664 - DNA, 22 bp, Homo sapiens
gtttccagagtgagggcacttg

SEQ ID NO: 8151665 - DNA, 22 bp, Homo sapiens
gtttccagagtgagggcacttg

SEQ ID NO: 8151666 - DNA, 22 bp, Homo sapiens
gtttccagagggaatatttgct

SEQ ID NO: 8151667 - DNA, 22 bp, Homo sapiens
gtttccaggaagggttgggagg

SEQ ID NO: 8151668 - DNA, 22 bp, Homo sapiens
gtttccaggaagggttgggagg

SEQ ID NO: 8151669 - DNA, 22 bp, Homo sapiens
gtttccaggcactttttctgct

SEQ ID NO: 8151670 - DNA, 22 bp, Homo sapiens
gtttccaggaggctacacctga

SEQ ID NO: 8151671 - DNA, 22 bp, Homo sapiens
gtttccaggaggctacacctga

SEQ ID NO: 8151672 - DNA, 22 bp, Homo sapiens
gtttccagctttctgatgcttg

SEQ ID NO: 8151673 - DNA, 22 bp, Homo sapiens
gtttccagcttgggcccgggga

SEQ ID NO: 8151674 - DNA, 22 bp, Homo sapiens
gtttccagctttctgatgcttg

SEQ ID NO: 8151675 - DNA, 22 bp, Homo sapiens
gtttccagctttctgatgcttg

SEQ ID NO: 8151676 - DNA, 22 bp, Homo sapiens
gtttccagctcttagcaaaggc

SEQ ID NO: 8151677 - DNA, 22 bp, Homo sapiens
gtttccagcctcctgggtaaag

SEQ ID NO: 8151678 - DNA, 22 bp, Homo sapiens
gtttccagcttgggcccgggga

SEQ ID NO: 8151679 - DNA, 22 bp, Homo sapiens
gtttccagctcttagcaaaggc

SEQ ID NO: 8151680 - DNA, 22 bp, Homo sapiens
gtttccagagatcatttacata

SEQ ID NO: 8151681 - DNA, 22 bp, Homo sapiens
gtttccagagatcatttacata

SEQ ID NO: 8151682 - DNA, 22 bp, Homo sapiens
gtttccagagatcatttacata

SEQ ID NO: 8151683 - DNA, 22 bp, Homo sapiens
gtttccacttatatggtaccta

SEQ ID NO: 8151684 - DNA, 22 bp, Homo sapiens
gtttccacttgagaggactcct

SEQ ID NO: 8151685 - DNA, 22 bp, Homo sapiens
gtttccacgtctcagttccaaa

SEQ ID NO: 8151686 - DNA, 19 bp, Homo sapiens
gttttgtttgcagaactta

SEQ ID NO: 8151687 - DNA, 22 bp, Homo sapiens
gtttttatctaatagcagttat

SEQ ID NO: 8151688 - DNA, 22 bp, Homo sapiens
gtttttatctaatagcagttat

SEQ ID NO: 8151689 - DNA, 22 bp, Homo sapiens
gtttttatatcctgtggagtgt

SEQ ID NO: 8151690 - DNA, 22 bp, Homo sapiens
gtttttatatcctgtggagtgt

SEQ ID NO: 8151691 - DNA, 22 bp, Homo sapiens
gtttttatatcctgtggagtgt

SEQ ID NO: 8151692 - DNA, 22 bp, Homo sapiens
gtttttatatcctgtggagtgt

SEQ ID NO: 8151693 - DNA, 22 bp, Homo sapiens
gtttttattgtgtaaatgtggg

SEQ ID NO: 8151694 - DNA, 22 bp, Homo sapiens
gtttttattgtgtaaatgtggg

SEQ ID NO: 8151695 - DNA, 22 bp, Homo sapiens
gtttttatctaatagcagttat

SEQ ID NO: 8151696 - DNA, 22 bp, Homo sapiens
gtttttatctaatagcagttat

SEQ ID NO: 8151697 - DNA, 22 bp, Homo sapiens
gtttttattgtgtaaatgtggg

SEQ ID NO: 8151698 - DNA, 22 bp, Homo sapiens
taaaatgccagaccagttcacg

SEQ ID NO: 8151699 - DNA, 22 bp, Homo sapiens
taaaatggtaactttcatttgc

SEQ ID NO: 8151700 - DNA, 19 bp, Homo sapiens
taaaatgtctgtggtcagt

SEQ ID NO: 8151701 - DNA, 22 bp, Homo sapiens
taaaatgatctctcatgttctt

SEQ ID NO: 8151702 - DNA, 22 bp, Homo sapiens
taaaatgatctctcatgttctt

SEQ ID NO: 8151703 - DNA, 22 bp, Homo sapiens
taaaatgatctctcatgttctt

SEQ ID NO: 8151704 - DNA, 22 bp, Homo sapiens
taaaatgatctctcatgttctt

SEQ ID NO: 8151705 - DNA, 22 bp, Homo sapiens
taaaatgcacagcagttgaaag

SEQ ID NO: 8151706 - DNA, 22 bp, Homo sapiens
taaaatgcacagcagttgaaag

SEQ ID NO: 8151707 - DNA, 22 bp, Homo sapiens
taaaatagaggatgtcatgcta

SEQ ID NO: 8151708 - DNA, 22 bp, Homo sapiens
taaaagttttagttgtacataa

SEQ ID NO: 8151709 - DNA, 22 bp, Homo sapiens
taaaagttttagttgtacataa

SEQ ID NO: 8151710 - DNA, 18 bp, Homo sapiens
taaaattcaaggcagggt

SEQ ID NO: 8151711 - DNA, 22 bp, Homo sapiens
taaaatgtttgcaagagaccag

SEQ ID NO: 8151712 - DNA, 22 bp, Homo sapiens
taaaatttgtccctgagtgttg

SEQ ID NO: 8151713 - DNA, 22 bp, Homo sapiens
taaaatttgtccctgagtgttg

SEQ ID NO: 8151714 - DNA, 22 bp, Homo sapiens
taaaattgcggtgaatatttcc

SEQ ID NO: 8151715 - DNA, 22 bp, Homo sapiens
taaaatttgtccctgagtgttg

SEQ ID NO: 8151716 - DNA, 22 bp, Homo sapiens
taaacactcacttcatagccat

SEQ ID NO: 8151717 - DNA, 22 bp, Homo sapiens
taaacaagctgtctgatattct

SEQ ID NO: 8151718 - DNA, 22 bp, Homo sapiens
taaacaagctggactgataagt

SEQ ID NO: 8151719 - DNA, 22 bp, Homo sapiens
taaacaagctggactgataagt

SEQ ID NO: 8151720 - DNA, 22 bp, Homo sapiens
taaagggtaggttttactgtaa

SEQ ID NO: 8151721 - DNA, 22 bp, Homo sapiens
taaacagaattcaggcaagata

SEQ ID NO: 8151722 - DNA, 22 bp, Homo sapiens
taaacagaatgcgtaagaagtg

SEQ ID NO: 8151723 - DNA, 22 bp, Homo sapiens
taaacactgccttggtgggtca

SEQ ID NO: 8151724 - DNA, 22 bp, Homo sapiens
taactctttactatacatttat

SEQ ID NO: 8151725 - DNA, 22 bp, Homo sapiens
taactgaatgtattacaacaga

SEQ ID NO: 8151726 - DNA, 22 bp, Homo sapiens
taactgagcctaaggcagtaga

SEQ ID NO: 8151727 - DNA, 22 bp, Homo sapiens
taactgatgttcccttactgta

SEQ ID NO: 8151728 - DNA, 22 bp, Homo sapiens
taactcaaatatgttgtctgaa

SEQ ID NO: 8151729 - DNA, 22 bp, Homo sapiens
taactcaaatacttatgttact

SEQ ID NO: 8151730 - DNA, 22 bp, Homo sapiens
taactcaaatacttatgttact

SEQ ID NO: 8151731 - DNA, 22 bp, Homo sapiens
taactagtcatgtcataacacc

SEQ ID NO: 8151732 - DNA, 22 bp, Homo sapiens
taactaggattacaagcgtgcg

SEQ ID NO: 8151733 - DNA, 22 bp, Homo sapiens
taactctgaatcctcacagcag

SEQ ID NO: 8151734 - DNA, 22 bp, Homo sapiens
taactctgcttgttctctgagt

SEQ ID NO: 8151735 - DNA, 23 bp, Homo sapiens
taactctgtgaagggtgactggg

SEQ ID NO: 8151736 - DNA, 22 bp, Homo sapiens
taactacatttcactgcaatta

SEQ ID NO: 8151737 - DNA, 22 bp, Homo sapiens
taactacaagggcggtctctgt

SEQ ID NO: 8151738 - DNA, 22 bp, Homo sapiens
taactaagtgactcaagtgatc

SEQ ID NO: 8151739 - DNA, 22 bp, Homo sapiens
taacctggatgtgccaacgtga

SEQ ID NO: 8151740 - DNA, 22 bp, Homo sapiens
taacctggggcctgaagaccat

SEQ ID NO: 8151741 - DNA, 22 bp, Homo sapiens
taaattcagtgagtaatttctg

SEQ ID NO: 8151742 - DNA, 22 bp, Homo sapiens
taaattcagtgagtaatttctg

SEQ ID NO: 8151743 - DNA, 22 bp, Homo sapiens
taaattgaaaatctacagaaca

SEQ ID NO: 8151744 - DNA, 22 bp, Homo sapiens
taaattgaaaatctacagaaca

SEQ ID NO: 8151745 - DNA, 22 bp, Homo sapiens
taaattgtggccatttgtgttt

SEQ ID NO: 8151746 - DNA, 22 bp, Homo sapiens
taaattgtcctccccctggtat

SEQ ID NO: 8151747 - DNA, 22 bp, Homo sapiens
taaattgtgtgttgctagggga

SEQ ID NO: 8151748 - DNA, 22 bp, Homo sapiens
taaatttacccaaggaacatgt

SEQ ID NO: 8151749 - DNA, 22 bp, Homo sapiens
taaattgttttctagaagttgt

SEQ ID NO: 8151750 - DNA, 23 bp, Homo sapiens
taaattgatggtatgggttaagc

SEQ ID NO: 8151751 - DNA, 22 bp, Homo sapiens
taaattgagattattagggtaa

SEQ ID NO: 8151752 - DNA, 22 bp, Homo sapiens
taaattgcataagtacaaatga

SEQ ID NO: 8151753 - DNA, 22 bp, Homo sapiens
taaattgcataagtacaaatga

SEQ ID NO: 8151754 - DNA, 23 bp, Homo sapiens
taaattgatggtatgggttaagc

SEQ ID NO: 8151755 - DNA, 22 bp, Homo sapiens
taaatttacccaaggaacatgt

SEQ ID NO: 8151756 - DNA, 22 bp, Homo sapiens
taacattaaaagagataattga

SEQ ID NO: 8151757 - DNA, 22 bp, Homo sapiens
taacattaaaagagataattga

SEQ ID NO: 8151758 - DNA, 22 bp, Homo sapiens
taacattaaaagagataattga

SEQ ID NO: 8151759 - DNA, 22 bp, Homo sapiens
taacattaaaagagataattga

SEQ ID NO: 8151760 - DNA, 22 bp, Homo sapiens
taacattacggacatctgtcag

SEQ ID NO: 8151761 - DNA, 22 bp, Homo sapiens
taacattacggacatctgtcag

SEQ ID NO: 8151762 - DNA, 22 bp, Homo sapiens
taacctacatgagaactttaaa

SEQ ID NO: 8151763 - DNA, 22 bp, Homo sapiens
taaccatattttccattaagtt

SEQ ID NO: 8151764 - DNA, 20 bp, Homo sapiens
taaattagccttgaagatta

SEQ ID NO: 8151765 - DNA, 20 bp, Homo sapiens
taaattagccttgaagatta

SEQ ID NO: 8151766 - DNA, 22 bp, Homo sapiens
taaattatggctggcagagcag

SEQ ID NO: 8151767 - DNA, 22 bp, Homo sapiens
taaattagggactttagttaat

SEQ ID NO: 8151768 - DNA, 22 bp, Homo sapiens
taaattatggctggcagagcag

SEQ ID NO: 8151769 - DNA, 22 bp, Homo sapiens
taaattatggctggcagagcag

SEQ ID NO: 8151770 - DNA, 22 bp, Homo sapiens
taaattatgtcacatgactctg

SEQ ID NO: 8151771 - DNA, 22 bp, Homo sapiens
taaattcactcctggtagacct

SEQ ID NO: 8151772 - DNA, 22 bp, Homo sapiens
taaattaaagattggagaagga

SEQ ID NO: 8151773 - DNA, 22 bp, Homo sapiens
taaattaaagattggagaagga

SEQ ID NO: 8151774 - DNA, 22 bp, Homo sapiens
taaattactcaatgcacataaa

SEQ ID NO: 8151775 - DNA, 22 bp, Homo sapiens
taaattactcaatgcacataaa

SEQ ID NO: 8151776 - DNA, 22 bp, Homo sapiens
taaattagagccaggtaagttt

SEQ ID NO: 8151777 - DNA, 22 bp, Homo sapiens
taaattaaagattggagaagga

SEQ ID NO: 8151778 - DNA, 22 bp, Homo sapiens
taaagtgctggatttgagtaaa

SEQ ID NO: 8151779 - DNA, 22 bp, Homo sapiens
taaagtcaaggtactgtttcac

SEQ ID NO: 8151780 - DNA, 22 bp, Homo sapiens
taaagtgcccagggaaagcggg

SEQ ID NO: 8151781 - DNA, 22 bp, Homo sapiens
taaaggtttattcaacaaaata

SEQ ID NO: 8151782 - DNA, 22 bp, Homo sapiens
taaaggtttattcaacaaaata

SEQ ID NO: 8151783 - DNA, 22 bp, Homo sapiens
taaaggttattgcactggagtt

SEQ ID NO: 8151784 - DNA, 22 bp, Homo sapiens
taaaggttgaaaactgactgcc

SEQ ID NO: 8151785 - DNA, 22 bp, Homo sapiens
taaagtagcaagtttagactga

SEQ ID NO: 8151786 - DNA, 22 bp, Homo sapiens
taaagtagcgcctaactaatgt

SEQ ID NO: 8151787 - DNA, 22 bp, Homo sapiens
taaaggtatgtcttaatcaaac

SEQ ID NO: 8151788 - DNA, 22 bp, Homo sapiens
taaaggttataaaggttagggg

SEQ ID NO: 8151789 - DNA, 22 bp, Homo sapiens
taaaggttagtagcagggaaac

SEQ ID NO: 8151790 - DNA, 22 bp, Homo sapiens
taaaggtagtgtgacatattgt

SEQ ID NO: 8151791 - DNA, 22 bp, Homo sapiens
gttgatttgaagagcagaaagt

SEQ ID NO: 8151792 - DNA, 22 bp, Homo sapiens
gttgatttagtgagtgagcagt

SEQ ID NO: 8151793 - DNA, 22 bp, Homo sapiens
gttgatgaaaatgaattgcatg

SEQ ID NO: 8151794 - DNA, 22 bp, Homo sapiens
gttgattgattgattgactggt

SEQ ID NO: 8151795 - DNA, 22 bp, Homo sapiens
gttgcagatactgaagcacagg

SEQ ID NO: 8151796 - DNA, 22 bp, Homo sapiens
gttgcagactcaagaaaataaa

SEQ ID NO: 8151797 - DNA, 22 bp, Homo sapiens
gttgcagatgtggaactcgtgc

SEQ ID NO: 8151798 - DNA, 22 bp, Homo sapiens
gttgcagacactccacagtcga

SEQ ID NO: 8151799 - DNA, 22 bp, Homo sapiens
gttgccctggctctgcccagct

SEQ ID NO: 8151800 - DNA, 22 bp, Homo sapiens
gttgcctaggctggagtgcagt

SEQ ID NO: 8151801 - DNA, 22 bp, Homo sapiens
gttgccgtttgttctaccagac

SEQ ID NO: 8151802 - DNA, 22 bp, Homo sapiens
gttgcctaggctggtcttgaac

SEQ ID NO: 8151803 - DNA, 22 bp, Homo sapiens
gttgcaggaagcacacacatgt

SEQ ID NO: 8151804 - DNA, 22 bp, Homo sapiens
gttgcaggaggatggctgcata

SEQ ID NO: 8151805 - DNA, 22 bp, Homo sapiens
gttgcaggaggatggctgcata

SEQ ID NO: 8151806 - DNA, 22 bp, Homo sapiens
gttgggagcagcagaccaagag

SEQ ID NO: 8151807 - DNA, 22 bp, Homo sapiens
gttgctcaatgggaataagaat

SEQ ID NO: 8151808 - DNA, 22 bp, Homo sapiens
gttgctcaggcaggagtacagt

SEQ ID NO: 8151809 - DNA, 22 bp, Homo sapiens
gttgctcaggcaggagtacagt

SEQ ID NO: 8151810 - DNA, 22 bp, Homo sapiens
gttgggctcattacagcctgct

SEQ ID NO: 8151811 - DNA, 22 bp, Homo sapiens
gttgggagcagcagaccaagag

SEQ ID NO: 8151812 - DNA, 22 bp, Homo sapiens
gttggggtgctataaaaatgat

SEQ ID NO: 8151813 - DNA, 22 bp, Homo sapiens
gttggggtccaatgaagcgagc

SEQ ID NO: 8151814 - DNA, 18 bp, Homo sapiens
gtttcatgcatgtgaaac

SEQ ID NO: 8151815 - DNA, 19 bp, Homo sapiens
gtttcattaagataggaaa

SEQ ID NO: 8151816 - DNA, 22 bp, Homo sapiens
gtttcatggttgtttgatggca

SEQ ID NO: 8151817 - DNA, 22 bp, Homo sapiens
gtttcataattcaatcaaatga

SEQ ID NO: 8151818 - DNA, 22 bp, Homo sapiens
gtttcataggcatgtgacctat

SEQ ID NO: 8151819 - DNA, 22 bp, Homo sapiens
gttgtacagacatgaaacttgc

SEQ ID NO: 8151820 - DNA, 22 bp, Homo sapiens
gttgtaaatgactggcattggg

SEQ ID NO: 8151821 - DNA, 22 bp, Homo sapiens
gttggtgtctgtcttgttcatt

SEQ ID NO: 8151822 - DNA, 22 bp, Homo sapiens
gttgtaaatacagcagataatt

SEQ ID NO: 8151823 - DNA, 22 bp, Homo sapiens
gttgtaaatacagtactgaaac

SEQ ID NO: 8151824 - DNA, 22 bp, Homo sapiens
gttgtaaatacagcagataatt

SEQ ID NO: 8151825 - DNA, 22 bp, Homo sapiens
gttgtaaatacagtactgaaac

SEQ ID NO: 8151826 - DNA, 22 bp, Homo sapiens
gtttcagcttcctttactgcag

SEQ ID NO: 8151827 - DNA, 22 bp, Homo sapiens
gtttcagagttagtgctggctg

SEQ ID NO: 8151828 - DNA, 22 bp, Homo sapiens
gttcactggctgtgtgactctg

SEQ ID NO: 8151829 - DNA, 22 bp, Homo sapiens
gttcacatggcattttcacatc

SEQ ID NO: 8151830 - DNA, 22 bp, Homo sapiens
gttcaccatatggtaatttaat

SEQ ID NO: 8151831 - DNA, 22 bp, Homo sapiens
gttcacatgtgttatcttcttt

SEQ ID NO: 8151832 - DNA, 22 bp, Homo sapiens
gttcagcaatagatctagaggc

SEQ ID NO: 8151833 - DNA, 22 bp, Homo sapiens
gttcaagtttctgagctttaat

SEQ ID NO: 8151834 - DNA, 22 bp, Homo sapiens
gttcaagttatgcctttaccct

SEQ ID NO: 8151835 - DNA, 22 bp, Homo sapiens
gttacaaaggtcataaaagtgt

SEQ ID NO: 8151836 - DNA, 21 bp, Homo sapiens
gttcaagtgatcctcctgtct

SEQ ID NO: 8151837 - DNA, 22 bp, Homo sapiens
gttacaaaggactgggggccac

SEQ ID NO: 8151838 - DNA, 22 bp, Homo sapiens
gttacaaaggactgggggccac

SEQ ID NO: 8151839 - DNA, 22 bp, Homo sapiens
gttcaatttcagcatccattga

SEQ ID NO: 8151840 - DNA, 22 bp, Homo sapiens
gttcaattatacagtcagaggg

SEQ ID NO: 8151841 - DNA, 22 bp, Homo sapiens
gttcaatttagaaagcacagtt

SEQ ID NO: 8151842 - DNA, 22 bp, Homo sapiens
gttcaattaagttacaaattta

SEQ ID NO: 8151843 - DNA, 22 bp, Homo sapiens
gttcatgtggaaatttaaaaca

SEQ ID NO: 8151844 - DNA, 20 bp, Homo sapiens
gttcatgtctcaaatagaaa

SEQ ID NO: 8151845 - DNA, 22 bp, Homo sapiens
gttcattcagctgggtaggagg

SEQ ID NO: 8151846 - DNA, 22 bp, Homo sapiens
gttcattcaatctatttgcttc

SEQ ID NO: 8151847 - DNA, 22 bp, Homo sapiens
gttcattcatcaaatatttact

SEQ ID NO: 8151848 - DNA, 22 bp, Homo sapiens
gttcattctgaaaagcagcttg

SEQ ID NO: 8151849 - DNA, 22 bp, Homo sapiens
gttcatttaggaaaggaagagt

SEQ ID NO: 8151850 - DNA, 19 bp, Homo sapiens
gttcattgttcaggaaaat

SEQ ID NO: 8151851 - DNA, 22 bp, Homo sapiens
gttcatttatgatgtaacatgt

SEQ ID NO: 8151852 - DNA, 22 bp, Homo sapiens
gttcatttatgatgtaacatgt

SEQ ID NO: 8151853 - DNA, 22 bp, Homo sapiens
gttgaggagcaagcatgtgtct

SEQ ID NO: 8151854 - DNA, 22 bp, Homo sapiens
gttgaggaggcactcactgtca

SEQ ID NO: 8151855 - DNA, 22 bp, Homo sapiens
gttgaggaggttcagggtggtt

SEQ ID NO: 8151856 - DNA, 22 bp, Homo sapiens
gttgagtgggttaggatgctga

SEQ ID NO: 8151857 - DNA, 22 bp, Homo sapiens
gttcataatttgaaggaatagg

SEQ ID NO: 8151858 - DNA, 22 bp, Homo sapiens
gttcatattactttgagtgcag

SEQ ID NO: 8151859 - DNA, 22 bp, Homo sapiens
gttcatatttaactaagatagg

SEQ ID NO: 8151860 - DNA, 22 bp, Homo sapiens
gttcatattctaagtaactggc

SEQ ID NO: 8151861 - DNA, 22 bp, Homo sapiens
gttcagtgattctcggtgttca

SEQ ID NO: 8151862 - DNA, 22 bp, Homo sapiens
gttcagtgattctcggtgttca

SEQ ID NO: 8151863 - DNA, 22 bp, Homo sapiens
gttcagtgtctctctattttat

SEQ ID NO: 8151864 - DNA, 22 bp, Homo sapiens
gttcagtggtgtatccccagtg

SEQ ID NO: 8151865 - DNA, 22 bp, Homo sapiens
gttcagtgccagttctaagact

SEQ ID NO: 8151866 - DNA, 22 bp, Homo sapiens
gttcagtggggccttgggggac

SEQ ID NO: 8151867 - DNA, 22 bp, Homo sapiens
gttcagtggggccttgggggac

SEQ ID NO: 8151868 - DNA, 22 bp, Homo sapiens
gttcagtgtttacatgattgtt

SEQ ID NO: 8151869 - DNA, 22 bp, Homo sapiens
gttcagtgtttttattgacagg

SEQ ID NO: 8151870 - DNA, 22 bp, Homo sapiens
gttcagtgtttgatttctgctg

SEQ ID NO: 8151871 - DNA, 22 bp, Homo sapiens
gttaatttgcagctttcgagct

SEQ ID NO: 8151872 - DNA, 18 bp, Homo sapiens
gttaattttgaagttcat

SEQ ID NO: 8151873 - DNA, 22 bp, Homo sapiens
gttacaaactcaggtgccaaaa

SEQ ID NO: 8151874 - DNA, 22 bp, Homo sapiens
gttacaaactcaggtgccaaaa

SEQ ID NO: 8151875 - DNA, 22 bp, Homo sapiens
gttacaaactcaggtgccaaaa

SEQ ID NO: 8151876 - DNA, 22 bp, Homo sapiens
gttacaaaggaagcttcactgc

SEQ ID NO: 8151877 - DNA, 22 bp, Homo sapiens
gttacaaaggaagcttcactgc

SEQ ID NO: 8151878 - DNA, 22 bp, Homo sapiens
gttacaaagcacttcaagtgaa

SEQ ID NO: 8151879 - DNA, 22 bp, Homo sapiens
gttacaaagcacttcaagtgaa

SEQ ID NO: 8151880 - DNA, 22 bp, Homo sapiens
gttaaggatcttgagatgagga

SEQ ID NO: 8151881 - DNA, 22 bp, Homo sapiens
gttaagtaaactatgatttatc

SEQ ID NO: 8151882 - DNA, 22 bp, Homo sapiens
gttaataaaggtatagaatcag

SEQ ID NO: 8151883 - DNA, 22 bp, Homo sapiens
gttaatttagtagagtccagat

SEQ ID NO: 8151884 - DNA, 22 bp, Homo sapiens
gtgtgggacgggtgagtggcca

SEQ ID NO: 8151885 - DNA, 22 bp, Homo sapiens
gtgtgggacgggtgagtggcca

SEQ ID NO: 8151886 - DNA, 22 bp, Homo sapiens
gtgtggcttgggtgaggcgcct

SEQ ID NO: 8151887 - DNA, 22 bp, Homo sapiens
gtgtggctttctgggtttaatt

SEQ ID NO: 8151888 - DNA, 22 bp, Homo sapiens
gtgtggcttgggtgaggcgcct

SEQ ID NO: 8151889 - DNA, 22 bp, Homo sapiens
gtgtgggaaggctaggatgctg

SEQ ID NO: 8151890 - DNA, 22 bp, Homo sapiens
gtgtgggaaggctaggatgctg

SEQ ID NO: 8151891 - DNA, 22 bp, Homo sapiens
gttaactttttacagaaatgaa

SEQ ID NO: 8151892 - DNA, 22 bp, Homo sapiens
gtgtgggacgggtgagtggcca

SEQ ID NO: 8151893 - DNA, 22 bp, Homo sapiens
gttaacatttctaggtgcaggg

SEQ ID NO: 8151894 - DNA, 22 bp, Homo sapiens
gtgtgggacgggtgagtggcca

SEQ ID NO: 8151895 - DNA, 22 bp, Homo sapiens
gtgtgcctcccattagggtgta

SEQ ID NO: 8151896 - DNA, 22 bp, Homo sapiens
gtgtgcctcgccaagctgtcgg

SEQ ID NO: 8151897 - DNA, 22 bp, Homo sapiens
gtgtggccttgggagaggtctg

SEQ ID NO: 8151898 - DNA, 22 bp, Homo sapiens
gtgtggccttgggagaggtctg

SEQ ID NO: 8151899 - DNA, 22 bp, Homo sapiens
gtgtggcctcaacgggatgcaa

SEQ ID NO: 8151900 - DNA, 22 bp, Homo sapiens
gtgtggctagaagtgtcttgtt

SEQ ID NO: 8151901 - DNA, 22 bp, Homo sapiens
gtgtggctagaagtgtcttgtt

SEQ ID NO: 8151902 - DNA, 22 bp, Homo sapiens
gtgtggctacctcagaggagca

SEQ ID NO: 8151903 - DNA, 22 bp, Homo sapiens
gtgtggctaggatggctttgct

SEQ ID NO: 8151904 - DNA, 22 bp, Homo sapiens
gtgtggctaggatggctttgct

SEQ ID NO: 8151905 - DNA, 22 bp, Homo sapiens
gtgtggctgaaatcaaggcagg

SEQ ID NO: 8151906 - DNA, 22 bp, Homo sapiens
gtgtggctgattgacatggtca

SEQ ID NO: 8151907 - DNA, 22 bp, Homo sapiens
gtgtggctgattgacatggtca

SEQ ID NO: 8151908 - DNA, 18 bp, Homo sapiens
gtgtggctgagatgaggc

SEQ ID NO: 8151909 - DNA, 22 bp, Homo sapiens
gtgtggctgattgacatggtca

SEQ ID NO: 8151910 - DNA, 22 bp, Homo sapiens
gtgtggctgccagccaagaggc

SEQ ID NO: 8151911 - DNA, 22 bp, Homo sapiens
gtgtggctgtgggagatgttca

SEQ ID NO: 8151912 - DNA, 22 bp, Homo sapiens
gtgtggctgtttagtgactttc

SEQ ID NO: 8151913 - DNA, 19 bp, Homo sapiens
gtgctccagggcaaggagt

SEQ ID NO: 8151914 - DNA, 22 bp, Homo sapiens
gtgctccaggataggctgacct

SEQ ID NO: 8151915 - DNA, 22 bp, Homo sapiens
gtgctccaacattagtgtgctt

SEQ ID NO: 8151916 - DNA, 22 bp, Homo sapiens
gtgctccaggtcgctcagagag

SEQ ID NO: 8151917 - DNA, 22 bp, Homo sapiens
gtgctccctccttcctcaagga

SEQ ID NO: 8151918 - DNA, 22 bp, Homo sapiens
gtgctccctccttcctcaagga

SEQ ID NO: 8151919 - DNA, 22 bp, Homo sapiens
gtgctccctccttcctcaagga

SEQ ID NO: 8151920 - DNA, 22 bp, Homo sapiens
gtgctccctccttcctcaagga

SEQ ID NO: 8151921 - DNA, 22 bp, Homo sapiens
gtgctcagcccggatgagatca

SEQ ID NO: 8151922 - DNA, 22 bp, Homo sapiens
gtgctcagcccggatgagatca

SEQ ID NO: 8151923 - DNA, 22 bp, Homo sapiens
gtgctcaggaccaaatgaacca

SEQ ID NO: 8151924 - DNA, 22 bp, Homo sapiens
gtgctcaggaccaaatgaacca

SEQ ID NO: 8151925 - DNA, 22 bp, Homo sapiens
gtgctcactccccacagtgccc

SEQ ID NO: 8151926 - DNA, 22 bp, Homo sapiens
gtgctcagaaacttgctcattt

SEQ ID NO: 8151927 - DNA, 22 bp, Homo sapiens
gtgctcactgtgagacgtcctg

SEQ ID NO: 8151928 - DNA, 22 bp, Homo sapiens
gtgctcaggttcccatgagtgc

SEQ ID NO: 8151929 - DNA, 22 bp, Homo sapiens
gtgctcaggttcccatgagtgc

SEQ ID NO: 8151930 - DNA, 22 bp, Homo sapiens
gtgctcaggaccaaatgaacca

SEQ ID NO: 8151931 - DNA, 22 bp, Homo sapiens
gtgctcaggggcaatcctggga

SEQ ID NO: 8151932 - DNA, 22 bp, Homo sapiens
gtgctcaggggcaatcctggga

SEQ ID NO: 8151933 - DNA, 22 bp, Homo sapiens
gtgctctaaggcaccactgagc

SEQ ID NO: 8151934 - DNA, 22 bp, Homo sapiens
gtgctctacatgctccatgttt

SEQ ID NO: 8151935 - DNA, 22 bp, Homo sapiens
gtgctctagaaatagtcagtgg

SEQ ID NO: 8151936 - DNA, 22 bp, Homo sapiens
gtgctctagaaattgtcagtgg

SEQ ID NO: 8151937 - DNA, 22 bp, Homo sapiens
gtgctctaggctacagggatgc

SEQ ID NO: 8151938 - DNA, 22 bp, Homo sapiens
gtgctctaggggtcagtggtta

SEQ ID NO: 8151939 - DNA, 23 bp, Homo sapiens
gtgctctgcggtctgctagtctg

SEQ ID NO: 8151940 - DNA, 23 bp, Homo sapiens
gtgctctgcggtctgctagtctg

SEQ ID NO: 8151941 - DNA, 22 bp, Homo sapiens
gtgctctggccaagcgcgtgcg

SEQ ID NO: 8151942 - DNA, 22 bp, Homo sapiens
gtgctctggccaagcgcgtgcg

SEQ ID NO: 8151943 - DNA, 23 bp, Homo sapiens
gtgctctgcggtctgctagtctg

SEQ ID NO: 8151944 - DNA, 22 bp, Homo sapiens
gtgctctgcctggggtcatggc

SEQ ID NO: 8151945 - DNA, 22 bp, Homo sapiens
gtgctctgcctggggtcatggc

SEQ ID NO: 8151946 - DNA, 22 bp, Homo sapiens
gtgctctgcctggggtcatggc

SEQ ID NO: 8151947 - DNA, 22 bp, Homo sapiens
gtgctctgcctggggtcatggc

SEQ ID NO: 8151948 - DNA, 22 bp, Homo sapiens
gtgctctgagtttgcatgtcag

SEQ ID NO: 8151949 - DNA, 22 bp, Homo sapiens
gtgctctgagtttgcatgtcag

SEQ ID NO: 8151950 - DNA, 22 bp, Homo sapiens
gtgctctcctggctgccctgac

SEQ ID NO: 8151951 - DNA, 22 bp, Homo sapiens
gtgctctgatctgtctgacatc

SEQ ID NO: 8151952 - DNA, 22 bp, Homo sapiens
gtgtgccaccagtcaaggtgaa

SEQ ID NO: 8151953 - DNA, 22 bp, Homo sapiens
gtgtgccaccactgacaggatt

SEQ ID NO: 8151954 - DNA, 22 bp, Homo sapiens
gtgtgccaccactgacaggatt

SEQ ID NO: 8151955 - DNA, 22 bp, Homo sapiens
gtgtgccaccactgacaggatt

SEQ ID NO: 8151956 - DNA, 22 bp, Homo sapiens
gtgtgccaccagtcaaggtgaa

SEQ ID NO: 8151957 - DNA, 22 bp, Homo sapiens
gtgtgccactgcctgaggaccc

SEQ ID NO: 8151958 - DNA, 22 bp, Homo sapiens
gtgtgccagacatgatgctatg

SEQ ID NO: 8151959 - DNA, 22 bp, Homo sapiens
gtgtgccagacatgatgctatg

SEQ ID NO: 8151960 - DNA, 22 bp, Homo sapiens
gtgtgccaggaactggctgctg

SEQ ID NO: 8151961 - DNA, 22 bp, Homo sapiens
gtgtgccaacaaaagacagtgc

SEQ ID NO: 8151962 - DNA, 22 bp, Homo sapiens
gtgtgccaacaaaagacagtgc

SEQ ID NO: 8151963 - DNA, 23 bp, Homo sapiens
gtgtgccaagcactgtgccagga

SEQ ID NO: 8151964 - DNA, 23 bp, Homo sapiens
gtgtgccaagcactgtgccagga

SEQ ID NO: 8151965 - DNA, 23 bp, Homo sapiens
gtgtgccaagcactgtgccagga

SEQ ID NO: 8151966 - DNA, 23 bp, Homo sapiens
gtgtgccaagcactgtgccagga

SEQ ID NO: 8151967 - DNA, 22 bp, Homo sapiens
gtgtgcatgtgcttgcacagat

SEQ ID NO: 8151968 - DNA, 22 bp, Homo sapiens
gtgtgcatgcatagacaccaca

SEQ ID NO: 8151969 - DNA, 22 bp, Homo sapiens
gtgtgcatgtgcttgcacagat

SEQ ID NO: 8151970 - DNA, 22 bp, Homo sapiens
gtgtgcatgtgcttgcacagat

SEQ ID NO: 8151971 - DNA, 22 bp, Homo sapiens
gtgtgcatgtggaagcatgtat

SEQ ID NO: 8151972 - DNA, 18 bp, Homo sapiens
gtgtgcagttgcaggggt

SEQ ID NO: 8151973 - DNA, 22 bp, Homo sapiens
gtgctgaagaagtctgttcgcc

SEQ ID NO: 8151974 - DNA, 22 bp, Homo sapiens
gtgctgaagtgaaattcatcaa

SEQ ID NO: 8151975 - DNA, 22 bp, Homo sapiens
gtgctgaaatggacctcaggaa

SEQ ID NO: 8151976 - DNA, 22 bp, Homo sapiens
gtgctgaactataaaaagcttt

SEQ ID NO: 8151977 - DNA, 22 bp, Homo sapiens
gtgctgaacatttgggacttgt

SEQ ID NO: 8151978 - DNA, 18 bp, Homo sapiens
gtgtgcagttgcaggggt

SEQ ID NO: 8151979 - DNA, 18 bp, Homo sapiens
gtgtgcagttgcaggggt

SEQ ID NO: 8151980 - DNA, 22 bp, Homo sapiens
gtgtgcatagtcgtgcatgcat

SEQ ID NO: 8151981 - DNA, 21 bp, Homo sapiens
gtgctctgggcagcagagggc

SEQ ID NO: 8151982 - DNA, 22 bp, Homo sapiens
gtgctctggctggtctcccggt

SEQ ID NO: 8151983 - DNA, 21 bp, Homo sapiens
gtgctctgggcagcagagggc

SEQ ID NO: 8151984 - DNA, 21 bp, Homo sapiens
gtgctctgggcagcagagggc

SEQ ID NO: 8151985 - DNA, 22 bp, Homo sapiens
gtgctgaaatagaggaggtggc

SEQ ID NO: 8151986 - DNA, 22 bp, Homo sapiens
gtgctctgtggattgagttgaa

SEQ ID NO: 8151987 - DNA, 22 bp, Homo sapiens
gtgctctgtgtattaggatgtc

SEQ ID NO: 8151988 - DNA, 22 bp, Homo sapiens
gtgctctgtggattgagttgaa

SEQ ID NO: 8151989 - DNA, 22 bp, Homo sapiens
gtgctctgtggattgagttgaa

SEQ ID NO: 8151990 - DNA, 22 bp, Homo sapiens
gtgctctgtgtattaggatgtc

SEQ ID NO: 8151991 - DNA, 22 bp, Homo sapiens
gtgctctgtggattgagttgaa

SEQ ID NO: 8151992 - DNA, 22 bp, Homo sapiens
gtgctctgtggattgagttgaa

SEQ ID NO: 8151993 - DNA, 22 bp, Homo sapiens
tacatacattacctcatttagt

SEQ ID NO: 8151994 - DNA, 22 bp, Homo sapiens
tacatacattacctcatttagt

SEQ ID NO: 8151995 - DNA, 22 bp, Homo sapiens
tacatacattacctcatttagt

SEQ ID NO: 8151996 - DNA, 22 bp, Homo sapiens
tacatacatgtatgtgtgtatt

SEQ ID NO: 8151997 - DNA, 22 bp, Homo sapiens
tacatacattacctcatttagt

SEQ ID NO: 8151998 - DNA, 22 bp, Homo sapiens
tacatacattacctcatttagt

SEQ ID NO: 8151999 - DNA, 22 bp, Homo sapiens
tacatagagggtaatagcatca

SEQ ID NO: 8152000 - DNA, 22 bp, Homo sapiens
tacatagagggtaatagcatca

SEQ ID NO: 8152001 - DNA, 22 bp, Homo sapiens
tacatagagggtaatagcatca

SEQ ID NO: 8152002 - DNA, 22 bp, Homo sapiens
tacatagaacatgtttaatgtc

SEQ ID NO: 8152003 - DNA, 22 bp, Homo sapiens
tacagtaataaaatgagctaca

SEQ ID NO: 8152004 - DNA, 22 bp, Homo sapiens
tacagtaatgtgtccctgcagg

SEQ ID NO: 8152005 - DNA, 22 bp, Homo sapiens
tacagtaccctgatgaactaaa

SEQ ID NO: 8152006 - DNA, 22 bp, Homo sapiens
tacatacatggtggaatggtta

SEQ ID NO: 8152007 - DNA, 22 bp, Homo sapiens
tacagtagacaggaccacaggc

SEQ ID NO: 8152008 - DNA, 22 bp, Homo sapiens
tacaggatatcacttcatttct

SEQ ID NO: 8152009 - DNA, 22 bp, Homo sapiens
tacaggcactgaaatgcttatt

SEQ ID NO: 8152010 - DNA, 22 bp, Homo sapiens
tacaggcactgaaatgcttatt

SEQ ID NO: 8152011 - DNA, 19 bp, Homo sapiens
tacaggcagtttctacaat

SEQ ID NO: 8152012 - DNA, 19 bp, Homo sapiens
tacaggaggcctgcaatct

SEQ ID NO: 8152013 - DNA, 20 bp, Homo sapiens
tacaggagtgagtgggtggg

SEQ ID NO: 8152014 - DNA, 20 bp, Homo sapiens
tacaggagtgagtgggtggg

SEQ ID NO: 8152015 - DNA, 22 bp, Homo sapiens
tacaggaggattatcaaaggat

SEQ ID NO: 8152016 - DNA, 22 bp, Homo sapiens
tacaggaggattatcaaaggat

SEQ ID NO: 8152017 - DNA, 22 bp, Homo sapiens
tacagcacggtgcatttactac

SEQ ID NO: 8152018 - DNA, 17 bp, Homo sapiens
tacaggagagcaggaac

SEQ ID NO: 8152019 - DNA, 22 bp, Homo sapiens
tacagcacattgtgatggcact

SEQ ID NO: 8152020 - DNA, 22 bp, Homo sapiens
tacagcacggtgcatttactac

SEQ ID NO: 8152021 - DNA, 22 bp, Homo sapiens
tacagcacggtgcatttactac

SEQ ID NO: 8152022 - DNA, 22 bp, Homo sapiens
tacaggagcatggggaagggat

SEQ ID NO: 8152023 - DNA, 22 bp, Homo sapiens
tacaggagctgctctgtgatac

SEQ ID NO: 8152024 - DNA, 22 bp, Homo sapiens
tacaggagcatggggaagggat

SEQ ID NO: 8152025 - DNA, 22 bp, Homo sapiens
tacaggagcacaaaagagttga

SEQ ID NO: 8152026 - DNA, 22 bp, Homo sapiens
tacagggaatgggacataaatc

SEQ ID NO: 8152027 - DNA, 20 bp, Homo sapiens
tacaggctctgagagatgat

SEQ ID NO: 8152028 - DNA, 22 bp, Homo sapiens
tacaggctcttgtcagacgtat

SEQ ID NO: 8152029 - DNA, 22 bp, Homo sapiens
tacaggcccatagtccctgctt

SEQ ID NO: 8152030 - DNA, 22 bp, Homo sapiens
tacaggctagggagagtgactg

SEQ ID NO: 8152031 - DNA, 22 bp, Homo sapiens
tacaggcatgaatgaaatctgt

SEQ ID NO: 8152032 - DNA, 22 bp, Homo sapiens
tacaggcatgtagcatggtgat

SEQ ID NO: 8152033 - DNA, 22 bp, Homo sapiens
tacaggcatgtagcatggtgat

SEQ ID NO: 8152034 - DNA, 22 bp, Homo sapiens
tacaggcatgtagcatggtgat

SEQ ID NO: 8152035 - DNA, 22 bp, Homo sapiens
tacagggactcccgcagagata

SEQ ID NO: 8152036 - DNA, 22 bp, Homo sapiens
tacagggactcccgcagagata

SEQ ID NO: 8152037 - DNA, 22 bp, Homo sapiens
tacagggaccaataataactat

SEQ ID NO: 8152038 - DNA, 22 bp, Homo sapiens
tacagggaatgggacataaatc

SEQ ID NO: 8152039 - DNA, 22 bp, Homo sapiens
tacagggacatggaacaggctc

SEQ ID NO: 8152040 - DNA, 22 bp, Homo sapiens
tacattgaattttttagcatgt

SEQ ID NO: 8152041 - DNA, 22 bp, Homo sapiens
tacattgactgtgtgcatcaca

SEQ ID NO: 8152042 - DNA, 22 bp, Homo sapiens
tacatttgctttgattttcagc

SEQ ID NO: 8152043 - DNA, 22 bp, Homo sapiens
tacattctgaaataaatggttt

SEQ ID NO: 8152044 - DNA, 22 bp, Homo sapiens
tacattctatatctgttacatc

SEQ ID NO: 8152045 - DNA, 22 bp, Homo sapiens
tacattgaaatcaatggatgtg

SEQ ID NO: 8152046 - DNA, 22 bp, Homo sapiens
tacattctggtggagaaagtaa

SEQ ID NO: 8152047 - DNA, 22 bp, Homo sapiens
tacattctggtggagaaagtaa

SEQ ID NO: 8152048 - DNA, 23 bp, Homo sapiens
tacattctgtatttttatagagt

SEQ ID NO: 8152049 - DNA, 22 bp, Homo sapiens
tacatatagacagttactctag

SEQ ID NO: 8152050 - DNA, 22 bp, Homo sapiens
tacatatagacagttactctag

SEQ ID NO: 8152051 - DNA, 22 bp, Homo sapiens
tacatatagacagttactctag

SEQ ID NO: 8152052 - DNA, 22 bp, Homo sapiens
tacatatactgagtgatttgct

SEQ ID NO: 8152053 - DNA, 22 bp, Homo sapiens
tacatatactgagtgatttgct

SEQ ID NO: 8152054 - DNA, 22 bp, Homo sapiens
tacatatactgagtgatttgct

SEQ ID NO: 8152055 - DNA, 22 bp, Homo sapiens
tacatatactgagtgatttgct

SEQ ID NO: 8152056 - DNA, 22 bp, Homo sapiens
tacatcatggcttcatgctgca

SEQ ID NO: 8152057 - DNA, 22 bp, Homo sapiens
tacatcatgtaagcagaatcat

SEQ ID NO: 8152058 - DNA, 22 bp, Homo sapiens
tacatatagacagttactctag

SEQ ID NO: 8152059 - DNA, 22 bp, Homo sapiens
tacatatagacagttactctag

SEQ ID NO: 8152060 - DNA, 22 bp, Homo sapiens
tacatcatggcttcatgctgca

SEQ ID NO: 8152061 - DNA, 22 bp, Homo sapiens
tacatatagacagttactctag

SEQ ID NO: 8152062 - DNA, 22 bp, Homo sapiens
tacatatagacagttactctag

SEQ ID NO: 8152063 - DNA, 22 bp, Homo sapiens
tacataggtacagcctttttta

SEQ ID NO: 8152064 - DNA, 22 bp, Homo sapiens
tacatagctcctagtgatgcat

SEQ ID NO: 8152065 - DNA, 22 bp, Homo sapiens
tacatagttccacttctgtttt

SEQ ID NO: 8152066 - DNA, 22 bp, Homo sapiens
tacatagtgaacatttacagag

SEQ ID NO: 8152067 - DNA, 22 bp, Homo sapiens
tacatagtattcacattgtttt

SEQ ID NO: 8152068 - DNA, 22 bp, Homo sapiens
tacatagttccatttacaggaa

SEQ ID NO: 8152069 - DNA, 22 bp, Homo sapiens
tacatatactgagtgatttgct

SEQ ID NO: 8152070 - DNA, 22 bp, Homo sapiens
tacatatactgagtgatttgct

SEQ ID NO: 8152071 - DNA, 22 bp, Homo sapiens
tacatctatttgacagatacag

SEQ ID NO: 8152072 - DNA, 22 bp, Homo sapiens
tacatctcatctgtgctctccg

SEQ ID NO: 8152073 - DNA, 18 bp, Homo sapiens
tacatctatatagtgttt

SEQ ID NO: 8152074 - DNA, 22 bp, Homo sapiens
tacatccaaagttgaggtgcct

SEQ ID NO: 8152075 - DNA, 22 bp, Homo sapiens
tacatccaaatgaattagaatt

SEQ ID NO: 8152076 - DNA, 22 bp, Homo sapiens
tacatcatgtaagcagaatcat

SEQ ID NO: 8152077 - DNA, 22 bp, Homo sapiens
tacatcatgtaagcagaatcat

SEQ ID NO: 8152078 - DNA, 22 bp, Homo sapiens
tacatcattttggagatgagca

SEQ ID NO: 8152079 - DNA, 22 bp, Homo sapiens
tacatcattttggagatgagca

SEQ ID NO: 8152080 - DNA, 22 bp, Homo sapiens
tacatcattttggagatgagca

SEQ ID NO: 8152081 - DNA, 22 bp, Homo sapiens
tacatctagccttacaattatt

SEQ ID NO: 8152082 - DNA, 22 bp, Homo sapiens
tacatctagccttacaattatt

SEQ ID NO: 8152083 - DNA, 22 bp, Homo sapiens
tacagataaaaatgctgttctt

SEQ ID NO: 8152084 - DNA, 22 bp, Homo sapiens
tacagagttttcctgccaagaa

SEQ ID NO: 8152085 - DNA, 22 bp, Homo sapiens
tacagataactgaatgcagact

SEQ ID NO: 8152086 - DNA, 22 bp, Homo sapiens
tacagatacagatctagataca

SEQ ID NO: 8152087 - DNA, 22 bp, Homo sapiens
tacagatagaattagtgagtta

SEQ ID NO: 8152088 - DNA, 22 bp, Homo sapiens
tacagataactgaatgcagact

SEQ ID NO: 8152089 - DNA, 22 bp, Homo sapiens
tacagatacagatctagataca

SEQ ID NO: 8152090 - DNA, 22 bp, Homo sapiens
tacagagtggtgagatcttttg

SEQ ID NO: 8152091 - DNA, 22 bp, Homo sapiens
tacagagtggtgagatcttttg

SEQ ID NO: 8152092 - DNA, 22 bp, Homo sapiens
tacagagttttcctgccaagaa

SEQ ID NO: 8152093 - DNA, 22 bp, Homo sapiens
tacagagtgttattacagaatc

SEQ ID NO: 8152094 - DNA, 22 bp, Homo sapiens
tacagaagttggttttagttta

SEQ ID NO: 8152095 - DNA, 17 bp, Homo sapiens
tacagaaggcaccacaa

SEQ ID NO: 8152096 - DNA, 22 bp, Homo sapiens
tacagaagctgagacactgaga

SEQ ID NO: 8152097 - DNA, 22 bp, Homo sapiens
tacagaaatactggggggttct

SEQ ID NO: 8152098 - DNA, 22 bp, Homo sapiens
tacagaaatactggggggttct

SEQ ID NO: 8152099 - DNA, 22 bp, Homo sapiens
tacagaaatcacatcgctttga

SEQ ID NO: 8152100 - DNA, 22 bp, Homo sapiens
tacagaaatacagtcaggccta

SEQ ID NO: 8152101 - DNA, 22 bp, Homo sapiens
tacagaaattgccaccagctct

SEQ ID NO: 8152102 - DNA, 22 bp, Homo sapiens
tacagcaatgcctgaaatagta

SEQ ID NO: 8152103 - DNA, 22 bp, Homo sapiens
tacagcaatgctacaagatgac

SEQ ID NO: 8152104 - DNA, 22 bp, Homo sapiens
tacagcaatgctacaagatgac

SEQ ID NO: 8152105 - DNA, 22 bp, Homo sapiens
tacagatttggggagtaaagtt

SEQ ID NO: 8152106 - DNA, 22 bp, Homo sapiens
tacagattttgtgaagaagtgt

SEQ ID NO: 8152107 - DNA, 22 bp, Homo sapiens
tacagattttgtgaagaagtgt

SEQ ID NO: 8152108 - DNA, 22 bp, Homo sapiens
tacagattttgtgaagaagtgt

SEQ ID NO: 8152109 - DNA, 22 bp, Homo sapiens
tacagataggaggaatctgaaa

SEQ ID NO: 8152110 - DNA, 22 bp, Homo sapiens
tacagataggaggaatctgaaa

SEQ ID NO: 8152111 - DNA, 22 bp, Homo sapiens
tacagatatagagatttataga

SEQ ID NO: 8152112 - DNA, 22 bp, Homo sapiens
tacagatatagagatttataga

SEQ ID NO: 8152113 - DNA, 22 bp, Homo sapiens
tacagatatagggcgagcttag

SEQ ID NO: 8152114 - DNA, 22 bp, Homo sapiens
tacagatatagagatttataga

SEQ ID NO: 8152115 - DNA, 22 bp, Homo sapiens
tacagatatgttccatgcatcg

SEQ ID NO: 8152116 - DNA, 22 bp, Homo sapiens
tacagatatatagtgtgtgcct

SEQ ID NO: 8152117 - DNA, 22 bp, Homo sapiens
tacagatatgtatgcacttttt

SEQ ID NO: 8152118 - DNA, 22 bp, Homo sapiens
tacagatatttctcttcaacaa

SEQ ID NO: 8152119 - DNA, 21 bp, Homo sapiens
tacagatgaggagaccaaggc

SEQ ID NO: 8152120 - DNA, 21 bp, Homo sapiens
tacagatgaggagaccaaggc

SEQ ID NO: 8152121 - DNA, 18 bp, Homo sapiens
tacagattatagatacat

SEQ ID NO: 8152122 - DNA, 18 bp, Homo sapiens
tacagattatagatacat

SEQ ID NO: 8152123 - DNA, 22 bp, Homo sapiens
tacagattgaggtttttaatat

SEQ ID NO: 8152124 - DNA, 22 bp, Homo sapiens
tacagaaagggatgattgatct

SEQ ID NO: 8152125 - DNA, 22 bp, Homo sapiens
tacagaaagacctctcgggaaa

SEQ ID NO: 8152126 - DNA, 22 bp, Homo sapiens
tacagaaagggatgattgatct

SEQ ID NO: 8152127 - DNA, 20 bp, Homo sapiens
tacagaaacaggacttttgg

SEQ ID NO: 8152128 - DNA, 22 bp, Homo sapiens
tacagaaaaacttggaggcttt

SEQ ID NO: 8152129 - DNA, 22 bp, Homo sapiens
tacagaaaaacatctggagccg

SEQ ID NO: 8152130 - DNA, 22 bp, Homo sapiens
tacagaaaaactggcattgaag

SEQ ID NO: 8152131 - DNA, 22 bp, Homo sapiens
tacagaaacagcgtggttagaa

SEQ ID NO: 8152132 - DNA, 22 bp, Homo sapiens
tacagaaacagcgtggttagaa

SEQ ID NO: 8152133 - DNA, 22 bp, Homo sapiens
tacagaaaaacttggaggcttt

SEQ ID NO: 8152134 - DNA, 22 bp, Homo sapiens
tacactttttactacagattct

SEQ ID NO: 8152135 - DNA, 22 bp, Homo sapiens
tacagaaaaacatctggagccg

SEQ ID NO: 8152136 - DNA, 22 bp, Homo sapiens
tacagaaaaacatctggagccg

SEQ ID NO: 8152137 - DNA, 22 bp, Homo sapiens
tacagaaaaacatctggagccg

SEQ ID NO: 8152138 - DNA, 22 bp, Homo sapiens
tacacttttctggttactcttg

SEQ ID NO: 8152139 - DNA, 22 bp, Homo sapiens
tacacttttctggttactcttg

SEQ ID NO: 8152140 - DNA, 22 bp, Homo sapiens
tacactattttactgatacaaa

SEQ ID NO: 8152141 - DNA, 21 bp, Homo sapiens
tacaacaggttttatttcgat

SEQ ID NO: 8152142 - DNA, 22 bp, Homo sapiens
tacactgaaagagaggattgaa

SEQ ID NO: 8152143 - DNA, 22 bp, Homo sapiens
tacaacaatttccacattagaa

SEQ ID NO: 8152144 - DNA, 22 bp, Homo sapiens
tacaacaatttccacattagaa

SEQ ID NO: 8152145 - DNA, 22 bp, Homo sapiens
tacaacaatttccacattagaa

SEQ ID NO: 8152146 - DNA, 22 bp, Homo sapiens
tacaacaatttccacattagaa

SEQ ID NO: 8152147 - DNA, 22 bp, Homo sapiens
tacaaatcagatcatgagttta

SEQ ID NO: 8152148 - DNA, 22 bp, Homo sapiens
tacaaatcagatcatgagttta

SEQ ID NO: 8152149 - DNA, 20 bp, Homo sapiens
tacaacaagtagagacatac

SEQ ID NO: 8152150 - DNA, 20 bp, Homo sapiens
tacaacaagtagagacatac

SEQ ID NO: 8152151 - DNA, 20 bp, Homo sapiens
tacaacaagtagagacatac

SEQ ID NO: 8152152 - DNA, 22 bp, Homo sapiens
tacaacaggaatttcaactttg

SEQ ID NO: 8152153 - DNA, 22 bp, Homo sapiens
tacaacaatttccacattagaa

SEQ ID NO: 8152154 - DNA, 22 bp, Homo sapiens
tacaacagaagtgtttatttag

SEQ ID NO: 8152155 - DNA, 22 bp, Homo sapiens
tacaaagtgctttagaaatgaa

SEQ ID NO: 8152156 - DNA, 22 bp, Homo sapiens
tacaaagtttgagaatgctttc

SEQ ID NO: 8152157 - DNA, 22 bp, Homo sapiens
tacaaagtttgagaatgctttc

SEQ ID NO: 8152158 - DNA, 22 bp, Homo sapiens
tacaaagtgaaataattctgag

SEQ ID NO: 8152159 - DNA, 22 bp, Homo sapiens
tacaaagtgctttagaaatgaa

SEQ ID NO: 8152160 - DNA, 22 bp, Homo sapiens
tacaaagtgaaataattctgag

SEQ ID NO: 8152161 - DNA, 22 bp, Homo sapiens
tacaaagtcagaataacaggtg

SEQ ID NO: 8152162 - DNA, 22 bp, Homo sapiens
tacaaagagtttggtctctaga

SEQ ID NO: 8152163 - DNA, 22 bp, Homo sapiens
tacaaagagtttggtctctaga

SEQ ID NO: 8152164 - DNA, 22 bp, Homo sapiens
tacaaagaggtaattgcatata

SEQ ID NO: 8152165 - DNA, 22 bp, Homo sapiens
tacaaagaggtaattgcatata

SEQ ID NO: 8152166 - DNA, 22 bp, Homo sapiens
tacaaagaggtaattgcatata

SEQ ID NO: 8152167 - DNA, 22 bp, Homo sapiens
tacaaacttgttttaagtaagt

SEQ ID NO: 8152168 - DNA, 20 bp, Homo sapiens
tacaaagaatgaggttcagg

SEQ ID NO: 8152169 - DNA, 22 bp, Homo sapiens
tacaaacttgttttaagtaagt

SEQ ID NO: 8152170 - DNA, 22 bp, Homo sapiens
tacaaagaggcagctccatttt

SEQ ID NO: 8152171 - DNA, 20 bp, Homo sapiens
tacaaagaatgaggttcagg

SEQ ID NO: 8152172 - DNA, 22 bp, Homo sapiens
taattatagccgctattttgct

SEQ ID NO: 8152173 - DNA, 22 bp, Homo sapiens
taattatagccgctattttgct

SEQ ID NO: 8152174 - DNA, 23 bp, Homo sapiens
taattatggaataatttgcaacg

SEQ ID NO: 8152175 - DNA, 22 bp, Homo sapiens
tacaaaaaattgatactgacga

SEQ ID NO: 8152176 - DNA, 22 bp, Homo sapiens
tacaaaaaattgatactgacga

SEQ ID NO: 8152177 - DNA, 22 bp, Homo sapiens
tacaaaaaattgatactgacga

SEQ ID NO: 8152178 - DNA, 22 bp, Homo sapiens
tacaaaaaattgatactgacga

SEQ ID NO: 8152179 - DNA, 22 bp, Homo sapiens
tacaaactctttatatttcata

SEQ ID NO: 8152180 - DNA, 22 bp, Homo sapiens
tacaaactgttattattattgt

SEQ ID NO: 8152181 - DNA, 22 bp, Homo sapiens
tacaaactgttattattattgt

SEQ ID NO: 8152182 - DNA, 22 bp, Homo sapiens
tacaaactgttattattattgt

SEQ ID NO: 8152183 - DNA, 22 bp, Homo sapiens
tacaaagtaatgtataatatcg

SEQ ID NO: 8152184 - DNA, 22 bp, Homo sapiens
tacaaagtagaaattcagtaaa

SEQ ID NO: 8152185 - DNA, 22 bp, Homo sapiens
tacaaagtcacattgaaatgaa

SEQ ID NO: 8152186 - DNA, 22 bp, Homo sapiens
tacaaagtagaaattcagtaaa

SEQ ID NO: 8152187 - DNA, 22 bp, Homo sapiens
tacaaaggaggtgcatagaaca

SEQ ID NO: 8152188 - DNA, 22 bp, Homo sapiens
tacaaaggaggtgcatagaaca

SEQ ID NO: 8152189 - DNA, 22 bp, Homo sapiens
tacaaaggcggtttttctgggc

SEQ ID NO: 8152190 - DNA, 22 bp, Homo sapiens
tacaaaggcttaaagagatttc

SEQ ID NO: 8152191 - DNA, 22 bp, Homo sapiens
tacaaagtaatgtataatatcg

SEQ ID NO: 8152192 - DNA, 22 bp, Homo sapiens
tacaaagatagtgttagagtaa

SEQ ID NO: 8152193 - DNA, 22 bp, Homo sapiens
tacaaagatagtgttagagtaa

SEQ ID NO: 8152194 - DNA, 22 bp, Homo sapiens
tacaaagatggaaggttatgtt

SEQ ID NO: 8152195 - DNA, 22 bp, Homo sapiens
tacaaaggaaacttcttttccc

SEQ ID NO: 8152196 - DNA, 22 bp, Homo sapiens
tacaaaggagactctgtattta

SEQ ID NO: 8152197 - DNA, 22 bp, Homo sapiens
tacaaaggacagcagaaaaata

SEQ ID NO: 8152198 - DNA, 22 bp, Homo sapiens
taatgtttttctcaacattgct

SEQ ID NO: 8152199 - DNA, 22 bp, Homo sapiens
taattacaaagcaagcacaggg

SEQ ID NO: 8152200 - DNA, 22 bp, Homo sapiens
taattacaaagcaagcacaggg

SEQ ID NO: 8152201 - DNA, 22 bp, Homo sapiens
taattacaaagcaagcacaggg

SEQ ID NO: 8152202 - DNA, 22 bp, Homo sapiens
taattacaaagcaagcacaggg

SEQ ID NO: 8152203 - DNA, 22 bp, Homo sapiens
taatgtttgggaaggtgctttg

SEQ ID NO: 8152204 - DNA, 22 bp, Homo sapiens
taatgtttgagatgttggattt

SEQ ID NO: 8152205 - DNA, 22 bp, Homo sapiens
taatgtttttctcaacattgct

SEQ ID NO: 8152206 - DNA, 22 bp, Homo sapiens
taatgtttgggaaggtgctttg

SEQ ID NO: 8152207 - DNA, 22 bp, Homo sapiens
taattacagaggtttgccagtt

SEQ ID NO: 8152208 - DNA, 22 bp, Homo sapiens
taattacagaggtttgccagtt

SEQ ID NO: 8152209 - DNA, 22 bp, Homo sapiens
taattacagaggtttgccagtt

SEQ ID NO: 8152210 - DNA, 22 bp, Homo sapiens
taattacaaagcaagcacaggg

SEQ ID NO: 8152211 - DNA, 22 bp, Homo sapiens
taattacagaggtttgccagtt

SEQ ID NO: 8152212 - DNA, 22 bp, Homo sapiens
taattacaggtccaaaacaatc

SEQ ID NO: 8152213 - DNA, 22 bp, Homo sapiens
taattacaggtccaaaacaatc

SEQ ID NO: 8152214 - DNA, 22 bp, Homo sapiens
taattacaggtccaaaacaatc

SEQ ID NO: 8152215 - DNA, 22 bp, Homo sapiens
taattacaggtccaaaacaatc

SEQ ID NO: 8152216 - DNA, 22 bp, Homo sapiens
taattacaggtccaaaacaatc

SEQ ID NO: 8152217 - DNA, 22 bp, Homo sapiens
taattactaagggctgcatacc

SEQ ID NO: 8152218 - DNA, 22 bp, Homo sapiens
taattataacagttacatctta

SEQ ID NO: 8152219 - DNA, 21 bp, Homo sapiens
taattagcaaagctgagattc

SEQ ID NO: 8152220 - DNA, 22 bp, Homo sapiens
taattagtgtccagcttctgct

SEQ ID NO: 8152221 - DNA, 22 bp, Homo sapiens
taattagagtttggtaaacaat

SEQ ID NO: 8152222 - DNA, 23 bp, Homo sapiens
taattagatgttgattcctgaga

SEQ ID NO: 8152223 - DNA, 23 bp, Homo sapiens
taattagatgttgattcctgaga

SEQ ID NO: 8152224 - DNA, 22 bp, Homo sapiens
taattataacagttacatctta

SEQ ID NO: 8152225 - DNA, 22 bp, Homo sapiens
taattataacagttacatctta

SEQ ID NO: 8152226 - DNA, 22 bp, Homo sapiens
taattatagccgctattttgct

SEQ ID NO: 8152227 - DNA, 22 bp, Homo sapiens
taattatagccgctattttgct

SEQ ID NO: 8152228 - DNA, 22 bp, Homo sapiens
taattatacaaaaaggcatgca

SEQ ID NO: 8152229 - DNA, 22 bp, Homo sapiens
taattataacatgctttctggc

SEQ ID NO: 8152230 - DNA, 22 bp, Homo sapiens
taattataacatgctttctggc

SEQ ID NO: 8152231 - DNA, 22 bp, Homo sapiens
taattataacagttacatctta

SEQ ID NO: 8152232 - DNA, 22 bp, Homo sapiens
taattataacagttacatctta

SEQ ID NO: 8152233 - DNA, 22 bp, Homo sapiens
taatggtgtttttctgtaattt

SEQ ID NO: 8152234 - DNA, 21 bp, Homo sapiens
taatggtgatggttatgttct

SEQ ID NO: 8152235 - DNA, 22 bp, Homo sapiens
taatgtttccagtctatgatgg

SEQ ID NO: 8152236 - DNA, 22 bp, Homo sapiens
taatgtttccagtctatgatgg

SEQ ID NO: 8152237 - DNA, 22 bp, Homo sapiens
taatgtaaacacagagacagaa

SEQ ID NO: 8152238 - DNA, 22 bp, Homo sapiens
taatggttttttggagactgct

SEQ ID NO: 8152239 - DNA, 22 bp, Homo sapiens
taatgtttagaagcagacagct

SEQ ID NO: 8152240 - DNA, 22 bp, Homo sapiens
taatgtttagaagcagacagct

SEQ ID NO: 8152241 - DNA, 22 bp, Homo sapiens
taatagctgttattgttataac

SEQ ID NO: 8152242 - DNA, 22 bp, Homo sapiens
taatacttaccttgcagagtct

SEQ ID NO: 8152243 - DNA, 22 bp, Homo sapiens
taatagaatagtggaaacattg

SEQ ID NO: 8152244 - DNA, 22 bp, Homo sapiens
taatagaatagtggaaacattg

SEQ ID NO: 8152245 - DNA, 22 bp, Homo sapiens
taatacttgctttggatgtatg

SEQ ID NO: 8152246 - DNA, 22 bp, Homo sapiens
taatacttgctttggatgtatg

SEQ ID NO: 8152247 - DNA, 22 bp, Homo sapiens
taatacttgtcataaaggcatt

SEQ ID NO: 8152248 - DNA, 22 bp, Homo sapiens
taatactttgaatgagagctaa

SEQ ID NO: 8152249 - DNA, 22 bp, Homo sapiens
taatactttgaatgagagctaa

SEQ ID NO: 8152250 - DNA, 22 bp, Homo sapiens
taatacagtagcttttacacag

SEQ ID NO: 8152251 - DNA, 22 bp, Homo sapiens
taataatagcagtagctgccac

SEQ ID NO: 8152252 - DNA, 22 bp, Homo sapiens
taataagcgtagaaggtatatc

SEQ ID NO: 8152253 - DNA, 22 bp, Homo sapiens
taagtgtctctcgaattatgct

SEQ ID NO: 8152254 - DNA, 22 bp, Homo sapiens
taagtgtccctattgtgatttt

SEQ ID NO: 8152255 - DNA, 22 bp, Homo sapiens
taagtgggcgccttgaattact

SEQ ID NO: 8152256 - DNA, 22 bp, Homo sapiens
taagtgggcgccttgaattact

SEQ ID NO: 8152257 - DNA, 22 bp, Homo sapiens
taagtgggtgaagaggaaatat

SEQ ID NO: 8152258 - DNA, 22 bp, Homo sapiens
taagtgggtttgtaatgtgcct

SEQ ID NO: 8152259 - DNA, 22 bp, Homo sapiens
taatactgaaaggagtatcagc

SEQ ID NO: 8152260 - DNA, 22 bp, Homo sapiens
taatacatcattcatctaagga

SEQ ID NO: 8152261 - DNA, 22 bp, Homo sapiens
taatacatcattcatctaagga

SEQ ID NO: 8152262 - DNA, 22 bp, Homo sapiens
taatacatgtattccagagagt

SEQ ID NO: 8152263 - DNA, 22 bp, Homo sapiens
taatacatgtattccagagagt

SEQ ID NO: 8152264 - DNA, 22 bp, Homo sapiens
taatacatcattcatctaagga

SEQ ID NO: 8152265 - DNA, 22 bp, Homo sapiens
taatacatcattcatctaagga

SEQ ID NO: 8152266 - DNA, 22 bp, Homo sapiens
taatacattacctaacctctct

SEQ ID NO: 8152267 - DNA, 22 bp, Homo sapiens
taatacattacctaacctctct

SEQ ID NO: 8152268 - DNA, 23 bp, Homo sapiens
taagtgattagaatttgctgtca

SEQ ID NO: 8152269 - DNA, 22 bp, Homo sapiens
taagtgatgatagtacctagaa

SEQ ID NO: 8152270 - DNA, 22 bp, Homo sapiens
taagtgatgtcttggttaatga

SEQ ID NO: 8152271 - DNA, 23 bp, Homo sapiens
taagtgataaagagtagagatgg

SEQ ID NO: 8152272 - DNA, 22 bp, Homo sapiens
taagtgagctagcagaagtgac

SEQ ID NO: 8152273 - DNA, 23 bp, Homo sapiens
taagtgataaagagtagagatgg

SEQ ID NO: 8152274 - DNA, 22 bp, Homo sapiens
taagtgatgaaagcagatgtct

SEQ ID NO: 8152275 - DNA, 22 bp, Homo sapiens
taagtgatgaagacctgtttgg

SEQ ID NO: 8152276 - DNA, 22 bp, Homo sapiens
taagtgatgagcacagtaatta

SEQ ID NO: 8152277 - DNA, 22 bp, Homo sapiens
taagtgatttgtagtatactat

SEQ ID NO: 8152278 - DNA, 21 bp, Homo sapiens
taagtgcaaagagacagatac

SEQ ID NO: 8152279 - DNA, 22 bp, Homo sapiens
taagtgatttataaggagatat

SEQ ID NO: 8152280 - DNA, 17 bp, Homo sapiens
taagtgattatctcata

SEQ ID NO: 8152281 - DNA, 23 bp, Homo sapiens
taagtgattccaagtttcaggga

SEQ ID NO: 8152282 - DNA, 22 bp, Homo sapiens
taagtgagatctgaaatgaaat

SEQ ID NO: 8152283 - DNA, 22 bp, Homo sapiens
taagtgagccctcagagtatgg

SEQ ID NO: 8152284 - DNA, 20 bp, Homo sapiens
taagtgagaacatgtggtat

SEQ ID NO: 8152285 - DNA, 22 bp, Homo sapiens
taagtagctcttggaatatata

SEQ ID NO: 8152286 - DNA, 22 bp, Homo sapiens
taagtacaaatgtatacataag

SEQ ID NO: 8152287 - DNA, 22 bp, Homo sapiens
taagtaactgcataattaaatt

SEQ ID NO: 8152288 - DNA, 18 bp, Homo sapiens
taagtaaggtcatatggg

SEQ ID NO: 8152289 - DNA, 22 bp, Homo sapiens
taagtaaatttataatgtgatt

SEQ ID NO: 8152290 - DNA, 22 bp, Homo sapiens
taaggtttgtggggagcaaaag

SEQ ID NO: 8152291 - DNA, 22 bp, Homo sapiens
taagtaaaacattcaagaagtc

SEQ ID NO: 8152292 - DNA, 22 bp, Homo sapiens
taaggtttcttcagatactagt

SEQ ID NO: 8152293 - DNA, 22 bp, Homo sapiens
taaggtttgaagaagactgagc

SEQ ID NO: 8152294 - DNA, 22 bp, Homo sapiens
taaggtttgcttatcttcgcct

SEQ ID NO: 8152295 - DNA, 22 bp, Homo sapiens
taaggtttggctgtctcttggt

SEQ ID NO: 8152296 - DNA, 22 bp, Homo sapiens
taaggtttggctgtctcttggt

SEQ ID NO: 8152297 - DNA, 22 bp, Homo sapiens
taaggtttgtggggagcaaaag

SEQ ID NO: 8152298 - DNA, 22 bp, Homo sapiens
taaggttttgagaccagaacgt

SEQ ID NO: 8152299 - DNA, 22 bp, Homo sapiens
taaggtttgtggggagcaaaag

SEQ ID NO: 8152300 - DNA, 22 bp, Homo sapiens
taaggttttgagaccagaacgt

SEQ ID NO: 8152301 - DNA, 22 bp, Homo sapiens
taagggttcagaatgcagtggt

SEQ ID NO: 8152302 - DNA, 22 bp, Homo sapiens
taagggttcagaatgcagtggt

SEQ ID NO: 8152303 - DNA, 22 bp, Homo sapiens
taaggtaactgcttttggctga

SEQ ID NO: 8152304 - DNA, 22 bp, Homo sapiens
taagggttcagaatgcagtggt

SEQ ID NO: 8152305 - DNA, 22 bp, Homo sapiens
taagggttcagaatgcagtggt

SEQ ID NO: 8152306 - DNA, 22 bp, Homo sapiens
taaggtagccctaatgtgggtt

SEQ ID NO: 8152307 - DNA, 20 bp, Homo sapiens
taaggtgatctcagagaagc

SEQ ID NO: 8152308 - DNA, 22 bp, Homo sapiens
taaggtttaacgccctgtctcg

SEQ ID NO: 8152309 - DNA, 22 bp, Homo sapiens
taaggtttaacgccctgtctcg

SEQ ID NO: 8152310 - DNA, 22 bp, Homo sapiens
taaggtttctagtttctaaact

SEQ ID NO: 8152311 - DNA, 22 bp, Homo sapiens
taaggtttctagtttctaaact

SEQ ID NO: 8152312 - DNA, 19 bp, Homo sapiens
taaggtttaccagcaaaat

SEQ ID NO: 8152313 - DNA, 22 bp, Homo sapiens
taaggtttgcttatcttcgcct

SEQ ID NO: 8152314 - DNA, 22 bp, Homo sapiens
taaggtttgaagaagactgagc

SEQ ID NO: 8152315 - DNA, 19 bp, Homo sapiens
taaggtttaccagcaaaat

SEQ ID NO: 8152316 - DNA, 22 bp, Homo sapiens
taaggtttctagtttctaaact

SEQ ID NO: 8152317 - DNA, 22 bp, Homo sapiens
taaggtttcttcagatactagt

SEQ ID NO: 8152318 - DNA, 22 bp, Homo sapiens
taaggccaccgttatagaacca

SEQ ID NO: 8152319 - DNA, 22 bp, Homo sapiens
taaggccaattaacaaccaggg

SEQ ID NO: 8152320 - DNA, 22 bp, Homo sapiens
taaggccaattacatatgttca

SEQ ID NO: 8152321 - DNA, 22 bp, Homo sapiens
taaggccagcatgaatgcagca

SEQ ID NO: 8152322 - DNA, 22 bp, Homo sapiens
taaggccaggctgtggtcggca

SEQ ID NO: 8152323 - DNA, 22 bp, Homo sapiens
taaggccagccagcaaatctgt

SEQ ID NO: 8152324 - DNA, 22 bp, Homo sapiens
taaggccattatggtgggcccg

SEQ ID NO: 8152325 - DNA, 22 bp, Homo sapiens
taaggcaaacaggaaagcaggc

SEQ ID NO: 8152326 - DNA, 22 bp, Homo sapiens
taaggcaaagtgatttcttaaa

SEQ ID NO: 8152327 - DNA, 22 bp, Homo sapiens
taaggcaaagtgatttcttaaa

SEQ ID NO: 8152328 - DNA, 22 bp, Homo sapiens
taactggcttaaattttatcaa

SEQ ID NO: 8152329 - DNA, 22 bp, Homo sapiens
taaggcaatggcattcttgaca

SEQ ID NO: 8152330 - DNA, 22 bp, Homo sapiens
taaggcattatagagacagcct

SEQ ID NO: 8152331 - DNA, 22 bp, Homo sapiens
taaggccaagttcatatacaac

SEQ ID NO: 8152332 - DNA, 22 bp, Homo sapiens
taaggccaaggggccatagtct

SEQ ID NO: 8152333 - DNA, 21 bp, Homo sapiens
taaggccaagtctatttctgt

SEQ ID NO: 8152334 - DNA, 22 bp, Homo sapiens
taaggccaagttcatatacaac

SEQ ID NO: 8152335 - DNA, 19 bp, Homo sapiens
taaggccaaaagtaagtgt

SEQ ID NO: 8152336 - DNA, 22 bp, Homo sapiens
taaggccaaactattatagttc

SEQ ID NO: 8152337 - DNA, 21 bp, Homo sapiens
tatttattaatttgtaaggct

SEQ ID NO: 8152338 - DNA, 21 bp, Homo sapiens
tatttattaatttgtaaggct

SEQ ID NO: 8152339 - DNA, 21 bp, Homo sapiens
tatttattaatttgtaaggct

SEQ ID NO: 8152340 - DNA, 21 bp, Homo sapiens
tatttattaatttgtaaggct

SEQ ID NO: 8152341 - DNA, 22 bp, Homo sapiens
tatttatgtatgtggatgtgtt

SEQ ID NO: 8152342 - DNA, 22 bp, Homo sapiens
tatttatcgagtgtctactatg

SEQ ID NO: 8152343 - DNA, 22 bp, Homo sapiens
tatttatcgagtgtctactatg

SEQ ID NO: 8152344 - DNA, 22 bp, Homo sapiens
tatttatcgagtgtctactatg

SEQ ID NO: 8152345 - DNA, 22 bp, Homo sapiens
tatttataccaggtgatcggag

SEQ ID NO: 8152346 - DNA, 22 bp, Homo sapiens
tatttatattctgccttctgct

SEQ ID NO: 8152347 - DNA, 22 bp, Homo sapiens
tatttataatctgccaaagaga

SEQ ID NO: 8152348 - DNA, 22 bp, Homo sapiens
tatttataatctgccaaagaga

SEQ ID NO: 8152349 - DNA, 22 bp, Homo sapiens
tatttataatctgccaaagaga

SEQ ID NO: 8152350 - DNA, 22 bp, Homo sapiens
tatttaattagtgattgtagag

SEQ ID NO: 8152351 - DNA, 22 bp, Homo sapiens
tatttaattagtgattgtagag

SEQ ID NO: 8152352 - DNA, 22 bp, Homo sapiens
tattgacagacttgaaagtgtt

SEQ ID NO: 8152353 - DNA, 22 bp, Homo sapiens
tattgacactttttgtgtagcc

SEQ ID NO: 8152354 - DNA, 20 bp, Homo sapiens
tatttacaacttagagcctc

SEQ ID NO: 8152355 - DNA, 22 bp, Homo sapiens
tatttataatctgccaaagaga

SEQ ID NO: 8152356 - DNA, 22 bp, Homo sapiens
tatttataacagtgagaacggg

SEQ ID NO: 8152357 - DNA, 22 bp, Homo sapiens
tatttattctttgtactgcctt

SEQ ID NO: 8152358 - DNA, 22 bp, Homo sapiens
tatttattggacagtgttgctg

SEQ ID NO: 8152359 - DNA, 22 bp, Homo sapiens
tatttattctttgtactgcctt

SEQ ID NO: 8152360 - DNA, 22 bp, Homo sapiens
tatttattctttgtactgcctt

SEQ ID NO: 8152361 - DNA, 22 bp, Homo sapiens
tatttattctttgtactgcctt

SEQ ID NO: 8152362 - DNA, 22 bp, Homo sapiens
tatttattctttgtactgcctt

SEQ ID NO: 8152363 - DNA, 22 bp, Homo sapiens
tatttattggacagtgttgctg

SEQ ID NO: 8152364 - DNA, 22 bp, Homo sapiens
tatttattggacagtgttgctg

SEQ ID NO: 8152365 - DNA, 22 bp, Homo sapiens
tatttattggacagtgttgctg

SEQ ID NO: 8152366 - DNA, 22 bp, Homo sapiens
tatttattggacagtgttgctg

SEQ ID NO: 8152367 - DNA, 22 bp, Homo sapiens
tatttattggacagtgttgctg

SEQ ID NO: 8152368 - DNA, 22 bp, Homo sapiens
tatttattggacagtgttgctg

SEQ ID NO: 8152369 - DNA, 21 bp, Homo sapiens
tatttattaatttgtaaggct

SEQ ID NO: 8152370 - DNA, 21 bp, Homo sapiens
tatttattaatttgtaaggct

SEQ ID NO: 8152371 - DNA, 22 bp, Homo sapiens
tatttattcattcagcaagcat

SEQ ID NO: 8152372 - DNA, 22 bp, Homo sapiens
tatttattcattcagcaagcat

SEQ ID NO: 8152373 - DNA, 22 bp, Homo sapiens
tatttattcattcagcaagcat

SEQ ID NO: 8152374 - DNA, 22 bp, Homo sapiens
tatttattcattcagcaagcat

SEQ ID NO: 8152375 - DNA, 22 bp, Homo sapiens
tatttattctttgtactgcctt

SEQ ID NO: 8152376 - DNA, 22 bp, Homo sapiens
tatttattctttgtactgcctt

SEQ ID NO: 8152377 - DNA, 22 bp, Homo sapiens
tatttattctttgtactgcctt

SEQ ID NO: 8152378 - DNA, 22 bp, Homo sapiens
tatttattcattcagcaagcat

SEQ ID NO: 8152379 - DNA, 22 bp, Homo sapiens
tatttattcattcagcaagcat

SEQ ID NO: 8152380 - DNA, 22 bp, Homo sapiens
tatttattcattcagcaagcat

SEQ ID NO: 8152381 - DNA, 22 bp, Homo sapiens
tatttattcattcagcaagcat

SEQ ID NO: 8152382 - DNA, 22 bp, Homo sapiens
tatttctgagaaccaacttacc

SEQ ID NO: 8152383 - DNA, 22 bp, Homo sapiens
tatttctgagaaccaacttacc

SEQ ID NO: 8152384 - DNA, 22 bp, Homo sapiens
tatttctgagaaccaacttacc

SEQ ID NO: 8152385 - DNA, 22 bp, Homo sapiens
tatttctctttgtagggatata

SEQ ID NO: 8152386 - DNA, 22 bp, Homo sapiens
tatttctgaatccaaaaggtca

SEQ ID NO: 8152387 - DNA, 22 bp, Homo sapiens
tatttctcttcaaaattgatgt

SEQ ID NO: 8152388 - DNA, 22 bp, Homo sapiens
tatttctcttcaaaattgatgt

SEQ ID NO: 8152389 - DNA, 22 bp, Homo sapiens
tatttctcttcaaaattgatgt

SEQ ID NO: 8152390 - DNA, 22 bp, Homo sapiens
tatttctctcacggttgcctgg

SEQ ID NO: 8152391 - DNA, 22 bp, Homo sapiens
tatttctccaagggggccctct

SEQ ID NO: 8152392 - DNA, 22 bp, Homo sapiens
tatttctctcacggttgcctgg

SEQ ID NO: 8152393 - DNA, 22 bp, Homo sapiens
tatttctccctataccctccaa

SEQ ID NO: 8152394 - DNA, 22 bp, Homo sapiens
tatttctccctataccctccaa

SEQ ID NO: 8152395 - DNA, 22 bp, Homo sapiens
tatttctctcacggttgcctgg

SEQ ID NO: 8152396 - DNA, 22 bp, Homo sapiens
tatttctcagcattttacatcc

SEQ ID NO: 8152397 - DNA, 22 bp, Homo sapiens
tatttctcagcattttacatcc

SEQ ID NO: 8152398 - DNA, 22 bp, Homo sapiens
tatttctcagcattttacatcc

SEQ ID NO: 8152399 - DNA, 22 bp, Homo sapiens
tatttctattccccaggcaagt

SEQ ID NO: 8152400 - DNA, 22 bp, Homo sapiens
tatttctattccccaggcaagt

SEQ ID NO: 8152401 - DNA, 22 bp, Homo sapiens
tatttctaagctgtaagtctga

SEQ ID NO: 8152402 - DNA, 22 bp, Homo sapiens
tatttcaacgtatgaaaagctg

SEQ ID NO: 8152403 - DNA, 22 bp, Homo sapiens
tatttctaagctgtaagtctga

SEQ ID NO: 8152404 - DNA, 22 bp, Homo sapiens
tatttattggacagtgttgctg

SEQ ID NO: 8152405 - DNA, 19 bp, Homo sapiens
tatttcaaagtgccgtcta

SEQ ID NO: 8152406 - DNA, 22 bp, Homo sapiens
tattctctgcagctgaatgttt

SEQ ID NO: 8152407 - DNA, 22 bp, Homo sapiens
tattctgggtaccaaacttcaa

SEQ ID NO: 8152408 - DNA, 22 bp, Homo sapiens
tattctgatttcaagtgagagt

SEQ ID NO: 8152409 - DNA, 22 bp, Homo sapiens
tattcttaattgctgagctgaa

SEQ ID NO: 8152410 - DNA, 22 bp, Homo sapiens
tattctgtgtgatatgtaaatg

SEQ ID NO: 8152411 - DNA, 22 bp, Homo sapiens
tattctgtgtgatatgtaaatg

SEQ ID NO: 8152412 - DNA, 22 bp, Homo sapiens
tattctgtgtgatatgtaaatg

SEQ ID NO: 8152413 - DNA, 18 bp, Homo sapiens
tattctgtcctatgaagc

SEQ ID NO: 8152414 - DNA, 22 bp, Homo sapiens
tattctcagcaacacacatgga

SEQ ID NO: 8152415 - DNA, 22 bp, Homo sapiens
tattctactagcattgttcact

SEQ ID NO: 8152416 - DNA, 22 bp, Homo sapiens
tattctacagtgttagtgttag

SEQ ID NO: 8152417 - DNA, 22 bp, Homo sapiens
tattctccccggatcagggcaa

SEQ ID NO: 8152418 - DNA, 22 bp, Homo sapiens
tattgaaatgaatgacagtgat

SEQ ID NO: 8152419 - DNA, 22 bp, Homo sapiens
tattcttgtcttttccagaaat

SEQ ID NO: 8152420 - DNA, 22 bp, Homo sapiens
tattgaaatccattacgttctt

SEQ ID NO: 8152421 - DNA, 22 bp, Homo sapiens
tattcttgtatactacaatctt

SEQ ID NO: 8152422 - DNA, 22 bp, Homo sapiens
tattcttgtatactacaatctt

SEQ ID NO: 8152423 - DNA, 22 bp, Homo sapiens
tattcttactctcgactgcatt

SEQ ID NO: 8152424 - DNA, 22 bp, Homo sapiens
tattcttagccagcagcctggg

SEQ ID NO: 8152425 - DNA, 22 bp, Homo sapiens
tattcttgactgcttactatgt

SEQ ID NO: 8152426 - DNA, 22 bp, Homo sapiens
tattcttgactgcttactatgt

SEQ ID NO: 8152427 - DNA, 22 bp, Homo sapiens
tattcttgtaccttaaatgatt

SEQ ID NO: 8152428 - DNA, 22 bp, Homo sapiens
tattcttgtaccttaaatgatt

SEQ ID NO: 8152429 - DNA, 22 bp, Homo sapiens
tattgaaattcttcatgtcctc

SEQ ID NO: 8152430 - DNA, 22 bp, Homo sapiens
tattgaagattttgtggttgct

SEQ ID NO: 8152431 - DNA, 22 bp, Homo sapiens
tattgaattagaccctaaaatg

SEQ ID NO: 8152432 - DNA, 22 bp, Homo sapiens
tattgacaatttgtgaaactat

SEQ ID NO: 8152433 - DNA, 22 bp, Homo sapiens
tattgacaataggcaactgagg

SEQ ID NO: 8152434 - DNA, 22 bp, Homo sapiens
tattcaaagtaccttcattgcc

SEQ ID NO: 8152435 - DNA, 22 bp, Homo sapiens
tattctacagtgttagtgttag

SEQ ID NO: 8152436 - DNA, 22 bp, Homo sapiens
tattccaactgtcatagtcata

SEQ ID NO: 8152437 - DNA, 22 bp, Homo sapiens
tattccaaaggtagggattact

SEQ ID NO: 8152438 - DNA, 22 bp, Homo sapiens
tattcatgagataggcagtttt

SEQ ID NO: 8152439 - DNA, 22 bp, Homo sapiens
tattcaaagtaccttcattgcc

SEQ ID NO: 8152440 - DNA, 22 bp, Homo sapiens
tattatttttattcgagggaaa

SEQ ID NO: 8152441 - DNA, 19 bp, Homo sapiens
tattatttgtagcaaggcc

SEQ ID NO: 8152442 - DNA, 19 bp, Homo sapiens
tattatttgtagcaaggcc

SEQ ID NO: 8152443 - DNA, 19 bp, Homo sapiens
tattatttgtagcaaggcc

SEQ ID NO: 8152444 - DNA, 22 bp, Homo sapiens
tattattttagcactgaggatt

SEQ ID NO: 8152445 - DNA, 22 bp, Homo sapiens
tattattatgcatagcatgaaa

SEQ ID NO: 8152446 - DNA, 22 bp, Homo sapiens
tattattatattggatgagact

SEQ ID NO: 8152447 - DNA, 22 bp, Homo sapiens
tattattatctttgaatgggac

SEQ ID NO: 8152448 - DNA, 22 bp, Homo sapiens
tattattgactattcagaatgt

SEQ ID NO: 8152449 - DNA, 22 bp, Homo sapiens
tattattgacatttacttggtg

SEQ ID NO: 8152450 - DNA, 22 bp, Homo sapiens
tattattgaatcagttctttga

SEQ ID NO: 8152451 - DNA, 22 bp, Homo sapiens
tattattaaatggcagaatttt

SEQ ID NO: 8152452 - DNA, 22 bp, Homo sapiens
tattattatattggatgagact

SEQ ID NO: 8152453 - DNA, 22 bp, Homo sapiens
tattattatattggatgagact

SEQ ID NO: 8152454 - DNA, 22 bp, Homo sapiens
tattaggtagattttactgatt

SEQ ID NO: 8152455 - DNA, 20 bp, Homo sapiens
tattaggaaggaggaaggaa

SEQ ID NO: 8152456 - DNA, 22 bp, Homo sapiens
tattaggcatttgaggataaac

SEQ ID NO: 8152457 - DNA, 22 bp, Homo sapiens
tatgtacagggatagaacttga

SEQ ID NO: 8152458 - DNA, 22 bp, Homo sapiens
tatgtacacttaagtttgagaa

SEQ ID NO: 8152459 - DNA, 22 bp, Homo sapiens
tatgtacagggatagaacttga

SEQ ID NO: 8152460 - DNA, 22 bp, Homo sapiens
tatgtacagggatagaacttga

SEQ ID NO: 8152461 - DNA, 22 bp, Homo sapiens
tatgtacaccggggaaggtggg

SEQ ID NO: 8152462 - DNA, 22 bp, Homo sapiens
tatgtacaccggggaaggtggg

SEQ ID NO: 8152463 - DNA, 22 bp, Homo sapiens
tatgtacacggtggctctgaag

SEQ ID NO: 8152464 - DNA, 22 bp, Homo sapiens
tatgtacaccggggaaggtggg

SEQ ID NO: 8152465 - DNA, 22 bp, Homo sapiens
tatgtacacatacacttgtaat

SEQ ID NO: 8152466 - DNA, 22 bp, Homo sapiens
tatgtacacatacacttgtaat

SEQ ID NO: 8152467 - DNA, 22 bp, Homo sapiens
tatgtacacatacacttgtaat

SEQ ID NO: 8152468 - DNA, 22 bp, Homo sapiens
tatgtacacatacacttgtaat

SEQ ID NO: 8152469 - DNA, 22 bp, Homo sapiens
tatgtacacacacatgcatgta

SEQ ID NO: 8152470 - DNA, 22 bp, Homo sapiens
tatgtacacacacatgcatgta

SEQ ID NO: 8152471 - DNA, 22 bp, Homo sapiens
tatgtacacacacatgcatgta

SEQ ID NO: 8152472 - DNA, 22 bp, Homo sapiens
tatgtacacatacacttgtaat

SEQ ID NO: 8152473 - DNA, 22 bp, Homo sapiens
tatgtacacatacacttgtaat

SEQ ID NO: 8152474 - DNA, 22 bp, Homo sapiens
tatgtacacatacacttgtaat

SEQ ID NO: 8152475 - DNA, 22 bp, Homo sapiens
tatgtacaccaaggattgaaaa

SEQ ID NO: 8152476 - DNA, 22 bp, Homo sapiens
tatgtacaccaaggattgaaaa

SEQ ID NO: 8152477 - DNA, 22 bp, Homo sapiens
tatgtacagtccttaacttaaa

SEQ ID NO: 8152478 - DNA, 22 bp, Homo sapiens
tatgtacagtccttaacttaaa

SEQ ID NO: 8152479 - DNA, 22 bp, Homo sapiens
tatgtacagtccttaacttaaa

SEQ ID NO: 8152480 - DNA, 22 bp, Homo sapiens
tatgtacagggatagaacttga

SEQ ID NO: 8152481 - DNA, 22 bp, Homo sapiens
tatgtacagtccttaacttaaa

SEQ ID NO: 8152482 - DNA, 22 bp, Homo sapiens
tatgtacagtccttaacttaaa

SEQ ID NO: 8152483 - DNA, 22 bp, Homo sapiens
tatgtacagtccttaacttaaa

SEQ ID NO: 8152484 - DNA, 22 bp, Homo sapiens
tatgtacagtccttaacttaaa

SEQ ID NO: 8152485 - DNA, 22 bp, Homo sapiens
tatgtacataacatgaaatgca

SEQ ID NO: 8152486 - DNA, 22 bp, Homo sapiens
tatgtacataacatgaaatgca

SEQ ID NO: 8152487 - DNA, 22 bp, Homo sapiens
tatgtctgaatcttatttaaat

SEQ ID NO: 8152488 - DNA, 22 bp, Homo sapiens
tatgtctagacccaagaatatg

SEQ ID NO: 8152489 - DNA, 22 bp, Homo sapiens
tatgtctggaatttgaggttca

SEQ ID NO: 8152490 - DNA, 22 bp, Homo sapiens
tatgtcctgctactctctcatg

SEQ ID NO: 8152491 - DNA, 22 bp, Homo sapiens
tatgtacatacatgtgcatacg

SEQ ID NO: 8152492 - DNA, 22 bp, Homo sapiens
tatgtacatacatgtgcatacg

SEQ ID NO: 8152493 - DNA, 22 bp, Homo sapiens
tatgtacataacatgaaatgca

SEQ ID NO: 8152494 - DNA, 22 bp, Homo sapiens
tatgtacataacatgaaatgca

SEQ ID NO: 8152495 - DNA, 22 bp, Homo sapiens
tatgtacatacatgtgcatacg

SEQ ID NO: 8152496 - DNA, 22 bp, Homo sapiens
tatgtacaagcacacatgtgac

SEQ ID NO: 8152497 - DNA, 22 bp, Homo sapiens
tatgtacaagcacacatgtgac

SEQ ID NO: 8152498 - DNA, 22 bp, Homo sapiens
tatgtacaagcacacatgtgac

SEQ ID NO: 8152499 - DNA, 22 bp, Homo sapiens
tatgtacaagcacacatgtgac

SEQ ID NO: 8152500 - DNA, 22 bp, Homo sapiens
tatgtacaatcagcagttcata

SEQ ID NO: 8152501 - DNA, 22 bp, Homo sapiens
tatgtacaatcagcagttcata

SEQ ID NO: 8152502 - DNA, 22 bp, Homo sapiens
tatgtacaatttgttgtatgtc

SEQ ID NO: 8152503 - DNA, 22 bp, Homo sapiens
tatgtacaatttgttgtatgtc

SEQ ID NO: 8152504 - DNA, 22 bp, Homo sapiens
tatgtacaatcagcagttcata

SEQ ID NO: 8152505 - DNA, 22 bp, Homo sapiens
tatgtacaatcagcagttcata

SEQ ID NO: 8152506 - DNA, 22 bp, Homo sapiens
tatgtacaatttgttgtatgtc

SEQ ID NO: 8152507 - DNA, 22 bp, Homo sapiens
tatgtacacacacatgcatgta

SEQ ID NO: 8152508 - DNA, 22 bp, Homo sapiens
tatgtacacacacatgcatgta

SEQ ID NO: 8152509 - DNA, 22 bp, Homo sapiens
tatgtacacacacatgcatgta

SEQ ID NO: 8152510 - DNA, 22 bp, Homo sapiens
tatgtacacacacatgcatgta

SEQ ID NO: 8152511 - DNA, 22 bp, Homo sapiens
tatgagataatagatgtgtaaa

SEQ ID NO: 8152512 - DNA, 22 bp, Homo sapiens
tatgagatactacagattgtga

SEQ ID NO: 8152513 - DNA, 22 bp, Homo sapiens
tatgagataaatggtgccccct

SEQ ID NO: 8152514 - DNA, 22 bp, Homo sapiens
tatgagcagacagtggttttac

SEQ ID NO: 8152515 - DNA, 22 bp, Homo sapiens
tatgagatttggattcagtgaa

SEQ ID NO: 8152516 - DNA, 22 bp, Homo sapiens
tatgagatattcccagcgtcta

SEQ ID NO: 8152517 - DNA, 21 bp, Homo sapiens
tatgagatatacttattcttt

SEQ ID NO: 8152518 - DNA, 20 bp, Homo sapiens
tatgagatttgacctcaaca

SEQ ID NO: 8152519 - DNA, 22 bp, Homo sapiens
tatgagatcccttttcctagag

SEQ ID NO: 8152520 - DNA, 22 bp, Homo sapiens
tatgaggcacttcattagctgg

SEQ ID NO: 8152521 - DNA, 17 bp, Homo sapiens
tatgaggcagtttgtga

SEQ ID NO: 8152522 - DNA, 22 bp, Homo sapiens
tatgaggtaggtattatactta

SEQ ID NO: 8152523 - DNA, 22 bp, Homo sapiens
tatgagttcagttatcttaagt

SEQ ID NO: 8152524 - DNA, 22 bp, Homo sapiens
tatgagtggcgtagaggtaggg

SEQ ID NO: 8152525 - DNA, 22 bp, Homo sapiens
tattactgaggttttatggagt

SEQ ID NO: 8152526 - DNA, 22 bp, Homo sapiens
tattagaggaaccaaggtggag

SEQ ID NO: 8152527 - DNA, 22 bp, Homo sapiens
tattagaaaggctattgcatag

SEQ ID NO: 8152528 - DNA, 22 bp, Homo sapiens
tattagaaagcttaatatcgtg

SEQ ID NO: 8152529 - DNA, 22 bp, Homo sapiens
tattagattaactttaatgtct

SEQ ID NO: 8152530 - DNA, 22 bp, Homo sapiens
tattagattaactttaatgtct

SEQ ID NO: 8152531 - DNA, 23 bp, Homo sapiens
tattagcaattcccacagagcag

SEQ ID NO: 8152532 - DNA, 22 bp, Homo sapiens
tattagcagcatgagaatgggc

SEQ ID NO: 8152533 - DNA, 22 bp, Homo sapiens
tattacatccacttttattgca

SEQ ID NO: 8152534 - DNA, 22 bp, Homo sapiens
tattacagggctagttatgagt

SEQ ID NO: 8152535 - DNA, 22 bp, Homo sapiens
tattacagctttgattatctgg

SEQ ID NO: 8152536 - DNA, 22 bp, Homo sapiens
tattacagaatcaggcataact

SEQ ID NO: 8152537 - DNA, 22 bp, Homo sapiens
tattacagaatcaggcataact

SEQ ID NO: 8152538 - DNA, 22 bp, Homo sapiens
tattacagggctagttatgagt

SEQ ID NO: 8152539 - DNA, 22 bp, Homo sapiens
tatgtgtgctttttccatgcat

SEQ ID NO: 8152540 - DNA, 19 bp, Homo sapiens
tatgtgtgcatttgtgcat

SEQ ID NO: 8152541 - DNA, 22 bp, Homo sapiens
tatgtgtggagccagcctggag

SEQ ID NO: 8152542 - DNA, 22 bp, Homo sapiens
tatgtgtggcagctgggagtgt

SEQ ID NO: 8152543 - DNA, 19 bp, Homo sapiens
tatgtgtgcatttgtgcat

SEQ ID NO: 8152544 - DNA, 19 bp, Homo sapiens
tatgtgtgcatttgtgcat

SEQ ID NO: 8152545 - DNA, 22 bp, Homo sapiens
tatgtgtggcagctgggagtgt

SEQ ID NO: 8152546 - DNA, 22 bp, Homo sapiens
tatgtgtggcagctgggagtgt

SEQ ID NO: 8152547 - DNA, 22 bp, Homo sapiens
tattacacagtgaaagcatgga

SEQ ID NO: 8152548 - DNA, 20 bp, Homo sapiens
tattacacacaatgagcagt

SEQ ID NO: 8152549 - DNA, 20 bp, Homo sapiens
tattacacacaatgagcagt

SEQ ID NO: 8152550 - DNA, 20 bp, Homo sapiens
tattacacacaatgagcagt

SEQ ID NO: 8152551 - DNA, 22 bp, Homo sapiens
tattacacagtgaaagcatgga

SEQ ID NO: 8152552 - DNA, 22 bp, Homo sapiens
tatgtgactctggacccattga

SEQ ID NO: 8152553 - DNA, 22 bp, Homo sapiens
tatgtgatataggctatttgat

SEQ ID NO: 8152554 - DNA, 22 bp, Homo sapiens
tatgtgatataggctatttgat

SEQ ID NO: 8152555 - DNA, 22 bp, Homo sapiens
tatgtgatcaaaaaagtttgga

SEQ ID NO: 8152556 - DNA, 18 bp, Homo sapiens
tatgtgtctgttacaact

SEQ ID NO: 8152557 - DNA, 22 bp, Homo sapiens
tatgtgtctgtcgtgcataaat

SEQ ID NO: 8152558 - DNA, 22 bp, Homo sapiens
tatgtgtctgtcgtgcataaat

SEQ ID NO: 8152559 - DNA, 21 bp, Homo sapiens
tatgtgtctgtggaaaactag

SEQ ID NO: 8152560 - DNA, 16 bp, Homo sapiens
tatgtgtctcatctac

SEQ ID NO: 8152561 - DNA, 22 bp, Homo sapiens
tatgtgtctttatctggctctt

SEQ ID NO: 8152562 - DNA, 18 bp, Homo sapiens
tatgtgtctgttacaact

SEQ ID NO: 8152563 - DNA, 22 bp, Homo sapiens
tatgtgtgcatgtatacattaa

SEQ ID NO: 8152564 - DNA, 22 bp, Homo sapiens
tatgtgtgcatgtatacattaa

SEQ ID NO: 8152565 - DNA, 22 bp, Homo sapiens
tatgtgtctgtcgtgcataaat

SEQ ID NO: 8152566 - DNA, 16 bp, Homo sapiens
tatgtgtctcatctac

SEQ ID NO: 8152567 - DNA, 22 bp, Homo sapiens
tatgtgtctcagttgtgattga

SEQ ID NO: 8152568 - DNA, 22 bp, Homo sapiens
tatgtgtctcagttgtgattga

SEQ ID NO: 8152569 - DNA, 22 bp, Homo sapiens
tatgtgtctcagttgtgattga

SEQ ID NO: 8152570 - DNA, 22 bp, Homo sapiens
tatgtgtcctgttaccggcagc

SEQ ID NO: 8152571 - DNA, 22 bp, Homo sapiens
tatgtgtcctaagcaatcatcc

SEQ ID NO: 8152572 - DNA, 22 bp, Homo sapiens
tatgtgcatatgcatacacaca

SEQ ID NO: 8152573 - DNA, 20 bp, Homo sapiens
tatgtgcagtttggtttatc

SEQ ID NO: 8152574 - DNA, 22 bp, Homo sapiens
tatgtcttaatccttccttagg

SEQ ID NO: 8152575 - DNA, 22 bp, Homo sapiens
tatgtctggcatgttgtaatta

SEQ ID NO: 8152576 - DNA, 22 bp, Homo sapiens
tatgtctttgtcccactcccag

SEQ ID NO: 8152577 - DNA, 22 bp, Homo sapiens
tatgtgaagagattaaaaaata

SEQ ID NO: 8152578 - DNA, 22 bp, Homo sapiens
tatgtcttttgcttgcaaatag

SEQ ID NO: 8152579 - DNA, 22 bp, Homo sapiens
tatccaattcaccattgatggg

SEQ ID NO: 8152580 - DNA, 22 bp, Homo sapiens
tatccaaagtggcatattatag

SEQ ID NO: 8152581 - DNA, 20 bp, Homo sapiens
tatatgacatcatgatctta

SEQ ID NO: 8152582 - DNA, 22 bp, Homo sapiens
tatatctaggaaccctgagatt

SEQ ID NO: 8152583 - DNA, 22 bp, Homo sapiens
tatccataccactacttccctt

SEQ ID NO: 8152584 - DNA, 22 bp, Homo sapiens
tatccatagtttatagatcaag

SEQ ID NO: 8152585 - DNA, 23 bp, Homo sapiens
tatccagtagggcccagagctga

SEQ ID NO: 8152586 - DNA, 22 bp, Homo sapiens
tatccatctatgtgtgtctgtg

SEQ ID NO: 8152587 - DNA, 22 bp, Homo sapiens
tatccatattcagactgtgaat

SEQ ID NO: 8152588 - DNA, 22 bp, Homo sapiens
tatccatattaagatgcctctg

SEQ ID NO: 8152589 - DNA, 22 bp, Homo sapiens
tatccatagtttatagatcaag

SEQ ID NO: 8152590 - DNA, 22 bp, Homo sapiens
tatccatcagtcacactataga

SEQ ID NO: 8152591 - DNA, 22 bp, Homo sapiens
tatatatgggggaagctggatg

SEQ ID NO: 8152592 - DNA, 22 bp, Homo sapiens
tatatattcttaagtagtgtag

SEQ ID NO: 8152593 - DNA, 22 bp, Homo sapiens
tatatattcttaagtagtgtag

SEQ ID NO: 8152594 - DNA, 19 bp, Homo sapiens
tatatattttggggttgtg

SEQ ID NO: 8152595 - DNA, 19 bp, Homo sapiens
tatatattttggggttgtg

SEQ ID NO: 8152596 - DNA, 22 bp, Homo sapiens
tatatcatggagattaacattc

SEQ ID NO: 8152597 - DNA, 22 bp, Homo sapiens
tatatcatggagattaacattc

SEQ ID NO: 8152598 - DNA, 22 bp, Homo sapiens
tatatgacagtatcattttaaa

SEQ ID NO: 8152599 - DNA, 22 bp, Homo sapiens
tatatcttatatgtgcaggtac

SEQ ID NO: 8152600 - DNA, 22 bp, Homo sapiens
tatatctaggaaccctgagatt

SEQ ID NO: 8152601 - DNA, 22 bp, Homo sapiens
tatatctaagtgtatgtaagag

SEQ ID NO: 8152602 - DNA, 22 bp, Homo sapiens
tatatctaagtgtatgtaagag

SEQ ID NO: 8152603 - DNA, 22 bp, Homo sapiens
tatagtacatggaatcttcata

SEQ ID NO: 8152604 - DNA, 22 bp, Homo sapiens
tatagtacacttaggtacttca

SEQ ID NO: 8152605 - DNA, 22 bp, Homo sapiens
tatagtacatggaatcttcata

SEQ ID NO: 8152606 - DNA, 22 bp, Homo sapiens
tatagtttcatgagctttttaa

SEQ ID NO: 8152607 - DNA, 21 bp, Homo sapiens
tatagtgtggatatgctgatg

SEQ ID NO: 8152608 - DNA, 22 bp, Homo sapiens
tatatatgagcatgtgaggaca

SEQ ID NO: 8152609 - DNA, 22 bp, Homo sapiens
tatagtttcatgagctttttaa

SEQ ID NO: 8152610 - DNA, 22 bp, Homo sapiens
tatagtaaaattttcatttatg

SEQ ID NO: 8152611 - DNA, 22 bp, Homo sapiens
tatagtaaaattttcatttatg

SEQ ID NO: 8152612 - DNA, 22 bp, Homo sapiens
tatagtacacttaggtacttca

SEQ ID NO: 8152613 - DNA, 22 bp, Homo sapiens
tataggaccgacttgtttatag

SEQ ID NO: 8152614 - DNA, 22 bp, Homo sapiens
tataggcagatctgagaatatt

SEQ ID NO: 8152615 - DNA, 22 bp, Homo sapiens
tataggactgatcacattttca

SEQ ID NO: 8152616 - DNA, 22 bp, Homo sapiens
tataggaaatttatctcctggg

SEQ ID NO: 8152617 - DNA, 22 bp, Homo sapiens
tataggaaataggtcttctgtg

SEQ ID NO: 8152618 - DNA, 22 bp, Homo sapiens
tataggaaggcagattttagct

SEQ ID NO: 8152619 - DNA, 22 bp, Homo sapiens
tataggaagtaattgttgcctg

SEQ ID NO: 8152620 - DNA, 22 bp, Homo sapiens
tatagcaattcagaatacatgt

SEQ ID NO: 8152621 - DNA, 22 bp, Homo sapiens
tatagcacacagtttataaaag

SEQ ID NO: 8152622 - DNA, 22 bp, Homo sapiens
tatagctaaggtcagactgttt

SEQ ID NO: 8152623 - DNA, 22 bp, Homo sapiens
tatagccatttccagtggcatc

SEQ ID NO: 8152624 - DNA, 22 bp, Homo sapiens
tataggaaacatacgtgactag

SEQ ID NO: 8152625 - DNA, 22 bp, Homo sapiens
tataggaaaggagtggtcacaa

SEQ ID NO: 8152626 - DNA, 22 bp, Homo sapiens
tatctacagttaatatgtcatc

SEQ ID NO: 8152627 - DNA, 22 bp, Homo sapiens
tatctagaaacagagttttact

SEQ ID NO: 8152628 - DNA, 23 bp, Homo sapiens
tatctactttgcaattcagtacc

SEQ ID NO: 8152629 - DNA, 21 bp, Homo sapiens
tatctactggtgtctttcaga

SEQ ID NO: 8152630 - DNA, 22 bp, Homo sapiens
tatctacattcttgtatcttct

SEQ ID NO: 8152631 - DNA, 22 bp, Homo sapiens
tatctacatgtaggtatgtatg

SEQ ID NO: 8152632 - DNA, 22 bp, Homo sapiens
tatctacatgtaggtatgtatg

SEQ ID NO: 8152633 - DNA, 22 bp, Homo sapiens
tatctagataccaagaagcaca

SEQ ID NO: 8152634 - DNA, 19 bp, Homo sapiens
tatgacaagtactagttct

SEQ ID NO: 8152635 - DNA, 20 bp, Homo sapiens
tatctaaatgcttacattac

SEQ ID NO: 8152636 - DNA, 20 bp, Homo sapiens
tatctaaatgcttacattac

SEQ ID NO: 8152637 - DNA, 22 bp, Homo sapiens
tatctaaaggatttaatttagt

SEQ ID NO: 8152638 - DNA, 22 bp, Homo sapiens
tatctaaaggatttaatttagt

SEQ ID NO: 8152639 - DNA, 22 bp, Homo sapiens
tatctaaatggaatattccaga

SEQ ID NO: 8152640 - DNA, 22 bp, Homo sapiens
tatctaaatggaatattccaga

SEQ ID NO: 8152641 - DNA, 22 bp, Homo sapiens
tatctacaggtgtcaggtaaga

SEQ ID NO: 8152642 - DNA, 23 bp, Homo sapiens
tatcctaaaggcaacaggaagtc

SEQ ID NO: 8152643 - DNA, 22 bp, Homo sapiens
tatcctggagaatctgatagga

SEQ ID NO: 8152644 - DNA, 22 bp, Homo sapiens
tatccccacctctgttaaggac

SEQ ID NO: 8152645 - DNA, 22 bp, Homo sapiens
tatctaaaggatttaatttagt

SEQ ID NO: 8152646 - DNA, 22 bp, Homo sapiens
tatcctgttttgcacaattata

SEQ ID NO: 8152647 - DNA, 22 bp, Homo sapiens
tatcctggagaatctgatagga

SEQ ID NO: 8152648 - DNA, 22 bp, Homo sapiens
tatcctggagaatctgatagga

SEQ ID NO: 8152649 - DNA, 22 bp, Homo sapiens
tatgagaaaataaatatctgtt

SEQ ID NO: 8152650 - DNA, 22 bp, Homo sapiens
tatgacattatgtattacatgt

SEQ ID NO: 8152651 - DNA, 19 bp, Homo sapiens
tatgacagctggagggctc

SEQ ID NO: 8152652 - DNA, 22 bp, Homo sapiens
tatgacagtttcgtaggggttg

SEQ ID NO: 8152653 - DNA, 22 bp, Homo sapiens
tatgacattgctttttagaact

SEQ ID NO: 8152654 - DNA, 22 bp, Homo sapiens
tatgacattgctttttagaact

SEQ ID NO: 8152655 - DNA, 22 bp, Homo sapiens
tatgacatttctctgatttgtg

SEQ ID NO: 8152656 - DNA, 22 bp, Homo sapiens
tatgacattggccaagttctgt

SEQ ID NO: 8152657 - DNA, 22 bp, Homo sapiens
tatgactatagggcttagtgtt

SEQ ID NO: 8152658 - DNA, 17 bp, Homo sapiens
tatacacagacagactg

SEQ ID NO: 8152659 - DNA, 17 bp, Homo sapiens
tatacacagacagactg

SEQ ID NO: 8152660 - DNA, 17 bp, Homo sapiens
tatacacagacagactg

SEQ ID NO: 8152661 - DNA, 22 bp, Homo sapiens
tatacacaggaatctgtgaaaa

SEQ ID NO: 8152662 - DNA, 22 bp, Homo sapiens
tatacacaggaatctgtgaaaa

SEQ ID NO: 8152663 - DNA, 22 bp, Homo sapiens
tatacacatatacgtttgtgtg

SEQ ID NO: 8152664 - DNA, 22 bp, Homo sapiens
tatacacatatacgtttgtgtg

SEQ ID NO: 8152665 - DNA, 22 bp, Homo sapiens
tatacacatcctccaaagatag

SEQ ID NO: 8152666 - DNA, 22 bp, Homo sapiens
tatacacatcctccaaagatag

SEQ ID NO: 8152667 - DNA, 22 bp, Homo sapiens
tatacacatatcttctaggcct

SEQ ID NO: 8152668 - DNA, 22 bp, Homo sapiens
tatacacatcctccaaagatag

SEQ ID NO: 8152669 - DNA, 22 bp, Homo sapiens
tatacacatcctccaaagatag

SEQ ID NO: 8152670 - DNA, 22 bp, Homo sapiens
tatacacattacagtttcagga

SEQ ID NO: 8152671 - DNA, 22 bp, Homo sapiens
tatacacatgtgtgtattcata

SEQ ID NO: 8152672 - DNA, 22 bp, Homo sapiens
tatacacatgtgtgtattcata

SEQ ID NO: 8152673 - DNA, 23 bp, Homo sapiens
tatacacatgtggcagtatagtg

SEQ ID NO: 8152674 - DNA, 22 bp, Homo sapiens
tatacacatgtgtgtattcata

SEQ ID NO: 8152675 - DNA, 23 bp, Homo sapiens
tatacacatgtggcagtatagtg

SEQ ID NO: 8152676 - DNA, 22 bp, Homo sapiens
tatacagaacattaagaactgt

SEQ ID NO: 8152677 - DNA, 22 bp, Homo sapiens
tatacagaaagaattcaagtct

SEQ ID NO: 8152678 - DNA, 22 bp, Homo sapiens
tatacagaaagaattcaagtct

SEQ ID NO: 8152679 - DNA, 22 bp, Homo sapiens
tatacacatttttacctatagt

SEQ ID NO: 8152680 - DNA, 22 bp, Homo sapiens
tatacacatttttacctatagt

SEQ ID NO: 8152681 - DNA, 22 bp, Homo sapiens
tatacacatttttacctatagt

SEQ ID NO: 8152682 - DNA, 22 bp, Homo sapiens
tatacacaaggtgtgcatttgt

SEQ ID NO: 8152683 - DNA, 22 bp, Homo sapiens
tatacacaaggtgtgcatttgt

SEQ ID NO: 8152684 - DNA, 22 bp, Homo sapiens
tatacacaaggtgtgcatttgt

SEQ ID NO: 8152685 - DNA, 22 bp, Homo sapiens
tatacacacatgctccggcctt

SEQ ID NO: 8152686 - DNA, 22 bp, Homo sapiens
tatacacacctccaaagcagga

SEQ ID NO: 8152687 - DNA, 22 bp, Homo sapiens
tatacacacctccaaagcagga

SEQ ID NO: 8152688 - DNA, 22 bp, Homo sapiens
tatacacacctccaaagcagga

SEQ ID NO: 8152689 - DNA, 22 bp, Homo sapiens
tatacaatggctgaatcatcca

SEQ ID NO: 8152690 - DNA, 22 bp, Homo sapiens
tatacaatggctgaatcatcca

SEQ ID NO: 8152691 - DNA, 22 bp, Homo sapiens
tatacacaaacaaggggttaag

SEQ ID NO: 8152692 - DNA, 22 bp, Homo sapiens
tatacacaaacaaggggttaag

SEQ ID NO: 8152693 - DNA, 22 bp, Homo sapiens
tatacaatggctgaatcatcca

SEQ ID NO: 8152694 - DNA, 22 bp, Homo sapiens
tatacaatggctgaatcatcca

SEQ ID NO: 8152695 - DNA, 22 bp, Homo sapiens
tatacaatggctgaatcatcca

SEQ ID NO: 8152696 - DNA, 22 bp, Homo sapiens
tatacaatggctgaatcatcca

SEQ ID NO: 8152697 - DNA, 22 bp, Homo sapiens
tataatttggggaaagtggtgt

SEQ ID NO: 8152698 - DNA, 22 bp, Homo sapiens
tataatttggggaaagtggtgt

SEQ ID NO: 8152699 - DNA, 22 bp, Homo sapiens
tataatttatcatgtcacagtt

SEQ ID NO: 8152700 - DNA, 22 bp, Homo sapiens
tataatttatcatgtcacagtt

SEQ ID NO: 8152701 - DNA, 22 bp, Homo sapiens
tataatttggggaaagtggtgt

SEQ ID NO: 8152702 - DNA, 22 bp, Homo sapiens
tataattttaagtggtaaatta

SEQ ID NO: 8152703 - DNA, 22 bp, Homo sapiens
tataattttaagtggtaaatta

SEQ ID NO: 8152704 - DNA, 22 bp, Homo sapiens
tataattttagaagagatggaa

SEQ ID NO: 8152705 - DNA, 22 bp, Homo sapiens
tataattttaagtggtaaatta

SEQ ID NO: 8152706 - DNA, 22 bp, Homo sapiens
tataattttagaagagatggaa

SEQ ID NO: 8152707 - DNA, 22 bp, Homo sapiens
tataatttttctgtggccagtt

SEQ ID NO: 8152708 - DNA, 22 bp, Homo sapiens
tatacaagaggtgagatgagca

SEQ ID NO: 8152709 - DNA, 22 bp, Homo sapiens
tataattagtaaatggcagatt

SEQ ID NO: 8152710 - DNA, 22 bp, Homo sapiens
tataactgagaagatacatagt

SEQ ID NO: 8152711 - DNA, 22 bp, Homo sapiens
tataactacttgaagagttcag

SEQ ID NO: 8152712 - DNA, 22 bp, Homo sapiens
tataactgagaagatacatagt

SEQ ID NO: 8152713 - DNA, 20 bp, Homo sapiens
tataaattcagagctttggt

SEQ ID NO: 8152714 - DNA, 20 bp, Homo sapiens
tataaattcagagctttggt

SEQ ID NO: 8152715 - DNA, 20 bp, Homo sapiens
tataaattcagagctttggt

SEQ ID NO: 8152716 - DNA, 20 bp, Homo sapiens
tataaattcagagctttggt

SEQ ID NO: 8152717 - DNA, 20 bp, Homo sapiens
tataaattcagagctttggt

SEQ ID NO: 8152718 - DNA, 22 bp, Homo sapiens
tataaattattaggctgctaaa

SEQ ID NO: 8152719 - DNA, 22 bp, Homo sapiens
tataaattattaggctgctaaa

SEQ ID NO: 8152720 - DNA, 22 bp, Homo sapiens
tataaattattaggctgctaaa

SEQ ID NO: 8152721 - DNA, 22 bp, Homo sapiens
tataaattattaggctgctaaa

SEQ ID NO: 8152722 - DNA, 22 bp, Homo sapiens
tataaatgcacttttgaaatat

SEQ ID NO: 8152723 - DNA, 22 bp, Homo sapiens
tataaagtttcgaaagatgtat

SEQ ID NO: 8152724 - DNA, 22 bp, Homo sapiens
tataaagtttcgaaagatgtat

SEQ ID NO: 8152725 - DNA, 22 bp, Homo sapiens
taggtgtctttctgtccttgtt

SEQ ID NO: 8152726 - DNA, 22 bp, Homo sapiens
taggtgtcttgtgtatggtaca

SEQ ID NO: 8152727 - DNA, 22 bp, Homo sapiens
taggtgtcttgtcactaccgtt

SEQ ID NO: 8152728 - DNA, 22 bp, Homo sapiens
taggtgtctttctgtccttgtt

SEQ ID NO: 8152729 - DNA, 22 bp, Homo sapiens
taggtgtcttgtgtatggtaca

SEQ ID NO: 8152730 - DNA, 22 bp, Homo sapiens
tataaagtttcgaaagatgtat

SEQ ID NO: 8152731 - DNA, 22 bp, Homo sapiens
tataaattaatgtgcccatgag

SEQ ID NO: 8152732 - DNA, 22 bp, Homo sapiens
tataaattaatgtgcccatgag

SEQ ID NO: 8152733 - DNA, 22 bp, Homo sapiens
tataaattaatgtgcccatgag

SEQ ID NO: 8152734 - DNA, 22 bp, Homo sapiens
tataaatgccaggactttagat

SEQ ID NO: 8152735 - DNA, 22 bp, Homo sapiens
tataaatgccaggactttagat

SEQ ID NO: 8152736 - DNA, 22 bp, Homo sapiens
tataaatgcacttttgaaatat

SEQ ID NO: 8152737 - DNA, 22 bp, Homo sapiens
tataaatgccaggactttagat

SEQ ID NO: 8152738 - DNA, 22 bp, Homo sapiens
taggggtgtttcgagagaggtt

SEQ ID NO: 8152739 - DNA, 22 bp, Homo sapiens
taggggtgtttcgagagaggtt

SEQ ID NO: 8152740 - DNA, 22 bp, Homo sapiens
taggtcagaacaagcagtatcg

SEQ ID NO: 8152741 - DNA, 22 bp, Homo sapiens
taggggtgaggccaggcatcag

SEQ ID NO: 8152742 - DNA, 22 bp, Homo sapiens
taggtctgtaaatgagagagac

SEQ ID NO: 8152743 - DNA, 22 bp, Homo sapiens
taggtctgtaccctgtccttct

SEQ ID NO: 8152744 - DNA, 22 bp, Homo sapiens
taggtctgtgcagaggctgagc

SEQ ID NO: 8152745 - DNA, 22 bp, Homo sapiens
taggtctgtaaatgagagagac

SEQ ID NO: 8152746 - DNA, 22 bp, Homo sapiens
taggtctggccccatgcagcca

SEQ ID NO: 8152747 - DNA, 22 bp, Homo sapiens
taggtctgatttccattcagtc

SEQ ID NO: 8152748 - DNA, 22 bp, Homo sapiens
taggtgaggttacaagagttca

SEQ ID NO: 8152749 - DNA, 20 bp, Homo sapiens
taggtgagggcagatagagg

SEQ ID NO: 8152750 - DNA, 22 bp, Homo sapiens
taggtgagggagcattgtgaga

SEQ ID NO: 8152751 - DNA, 22 bp, Homo sapiens
taggtctctcttcttgatggga

SEQ ID NO: 8152752 - DNA, 22 bp, Homo sapiens
taggtctgaggctgcatcttgg

SEQ ID NO: 8152753 - DNA, 22 bp, Homo sapiens
taggtcccagcatcttctgagc

SEQ ID NO: 8152754 - DNA, 20 bp, Homo sapiens
taggtccaatgctcgtcttc

SEQ ID NO: 8152755 - DNA, 22 bp, Homo sapiens
taggtgtctgctcttatttaac

SEQ ID NO: 8152756 - DNA, 23 bp, Homo sapiens
taggtgtctagtgtccactatgt

SEQ ID NO: 8152757 - DNA, 22 bp, Homo sapiens
taggtgtctgctcttatttaac

SEQ ID NO: 8152758 - DNA, 22 bp, Homo sapiens
taggtgtctaacaataagtgta

SEQ ID NO: 8152759 - DNA, 23 bp, Homo sapiens
taggtgtctagtgtccactatgt

SEQ ID NO: 8152760 - DNA, 22 bp, Homo sapiens
taggtgtctgtcctgggctgtg

SEQ ID NO: 8152761 - DNA, 22 bp, Homo sapiens
taggtgtctggacaactttgta

SEQ ID NO: 8152762 - DNA, 22 bp, Homo sapiens
taggtgtcttgtcactaccgtt

SEQ ID NO: 8152763 - DNA, 22 bp, Homo sapiens
taggtgtctgtcctgggctgtg

SEQ ID NO: 8152764 - DNA, 22 bp, Homo sapiens
taggtgtctgctcttatttaac

SEQ ID NO: 8152765 - DNA, 22 bp, Homo sapiens
taggtgtctggacaactttgta

SEQ ID NO: 8152766 - DNA, 22 bp, Homo sapiens
taggtgtctaacaataagtgta

SEQ ID NO: 8152767 - DNA, 22 bp, Homo sapiens
taggtgtcaggtatagaattta

SEQ ID NO: 8152768 - DNA, 22 bp, Homo sapiens
taggtgtccatatatgtgtgta

SEQ ID NO: 8152769 - DNA, 19 bp, Homo sapiens
taggtgtccgccggaggtg

SEQ ID NO: 8152770 - DNA, 22 bp, Homo sapiens
taggtgtcctcgtccaaagatt

SEQ ID NO: 8152771 - DNA, 22 bp, Homo sapiens
taggtgtcctcgtccaaagatt

SEQ ID NO: 8152772 - DNA, 19 bp, Homo sapiens
taggtgtccgccggaggtg

SEQ ID NO: 8152773 - DNA, 22 bp, Homo sapiens
taggtgtccatatatgtgtgta

SEQ ID NO: 8152774 - DNA, 22 bp, Homo sapiens
taggtgtcaggtatagaattta

SEQ ID NO: 8152775 - DNA, 22 bp, Homo sapiens
taggtgtcaggcctcctccagc

SEQ ID NO: 8152776 - DNA, 22 bp, Homo sapiens
taggtgtcaggcctcctccagc

SEQ ID NO: 8152777 - DNA, 17 bp, Homo sapiens
taggtggttgctggtct

SEQ ID NO: 8152778 - DNA, 22 bp, Homo sapiens
taggtggttgtctgctttccta

SEQ ID NO: 8152779 - DNA, 22 bp, Homo sapiens
taggtgagtttggggaagatag

SEQ ID NO: 8152780 - DNA, 22 bp, Homo sapiens
taggtgcctgcacgacccaaac

SEQ ID NO: 8152781 - DNA, 22 bp, Homo sapiens
taggtgcctcggagaaaggacc

SEQ ID NO: 8152782 - DNA, 22 bp, Homo sapiens
taggtggtagagcctggcttgc

SEQ ID NO: 8152783 - DNA, 22 bp, Homo sapiens
taggtggtagagcctggcttgc

SEQ ID NO: 8152784 - DNA, 17 bp, Homo sapiens
taggtggttgctggtct

SEQ ID NO: 8152785 - DNA, 22 bp, Homo sapiens
taggtggttatgtcagcctaga

SEQ ID NO: 8152786 - DNA, 22 bp, Homo sapiens
taggtggttgtctgctttccta

SEQ ID NO: 8152787 - DNA, 22 bp, Homo sapiens
taggtggttataaattcaaggc

SEQ ID NO: 8152788 - DNA, 22 bp, Homo sapiens
taggtggttatgtcagcctaga

SEQ ID NO: 8152789 - DNA, 22 bp, Homo sapiens
taggtggtgtgcgaagagcgtg

SEQ ID NO: 8152790 - DNA, 22 bp, Homo sapiens
taggtggtgggatatgagcatc

SEQ ID NO: 8152791 - DNA, 22 bp, Homo sapiens
taggtggttataaattcaaggc

SEQ ID NO: 8152792 - DNA, 22 bp, Homo sapiens
taggtggtgtgcgaagagcgtg

SEQ ID NO: 8152793 - DNA, 22 bp, Homo sapiens
taggtggtgggatatgagcatc

SEQ ID NO: 8152794 - DNA, 22 bp, Homo sapiens
tagaaactgatagtcttgtgct

SEQ ID NO: 8152795 - DNA, 22 bp, Homo sapiens
tagaaactgatagtcttgtgct

SEQ ID NO: 8152796 - DNA, 22 bp, Homo sapiens
tagaaactctcacgagtgaaac

SEQ ID NO: 8152797 - DNA, 22 bp, Homo sapiens
tagaaactctcacgagtgaaac

SEQ ID NO: 8152798 - DNA, 22 bp, Homo sapiens
tagaaactcacgttatcattgc

SEQ ID NO: 8152799 - DNA, 22 bp, Homo sapiens
tagaaactagattgatagcgga

SEQ ID NO: 8152800 - DNA, 22 bp, Homo sapiens
tagaaactcaggatactcttcc

SEQ ID NO: 8152801 - DNA, 22 bp, Homo sapiens
tagaaactctcaatctgggatg

SEQ ID NO: 8152802 - DNA, 22 bp, Homo sapiens
tagaaactactagaataagaga

SEQ ID NO: 8152803 - DNA, 22 bp, Homo sapiens
tagaaactagattgatagcgga

SEQ ID NO: 8152804 - DNA, 22 bp, Homo sapiens
tagaaacattcagttgcagtcc

SEQ ID NO: 8152805 - DNA, 22 bp, Homo sapiens
tagaaacattcagttgcagtcc

SEQ ID NO: 8152806 - DNA, 22 bp, Homo sapiens
tagaaacatgttctgttctgtt

SEQ ID NO: 8152807 - DNA, 22 bp, Homo sapiens
tagaaacatgagagaaactctt

SEQ ID NO: 8152808 - DNA, 22 bp, Homo sapiens
tagaaacatgagagaaactctt

SEQ ID NO: 8152809 - DNA, 22 bp, Homo sapiens
tagaaacattcagttgcagtcc

SEQ ID NO: 8152810 - DNA, 22 bp, Homo sapiens
tagaaacatcagctaaccaaaa

SEQ ID NO: 8152811 - DNA, 22 bp, Homo sapiens
tagaaacatcagctaaccaaaa

SEQ ID NO: 8152812 - DNA, 22 bp, Homo sapiens
tagaaacatcagctaaccaaaa

SEQ ID NO: 8152813 - DNA, 22 bp, Homo sapiens
tagaaacaatgacatgcttgta

SEQ ID NO: 8152814 - DNA, 22 bp, Homo sapiens
tagaaaagccccagctggaggg

SEQ ID NO: 8152815 - DNA, 22 bp, Homo sapiens
tagaaacacagagagacccatg

SEQ ID NO: 8152816 - DNA, 22 bp, Homo sapiens
tagaaacaatgacatgcttgta

SEQ ID NO: 8152817 - DNA, 22 bp, Homo sapiens
tagaaacagaatatgagtgaga

SEQ ID NO: 8152818 - DNA, 22 bp, Homo sapiens
tagaaacacagatctggtgtca

SEQ ID NO: 8152819 - DNA, 22 bp, Homo sapiens
tagaaacagaaaactgtaatag

SEQ ID NO: 8152820 - DNA, 22 bp, Homo sapiens
tagaaacagaaaactgtaatag

SEQ ID NO: 8152821 - DNA, 22 bp, Homo sapiens
tagaaacagatgtttttgaaga

SEQ ID NO: 8152822 - DNA, 22 bp, Homo sapiens
tagaaacagatgtttttgaaga

SEQ ID NO: 8152823 - DNA, 22 bp, Homo sapiens
tagaaacagagcaggtggccca

SEQ ID NO: 8152824 - DNA, 22 bp, Homo sapiens
tagaaacagagagatatgcccc

SEQ ID NO: 8152825 - DNA, 22 bp, Homo sapiens
tagaaacagagagatatgcccc

SEQ ID NO: 8152826 - DNA, 22 bp, Homo sapiens
tagaaacatataggatggcagg

SEQ ID NO: 8152827 - DNA, 22 bp, Homo sapiens
tagaaacatatgtttgagacat

SEQ ID NO: 8152828 - DNA, 22 bp, Homo sapiens
tagaaacatataggatggcagg

SEQ ID NO: 8152829 - DNA, 22 bp, Homo sapiens
tagaaacagcatatattagccc

SEQ ID NO: 8152830 - DNA, 22 bp, Homo sapiens
tagaaacagcatatattagccc

SEQ ID NO: 8152831 - DNA, 22 bp, Homo sapiens
tacttttagcctatttgattct

SEQ ID NO: 8152832 - DNA, 22 bp, Homo sapiens
tacttttagcctatttgattct

SEQ ID NO: 8152833 - DNA, 22 bp, Homo sapiens
tactttgtggagattaaaaata

SEQ ID NO: 8152834 - DNA, 22 bp, Homo sapiens
tacttttaaaattcacaggtat

SEQ ID NO: 8152835 - DNA, 22 bp, Homo sapiens
tacttttaaaattcacaggtat

SEQ ID NO: 8152836 - DNA, 22 bp, Homo sapiens
tactttgtccatttgcaggcag

SEQ ID NO: 8152837 - DNA, 22 bp, Homo sapiens
tactttgtggagattaaaaata

SEQ ID NO: 8152838 - DNA, 22 bp, Homo sapiens
tactttggttgaatatgtaatg

SEQ ID NO: 8152839 - DNA, 21 bp, Homo sapiens
tactttgcaatgtatctcctt

SEQ ID NO: 8152840 - DNA, 20 bp, Homo sapiens
tactttgatctgataagcaa

SEQ ID NO: 8152841 - DNA, 22 bp, Homo sapiens
tactttggatccttacaatagc

SEQ ID NO: 8152842 - DNA, 22 bp, Homo sapiens
tactttggaagagttcatacag

SEQ ID NO: 8152843 - DNA, 22 bp, Homo sapiens
tactttgggtttagaataaact

SEQ ID NO: 8152844 - DNA, 22 bp, Homo sapiens
tactttggatccttacaatagc

SEQ ID NO: 8152845 - DNA, 22 bp, Homo sapiens
tactttggggacaatatggaat

SEQ ID NO: 8152846 - DNA, 22 bp, Homo sapiens
taccaaagaatattttaaatag

SEQ ID NO: 8152847 - DNA, 22 bp, Homo sapiens
taccaaaaccaagccattatct

SEQ ID NO: 8152848 - DNA, 22 bp, Homo sapiens
tacattttctaggggaccaaga

SEQ ID NO: 8152849 - DNA, 22 bp, Homo sapiens
tagaaaagaattttatttgata

SEQ ID NO: 8152850 - DNA, 22 bp, Homo sapiens
tagaaaagaattttatttgata

SEQ ID NO: 8152851 - DNA, 22 bp, Homo sapiens
tagaaaagataacattctgtgc

SEQ ID NO: 8152852 - DNA, 22 bp, Homo sapiens
tagaaaactaatacatgcttga

SEQ ID NO: 8152853 - DNA, 22 bp, Homo sapiens
tagaaaactaatacatgcttga

SEQ ID NO: 8152854 - DNA, 22 bp, Homo sapiens
tagaaaactaatacatgcttga

SEQ ID NO: 8152855 - DNA, 22 bp, Homo sapiens
tactttttgtctctttgaatgt

SEQ ID NO: 8152856 - DNA, 22 bp, Homo sapiens
tactttttgtctctttgaatgt

SEQ ID NO: 8152857 - DNA, 22 bp, Homo sapiens
tactttttgtctctttgaatgt

SEQ ID NO: 8152858 - DNA, 22 bp, Homo sapiens
tactttttgtctctttgaatgt

SEQ ID NO: 8152859 - DNA, 22 bp, Homo sapiens
tactttttgtctctttgaatgt

SEQ ID NO: 8152860 - DNA, 22 bp, Homo sapiens
tacttttctataggtttgaaat

SEQ ID NO: 8152861 - DNA, 22 bp, Homo sapiens
tacttttctgtgtggcagtcac

SEQ ID NO: 8152862 - DNA, 22 bp, Homo sapiens
tacttttctttgtcatgcatct

SEQ ID NO: 8152863 - DNA, 22 bp, Homo sapiens
tactttttagcacagtgtgtgc

SEQ ID NO: 8152864 - DNA, 22 bp, Homo sapiens
tactttttagcacagtgtgtgc

SEQ ID NO: 8152865 - DNA, 22 bp, Homo sapiens
tactttttatgataagaactga

SEQ ID NO: 8152866 - DNA, 19 bp, Homo sapiens
tactttttcaggacagagt

SEQ ID NO: 8152867 - DNA, 22 bp, Homo sapiens
tacttttcataatgaagcagca

SEQ ID NO: 8152868 - DNA, 22 bp, Homo sapiens
tacttttcacccagcccgcttc

SEQ ID NO: 8152869 - DNA, 22 bp, Homo sapiens
tacttttcaagcagctggttat

SEQ ID NO: 8152870 - DNA, 22 bp, Homo sapiens
tacttttatgtgatgaaatctg

SEQ ID NO: 8152871 - DNA, 22 bp, Homo sapiens
tacttttattattgcccctcca

SEQ ID NO: 8152872 - DNA, 22 bp, Homo sapiens
tacttttcctggaaccactgct

SEQ ID NO: 8152873 - DNA, 22 bp, Homo sapiens
tacttttccagggctggctgag

SEQ ID NO: 8152874 - DNA, 22 bp, Homo sapiens
tacttttatgtgatgaaatctg

SEQ ID NO: 8152875 - DNA, 22 bp, Homo sapiens
tacttttagcctatttgattct

SEQ ID NO: 8152876 - DNA, 22 bp, Homo sapiens
tacttttatgtgatgaaatctg

SEQ ID NO: 8152877 - DNA, 22 bp, Homo sapiens
tacttttatgtgatgaaatctg

SEQ ID NO: 8152878 - DNA, 22 bp, Homo sapiens
tacttttattattgcccctcca

SEQ ID NO: 8152879 - DNA, 22 bp, Homo sapiens
tacttttatgtgatgaaatctg

SEQ ID NO: 8152880 - DNA, 22 bp, Homo sapiens
tagacacaggggaatgtgaggt

SEQ ID NO: 8152881 - DNA, 22 bp, Homo sapiens
tagacacatacccttgcccaaa

SEQ ID NO: 8152882 - DNA, 22 bp, Homo sapiens
tagacaatgccatcttgtggtt

SEQ ID NO: 8152883 - DNA, 22 bp, Homo sapiens
tagaattgggcctaacttccat

SEQ ID NO: 8152884 - DNA, 22 bp, Homo sapiens
tagaattttctgctttgatagt

SEQ ID NO: 8152885 - DNA, 22 bp, Homo sapiens
tagaatgtggaggtaacagact

SEQ ID NO: 8152886 - DNA, 22 bp, Homo sapiens
tagaatgagaaagtgtagcagg

SEQ ID NO: 8152887 - DNA, 22 bp, Homo sapiens
tagaatgagaaagtgtagcagg

SEQ ID NO: 8152888 - DNA, 22 bp, Homo sapiens
tagaatgacctcctcttagctt

SEQ ID NO: 8152889 - DNA, 22 bp, Homo sapiens
tagaatgtagtgcttcaagatt

SEQ ID NO: 8152890 - DNA, 22 bp, Homo sapiens
tagacacatcaagtatagttaa

SEQ ID NO: 8152891 - DNA, 22 bp, Homo sapiens
tagacacatcaagtatagttaa

SEQ ID NO: 8152892 - DNA, 22 bp, Homo sapiens
tagacacatcaagtatagttaa

SEQ ID NO: 8152893 - DNA, 22 bp, Homo sapiens
tagacactagggatttagtact

SEQ ID NO: 8152894 - DNA, 22 bp, Homo sapiens
tagacactagggatttagtact

SEQ ID NO: 8152895 - DNA, 22 bp, Homo sapiens
tagacactgtatgagctgggtg

SEQ ID NO: 8152896 - DNA, 23 bp, Homo sapiens
tagacactcctttgtctgtcctt

SEQ ID NO: 8152897 - DNA, 22 bp, Homo sapiens
tagacactttagaagtaagggt

SEQ ID NO: 8152898 - DNA, 22 bp, Homo sapiens
tagaggcagaagaaattgacaa

SEQ ID NO: 8152899 - DNA, 22 bp, Homo sapiens
tagacagatttaaaggaatgga

SEQ ID NO: 8152900 - DNA, 22 bp, Homo sapiens
tagagggaaggaagaatggatt

SEQ ID NO: 8152901 - DNA, 22 bp, Homo sapiens
tagagggaagactgctagattt

SEQ ID NO: 8152902 - DNA, 22 bp, Homo sapiens
tagaggctgggaattattttca

SEQ ID NO: 8152903 - DNA, 22 bp, Homo sapiens
tagaggcttctactgctcactt

SEQ ID NO: 8152904 - DNA, 22 bp, Homo sapiens
tagaggctttcagcggtaggtc

SEQ ID NO: 8152905 - DNA, 22 bp, Homo sapiens
tagagggaagactgctagattt

SEQ ID NO: 8152906 - DNA, 22 bp, Homo sapiens
tagaggcttctactgctcactt

SEQ ID NO: 8152907 - DNA, 22 bp, Homo sapiens
tagaggctactagaggcacctg

SEQ ID NO: 8152908 - DNA, 22 bp, Homo sapiens
tagaggctcttcattgcagtag

SEQ ID NO: 8152909 - DNA, 22 bp, Homo sapiens
tagaggctcctgtgtgtaggtt

SEQ ID NO: 8152910 - DNA, 22 bp, Homo sapiens
tagaggcattgcttaatttcag

SEQ ID NO: 8152911 - DNA, 22 bp, Homo sapiens
tagaggcattaatgaataaaca

SEQ ID NO: 8152912 - DNA, 17 bp, Homo sapiens
tagaaatcatagggttg

SEQ ID NO: 8152913 - DNA, 22 bp, Homo sapiens
tagaaatcaggtttttagaaag

SEQ ID NO: 8152914 - DNA, 22 bp, Homo sapiens
tagaaatcatttagaagtattg

SEQ ID NO: 8152915 - DNA, 20 bp, Homo sapiens
tagaaatcttataaaagact

SEQ ID NO: 8152916 - DNA, 22 bp, Homo sapiens
tagaaatcacaaaccagtagtt

SEQ ID NO: 8152917 - DNA, 22 bp, Homo sapiens
tagaaatcagcaggcatatgta

SEQ ID NO: 8152918 - DNA, 22 bp, Homo sapiens
tagaaagtggttgagagtttag

SEQ ID NO: 8152919 - DNA, 22 bp, Homo sapiens
tagaaagtgaaggttaattaat

SEQ ID NO: 8152920 - DNA, 22 bp, Homo sapiens
tagaaatgcagtgtactgtgtc

SEQ ID NO: 8152921 - DNA, 22 bp, Homo sapiens
tagaaatgcccagattctgcta

SEQ ID NO: 8152922 - DNA, 22 bp, Homo sapiens
tagaaatgattttgatgcttca

SEQ ID NO: 8152923 - DNA, 22 bp, Homo sapiens
tagaaatgattttgatgcttca

SEQ ID NO: 8152924 - DNA, 22 bp, Homo sapiens
tagaaatgaatgtttaaaagtc

SEQ ID NO: 8152925 - DNA, 22 bp, Homo sapiens
tagaaatgaatgtttaaaagtc

SEQ ID NO: 8152926 - DNA, 22 bp, Homo sapiens
tagaaatgaatgtttaaaagtc

SEQ ID NO: 8152927 - DNA, 22 bp, Homo sapiens
tagaaatgattggttgagctct

SEQ ID NO: 8152928 - DNA, 22 bp, Homo sapiens
tagaaatgattggttgagctct

SEQ ID NO: 8152929 - DNA, 22 bp, Homo sapiens
tagaaatgagccatggtagagc

SEQ ID NO: 8152930 - DNA, 22 bp, Homo sapiens
tagaaagaacttcatgtaaaac

SEQ ID NO: 8152931 - DNA, 19 bp, Homo sapiens
tagaaagccagaaaacaga

SEQ ID NO: 8152932 - DNA, 22 bp, Homo sapiens
tagaaagctgagtaatacattt

SEQ ID NO: 8152933 - DNA, 22 bp, Homo sapiens
tagaaaggatattgagatgaat

SEQ ID NO: 8152934 - DNA, 22 bp, Homo sapiens
tagaaagtaaatcagttttatt

SEQ ID NO: 8152935 - DNA, 22 bp, Homo sapiens
tagaaagtaaacacgaagtctc

SEQ ID NO: 8152936 - DNA, 22 bp, Homo sapiens
tagaaagtactaaatttaactg

SEQ ID NO: 8152937 - DNA, 22 bp, Homo sapiens
tagaaagtactaaatttaactg

SEQ ID NO: 8152938 - DNA, 22 bp, Homo sapiens
tagaaagtagccacttacagag

SEQ ID NO: 8152939 - DNA, 22 bp, Homo sapiens
tagaaagtagccacttacagag

SEQ ID NO: 8152940 - DNA, 22 bp, Homo sapiens
tagaaagtagggaaggtaggat

SEQ ID NO: 8152941 - DNA, 22 bp, Homo sapiens
tagaaagtcaaaacactgtgtt

SEQ ID NO: 8152942 - DNA, 22 bp, Homo sapiens
tagaaagtcatgaattacacca

SEQ ID NO: 8152943 - DNA, 22 bp, Homo sapiens
tagaaagtcatgaattacacca

SEQ ID NO: 8152944 - DNA, 22 bp, Homo sapiens
tagaaagtgaaggttaattaat

SEQ ID NO: 8152945 - DNA, 21 bp, Homo sapiens
tagaaagtcaaagctatcagc

SEQ ID NO: 8152946 - DNA, 22 bp, Homo sapiens
tagctcttcatttcatctgatt

SEQ ID NO: 8152947 - DNA, 22 bp, Homo sapiens
tagcttaaaccaatctgaataa

SEQ ID NO: 8152948 - DNA, 22 bp, Homo sapiens
tagctttaatgagttggtaaga

SEQ ID NO: 8152949 - DNA, 22 bp, Homo sapiens
tagctttaatgagttggtaaga

SEQ ID NO: 8152950 - DNA, 22 bp, Homo sapiens
tagctttaatgagttggtaaga

SEQ ID NO: 8152951 - DNA, 22 bp, Homo sapiens
tagccgggtgtggtggaactcc

SEQ ID NO: 8152952 - DNA, 22 bp, Homo sapiens
tagccgcgtcagcagttcccca

SEQ ID NO: 8152953 - DNA, 22 bp, Homo sapiens
tagccgggtgttgtgtcatgca

SEQ ID NO: 8152954 - DNA, 22 bp, Homo sapiens
tagctcctggtgagcctactct

SEQ ID NO: 8152955 - DNA, 22 bp, Homo sapiens
tagctcttcaatcactgtctcc

SEQ ID NO: 8152956 - DNA, 21 bp, Homo sapiens
tagccctctctgtctgtgtac

SEQ ID NO: 8152957 - DNA, 21 bp, Homo sapiens
tagcccttctccacctcgccc

SEQ ID NO: 8152958 - DNA, 22 bp, Homo sapiens
tagccctgtccttggcctgtgc

SEQ ID NO: 8152959 - DNA, 21 bp, Homo sapiens
tagcccttctccacctcgccc

SEQ ID NO: 8152960 - DNA, 22 bp, Homo sapiens
tagcccttttctgagcccacat

SEQ ID NO: 8152961 - DNA, 22 bp, Homo sapiens
tagccgcgcttacctcgccgtg

SEQ ID NO: 8152962 - DNA, 22 bp, Homo sapiens
tagcccctgcctttgaacctgg

SEQ ID NO: 8152963 - DNA, 22 bp, Homo sapiens
tagcccctgcctttgaacctgg

SEQ ID NO: 8152964 - DNA, 22 bp, Homo sapiens
tagccctcatctgctcaaaagg

SEQ ID NO: 8152965 - DNA, 22 bp, Homo sapiens
tagcccatgcagctctgtcatt

SEQ ID NO: 8152966 - DNA, 22 bp, Homo sapiens
tagcagctcctaaacagtggtg

SEQ ID NO: 8152967 - DNA, 22 bp, Homo sapiens
tagcagctcactaactctgcgt

SEQ ID NO: 8152968 - DNA, 22 bp, Homo sapiens
tagcagctcactaactctgcgt

SEQ ID NO: 8152969 - DNA, 22 bp, Homo sapiens
tagcagctccatttctctggca

SEQ ID NO: 8152970 - DNA, 22 bp, Homo sapiens
tagcagctccatttctctggca

SEQ ID NO: 8152971 - DNA, 22 bp, Homo sapiens
tagcagctcacagcctcccatt

SEQ ID NO: 8152972 - DNA, 22 bp, Homo sapiens
tagcagctatgccattttgaca

SEQ ID NO: 8152973 - DNA, 22 bp, Homo sapiens
tagcagaaccagtcagtgagcc

SEQ ID NO: 8152974 - DNA, 22 bp, Homo sapiens
tagcagaagaaattcagagttg

SEQ ID NO: 8152975 - DNA, 22 bp, Homo sapiens
tagaggtgttgttgatatagaa

SEQ ID NO: 8152976 - DNA, 22 bp, Homo sapiens
tagaggtgttcattctctccat

SEQ ID NO: 8152977 - DNA, 22 bp, Homo sapiens
tagcagaagttgcaaactaggg

SEQ ID NO: 8152978 - DNA, 22 bp, Homo sapiens
tagcagaagttgcaaactaggg

SEQ ID NO: 8152979 - DNA, 22 bp, Homo sapiens
tagcagagaggggacagtggca

SEQ ID NO: 8152980 - DNA, 22 bp, Homo sapiens
tagaggtactcccctcaaagtt

SEQ ID NO: 8152981 - DNA, 22 bp, Homo sapiens
tagaggtagcaacaggactaga

SEQ ID NO: 8152982 - DNA, 22 bp, Homo sapiens
tagaggtagatggtcagccaat

SEQ ID NO: 8152983 - DNA, 22 bp, Homo sapiens
tagaggtagagttacattagtc

SEQ ID NO: 8152984 - DNA, 18 bp, Homo sapiens
tagagggggcctgggcat

SEQ ID NO: 8152985 - DNA, 22 bp, Homo sapiens
tagaggtgacactgagaccata

SEQ ID NO: 8152986 - DNA, 22 bp, Homo sapiens
tagaggtatttttgatggtcat

SEQ ID NO: 8152987 - DNA, 22 bp, Homo sapiens
tagaggtataccaaaaaggcat

SEQ ID NO: 8152988 - DNA, 22 bp, Homo sapiens
tagaggtgagatattttatttt

SEQ ID NO: 8152989 - DNA, 22 bp, Homo sapiens
tagaggtgagaggaactttgga

SEQ ID NO: 8152990 - DNA, 22 bp, Homo sapiens
tagcagagcagggatcagagcc

SEQ ID NO: 8152991 - DNA, 19 bp, Homo sapiens
tagcagagatgactccagc

SEQ ID NO: 8152992 - DNA, 19 bp, Homo sapiens
tagcagagatgactccagc

SEQ ID NO: 8152993 - DNA, 22 bp, Homo sapiens
tagcagaggaaatccagagtaa

SEQ ID NO: 8152994 - DNA, 17 bp, Homo sapiens
tagcagcagtaattgtg

SEQ ID NO: 8152995 - DNA, 22 bp, Homo sapiens
tagcagcccagtttctggccaa

SEQ ID NO: 8152996 - DNA, 22 bp, Homo sapiens
tagcagcccagtttctggccaa

SEQ ID NO: 8152997 - DNA, 22 bp, Homo sapiens
tagcagctacctggctaagagt

SEQ ID NO: 8152998 - DNA, 22 bp, Homo sapiens
tagcagcatttttgtagagtat

SEQ ID NO: 8152999 - DNA, 23 bp, Homo sapiens
tagcagcatttttagcctctgtc

SEQ ID NO: 8153000 - DNA, 23 bp, Homo sapiens
tagcagcatttttagcctctgtc

SEQ ID NO: 8153001 - DNA, 22 bp, Homo sapiens
tagcagcatgtaagtgagtaga

SEQ ID NO: 8153002 - DNA, 22 bp, Homo sapiens
taggattccagaacagtgctgc

SEQ ID NO: 8153003 - DNA, 22 bp, Homo sapiens
taggattcctattagctttctc

SEQ ID NO: 8153004 - DNA, 22 bp, Homo sapiens
taggatggtacaaggcaggggt

SEQ ID NO: 8153005 - DNA, 22 bp, Homo sapiens
taggatggtcacagagatggac

SEQ ID NO: 8153006 - DNA, 22 bp, Homo sapiens
taggatgtagctatgtcatcat

SEQ ID NO: 8153007 - DNA, 22 bp, Homo sapiens
taggatttaggctttaacatct

SEQ ID NO: 8153008 - DNA, 22 bp, Homo sapiens
taggatggtcacagagatggac

SEQ ID NO: 8153009 - DNA, 22 bp, Homo sapiens
taggatatggtagaaatcattc

SEQ ID NO: 8153010 - DNA, 22 bp, Homo sapiens
taggatatgcatttttatacat

SEQ ID NO: 8153011 - DNA, 22 bp, Homo sapiens
taggatatgtgaaatcatatta

SEQ ID NO: 8153012 - DNA, 22 bp, Homo sapiens
taggatatgagtaagcctttgt

SEQ ID NO: 8153013 - DNA, 22 bp, Homo sapiens
taggatatgagtaagcctttgt

SEQ ID NO: 8153014 - DNA, 22 bp, Homo sapiens
taggatatgcatttttatacat

SEQ ID NO: 8153015 - DNA, 22 bp, Homo sapiens
taggagggggaacaaggcatac

SEQ ID NO: 8153016 - DNA, 22 bp, Homo sapiens
taggagggggaacaaggcatac

SEQ ID NO: 8153017 - DNA, 22 bp, Homo sapiens
taggagggttagagggaaatat

SEQ ID NO: 8153018 - DNA, 22 bp, Homo sapiens
taggagggccctgaaaatggca

SEQ ID NO: 8153019 - DNA, 22 bp, Homo sapiens
taggacagtagctggtgcacag

SEQ ID NO: 8153020 - DNA, 22 bp, Homo sapiens
taggacaggtgaggggctgtgg

SEQ ID NO: 8153021 - DNA, 22 bp, Homo sapiens
taggaaactaatacagtctgga

SEQ ID NO: 8153022 - DNA, 22 bp, Homo sapiens
taggaaactcaaagggaagtgg

SEQ ID NO: 8153023 - DNA, 22 bp, Homo sapiens
taggaaaatatctcttattggg

SEQ ID NO: 8153024 - DNA, 22 bp, Homo sapiens
taggaaacaaagtaatgcaact

SEQ ID NO: 8153025 - DNA, 22 bp, Homo sapiens
taggaaacaaagtggatgaaat

SEQ ID NO: 8153026 - DNA, 22 bp, Homo sapiens
tagctttctcaattttctgcca

SEQ ID NO: 8153027 - DNA, 22 bp, Homo sapiens
tagctttacaaagtgctgcacc

SEQ ID NO: 8153028 - DNA, 22 bp, Homo sapiens
tagctttacaaagtgctgcacc

SEQ ID NO: 8153029 - DNA, 22 bp, Homo sapiens
tagctttaggatggttctcttg

SEQ ID NO: 8153030 - DNA, 22 bp, Homo sapiens
tagctttagaaatattctcaga

SEQ ID NO: 8153031 - DNA, 22 bp, Homo sapiens
tagctttaggatggttctcttg

SEQ ID NO: 8153032 - DNA, 22 bp, Homo sapiens
tagctttaggcacgtttgaatt

SEQ ID NO: 8153033 - DNA, 22 bp, Homo sapiens
tagctttagtgaaaaatatcag

SEQ ID NO: 8153034 - DNA, 22 bp, Homo sapiens
taggaaaaagaggctggcaagg

SEQ ID NO: 8153035 - DNA, 22 bp, Homo sapiens
taggaaaaatacagaattatat

SEQ ID NO: 8153036 - DNA, 22 bp, Homo sapiens
tagcttttatccactgcttttg

SEQ ID NO: 8153037 - DNA, 22 bp, Homo sapiens
taggaaaacgtgattttctcac

SEQ ID NO: 8153038 - DNA, 22 bp, Homo sapiens
taggaaaagcacaggatgttct

SEQ ID NO: 8153039 - DNA, 22 bp, Homo sapiens
taggaaaagcacaggatgttct

SEQ ID NO: 8153040 - DNA, 22 bp, Homo sapiens
taggaaaacgtgattttctcac

SEQ ID NO: 8153041 - DNA, 22 bp, Homo sapiens
taggaaaaatacagaattatat

SEQ ID NO: 8153042 - DNA, 22 bp, Homo sapiens
taggaaaagtctagattgatga

SEQ ID NO: 8153043 - DNA, 22 bp, Homo sapiens
taggaaaagtctagattgatga

SEQ ID NO: 8153044 - DNA, 22 bp, Homo sapiens
taggaaaagtctagattgatga

SEQ ID NO: 8153045 - DNA, 22 bp, Homo sapiens
taggcacaaaatgaaaatggca

SEQ ID NO: 8153046 - DNA, 22 bp, Homo sapiens
taggcacaagaccatgcaaagg

SEQ ID NO: 8153047 - DNA, 22 bp, Homo sapiens
taggcactgaggggagcaaggt

SEQ ID NO: 8153048 - DNA, 22 bp, Homo sapiens
taggcaagttgcccaatctctc

SEQ ID NO: 8153049 - DNA, 22 bp, Homo sapiens
taggcaagtctctttgtttata

SEQ ID NO: 8153050 - DNA, 22 bp, Homo sapiens
taggcaagtggaccagaggttt

SEQ ID NO: 8153051 - DNA, 22 bp, Homo sapiens
taggcaagtagaaaagtttgaa

SEQ ID NO: 8153052 - DNA, 22 bp, Homo sapiens
taggcaaggcatttggctcttg

SEQ ID NO: 8153053 - DNA, 22 bp, Homo sapiens
taggatttggctttagtcaggt

SEQ ID NO: 8153054 - DNA, 22 bp, Homo sapiens
taggcaagaccttccctcttta

SEQ ID NO: 8153055 - DNA, 22 bp, Homo sapiens
taggattttaacccacctctga

SEQ ID NO: 8153056 - DNA, 22 bp, Homo sapiens
taggattttttggattctggat

SEQ ID NO: 8153057 - DNA, 22 bp, Homo sapiens
taggctgggcattctggccagg

SEQ ID NO: 8153058 - DNA, 22 bp, Homo sapiens
taggctgggcattctggccagg

SEQ ID NO: 8153059 - DNA, 22 bp, Homo sapiens
taggctgggagcctgaggctag

SEQ ID NO: 8153060 - DNA, 22 bp, Homo sapiens
taggctgggcattctggccagg

SEQ ID NO: 8153061 - DNA, 22 bp, Homo sapiens
taggctgggagcctgaggctag

SEQ ID NO: 8153062 - DNA, 22 bp, Homo sapiens
taggcactggttgtggatagtt

SEQ ID NO: 8153063 - DNA, 22 bp, Homo sapiens
taggcactggggaggcagcatg

SEQ ID NO: 8153064 - DNA, 22 bp, Homo sapiens
taggcacttggcgtgttggaga

SEQ ID NO: 8153065 - DNA, 22 bp, Homo sapiens
taggcagaaaggaaggcaagtt

SEQ ID NO: 8153066 - DNA, 22 bp, Homo sapiens
tagggagaggaagcaggccgct

SEQ ID NO: 8153067 - DNA, 22 bp, Homo sapiens
tagggactgtgtgagggacttg

SEQ ID NO: 8153068 - DNA, 20 bp, Homo sapiens
tagggagatatgctcttttc

SEQ ID NO: 8153069 - DNA, 20 bp, Homo sapiens
tagggagatatgctcttttc

SEQ ID NO: 8153070 - DNA, 22 bp, Homo sapiens
tagggagatgcaagggacggag

SEQ ID NO: 8153071 - DNA, 22 bp, Homo sapiens
tagggagatgcaagggacggag

SEQ ID NO: 8153072 - DNA, 22 bp, Homo sapiens
tagggactagtttcaaggctaa

SEQ ID NO: 8153073 - DNA, 22 bp, Homo sapiens
taggctgggcctgccttccagg

SEQ ID NO: 8153074 - DNA, 22 bp, Homo sapiens
tagggaggctacttcttgtagg

SEQ ID NO: 8153075 - DNA, 22 bp, Homo sapiens
tagggaggctacttcttgtagg

SEQ ID NO: 8153076 - DNA, 22 bp, Homo sapiens
tagggagctctggcagaaggaa

SEQ ID NO: 8153077 - DNA, 22 bp, Homo sapiens
tagggaggagggttttcaaatc

SEQ ID NO: 8153078 - DNA, 22 bp, Homo sapiens
tagggagatgcaagggacggag

SEQ ID NO: 8153079 - DNA, 22 bp, Homo sapiens
tagggagcagccctgccactcc

SEQ ID NO: 8153080 - DNA, 22 bp, Homo sapiens
tagggatgagccagtgggtagt

SEQ ID NO: 8153081 - DNA, 22 bp, Homo sapiens
tagggatgatggagcctatgta

SEQ ID NO: 8153082 - DNA, 22 bp, Homo sapiens
tagggatgagccagtgggtagt

SEQ ID NO: 8153083 - DNA, 22 bp, Homo sapiens
tagggatgacgaaaggacagag

SEQ ID NO: 8153084 - DNA, 22 bp, Homo sapiens
tagggatgagcaactggtagtg

SEQ ID NO: 8153085 - DNA, 22 bp, Homo sapiens
tagggatgacgaaaggacagag

SEQ ID NO: 8153086 - DNA, 22 bp, Homo sapiens
tagggatggatgatgcctggca

SEQ ID NO: 8153087 - DNA, 22 bp, Homo sapiens
tagggatggcagcatgtagctt

SEQ ID NO: 8153088 - DNA, 22 bp, Homo sapiens
tagggatggaaactaggaatct

SEQ ID NO: 8153089 - DNA, 22 bp, Homo sapiens
tagggatgtcctgagacttggc

SEQ ID NO: 8153090 - DNA, 22 bp, Homo sapiens
tagggcaatatttcccagaaaa

SEQ ID NO: 8153091 - DNA, 22 bp, Homo sapiens
tagggatgtggtgagaactgag

SEQ ID NO: 8153092 - DNA, 22 bp, Homo sapiens
tagggcagagcttgtacacgat

SEQ ID NO: 8153093 - DNA, 22 bp, Homo sapiens
tagggcagagtccaggatgggc

SEQ ID NO: 8153094 - DNA, 22 bp, Homo sapiens
tagggcagagtccaggatgggc

SEQ ID NO: 8153095 - DNA, 22 bp, Homo sapiens
tagggcagagcttgtacacgat

SEQ ID NO: 8153096 - DNA, 22 bp, Homo sapiens
gcggggttccgtgccccagagt

SEQ ID NO: 8153097 - DNA, 22 bp, Homo sapiens
gcgggggtggccagcaagacct

SEQ ID NO: 8153098 - DNA, 22 bp, Homo sapiens
gcgggttgaagggcgcatcgaa

SEQ ID NO: 8153099 - DNA, 22 bp, Homo sapiens
gcgggttgaagggcgcatcgaa

SEQ ID NO: 8153100 - DNA, 22 bp, Homo sapiens
gcctttggagatgtcataggat

SEQ ID NO: 8153101 - DNA, 22 bp, Homo sapiens
gcctttggatatattcagggat

SEQ ID NO: 8153102 - DNA, 22 bp, Homo sapiens
gcctttatgtctgaaaatcagc

SEQ ID NO: 8153103 - DNA, 22 bp, Homo sapiens
gcctttcatctcagctggccgg

SEQ ID NO: 8153104 - DNA, 22 bp, Homo sapiens
gcctttcagtgccttctgttca

SEQ ID NO: 8153105 - DNA, 22 bp, Homo sapiens
gcctttcactggtgccggctgt

SEQ ID NO: 8153106 - DNA, 22 bp, Homo sapiens
gcctttatttacgaaagggaaa

SEQ ID NO: 8153107 - DNA, 22 bp, Homo sapiens
gcctttatttacgaaagggaaa

SEQ ID NO: 8153108 - DNA, 22 bp, Homo sapiens
gcctttatccctgtacaaggtg

SEQ ID NO: 8153109 - DNA, 22 bp, Homo sapiens
gcctttatccctgtacaaggtg

SEQ ID NO: 8153110 - DNA, 22 bp, Homo sapiens
gcctttaaagctggcaggcttt

SEQ ID NO: 8153111 - DNA, 22 bp, Homo sapiens
gccttgtttctctcccagataa

SEQ ID NO: 8153112 - DNA, 22 bp, Homo sapiens
gcctttaaagccccgagagccc

SEQ ID NO: 8153113 - DNA, 22 bp, Homo sapiens
gccttgggtttcctatcctgag

SEQ ID NO: 8153114 - DNA, 22 bp, Homo sapiens
gcggtagctcaagcttgtaatc

SEQ ID NO: 8153115 - DNA, 22 bp, Homo sapiens
gcggtaggagagacagaagtta

SEQ ID NO: 8153116 - DNA, 22 bp, Homo sapiens
gcgtctcaaggcccccaggcca

SEQ ID NO: 8153117 - DNA, 22 bp, Homo sapiens
gcgtctcaaggcccccaggcca

SEQ ID NO: 8153118 - DNA, 22 bp, Homo sapiens
gcgtgcaacagcctcttccatt

SEQ ID NO: 8153119 - DNA, 22 bp, Homo sapiens
gcgtgccggccggtggaggcga

SEQ ID NO: 8153120 - DNA, 22 bp, Homo sapiens
gcgtccagggaaggcccagctg

SEQ ID NO: 8153121 - DNA, 22 bp, Homo sapiens
gcgtccccatcatccagccgta

SEQ ID NO: 8153122 - DNA, 22 bp, Homo sapiens
gcgtctcaaggcccccaggcca

SEQ ID NO: 8153123 - DNA, 22 bp, Homo sapiens
gcgtggctcctaacagatctga

SEQ ID NO: 8153124 - DNA, 18 bp, Homo sapiens
gcgtggagcgggctcggt

SEQ ID NO: 8153125 - DNA, 18 bp, Homo sapiens
gcgtggagcgggctcggt

SEQ ID NO: 8153126 - DNA, 22 bp, Homo sapiens
gcgtggagacaactctggggtg

SEQ ID NO: 8153127 - DNA, 22 bp, Homo sapiens
gcgtggagacaactctggggtg

SEQ ID NO: 8153128 - DNA, 22 bp, Homo sapiens
gcgtggcttagagtggggtacc

SEQ ID NO: 8153129 - DNA, 22 bp, Homo sapiens
gcgtggggcagcccagggcttc

SEQ ID NO: 8153130 - DNA, 22 bp, Homo sapiens
gcgtggggcagcccagggcttc

SEQ ID NO: 8153131 - DNA, 22 bp, Homo sapiens
gcgtgggctggactgggatgaa

SEQ ID NO: 8153132 - DNA, 22 bp, Homo sapiens
gctacagagctctgtgaagaga

SEQ ID NO: 8153133 - DNA, 22 bp, Homo sapiens
gctacaggagctgtcacatgct

SEQ ID NO: 8153134 - DNA, 22 bp, Homo sapiens
gctacaggagataaaggcctct

SEQ ID NO: 8153135 - DNA, 23 bp, Homo sapiens
gctacagctgactgtcattccct

SEQ ID NO: 8153136 - DNA, 22 bp, Homo sapiens
gctacaggtgacagcctctgca

SEQ ID NO: 8153137 - DNA, 22 bp, Homo sapiens
gctacaggtatatagatgaaac

SEQ ID NO: 8153138 - DNA, 22 bp, Homo sapiens
gctacaggtgacagcctctgca

SEQ ID NO: 8153139 - DNA, 22 bp, Homo sapiens
gctacaggagctgtcacatgct

SEQ ID NO: 8153140 - DNA, 22 bp, Homo sapiens
gctacaggggtcagtcctttgc

SEQ ID NO: 8153141 - DNA, 22 bp, Homo sapiens
gctacaggtatatagatgaaac

SEQ ID NO: 8153142 - DNA, 22 bp, Homo sapiens
gcctctgggggctcagacctgt

SEQ ID NO: 8153143 - DNA, 22 bp, Homo sapiens
gcctctggggcagctgagtcat

SEQ ID NO: 8153144 - DNA, 22 bp, Homo sapiens
gcctctggggcagctgagtcat

SEQ ID NO: 8153145 - DNA, 22 bp, Homo sapiens
gcctctggggcagctgagtcat

SEQ ID NO: 8153146 - DNA, 22 bp, Homo sapiens
gcctctggggcagctgagtcat

SEQ ID NO: 8153147 - DNA, 22 bp, Homo sapiens
gcctctggggtggagcccagca

SEQ ID NO: 8153148 - DNA, 22 bp, Homo sapiens
gcctctgggggctcagacctgt

SEQ ID NO: 8153149 - DNA, 22 bp, Homo sapiens
gcctctgggtgacgaaaggtga

SEQ ID NO: 8153150 - DNA, 22 bp, Homo sapiens
gcctctggggttaatagagttt

SEQ ID NO: 8153151 - DNA, 22 bp, Homo sapiens
gcctctggggtggagcccagca

SEQ ID NO: 8153152 - DNA, 22 bp, Homo sapiens
gcctctggtccctcatgctgtg

SEQ ID NO: 8153153 - DNA, 22 bp, Homo sapiens
gcctctggtccctcatgctgtg

SEQ ID NO: 8153154 - DNA, 22 bp, Homo sapiens
gcctctggtccctcatgctgtg

SEQ ID NO: 8153155 - DNA, 22 bp, Homo sapiens
gcctctgggttggtgacaggct

SEQ ID NO: 8153156 - DNA, 22 bp, Homo sapiens
gcctctgggtgacgaaaggtga

SEQ ID NO: 8153157 - DNA, 22 bp, Homo sapiens
gcctctgggtgacgaaaggtga

SEQ ID NO: 8153158 - DNA, 22 bp, Homo sapiens
gcctctggtccctcatgctgtg

SEQ ID NO: 8153159 - DNA, 22 bp, Homo sapiens
gcctctgggttggtgacaggct

SEQ ID NO: 8153160 - DNA, 22 bp, Homo sapiens
gcctctgggttggtgacaggct

SEQ ID NO: 8153161 - DNA, 19 bp, Homo sapiens
gcctgagccagccatgcaa

SEQ ID NO: 8153162 - DNA, 22 bp, Homo sapiens
gcctgagccgcctgagcggcgg

SEQ ID NO: 8153163 - DNA, 22 bp, Homo sapiens
gcctgagcccaggtgtgcagag

SEQ ID NO: 8153164 - DNA, 19 bp, Homo sapiens
gcctgagccagccatgcaa

SEQ ID NO: 8153165 - DNA, 21 bp, Homo sapiens
gcctgagcatgtcttcaggtc

SEQ ID NO: 8153166 - DNA, 22 bp, Homo sapiens
gcctgagcaggcgtggaccatg

SEQ ID NO: 8153167 - DNA, 22 bp, Homo sapiens
gcctgagcaggcgtggaccatg

SEQ ID NO: 8153168 - DNA, 22 bp, Homo sapiens
gcctgagattggacattattta

SEQ ID NO: 8153169 - DNA, 22 bp, Homo sapiens
gccttggcccacagtgctcctg

SEQ ID NO: 8153170 - DNA, 22 bp, Homo sapiens
gccttggccttcctaggcctga

SEQ ID NO: 8153171 - DNA, 22 bp, Homo sapiens
gccttggctgatgtgcgaatga

SEQ ID NO: 8153172 - DNA, 22 bp, Homo sapiens
gccttggctgttggagcttgat

SEQ ID NO: 8153173 - DNA, 22 bp, Homo sapiens
gccttggctgccaagctgctga

SEQ ID NO: 8153174 - DNA, 22 bp, Homo sapiens
gccttgggaaagtgggaggaga

SEQ ID NO: 8153175 - DNA, 22 bp, Homo sapiens
gccttgggaaagtgggaggaga

SEQ ID NO: 8153176 - DNA, 22 bp, Homo sapiens
gccttgggacggaggggtcacc

SEQ ID NO: 8153177 - DNA, 22 bp, Homo sapiens
gccttgggcacaggcagggccc

SEQ ID NO: 8153178 - DNA, 22 bp, Homo sapiens
gccttgggattcttggatgctc

SEQ ID NO: 8153179 - DNA, 22 bp, Homo sapiens
gccttgggacggaggggtcacc

SEQ ID NO: 8153180 - DNA, 22 bp, Homo sapiens
gccttgggcacaggcagggccc

SEQ ID NO: 8153181 - DNA, 22 bp, Homo sapiens
gccttgggccagctgctctgga

SEQ ID NO: 8153182 - DNA, 22 bp, Homo sapiens
gccttgggggtgaaagaggcta

SEQ ID NO: 8153183 - DNA, 22 bp, Homo sapiens
gccttgggggtgaaagaggcta

SEQ ID NO: 8153184 - DNA, 22 bp, Homo sapiens
gccttgctgattaccttccttt

SEQ ID NO: 8153185 - DNA, 22 bp, Homo sapiens
gccttgctaatttctcctcaac

SEQ ID NO: 8153186 - DNA, 22 bp, Homo sapiens
gccttggaaagctggagcagtt

SEQ ID NO: 8153187 - DNA, 22 bp, Homo sapiens
gccttgctttgcttctggacag

SEQ ID NO: 8153188 - DNA, 22 bp, Homo sapiens
gccttgcctcagccatggaaac

SEQ ID NO: 8153189 - DNA, 22 bp, Homo sapiens
gccttgccgctcagcagtgggg

SEQ ID NO: 8153190 - DNA, 22 bp, Homo sapiens
gccttgctaatttctcctcaac

SEQ ID NO: 8153191 - DNA, 22 bp, Homo sapiens
gccttggagatcactgctcatg

SEQ ID NO: 8153192 - DNA, 20 bp, Homo sapiens
gcctgagctccgcctcctgt

SEQ ID NO: 8153193 - DNA, 20 bp, Homo sapiens
gcctgagctccgcctcctgt

SEQ ID NO: 8153194 - DNA, 20 bp, Homo sapiens
gcctgagctccgcctcctgt

SEQ ID NO: 8153195 - DNA, 20 bp, Homo sapiens
gcctgagctccgcctcctgt

SEQ ID NO: 8153196 - DNA, 21 bp, Homo sapiens
gccttgccacatgtgccacag

SEQ ID NO: 8153197 - DNA, 20 bp, Homo sapiens
gcctgagctattgccaggat

SEQ ID NO: 8153198 - DNA, 22 bp, Homo sapiens
gcctgagctactagggagtctg

SEQ ID NO: 8153199 - DNA, 22 bp, Homo sapiens
gcctgagctactagggagtctg

SEQ ID NO: 8153200 - DNA, 22 bp, Homo sapiens
gctaccctgggaatctccctca

SEQ ID NO: 8153201 - DNA, 22 bp, Homo sapiens
gctactgttcggcatgctgaag

SEQ ID NO: 8153202 - DNA, 22 bp, Homo sapiens
gctcagagcttgaagttccact

SEQ ID NO: 8153203 - DNA, 22 bp, Homo sapiens
gctactgattgaccttggagag

SEQ ID NO: 8153204 - DNA, 22 bp, Homo sapiens
gctactgattgaccttggagag

SEQ ID NO: 8153205 - DNA, 22 bp, Homo sapiens
gctcagaggccactgttggaaa

SEQ ID NO: 8153206 - DNA, 22 bp, Homo sapiens
gctcagaggccaagtgcccgcc

SEQ ID NO: 8153207 - DNA, 22 bp, Homo sapiens
gctcagagggaacaaggggctg

SEQ ID NO: 8153208 - DNA, 22 bp, Homo sapiens
gctcagaggcacgacctcttgg

SEQ ID NO: 8153209 - DNA, 22 bp, Homo sapiens
gctcagaggaggcctttaccta

SEQ ID NO: 8153210 - DNA, 22 bp, Homo sapiens
gctcagaggatgctcctttatg

SEQ ID NO: 8153211 - DNA, 22 bp, Homo sapiens
gctcagaggagcatcataagga

SEQ ID NO: 8153212 - DNA, 19 bp, Homo sapiens
gctcagagtccccctgcgg

SEQ ID NO: 8153213 - DNA, 22 bp, Homo sapiens
gctcagagtggcctggctaggg

SEQ ID NO: 8153214 - DNA, 21 bp, Homo sapiens
gctcagagtattgcactgttt

SEQ ID NO: 8153215 - DNA, 23 bp, Homo sapiens
gctcagaggtttttctctggatg

SEQ ID NO: 8153216 - DNA, 17 bp, Homo sapiens
gctcagagtacacgtgt

SEQ ID NO: 8153217 - DNA, 19 bp, Homo sapiens
gctcagagggccctgtgct

SEQ ID NO: 8153218 - DNA, 19 bp, Homo sapiens
gctcagagggccctgtgct

SEQ ID NO: 8153219 - DNA, 23 bp, Homo sapiens
gctcagaggtgaaatgttttggg

SEQ ID NO: 8153220 - DNA, 22 bp, Homo sapiens
gctcagagggttttggccaagt

SEQ ID NO: 8153221 - DNA, 22 bp, Homo sapiens
gctcagaggttgttcttgggtt

SEQ ID NO: 8153222 - DNA, 22 bp, Homo sapiens
gctcagaggttgttcttgggtt

SEQ ID NO: 8153223 - DNA, 23 bp, Homo sapiens
gctcagaggtttttctctggatg

SEQ ID NO: 8153224 - DNA, 22 bp, Homo sapiens
gctcagctacttacaggtggct

SEQ ID NO: 8153225 - DNA, 22 bp, Homo sapiens
gctcagctacttacaggtggct

SEQ ID NO: 8153226 - DNA, 22 bp, Homo sapiens
gctcagccgaacttcagagcag

SEQ ID NO: 8153227 - DNA, 23 bp, Homo sapiens
gctcagcctcagcaggcccagga

SEQ ID NO: 8153228 - DNA, 18 bp, Homo sapiens
gctcagctatgggaggtt

SEQ ID NO: 8153229 - DNA, 18 bp, Homo sapiens
gctcagctatgggaggtt

SEQ ID NO: 8153230 - DNA, 22 bp, Homo sapiens
gctcagctatcagtgttcctga

SEQ ID NO: 8153231 - DNA, 22 bp, Homo sapiens
gctcagctctatggacacaaag

SEQ ID NO: 8153232 - DNA, 18 bp, Homo sapiens
gctcagctatgggaggtt

SEQ ID NO: 8153233 - DNA, 21 bp, Homo sapiens
gctcagcaaaggtgaggtgca

SEQ ID NO: 8153234 - DNA, 21 bp, Homo sapiens
gctcagcaaaggtgaggtgca

SEQ ID NO: 8153235 - DNA, 19 bp, Homo sapiens
gctcagcagacccagtgct

SEQ ID NO: 8153236 - DNA, 22 bp, Homo sapiens
gctcagcactttctccaaccac

SEQ ID NO: 8153237 - DNA, 22 bp, Homo sapiens
gctcagccgaacttcagagcag

SEQ ID NO: 8153238 - DNA, 22 bp, Homo sapiens
gctcagccgaacttcagagcag

SEQ ID NO: 8153239 - DNA, 22 bp, Homo sapiens
gctcagccgaacttcagagcag

SEQ ID NO: 8153240 - DNA, 19 bp, Homo sapiens
gctcagcagacccagtgct

SEQ ID NO: 8153241 - DNA, 19 bp, Homo sapiens
gctcagcagacccagtgct

SEQ ID NO: 8153242 - DNA, 22 bp, Homo sapiens
gctcagagttaattggatgggt

SEQ ID NO: 8153243 - DNA, 22 bp, Homo sapiens
gctcagagttaaatatagtgct

SEQ ID NO: 8153244 - DNA, 22 bp, Homo sapiens
gctcagagttaaatatagtgct

SEQ ID NO: 8153245 - DNA, 22 bp, Homo sapiens
gctccagggtcagctcagaact

SEQ ID NO: 8153246 - DNA, 22 bp, Homo sapiens
gctccagggtcagctcagaact

SEQ ID NO: 8153247 - DNA, 22 bp, Homo sapiens
gctccagggtcagctcagaact

SEQ ID NO: 8153248 - DNA, 22 bp, Homo sapiens
gctccagggtggatgacaattc

SEQ ID NO: 8153249 - DNA, 22 bp, Homo sapiens
gctccagggacccaagagaaaa

SEQ ID NO: 8153250 - DNA, 22 bp, Homo sapiens
gctccagggtcagctcagaact

SEQ ID NO: 8153251 - DNA, 22 bp, Homo sapiens
gctccagggagtacatttatca

SEQ ID NO: 8153252 - DNA, 22 bp, Homo sapiens
gctccaggataataaagttgtt

SEQ ID NO: 8153253 - DNA, 22 bp, Homo sapiens
gctccaggataataaagttgtt

SEQ ID NO: 8153254 - DNA, 22 bp, Homo sapiens
gctccaggcagagcctctttcg

SEQ ID NO: 8153255 - DNA, 22 bp, Homo sapiens
gctccaggaggctcccgcgtct

SEQ ID NO: 8153256 - DNA, 22 bp, Homo sapiens
gctccaggaggctcccgcgtct

SEQ ID NO: 8153257 - DNA, 22 bp, Homo sapiens
gctccaggaggctcccgcgtct

SEQ ID NO: 8153258 - DNA, 22 bp, Homo sapiens
gctcagctgcacctggagagcc

SEQ ID NO: 8153259 - DNA, 22 bp, Homo sapiens
gctcagctgagcgaaggacatg

SEQ ID NO: 8153260 - DNA, 22 bp, Homo sapiens
gctcagctgagcgaaggacatg

SEQ ID NO: 8153261 - DNA, 22 bp, Homo sapiens
gctccctgcctacacggacctt

SEQ ID NO: 8153262 - DNA, 22 bp, Homo sapiens
gctccctgcctacacggacctt

SEQ ID NO: 8153263 - DNA, 21 bp, Homo sapiens
gctccctgctcagctcctggg

SEQ ID NO: 8153264 - DNA, 21 bp, Homo sapiens
gctccctgctcagctcctggg

SEQ ID NO: 8153265 - DNA, 21 bp, Homo sapiens
gctccctgctcagctcctggg

SEQ ID NO: 8153266 - DNA, 22 bp, Homo sapiens
gctccctgcagctgagagttcc

SEQ ID NO: 8153267 - DNA, 22 bp, Homo sapiens
gctccctgcactctgcagccct

SEQ ID NO: 8153268 - DNA, 22 bp, Homo sapiens
gctccctgcactctgcagccct

SEQ ID NO: 8153269 - DNA, 17 bp, Homo sapiens
gctccctgaggacagct

SEQ ID NO: 8153270 - DNA, 17 bp, Homo sapiens
gctccctgaggacagct

SEQ ID NO: 8153271 - DNA, 22 bp, Homo sapiens
gctccctgactcagttcctgag

SEQ ID NO: 8153272 - DNA, 22 bp, Homo sapiens
gctccctgactcagttcctgag

SEQ ID NO: 8153273 - DNA, 23 bp, Homo sapiens
gctccctgtccctgcacttaggc

SEQ ID NO: 8153274 - DNA, 22 bp, Homo sapiens
gctccctgtctctggggtccat

SEQ ID NO: 8153275 - DNA, 23 bp, Homo sapiens
gctccctgtgctccaggagatgc

SEQ ID NO: 8153276 - DNA, 22 bp, Homo sapiens
gctccctggtagccatgctctc

SEQ ID NO: 8153277 - DNA, 22 bp, Homo sapiens
gctccctggtattgctgccact

SEQ ID NO: 8153278 - DNA, 22 bp, Homo sapiens
gctccctggaatgttggctgcc

SEQ ID NO: 8153279 - DNA, 21 bp, Homo sapiens
gctccctggctgtgtgacctg

SEQ ID NO: 8153280 - DNA, 22 bp, Homo sapiens
gctccctggaggatgtgaactt

SEQ ID NO: 8153281 - DNA, 20 bp, Homo sapiens
gctccctggtagaaatgttt

SEQ ID NO: 8153282 - DNA, 22 bp, Homo sapiens
gctccctggtagccatgctctc

SEQ ID NO: 8153283 - DNA, 22 bp, Homo sapiens
gctccctggtagccatgctctc

SEQ ID NO: 8153284 - DNA, 20 bp, Homo sapiens
gctccaggtcagagaggacg

SEQ ID NO: 8153285 - DNA, 22 bp, Homo sapiens
gctccaggtgaatcctctcacc

SEQ ID NO: 8153286 - DNA, 22 bp, Homo sapiens
gctccaggtgaatcctctcacc

SEQ ID NO: 8153287 - DNA, 20 bp, Homo sapiens
gctccaggtcagagaggacg

SEQ ID NO: 8153288 - DNA, 20 bp, Homo sapiens
gctccaggtcagagaggacg

SEQ ID NO: 8153289 - DNA, 22 bp, Homo sapiens
gctccaggtatttgccctttta

SEQ ID NO: 8153290 - DNA, 22 bp, Homo sapiens
gctccaggtgtcccaggtaaaa

SEQ ID NO: 8153291 - DNA, 22 bp, Homo sapiens
gctccaggtggcttatttgtat

SEQ ID NO: 8153292 - DNA, 22 bp, Homo sapiens
gctcccacaaccttcttgctcc

SEQ ID NO: 8153293 - DNA, 22 bp, Homo sapiens
gctcccaactcaggcctcctcc

SEQ ID NO: 8153294 - DNA, 22 bp, Homo sapiens
gctccaggtgtcccaggtaaaa

SEQ ID NO: 8153295 - DNA, 22 bp, Homo sapiens
gctcccagaaccaaggctgggg

SEQ ID NO: 8153296 - DNA, 22 bp, Homo sapiens
gctcccagactgaccagaggtg

SEQ ID NO: 8153297 - DNA, 22 bp, Homo sapiens
gctccctgaaaagaacaaagtc

SEQ ID NO: 8153298 - DNA, 22 bp, Homo sapiens
gctcccagaaccaaggctgggg

SEQ ID NO: 8153299 - DNA, 22 bp, Homo sapiens
gctcccagaaccaaggctgggg

SEQ ID NO: 8153300 - DNA, 22 bp, Homo sapiens
gctcccactgcagccctgagcc

SEQ ID NO: 8153301 - DNA, 22 bp, Homo sapiens
gctcccactgcagccctgagcc

SEQ ID NO: 8153302 - DNA, 22 bp, Homo sapiens
gctcccacctccagcctgagtt

SEQ ID NO: 8153303 - DNA, 22 bp, Homo sapiens
gctcccacctccagcctgagtt

SEQ ID NO: 8153304 - DNA, 22 bp, Homo sapiens
gctcccaccttaaccttcacat

SEQ ID NO: 8153305 - DNA, 22 bp, Homo sapiens
gctcccaccgccgctatgggta

SEQ ID NO: 8153306 - DNA, 22 bp, Homo sapiens
gctcccaccaggcagacctacc

SEQ ID NO: 8153307 - DNA, 22 bp, Homo sapiens
gctgagactggcagcaggaagt

SEQ ID NO: 8153308 - DNA, 22 bp, Homo sapiens
gctgagactggcagcaggaagt

SEQ ID NO: 8153309 - DNA, 22 bp, Homo sapiens
gctgagacttccactgccatct

SEQ ID NO: 8153310 - DNA, 22 bp, Homo sapiens
gctgagagaaaagtgaggttct

SEQ ID NO: 8153311 - DNA, 22 bp, Homo sapiens
gctgagagaaaagtgaggttct

SEQ ID NO: 8153312 - DNA, 22 bp, Homo sapiens
gctgagagatcaaggcaggatt

SEQ ID NO: 8153313 - DNA, 22 bp, Homo sapiens
gctgagagatcaaggcaggatt

SEQ ID NO: 8153314 - DNA, 22 bp, Homo sapiens
gctgagagaaaagtgaggttct

SEQ ID NO: 8153315 - DNA, 22 bp, Homo sapiens
gctgagagaaaagtgaggttct

SEQ ID NO: 8153316 - DNA, 22 bp, Homo sapiens
gctgagagatcaaggcaggatt

SEQ ID NO: 8153317 - DNA, 22 bp, Homo sapiens
gctgagagatcaaggcaggatt

SEQ ID NO: 8153318 - DNA, 22 bp, Homo sapiens
gctgagagatcaaggcaggatt

SEQ ID NO: 8153319 - DNA, 22 bp, Homo sapiens
gctgagaatgttcctactggta

SEQ ID NO: 8153320 - DNA, 22 bp, Homo sapiens
gctgacagagtgcctggcctca

SEQ ID NO: 8153321 - DNA, 22 bp, Homo sapiens
gctgagaggcagccagaccctc

SEQ ID NO: 8153322 - DNA, 22 bp, Homo sapiens
gctgagagtccaggaaaacatc

SEQ ID NO: 8153323 - DNA, 22 bp, Homo sapiens
gctgagagtgagcactggatat

SEQ ID NO: 8153324 - DNA, 17 bp, Homo sapiens
gctgagaggcagcacag

SEQ ID NO: 8153325 - DNA, 17 bp, Homo sapiens
gctgagaggcagcacag

SEQ ID NO: 8153326 - DNA, 22 bp, Homo sapiens
gctgagaggcagccagaccctc

SEQ ID NO: 8153327 - DNA, 17 bp, Homo sapiens
gctgagaggcagcacag

SEQ ID NO: 8153328 - DNA, 22 bp, Homo sapiens
gctgagagcaaagcatgtctag

SEQ ID NO: 8153329 - DNA, 22 bp, Homo sapiens
gctgagagatcaaggcaggatt

SEQ ID NO: 8153330 - DNA, 22 bp, Homo sapiens
gctgagagcaaagcatgtctag

SEQ ID NO: 8153331 - DNA, 22 bp, Homo sapiens
gctgagagcaaggacaaagcat

SEQ ID NO: 8153332 - DNA, 22 bp, Homo sapiens
gctgagagcaaggacaaagcat

SEQ ID NO: 8153333 - DNA, 22 bp, Homo sapiens
gctgagagcacatagaaggggc

SEQ ID NO: 8153334 - DNA, 22 bp, Homo sapiens
gctgagagcggccagctgggaa

SEQ ID NO: 8153335 - DNA, 22 bp, Homo sapiens
gctgagagcggccagctgggaa

SEQ ID NO: 8153336 - DNA, 22 bp, Homo sapiens
gctgagagcggccagctgggaa

SEQ ID NO: 8153337 - DNA, 22 bp, Homo sapiens
gctgagagcggccagctgggaa

SEQ ID NO: 8153338 - DNA, 22 bp, Homo sapiens
gctgagagtgggtgcagtgctt

SEQ ID NO: 8153339 - DNA, 22 bp, Homo sapiens
gctgaggccaggccccaccgga

SEQ ID NO: 8153340 - DNA, 22 bp, Homo sapiens
gctgaggccaggccccaccgga

SEQ ID NO: 8153341 - DNA, 22 bp, Homo sapiens
gctgaggccagtttaatgagga

SEQ ID NO: 8153342 - DNA, 22 bp, Homo sapiens
gctgaggccagtttaatgagga

SEQ ID NO: 8153343 - DNA, 22 bp, Homo sapiens
gctgaggccaggccccaccgga

SEQ ID NO: 8153344 - DNA, 22 bp, Homo sapiens
gctgaggccccagggtgatggg

SEQ ID NO: 8153345 - DNA, 22 bp, Homo sapiens
gctgaggccccagggtgatggg

SEQ ID NO: 8153346 - DNA, 22 bp, Homo sapiens
gctgaggccccagggtgatggg

SEQ ID NO: 8153347 - DNA, 22 bp, Homo sapiens
gctgaggccccagggtgatggg

SEQ ID NO: 8153348 - DNA, 22 bp, Homo sapiens
gctgaggcctcagaaggctgag

SEQ ID NO: 8153349 - DNA, 22 bp, Homo sapiens
gctgaggcctcagaaggctgag

SEQ ID NO: 8153350 - DNA, 22 bp, Homo sapiens
gctgaggcctcagaaggctgag

SEQ ID NO: 8153351 - DNA, 22 bp, Homo sapiens
gctgaggcctcagaaggctgag

SEQ ID NO: 8153352 - DNA, 22 bp, Homo sapiens
gctgaggcggaaggattgctag

SEQ ID NO: 8153353 - DNA, 22 bp, Homo sapiens
gctgaggcggaaggattgctag

SEQ ID NO: 8153354 - DNA, 22 bp, Homo sapiens
gctgaggcggaaggattgctag

SEQ ID NO: 8153355 - DNA, 22 bp, Homo sapiens
gctgaggcggaaggattgctag

SEQ ID NO: 8153356 - DNA, 22 bp, Homo sapiens
gctgaggctcaagtcatgggtc

SEQ ID NO: 8153357 - DNA, 22 bp, Homo sapiens
gctgaggctcaagtcatgggtc

SEQ ID NO: 8153358 - DNA, 22 bp, Homo sapiens
gctgagggatagctgctcactg

SEQ ID NO: 8153359 - DNA, 22 bp, Homo sapiens
gctgagggatagctgctcactg

SEQ ID NO: 8153360 - DNA, 22 bp, Homo sapiens
gctgagggaggctgaactgagt

SEQ ID NO: 8153361 - DNA, 22 bp, Homo sapiens
gctgagggaggctgaactgagt

SEQ ID NO: 8153362 - DNA, 22 bp, Homo sapiens
gctgagggaggctgaactgagt

SEQ ID NO: 8153363 - DNA, 22 bp, Homo sapiens
gctgagggaccatgtttcagga

SEQ ID NO: 8153364 - DNA, 22 bp, Homo sapiens
gctgaggctgggagcagcctgt

SEQ ID NO: 8153365 - DNA, 22 bp, Homo sapiens
gctgaggctgggagcagcctgt

SEQ ID NO: 8153366 - DNA, 22 bp, Homo sapiens
gctgaggcttagctaaaaattt

SEQ ID NO: 8153367 - DNA, 22 bp, Homo sapiens
gctgaggcttagctaaaaattt

SEQ ID NO: 8153368 - DNA, 22 bp, Homo sapiens
gctgaggctgggagcagcctgt

SEQ ID NO: 8153369 - DNA, 22 bp, Homo sapiens
gctgaggctgggagcagcctgt

SEQ ID NO: 8153370 - DNA, 22 bp, Homo sapiens
gctgaggctgggagcagcctgt

SEQ ID NO: 8153371 - DNA, 22 bp, Homo sapiens
gctgaggctcctcgggaggaca

SEQ ID NO: 8153372 - DNA, 22 bp, Homo sapiens
gctgaggctcaagtcatgggtc

SEQ ID NO: 8153373 - DNA, 22 bp, Homo sapiens
gctgaggctcaatccccttctg

SEQ ID NO: 8153374 - DNA, 22 bp, Homo sapiens
gctgaggctcaatccccttctg

SEQ ID NO: 8153375 - DNA, 22 bp, Homo sapiens
gctgaggctcctcgggaggaca

SEQ ID NO: 8153376 - DNA, 22 bp, Homo sapiens
gctctggggatgcttctgccgt

SEQ ID NO: 8153377 - DNA, 22 bp, Homo sapiens
gctctggggatgcttctgccgt

SEQ ID NO: 8153378 - DNA, 22 bp, Homo sapiens
gctctgggctgccctctggaca

SEQ ID NO: 8153379 - DNA, 22 bp, Homo sapiens
gctctgggctgccctctggaca

SEQ ID NO: 8153380 - DNA, 22 bp, Homo sapiens
gctctgggctgccctctggaca

SEQ ID NO: 8153381 - DNA, 22 bp, Homo sapiens
gctctgggctgaatcatttatc

SEQ ID NO: 8153382 - DNA, 22 bp, Homo sapiens
gctctgggctgccctctggaca

SEQ ID NO: 8153383 - DNA, 22 bp, Homo sapiens
gctctggggatgcttctgccgt

SEQ ID NO: 8153384 - DNA, 22 bp, Homo sapiens
gctctggggcccagggatcaca

SEQ ID NO: 8153385 - DNA, 22 bp, Homo sapiens
gctctggggcccagggatcaca

SEQ ID NO: 8153386 - DNA, 22 bp, Homo sapiens
gctctggggttggaaagtgatc

SEQ ID NO: 8153387 - DNA, 22 bp, Homo sapiens
gctctggggttggaaagtgatc

SEQ ID NO: 8153388 - DNA, 22 bp, Homo sapiens
gctgaataggggtcccaaagat

SEQ ID NO: 8153389 - DNA, 22 bp, Homo sapiens
gctgaataggcacagagggcat

SEQ ID NO: 8153390 - DNA, 23 bp, Homo sapiens
gctgaattaagcaatgaagaaat

SEQ ID NO: 8153391 - DNA, 22 bp, Homo sapiens
gctgaatgaatgtattttaaaa

SEQ ID NO: 8153392 - DNA, 22 bp, Homo sapiens
gctctgggccgggcaccagcct

SEQ ID NO: 8153393 - DNA, 22 bp, Homo sapiens
gctctgggccgggcaccagcct

SEQ ID NO: 8153394 - DNA, 22 bp, Homo sapiens
gctctgggccgggcaccagcct

SEQ ID NO: 8153395 - DNA, 22 bp, Homo sapiens
gctctgggccatcctggccggg

SEQ ID NO: 8153396 - DNA, 22 bp, Homo sapiens
gctctgggccatcctggccggg

SEQ ID NO: 8153397 - DNA, 22 bp, Homo sapiens
gctctgggattaccagccttag

SEQ ID NO: 8153398 - DNA, 22 bp, Homo sapiens
gctctgggccatcctggccggg

SEQ ID NO: 8153399 - DNA, 22 bp, Homo sapiens
gctctgggccatcctggccggg

SEQ ID NO: 8153400 - DNA, 22 bp, Homo sapiens
gctctgggattaccagccttag

SEQ ID NO: 8153401 - DNA, 22 bp, Homo sapiens
gctctgggattaccagccttag

SEQ ID NO: 8153402 - DNA, 22 bp, Homo sapiens
gctctgggattaccagccttag

SEQ ID NO: 8153403 - DNA, 20 bp, Homo sapiens
gctctgggagggatgtgatg

SEQ ID NO: 8153404 - DNA, 20 bp, Homo sapiens
gctctgggagggatgtgatg

SEQ ID NO: 8153405 - DNA, 22 bp, Homo sapiens
gctctgggaattcagaaagcct

SEQ ID NO: 8153406 - DNA, 22 bp, Homo sapiens
gctctgggaattcagaaagcct

SEQ ID NO: 8153407 - DNA, 22 bp, Homo sapiens
gctctgggaactgactgccttc

SEQ ID NO: 8153408 - DNA, 22 bp, Homo sapiens
gctctgggaattcagaaagcct

SEQ ID NO: 8153409 - DNA, 22 bp, Homo sapiens
gctctgggaattcagaaagcct

SEQ ID NO: 8153410 - DNA, 22 bp, Homo sapiens
gctctgggaagtcctttaccat

SEQ ID NO: 8153411 - DNA, 22 bp, Homo sapiens
gctctgggaaggatcgtagtga

SEQ ID NO: 8153412 - DNA, 22 bp, Homo sapiens
gctctgggaaggatcgtagtga

SEQ ID NO: 8153413 - DNA, 22 bp, Homo sapiens
gctctgggaagtcctttaccat

SEQ ID NO: 8153414 - DNA, 22 bp, Homo sapiens
gctctgggaactgactgccttc

SEQ ID NO: 8153415 - DNA, 22 bp, Homo sapiens
gctctgggaactgactgccttc

SEQ ID NO: 8153416 - DNA, 18 bp, Homo sapiens
gctctggctcacctccag

SEQ ID NO: 8153417 - DNA, 18 bp, Homo sapiens
gctctggctcacctccag

SEQ ID NO: 8153418 - DNA, 18 bp, Homo sapiens
gctctggctcacctccag

SEQ ID NO: 8153419 - DNA, 22 bp, Homo sapiens
gctccgtgggcattgctaggtg

SEQ ID NO: 8153420 - DNA, 22 bp, Homo sapiens
gctccctgttctcagccatgat

SEQ ID NO: 8153421 - DNA, 22 bp, Homo sapiens
gctccctgtgggatgaggcgcc

SEQ ID NO: 8153422 - DNA, 22 bp, Homo sapiens
gctccctgttctcagccatgat

SEQ ID NO: 8153423 - DNA, 22 bp, Homo sapiens
gctccctgtgctctgagtgata

SEQ ID NO: 8153424 - DNA, 22 bp, Homo sapiens
gctccctgtgctctgagtgata

SEQ ID NO: 8153425 - DNA, 22 bp, Homo sapiens
gctcctccctgtgcagacccag

SEQ ID NO: 8153426 - DNA, 22 bp, Homo sapiens
gctcctctcccagagctgcagg

SEQ ID NO: 8153427 - DNA, 22 bp, Homo sapiens
gctcctctcccagagctgcagg

SEQ ID NO: 8153428 - DNA, 22 bp, Homo sapiens
gctctggctcaaaccaccggct

SEQ ID NO: 8153429 - DNA, 22 bp, Homo sapiens
gctctggctcaaaccaccggct

SEQ ID NO: 8153430 - DNA, 22 bp, Homo sapiens
gctctggctcaaaccaccggct

SEQ ID NO: 8153431 - DNA, 22 bp, Homo sapiens
gctgcctgtgcgggtcgctagg

SEQ ID NO: 8153432 - DNA, 22 bp, Homo sapiens
gctgcctgtgcgggtcgctagg

SEQ ID NO: 8153433 - DNA, 22 bp, Homo sapiens
gctgcctgtctgctgacccagg

SEQ ID NO: 8153434 - DNA, 22 bp, Homo sapiens
gctgcctgtctgctgacccagg

SEQ ID NO: 8153435 - DNA, 22 bp, Homo sapiens
gctgcctgtctgctgacccagg

SEQ ID NO: 8153436 - DNA, 22 bp, Homo sapiens
gctgcctgtcctgaggagtccg

SEQ ID NO: 8153437 - DNA, 22 bp, Homo sapiens
gctgcctgtcctgaggagtccg

SEQ ID NO: 8153438 - DNA, 22 bp, Homo sapiens
gctgcctgtgtggccactcact

SEQ ID NO: 8153439 - DNA, 22 bp, Homo sapiens
gctgcctgtgtggccactcact

SEQ ID NO: 8153440 - DNA, 22 bp, Homo sapiens
gctgcctgttgaagggtctgtg

SEQ ID NO: 8153441 - DNA, 22 bp, Homo sapiens
gctgcctgttgaagggtctgtg

SEQ ID NO: 8153442 - DNA, 22 bp, Homo sapiens
gctgcctgttgaagggtctgtg

SEQ ID NO: 8153443 - DNA, 22 bp, Homo sapiens
gctgcctgtggcccttctgggt

SEQ ID NO: 8153444 - DNA, 22 bp, Homo sapiens
gctgcctgtggcccttctgggt

SEQ ID NO: 8153445 - DNA, 22 bp, Homo sapiens
gctgcggctgtggaggtaccac

SEQ ID NO: 8153446 - DNA, 20 bp, Homo sapiens
gctgcggttacagagacaca

SEQ ID NO: 8153447 - DNA, 22 bp, Homo sapiens
gctgcgccggatcccacgttcc

SEQ ID NO: 8153448 - DNA, 22 bp, Homo sapiens
gctgctaagcgtttctgttcca

SEQ ID NO: 8153449 - DNA, 22 bp, Homo sapiens
gctgctagacagcatgtgagct

SEQ ID NO: 8153450 - DNA, 22 bp, Homo sapiens
gctgctcactgaaggaccctgt

SEQ ID NO: 8153451 - DNA, 20 bp, Homo sapiens
gctgcctgtttctgtaagta

SEQ ID NO: 8153452 - DNA, 22 bp, Homo sapiens
gctgccttaacttcttcgctgt

SEQ ID NO: 8153453 - DNA, 20 bp, Homo sapiens
gctgcctgtttctgtaagta

SEQ ID NO: 8153454 - DNA, 22 bp, Homo sapiens
gctgcctgttgaagggtctgtg

SEQ ID NO: 8153455 - DNA, 22 bp, Homo sapiens
gctgccttagagggagtggttc

SEQ ID NO: 8153456 - DNA, 22 bp, Homo sapiens
gctgccttaacttcttcgctgt

SEQ ID NO: 8153457 - DNA, 22 bp, Homo sapiens
gctgccttatgtctattagtat

SEQ ID NO: 8153458 - DNA, 22 bp, Homo sapiens
gctgccttcagttctgattcat

SEQ ID NO: 8153459 - DNA, 22 bp, Homo sapiens
gctgccttcagttctgattcat

SEQ ID NO: 8153460 - DNA, 22 bp, Homo sapiens
gctgccttccaaagagttttat

SEQ ID NO: 8153461 - DNA, 22 bp, Homo sapiens
gctgctccagtgttctgtctag

SEQ ID NO: 8153462 - DNA, 22 bp, Homo sapiens
gctgctcagtgggcctgagcct

SEQ ID NO: 8153463 - DNA, 21 bp, Homo sapiens
gctgctcgagatccagtgctt

SEQ ID NO: 8153464 - DNA, 21 bp, Homo sapiens
gctgctcgagatccagtgctt

SEQ ID NO: 8153465 - DNA, 21 bp, Homo sapiens
gctgctcgagatccagtgctt

SEQ ID NO: 8153466 - DNA, 22 bp, Homo sapiens
gctgctgtgaattttttaaatg

SEQ ID NO: 8153467 - DNA, 22 bp, Homo sapiens
gctgctgtgaattttttaaatg

SEQ ID NO: 8153468 - DNA, 22 bp, Homo sapiens
gctgctgtctggtctgagggct

SEQ ID NO: 8153469 - DNA, 22 bp, Homo sapiens
gctgctgtctggtctgagggct

SEQ ID NO: 8153470 - DNA, 22 bp, Homo sapiens
gctgctgtgccccatctgcaga

SEQ ID NO: 8153471 - DNA, 22 bp, Homo sapiens
gctgctgtgcctggcgtcctgt

SEQ ID NO: 8153472 - DNA, 22 bp, Homo sapiens
gctgctgtgcctggcgtcctgt

SEQ ID NO: 8153473 - DNA, 22 bp, Homo sapiens
gctgctgtgcctggcgtcctgt

SEQ ID NO: 8153474 - DNA, 22 bp, Homo sapiens
gctgctgtggcagattggattc

SEQ ID NO: 8153475 - DNA, 21 bp, Homo sapiens
gctgctgtgggccagggaggc

SEQ ID NO: 8153476 - DNA, 21 bp, Homo sapiens
gctgctgtgggccagggaggc

SEQ ID NO: 8153477 - DNA, 22 bp, Homo sapiens
gctgcttcctagaaggcccagt

SEQ ID NO: 8153478 - DNA, 22 bp, Homo sapiens
gctgctgttgatttagtccaat

SEQ ID NO: 8153479 - DNA, 22 bp, Homo sapiens
gctgctgttgatttagtccaat

SEQ ID NO: 8153480 - DNA, 22 bp, Homo sapiens
gctgctgttgatttagtccaat

SEQ ID NO: 8153481 - DNA, 22 bp, Homo sapiens
gctgctgttcctccagtggatc

SEQ ID NO: 8153482 - DNA, 22 bp, Homo sapiens
gctgcttgattaggttgacact

SEQ ID NO: 8153483 - DNA, 22 bp, Homo sapiens
gctgctttaaaatcagcatagc

SEQ ID NO: 8153484 - DNA, 22 bp, Homo sapiens
gctgctttaactggacggctcc

SEQ ID NO: 8153485 - DNA, 22 bp, Homo sapiens
gctgctttacaggtgggggagc

SEQ ID NO: 8153486 - DNA, 22 bp, Homo sapiens
gctgctgtgttggccactgctt

SEQ ID NO: 8153487 - DNA, 22 bp, Homo sapiens
gctgctgttatgatgttacttt

SEQ ID NO: 8153488 - DNA, 22 bp, Homo sapiens
gctgctgttatgatgttacttt

SEQ ID NO: 8153489 - DNA, 22 bp, Homo sapiens
gctgctgttccggctacagccc

SEQ ID NO: 8153490 - DNA, 22 bp, Homo sapiens
gctgctgttcctccagtggatc

SEQ ID NO: 8153491 - DNA, 21 bp, Homo sapiens
gctgctgtgggccagggaggc

SEQ ID NO: 8153492 - DNA, 22 bp, Homo sapiens
gctgctgtgtgggagacaggcg

SEQ ID NO: 8153493 - DNA, 22 bp, Homo sapiens
gctgctgtgttggagagggact

SEQ ID NO: 8153494 - DNA, 22 bp, Homo sapiens
gctgctgtgttggagagggact

SEQ ID NO: 8153495 - DNA, 22 bp, Homo sapiens
gctgctgtgttctcttgaccca

SEQ ID NO: 8153496 - DNA, 22 bp, Homo sapiens
gctgctgtgttctcttgaccca

SEQ ID NO: 8153497 - DNA, 22 bp, Homo sapiens
gctgctgtgtgggagacaggcg

SEQ ID NO: 8153498 - DNA, 22 bp, Homo sapiens
gctgcccaattacagggccgtg

SEQ ID NO: 8153499 - DNA, 22 bp, Homo sapiens
gctgcccaattacagggccgtg

SEQ ID NO: 8153500 - DNA, 22 bp, Homo sapiens
gctgagggctgtaacagcagag

SEQ ID NO: 8153501 - DNA, 22 bp, Homo sapiens
gctgagggccgcatagggtcat

SEQ ID NO: 8153502 - DNA, 22 bp, Homo sapiens
gctgagggcatgtgtggcgact

SEQ ID NO: 8153503 - DNA, 22 bp, Homo sapiens
gctgagggcatgtgtggcgact

SEQ ID NO: 8153504 - DNA, 22 bp, Homo sapiens
gctgagggcatgtgtggcgact

SEQ ID NO: 8153505 - DNA, 22 bp, Homo sapiens
gctgagggatagctgctcactg

SEQ ID NO: 8153506 - DNA, 22 bp, Homo sapiens
gctgagggcagcctcctaggtc

SEQ ID NO: 8153507 - DNA, 22 bp, Homo sapiens
gctgagggcagcctcctaggtc

SEQ ID NO: 8153508 - DNA, 22 bp, Homo sapiens
gctgagggcagcctcctaggtc

SEQ ID NO: 8153509 - DNA, 22 bp, Homo sapiens
gctgagggcagcctcctaggtc

SEQ ID NO: 8153510 - DNA, 22 bp, Homo sapiens
gctgcccagttctgctgctgcc

SEQ ID NO: 8153511 - DNA, 22 bp, Homo sapiens
gctgcccagtgtgctcatgcag

SEQ ID NO: 8153512 - DNA, 22 bp, Homo sapiens
gctgcccagggtggagccggct

SEQ ID NO: 8153513 - DNA, 22 bp, Homo sapiens
gctgcccagggtggagccggct

SEQ ID NO: 8153514 - DNA, 22 bp, Homo sapiens
gctgcccagggctgagtgtcct

SEQ ID NO: 8153515 - DNA, 22 bp, Homo sapiens
gctgcccaggcaacattgactt

SEQ ID NO: 8153516 - DNA, 22 bp, Homo sapiens
gctgcccagcaggccccagggg

SEQ ID NO: 8153517 - DNA, 22 bp, Homo sapiens
gctgcccagcaggccccagggg

SEQ ID NO: 8153518 - DNA, 22 bp, Homo sapiens
gctgcccacaaccccgtgtcta

SEQ ID NO: 8153519 - DNA, 22 bp, Homo sapiens
gctgccctgtttagccagggtt

SEQ ID NO: 8153520 - DNA, 22 bp, Homo sapiens
gctgcctcaggcacctcctggc

SEQ ID NO: 8153521 - DNA, 22 bp, Homo sapiens
gctgcctcactccagcccaata

SEQ ID NO: 8153522 - DNA, 22 bp, Homo sapiens
gctgcctgtcctgaggagtccg

SEQ ID NO: 8153523 - DNA, 22 bp, Homo sapiens
gctgcctccaatctgtgccccg

SEQ ID NO: 8153524 - DNA, 22 bp, Homo sapiens
gctgcctgtcctgaggagtccg

SEQ ID NO: 8153525 - DNA, 22 bp, Homo sapiens
gctgcctgtcctgaggagtccg

SEQ ID NO: 8153526 - DNA, 22 bp, Homo sapiens
gctgcctcaggcacctcctggc

SEQ ID NO: 8153527 - DNA, 22 bp, Homo sapiens
gctgcctcaggcacctcctggc

SEQ ID NO: 8153528 - DNA, 22 bp, Homo sapiens
gctgcctcaggcacctcctggc

SEQ ID NO: 8153529 - DNA, 22 bp, Homo sapiens
gctgccccagctgggggctgga

SEQ ID NO: 8153530 - DNA, 22 bp, Homo sapiens
gctgcccattgctctcccactc

SEQ ID NO: 8153531 - DNA, 22 bp, Homo sapiens
gctgcccattgctctcccactc

SEQ ID NO: 8153532 - DNA, 22 bp, Homo sapiens
gctgccccagctgggggctgga

SEQ ID NO: 8153533 - DNA, 22 bp, Homo sapiens
gctgcccattgctctcccactc

SEQ ID NO: 8153534 - DNA, 22 bp, Homo sapiens
gctgcccattccactggatggt

SEQ ID NO: 8153535 - DNA, 22 bp, Homo sapiens
gctgcccattccactggatggt

SEQ ID NO: 8153536 - DNA, 22 bp, Homo sapiens
gctgccccccggactcggcggg

SEQ ID NO: 8153537 - DNA, 22 bp, Homo sapiens
gctgccctaatatcacatgtta

SEQ ID NO: 8153538 - DNA, 22 bp, Homo sapiens
gctgccctaatatcacatgtta

SEQ ID NO: 8153539 - DNA, 22 bp, Homo sapiens
gctgccctaatatcacatgtta

SEQ ID NO: 8153540 - DNA, 22 bp, Homo sapiens
gctgccccgagccatccttcag

SEQ ID NO: 8153541 - DNA, 22 bp, Homo sapiens
gctgccctagaagtacagagag

SEQ ID NO: 8153542 - DNA, 22 bp, Homo sapiens
gctgccctagaagtacagagag

SEQ ID NO: 8153543 - DNA, 22 bp, Homo sapiens
gctgccctacccgaggcactct

SEQ ID NO: 8153544 - DNA, 22 bp, Homo sapiens
gctgccctgtctgcagcaggac

SEQ ID NO: 8153545 - DNA, 18 bp, Homo sapiens
gctgccctagctcccctc

SEQ ID NO: 8153546 - DNA, 18 bp, Homo sapiens
gctgccctagctcccctc

SEQ ID NO: 8153547 - DNA, 22 bp, Homo sapiens
gctgccctgtggtccagcaggt

SEQ ID NO: 8153548 - DNA, 22 bp, Homo sapiens
gctgccctgtggtccagcaggt

SEQ ID NO: 8153549 - DNA, 22 bp, Homo sapiens
ggaatgctcagttcttggtgct

SEQ ID NO: 8153550 - DNA, 22 bp, Homo sapiens
ggaatgagctcggagcagaagg

SEQ ID NO: 8153551 - DNA, 22 bp, Homo sapiens
ggaatgagctcggagcagaagg

SEQ ID NO: 8153552 - DNA, 22 bp, Homo sapiens
ggaatgaatttccagctgggtc

SEQ ID NO: 8153553 - DNA, 22 bp, Homo sapiens
ggaatgaaacacttctgattct

SEQ ID NO: 8153554 - DNA, 22 bp, Homo sapiens
ggaatgaatttccagctgggtc

SEQ ID NO: 8153555 - DNA, 22 bp, Homo sapiens
ggaatgaaacacttctgattct

SEQ ID NO: 8153556 - DNA, 22 bp, Homo sapiens
ggaatgtgcgtactcagtgtca

SEQ ID NO: 8153557 - DNA, 22 bp, Homo sapiens
ggaatgtagtttgtgcactgta

SEQ ID NO: 8153558 - DNA, 22 bp, Homo sapiens
ggaatgtgctgacacgcgagag

SEQ ID NO: 8153559 - DNA, 22 bp, Homo sapiens
ggaatgtagtttgtgcactgta

SEQ ID NO: 8153560 - DNA, 22 bp, Homo sapiens
ggaatgtagaatctctggtctc

SEQ ID NO: 8153561 - DNA, 22 bp, Homo sapiens
ggaatgtaccacctattgttag

SEQ ID NO: 8153562 - DNA, 22 bp, Homo sapiens
ggaatgtaaatttactgttgta

SEQ ID NO: 8153563 - DNA, 22 bp, Homo sapiens
ggaatgtaacgtgaccaagttc

SEQ ID NO: 8153564 - DNA, 22 bp, Homo sapiens
ggaatgtaaatttactgttgta

SEQ ID NO: 8153565 - DNA, 22 bp, Homo sapiens
ggaatgtgttcttactgtattt

SEQ ID NO: 8153566 - DNA, 17 bp, Homo sapiens
ggacacagctcatggct

SEQ ID NO: 8153567 - DNA, 17 bp, Homo sapiens
ggacacagctcatggct

SEQ ID NO: 8153568 - DNA, 22 bp, Homo sapiens
ggacacagataatcacacagat

SEQ ID NO: 8153569 - DNA, 18 bp, Homo sapiens
ggacacagataggtacag

SEQ ID NO: 8153570 - DNA, 20 bp, Homo sapiens
ggaattgctttcctgtcttt

SEQ ID NO: 8153571 - DNA, 22 bp, Homo sapiens
ggacaaaccaatagacactggc

SEQ ID NO: 8153572 - DNA, 22 bp, Homo sapiens
ggacaaaatccaaacttcttag

SEQ ID NO: 8153573 - DNA, 22 bp, Homo sapiens
ggaattgctaacattctgaagg

SEQ ID NO: 8153574 - DNA, 21 bp, Homo sapiens
ggaattgcaggctgtcttttg

SEQ ID NO: 8153575 - DNA, 22 bp, Homo sapiens
ggaattctgtagctcttcctct

SEQ ID NO: 8153576 - DNA, 22 bp, Homo sapiens
ggaagagtaacaggaggtggaa

SEQ ID NO: 8153577 - DNA, 22 bp, Homo sapiens
ggaagagggaaccacgactgta

SEQ ID NO: 8153578 - DNA, 22 bp, Homo sapiens
ggaagaggctggtagtgcccgt

SEQ ID NO: 8153579 - DNA, 22 bp, Homo sapiens
ggaagaggctggtagtgcccgt

SEQ ID NO: 8153580 - DNA, 22 bp, Homo sapiens
ggaagagtaacaggaggtggaa

SEQ ID NO: 8153581 - DNA, 22 bp, Homo sapiens
ggaagagtaacaggaggtggaa

SEQ ID NO: 8153582 - DNA, 22 bp, Homo sapiens
ggaagagtgcaggtttgtttca

SEQ ID NO: 8153583 - DNA, 22 bp, Homo sapiens
ggaagagtaacaggaggtggaa

SEQ ID NO: 8153584 - DNA, 22 bp, Homo sapiens
ggaagagtaacaggaggtggaa

SEQ ID NO: 8153585 - DNA, 22 bp, Homo sapiens
ggaagatgagaagtggggctcc

SEQ ID NO: 8153586 - DNA, 22 bp, Homo sapiens
ggaagatgcccaacccagcttt

SEQ ID NO: 8153587 - DNA, 22 bp, Homo sapiens
ggaagcagcctgaagccaaggg

SEQ ID NO: 8153588 - DNA, 22 bp, Homo sapiens
ggaagcagcctgaagccaaggg

SEQ ID NO: 8153589 - DNA, 22 bp, Homo sapiens
ggaagcagcctgaagccaaggg

SEQ ID NO: 8153590 - DNA, 22 bp, Homo sapiens
ggaagcaggaggctggggtaaa

SEQ ID NO: 8153591 - DNA, 22 bp, Homo sapiens
ggaagcagcctgaagccaaggg

SEQ ID NO: 8153592 - DNA, 22 bp, Homo sapiens
ggaagcactgaggcagagaggg

SEQ ID NO: 8153593 - DNA, 20 bp, Homo sapiens
ggaatcagggtaatgtactg

SEQ ID NO: 8153594 - DNA, 22 bp, Homo sapiens
ggaatcctgccagctctgcccc

SEQ ID NO: 8153595 - DNA, 22 bp, Homo sapiens
ggaatcagatgaggggcagagc

SEQ ID NO: 8153596 - DNA, 22 bp, Homo sapiens
ggaatcagaattactgaatgga

SEQ ID NO: 8153597 - DNA, 22 bp, Homo sapiens
ggaatcgttaggtaagcaggga

SEQ ID NO: 8153598 - DNA, 22 bp, Homo sapiens
ggaagaggctgagccaggtccc

SEQ ID NO: 8153599 - DNA, 22 bp, Homo sapiens
ggaagaggctgaggccatgctg

SEQ ID NO: 8153600 - DNA, 22 bp, Homo sapiens
ggaagaggctgagccaggtccc

SEQ ID NO: 8153601 - DNA, 22 bp, Homo sapiens
ggaagaggctggtagtgcccgt

SEQ ID NO: 8153602 - DNA, 22 bp, Homo sapiens
ggaagaggctgaggccatgctg

SEQ ID NO: 8153603 - DNA, 22 bp, Homo sapiens
ggaagaggctctcattgagggc

SEQ ID NO: 8153604 - DNA, 22 bp, Homo sapiens
ggaagaggctctcattgagggc

SEQ ID NO: 8153605 - DNA, 22 bp, Homo sapiens
ggaagaggctgagccaggtccc

SEQ ID NO: 8153606 - DNA, 22 bp, Homo sapiens
ggaagaggctctcattgagggc

SEQ ID NO: 8153607 - DNA, 22 bp, Homo sapiens
ggaagaggctctcattgagggc

SEQ ID NO: 8153608 - DNA, 22 bp, Homo sapiens
ggaagaggctctcattgagggc

SEQ ID NO: 8153609 - DNA, 22 bp, Homo sapiens
ggaagaggctctcattgagggc

SEQ ID NO: 8153610 - DNA, 22 bp, Homo sapiens
ggaagacagaagcctacagctt

SEQ ID NO: 8153611 - DNA, 22 bp, Homo sapiens
ggaagacaagcagtggctgagc

SEQ ID NO: 8153612 - DNA, 22 bp, Homo sapiens
ggaagacagaagcctacagctt

SEQ ID NO: 8153613 - DNA, 22 bp, Homo sapiens
gctttggagtcagaaagaccta

SEQ ID NO: 8153614 - DNA, 22 bp, Homo sapiens
gctttggagcctgtgttctgcc

SEQ ID NO: 8153615 - DNA, 19 bp, Homo sapiens
gctttggagggaggttcta

SEQ ID NO: 8153616 - DNA, 22 bp, Homo sapiens
gctttattttgtgagggattac

SEQ ID NO: 8153617 - DNA, 22 bp, Homo sapiens
gctttattttgtgagggattac

SEQ ID NO: 8153618 - DNA, 22 bp, Homo sapiens
gctttattttgtgagggattac

SEQ ID NO: 8153619 - DNA, 22 bp, Homo sapiens
gctttattttgtgagggattac

SEQ ID NO: 8153620 - DNA, 22 bp, Homo sapiens
gctttattttgtgagggattac

SEQ ID NO: 8153621 - DNA, 22 bp, Homo sapiens
gctttcatgaaaataatctact

SEQ ID NO: 8153622 - DNA, 17 bp, Homo sapiens
gctttccttgcccctcc

SEQ ID NO: 8153623 - DNA, 22 bp, Homo sapiens
gctttgctggcttgaaatgctg

SEQ ID NO: 8153624 - DNA, 22 bp, Homo sapiens
gctttctcttcactgatgttca

SEQ ID NO: 8153625 - DNA, 20 bp, Homo sapiens
gctttctatgagatggactg

SEQ ID NO: 8153626 - DNA, 22 bp, Homo sapiens
gctttctgaagcagtgtttctc

SEQ ID NO: 8153627 - DNA, 22 bp, Homo sapiens
gctttctgaagcagtgtttctc

SEQ ID NO: 8153628 - DNA, 22 bp, Homo sapiens
gctttggaaatatagactcaag

SEQ ID NO: 8153629 - DNA, 22 bp, Homo sapiens
gctttgcttcctgttctagcct

SEQ ID NO: 8153630 - DNA, 22 bp, Homo sapiens
ggacagtgtctgcttcaggccc

SEQ ID NO: 8153631 - DNA, 22 bp, Homo sapiens
ggacagtggcctggtggtatag

SEQ ID NO: 8153632 - DNA, 22 bp, Homo sapiens
ggacagtgtgggccatctcact

SEQ ID NO: 8153633 - DNA, 22 bp, Homo sapiens
ggacatagaggccctgcatggc

SEQ ID NO: 8153634 - DNA, 22 bp, Homo sapiens
ggacatagaggccctgcatggc

SEQ ID NO: 8153635 - DNA, 22 bp, Homo sapiens
ggacagtgaatgtggggatgca

SEQ ID NO: 8153636 - DNA, 20 bp, Homo sapiens
ggacagtgagacatatctca

SEQ ID NO: 8153637 - DNA, 19 bp, Homo sapiens
ggacagtctcagcctcatg

SEQ ID NO: 8153638 - DNA, 22 bp, Homo sapiens
ggacaggttcagcagtttataa

SEQ ID NO: 8153639 - DNA, 22 bp, Homo sapiens
ggacaggtgtgaggctggcaca

SEQ ID NO: 8153640 - DNA, 22 bp, Homo sapiens
ggacagggtaagtactagtgtg

SEQ ID NO: 8153641 - DNA, 22 bp, Homo sapiens
ggacaggtgtgaggctggcaca

SEQ ID NO: 8153642 - DNA, 22 bp, Homo sapiens
ggacaggtgtgaggctggcaca

SEQ ID NO: 8153643 - DNA, 22 bp, Homo sapiens
ggacaggtgcaaagggcacatg

SEQ ID NO: 8153644 - DNA, 22 bp, Homo sapiens
ggacagggtaagtactagtgtg

SEQ ID NO: 8153645 - DNA, 22 bp, Homo sapiens
ggacaggtgactgcccagagtg

SEQ ID NO: 8153646 - DNA, 22 bp, Homo sapiens
ggacagggttggggcatataaa

SEQ ID NO: 8153647 - DNA, 22 bp, Homo sapiens
ggacacaggtaaataccactga

SEQ ID NO: 8153648 - DNA, 22 bp, Homo sapiens
ggacacagtggaagacagcttg

SEQ ID NO: 8153649 - DNA, 22 bp, Homo sapiens
ggacacagtggaagacagcttg

SEQ ID NO: 8153650 - DNA, 22 bp, Homo sapiens
ggacacagctgcagccacaccc

SEQ ID NO: 8153651 - DNA, 22 bp, Homo sapiens
ggagacagtatggcttgtagct

SEQ ID NO: 8153652 - DNA, 22 bp, Homo sapiens
ggagacagtatggcttgtagct

SEQ ID NO: 8153653 - DNA, 22 bp, Homo sapiens
ggagacagtatggcttgtagct

SEQ ID NO: 8153654 - DNA, 22 bp, Homo sapiens
ggagacagtatggcttgtagct

SEQ ID NO: 8153655 - DNA, 22 bp, Homo sapiens
ggagacagtatggcttgtagct

SEQ ID NO: 8153656 - DNA, 22 bp, Homo sapiens
ggagacagggttgaaccacgca

SEQ ID NO: 8153657 - DNA, 17 bp, Homo sapiens
ggaccaggggttgccat

SEQ ID NO: 8153658 - DNA, 20 bp, Homo sapiens
ggaccaggtggggcggtggc

SEQ ID NO: 8153659 - DNA, 22 bp, Homo sapiens
ggaccagtggcagggtgctgtg

SEQ ID NO: 8153660 - DNA, 19 bp, Homo sapiens
ggaccaggtcctgggcagc

SEQ ID NO: 8153661 - DNA, 19 bp, Homo sapiens
ggaccaggtcctgggcagc

SEQ ID NO: 8153662 - DNA, 19 bp, Homo sapiens
ggaccaggtcctgggcagc

SEQ ID NO: 8153663 - DNA, 19 bp, Homo sapiens
ggaccaggtcctgggcagc

SEQ ID NO: 8153664 - DNA, 19 bp, Homo sapiens
ggaccaggtcctgggcagc

SEQ ID NO: 8153665 - DNA, 21 bp, Homo sapiens
ggacatgaggcaggagaggct

SEQ ID NO: 8153666 - DNA, 22 bp, Homo sapiens
ggacatgatatttcaggaagac

SEQ ID NO: 8153667 - DNA, 22 bp, Homo sapiens
ggacatgattagcagggagagc

SEQ ID NO: 8153668 - DNA, 22 bp, Homo sapiens
ggacatgatatttcaggaagac

SEQ ID NO: 8153669 - DNA, 20 bp, Homo sapiens
ggaccagctgtctgaggggc

SEQ ID NO: 8153670 - DNA, 22 bp, Homo sapiens
ggaccaggagctcagagccctc

SEQ ID NO: 8153671 - DNA, 22 bp, Homo sapiens
ggaccaggagctcagagccctc

SEQ ID NO: 8153672 - DNA, 19 bp, Homo sapiens
ggaccagctttcaggaggc

SEQ ID NO: 8153673 - DNA, 22 bp, Homo sapiens
ggaccaggcaagctgaggcggg

SEQ ID NO: 8153674 - DNA, 22 bp, Homo sapiens
ggaccaggcaagctgaggcggg

SEQ ID NO: 8153675 - DNA, 22 bp, Homo sapiens
ggagacagtgacttagagactg

SEQ ID NO: 8153676 - DNA, 22 bp, Homo sapiens
ggagacagtgacttagagactg

SEQ ID NO: 8153677 - DNA, 22 bp, Homo sapiens
ggagacagtgacttagagactg

SEQ ID NO: 8153678 - DNA, 22 bp, Homo sapiens
ggagacagtgacttagagactg

SEQ ID NO: 8153679 - DNA, 22 bp, Homo sapiens
ggagacagtggtagggcctaag

SEQ ID NO: 8153680 - DNA, 22 bp, Homo sapiens
ggagacagtggtagggcctaag

SEQ ID NO: 8153681 - DNA, 22 bp, Homo sapiens
ggagacagtggtagggcctaag

SEQ ID NO: 8153682 - DNA, 22 bp, Homo sapiens
ggagactacctagcaggctgtt

SEQ ID NO: 8153683 - DNA, 19 bp, Homo sapiens
ggagactcagcccatgcct

SEQ ID NO: 8153684 - DNA, 22 bp, Homo sapiens
ggagaccaggtcagagatggtg

SEQ ID NO: 8153685 - DNA, 18 bp, Homo sapiens
ggagactaaactgttgac

SEQ ID NO: 8153686 - DNA, 22 bp, Homo sapiens
ggagaccagaaggaagcttcga

SEQ ID NO: 8153687 - DNA, 22 bp, Homo sapiens
ggagagaatctgaacctgctcc

SEQ ID NO: 8153688 - DNA, 22 bp, Homo sapiens
ggagagaattcagcttaagatt

SEQ ID NO: 8153689 - DNA, 22 bp, Homo sapiens
ggagagaattccatggacatgt

SEQ ID NO: 8153690 - DNA, 22 bp, Homo sapiens
ggagagaattccatggacatgt

SEQ ID NO: 8153691 - DNA, 22 bp, Homo sapiens
ggagagaattccatggacatgt

SEQ ID NO: 8153692 - DNA, 22 bp, Homo sapiens
ggagagaatctgaacctgctcc

SEQ ID NO: 8153693 - DNA, 22 bp, Homo sapiens
ggagagaactggctccttctag

SEQ ID NO: 8153694 - DNA, 22 bp, Homo sapiens
ggagagaactgacctgaaagga

SEQ ID NO: 8153695 - DNA, 22 bp, Homo sapiens
ggagagaactgacctgaaagga

SEQ ID NO: 8153696 - DNA, 22 bp, Homo sapiens
ggagagaactgacctgaaagga

SEQ ID NO: 8153697 - DNA, 22 bp, Homo sapiens
ggagagaaattgaggtagcaag

SEQ ID NO: 8153698 - DNA, 22 bp, Homo sapiens
ggagagaaattgaggtagcaag

SEQ ID NO: 8153699 - DNA, 22 bp, Homo sapiens
ggagagagagattgtgtttatt

SEQ ID NO: 8153700 - DNA, 22 bp, Homo sapiens
ggagagagacctccatgcccag

SEQ ID NO: 8153701 - DNA, 22 bp, Homo sapiens
ggagagaccctggagaaggtcc

SEQ ID NO: 8153702 - DNA, 22 bp, Homo sapiens
ggagcaggctctgtggtttcca

SEQ ID NO: 8153703 - DNA, 22 bp, Homo sapiens
ggagcagggaattacagcgcag

SEQ ID NO: 8153704 - DNA, 22 bp, Homo sapiens
ggagcagcactgattagcggtt

SEQ ID NO: 8153705 - DNA, 22 bp, Homo sapiens
ggagcagcactgattagcggtt

SEQ ID NO: 8153706 - DNA, 22 bp, Homo sapiens
ggagcagcactgccacacagag

SEQ ID NO: 8153707 - DNA, 22 bp, Homo sapiens
ggagcagcactgccacacagag

SEQ ID NO: 8153708 - DNA, 22 bp, Homo sapiens
ggagcagtctaaatgataagag

SEQ ID NO: 8153709 - DNA, 22 bp, Homo sapiens
ggagcagggaattacagcgcag

SEQ ID NO: 8153710 - DNA, 22 bp, Homo sapiens
ggagcagggaattacagcgcag

SEQ ID NO: 8153711 - DNA, 22 bp, Homo sapiens
ggagcagggaattacagcgcag

SEQ ID NO: 8153712 - DNA, 22 bp, Homo sapiens
ggagcagggcagtgaattctgg

SEQ ID NO: 8153713 - DNA, 22 bp, Homo sapiens
ggagcagttgttgagcaagcca

SEQ ID NO: 8153714 - DNA, 22 bp, Homo sapiens
ggagcatgcgctctgtgaccga

SEQ ID NO: 8153715 - DNA, 22 bp, Homo sapiens
ggagcatgcgctctgtgaccga

SEQ ID NO: 8153716 - DNA, 22 bp, Homo sapiens
ggagcatgtggggtgagcaggg

SEQ ID NO: 8153717 - DNA, 22 bp, Homo sapiens
ggagcatgtggggtgagcaggg

SEQ ID NO: 8153718 - DNA, 22 bp, Homo sapiens
ggagcatgggtcagaactcagt

SEQ ID NO: 8153719 - DNA, 22 bp, Homo sapiens
ggagccagagcactggggagcc

SEQ ID NO: 8153720 - DNA, 22 bp, Homo sapiens
gctggggagggcgtcaaggcca

SEQ ID NO: 8153721 - DNA, 22 bp, Homo sapiens
gctggggagggcgtcaaggcca

SEQ ID NO: 8153722 - DNA, 22 bp, Homo sapiens
gctggggcctctgtgaggttaa

SEQ ID NO: 8153723 - DNA, 22 bp, Homo sapiens
gctggggcctctgtgaggttaa

SEQ ID NO: 8153724 - DNA, 22 bp, Homo sapiens
gctggggcctgaacagtcagct

SEQ ID NO: 8153725 - DNA, 22 bp, Homo sapiens
gctggggcctgaacagtcagct

SEQ ID NO: 8153726 - DNA, 22 bp, Homo sapiens
gctggggcctgaacagtcagct

SEQ ID NO: 8153727 - DNA, 22 bp, Homo sapiens
gctggggcctgaacagtcagct

SEQ ID NO: 8153728 - DNA, 22 bp, Homo sapiens
gctgggcttctcaatgctgcct

SEQ ID NO: 8153729 - DNA, 19 bp, Homo sapiens
gctgggcttgggtttgtag

SEQ ID NO: 8153730 - DNA, 22 bp, Homo sapiens
gctgggcttggtttccctgctt

SEQ ID NO: 8153731 - DNA, 19 bp, Homo sapiens
gctgggcttgggtttgtag

SEQ ID NO: 8153732 - DNA, 22 bp, Homo sapiens
gctgggcttggtttccctgctt

SEQ ID NO: 8153733 - DNA, 22 bp, Homo sapiens
gctggggaggcagcagagaaca

SEQ ID NO: 8153734 - DNA, 22 bp, Homo sapiens
gctgggcttggtttccctgctt

SEQ ID NO: 8153735 - DNA, 22 bp, Homo sapiens
gctggggctgggctgaggaaga

SEQ ID NO: 8153736 - DNA, 22 bp, Homo sapiens
gctggggctgggctgaggaaga

SEQ ID NO: 8153737 - DNA, 22 bp, Homo sapiens
gctggggctgggctgaggaaga

SEQ ID NO: 8153738 - DNA, 19 bp, Homo sapiens
gctggggcctgaccagaca

SEQ ID NO: 8153739 - DNA, 19 bp, Homo sapiens
gctggggcctgaccagaca

SEQ ID NO: 8153740 - DNA, 19 bp, Homo sapiens
gctggggcctgaccagaca

SEQ ID NO: 8153741 - DNA, 19 bp, Homo sapiens
gctggggcctgaccagaca

SEQ ID NO: 8153742 - DNA, 22 bp, Homo sapiens
gctgtggcggcagcagctggtg

SEQ ID NO: 8153743 - DNA, 22 bp, Homo sapiens
gctgtgctgattcattccctgc

SEQ ID NO: 8153744 - DNA, 19 bp, Homo sapiens
gctgtgcctctctcctgct

SEQ ID NO: 8153745 - DNA, 19 bp, Homo sapiens
gctgtgcctctctcctgct

SEQ ID NO: 8153746 - DNA, 19 bp, Homo sapiens
gctgtgcctctctcctgct

SEQ ID NO: 8153747 - DNA, 19 bp, Homo sapiens
gctgtgcccctgccgcttg

SEQ ID NO: 8153748 - DNA, 19 bp, Homo sapiens
gctgtgcccctgccgcttg

SEQ ID NO: 8153749 - DNA, 22 bp, Homo sapiens
gctgtgggtgctggctccaccc

SEQ ID NO: 8153750 - DNA, 22 bp, Homo sapiens
gctgtgggtgctggctccaccc

SEQ ID NO: 8153751 - DNA, 22 bp, Homo sapiens
gctgtgggtccggaccccacgg

SEQ ID NO: 8153752 - DNA, 22 bp, Homo sapiens
gctgtgggtccggaccccacgg

SEQ ID NO: 8153753 - DNA, 22 bp, Homo sapiens
gctgtgggtaaacgctgagggt

SEQ ID NO: 8153754 - DNA, 22 bp, Homo sapiens
gctgtgggtacaaatacacaat

SEQ ID NO: 8153755 - DNA, 22 bp, Homo sapiens
gctgtggtctgtgagctccaaa

SEQ ID NO: 8153756 - DNA, 22 bp, Homo sapiens
gctgtgggtttccaatcctgga

SEQ ID NO: 8153757 - DNA, 22 bp, Homo sapiens
gctgtgggtttccaatcctgga

SEQ ID NO: 8153758 - DNA, 22 bp, Homo sapiens
gctgtgggtttccaatcctgga

SEQ ID NO: 8153759 - DNA, 22 bp, Homo sapiens
gctgtgggttcctggcatttga

SEQ ID NO: 8153760 - DNA, 22 bp, Homo sapiens
gctgtgggttcctggcatttga

SEQ ID NO: 8153761 - DNA, 22 bp, Homo sapiens
gctgtgggacaggtccagccag

SEQ ID NO: 8153762 - DNA, 22 bp, Homo sapiens
gctgtgggccacacggctgagt

SEQ ID NO: 8153763 - DNA, 22 bp, Homo sapiens
gctgtgggccacacggctgagt

SEQ ID NO: 8153764 - DNA, 22 bp, Homo sapiens
gctgtgggacaggtccagccag

SEQ ID NO: 8153765 - DNA, 22 bp, Homo sapiens
gctgtggggagagaacacacaa

SEQ ID NO: 8153766 - DNA, 22 bp, Homo sapiens
gctgtggggagagaacacacaa

SEQ ID NO: 8153767 - DNA, 22 bp, Homo sapiens
gctgtgggccatggccaagtga

SEQ ID NO: 8153768 - DNA, 22 bp, Homo sapiens
gctgtgggccatggccaagtga

SEQ ID NO: 8153769 - DNA, 22 bp, Homo sapiens
gctgtgggtaaacgctgagggt

SEQ ID NO: 8153770 - DNA, 22 bp, Homo sapiens
gctgtgggtaaacgctgagggt

SEQ ID NO: 8153771 - DNA, 22 bp, Homo sapiens
gctgtggctccaatggtgagcc

SEQ ID NO: 8153772 - DNA, 22 bp, Homo sapiens
gctgtggcggcagcagctggtg

SEQ ID NO: 8153773 - DNA, 22 bp, Homo sapiens
gctgtggctgaagatgcaggga

SEQ ID NO: 8153774 - DNA, 22 bp, Homo sapiens
gctgtggctgaagatgcaggga

SEQ ID NO: 8153775 - DNA, 19 bp, Homo sapiens
gctgtgggacagcagggtg

SEQ ID NO: 8153776 - DNA, 19 bp, Homo sapiens
gctgtgggacagcagggtg

SEQ ID NO: 8153777 - DNA, 22 bp, Homo sapiens
gctgtggctgtacagagaccat

SEQ ID NO: 8153778 - DNA, 22 bp, Homo sapiens
gcttctgtggtgcatctttgct

SEQ ID NO: 8153779 - DNA, 22 bp, Homo sapiens
gcttctgtggtgcatctttgct

SEQ ID NO: 8153780 - DNA, 22 bp, Homo sapiens
gcttctgttaacttatgttccc

SEQ ID NO: 8153781 - DNA, 22 bp, Homo sapiens
gcttctgttaacttatgttccc

SEQ ID NO: 8153782 - DNA, 22 bp, Homo sapiens
gcttctgtggttgtcacgacta

SEQ ID NO: 8153783 - DNA, 22 bp, Homo sapiens
gcttctgtggttgtcacgacta

SEQ ID NO: 8153784 - DNA, 19 bp, Homo sapiens
gcttctgtttgggcttaga

SEQ ID NO: 8153785 - DNA, 19 bp, Homo sapiens
gcttctgtttgggcttaga

SEQ ID NO: 8153786 - DNA, 19 bp, Homo sapiens
gcttctgtttgggcttaga

SEQ ID NO: 8153787 - DNA, 22 bp, Homo sapiens
gcttctgttcaaggatataagg

SEQ ID NO: 8153788 - DNA, 22 bp, Homo sapiens
gcttctgttcaaggatataagg

SEQ ID NO: 8153789 - DNA, 19 bp, Homo sapiens
gcttctgtttgggcttaga

SEQ ID NO: 8153790 - DNA, 21 bp, Homo sapiens
gcttctgtatctagcaggaac

SEQ ID NO: 8153791 - DNA, 21 bp, Homo sapiens
gcttctgtatctagcaggaac

SEQ ID NO: 8153792 - DNA, 22 bp, Homo sapiens
gcttctgtatttattgtccttt

SEQ ID NO: 8153793 - DNA, 21 bp, Homo sapiens
gcttctgtatctagcaggaac

SEQ ID NO: 8153794 - DNA, 22 bp, Homo sapiens
gcttctgtcttagctacctccc

SEQ ID NO: 8153795 - DNA, 22 bp, Homo sapiens
gcttctgtcttagctacctccc

SEQ ID NO: 8153796 - DNA, 22 bp, Homo sapiens
gcttctgtatttattgtccttt

SEQ ID NO: 8153797 - DNA, 22 bp, Homo sapiens
gcttctgtcttagctacctccc

SEQ ID NO: 8153798 - DNA, 22 bp, Homo sapiens
gcttctgtgagtgcagatgctg

SEQ ID NO: 8153799 - DNA, 22 bp, Homo sapiens
gcttctgtggattggctggctt

SEQ ID NO: 8153800 - DNA, 22 bp, Homo sapiens
gcttctgtgagtgcagatgctg

SEQ ID NO: 8153801 - DNA, 22 bp, Homo sapiens
gcttctgtggtgaggtcacctt

SEQ ID NO: 8153802 - DNA, 22 bp, Homo sapiens
gcttctgtggtgaggtcacctt

SEQ ID NO: 8153803 - DNA, 22 bp, Homo sapiens
gcttctgtggattggctggctt

SEQ ID NO: 8153804 - DNA, 22 bp, Homo sapiens
gcttctgtggattggctggctt

SEQ ID NO: 8153805 - DNA, 22 bp, Homo sapiens
gctgtgtacctactaactgctt

SEQ ID NO: 8153806 - DNA, 22 bp, Homo sapiens
gctgtgtatcagatgccacggg

SEQ ID NO: 8153807 - DNA, 22 bp, Homo sapiens
gctgtgtatcagatgccacggg

SEQ ID NO: 8153808 - DNA, 22 bp, Homo sapiens
gctgtgtatcagatgccacggg

SEQ ID NO: 8153809 - DNA, 22 bp, Homo sapiens
gctgtgtcctcacacagccttt

SEQ ID NO: 8153810 - DNA, 22 bp, Homo sapiens
gctgtgtgaaaactgggcctgg

SEQ ID NO: 8153811 - DNA, 22 bp, Homo sapiens
gctgtgtgaaaactgggcctgg

SEQ ID NO: 8153812 - DNA, 22 bp, Homo sapiens
gctgtgtcctcacacagccttt

SEQ ID NO: 8153813 - DNA, 22 bp, Homo sapiens
gctgtgtcctcacacagccttt

SEQ ID NO: 8153814 - DNA, 22 bp, Homo sapiens
gctgtgtgaccctagccagtag

SEQ ID NO: 8153815 - DNA, 22 bp, Homo sapiens
gctgtgtgaccctagccagtag

SEQ ID NO: 8153816 - DNA, 22 bp, Homo sapiens
gcttctggtgaggcctcaggaa

SEQ ID NO: 8153817 - DNA, 21 bp, Homo sapiens
gcttctgtatctagcaggaac

SEQ ID NO: 8153818 - DNA, 22 bp, Homo sapiens
gcttgctctttagccatggcca

SEQ ID NO: 8153819 - DNA, 23 bp, Homo sapiens
gcttgcctggtgtgtggctgacc

SEQ ID NO: 8153820 - DNA, 17 bp, Homo sapiens
gcttgccttgtcttcct

SEQ ID NO: 8153821 - DNA, 22 bp, Homo sapiens
gcttgcatgattggagtgggtg

SEQ ID NO: 8153822 - DNA, 20 bp, Homo sapiens
gcttgcccacatctgcactg

SEQ ID NO: 8153823 - DNA, 22 bp, Homo sapiens
gctttatgtaagtccaaaggca

SEQ ID NO: 8153824 - DNA, 22 bp, Homo sapiens
gctttatgtgagtagcactgtc

SEQ ID NO: 8153825 - DNA, 22 bp, Homo sapiens
gctttatgtgagtagcactgtc

SEQ ID NO: 8153826 - DNA, 18 bp, Homo sapiens
gctttatttcttggggaa

SEQ ID NO: 8153827 - DNA, 18 bp, Homo sapiens
gctttatttcttggggaa

SEQ ID NO: 8153828 - DNA, 18 bp, Homo sapiens
gctttatttcttggggaa

SEQ ID NO: 8153829 - DNA, 18 bp, Homo sapiens
gctttatttcttggggaa

SEQ ID NO: 8153830 - DNA, 18 bp, Homo sapiens
gctttatttcttggggaa

SEQ ID NO: 8153831 - DNA, 18 bp, Homo sapiens
gctttatttcttggggaa

SEQ ID NO: 8153832 - DNA, 22 bp, Homo sapiens
gcttgctctttagccatggcca

SEQ ID NO: 8153833 - DNA, 19 bp, Homo sapiens
gcttgctgctaggtaggga

SEQ ID NO: 8153834 - DNA, 19 bp, Homo sapiens
gcttgctggcgggggtctg

SEQ ID NO: 8153835 - DNA, 19 bp, Homo sapiens
gcttgctggcgggggtctg

SEQ ID NO: 8153836 - DNA, 22 bp, Homo sapiens
gcttgctggtgcctgcaggctc

SEQ ID NO: 8153837 - DNA, 19 bp, Homo sapiens
gcttgctttatgaaggggg

SEQ ID NO: 8153838 - DNA, 22 bp, Homo sapiens
gcttgctttgtaaatatctgtg

SEQ ID NO: 8153839 - DNA, 20 bp, Homo sapiens
gcttgctttgtctgatgggc

SEQ ID NO: 8153840 - DNA, 21 bp, Homo sapiens
gctggcttcctgagggctgag

SEQ ID NO: 8153841 - DNA, 22 bp, Homo sapiens
gctggcttccatcagagggtga

SEQ ID NO: 8153842 - DNA, 22 bp, Homo sapiens
gctggctgttggaggtacctgc

SEQ ID NO: 8153843 - DNA, 22 bp, Homo sapiens
gctggctgttggaggtacctgc

SEQ ID NO: 8153844 - DNA, 22 bp, Homo sapiens
gctggcttaatagggatgggct

SEQ ID NO: 8153845 - DNA, 22 bp, Homo sapiens
gctggctgttggaggtacctgc

SEQ ID NO: 8153846 - DNA, 22 bp, Homo sapiens
gctggcttccttctgcagctag

SEQ ID NO: 8153847 - DNA, 22 bp, Homo sapiens
gctggcttccttctgcagctag

SEQ ID NO: 8153848 - DNA, 22 bp, Homo sapiens
gctggcttgatagtttctgctt

SEQ ID NO: 8153849 - DNA, 18 bp, Homo sapiens
gctggcttgctgggtttg

SEQ ID NO: 8153850 - DNA, 22 bp, Homo sapiens
gctggcttgtaataggaatttc

SEQ ID NO: 8153851 - DNA, 22 bp, Homo sapiens
gctggctgtgtttcatctctga

SEQ ID NO: 8153852 - DNA, 22 bp, Homo sapiens
gctggctgtgtttcatctctga

SEQ ID NO: 8153853 - DNA, 22 bp, Homo sapiens
gctggctgttgaataatggcat

SEQ ID NO: 8153854 - DNA, 22 bp, Homo sapiens
gctggctgttgaataatggcat

SEQ ID NO: 8153855 - DNA, 22 bp, Homo sapiens
gctggctgttgaataatggcat

SEQ ID NO: 8153856 - DNA, 22 bp, Homo sapiens
gctggctgtgtttcatctctga

SEQ ID NO: 8153857 - DNA, 22 bp, Homo sapiens
gctggctgtgttccttctgcca

SEQ ID NO: 8153858 - DNA, 22 bp, Homo sapiens
gctggctgtgttccttctgcca

SEQ ID NO: 8153859 - DNA, 22 bp, Homo sapiens
gctggctgtgttccttctgcca

SEQ ID NO: 8153860 - DNA, 22 bp, Homo sapiens
gctggctgtgggctccacgctc

SEQ ID NO: 8153861 - DNA, 22 bp, Homo sapiens
gctggctgtgttccttctgcca

SEQ ID NO: 8153862 - DNA, 21 bp, Homo sapiens
gctggctggctgaccggcctt

SEQ ID NO: 8153863 - DNA, 22 bp, Homo sapiens
gctggctggcgggtgcgtcctc

SEQ ID NO: 8153864 - DNA, 22 bp, Homo sapiens
gctggctggcgggtgcgtcctc

SEQ ID NO: 8153865 - DNA, 21 bp, Homo sapiens
gctggctggctgaccggcctt

SEQ ID NO: 8153866 - DNA, 21 bp, Homo sapiens
gctggctggctgaccggcctt

SEQ ID NO: 8153867 - DNA, 21 bp, Homo sapiens
gctggctggctgaccggcctt

SEQ ID NO: 8153868 - DNA, 22 bp, Homo sapiens
gctggctgtgggctccacgctc

SEQ ID NO: 8153869 - DNA, 22 bp, Homo sapiens
gctggctgtgggctccacgctc

SEQ ID NO: 8153870 - DNA, 22 bp, Homo sapiens
gctggctgtgggctccacgctc

SEQ ID NO: 8153871 - DNA, 22 bp, Homo sapiens
gctggctgtgattttgccaaca

SEQ ID NO: 8153872 - DNA, 22 bp, Homo sapiens
gctggctgtgattttgccaaca

SEQ ID NO: 8153873 - DNA, 22 bp, Homo sapiens
gctggctgtggcttaagcaaac

SEQ ID NO: 8153874 - DNA, 22 bp, Homo sapiens
gctggctgtggcttaagcaaac

SEQ ID NO: 8153875 - DNA, 22 bp, Homo sapiens
gctggctgtggcttaagcaaac

SEQ ID NO: 8153876 - DNA, 21 bp, Homo sapiens
gctggctttcctggatgtgca

SEQ ID NO: 8153877 - DNA, 22 bp, Homo sapiens
gctggctttatggggcttgtgg

SEQ ID NO: 8153878 - DNA, 22 bp, Homo sapiens
gctggctttgtggtctctcctc

SEQ ID NO: 8153879 - DNA, 22 bp, Homo sapiens
gctggctttgtcaagggcagca

SEQ ID NO: 8153880 - DNA, 22 bp, Homo sapiens
gctggctttgtcaagggcagca

SEQ ID NO: 8153881 - DNA, 22 bp, Homo sapiens
gctggctttgcactgggtgcat

SEQ ID NO: 8153882 - DNA, 22 bp, Homo sapiens
gctgggctggccgccgagatcg

SEQ ID NO: 8153883 - DNA, 22 bp, Homo sapiens
gctgggctggaaggccaaggca

SEQ ID NO: 8153884 - DNA, 22 bp, Homo sapiens
gctgggctggaaggccaaggca

SEQ ID NO: 8153885 - DNA, 22 bp, Homo sapiens
gctgggctgtagtttgctgacc

SEQ ID NO: 8153886 - DNA, 22 bp, Homo sapiens
gctgggctggccgccgagatcg

SEQ ID NO: 8153887 - DNA, 22 bp, Homo sapiens
gctgggctgtagtttgctgacc

SEQ ID NO: 8153888 - DNA, 22 bp, Homo sapiens
gctgggctgtagtttgctgacc

SEQ ID NO: 8153889 - DNA, 22 bp, Homo sapiens
gctgggcttcacagagccttta

SEQ ID NO: 8153890 - DNA, 23 bp, Homo sapiens
gctgggcttactctttcagtgag

SEQ ID NO: 8153891 - DNA, 23 bp, Homo sapiens
gctgggcttactctttcagtgag

SEQ ID NO: 8153892 - DNA, 23 bp, Homo sapiens
gctgggcttactctttcagtgag

SEQ ID NO: 8153893 - DNA, 23 bp, Homo sapiens
gctgggcttactctttcagtgag

SEQ ID NO: 8153894 - DNA, 22 bp, Homo sapiens
gctgggcttctcaatgctgcct

SEQ ID NO: 8153895 - DNA, 22 bp, Homo sapiens
gctgggcttcacctccagagtt

SEQ ID NO: 8153896 - DNA, 22 bp, Homo sapiens
gctgggcttcacctccagagtt

SEQ ID NO: 8153897 - DNA, 22 bp, Homo sapiens
gctgggcttcacctccagagtt

SEQ ID NO: 8153898 - DNA, 22 bp, Homo sapiens
gctgggcttcacctccagagtt

SEQ ID NO: 8153899 - DNA, 22 bp, Homo sapiens
gctgggcttcacctccagagtt

SEQ ID NO: 8153900 - DNA, 22 bp, Homo sapiens
gctgggcttcacctccagagtt

SEQ ID NO: 8153901 - DNA, 22 bp, Homo sapiens
gctgggcttcacctccagagtt

SEQ ID NO: 8153902 - DNA, 22 bp, Homo sapiens
gctgggcttcacagagccttta

SEQ ID NO: 8153903 - DNA, 22 bp, Homo sapiens
gctggagagataggcatggggt

SEQ ID NO: 8153904 - DNA, 22 bp, Homo sapiens
gctggagagataggcatggggt

SEQ ID NO: 8153905 - DNA, 22 bp, Homo sapiens
gctggagagataggcatggggt

SEQ ID NO: 8153906 - DNA, 22 bp, Homo sapiens
gctggagagataggcatggggt

SEQ ID NO: 8153907 - DNA, 22 bp, Homo sapiens
gctggagagataggcatggggt

SEQ ID NO: 8153908 - DNA, 22 bp, Homo sapiens
gctggagagataggcatggggt

SEQ ID NO: 8153909 - DNA, 22 bp, Homo sapiens
gctggctgcgtcatcacagggc

SEQ ID NO: 8153910 - DNA, 22 bp, Homo sapiens
gctggctgccttactttgtgga

SEQ ID NO: 8153911 - DNA, 22 bp, Homo sapiens
gctggctgccttactttgtgga

SEQ ID NO: 8153912 - DNA, 22 bp, Homo sapiens
gctggagagataggcatggggt

SEQ ID NO: 8153913 - DNA, 22 bp, Homo sapiens
gctggagagataggcatggggt

SEQ ID NO: 8153914 - DNA, 21 bp, Homo sapiens
gctggagagccaggcaggggc

SEQ ID NO: 8153915 - DNA, 22 bp, Homo sapiens
gctggctgcgtcatcacagggc

SEQ ID NO: 8153916 - DNA, 22 bp, Homo sapiens
gctggctgcgtcatcacagggc

SEQ ID NO: 8153917 - DNA, 22 bp, Homo sapiens
gctggctgctaggacagctaca

SEQ ID NO: 8153918 - DNA, 22 bp, Homo sapiens
gctggctgcgtcatcacagggc

SEQ ID NO: 8153919 - DNA, 22 bp, Homo sapiens
gctggctgcgtcatcacagggc

SEQ ID NO: 8153920 - DNA, 22 bp, Homo sapiens
gctggctgctgttgagacttgt

SEQ ID NO: 8153921 - DNA, 22 bp, Homo sapiens
gctggctgctaggacagctaca

SEQ ID NO: 8153922 - DNA, 22 bp, Homo sapiens
gctggctgctgttgagacttgt

SEQ ID NO: 8153923 - DNA, 22 bp, Homo sapiens
gctggctgctgttgagacttgt

SEQ ID NO: 8153924 - DNA, 22 bp, Homo sapiens
gctggctgctgttgagacttgt

SEQ ID NO: 8153925 - DNA, 22 bp, Homo sapiens
gctggctgctaggacagctaca

SEQ ID NO: 8153926 - DNA, 22 bp, Homo sapiens
gctggagaaactgcagctgagg

SEQ ID NO: 8153927 - DNA, 22 bp, Homo sapiens
gctggagaacccaggaggaaga

SEQ ID NO: 8153928 - DNA, 22 bp, Homo sapiens
gctggagaacccaggaggaaga

SEQ ID NO: 8153929 - DNA, 22 bp, Homo sapiens
gctggagaacccaggaggaaga

SEQ ID NO: 8153930 - DNA, 22 bp, Homo sapiens
gctggagacctcagagaaccca

SEQ ID NO: 8153931 - DNA, 22 bp, Homo sapiens
gctggagaacccaggaggaaga

SEQ ID NO: 8153932 - DNA, 22 bp, Homo sapiens
gctggagaaactgcagctgagg

SEQ ID NO: 8153933 - DNA, 22 bp, Homo sapiens
gctggagaaacaggaggaggaa

SEQ ID NO: 8153934 - DNA, 22 bp, Homo sapiens
gctggagaaactgcagctgagg

SEQ ID NO: 8153935 - DNA, 22 bp, Homo sapiens
gctggagaaactgcagctgagg

SEQ ID NO: 8153936 - DNA, 22 bp, Homo sapiens
gctgctttacaggtgggggagc

SEQ ID NO: 8153937 - DNA, 22 bp, Homo sapiens
gctgctttactgaagagatatg

SEQ ID NO: 8153938 - DNA, 22 bp, Homo sapiens
gctgctttagaattgaaacaga

SEQ ID NO: 8153939 - DNA, 22 bp, Homo sapiens
gctgctttagaattgaaacaga

SEQ ID NO: 8153940 - DNA, 22 bp, Homo sapiens
gctgctttagacaggagaagca

SEQ ID NO: 8153941 - DNA, 22 bp, Homo sapiens
gctgctttaggttgagctcagc

SEQ ID NO: 8153942 - DNA, 20 bp, Homo sapiens
gctgctttcaaatgacacgt

SEQ ID NO: 8153943 - DNA, 22 bp, Homo sapiens
gctgctttataatctcggcaga

SEQ ID NO: 8153944 - DNA, 22 bp, Homo sapiens
gctgctttaggttgagctcagc

SEQ ID NO: 8153945 - DNA, 22 bp, Homo sapiens
gctggagaaacaggaggaggaa

SEQ ID NO: 8153946 - DNA, 19 bp, Homo sapiens
gctggctggaggagggaca

SEQ ID NO: 8153947 - DNA, 19 bp, Homo sapiens
gctggctggaggagggaca

SEQ ID NO: 8153948 - DNA, 19 bp, Homo sapiens
gctggctggaggagggaca

SEQ ID NO: 8153949 - DNA, 22 bp, Homo sapiens
gctggctggaggagggaggttg

SEQ ID NO: 8153950 - DNA, 22 bp, Homo sapiens
gctggctggaggagggaggttg

SEQ ID NO: 8153951 - DNA, 22 bp, Homo sapiens
gctggctggaggtgaggaagaa

SEQ ID NO: 8153952 - DNA, 22 bp, Homo sapiens
gctggctggaggtgaggaagaa

SEQ ID NO: 8153953 - DNA, 22 bp, Homo sapiens
gctggctggaggagggaggttg

SEQ ID NO: 8153954 - DNA, 22 bp, Homo sapiens
gctggctggaggagggaggttg

SEQ ID NO: 8153955 - DNA, 19 bp, Homo sapiens
gctggctggaggagggaca

SEQ ID NO: 8153956 - DNA, 22 bp, Homo sapiens
gctggctggaatgggagaagaa

SEQ ID NO: 8153957 - DNA, 22 bp, Homo sapiens
gctggctggaatgggagaagaa

SEQ ID NO: 8153958 - DNA, 22 bp, Homo sapiens
gctggctggaatgggagaagaa

SEQ ID NO: 8153959 - DNA, 22 bp, Homo sapiens
gctggctggaatgggagaagaa

SEQ ID NO: 8153960 - DNA, 22 bp, Homo sapiens
gctggctggaatgggagaagaa

SEQ ID NO: 8153961 - DNA, 22 bp, Homo sapiens
gctggctggaatgggagaagaa

SEQ ID NO: 8153962 - DNA, 22 bp, Homo sapiens
gctggctggaactagcagttgg

SEQ ID NO: 8153963 - DNA, 22 bp, Homo sapiens
gctggctggaactagcagttgg

SEQ ID NO: 8153964 - DNA, 22 bp, Homo sapiens
gctggctggaactagcagttgg

SEQ ID NO: 8153965 - DNA, 22 bp, Homo sapiens
gctggctggaactagcagttgg

SEQ ID NO: 8153966 - DNA, 22 bp, Homo sapiens
gctggctggaggtgaggaagaa

SEQ ID NO: 8153967 - DNA, 22 bp, Homo sapiens
gctggctggaggtgaggaagaa

SEQ ID NO: 8153968 - DNA, 22 bp, Homo sapiens
gctggctggaggtgaggaagaa

SEQ ID NO: 8153969 - DNA, 22 bp, Homo sapiens
gctggctggagtaaggagggag

SEQ ID NO: 8153970 - DNA, 22 bp, Homo sapiens
gctggctggaggtgaggaagaa

SEQ ID NO: 8153971 - DNA, 22 bp, Homo sapiens
gctggctggagtaaggagggag

SEQ ID NO: 8153972 - DNA, 22 bp, Homo sapiens
gctggctggagtgagctaccct

SEQ ID NO: 8153973 - DNA, 22 bp, Homo sapiens
gctggctggagtgagctaccct

SEQ ID NO: 8153974 - DNA, 22 bp, Homo sapiens
gctggctggagtgagctaccct

SEQ ID NO: 8153975 - DNA, 22 bp, Homo sapiens
gctggctggagtgagctaccct

SEQ ID NO: 8153976 - DNA, 22 bp, Homo sapiens
gctggctggagtaaggagggag

SEQ ID NO: 8153977 - DNA, 22 bp, Homo sapiens
gctggctggagtaaggagggag

SEQ ID NO: 8153978 - DNA, 22 bp, Homo sapiens
gctggctggcgggtgcgtcctc

SEQ ID NO: 8153979 - DNA, 23 bp, Homo sapiens
gctggctggcagtaaaggttgtt

SEQ ID NO: 8153980 - DNA, 23 bp, Homo sapiens
gctggctggcagtaaaggttgtt

SEQ ID NO: 8153981 - DNA, 23 bp, Homo sapiens
gctggctggcagtaaaggttgtt

SEQ ID NO: 8153982 - DNA, 22 bp, Homo sapiens
gctggctggcacgttcgcacgt

SEQ ID NO: 8153983 - DNA, 22 bp, Homo sapiens
gctggctggcgggtgcgtcctc

SEQ ID NO: 8153984 - DNA, 22 bp, Homo sapiens
gctggctggcgggtgcgtcctc

SEQ ID NO: 8153985 - DNA, 23 bp, Homo sapiens
gctggctggcagtaaaggttgtt

SEQ ID NO: 8153986 - DNA, 22 bp, Homo sapiens
gctggctggcacgttcgcacgt

SEQ ID NO: 8153987 - DNA, 22 bp, Homo sapiens
gctggctggcacgttcgcacgt

SEQ ID NO: 8153988 - DNA, 22 bp, Homo sapiens
gctggctggatggttggttcgc

SEQ ID NO: 8153989 - DNA, 22 bp, Homo sapiens
gctggctggcacgttcgcacgt

SEQ ID NO: 8153990 - DNA, 22 bp, Homo sapiens
gctggctggatggttggttcgc

SEQ ID NO: 8153991 - DNA, 22 bp, Homo sapiens
gctggctggatggttggttcgc

SEQ ID NO: 8153992 - DNA, 22 bp, Homo sapiens
gctggctggagtgagctaccct

SEQ ID NO: 8153993 - DNA, 22 bp, Homo sapiens
gctggctggagtgagctaccct

SEQ ID NO: 8153994 - DNA, 22 bp, Homo sapiens
gcatgctgcaccagagcctctc

SEQ ID NO: 8153995 - DNA, 22 bp, Homo sapiens
gcatgctgcaccagagcctctc

SEQ ID NO: 8153996 - DNA, 22 bp, Homo sapiens
gcatgctgcccagggactctct

SEQ ID NO: 8153997 - DNA, 22 bp, Homo sapiens
gcatgctgcccagggactctct

SEQ ID NO: 8153998 - DNA, 22 bp, Homo sapiens
gcatggccaggaaaggtagaaa

SEQ ID NO: 8153999 - DNA, 22 bp, Homo sapiens
gcatggccaggaaaggtagaaa

SEQ ID NO: 8154000 - DNA, 22 bp, Homo sapiens
gcatgctgcaccagagcctctc

SEQ ID NO: 8154001 - DNA, 22 bp, Homo sapiens
gcatgctgcaccagagcctctc

SEQ ID NO: 8154002 - DNA, 22 bp, Homo sapiens
gcatgctgagcccacgcctggg

SEQ ID NO: 8154003 - DNA, 22 bp, Homo sapiens
gcatgcattttctgagagtcag

SEQ ID NO: 8154004 - DNA, 22 bp, Homo sapiens
gcatgcatttgtacttgatttt

SEQ ID NO: 8154005 - DNA, 22 bp, Homo sapiens
gcatgcatctagatatgcagac

SEQ ID NO: 8154006 - DNA, 22 bp, Homo sapiens
gcatgcatctagatatgcagac

SEQ ID NO: 8154007 - DNA, 22 bp, Homo sapiens
gcatgcattacatgggatatgc

SEQ ID NO: 8154008 - DNA, 22 bp, Homo sapiens
gcatgcatttccattctcacat

SEQ ID NO: 8154009 - DNA, 22 bp, Homo sapiens
gcatgcatttcactaggtatgt

SEQ ID NO: 8154010 - DNA, 22 bp, Homo sapiens
gcatgcatggtttgtgactgtg

SEQ ID NO: 8154011 - DNA, 22 bp, Homo sapiens
gcatgcatgtgtgcagacagtc

SEQ ID NO: 8154012 - DNA, 22 bp, Homo sapiens
gcatgcatgatgttggcagtgg

SEQ ID NO: 8154013 - DNA, 22 bp, Homo sapiens
gcatggccttgctgtagtggta

SEQ ID NO: 8154014 - DNA, 20 bp, Homo sapiens
gcatggctaatctgtactga

SEQ ID NO: 8154015 - DNA, 22 bp, Homo sapiens
gcatggctattatgaggcagaa

SEQ ID NO: 8154016 - DNA, 22 bp, Homo sapiens
gcatggccttgtgctccttctc

SEQ ID NO: 8154017 - DNA, 22 bp, Homo sapiens
gcatggctattatgaggcagaa

SEQ ID NO: 8154018 - DNA, 22 bp, Homo sapiens
gcatggccatggcactatggac

SEQ ID NO: 8154019 - DNA, 22 bp, Homo sapiens
gcatggcctccagccaacagca

SEQ ID NO: 8154020 - DNA, 22 bp, Homo sapiens
gcatggcctctgtgcttgttgc

SEQ ID NO: 8154021 - DNA, 22 bp, Homo sapiens
gcatggccttcagggacagctg

SEQ ID NO: 8154022 - DNA, 22 bp, Homo sapiens
gcatggctgtgagcaccctgcc

SEQ ID NO: 8154023 - DNA, 22 bp, Homo sapiens
gcatggctgttgaagtcagctc

SEQ ID NO: 8154024 - DNA, 22 bp, Homo sapiens
gcatggctgttgaagtcagctc

SEQ ID NO: 8154025 - DNA, 22 bp, Homo sapiens
gcatggctgttgaagtcagctc

SEQ ID NO: 8154026 - DNA, 22 bp, Homo sapiens
gcatggcttccaaaagtgctaa

SEQ ID NO: 8154027 - DNA, 22 bp, Homo sapiens
gcatggcttacagaggctgcag

SEQ ID NO: 8154028 - DNA, 22 bp, Homo sapiens
gcatggcttccaaaagtgctaa

SEQ ID NO: 8154029 - DNA, 22 bp, Homo sapiens
gcatggcttacagaggctgcag

SEQ ID NO: 8154030 - DNA, 22 bp, Homo sapiens
gcatggcttacagaggctgcag

SEQ ID NO: 8154031 - DNA, 22 bp, Homo sapiens
gcatggcttacagaggctgcag

SEQ ID NO: 8154032 - DNA, 22 bp, Homo sapiens
gcatggctctggcctcagtgtg

SEQ ID NO: 8154033 - DNA, 22 bp, Homo sapiens
gcatggctctggcctcagtgtg

SEQ ID NO: 8154034 - DNA, 22 bp, Homo sapiens
gcatggctattatgaggcagaa

SEQ ID NO: 8154035 - DNA, 22 bp, Homo sapiens
gcatggctattctaactcacat

SEQ ID NO: 8154036 - DNA, 22 bp, Homo sapiens
gcatggctgctccctggctgca

SEQ ID NO: 8154037 - DNA, 22 bp, Homo sapiens
gcatggctggtgtcctgaggga

SEQ ID NO: 8154038 - DNA, 22 bp, Homo sapiens
gcatggctggtgtcctgaggga

SEQ ID NO: 8154039 - DNA, 22 bp, Homo sapiens
gccaccagcagaaaaggggcca

SEQ ID NO: 8154040 - DNA, 22 bp, Homo sapiens
gccacatgtcatgtgctcagta

SEQ ID NO: 8154041 - DNA, 22 bp, Homo sapiens
gccaccagccccatgcgctgtg

SEQ ID NO: 8154042 - DNA, 22 bp, Homo sapiens
gccacatgtcatgtgctcagta

SEQ ID NO: 8154043 - DNA, 22 bp, Homo sapiens
gccacatgtcatgtgctcagta

SEQ ID NO: 8154044 - DNA, 22 bp, Homo sapiens
gccacatgtcatgtgctcagta

SEQ ID NO: 8154045 - DNA, 22 bp, Homo sapiens
gccacatgcaattgcagcacgt

SEQ ID NO: 8154046 - DNA, 22 bp, Homo sapiens
gccacatgcaattgcagcacgt

SEQ ID NO: 8154047 - DNA, 22 bp, Homo sapiens
gccacatgcaattgcagcacgt

SEQ ID NO: 8154048 - DNA, 22 bp, Homo sapiens
gccacaggcttaggagggaggt

SEQ ID NO: 8154049 - DNA, 22 bp, Homo sapiens
gccacaggcttaggagggaggt

SEQ ID NO: 8154050 - DNA, 22 bp, Homo sapiens
gccacaggcttaggagggaggt

SEQ ID NO: 8154051 - DNA, 22 bp, Homo sapiens
gccacaggcttaggagggaggt

SEQ ID NO: 8154052 - DNA, 22 bp, Homo sapiens
gcatggcttcggggtgctgcct

SEQ ID NO: 8154053 - DNA, 22 bp, Homo sapiens
gccacaggctccagcatcagta

SEQ ID NO: 8154054 - DNA, 22 bp, Homo sapiens
gccacatccttcagaaagcttt

SEQ ID NO: 8154055 - DNA, 22 bp, Homo sapiens
gccacaggcttaggagggaggt

SEQ ID NO: 8154056 - DNA, 22 bp, Homo sapiens
gccacaggcttaggagggaggt

SEQ ID NO: 8154057 - DNA, 22 bp, Homo sapiens
gccaccaggagcccagtccaaa

SEQ ID NO: 8154058 - DNA, 22 bp, Homo sapiens
gccaccagccccatgcgctgtg

SEQ ID NO: 8154059 - DNA, 22 bp, Homo sapiens
gccaccaggagcccagtccaaa

SEQ ID NO: 8154060 - DNA, 22 bp, Homo sapiens
gccaccagggggctccagtgag

SEQ ID NO: 8154061 - DNA, 22 bp, Homo sapiens
gccaccaggagcccagtccaaa

SEQ ID NO: 8154062 - DNA, 22 bp, Homo sapiens
gccaccagggggctccagtgag

SEQ ID NO: 8154063 - DNA, 22 bp, Homo sapiens
gccaccagggggtgcaaggtcc

SEQ ID NO: 8154064 - DNA, 22 bp, Homo sapiens
gccaccagggggtgcaaggtcc

SEQ ID NO: 8154065 - DNA, 22 bp, Homo sapiens
gccaccaggttagatccagcct

SEQ ID NO: 8154066 - DNA, 22 bp, Homo sapiens
gccaccagtgggggcctgggca

SEQ ID NO: 8154067 - DNA, 22 bp, Homo sapiens
gccaccagtgggggcctgggca

SEQ ID NO: 8154068 - DNA, 22 bp, Homo sapiens
gcaggggagtggatgatggatt

SEQ ID NO: 8154069 - DNA, 22 bp, Homo sapiens
gcaggggagtggatgatggatt

SEQ ID NO: 8154070 - DNA, 22 bp, Homo sapiens
gcaggggagtccactctatgca

SEQ ID NO: 8154071 - DNA, 22 bp, Homo sapiens
gcaggggagtggatgatggatt

SEQ ID NO: 8154072 - DNA, 22 bp, Homo sapiens
gcagtgaagccagatctgaaat

SEQ ID NO: 8154073 - DNA, 22 bp, Homo sapiens
gcagtgacagggctgctgcctt

SEQ ID NO: 8154074 - DNA, 22 bp, Homo sapiens
gcagtggaagcctctttaagca

SEQ ID NO: 8154075 - DNA, 22 bp, Homo sapiens
gcagtggaagcctctttaagca

SEQ ID NO: 8154076 - DNA, 22 bp, Homo sapiens
gcagtgattggatcagagatgg

SEQ ID NO: 8154077 - DNA, 22 bp, Homo sapiens
gcagtgagttatgatcatgcca

SEQ ID NO: 8154078 - DNA, 22 bp, Homo sapiens
gcagtggatccaatggtatctt

SEQ ID NO: 8154079 - DNA, 22 bp, Homo sapiens
gcagtggatggccagcaggggc

SEQ ID NO: 8154080 - DNA, 22 bp, Homo sapiens
gcagtggatccaatggtatctt

SEQ ID NO: 8154081 - DNA, 23 bp, Homo sapiens
gcagtggaatgtctctgtttgga

SEQ ID NO: 8154082 - DNA, 17 bp, Homo sapiens
gcagtggaggggtagtt

SEQ ID NO: 8154083 - DNA, 22 bp, Homo sapiens
gcagtggcaccgctggctctgg

SEQ ID NO: 8154084 - DNA, 22 bp, Homo sapiens
gcagtggcaccgctggctctgg

SEQ ID NO: 8154085 - DNA, 22 bp, Homo sapiens
gcagtggcagagacagcaccaa

SEQ ID NO: 8154086 - DNA, 22 bp, Homo sapiens
gcagtggcagctgagggggtat

SEQ ID NO: 8154087 - DNA, 22 bp, Homo sapiens
gcagtggcagctgagggggtat

SEQ ID NO: 8154088 - DNA, 22 bp, Homo sapiens
gcagtggcagagacagcaccaa

SEQ ID NO: 8154089 - DNA, 22 bp, Homo sapiens
gcagtggcagctgagggggtat

SEQ ID NO: 8154090 - DNA, 22 bp, Homo sapiens
gcagtggcatgatgtgggctca

SEQ ID NO: 8154091 - DNA, 22 bp, Homo sapiens
gcagtggcatgatgtgggctca

SEQ ID NO: 8154092 - DNA, 22 bp, Homo sapiens
gcagtgggaaggttggcacatg

SEQ ID NO: 8154093 - DNA, 22 bp, Homo sapiens
gcagtgggaaggttggcacatg

SEQ ID NO: 8154094 - DNA, 22 bp, Homo sapiens
gcagtgggaaggttggcacatg

SEQ ID NO: 8154095 - DNA, 22 bp, Homo sapiens
gcagtggctaggagtctggcgt

SEQ ID NO: 8154096 - DNA, 22 bp, Homo sapiens
gcagtggcccagcttgcaggct

SEQ ID NO: 8154097 - DNA, 22 bp, Homo sapiens
gcagtggctaagctcgcatgca

SEQ ID NO: 8154098 - DNA, 22 bp, Homo sapiens
gcagtggctaggagtctggcgt

SEQ ID NO: 8154099 - DNA, 22 bp, Homo sapiens
gcagtggctaggagtctggcgt

SEQ ID NO: 8154100 - DNA, 22 bp, Homo sapiens
gcagtggctaagctcgcatgca

SEQ ID NO: 8154101 - DNA, 22 bp, Homo sapiens
gcagtggcccagcttgcaggct

SEQ ID NO: 8154102 - DNA, 22 bp, Homo sapiens
gcagtggccacatggaggagga

SEQ ID NO: 8154103 - DNA, 22 bp, Homo sapiens
gcagtggccacatggaggagga

SEQ ID NO: 8154104 - DNA, 22 bp, Homo sapiens
gcagtggccacatggaggagga

SEQ ID NO: 8154105 - DNA, 22 bp, Homo sapiens
gcagtggccacatggaggagga

SEQ ID NO: 8154106 - DNA, 23 bp, Homo sapiens
gcatgcaacttgcagtagtattc

SEQ ID NO: 8154107 - DNA, 22 bp, Homo sapiens
gcagtgggagcttaggcagtgc

SEQ ID NO: 8154108 - DNA, 22 bp, Homo sapiens
gcagtgggagcttaggcagtgc

SEQ ID NO: 8154109 - DNA, 22 bp, Homo sapiens
gcatgcaattatggtattagat

SEQ ID NO: 8154110 - DNA, 22 bp, Homo sapiens
gcatgcactgtatttaagtatc

SEQ ID NO: 8154111 - DNA, 22 bp, Homo sapiens
gcatgcacagtttttcacctca

SEQ ID NO: 8154112 - DNA, 22 bp, Homo sapiens
gcatgcacagtttttcacctca

SEQ ID NO: 8154113 - DNA, 22 bp, Homo sapiens
gcatgcacacctgtgcacattt

SEQ ID NO: 8154114 - DNA, 22 bp, Homo sapiens
gcatgcacacactttctcacta

SEQ ID NO: 8154115 - DNA, 22 bp, Homo sapiens
gcatgcacacactttctcacta

SEQ ID NO: 8154116 - DNA, 19 bp, Homo sapiens
gcatgcagagtaagaaggt

SEQ ID NO: 8154117 - DNA, 22 bp, Homo sapiens
gcatgcaggaagggcttgggga

SEQ ID NO: 8154118 - DNA, 22 bp, Homo sapiens
gcatgcaggaagggcttgggga

SEQ ID NO: 8154119 - DNA, 22 bp, Homo sapiens
gccagggctgtgcaggtttgtt

SEQ ID NO: 8154120 - DNA, 22 bp, Homo sapiens
gccagggctgtgcaggtttgtt

SEQ ID NO: 8154121 - DNA, 22 bp, Homo sapiens
gccagggctgtgcaggtttgtt

SEQ ID NO: 8154122 - DNA, 22 bp, Homo sapiens
gccagggctcgcggtccctcgt

SEQ ID NO: 8154123 - DNA, 22 bp, Homo sapiens
gccagggctcgcggtccctcgt

SEQ ID NO: 8154124 - DNA, 22 bp, Homo sapiens
gccagggagtctgggccacaga

SEQ ID NO: 8154125 - DNA, 22 bp, Homo sapiens
gccagggagtctgggccacaga

SEQ ID NO: 8154126 - DNA, 22 bp, Homo sapiens
gccagggaggctgtagggtcct

SEQ ID NO: 8154127 - DNA, 22 bp, Homo sapiens
gccagggagtctgggccacaga

SEQ ID NO: 8154128 - DNA, 21 bp, Homo sapiens
gccagggagttaaagagtctt

SEQ ID NO: 8154129 - DNA, 22 bp, Homo sapiens
gccagggcaggggagcatctgc

SEQ ID NO: 8154130 - DNA, 22 bp, Homo sapiens
gccagggcaggggagcatctgc

SEQ ID NO: 8154131 - DNA, 22 bp, Homo sapiens
gccagggcaggggagcatctgc

SEQ ID NO: 8154132 - DNA, 21 bp, Homo sapiens
gccagggagttaaagagtctt

SEQ ID NO: 8154133 - DNA, 21 bp, Homo sapiens
gccagggagttaaagagtctt

SEQ ID NO: 8154134 - DNA, 17 bp, Homo sapiens
gccagggagaggaagcc

SEQ ID NO: 8154135 - DNA, 17 bp, Homo sapiens
gccagggagaggaagcc

SEQ ID NO: 8154136 - DNA, 22 bp, Homo sapiens
gccagggaggctgtagggtcct

SEQ ID NO: 8154137 - DNA, 22 bp, Homo sapiens
gccagggaggctgtagggtcct

SEQ ID NO: 8154138 - DNA, 21 bp, Homo sapiens
gccagggaagagagttggctg

SEQ ID NO: 8154139 - DNA, 21 bp, Homo sapiens
gccagggaagagagttggctg

SEQ ID NO: 8154140 - DNA, 17 bp, Homo sapiens
gccagggagaggaagcc

SEQ ID NO: 8154141 - DNA, 22 bp, Homo sapiens
gccaggcatgtcctctgcagaa

SEQ ID NO: 8154142 - DNA, 22 bp, Homo sapiens
gccagggaacccaagggcctca

SEQ ID NO: 8154143 - DNA, 22 bp, Homo sapiens
gccagggaacccaagggcctca

SEQ ID NO: 8154144 - DNA, 22 bp, Homo sapiens
gccagggaacccaagggcctca

SEQ ID NO: 8154145 - DNA, 22 bp, Homo sapiens
gccaggcatgggcttctgggcg

SEQ ID NO: 8154146 - DNA, 22 bp, Homo sapiens
gccaggcatgggcttctgggcg

SEQ ID NO: 8154147 - DNA, 22 bp, Homo sapiens
gccaggcagccaccctctgcga

SEQ ID NO: 8154148 - DNA, 22 bp, Homo sapiens
gccaggcagccaccctctgcga

SEQ ID NO: 8154149 - DNA, 22 bp, Homo sapiens
gccaggcagccaccctctgcga

SEQ ID NO: 8154150 - DNA, 22 bp, Homo sapiens
gccaggcagcaggaagccagtg

SEQ ID NO: 8154151 - DNA, 22 bp, Homo sapiens
gccaggcagcagcgaggatggt

SEQ ID NO: 8154152 - DNA, 22 bp, Homo sapiens
gccaggcagcagcgaggatggt

SEQ ID NO: 8154153 - DNA, 22 bp, Homo sapiens
gccaggcagcagcgaggatggt

SEQ ID NO: 8154154 - DNA, 22 bp, Homo sapiens
gccaggcagatatgtgagctta

SEQ ID NO: 8154155 - DNA, 22 bp, Homo sapiens
gccaggcagatatgtgagctta

SEQ ID NO: 8154156 - DNA, 22 bp, Homo sapiens
gccaggcagcagcgaggatggt

SEQ ID NO: 8154157 - DNA, 22 bp, Homo sapiens
gccaggcagatatgtgagctta

SEQ ID NO: 8154158 - DNA, 22 bp, Homo sapiens
gccaggcagcagcgaggatggt

SEQ ID NO: 8154159 - DNA, 22 bp, Homo sapiens
gccaggcaggtgtcggagccct

SEQ ID NO: 8154160 - DNA, 22 bp, Homo sapiens
gccaggcaggtgtcggagccct

SEQ ID NO: 8154161 - DNA, 22 bp, Homo sapiens
gccaggcaggtgtcggagccct

SEQ ID NO: 8154162 - DNA, 22 bp, Homo sapiens
gccaggcagttcaagtacacca

SEQ ID NO: 8154163 - DNA, 22 bp, Homo sapiens
gccaggcagttcaagtacacca

SEQ ID NO: 8154164 - DNA, 18 bp, Homo sapiens
gccaggcagggtggggaa

SEQ ID NO: 8154165 - DNA, 18 bp, Homo sapiens
gccaggcagggtggggaa

SEQ ID NO: 8154166 - DNA, 18 bp, Homo sapiens
gccaggcagggtggggaa

SEQ ID NO: 8154167 - DNA, 22 bp, Homo sapiens
gccaggcaggccacgctgtgtt

SEQ ID NO: 8154168 - DNA, 22 bp, Homo sapiens
gccaggcaggccacgctgtgtt

SEQ ID NO: 8154169 - DNA, 22 bp, Homo sapiens
gccaggcagctgggagggtgcc

SEQ ID NO: 8154170 - DNA, 22 bp, Homo sapiens
gccaggcagctgggagggtgcc

SEQ ID NO: 8154171 - DNA, 22 bp, Homo sapiens
gccaggcagctagcaacccctg

SEQ ID NO: 8154172 - DNA, 22 bp, Homo sapiens
gccaggcagctagcaacccctg

SEQ ID NO: 8154173 - DNA, 22 bp, Homo sapiens
gccaggcagctagcaacccctg

SEQ ID NO: 8154174 - DNA, 22 bp, Homo sapiens
gccagctgaaatttcagttctg

SEQ ID NO: 8154175 - DNA, 22 bp, Homo sapiens
gccagctgaaatttcagttctg

SEQ ID NO: 8154176 - DNA, 22 bp, Homo sapiens
gccagctgaaatttcagttctg

SEQ ID NO: 8154177 - DNA, 22 bp, Homo sapiens
gccagctgaagccctggtggaa

SEQ ID NO: 8154178 - DNA, 22 bp, Homo sapiens
gccagctgaagccctggtggaa

SEQ ID NO: 8154179 - DNA, 22 bp, Homo sapiens
gccagctgaagccctggtggaa

SEQ ID NO: 8154180 - DNA, 22 bp, Homo sapiens
gccagctgaagccctggtggaa

SEQ ID NO: 8154181 - DNA, 22 bp, Homo sapiens
gccagctgaatttccaactgtt

SEQ ID NO: 8154182 - DNA, 22 bp, Homo sapiens
gccaggcagagccccgtgcagc

SEQ ID NO: 8154183 - DNA, 22 bp, Homo sapiens
gccaggcagagccccgtgcagc

SEQ ID NO: 8154184 - DNA, 22 bp, Homo sapiens
gccaggcagacaggtcatcagg

SEQ ID NO: 8154185 - DNA, 22 bp, Homo sapiens
gccaggcagacaggtcatcagg

SEQ ID NO: 8154186 - DNA, 20 bp, Homo sapiens
gccaggcactgttctcaata

SEQ ID NO: 8154187 - DNA, 22 bp, Homo sapiens
gccaggcactgctctaagccct

SEQ ID NO: 8154188 - DNA, 22 bp, Homo sapiens
gccaggcactgctctaagccct

SEQ ID NO: 8154189 - DNA, 22 bp, Homo sapiens
gccaggcactgctctaagccct

SEQ ID NO: 8154190 - DNA, 22 bp, Homo sapiens
gccagctagaggctgcagtgca

SEQ ID NO: 8154191 - DNA, 22 bp, Homo sapiens
gccagctcagatgcaggaagga

SEQ ID NO: 8154192 - DNA, 22 bp, Homo sapiens
gccagctagctagttgctgggt

SEQ ID NO: 8154193 - DNA, 22 bp, Homo sapiens
gccagctcagatgcaggaagga

SEQ ID NO: 8154194 - DNA, 22 bp, Homo sapiens
gccagctcagatgcaggaagga

SEQ ID NO: 8154195 - DNA, 22 bp, Homo sapiens
gccagctcagtgccaggcccct

SEQ ID NO: 8154196 - DNA, 22 bp, Homo sapiens
gccagctcagtgccaggcccct

SEQ ID NO: 8154197 - DNA, 22 bp, Homo sapiens
gccagctcagtgccaggcccct

SEQ ID NO: 8154198 - DNA, 22 bp, Homo sapiens
gccagctctgtggctgtacttg

SEQ ID NO: 8154199 - DNA, 22 bp, Homo sapiens
gccagctcccaagtgagcccct

SEQ ID NO: 8154200 - DNA, 22 bp, Homo sapiens
gccagctcccaagtgagcccct

SEQ ID NO: 8154201 - DNA, 18 bp, Homo sapiens
gccagccctccaacctcc

SEQ ID NO: 8154202 - DNA, 18 bp, Homo sapiens
gccagccctccaacctcc

SEQ ID NO: 8154203 - DNA, 22 bp, Homo sapiens
gccagccctgggagacttatgg

SEQ ID NO: 8154204 - DNA, 22 bp, Homo sapiens
gccagcctgtgcttggccaggc

SEQ ID NO: 8154205 - DNA, 20 bp, Homo sapiens
gccagccctgacacaggagc

SEQ ID NO: 8154206 - DNA, 20 bp, Homo sapiens
gccagccctgacacaggagc

SEQ ID NO: 8154207 - DNA, 20 bp, Homo sapiens
gccagccctgacacaggagc

SEQ ID NO: 8154208 - DNA, 21 bp, Homo sapiens
gccagcctgtttacctgtggt

SEQ ID NO: 8154209 - DNA, 22 bp, Homo sapiens
gccagcctgtgggggctctgtg

SEQ ID NO: 8154210 - DNA, 22 bp, Homo sapiens
gccagcctgtgggggctctgtg

SEQ ID NO: 8154211 - DNA, 22 bp, Homo sapiens
gccagcctgtgggggctctgtg

SEQ ID NO: 8154212 - DNA, 22 bp, Homo sapiens
gccagcctgtgcttggccaggc

SEQ ID NO: 8154213 - DNA, 22 bp, Homo sapiens
gccagcctgtgcttggccaggc

SEQ ID NO: 8154214 - DNA, 22 bp, Homo sapiens
gccagccttctgtggcctgcaa

SEQ ID NO: 8154215 - DNA, 22 bp, Homo sapiens
gccagccttctgtggcctgcaa

SEQ ID NO: 8154216 - DNA, 21 bp, Homo sapiens
gccagcctgtttacctgtggt

SEQ ID NO: 8154217 - DNA, 23 bp, Homo sapiens
gccagccttgctctcctgcagcc

SEQ ID NO: 8154218 - DNA, 23 bp, Homo sapiens
gccagccttgctctcctgcagcc

SEQ ID NO: 8154219 - DNA, 23 bp, Homo sapiens
gccagccttgctctcctgcagcc

SEQ ID NO: 8154220 - DNA, 23 bp, Homo sapiens
gccagccttgctctcctgcagcc

SEQ ID NO: 8154221 - DNA, 23 bp, Homo sapiens
gccagccttgctctcctgcagcc

SEQ ID NO: 8154222 - DNA, 23 bp, Homo sapiens
gccagccttgctctcctgcagcc

SEQ ID NO: 8154223 - DNA, 22 bp, Homo sapiens
gccccaccttgagagcagaaac

SEQ ID NO: 8154224 - DNA, 22 bp, Homo sapiens
gccccacctgctaccttccagc

SEQ ID NO: 8154225 - DNA, 22 bp, Homo sapiens
gccccaccgagggtgcagtcct

SEQ ID NO: 8154226 - DNA, 22 bp, Homo sapiens
gccccacagcctgcggtctcag

SEQ ID NO: 8154227 - DNA, 22 bp, Homo sapiens
gccccaagtccctatgtttcca

SEQ ID NO: 8154228 - DNA, 16 bp, Homo sapiens
gccccaatgattctga

SEQ ID NO: 8154229 - DNA, 22 bp, Homo sapiens
gcccatggttacttttctggct

SEQ ID NO: 8154230 - DNA, 22 bp, Homo sapiens
gcccatgtgatttcctgggagt

SEQ ID NO: 8154231 - DNA, 22 bp, Homo sapiens
gcccatggtgaggttgttggtg

SEQ ID NO: 8154232 - DNA, 22 bp, Homo sapiens
gcccatggtggcgttcggtgca

SEQ ID NO: 8154233 - DNA, 22 bp, Homo sapiens
gcccatggtgaggttgttggtg

SEQ ID NO: 8154234 - DNA, 22 bp, Homo sapiens
gcccatggtccaggaagacaga

SEQ ID NO: 8154235 - DNA, 22 bp, Homo sapiens
gcccatggtcagggaggcaggg

SEQ ID NO: 8154236 - DNA, 22 bp, Homo sapiens
gcccatggtcagggaggcaggg

SEQ ID NO: 8154237 - DNA, 22 bp, Homo sapiens
gcccatggtcagggaggcaggg

SEQ ID NO: 8154238 - DNA, 22 bp, Homo sapiens
gcccatggtcagggaggcaggg

SEQ ID NO: 8154239 - DNA, 22 bp, Homo sapiens
gcccatgggcctgaggccctag

SEQ ID NO: 8154240 - DNA, 18 bp, Homo sapiens
gcccatggtaaatgctgt

SEQ ID NO: 8154241 - DNA, 22 bp, Homo sapiens
gcccatgggctccagacctggg

SEQ ID NO: 8154242 - DNA, 22 bp, Homo sapiens
gcccatggcagaactgtgagca

SEQ ID NO: 8154243 - DNA, 22 bp, Homo sapiens
gcccatggcttccctaggcaca

SEQ ID NO: 8154244 - DNA, 22 bp, Homo sapiens
gcccatggcagaactgtgagca

SEQ ID NO: 8154245 - DNA, 22 bp, Homo sapiens
gcccatggcagaactgtgagca

SEQ ID NO: 8154246 - DNA, 22 bp, Homo sapiens
gcccaggagcctggagatgtgt

SEQ ID NO: 8154247 - DNA, 22 bp, Homo sapiens
gcccaggagaggccagggctga

SEQ ID NO: 8154248 - DNA, 22 bp, Homo sapiens
gcccaggagaggccagggctga

SEQ ID NO: 8154249 - DNA, 22 bp, Homo sapiens
gcccaggactcagggtgtcgcg

SEQ ID NO: 8154250 - DNA, 22 bp, Homo sapiens
gcccaggactcagggtgtcgcg

SEQ ID NO: 8154251 - DNA, 22 bp, Homo sapiens
gcccaggagaggccagggctga

SEQ ID NO: 8154252 - DNA, 22 bp, Homo sapiens
gcccaggagcctggagatgtgt

SEQ ID NO: 8154253 - DNA, 22 bp, Homo sapiens
gcccaggagcctggagatgtgt

SEQ ID NO: 8154254 - DNA, 22 bp, Homo sapiens
gcccaggagcctggagatgtgt

SEQ ID NO: 8154255 - DNA, 22 bp, Homo sapiens
gcccagctgtctggcagggatg

SEQ ID NO: 8154256 - DNA, 22 bp, Homo sapiens
gcccagctgtctggcagggatg

SEQ ID NO: 8154257 - DNA, 22 bp, Homo sapiens
gcccagctggcttccagcacat

SEQ ID NO: 8154258 - DNA, 22 bp, Homo sapiens
gcccagctggcttccagcacat

SEQ ID NO: 8154259 - DNA, 22 bp, Homo sapiens
gcccagctgtctggcagggatg

SEQ ID NO: 8154260 - DNA, 22 bp, Homo sapiens
gcccagcttttcacttccacac

SEQ ID NO: 8154261 - DNA, 22 bp, Homo sapiens
gcccagctttttgaggcaggca

SEQ ID NO: 8154262 - DNA, 22 bp, Homo sapiens
gcccagctttttgaggcaggca

SEQ ID NO: 8154263 - DNA, 22 bp, Homo sapiens
gcccagctttttgaggcaggca

SEQ ID NO: 8154264 - DNA, 22 bp, Homo sapiens
gcccagctttttgaggcaggca

SEQ ID NO: 8154265 - DNA, 22 bp, Homo sapiens
gcccaggaaagatagggcctca

SEQ ID NO: 8154266 - DNA, 22 bp, Homo sapiens
gcccaggaaagatagggcctca

SEQ ID NO: 8154267 - DNA, 22 bp, Homo sapiens
gcccaggaaagatagggcctca

SEQ ID NO: 8154268 - DNA, 22 bp, Homo sapiens
gcccaggaaagatagggcctca

SEQ ID NO: 8154269 - DNA, 22 bp, Homo sapiens
gcccaggaaatgccccgtggtg

SEQ ID NO: 8154270 - DNA, 22 bp, Homo sapiens
gcccaggaaatgccccgtggtg

SEQ ID NO: 8154271 - DNA, 22 bp, Homo sapiens
gcccaggaaataaaagtgggct

SEQ ID NO: 8154272 - DNA, 22 bp, Homo sapiens
gcccaggaaataaaagtgggct

SEQ ID NO: 8154273 - DNA, 22 bp, Homo sapiens
gcccaggaaataaaagtgggct

SEQ ID NO: 8154274 - DNA, 22 bp, Homo sapiens
gcccaggaagtgactcagatgt

SEQ ID NO: 8154275 - DNA, 22 bp, Homo sapiens
gcccaggaagtgactcagatgt

SEQ ID NO: 8154276 - DNA, 22 bp, Homo sapiens
gcccaggaagtgactcagatgt

SEQ ID NO: 8154277 - DNA, 17 bp, Homo sapiens
gcccaggaaggacggcc

SEQ ID NO: 8154278 - DNA, 17 bp, Homo sapiens
gcccaggaaggacggcc

SEQ ID NO: 8154279 - DNA, 17 bp, Homo sapiens
gcccaggaaggacggcc

SEQ ID NO: 8154280 - DNA, 22 bp, Homo sapiens
gcccaggaaatgccccgtggtg

SEQ ID NO: 8154281 - DNA, 22 bp, Homo sapiens
gcccaggaagccaccgggaagt

SEQ ID NO: 8154282 - DNA, 22 bp, Homo sapiens
gcccaggaagttgaggctgccg

SEQ ID NO: 8154283 - DNA, 22 bp, Homo sapiens
gcccaggaagttgaggctgccg

SEQ ID NO: 8154284 - DNA, 22 bp, Homo sapiens
gcccaggaagttgaggctgccg

SEQ ID NO: 8154285 - DNA, 20 bp, Homo sapiens
gcccaggaatttgcatttct

SEQ ID NO: 8154286 - DNA, 16 bp, Homo sapiens
gcccaggacgggaggc

SEQ ID NO: 8154287 - DNA, 16 bp, Homo sapiens
gcccaggacgggaggc

SEQ ID NO: 8154288 - DNA, 22 bp, Homo sapiens
gccagggtgtgcagggacagga

SEQ ID NO: 8154289 - DNA, 22 bp, Homo sapiens
gccagggtcctgaagaccaagt

SEQ ID NO: 8154290 - DNA, 22 bp, Homo sapiens
gccagggttcgaatccgtatgg

SEQ ID NO: 8154291 - DNA, 22 bp, Homo sapiens
gccagggttcgaatccgtatgg

SEQ ID NO: 8154292 - DNA, 22 bp, Homo sapiens
gccaggggtgcccacccaagga

SEQ ID NO: 8154293 - DNA, 22 bp, Homo sapiens
gccagggtgagggctgagaggt

SEQ ID NO: 8154294 - DNA, 22 bp, Homo sapiens
gccagggtgagggctgagaggt

SEQ ID NO: 8154295 - DNA, 22 bp, Homo sapiens
gccagggtgtgcagggacagga

SEQ ID NO: 8154296 - DNA, 22 bp, Homo sapiens
gccagggtggcagaaggcccca

SEQ ID NO: 8154297 - DNA, 22 bp, Homo sapiens
gccagggggtcagcaggcactt

SEQ ID NO: 8154298 - DNA, 22 bp, Homo sapiens
gccagggggtcagcaggcactt

SEQ ID NO: 8154299 - DNA, 22 bp, Homo sapiens
gccagggggtcagcaggcactt

SEQ ID NO: 8154300 - DNA, 22 bp, Homo sapiens
gccaggggacgcggagcgacga

SEQ ID NO: 8154301 - DNA, 22 bp, Homo sapiens
gccaggggacgcggagcgacga

SEQ ID NO: 8154302 - DNA, 22 bp, Homo sapiens
gccaggggacgcggagcgacga

SEQ ID NO: 8154303 - DNA, 22 bp, Homo sapiens
gccaggggacgcggagcgacga

SEQ ID NO: 8154304 - DNA, 22 bp, Homo sapiens
gcccagcacagctggaagagtc

SEQ ID NO: 8154305 - DNA, 22 bp, Homo sapiens
gcccagcacatctggccttgaa

SEQ ID NO: 8154306 - DNA, 22 bp, Homo sapiens
gcccagcacattgctgaggacc

SEQ ID NO: 8154307 - DNA, 22 bp, Homo sapiens
gcccagcacatctggccttgaa

SEQ ID NO: 8154308 - DNA, 22 bp, Homo sapiens
gcccagcacattgctgaggacc

SEQ ID NO: 8154309 - DNA, 22 bp, Homo sapiens
gcccagcacattgctgaggacc

SEQ ID NO: 8154310 - DNA, 22 bp, Homo sapiens
gcccagcacattgctgaggacc

SEQ ID NO: 8154311 - DNA, 22 bp, Homo sapiens
gcccagcacattgctgaggacc

SEQ ID NO: 8154312 - DNA, 22 bp, Homo sapiens
gcccagcagctggtggagaagg

SEQ ID NO: 8154313 - DNA, 22 bp, Homo sapiens
gcccagccctgaggtcacagct

SEQ ID NO: 8154314 - DNA, 22 bp, Homo sapiens
gcccagcagatctcagtgtctc

SEQ ID NO: 8154315 - DNA, 22 bp, Homo sapiens
gcccagcagatctcagtgtctc

SEQ ID NO: 8154316 - DNA, 22 bp, Homo sapiens
gcccagcagatctcagtgtctc

SEQ ID NO: 8154317 - DNA, 22 bp, Homo sapiens
gcccagcagatctcagtgtctc

SEQ ID NO: 8154318 - DNA, 22 bp, Homo sapiens
gcccagcactcctctctgacat

SEQ ID NO: 8154319 - DNA, 22 bp, Homo sapiens
gcccagcacctctctcagggtt

SEQ ID NO: 8154320 - DNA, 22 bp, Homo sapiens
gcccagccctgaggtcacagct

SEQ ID NO: 8154321 - DNA, 22 bp, Homo sapiens
gcccagctccattcttggtgag

SEQ ID NO: 8154322 - DNA, 22 bp, Homo sapiens
gcccagctgcaccctggtgggt

SEQ ID NO: 8154323 - DNA, 22 bp, Homo sapiens
gcccagctgagaagcgcggggc

SEQ ID NO: 8154324 - DNA, 22 bp, Homo sapiens
gcccagctcctctgcagaccct

SEQ ID NO: 8154325 - DNA, 22 bp, Homo sapiens
gcccagctcctctgcagaccct

SEQ ID NO: 8154326 - DNA, 22 bp, Homo sapiens
gccccagcagcaatgcggttga

SEQ ID NO: 8154327 - DNA, 22 bp, Homo sapiens
gccccagccaaggtgacacgaa

SEQ ID NO: 8154328 - DNA, 22 bp, Homo sapiens
gccccagcctgggaactggagg

SEQ ID NO: 8154329 - DNA, 22 bp, Homo sapiens
gccccagcctcccgagtagctg

SEQ ID NO: 8154330 - DNA, 22 bp, Homo sapiens
gccccagcctcccgagtagctg

SEQ ID NO: 8154331 - DNA, 22 bp, Homo sapiens
gccccagcctcccgagtagctg

SEQ ID NO: 8154332 - DNA, 22 bp, Homo sapiens
gccccagccaaggtgacacgaa

SEQ ID NO: 8154333 - DNA, 22 bp, Homo sapiens
gccccagccaaggtgacacgaa

SEQ ID NO: 8154334 - DNA, 22 bp, Homo sapiens
gccccagccaaggtgacacgaa

SEQ ID NO: 8154335 - DNA, 17 bp, Homo sapiens
gccctggagccaggcta

SEQ ID NO: 8154336 - DNA, 22 bp, Homo sapiens
gccctggagggccagcgactgg

SEQ ID NO: 8154337 - DNA, 22 bp, Homo sapiens
gccccagctctgccacaactag

SEQ ID NO: 8154338 - DNA, 22 bp, Homo sapiens
gccccagctctgccacaactag

SEQ ID NO: 8154339 - DNA, 22 bp, Homo sapiens
gccccagcctgggaactggagg

SEQ ID NO: 8154340 - DNA, 22 bp, Homo sapiens
gccccagcgtggctgtgttagg

SEQ ID NO: 8154341 - DNA, 22 bp, Homo sapiens
gccccaggggaggtgccctgca

SEQ ID NO: 8154342 - DNA, 22 bp, Homo sapiens
gccccaggggaggtgccctgca

SEQ ID NO: 8154343 - DNA, 22 bp, Homo sapiens
gccccaggggaggtgccctgca

SEQ ID NO: 8154344 - DNA, 22 bp, Homo sapiens
gccccaggataaatttgtaaga

SEQ ID NO: 8154345 - DNA, 15 bp, Homo sapiens
gccccaggaatcaaa

SEQ ID NO: 8154346 - DNA, 15 bp, Homo sapiens
gccccaggaatcaaa

SEQ ID NO: 8154347 - DNA, 22 bp, Homo sapiens
gccccaggataaatttgtaaga

SEQ ID NO: 8154348 - DNA, 22 bp, Homo sapiens
gccccaggataaatttgtaaga

SEQ ID NO: 8154349 - DNA, 22 bp, Homo sapiens
gccctgggctccctgctccaca

SEQ ID NO: 8154350 - DNA, 22 bp, Homo sapiens
gccctgtgccagtcacgctgtg

SEQ ID NO: 8154351 - DNA, 22 bp, Homo sapiens
gccctgtgcgactctagaggtt

SEQ ID NO: 8154352 - DNA, 22 bp, Homo sapiens
gccctgtgcgactctagaggtt

SEQ ID NO: 8154353 - DNA, 22 bp, Homo sapiens
gccctgggcaaggttctggcca

SEQ ID NO: 8154354 - DNA, 22 bp, Homo sapiens
gccctgggcaaggttctggcca

SEQ ID NO: 8154355 - DNA, 22 bp, Homo sapiens
gccctgggcaaggttctggcca

SEQ ID NO: 8154356 - DNA, 22 bp, Homo sapiens
gccctgggcaaggttctggcca

SEQ ID NO: 8154357 - DNA, 22 bp, Homo sapiens
gccctgtggacagtgagaagtg

SEQ ID NO: 8154358 - DNA, 22 bp, Homo sapiens
gccctgtgctataggttagggc

SEQ ID NO: 8154359 - DNA, 22 bp, Homo sapiens
gccctgtggattaatgagcagg

SEQ ID NO: 8154360 - DNA, 22 bp, Homo sapiens
gccctgtggacagtgagaagtg

SEQ ID NO: 8154361 - DNA, 22 bp, Homo sapiens
gccctggatgtacaggcatgtt

SEQ ID NO: 8154362 - DNA, 22 bp, Homo sapiens
gccctggatgtacaggcatgtt

SEQ ID NO: 8154363 - DNA, 22 bp, Homo sapiens
gccctggatgtacaggcatgtt

SEQ ID NO: 8154364 - DNA, 22 bp, Homo sapiens
gccctggatggcaggagccatc

SEQ ID NO: 8154365 - DNA, 22 bp, Homo sapiens
gccctggatggcaggagccatc

SEQ ID NO: 8154366 - DNA, 22 bp, Homo sapiens
gccctggccttcatctcagaca

SEQ ID NO: 8154367 - DNA, 22 bp, Homo sapiens
gccctggccttcatctcagaca

SEQ ID NO: 8154368 - DNA, 22 bp, Homo sapiens
gccctgggattgggtggaggct

SEQ ID NO: 8154369 - DNA, 22 bp, Homo sapiens
gccctgggattgggtggaggct

SEQ ID NO: 8154370 - DNA, 22 bp, Homo sapiens
gccctgggattgggtggaggct

SEQ ID NO: 8154371 - DNA, 22 bp, Homo sapiens
gccctgggattgggtggaggct

SEQ ID NO: 8154372 - DNA, 22 bp, Homo sapiens
gccctgggattgggtggaggct

SEQ ID NO: 8154373 - DNA, 22 bp, Homo sapiens
gcctcctcacaatgtacccacg

SEQ ID NO: 8154374 - DNA, 22 bp, Homo sapiens
gcctcctccttcccgagggtct

SEQ ID NO: 8154375 - DNA, 22 bp, Homo sapiens
gcctcctccttcccgagggtct

SEQ ID NO: 8154376 - DNA, 22 bp, Homo sapiens
gcctcctccttcccgagggtct

SEQ ID NO: 8154377 - DNA, 23 bp, Homo sapiens
gcctcctagcagtaaacatgtta

SEQ ID NO: 8154378 - DNA, 22 bp, Homo sapiens
gcctcctcacaatgtacccacg

SEQ ID NO: 8154379 - DNA, 22 bp, Homo sapiens
gcctcctattaaaatttacctt

SEQ ID NO: 8154380 - DNA, 22 bp, Homo sapiens
gcctcctgacttacactgagct

SEQ ID NO: 8154381 - DNA, 22 bp, Homo sapiens
gcctcctgaagtgctgggatta

SEQ ID NO: 8154382 - DNA, 22 bp, Homo sapiens
gcctcctgaagtgctgggatta

SEQ ID NO: 8154383 - DNA, 22 bp, Homo sapiens
gcctcctcttgagggtcaggga

SEQ ID NO: 8154384 - DNA, 22 bp, Homo sapiens
gcctcctcttgagggtcaggga

SEQ ID NO: 8154385 - DNA, 22 bp, Homo sapiens
gcctcctgaaaggaagagctcc

SEQ ID NO: 8154386 - DNA, 22 bp, Homo sapiens
gcctcctgaaaggaagagctcc

SEQ ID NO: 8154387 - DNA, 22 bp, Homo sapiens
gcctccggagttgcagtgtctt

SEQ ID NO: 8154388 - DNA, 22 bp, Homo sapiens
gcctccggagttgcagtgtctt

SEQ ID NO: 8154389 - DNA, 22 bp, Homo sapiens
gcctccggagttgcagtgtctt

SEQ ID NO: 8154390 - DNA, 22 bp, Homo sapiens
gcctccggagtcacagtgtctt

SEQ ID NO: 8154391 - DNA, 22 bp, Homo sapiens
gcctccggagtcacagtgtctt

SEQ ID NO: 8154392 - DNA, 22 bp, Homo sapiens
gcctccggagtcacagtgtctt

SEQ ID NO: 8154393 - DNA, 22 bp, Homo sapiens
gccctgtgtgatctgctgttag

SEQ ID NO: 8154394 - DNA, 22 bp, Homo sapiens
gccctgtgtatcccctgtgctt

SEQ ID NO: 8154395 - DNA, 22 bp, Homo sapiens
gcctcctggaagtcacatgttt

SEQ ID NO: 8154396 - DNA, 22 bp, Homo sapiens
gcctcctggaagtcacatgttt

SEQ ID NO: 8154397 - DNA, 22 bp, Homo sapiens
gcctcctgcccagatgagtgat

SEQ ID NO: 8154398 - DNA, 22 bp, Homo sapiens
gcctcctgcccagatgagtgat

SEQ ID NO: 8154399 - DNA, 22 bp, Homo sapiens
gcctcctggattttagtgccat

SEQ ID NO: 8154400 - DNA, 22 bp, Homo sapiens
gcctcctggattttagtgccat

SEQ ID NO: 8154401 - DNA, 22 bp, Homo sapiens
gcctcctggcctttgctcctca

SEQ ID NO: 8154402 - DNA, 22 bp, Homo sapiens
gcctcctggcctttgctcctca

SEQ ID NO: 8154403 - DNA, 22 bp, Homo sapiens
gcctcctgagaagccacaggct

SEQ ID NO: 8154404 - DNA, 22 bp, Homo sapiens
gcctcctgagaagccacaggct

SEQ ID NO: 8154405 - DNA, 22 bp, Homo sapiens
gcctcctgagaagccacaggct

SEQ ID NO: 8154406 - DNA, 22 bp, Homo sapiens
gcctcctgacttacactgagct

SEQ ID NO: 8154407 - DNA, 22 bp, Homo sapiens
gcctcctgacttacactgagct

SEQ ID NO: 8154408 - DNA, 22 bp, Homo sapiens
gcctcctgagtagctgggattg

SEQ ID NO: 8154409 - DNA, 22 bp, Homo sapiens
gcctcctgagtagctgggattg

SEQ ID NO: 8154410 - DNA, 22 bp, Homo sapiens
gcctcctgagaagccacaggct

SEQ ID NO: 8154411 - DNA, 22 bp, Homo sapiens
gcctctgggctctgcccctggc

SEQ ID NO: 8154412 - DNA, 22 bp, Homo sapiens
gcctctgggctctgcccctggc

SEQ ID NO: 8154413 - DNA, 22 bp, Homo sapiens
gcctctgggctctgcccctggc

SEQ ID NO: 8154414 - DNA, 22 bp, Homo sapiens
gcctctggcttctgcatcagtg

SEQ ID NO: 8154415 - DNA, 22 bp, Homo sapiens
gcctctgggctctgcccctggc

SEQ ID NO: 8154416 - DNA, 22 bp, Homo sapiens
gcctctggagtcgcagcgtctt

SEQ ID NO: 8154417 - DNA, 22 bp, Homo sapiens
gcctctggcttctgcatcagtg

SEQ ID NO: 8154418 - DNA, 22 bp, Homo sapiens
gcctctggagttgcttgtaaat

SEQ ID NO: 8154419 - DNA, 22 bp, Homo sapiens
gcctctggcttctgcatcagtg

SEQ ID NO: 8154420 - DNA, 22 bp, Homo sapiens
gcctcctgggttcatgccattc

SEQ ID NO: 8154421 - DNA, 22 bp, Homo sapiens
gcctcctgggttcatgccattc

SEQ ID NO: 8154422 - DNA, 22 bp, Homo sapiens
gcctcctggttgcttctccaac

SEQ ID NO: 8154423 - DNA, 22 bp, Homo sapiens
gcctcctggttgcttctccaac

SEQ ID NO: 8154424 - DNA, 22 bp, Homo sapiens
gcctctggagtcgcagcgtctt

SEQ ID NO: 8154425 - DNA, 22 bp, Homo sapiens
gcctcctggggtgccatcatct

SEQ ID NO: 8154426 - DNA, 22 bp, Homo sapiens
gcctcctggggtgccatcatct

SEQ ID NO: 8154427 - DNA, 22 bp, Homo sapiens
gcctcctggcctttgctcctca

SEQ ID NO: 8154428 - DNA, 21 bp, Homo sapiens
gcagggacaaagcttcaggag

SEQ ID NO: 8154429 - DNA, 21 bp, Homo sapiens
gcagggacaaagcttcaggag

SEQ ID NO: 8154430 - DNA, 22 bp, Homo sapiens
gcagggacaactgtgcacctga

SEQ ID NO: 8154431 - DNA, 22 bp, Homo sapiens
gcagggacaactgtgcacctga

SEQ ID NO: 8154432 - DNA, 22 bp, Homo sapiens
gcagggaaggggcatgctggag

SEQ ID NO: 8154433 - DNA, 22 bp, Homo sapiens
gcagggaaggggcatgctggag

SEQ ID NO: 8154434 - DNA, 22 bp, Homo sapiens
gcagggaagtttgatctttttc

SEQ ID NO: 8154435 - DNA, 22 bp, Homo sapiens
gcagggaagttgtaatgtaatg

SEQ ID NO: 8154436 - DNA, 22 bp, Homo sapiens
gcagggaagggaaacagagacc

SEQ ID NO: 8154437 - DNA, 22 bp, Homo sapiens
gcagggaagatcttggagctgc

SEQ ID NO: 8154438 - DNA, 22 bp, Homo sapiens
gcagggaagggaaacagagacc

SEQ ID NO: 8154439 - DNA, 22 bp, Homo sapiens
gcagggaaggggacggaaccag

SEQ ID NO: 8154440 - DNA, 22 bp, Homo sapiens
gcagggaagacccggagcagcg

SEQ ID NO: 8154441 - DNA, 22 bp, Homo sapiens
gcagggaagacccggagcagcg

SEQ ID NO: 8154442 - DNA, 22 bp, Homo sapiens
gcagggaagacccggagcagcg

SEQ ID NO: 8154443 - DNA, 22 bp, Homo sapiens
gcagggaagatcttggagctgc

SEQ ID NO: 8154444 - DNA, 22 bp, Homo sapiens
gcagggaagatcttggagctgc

SEQ ID NO: 8154445 - DNA, 22 bp, Homo sapiens
gcaggcaggtggcatcttgtga

SEQ ID NO: 8154446 - DNA, 22 bp, Homo sapiens
gcaggcagtcatctttcatatt

SEQ ID NO: 8154447 - DNA, 22 bp, Homo sapiens
gcaggcagtcatctttcatatt

SEQ ID NO: 8154448 - DNA, 22 bp, Homo sapiens
gcaggcagtcatctttcatatt

SEQ ID NO: 8154449 - DNA, 19 bp, Homo sapiens
gcaggcagtggcattcgga

SEQ ID NO: 8154450 - DNA, 22 bp, Homo sapiens
gcaggcagtcatctttcatatt

SEQ ID NO: 8154451 - DNA, 19 bp, Homo sapiens
gcaggcagtggcattcgga

SEQ ID NO: 8154452 - DNA, 22 bp, Homo sapiens
gcaggcagttatttagtagaat

SEQ ID NO: 8154453 - DNA, 19 bp, Homo sapiens
gcaggcagtggcattcgga

SEQ ID NO: 8154454 - DNA, 19 bp, Homo sapiens
gcaggcagtggcattcgga

SEQ ID NO: 8154455 - DNA, 22 bp, Homo sapiens
gcaggcagttgcagttttctag

SEQ ID NO: 8154456 - DNA, 22 bp, Homo sapiens
gcaggcagttgcagttttctag

SEQ ID NO: 8154457 - DNA, 22 bp, Homo sapiens
gcaggcagttgcagttttctag

SEQ ID NO: 8154458 - DNA, 22 bp, Homo sapiens
gcaggcagttgcagttttctag

SEQ ID NO: 8154459 - DNA, 22 bp, Homo sapiens
gcagggaagacccggagcagcg

SEQ ID NO: 8154460 - DNA, 22 bp, Homo sapiens
gcaggcagttatttagtagaat

SEQ ID NO: 8154461 - DNA, 22 bp, Homo sapiens
gcaggcagttatttagtagaat

SEQ ID NO: 8154462 - DNA, 22 bp, Homo sapiens
gcaggcagttatttagtagaat

SEQ ID NO: 8154463 - DNA, 22 bp, Homo sapiens
gcaggcagttatttagtagaat

SEQ ID NO: 8154464 - DNA, 14 bp, Homo sapiens
gcaggcagatcact

SEQ ID NO: 8154465 - DNA, 22 bp, Homo sapiens
gcaggcagatcacctgtcagga

SEQ ID NO: 8154466 - DNA, 22 bp, Homo sapiens
gcaggcagatcacctgtcagga

SEQ ID NO: 8154467 - DNA, 22 bp, Homo sapiens
gcaggcagatcacctgtcagga

SEQ ID NO: 8154468 - DNA, 22 bp, Homo sapiens
gcaggcagatcacctgtcagga

SEQ ID NO: 8154469 - DNA, 22 bp, Homo sapiens
gcaggcagatcacctgtcagga

SEQ ID NO: 8154470 - DNA, 22 bp, Homo sapiens
gcaggcagatcacctgtcagga

SEQ ID NO: 8154471 - DNA, 22 bp, Homo sapiens
gcaggcagatcacctgtcagga

SEQ ID NO: 8154472 - DNA, 22 bp, Homo sapiens
gcaggcagccacgattcccttg

SEQ ID NO: 8154473 - DNA, 22 bp, Homo sapiens
gcaggcagccacgattcccttg

SEQ ID NO: 8154474 - DNA, 14 bp, Homo sapiens
gcaggcagatcatt

SEQ ID NO: 8154475 - DNA, 19 bp, Homo sapiens
gcaggcagctggggtatcc

SEQ ID NO: 8154476 - DNA, 19 bp, Homo sapiens
gcaggcagctggggtatcc

SEQ ID NO: 8154477 - DNA, 19 bp, Homo sapiens
gcaggcagctggggtatcc

SEQ ID NO: 8154478 - DNA, 19 bp, Homo sapiens
gcaggcagctggggtatcc

SEQ ID NO: 8154479 - DNA, 19 bp, Homo sapiens
gcaggcagctggggtatcc

SEQ ID NO: 8154480 - DNA, 22 bp, Homo sapiens
gcaggcaggtggcatcttgtga

SEQ ID NO: 8154481 - DNA, 22 bp, Homo sapiens
gcaggcaggtggcatcttgtga

SEQ ID NO: 8154482 - DNA, 22 bp, Homo sapiens
gcaggcagagtcaatttgatcc

SEQ ID NO: 8154483 - DNA, 22 bp, Homo sapiens
gcaggcagagtcaatttgatcc

SEQ ID NO: 8154484 - DNA, 22 bp, Homo sapiens
gcaggcagagtcaatttgatcc

SEQ ID NO: 8154485 - DNA, 16 bp, Homo sapiens
gcaggcagatcacatg

SEQ ID NO: 8154486 - DNA, 22 bp, Homo sapiens
gcaggcagatcacctgtcagga

SEQ ID NO: 8154487 - DNA, 22 bp, Homo sapiens
gcaggcagatcacctgtcagga

SEQ ID NO: 8154488 - DNA, 15 bp, Homo sapiens
gcaggcagatcaccg

SEQ ID NO: 8154489 - DNA, 14 bp, Homo sapiens
gcaggcagatcacc

SEQ ID NO: 8154490 - DNA, 16 bp, Homo sapiens
gcaggcagatcacatg

SEQ ID NO: 8154491 - DNA, 16 bp, Homo sapiens
gcaggcagatcacatg

SEQ ID NO: 8154492 - DNA, 22 bp, Homo sapiens
gcaggcagaggtggaggagaca

SEQ ID NO: 8154493 - DNA, 22 bp, Homo sapiens
gcaggcagaggtggaggagaca

SEQ ID NO: 8154494 - DNA, 22 bp, Homo sapiens
gcaggacacagatgcaaggcca

SEQ ID NO: 8154495 - DNA, 22 bp, Homo sapiens
gcaggacacagatgcaaggcca

SEQ ID NO: 8154496 - DNA, 22 bp, Homo sapiens
gcaggcagaggtggaggagaca

SEQ ID NO: 8154497 - DNA, 16 bp, Homo sapiens
gcaggacactcagaca

SEQ ID NO: 8154498 - DNA, 22 bp, Homo sapiens
gcagggacctgccactgctgtc

SEQ ID NO: 8154499 - DNA, 22 bp, Homo sapiens
gcagggacctcactacccccag

SEQ ID NO: 8154500 - DNA, 22 bp, Homo sapiens
gcagggctgaaggtcccaggcc

SEQ ID NO: 8154501 - DNA, 22 bp, Homo sapiens
gcagggctgaaggtcccaggcc

SEQ ID NO: 8154502 - DNA, 22 bp, Homo sapiens
gcagggctctgctgtagtccta

SEQ ID NO: 8154503 - DNA, 22 bp, Homo sapiens
gcagggacctgccactgctgtc

SEQ ID NO: 8154504 - DNA, 22 bp, Homo sapiens
gcagggctctgctgtagtccta

SEQ ID NO: 8154505 - DNA, 22 bp, Homo sapiens
gcagggctctgctgtagtccta

SEQ ID NO: 8154506 - DNA, 22 bp, Homo sapiens
gcagggaccaaaagaggcagta

SEQ ID NO: 8154507 - DNA, 22 bp, Homo sapiens
gcagggaccaaaagaggcagta

SEQ ID NO: 8154508 - DNA, 22 bp, Homo sapiens
gcagggaccaaaagaggcagta

SEQ ID NO: 8154509 - DNA, 22 bp, Homo sapiens
gcagggacctatgacgatggaa

SEQ ID NO: 8154510 - DNA, 21 bp, Homo sapiens
gcagggaccgcgacttctggg

SEQ ID NO: 8154511 - DNA, 21 bp, Homo sapiens
gcagggaccgcgacttctggg

SEQ ID NO: 8154512 - DNA, 22 bp, Homo sapiens
gcagggaccagggccagatcca

SEQ ID NO: 8154513 - DNA, 22 bp, Homo sapiens
gcagggacaactgtgcacctga

SEQ ID NO: 8154514 - DNA, 22 bp, Homo sapiens
gcagggacaaggcaggtgttct

SEQ ID NO: 8154515 - DNA, 22 bp, Homo sapiens
gcagggacaaggcaggtgttct

SEQ ID NO: 8154516 - DNA, 22 bp, Homo sapiens
gcagggacaaggcaggtgttct

SEQ ID NO: 8154517 - DNA, 22 bp, Homo sapiens
gcagggacaaggcaggtgttct

SEQ ID NO: 8154518 - DNA, 18 bp, Homo sapiens
gcagggacacagggtcac

SEQ ID NO: 8154519 - DNA, 22 bp, Homo sapiens
gcagggacacctttgtgaagct

SEQ ID NO: 8154520 - DNA, 22 bp, Homo sapiens
gcagggacacctttgtgaagct

SEQ ID NO: 8154521 - DNA, 22 bp, Homo sapiens
gcagggacagggcagggccttt

SEQ ID NO: 8154522 - DNA, 22 bp, Homo sapiens
gcagggacagggcagggccttt

SEQ ID NO: 8154523 - DNA, 22 bp, Homo sapiens
gcagggacagggcagggccttt

SEQ ID NO: 8154524 - DNA, 22 bp, Homo sapiens
gcagggacatcttcagatcact

SEQ ID NO: 8154525 - DNA, 22 bp, Homo sapiens
gcagggacatctttgtctagta

SEQ ID NO: 8154526 - DNA, 22 bp, Homo sapiens
gcagggacatctttgtctagta

SEQ ID NO: 8154527 - DNA, 22 bp, Homo sapiens
gcagggaccaaaagaggcagta

SEQ ID NO: 8154528 - DNA, 22 bp, Homo sapiens
gcagggcttgcagcagctagac

SEQ ID NO: 8154529 - DNA, 22 bp, Homo sapiens
gcagggcttgcagcagctagac

SEQ ID NO: 8154530 - DNA, 22 bp, Homo sapiens
gcagggctttttgaaacatggt

SEQ ID NO: 8154531 - DNA, 22 bp, Homo sapiens
gcaggggagtccactctatgca

SEQ ID NO: 8154532 - DNA, 22 bp, Homo sapiens
gcagggcttagaaatggtggct

SEQ ID NO: 8154533 - DNA, 22 bp, Homo sapiens
gcagggcttagaaatggtggct

SEQ ID NO: 8154534 - DNA, 22 bp, Homo sapiens
gcagggcttagaaatggtggct

SEQ ID NO: 8154535 - DNA, 22 bp, Homo sapiens
gcagggcttgcagcagctagac

SEQ ID NO: 8154536 - DNA, 22 bp, Homo sapiens
gcagggcttgcagcagctagac

SEQ ID NO: 8154537 - DNA, 22 bp, Homo sapiens
gcagggctgttcaggagggtgg

SEQ ID NO: 8154538 - DNA, 22 bp, Homo sapiens
gcagggctgttcaggagggtgg

SEQ ID NO: 8154539 - DNA, 22 bp, Homo sapiens
gcagggctgttcaggagggtgg

SEQ ID NO: 8154540 - DNA, 22 bp, Homo sapiens
gcagggctgttcaggagggtgg

SEQ ID NO: 8154541 - DNA, 22 bp, Homo sapiens
gcagggctgtggacactttggt

SEQ ID NO: 8154542 - DNA, 22 bp, Homo sapiens
gcagggctgttcaggagggtgg

SEQ ID NO: 8154543 - DNA, 22 bp, Homo sapiens
gcagggctgttcaggagggtgg

SEQ ID NO: 8154544 - DNA, 22 bp, Homo sapiens
gcagggctgtttagtgaatagg

SEQ ID NO: 8154545 - DNA, 22 bp, Homo sapiens
gcagggcttagaaatggtggct

SEQ ID NO: 8154546 - DNA, 22 bp, Homo sapiens
gcagggctgttcaggagggtgg

SEQ ID NO: 8154547 - DNA, 22 bp, Homo sapiens
gcagggctgttcaggagggtgg

SEQ ID NO: 8154548 - DNA, 22 bp, Homo sapiens
gcagggctgtggacactttggt

SEQ ID NO: 8154549 - DNA, 22 bp, Homo sapiens
gcagggctgtggacactttggt

SEQ ID NO: 8154550 - DNA, 22 bp, Homo sapiens
gcagggctgtggacactttggt

SEQ ID NO: 8154551 - DNA, 22 bp, Homo sapiens
gcagggctgtaatttgagcctg

SEQ ID NO: 8154552 - DNA, 22 bp, Homo sapiens
gcagggctgtaatttgagcctg

SEQ ID NO: 8154553 - DNA, 22 bp, Homo sapiens
gcagggctgtaatttgagcctg

SEQ ID NO: 8154554 - DNA, 22 bp, Homo sapiens
gcagggctgggtgggagacaga

SEQ ID NO: 8154555 - DNA, 22 bp, Homo sapiens
gcagggctgggtgggagacaga

SEQ ID NO: 8154556 - DNA, 22 bp, Homo sapiens
gcagggctgggtgggagacaga

SEQ ID NO: 8154557 - DNA, 22 bp, Homo sapiens
gcagggctgggtgggagacaga

SEQ ID NO: 8154558 - DNA, 22 bp, Homo sapiens
gcagggctgggtgggagacaga

SEQ ID NO: 8154559 - DNA, 22 bp, Homo sapiens
gcagggctgaaggtcccaggcc

SEQ ID NO: 8154560 - DNA, 22 bp, Homo sapiens
gcagggctgaaggtcccaggcc

SEQ ID NO: 8154561 - DNA, 22 bp, Homo sapiens
gcagggctgaaggtcccaggcc

SEQ ID NO: 8154562 - DNA, 22 bp, Homo sapiens
gcagggctgactcagccaccct

SEQ ID NO: 8154563 - DNA, 22 bp, Homo sapiens
gcagggctggggctgctcctga

SEQ ID NO: 8154564 - DNA, 22 bp, Homo sapiens
gcagggctggggctgctcctga

SEQ ID NO: 8154565 - DNA, 22 bp, Homo sapiens
gcagggctggggctgctcctga

SEQ ID NO: 8154566 - DNA, 22 bp, Homo sapiens
gcagggctgggtcctgtctcat

SEQ ID NO: 8154567 - DNA, 22 bp, Homo sapiens
gcagggctgggtcctgtctcat

SEQ ID NO: 8154568 - DNA, 22 bp, Homo sapiens
gcagggctgggtcctgtctcat

SEQ ID NO: 8154569 - DNA, 22 bp, Homo sapiens
gcagggctggggctgctcctga

SEQ ID NO: 8154570 - DNA, 22 bp, Homo sapiens
gcagggctgggtcctgtctcat

SEQ ID NO: 8154571 - DNA, 22 bp, Homo sapiens
gcagatggcagcccaggctggg

SEQ ID NO: 8154572 - DNA, 22 bp, Homo sapiens
gcagatggcagcccaggctggg

SEQ ID NO: 8154573 - DNA, 22 bp, Homo sapiens
gcagatggatcacctgaggtcg

SEQ ID NO: 8154574 - DNA, 22 bp, Homo sapiens
gcagatggagacgaggttccgc

SEQ ID NO: 8154575 - DNA, 22 bp, Homo sapiens
gcagatggagataaatggaact

SEQ ID NO: 8154576 - DNA, 22 bp, Homo sapiens
gcagatggatcacctgaggtcg

SEQ ID NO: 8154577 - DNA, 22 bp, Homo sapiens
gcagatggcgcagtggaagttc

SEQ ID NO: 8154578 - DNA, 22 bp, Homo sapiens
gcagatggcgcagtggaagttc

SEQ ID NO: 8154579 - DNA, 23 bp, Homo sapiens
gcagatggccccagagtgctgcc

SEQ ID NO: 8154580 - DNA, 22 bp, Homo sapiens
gcagatggcagcccaggctggg

SEQ ID NO: 8154581 - DNA, 21 bp, Homo sapiens
gcagatgggagtcatcaggct

SEQ ID NO: 8154582 - DNA, 22 bp, Homo sapiens
gcagatgggagccccaggggag

SEQ ID NO: 8154583 - DNA, 21 bp, Homo sapiens
gcagatgggaagagacgaggc

SEQ ID NO: 8154584 - DNA, 22 bp, Homo sapiens
gcagatggctgagcctgcagat

SEQ ID NO: 8154585 - DNA, 22 bp, Homo sapiens
gcagatggctcagacactgggg

SEQ ID NO: 8154586 - DNA, 22 bp, Homo sapiens
gcagatggctcagacactgggg

SEQ ID NO: 8154587 - DNA, 22 bp, Homo sapiens
gcagatggtggggcaggaaaat

SEQ ID NO: 8154588 - DNA, 22 bp, Homo sapiens
gcagatggtggaggcaagaggc

SEQ ID NO: 8154589 - DNA, 22 bp, Homo sapiens
gcagatggtgccatgtcttgtg

SEQ ID NO: 8154590 - DNA, 21 bp, Homo sapiens
gcagatgggagtcatcaggct

SEQ ID NO: 8154591 - DNA, 22 bp, Homo sapiens
gcagatgtctgtgcctgcaggg

SEQ ID NO: 8154592 - DNA, 22 bp, Homo sapiens
gcagatggtgggggaggagtac

SEQ ID NO: 8154593 - DNA, 22 bp, Homo sapiens
gcagcccaggaccctggacaga

SEQ ID NO: 8154594 - DNA, 22 bp, Homo sapiens
gcagcccagagcgcaggacccc

SEQ ID NO: 8154595 - DNA, 22 bp, Homo sapiens
gcagcccagagcgcaggacccc

SEQ ID NO: 8154596 - DNA, 22 bp, Homo sapiens
gcagcccaggtctctctcactc

SEQ ID NO: 8154597 - DNA, 22 bp, Homo sapiens
gcagcccaggaccctggacaga

SEQ ID NO: 8154598 - DNA, 22 bp, Homo sapiens
gcagcccaggagcaggcgaccc

SEQ ID NO: 8154599 - DNA, 18 bp, Homo sapiens
gcagcccctcttccttcc

SEQ ID NO: 8154600 - DNA, 22 bp, Homo sapiens
gcagccctaacctgtcatagtg

SEQ ID NO: 8154601 - DNA, 22 bp, Homo sapiens
gcagccctaacctgtcatagtg

SEQ ID NO: 8154602 - DNA, 22 bp, Homo sapiens
gcagccctaacctgtcatagtg

SEQ ID NO: 8154603 - DNA, 22 bp, Homo sapiens
gcagccctagcgacaaattgat

SEQ ID NO: 8154604 - DNA, 18 bp, Homo sapiens
gcagcccctcttccttcc

SEQ ID NO: 8154605 - DNA, 18 bp, Homo sapiens
gcagcccctcttccttcc

SEQ ID NO: 8154606 - DNA, 18 bp, Homo sapiens
gcagcccctcttccttcc

SEQ ID NO: 8154607 - DNA, 22 bp, Homo sapiens
gcagccccaggagacgcccagg

SEQ ID NO: 8154608 - DNA, 22 bp, Homo sapiens
gcagccctcgctagctctcccc

SEQ ID NO: 8154609 - DNA, 22 bp, Homo sapiens
gcagccctcgctagctctcccc

SEQ ID NO: 8154610 - DNA, 22 bp, Homo sapiens
gcagccctcgctagctctcccc

SEQ ID NO: 8154611 - DNA, 22 bp, Homo sapiens
gcagccctccctgggtgtgtct

SEQ ID NO: 8154612 - DNA, 22 bp, Homo sapiens
gcagccctccctgggtgtgtct

SEQ ID NO: 8154613 - DNA, 22 bp, Homo sapiens
gcagccctcgggtactcacgtg

SEQ ID NO: 8154614 - DNA, 22 bp, Homo sapiens
gcagccctcttggtcactaggc

SEQ ID NO: 8154615 - DNA, 22 bp, Homo sapiens
gcagccctgcagctccacaccg

SEQ ID NO: 8154616 - DNA, 22 bp, Homo sapiens
gcagccctgcagctccacaccg

SEQ ID NO: 8154617 - DNA, 22 bp, Homo sapiens
gcaggaatatagtatttcgagg

SEQ ID NO: 8154618 - DNA, 22 bp, Homo sapiens
gcaggaagggaaaggttgactc

SEQ ID NO: 8154619 - DNA, 22 bp, Homo sapiens
gcaggaagggaaaggttgactc

SEQ ID NO: 8154620 - DNA, 23 bp, Homo sapiens
gcaggacaacagagtgggaaggc

SEQ ID NO: 8154621 - DNA, 22 bp, Homo sapiens
gcaggacaaaatttccagggtg

SEQ ID NO: 8154622 - DNA, 23 bp, Homo sapiens
gcaggacaacagagtgggaaggc

SEQ ID NO: 8154623 - DNA, 22 bp, Homo sapiens
gcaggacacagatgcaaggcca

SEQ ID NO: 8154624 - DNA, 22 bp, Homo sapiens
gcaggaagccttaccaagccca

SEQ ID NO: 8154625 - DNA, 22 bp, Homo sapiens
gcaggaagccttaccaagccca

SEQ ID NO: 8154626 - DNA, 22 bp, Homo sapiens
gcaggaagccttaccaagccca

SEQ ID NO: 8154627 - DNA, 22 bp, Homo sapiens
gcaggaagcatagaagaatgcc

SEQ ID NO: 8154628 - DNA, 22 bp, Homo sapiens
gcaggaagatgagctcaggtaa

SEQ ID NO: 8154629 - DNA, 22 bp, Homo sapiens
gcaggaagatgagctcaggtaa

SEQ ID NO: 8154630 - DNA, 22 bp, Homo sapiens
gcaggaagcatagaagaatgcc

SEQ ID NO: 8154631 - DNA, 22 bp, Homo sapiens
gcaggaagcatagaagaatgcc

SEQ ID NO: 8154632 - DNA, 22 bp, Homo sapiens
gcaggaagcatagaagaatgcc

SEQ ID NO: 8154633 - DNA, 22 bp, Homo sapiens
gcaggaagcatagaagaatgcc

SEQ ID NO: 8154634 - DNA, 22 bp, Homo sapiens
gcaggaagaggctcgaagcccc

SEQ ID NO: 8154635 - DNA, 22 bp, Homo sapiens
gcaggaactggagctggatgtt

SEQ ID NO: 8154636 - DNA, 22 bp, Homo sapiens
gcaggaagaggctcgaagcccc

SEQ ID NO: 8154637 - DNA, 22 bp, Homo sapiens
gcaggaagaggctcgaagcccc

SEQ ID NO: 8154638 - DNA, 22 bp, Homo sapiens
gcaggaagatgagctcaggtaa

SEQ ID NO: 8154639 - DNA, 22 bp, Homo sapiens
gcaggaaaggttgagactttgc

SEQ ID NO: 8154640 - DNA, 22 bp, Homo sapiens
gcagctttgtcacggagtgtcg

SEQ ID NO: 8154641 - DNA, 22 bp, Homo sapiens
gcagctttgtggagaggcccat

SEQ ID NO: 8154642 - DNA, 22 bp, Homo sapiens
gcagcctccgcactgcgagtcc

SEQ ID NO: 8154643 - DNA, 22 bp, Homo sapiens
gcagcctcagggcactcagatg

SEQ ID NO: 8154644 - DNA, 22 bp, Homo sapiens
gcagcctccgcactgcgagtcc

SEQ ID NO: 8154645 - DNA, 22 bp, Homo sapiens
gcagcctccgcactgcgagtcc

SEQ ID NO: 8154646 - DNA, 22 bp, Homo sapiens
gcagcctccgcactgcgagtcc

SEQ ID NO: 8154647 - DNA, 22 bp, Homo sapiens
gcagctgtcatttacaacaggg

SEQ ID NO: 8154648 - DNA, 22 bp, Homo sapiens
gcagctgtcggaaagctaagtg

SEQ ID NO: 8154649 - DNA, 22 bp, Homo sapiens
gcagctttctttttgcatgtct

SEQ ID NO: 8154650 - DNA, 22 bp, Homo sapiens
gcagctttcttgccctaatctt

SEQ ID NO: 8154651 - DNA, 22 bp, Homo sapiens
gcagctttctttttgcatgtct

SEQ ID NO: 8154652 - DNA, 22 bp, Homo sapiens
gcagctttctgcaatgtcatcc

SEQ ID NO: 8154653 - DNA, 22 bp, Homo sapiens
gcagcccttcaggtgaggggca

SEQ ID NO: 8154654 - DNA, 22 bp, Homo sapiens
gcagcccttcaggtgaggggca

SEQ ID NO: 8154655 - DNA, 22 bp, Homo sapiens
gcagcccttcaggtgaggggca

SEQ ID NO: 8154656 - DNA, 22 bp, Homo sapiens
gcagcccttcaggtgaggggca

SEQ ID NO: 8154657 - DNA, 22 bp, Homo sapiens
gcagccctttctgggcagggga

SEQ ID NO: 8154658 - DNA, 22 bp, Homo sapiens
gcagccctttctgggcagggga

SEQ ID NO: 8154659 - DNA, 22 bp, Homo sapiens
gcagccctttctgggcagggga

SEQ ID NO: 8154660 - DNA, 22 bp, Homo sapiens
gcagccctgcaggcagctccag

SEQ ID NO: 8154661 - DNA, 22 bp, Homo sapiens
gcagccctgcaggcagctccag

SEQ ID NO: 8154662 - DNA, 22 bp, Homo sapiens
gcagccctgcaggcagctccag

SEQ ID NO: 8154663 - DNA, 22 bp, Homo sapiens
gcagccctggcctggcctactt

SEQ ID NO: 8154664 - DNA, 22 bp, Homo sapiens
gcagccctggcctggcctactt

SEQ ID NO: 8154665 - DNA, 22 bp, Homo sapiens
gcagcctcaaactccccagctc

SEQ ID NO: 8154666 - DNA, 20 bp, Homo sapiens
gcagcctcaacaggcacagc

SEQ ID NO: 8154667 - DNA, 22 bp, Homo sapiens
gcagcctcaaactccccagctc

SEQ ID NO: 8154668 - DNA, 20 bp, Homo sapiens
gcagcctcaacaggcacagc

SEQ ID NO: 8154669 - DNA, 20 bp, Homo sapiens
gcagcctcaacaggcacagc

SEQ ID NO: 8154670 - DNA, 20 bp, Homo sapiens
gcagcctcaacaggcacagc

SEQ ID NO: 8154671 - DNA, 20 bp, Homo sapiens
gcagcctcaacaggcacagc

SEQ ID NO: 8154672 - DNA, 20 bp, Homo sapiens
gcagcctcaacaggcacagc

SEQ ID NO: 8154673 - DNA, 22 bp, Homo sapiens
gcaaagacaaattagaactcct

SEQ ID NO: 8154674 - DNA, 22 bp, Homo sapiens
gcaaagacaatttgaatagctt

SEQ ID NO: 8154675 - DNA, 18 bp, Homo sapiens
gcaaagacaggctgggct

SEQ ID NO: 8154676 - DNA, 23 bp, Homo sapiens
gcaaagactctgccaaaaactgc

SEQ ID NO: 8154677 - DNA, 22 bp, Homo sapiens
gcaaagactgcaattacttttg

SEQ ID NO: 8154678 - DNA, 22 bp, Homo sapiens
gcaaagacggactcaggagtgc

SEQ ID NO: 8154679 - DNA, 22 bp, Homo sapiens
gcaaagacggactcaggagtgc

SEQ ID NO: 8154680 - DNA, 22 bp, Homo sapiens
gcaaagacccaggtgtctatcc

SEQ ID NO: 8154681 - DNA, 22 bp, Homo sapiens
gcaaagacggactcaggagtgc

SEQ ID NO: 8154682 - DNA, 18 bp, Homo sapiens
gcaaagacaggctgggct

SEQ ID NO: 8154683 - DNA, 22 bp, Homo sapiens
gcaaagaaagccaaggtctaac

SEQ ID NO: 8154684 - DNA, 22 bp, Homo sapiens
gcaaactggtagctcgcctgcc

SEQ ID NO: 8154685 - DNA, 22 bp, Homo sapiens
gaggcccagcagcgcaggtctt

SEQ ID NO: 8154686 - DNA, 22 bp, Homo sapiens
gaggcccagcagcgcaggtctt

SEQ ID NO: 8154687 - DNA, 22 bp, Homo sapiens
gcaaagaaatgtcagtgagagg

SEQ ID NO: 8154688 - DNA, 20 bp, Homo sapiens
gaggcccagagaggtgaagc

SEQ ID NO: 8154689 - DNA, 22 bp, Homo sapiens
gaggcccagagaggttgcatga

SEQ ID NO: 8154690 - DNA, 22 bp, Homo sapiens
gaggcccagcagcgcaggtctt

SEQ ID NO: 8154691 - DNA, 22 bp, Homo sapiens
gaggcccagcagcgcaggtctt

SEQ ID NO: 8154692 - DNA, 22 bp, Homo sapiens
gaggcccacagggagtaccaag

SEQ ID NO: 8154693 - DNA, 22 bp, Homo sapiens
gaggcccacagggagtaccaag

SEQ ID NO: 8154694 - DNA, 22 bp, Homo sapiens
gaggcccaatgcttccctcctt

SEQ ID NO: 8154695 - DNA, 20 bp, Homo sapiens
gaggcccagagaggtgaagc

SEQ ID NO: 8154696 - DNA, 22 bp, Homo sapiens
gaggcccacagggagtaccaag

SEQ ID NO: 8154697 - DNA, 20 bp, Homo sapiens
gaggcccagagaggtgaagc

SEQ ID NO: 8154698 - DNA, 22 bp, Homo sapiens
gaggccaggaggatctctctaa

SEQ ID NO: 8154699 - DNA, 22 bp, Homo sapiens
gaggccaggaggatctctctaa

SEQ ID NO: 8154700 - DNA, 22 bp, Homo sapiens
gaggccaggaggatctctctaa

SEQ ID NO: 8154701 - DNA, 22 bp, Homo sapiens
gaggccaggaggatctctctaa

SEQ ID NO: 8154702 - DNA, 22 bp, Homo sapiens
gaggccagtgtgctgtgttttc

SEQ ID NO: 8154703 - DNA, 22 bp, Homo sapiens
gaggccagtgtgctgtgttttc

SEQ ID NO: 8154704 - DNA, 22 bp, Homo sapiens
gaggccagtgaaatgttataaa

SEQ ID NO: 8154705 - DNA, 22 bp, Homo sapiens
gaggccagtgaaatgttataaa

SEQ ID NO: 8154706 - DNA, 22 bp, Homo sapiens
gaggcccaaggactctgtcccg

SEQ ID NO: 8154707 - DNA, 22 bp, Homo sapiens
gaggcccaaggactctgtcccg

SEQ ID NO: 8154708 - DNA, 22 bp, Homo sapiens
gaggcccaaggactctgtcccg

SEQ ID NO: 8154709 - DNA, 22 bp, Homo sapiens
gcaaagcaagctgtcagcctca

SEQ ID NO: 8154710 - DNA, 22 bp, Homo sapiens
gcaaagcaagattcagatgtag

SEQ ID NO: 8154711 - DNA, 22 bp, Homo sapiens
gcaaagcacactggagatgtcg

SEQ ID NO: 8154712 - DNA, 22 bp, Homo sapiens
gcaaagctgggtgtgaatgcac

SEQ ID NO: 8154713 - DNA, 22 bp, Homo sapiens
gcaaagcatcagtagaaatgtt

SEQ ID NO: 8154714 - DNA, 22 bp, Homo sapiens
gcaaataatatactttgatctc

SEQ ID NO: 8154715 - DNA, 22 bp, Homo sapiens
gcaaatacatgttgagcaccta

SEQ ID NO: 8154716 - DNA, 22 bp, Homo sapiens
gcaaaggccactggggcgatgg

SEQ ID NO: 8154717 - DNA, 17 bp, Homo sapiens
gcaaaggtgaggagaga

SEQ ID NO: 8154718 - DNA, 22 bp, Homo sapiens
gcaaagtaaaaatagattctga

SEQ ID NO: 8154719 - DNA, 22 bp, Homo sapiens
gcaaagtattaaccaacaggat

SEQ ID NO: 8154720 - DNA, 22 bp, Homo sapiens
gcaaaggtagccaaggagctca

SEQ ID NO: 8154721 - DNA, 17 bp, Homo sapiens
gcaaaggtgaggagaga

SEQ ID NO: 8154722 - DNA, 22 bp, Homo sapiens
gcaaaggtagccaaggagctca

SEQ ID NO: 8154723 - DNA, 17 bp, Homo sapiens
gcaaaggtgaggagaga

SEQ ID NO: 8154724 - DNA, 22 bp, Homo sapiens
gcacacatgcgtgtatatgggt

SEQ ID NO: 8154725 - DNA, 22 bp, Homo sapiens
gcacacatgcatgtgtgcatcc

SEQ ID NO: 8154726 - DNA, 22 bp, Homo sapiens
gcacacatgcatgtgtgcatcc

SEQ ID NO: 8154727 - DNA, 22 bp, Homo sapiens
gcacacatgcatgtgtgcatcc

SEQ ID NO: 8154728 - DNA, 22 bp, Homo sapiens
gcacacatgcatgcacaggagt

SEQ ID NO: 8154729 - DNA, 22 bp, Homo sapiens
gcacacatgcatgtgtgcatcc

SEQ ID NO: 8154730 - DNA, 22 bp, Homo sapiens
gcacacatgcatgcacaggagt

SEQ ID NO: 8154731 - DNA, 22 bp, Homo sapiens
gcacacatgcatgcacaggagt

SEQ ID NO: 8154732 - DNA, 22 bp, Homo sapiens
gcacacatgcatgcacaggagt

SEQ ID NO: 8154733 - DNA, 22 bp, Homo sapiens
gcacacatgcatgcacaggagt

SEQ ID NO: 8154734 - DNA, 22 bp, Homo sapiens
gcacacatcttgtaatcctgag

SEQ ID NO: 8154735 - DNA, 22 bp, Homo sapiens
gcacacattcggattcttaacc

SEQ ID NO: 8154736 - DNA, 22 bp, Homo sapiens
gcacacatgcgtgtatatgggt

SEQ ID NO: 8154737 - DNA, 22 bp, Homo sapiens
gcacacatgtgagtgtcctttc

SEQ ID NO: 8154738 - DNA, 22 bp, Homo sapiens
gcacacattcggattcttaacc

SEQ ID NO: 8154739 - DNA, 20 bp, Homo sapiens
gcacacatagaaatgcatat

SEQ ID NO: 8154740 - DNA, 20 bp, Homo sapiens
gcacacatagaaatgcatat

SEQ ID NO: 8154741 - DNA, 20 bp, Homo sapiens
gcacacatagaaatgcatat

SEQ ID NO: 8154742 - DNA, 22 bp, Homo sapiens
gcacacatatatatgagcatgt

SEQ ID NO: 8154743 - DNA, 22 bp, Homo sapiens
gcacacatatatatgagcatgt

SEQ ID NO: 8154744 - DNA, 20 bp, Homo sapiens
gcacacatagaaatgcatat

SEQ ID NO: 8154745 - DNA, 22 bp, Homo sapiens
gcacacatatatatgagcatgt

SEQ ID NO: 8154746 - DNA, 22 bp, Homo sapiens
gcacacagtatatgctcattaa

SEQ ID NO: 8154747 - DNA, 20 bp, Homo sapiens
gcacacatagaaatgcatat

SEQ ID NO: 8154748 - DNA, 19 bp, Homo sapiens
gcacacatacaccctttgg

SEQ ID NO: 8154749 - DNA, 19 bp, Homo sapiens
gcacacagtagggctggca

SEQ ID NO: 8154750 - DNA, 22 bp, Homo sapiens
gcacacagtagggattcaatga

SEQ ID NO: 8154751 - DNA, 19 bp, Homo sapiens
gcacacagtagggctggca

SEQ ID NO: 8154752 - DNA, 22 bp, Homo sapiens
gcacacagtagggattcaatga

SEQ ID NO: 8154753 - DNA, 22 bp, Homo sapiens
gcacacagaatcagtgggcata

SEQ ID NO: 8154754 - DNA, 22 bp, Homo sapiens
gcaaatatttctaattcctgaa

SEQ ID NO: 8154755 - DNA, 22 bp, Homo sapiens
gcacacagaatcagtgggcata

SEQ ID NO: 8154756 - DNA, 22 bp, Homo sapiens
gcaaatattcaagacttttcca

SEQ ID NO: 8154757 - DNA, 22 bp, Homo sapiens
gcacacactgttttcctcacat

SEQ ID NO: 8154758 - DNA, 22 bp, Homo sapiens
gcacagggctgccaggcggctt

SEQ ID NO: 8154759 - DNA, 22 bp, Homo sapiens
gcacagggctgccaggcggctt

SEQ ID NO: 8154760 - DNA, 22 bp, Homo sapiens
gcacaggctccggaggagagct

SEQ ID NO: 8154761 - DNA, 22 bp, Homo sapiens
gcacaggctccggaggagagct

SEQ ID NO: 8154762 - DNA, 22 bp, Homo sapiens
gcacaggctctcttggggacac

SEQ ID NO: 8154763 - DNA, 22 bp, Homo sapiens
gcacagggctgccaggcggctt

SEQ ID NO: 8154764 - DNA, 22 bp, Homo sapiens
gcacagtgataggcagttgtgc

SEQ ID NO: 8154765 - DNA, 22 bp, Homo sapiens
gcacagtgataggcagttgtgc

SEQ ID NO: 8154766 - DNA, 22 bp, Homo sapiens
gcacaccttagaggggagctgc

SEQ ID NO: 8154767 - DNA, 22 bp, Homo sapiens
gcacacattctagccttttgtg

SEQ ID NO: 8154768 - DNA, 21 bp, Homo sapiens
gcacaccctccaggcccggcg

SEQ ID NO: 8154769 - DNA, 22 bp, Homo sapiens
gcacactgcggtgatgtgagtc

SEQ ID NO: 8154770 - DNA, 22 bp, Homo sapiens
gcacactgcggtgatgtgagtc

SEQ ID NO: 8154771 - DNA, 22 bp, Homo sapiens
gcacagaaatgtctacacatgt

SEQ ID NO: 8154772 - DNA, 22 bp, Homo sapiens
gcacaggctccggaggagagct

SEQ ID NO: 8154773 - DNA, 22 bp, Homo sapiens
gcacaggccatgggaggacagc

SEQ ID NO: 8154774 - DNA, 22 bp, Homo sapiens
gcacagaaccagacatgaggca

SEQ ID NO: 8154775 - DNA, 22 bp, Homo sapiens
gcacagaaatgtctacacatgt

SEQ ID NO: 8154776 - DNA, 21 bp, Homo sapiens
gcacatgagggagggcatgcc

SEQ ID NO: 8154777 - DNA, 19 bp, Homo sapiens
gcagacaggtccagagagg

SEQ ID NO: 8154778 - DNA, 20 bp, Homo sapiens
gcacatctgctttggatttc

SEQ ID NO: 8154779 - DNA, 22 bp, Homo sapiens
gcacatctggagctctgtggaa

SEQ ID NO: 8154780 - DNA, 22 bp, Homo sapiens
gcacatgactttgaggaaacca

SEQ ID NO: 8154781 - DNA, 22 bp, Homo sapiens
gcacatccaatgattgttttga

SEQ ID NO: 8154782 - DNA, 22 bp, Homo sapiens
gcacatccaatgattgttttga

SEQ ID NO: 8154783 - DNA, 22 bp, Homo sapiens
gcacatatgctgtaagcacatg

SEQ ID NO: 8154784 - DNA, 22 bp, Homo sapiens
gcacatacccactgtcaagcac

SEQ ID NO: 8154785 - DNA, 22 bp, Homo sapiens
gcacatacatattagtgtcaca

SEQ ID NO: 8154786 - DNA, 22 bp, Homo sapiens
gcacagtgtaccacagtcccta

SEQ ID NO: 8154787 - DNA, 22 bp, Homo sapiens
gcacagttaaagggtcatgtga

SEQ ID NO: 8154788 - DNA, 22 bp, Homo sapiens
gcacagtgggtggtcatgtaca

SEQ ID NO: 8154789 - DNA, 22 bp, Homo sapiens
gcacagtggtgaaagcatgggt

SEQ ID NO: 8154790 - DNA, 22 bp, Homo sapiens
gcacagtggtgaaagcatgggt

SEQ ID NO: 8154791 - DNA, 22 bp, Homo sapiens
gcacagtggagtgtgtccaggg

SEQ ID NO: 8154792 - DNA, 22 bp, Homo sapiens
gcacagtggagtgtgtccaggg

SEQ ID NO: 8154793 - DNA, 21 bp, Homo sapiens
gcacagtgccaggcacacagt

SEQ ID NO: 8154794 - DNA, 21 bp, Homo sapiens
gcacagtgccaggcacacagt

SEQ ID NO: 8154795 - DNA, 21 bp, Homo sapiens
gcacagtgccaggcacacagt

SEQ ID NO: 8154796 - DNA, 22 bp, Homo sapiens
gcagacatgtgttctaacagga

SEQ ID NO: 8154797 - DNA, 22 bp, Homo sapiens
gcagacctgaccttgggcagca

SEQ ID NO: 8154798 - DNA, 22 bp, Homo sapiens
gcagactctgagagtgagtgcc

SEQ ID NO: 8154799 - DNA, 22 bp, Homo sapiens
gcagactgtacctggaagaggg

SEQ ID NO: 8154800 - DNA, 22 bp, Homo sapiens
gcagactggtcttcagccttgg

SEQ ID NO: 8154801 - DNA, 22 bp, Homo sapiens
gcagactgtatcaatgtcagta

SEQ ID NO: 8154802 - DNA, 22 bp, Homo sapiens
gcagactgtatcaatgtcagta

SEQ ID NO: 8154803 - DNA, 22 bp, Homo sapiens
gcagactgcgagcgtgctggtg

SEQ ID NO: 8154804 - DNA, 21 bp, Homo sapiens
gcagactgccctgctgtcccc

SEQ ID NO: 8154805 - DNA, 21 bp, Homo sapiens
gcagactgccctgctgtcccc

SEQ ID NO: 8154806 - DNA, 22 bp, Homo sapiens
gcagactggtcttcagccttgg

SEQ ID NO: 8154807 - DNA, 18 bp, Homo sapiens
gcagagcagaagctcaag

SEQ ID NO: 8154808 - DNA, 22 bp, Homo sapiens
gcagagcaccaaagtgaaagat

SEQ ID NO: 8154809 - DNA, 22 bp, Homo sapiens
gcagagcaccaaagtgaaagat

SEQ ID NO: 8154810 - DNA, 22 bp, Homo sapiens
gcagagatttcagtaacagcag

SEQ ID NO: 8154811 - DNA, 22 bp, Homo sapiens
gcagagaagatgcccaggcttc

SEQ ID NO: 8154812 - DNA, 22 bp, Homo sapiens
gcagagaagatgcccaggcttc

SEQ ID NO: 8154813 - DNA, 22 bp, Homo sapiens
gcagagaacccagcagattggc

SEQ ID NO: 8154814 - DNA, 22 bp, Homo sapiens
gcagagaagatgcccaggcttc

SEQ ID NO: 8154815 - DNA, 22 bp, Homo sapiens
gcagagaaagttttgtcctcag

SEQ ID NO: 8154816 - DNA, 22 bp, Homo sapiens
gcagactgtatcaatgtcagta

SEQ ID NO: 8154817 - DNA, 22 bp, Homo sapiens
gcagacttataatctgtcccag

SEQ ID NO: 8154818 - DNA, 22 bp, Homo sapiens
gcagaggatagcatatgaacct

SEQ ID NO: 8154819 - DNA, 22 bp, Homo sapiens
gcagaggatcaggctctggaaa

SEQ ID NO: 8154820 - DNA, 22 bp, Homo sapiens
gcagaggatagcatatgaacct

SEQ ID NO: 8154821 - DNA, 22 bp, Homo sapiens
gcagaggatcaggctctggaaa

SEQ ID NO: 8154822 - DNA, 22 bp, Homo sapiens
gcagaggatcaggctctggaaa

SEQ ID NO: 8154823 - DNA, 22 bp, Homo sapiens
gcagaggatcaggctctggaaa

SEQ ID NO: 8154824 - DNA, 22 bp, Homo sapiens
gcagaggcatttctgacgctgc

SEQ ID NO: 8154825 - DNA, 21 bp, Homo sapiens
gcagaggcacggcaccaaggg

SEQ ID NO: 8154826 - DNA, 21 bp, Homo sapiens
gcagaggcacggcaccaaggg

SEQ ID NO: 8154827 - DNA, 22 bp, Homo sapiens
gcagaggatagcatatgaacct

SEQ ID NO: 8154828 - DNA, 22 bp, Homo sapiens
gcagaggagtgattatgccgtg

SEQ ID NO: 8154829 - DNA, 22 bp, Homo sapiens
gcagaggagtgattatgccgtg

SEQ ID NO: 8154830 - DNA, 22 bp, Homo sapiens
gcagagcaggggctgaacctgg

SEQ ID NO: 8154831 - DNA, 22 bp, Homo sapiens
gcagagcagggattttgccata

SEQ ID NO: 8154832 - DNA, 22 bp, Homo sapiens
gcagagcagggattttgccata

SEQ ID NO: 8154833 - DNA, 22 bp, Homo sapiens
gcagagcagtactctcttgact

SEQ ID NO: 8154834 - DNA, 22 bp, Homo sapiens
gcagagcagtactctcttgact

SEQ ID NO: 8154835 - DNA, 22 bp, Homo sapiens
gcagagcagtactctcttgact

SEQ ID NO: 8154836 - DNA, 22 bp, Homo sapiens
gcagagcaggaaggaagtcagg

SEQ ID NO: 8154837 - DNA, 22 bp, Homo sapiens
gcagagcaggaaggaagtcagg

SEQ ID NO: 8154838 - DNA, 22 bp, Homo sapiens
gcagagcagcaaatggaaagga

SEQ ID NO: 8154839 - DNA, 22 bp, Homo sapiens
gcagagcagcaaatggaaagga

SEQ ID NO: 8154840 - DNA, 22 bp, Homo sapiens
gcagagcagaggtgcaggttgg

SEQ ID NO: 8154841 - DNA, 22 bp, Homo sapiens
gcagagcagaggtgcaggttgg

SEQ ID NO: 8154842 - DNA, 18 bp, Homo sapiens
gcagagcagaagctcaag

SEQ ID NO: 8154843 - DNA, 22 bp, Homo sapiens
gcagagcagagcctgcattggc

SEQ ID NO: 8154844 - DNA, 22 bp, Homo sapiens
gcagaggtgagtttctcagctg

SEQ ID NO: 8154845 - DNA, 22 bp, Homo sapiens
gcagaggtgaccagcagcaggg

SEQ ID NO: 8154846 - DNA, 22 bp, Homo sapiens
gcagaggtgaccagcagcaggg

SEQ ID NO: 8154847 - DNA, 22 bp, Homo sapiens
gcagaggtctcttcaaaataat

SEQ ID NO: 8154848 - DNA, 22 bp, Homo sapiens
gcagaggtctagcaccaagaat

SEQ ID NO: 8154849 - DNA, 22 bp, Homo sapiens
gcagaggtctagcaccaagaat

SEQ ID NO: 8154850 - DNA, 20 bp, Homo sapiens
gcagagtgtgagagggtgaa

SEQ ID NO: 8154851 - DNA, 20 bp, Homo sapiens
gcagagtgtgagagggtgaa

SEQ ID NO: 8154852 - DNA, 22 bp, Homo sapiens
gcagatggaaagtgcttgaggg

SEQ ID NO: 8154853 - DNA, 22 bp, Homo sapiens
gcagatggactgtatgacctga

SEQ ID NO: 8154854 - DNA, 22 bp, Homo sapiens
gcagaggtcaaatacctcattt

SEQ ID NO: 8154855 - DNA, 22 bp, Homo sapiens
gcagagggtcctgtgccagcag

SEQ ID NO: 8154856 - DNA, 22 bp, Homo sapiens
gcagagggtcctgtgccagcag

SEQ ID NO: 8154857 - DNA, 22 bp, Homo sapiens
gcagaggccaggccaccagcaa

SEQ ID NO: 8154858 - DNA, 22 bp, Homo sapiens
gcagaggcatttctgacgctgc

SEQ ID NO: 8154859 - DNA, 22 bp, Homo sapiens
ggcaaacaggagagtaaagaga

SEQ ID NO: 8154860 - DNA, 22 bp, Homo sapiens
ggcaaagagacatgcatcgggg

SEQ ID NO: 8154861 - DNA, 22 bp, Homo sapiens
ggcaaacagacttgaccatctt

SEQ ID NO: 8154862 - DNA, 22 bp, Homo sapiens
ggcaaacaccaggcgagggagc

SEQ ID NO: 8154863 - DNA, 22 bp, Homo sapiens
ggcaaacacacctcggtgagaa

SEQ ID NO: 8154864 - DNA, 22 bp, Homo sapiens
ggagtgctcctctccccagtgc

SEQ ID NO: 8154865 - DNA, 22 bp, Homo sapiens
ggattttgttcctagctttaaa

SEQ ID NO: 8154866 - DNA, 22 bp, Homo sapiens
ggagtgagtactggagtagctg

SEQ ID NO: 8154867 - DNA, 23 bp, Homo sapiens
ggagtgcaatggcgccatctcgg

SEQ ID NO: 8154868 - DNA, 23 bp, Homo sapiens
ggagtgcaatggcgccatctcgg

SEQ ID NO: 8154869 - DNA, 23 bp, Homo sapiens
ggagtgcaatggcgccatctcgg

SEQ ID NO: 8154870 - DNA, 22 bp, Homo sapiens
ggagtgcaatggcgtgatctca

SEQ ID NO: 8154871 - DNA, 22 bp, Homo sapiens
ggagtgcagctcacaggacatc

SEQ ID NO: 8154872 - DNA, 22 bp, Homo sapiens
ggagtgcagtggtgggatctca

SEQ ID NO: 8154873 - DNA, 22 bp, Homo sapiens
ggagtgctccgcgagagggatg

SEQ ID NO: 8154874 - DNA, 22 bp, Homo sapiens
ggagtgcagtggcgtgatctcg

SEQ ID NO: 8154875 - DNA, 22 bp, Homo sapiens
ggagtgcagtggcgtgatctca

SEQ ID NO: 8154876 - DNA, 22 bp, Homo sapiens
ggagtgcagtggcgtgagctcg

SEQ ID NO: 8154877 - DNA, 22 bp, Homo sapiens
ggagtgcaggtagcacaggaaa

SEQ ID NO: 8154878 - DNA, 22 bp, Homo sapiens
ggcaagaggtccaagaggtctc

SEQ ID NO: 8154879 - DNA, 22 bp, Homo sapiens
ggcaagaggtccaagaggtctc

SEQ ID NO: 8154880 - DNA, 22 bp, Homo sapiens
ggcaagagtgaggagtgtctct

SEQ ID NO: 8154881 - DNA, 22 bp, Homo sapiens
ggcaagagtgaggagtgtctct

SEQ ID NO: 8154882 - DNA, 22 bp, Homo sapiens
ggcaagagtgaggagtgtctct

SEQ ID NO: 8154883 - DNA, 22 bp, Homo sapiens
ggcaagaggtccaagaggtctc

SEQ ID NO: 8154884 - DNA, 22 bp, Homo sapiens
ggcaagaggtccaagaggtctc

SEQ ID NO: 8154885 - DNA, 22 bp, Homo sapiens
ggcaagagggcagatggagtgc

SEQ ID NO: 8154886 - DNA, 22 bp, Homo sapiens
ggcaagagggcagatggagtgc

SEQ ID NO: 8154887 - DNA, 22 bp, Homo sapiens
ggcaagaggtccaagaggtctc

SEQ ID NO: 8154888 - DNA, 22 bp, Homo sapiens
ggcaagagttgaagctccagga

SEQ ID NO: 8154889 - DNA, 22 bp, Homo sapiens
ggcaagagtgaggagtgtctct

SEQ ID NO: 8154890 - DNA, 20 bp, Homo sapiens
ggcaagcaactgagggagga

SEQ ID NO: 8154891 - DNA, 22 bp, Homo sapiens
ggcacagcaggagctatgtgaa

SEQ ID NO: 8154892 - DNA, 22 bp, Homo sapiens
ggcaaggaagaagccatgatgt

SEQ ID NO: 8154893 - DNA, 22 bp, Homo sapiens
ggcaagctcaggcctcaggtgt

SEQ ID NO: 8154894 - DNA, 22 bp, Homo sapiens
ggcaaggaagaagccatgatgt

SEQ ID NO: 8154895 - DNA, 22 bp, Homo sapiens
ggcaaaggaaaacgtctcagct

SEQ ID NO: 8154896 - DNA, 22 bp, Homo sapiens
ggcaaaggaaaacgtctcagct

SEQ ID NO: 8154897 - DNA, 22 bp, Homo sapiens
ggcaacaactggacatagctgg

SEQ ID NO: 8154898 - DNA, 22 bp, Homo sapiens
ggcaaatttgtcttaagacacc

SEQ ID NO: 8154899 - DNA, 22 bp, Homo sapiens
ggcaaattgctgcaattactta

SEQ ID NO: 8154900 - DNA, 22 bp, Homo sapiens
ggcaagaaggcttcaggtagct

SEQ ID NO: 8154901 - DNA, 22 bp, Homo sapiens
ggcaagaaggcttcaggtagct

SEQ ID NO: 8154902 - DNA, 21 bp, Homo sapiens
ggcaagaaacacaatcaagta

SEQ ID NO: 8154903 - DNA, 22 bp, Homo sapiens
ggcaacattctccagatccttt

SEQ ID NO: 8154904 - DNA, 22 bp, Homo sapiens
ggcaacattctccagatccttt

SEQ ID NO: 8154905 - DNA, 17 bp, Homo sapiens
ggcaacatgttcttctg

SEQ ID NO: 8154906 - DNA, 22 bp, Homo sapiens
ggagccagagcactggggagcc

SEQ ID NO: 8154907 - DNA, 22 bp, Homo sapiens
ggagccagagcactggggagcc

SEQ ID NO: 8154908 - DNA, 22 bp, Homo sapiens
ggagccagaggctgctgctgtg

SEQ ID NO: 8154909 - DNA, 22 bp, Homo sapiens
ggagccagaggctgctgctgtg

SEQ ID NO: 8154910 - DNA, 22 bp, Homo sapiens
ggagccagaggctgctgctgtg

SEQ ID NO: 8154911 - DNA, 22 bp, Homo sapiens
ggagccagaggctgctgctgtg

SEQ ID NO: 8154912 - DNA, 22 bp, Homo sapiens
ggagccagagtttaatgtggag

SEQ ID NO: 8154913 - DNA, 22 bp, Homo sapiens
ggagccagattgtataaaaaag

SEQ ID NO: 8154914 - DNA, 22 bp, Homo sapiens
ggagccagagtttaatgtggag

SEQ ID NO: 8154915 - DNA, 22 bp, Homo sapiens
ggagccagagtttaatgtggag

SEQ ID NO: 8154916 - DNA, 22 bp, Homo sapiens
ggagccagagtctgcagtgtaa

SEQ ID NO: 8154917 - DNA, 22 bp, Homo sapiens
ggagccagagtctgcagtgtaa

SEQ ID NO: 8154918 - DNA, 22 bp, Homo sapiens
ggagccagctccctccttgtga

SEQ ID NO: 8154919 - DNA, 22 bp, Homo sapiens
ggagccagcagggtgacactga

SEQ ID NO: 8154920 - DNA, 22 bp, Homo sapiens
ggagccagcagggtgacactga

SEQ ID NO: 8154921 - DNA, 23 bp, Homo sapiens
ggagccagcctgtggggagcggg

SEQ ID NO: 8154922 - DNA, 17 bp, Homo sapiens
ggagccaggagcccacc

SEQ ID NO: 8154923 - DNA, 19 bp, Homo sapiens
ggagccagctgtggaaggc

SEQ ID NO: 8154924 - DNA, 17 bp, Homo sapiens
ggagccaggagcccacc

SEQ ID NO: 8154925 - DNA, 17 bp, Homo sapiens
ggagccaggagcccacc

SEQ ID NO: 8154926 - DNA, 22 bp, Homo sapiens
ggagtatatcgtgtatcatatg

SEQ ID NO: 8154927 - DNA, 22 bp, Homo sapiens
ggagtcacacagagaagataag

SEQ ID NO: 8154928 - DNA, 22 bp, Homo sapiens
ggagtctgagcttgtgtcctgg

SEQ ID NO: 8154929 - DNA, 22 bp, Homo sapiens
ggagtgaggcatttgtagctga

SEQ ID NO: 8154930 - DNA, 22 bp, Homo sapiens
ggagtgaggcatttgtagctga

SEQ ID NO: 8154931 - DNA, 22 bp, Homo sapiens
ggagtgaggcatttgtagctga

SEQ ID NO: 8154932 - DNA, 22 bp, Homo sapiens
ggagtccaacgtgcagccagga

SEQ ID NO: 8154933 - DNA, 22 bp, Homo sapiens
ggagtcagtgatcgcgtgtctc

SEQ ID NO: 8154934 - DNA, 22 bp, Homo sapiens
ggagtcatctcagctgagaggc

SEQ ID NO: 8154935 - DNA, 17 bp, Homo sapiens
ggagtccaggggttagc

SEQ ID NO: 8154936 - DNA, 18 bp, Homo sapiens
ggagtctcaggagaggaa

SEQ ID NO: 8154937 - DNA, 22 bp, Homo sapiens
ggagtcctgtgtcttccaggaa

SEQ ID NO: 8154938 - DNA, 18 bp, Homo sapiens
ggagtctcaggagaggaa

SEQ ID NO: 8154939 - DNA, 22 bp, Homo sapiens
ggagtcaccaagtaggagtctt

SEQ ID NO: 8154940 - DNA, 22 bp, Homo sapiens
ggagtcaccaagtaggagtctt

SEQ ID NO: 8154941 - DNA, 22 bp, Homo sapiens
ggagtcagaatggcagggtggt

SEQ ID NO: 8154942 - DNA, 21 bp, Homo sapiens
ggagtcagggtctggctgggg

SEQ ID NO: 8154943 - DNA, 22 bp, Homo sapiens
ggagtcagcctgtcagagtgta

SEQ ID NO: 8154944 - DNA, 21 bp, Homo sapiens
ggcaggatggcagtggacccc

SEQ ID NO: 8154945 - DNA, 18 bp, Homo sapiens
ggcaggatttcaactttc

SEQ ID NO: 8154946 - DNA, 22 bp, Homo sapiens
ggcaggcaacggaccactagtc

SEQ ID NO: 8154947 - DNA, 21 bp, Homo sapiens
ggcaggatggcagtggacccc

SEQ ID NO: 8154948 - DNA, 22 bp, Homo sapiens
ggcaggcaacggaccactagtc

SEQ ID NO: 8154949 - DNA, 22 bp, Homo sapiens
ggcaggcaacggaccactagtc

SEQ ID NO: 8154950 - DNA, 22 bp, Homo sapiens
ggcaggcaacggaccactagtc

SEQ ID NO: 8154951 - DNA, 22 bp, Homo sapiens
ggcaggcaaggcagcctggtga

SEQ ID NO: 8154952 - DNA, 22 bp, Homo sapiens
ggcaggcaagtctgctctgtga

SEQ ID NO: 8154953 - DNA, 22 bp, Homo sapiens
ggcaggcaatgaggatgggaag

SEQ ID NO: 8154954 - DNA, 22 bp, Homo sapiens
ggcaggcaatgaggatgggaag

SEQ ID NO: 8154955 - DNA, 22 bp, Homo sapiens
ggcaggcaagtctgctctgtga

SEQ ID NO: 8154956 - DNA, 22 bp, Homo sapiens
ggcaggcaagtctgctctgtga

SEQ ID NO: 8154957 - DNA, 22 bp, Homo sapiens
ggcaggcaaggcagcctggtga

SEQ ID NO: 8154958 - DNA, 22 bp, Homo sapiens
ggcaggcaaggcagcctggtga

SEQ ID NO: 8154959 - DNA, 22 bp, Homo sapiens
ggcaggcactgtgttttgtgtt

SEQ ID NO: 8154960 - DNA, 22 bp, Homo sapiens
ggcaggcagaaaaatagaatat

SEQ ID NO: 8154961 - DNA, 22 bp, Homo sapiens
ggcaggcagaggctgagacagg

SEQ ID NO: 8154962 - DNA, 22 bp, Homo sapiens
ggcaggcactgtgctaggcgct

SEQ ID NO: 8154963 - DNA, 22 bp, Homo sapiens
ggcaggcactgtgctaggcgct

SEQ ID NO: 8154964 - DNA, 22 bp, Homo sapiens
ggcaggcactgtgctaggcgct

SEQ ID NO: 8154965 - DNA, 22 bp, Homo sapiens
ggcaggcacatttgggggccgt

SEQ ID NO: 8154966 - DNA, 22 bp, Homo sapiens
ggcaggcacatttgggggccgt

SEQ ID NO: 8154967 - DNA, 22 bp, Homo sapiens
ggcaggcacagtaatacatgtt

SEQ ID NO: 8154968 - DNA, 22 bp, Homo sapiens
ggcaggcaccagctcagcaata

SEQ ID NO: 8154969 - DNA, 22 bp, Homo sapiens
ggcaggcaccagctcagcaata

SEQ ID NO: 8154970 - DNA, 22 bp, Homo sapiens
ggcaggcactgtgatagattct

SEQ ID NO: 8154971 - DNA, 20 bp, Homo sapiens
ggcagagggcctgggagaag

SEQ ID NO: 8154972 - DNA, 22 bp, Homo sapiens
ggcagaggtagctggaaccagg

SEQ ID NO: 8154973 - DNA, 22 bp, Homo sapiens
ggcagaggtagctggaaccagg

SEQ ID NO: 8154974 - DNA, 20 bp, Homo sapiens
ggcagagggcctgggagaag

SEQ ID NO: 8154975 - DNA, 20 bp, Homo sapiens
ggcagagggcctgggagaag

SEQ ID NO: 8154976 - DNA, 20 bp, Homo sapiens
ggcagagggcctgggagaag

SEQ ID NO: 8154977 - DNA, 20 bp, Homo sapiens
ggcagagggcctgggagaag

SEQ ID NO: 8154978 - DNA, 22 bp, Homo sapiens
ggcagaggtagctggaaccagg

SEQ ID NO: 8154979 - DNA, 22 bp, Homo sapiens
ggcagaggtagctggaaccagg

SEQ ID NO: 8154980 - DNA, 22 bp, Homo sapiens
ggcagaggtagctggaaccagg

SEQ ID NO: 8154981 - DNA, 22 bp, Homo sapiens
ggcagaggtagctggaaccagg

SEQ ID NO: 8154982 - DNA, 22 bp, Homo sapiens
ggcagaggtagctggaaccagg

SEQ ID NO: 8154983 - DNA, 22 bp, Homo sapiens
ggcaggagggcggacaatgacc

SEQ ID NO: 8154984 - DNA, 22 bp, Homo sapiens
ggcaggaggaagagttagcacc

SEQ ID NO: 8154985 - DNA, 22 bp, Homo sapiens
ggcaggagggcggacaatgacc

SEQ ID NO: 8154986 - DNA, 22 bp, Homo sapiens
ggcaggaggtgagtggcgggtg

SEQ ID NO: 8154987 - DNA, 22 bp, Homo sapiens
ggcaggaggtgagtggcgggtg

SEQ ID NO: 8154988 - DNA, 22 bp, Homo sapiens
ggcaggaggtgagtggcgggtg

SEQ ID NO: 8154989 - DNA, 22 bp, Homo sapiens
ggcaggagggcggacaatgacc

SEQ ID NO: 8154990 - DNA, 22 bp, Homo sapiens
ggcagaggaggggtgaatttgc

SEQ ID NO: 8154991 - DNA, 22 bp, Homo sapiens
ggcagaggagctggaaacatgg

SEQ ID NO: 8154992 - DNA, 22 bp, Homo sapiens
ggcagaggagctggaaacatgg

SEQ ID NO: 8154993 - DNA, 22 bp, Homo sapiens
ggcagaggagctggaaacatgg

SEQ ID NO: 8154994 - DNA, 22 bp, Homo sapiens
ggcagaggagctggaaacatgg

SEQ ID NO: 8154995 - DNA, 20 bp, Homo sapiens
ggcagagggcctgggagaag

SEQ ID NO: 8154996 - DNA, 22 bp, Homo sapiens
ggcagaggaggggtgaatttgc

SEQ ID NO: 8154997 - DNA, 20 bp, Homo sapiens
ggcagagggcctgggagaag

SEQ ID NO: 8154998 - DNA, 20 bp, Homo sapiens
ggcagagggcctgggagaag

SEQ ID NO: 8154999 - DNA, 22 bp, Homo sapiens
ggcagaggagctggaaacatgg

SEQ ID NO: 8155000 - DNA, 22 bp, Homo sapiens
ggcagaggaaggatgaattcac

SEQ ID NO: 8155001 - DNA, 22 bp, Homo sapiens
ggcagaggaaggatgaattcac

SEQ ID NO: 8155002 - DNA, 22 bp, Homo sapiens
ggcagaggaaggatgaattcac

SEQ ID NO: 8155003 - DNA, 23 bp, Homo sapiens
ggcaccaggccatggagcgggag

SEQ ID NO: 8155004 - DNA, 22 bp, Homo sapiens
ggcaccaggatcagtctgtcat

SEQ ID NO: 8155005 - DNA, 22 bp, Homo sapiens
ggcaccaggacatgactcccag

SEQ ID NO: 8155006 - DNA, 22 bp, Homo sapiens
ggcaccaggctgggcataggcc

SEQ ID NO: 8155007 - DNA, 22 bp, Homo sapiens
ggcaccaggctgggcataggcc

SEQ ID NO: 8155008 - DNA, 22 bp, Homo sapiens
ggcagaggaagctggaagtggg

SEQ ID NO: 8155009 - DNA, 22 bp, Homo sapiens
ggcagaggaagctggaagtggg

SEQ ID NO: 8155010 - DNA, 20 bp, Homo sapiens
ggcaccaggctaggattgga

SEQ ID NO: 8155011 - DNA, 22 bp, Homo sapiens
ggcacaggagctagtcaaagcc

SEQ ID NO: 8155012 - DNA, 22 bp, Homo sapiens
ggcacaggaatctgtgaagtgc

SEQ ID NO: 8155013 - DNA, 22 bp, Homo sapiens
ggcacaggagctagtcaaagcc

SEQ ID NO: 8155014 - DNA, 17 bp, Homo sapiens
ggcaccagacggagagt

SEQ ID NO: 8155015 - DNA, 17 bp, Homo sapiens
ggcaccagacggagagt

SEQ ID NO: 8155016 - DNA, 22 bp, Homo sapiens
ggcacaggaatctgtgaagtgc

SEQ ID NO: 8155017 - DNA, 22 bp, Homo sapiens
ggcacaggaatctgtgaagtgc

SEQ ID NO: 8155018 - DNA, 22 bp, Homo sapiens
ggcacaggaatctgtgaagtgc

SEQ ID NO: 8155019 - DNA, 22 bp, Homo sapiens
ggcacagctcaggtcccagctc

SEQ ID NO: 8155020 - DNA, 22 bp, Homo sapiens
ggcacagccctctctgtggaca

SEQ ID NO: 8155021 - DNA, 22 bp, Homo sapiens
ggcacagccactttggagaact

SEQ ID NO: 8155022 - DNA, 22 bp, Homo sapiens
ggcacagccctctctgtggaca

SEQ ID NO: 8155023 - DNA, 22 bp, Homo sapiens
ggcacagccactttggagaact

SEQ ID NO: 8155024 - DNA, 22 bp, Homo sapiens
ggcacagccactttggagaact

SEQ ID NO: 8155025 - DNA, 22 bp, Homo sapiens
ggcacagcgactaccatcgaaa

SEQ ID NO: 8155026 - DNA, 22 bp, Homo sapiens
ggcacagctacttgctcactct

SEQ ID NO: 8155027 - DNA, 22 bp, Homo sapiens
ggcacagctacttgctcactct

SEQ ID NO: 8155028 - DNA, 22 bp, Homo sapiens
ggccatgctgttgcctgctggt

SEQ ID NO: 8155029 - DNA, 22 bp, Homo sapiens
ggccatgctgttgcctgctggt

SEQ ID NO: 8155030 - DNA, 22 bp, Homo sapiens
ggccatgctcgtggctggactg

SEQ ID NO: 8155031 - DNA, 22 bp, Homo sapiens
ggccatgcctgtgggtgcaggc

SEQ ID NO: 8155032 - DNA, 22 bp, Homo sapiens
ggccatggaccccgagctgacc

SEQ ID NO: 8155033 - DNA, 22 bp, Homo sapiens
ggccatggaccccgagctgacc

SEQ ID NO: 8155034 - DNA, 23 bp, Homo sapiens
ggccatggagacttagaatgggc

SEQ ID NO: 8155035 - DNA, 23 bp, Homo sapiens
ggccatggagacttagaatgggc

SEQ ID NO: 8155036 - DNA, 23 bp, Homo sapiens
ggccatggagacttagaatgggc

SEQ ID NO: 8155037 - DNA, 23 bp, Homo sapiens
ggccatggagacttagaatgggc

SEQ ID NO: 8155038 - DNA, 23 bp, Homo sapiens
ggccatggagacttagaatgggc

SEQ ID NO: 8155039 - DNA, 22 bp, Homo sapiens
ggcctcagagaaggctgtgcgg

SEQ ID NO: 8155040 - DNA, 22 bp, Homo sapiens
ggcctcagagaaggctgtgcgg

SEQ ID NO: 8155041 - DNA, 22 bp, Homo sapiens
ggcctcagagaaggctgtgcgg

SEQ ID NO: 8155042 - DNA, 22 bp, Homo sapiens
ggcctcagagaaggctgtgcgg

SEQ ID NO: 8155043 - DNA, 22 bp, Homo sapiens
ggcctcagagaaggctgtgcgg

SEQ ID NO: 8155044 - DNA, 22 bp, Homo sapiens
ggcctcagagaaggctgtgcgg

SEQ ID NO: 8155045 - DNA, 19 bp, Homo sapiens
ggccatggcgggggtcaca

SEQ ID NO: 8155046 - DNA, 22 bp, Homo sapiens
ggcctcagaccggagctggcca

SEQ ID NO: 8155047 - DNA, 22 bp, Homo sapiens
ggcctcagaccggagctggcca

SEQ ID NO: 8155048 - DNA, 19 bp, Homo sapiens
ggccatggcgggggtcaca

SEQ ID NO: 8155049 - DNA, 19 bp, Homo sapiens
ggccatggcgggggtcaca

SEQ ID NO: 8155050 - DNA, 22 bp, Homo sapiens
ggccatggcgggagccggcgtc

SEQ ID NO: 8155051 - DNA, 18 bp, Homo sapiens
ggcctcagcctggccgga

SEQ ID NO: 8155052 - DNA, 18 bp, Homo sapiens
ggcctcagcctggccgga

SEQ ID NO: 8155053 - DNA, 18 bp, Homo sapiens
ggcctcagcctggccgga

SEQ ID NO: 8155054 - DNA, 23 bp, Homo sapiens
ggcctcagcgcacagaaactgct

SEQ ID NO: 8155055 - DNA, 23 bp, Homo sapiens
ggcctcagcgcacagaaactgct

SEQ ID NO: 8155056 - DNA, 22 bp, Homo sapiens
ggcctcagggtcactctgtaga

SEQ ID NO: 8155057 - DNA, 23 bp, Homo sapiens
ggcctcagcgcacagaaactgct

SEQ ID NO: 8155058 - DNA, 22 bp, Homo sapiens
ggcctcagggttgggcccatta

SEQ ID NO: 8155059 - DNA, 22 bp, Homo sapiens
ggcctcagggttgggcccatta

SEQ ID NO: 8155060 - DNA, 22 bp, Homo sapiens
ggcctcagggtcactctgtaga

SEQ ID NO: 8155061 - DNA, 22 bp, Homo sapiens
ggcctcagggtcactctgtaga

SEQ ID NO: 8155062 - DNA, 22 bp, Homo sapiens
ggcctcagggtcactctgtaga

SEQ ID NO: 8155063 - DNA, 21 bp, Homo sapiens
ggcctcagccacctggctctg

SEQ ID NO: 8155064 - DNA, 21 bp, Homo sapiens
ggcctcagccacctggctctg

SEQ ID NO: 8155065 - DNA, 18 bp, Homo sapiens
ggcctcagcctggccgga

SEQ ID NO: 8155066 - DNA, 21 bp, Homo sapiens
ggcctcagccacctggctctg

SEQ ID NO: 8155067 - DNA, 21 bp, Homo sapiens
ggcctcagccacctggctctg

SEQ ID NO: 8155068 - DNA, 22 bp, Homo sapiens
ggcctcagaggaggtgtgagtc

SEQ ID NO: 8155069 - DNA, 22 bp, Homo sapiens
ggcctcagagaaggctgtgcgg

SEQ ID NO: 8155070 - DNA, 22 bp, Homo sapiens
ggcctcagaggaggtgtgagtc

SEQ ID NO: 8155071 - DNA, 22 bp, Homo sapiens
ggcctcagaggaggtgtgagtc

SEQ ID NO: 8155072 - DNA, 21 bp, Homo sapiens
ggcctcagccacctggctctg

SEQ ID NO: 8155073 - DNA, 21 bp, Homo sapiens
ggcctctgtcatcctgggaag

SEQ ID NO: 8155074 - DNA, 21 bp, Homo sapiens
ggcctctgtcatcctgggaag

SEQ ID NO: 8155075 - DNA, 22 bp, Homo sapiens
ggcctctggttcgtggtgacct

SEQ ID NO: 8155076 - DNA, 22 bp, Homo sapiens
ggcctctggttcgtggtgacct

SEQ ID NO: 8155077 - DNA, 22 bp, Homo sapiens
ggcctctggttcgtggtgacct

SEQ ID NO: 8155078 - DNA, 22 bp, Homo sapiens
ggcctctggttcacagggagga

SEQ ID NO: 8155079 - DNA, 22 bp, Homo sapiens
ggcctctggttcacagggagga

SEQ ID NO: 8155080 - DNA, 22 bp, Homo sapiens
ggcctctggttcacagggagga

SEQ ID NO: 8155081 - DNA, 22 bp, Homo sapiens
ggcctctgtttggagccaggat

SEQ ID NO: 8155082 - DNA, 22 bp, Homo sapiens
ggcctctgtttggagccaggat

SEQ ID NO: 8155083 - DNA, 22 bp, Homo sapiens
ggcctctgtttggagccaggat

SEQ ID NO: 8155084 - DNA, 22 bp, Homo sapiens
ggcctctgtttggagccaggat

SEQ ID NO: 8155085 - DNA, 22 bp, Homo sapiens
ggcctctgtttggagccaggat

SEQ ID NO: 8155086 - DNA, 23 bp, Homo sapiens
ggcctctgtgttctgcccacatg

SEQ ID NO: 8155087 - DNA, 23 bp, Homo sapiens
ggcctctgtgttctgcccacatg

SEQ ID NO: 8155088 - DNA, 22 bp, Homo sapiens
ggcctctgttctgcattcctcc

SEQ ID NO: 8155089 - DNA, 22 bp, Homo sapiens
ggcctcagtttcttcaactgta

SEQ ID NO: 8155090 - DNA, 22 bp, Homo sapiens
ggcctcagtttcttcaactgta

SEQ ID NO: 8155091 - DNA, 22 bp, Homo sapiens
ggcctctggttcacagggagga

SEQ ID NO: 8155092 - DNA, 22 bp, Homo sapiens
ggcctcagtttcttcaactgta

SEQ ID NO: 8155093 - DNA, 22 bp, Homo sapiens
ggcctcagtttcttcaactgta

SEQ ID NO: 8155094 - DNA, 22 bp, Homo sapiens
ggcctcagtttcttcaactgta

SEQ ID NO: 8155095 - DNA, 22 bp, Homo sapiens
ggcctcagtttctccatgggtt

SEQ ID NO: 8155096 - DNA, 22 bp, Homo sapiens
ggcctcagtttctccatgggtt

SEQ ID NO: 8155097 - DNA, 22 bp, Homo sapiens
ggcctcagtttctccatgggtt

SEQ ID NO: 8155098 - DNA, 22 bp, Homo sapiens
ggcctcagtttctccatgggtt

SEQ ID NO: 8155099 - DNA, 20 bp, Homo sapiens
ggcctcagtgtccttgtttg

SEQ ID NO: 8155100 - DNA, 22 bp, Homo sapiens
ggcctcagtttctccatgggtt

SEQ ID NO: 8155101 - DNA, 22 bp, Homo sapiens
ggcctcagtttctccatgggtt

SEQ ID NO: 8155102 - DNA, 22 bp, Homo sapiens
ggcctcagtgggccgctgcagg

SEQ ID NO: 8155103 - DNA, 22 bp, Homo sapiens
ggcctcagtgggccgctgcagg

SEQ ID NO: 8155104 - DNA, 20 bp, Homo sapiens
ggcctcagtgtccttgtttg

SEQ ID NO: 8155105 - DNA, 23 bp, Homo sapiens
ggcctcagtgatgatgggttaaa

SEQ ID NO: 8155106 - DNA, 22 bp, Homo sapiens
ggcctcagtgggccgctgcagg

SEQ ID NO: 8155107 - DNA, 22 bp, Homo sapiens
ggcctcagggttgggcccatta

SEQ ID NO: 8155108 - DNA, 22 bp, Homo sapiens
ggcctcagggttgggcccatta

SEQ ID NO: 8155109 - DNA, 22 bp, Homo sapiens
ggccttggttctgtcacagccg

SEQ ID NO: 8155110 - DNA, 22 bp, Homo sapiens
ggccttggttctgtcacagccg

SEQ ID NO: 8155111 - DNA, 22 bp, Homo sapiens
ggccttggttccaaagcaggca

SEQ ID NO: 8155112 - DNA, 22 bp, Homo sapiens
ggccttggtggctttgctgatg

SEQ ID NO: 8155113 - DNA, 22 bp, Homo sapiens
ggcctttgctggccctcaggct

SEQ ID NO: 8155114 - DNA, 22 bp, Homo sapiens
ggcctttgcgtccacgccgctt

SEQ ID NO: 8155115 - DNA, 19 bp, Homo sapiens
ggcctttcacctggatgct

SEQ ID NO: 8155116 - DNA, 22 bp, Homo sapiens
ggcgctggtggtcttgcgagcg

SEQ ID NO: 8155117 - DNA, 22 bp, Homo sapiens
ggcgctggtggtcttgcgagcg

SEQ ID NO: 8155118 - DNA, 22 bp, Homo sapiens
ggcgctggtggtcttgcgagcg

SEQ ID NO: 8155119 - DNA, 22 bp, Homo sapiens
ggcgctggccacggtggctctg

SEQ ID NO: 8155120 - DNA, 22 bp, Homo sapiens
ggcgctggccacggtggctctg

SEQ ID NO: 8155121 - DNA, 22 bp, Homo sapiens
ggcgaggccgggacaggctgga

SEQ ID NO: 8155122 - DNA, 22 bp, Homo sapiens
ggcgctggccacggtggctctg

SEQ ID NO: 8155123 - DNA, 22 bp, Homo sapiens
ggcgaggccgggacaggctgga

SEQ ID NO: 8155124 - DNA, 22 bp, Homo sapiens
ggcgaggccgggacaggctgga

SEQ ID NO: 8155125 - DNA, 22 bp, Homo sapiens
ggcgagaagttgttagtggctt

SEQ ID NO: 8155126 - DNA, 22 bp, Homo sapiens
ggccttggtaaagggatgcatg

SEQ ID NO: 8155127 - DNA, 22 bp, Homo sapiens
ggccttggtgctctgtgttgca

SEQ ID NO: 8155128 - DNA, 22 bp, Homo sapiens
ggccttggtggctttgctgatg

SEQ ID NO: 8155129 - DNA, 22 bp, Homo sapiens
ggccttggtgctctgtgttgca

SEQ ID NO: 8155130 - DNA, 22 bp, Homo sapiens
ggccttggtgccatggccagtt

SEQ ID NO: 8155131 - DNA, 22 bp, Homo sapiens
ggccttggtgccatggccagtt

SEQ ID NO: 8155132 - DNA, 20 bp, Homo sapiens
ggccttgggtttcgcctgtt

SEQ ID NO: 8155133 - DNA, 17 bp, Homo sapiens
ggccttggggcctcagt

SEQ ID NO: 8155134 - DNA, 17 bp, Homo sapiens
ggccttgggctgctctt

SEQ ID NO: 8155135 - DNA, 22 bp, Homo sapiens
ggccttggggaggatggtgtcc

SEQ ID NO: 8155136 - DNA, 22 bp, Homo sapiens
ggccttgggctggctgcagtat

SEQ ID NO: 8155137 - DNA, 22 bp, Homo sapiens
ggcctgagggtgggctctcagt

SEQ ID NO: 8155138 - DNA, 22 bp, Homo sapiens
ggcctgagggtgggctctcagt

SEQ ID NO: 8155139 - DNA, 22 bp, Homo sapiens
ggcctgaggcgtcccagctgtg

SEQ ID NO: 8155140 - DNA, 21 bp, Homo sapiens
ggcctgagtataggacaggcc

SEQ ID NO: 8155141 - DNA, 22 bp, Homo sapiens
ggcctgagaatgtaccagatct

SEQ ID NO: 8155142 - DNA, 22 bp, Homo sapiens
ggcctgagaatgtaccagatct

SEQ ID NO: 8155143 - DNA, 21 bp, Homo sapiens
ggcctgagcacctgtccacct

SEQ ID NO: 8155144 - DNA, 22 bp, Homo sapiens
ggcctgaggcgtcccagctgtg

SEQ ID NO: 8155145 - DNA, 22 bp, Homo sapiens
ggcctgagaaccatggggccaa

SEQ ID NO: 8155146 - DNA, 22 bp, Homo sapiens
ggcctgagaaccatggggccaa

SEQ ID NO: 8155147 - DNA, 22 bp, Homo sapiens
ggcctcttatctggctcctgca

SEQ ID NO: 8155148 - DNA, 22 bp, Homo sapiens
ggcctcttatctggctcctgca

SEQ ID NO: 8155149 - DNA, 22 bp, Homo sapiens
ggcctcttctgctcatactttc

SEQ ID NO: 8155150 - DNA, 19 bp, Homo sapiens
ggcctgcccaatgtctgct

SEQ ID NO: 8155151 - DNA, 22 bp, Homo sapiens
ggccttgggatgtggctgcagc

SEQ ID NO: 8155152 - DNA, 22 bp, Homo sapiens
ggccttgggatgtggctgcagc

SEQ ID NO: 8155153 - DNA, 22 bp, Homo sapiens
ggccttgggatgtggctgcagc

SEQ ID NO: 8155154 - DNA, 22 bp, Homo sapiens
ggccttgggcagacacgtcaca

SEQ ID NO: 8155155 - DNA, 22 bp, Homo sapiens
ggcctgcacagaggtggctcta

SEQ ID NO: 8155156 - DNA, 17 bp, Homo sapiens
ggcctgcacctcctgct

SEQ ID NO: 8155157 - DNA, 18 bp, Homo sapiens
ggcctgcagtgaagcaag

SEQ ID NO: 8155158 - DNA, 22 bp, Homo sapiens
ggcctgagtcccacctggctgt

SEQ ID NO: 8155159 - DNA, 22 bp, Homo sapiens
ggcctgatgtgggatcctctgc

SEQ ID NO: 8155160 - DNA, 22 bp, Homo sapiens
ggcctgcaaatggcaccttttt

SEQ ID NO: 8155161 - DNA, 22 bp, Homo sapiens
ggcctgagtcccacctggctgt

SEQ ID NO: 8155162 - DNA, 22 bp, Homo sapiens
ggcctgagtcacatcaggagag

SEQ ID NO: 8155163 - DNA, 22 bp, Homo sapiens
ggcctgagtcacatcaggagag

SEQ ID NO: 8155164 - DNA, 21 bp, Homo sapiens
ggcctgagtataggacaggcc

SEQ ID NO: 8155165 - DNA, 22 bp, Homo sapiens
ggcaggtgggaaccctccccac

SEQ ID NO: 8155166 - DNA, 22 bp, Homo sapiens
ggcaggtgggaaccctccccac

SEQ ID NO: 8155167 - DNA, 22 bp, Homo sapiens
ggcaggtgggaaccctccccac

SEQ ID NO: 8155168 - DNA, 22 bp, Homo sapiens
ggcaggtggtaaggatttcata

SEQ ID NO: 8155169 - DNA, 21 bp, Homo sapiens
ggcaggtgggtctctgttgct

SEQ ID NO: 8155170 - DNA, 21 bp, Homo sapiens
ggcaggtgggtctctgttgct

SEQ ID NO: 8155171 - DNA, 22 bp, Homo sapiens
ggcaggtggccaagtgtctaag

SEQ ID NO: 8155172 - DNA, 22 bp, Homo sapiens
ggcaggtggcactgctgctccc

SEQ ID NO: 8155173 - DNA, 22 bp, Homo sapiens
ggcaggtggccaagtgtctaag

SEQ ID NO: 8155174 - DNA, 22 bp, Homo sapiens
ggcaggtgtgagatcgaggcca

SEQ ID NO: 8155175 - DNA, 22 bp, Homo sapiens
ggcagtcacttttgcttgtgcc

SEQ ID NO: 8155176 - DNA, 22 bp, Homo sapiens
ggcaggtgtgagatcgaggcca

SEQ ID NO: 8155177 - DNA, 22 bp, Homo sapiens
ggcaggtggtaaggatttcata

SEQ ID NO: 8155178 - DNA, 22 bp, Homo sapiens
ggcagtcagtttggagatggat

SEQ ID NO: 8155179 - DNA, 22 bp, Homo sapiens
ggcaggtggattttctactcta

SEQ ID NO: 8155180 - DNA, 22 bp, Homo sapiens
ggcaggtggattttctactcta

SEQ ID NO: 8155181 - DNA, 15 bp, Homo sapiens
ggcaggtggatcact

SEQ ID NO: 8155182 - DNA, 22 bp, Homo sapiens
ggcaggtggcactgctgctccc

SEQ ID NO: 8155183 - DNA, 22 bp, Homo sapiens
ggcaggtggcactgctgctccc

SEQ ID NO: 8155184 - DNA, 22 bp, Homo sapiens
ggcaggtggcactgctgctccc

SEQ ID NO: 8155185 - DNA, 22 bp, Homo sapiens
ggcaggtggcactgctgctccc

SEQ ID NO: 8155186 - DNA, 22 bp, Homo sapiens
ggcaggtggcactgctgctccc

SEQ ID NO: 8155187 - DNA, 15 bp, Homo sapiens
ggcaggtggatcact

SEQ ID NO: 8155188 - DNA, 22 bp, Homo sapiens
ggcaggtggacgtgctaaagct

SEQ ID NO: 8155189 - DNA, 22 bp, Homo sapiens
ggcaggtggacgtgctaaagct

SEQ ID NO: 8155190 - DNA, 22 bp, Homo sapiens
ggcaggtggacgtgctaaagct

SEQ ID NO: 8155191 - DNA, 22 bp, Homo sapiens
ggcaggtggacgtgctaaagct

SEQ ID NO: 8155192 - DNA, 22 bp, Homo sapiens
ggcaggtggaagttggcagagc

SEQ ID NO: 8155193 - DNA, 22 bp, Homo sapiens
ggcaggcagaggctgagacagg

SEQ ID NO: 8155194 - DNA, 22 bp, Homo sapiens
ggcaggcagaggctgagacagg

SEQ ID NO: 8155195 - DNA, 22 bp, Homo sapiens
ggcaggcagatggctgcaccaa

SEQ ID NO: 8155196 - DNA, 22 bp, Homo sapiens
ggcaggtggaagttggcagagc

SEQ ID NO: 8155197 - DNA, 22 bp, Homo sapiens
ggcaggtggaagttggcagagc

SEQ ID NO: 8155198 - DNA, 22 bp, Homo sapiens
ggcaggtggaagttggcagagc

SEQ ID NO: 8155199 - DNA, 22 bp, Homo sapiens
ggcaggtggaagttggcagagc

SEQ ID NO: 8155200 - DNA, 22 bp, Homo sapiens
ggcaggtggaagttggcagagc

SEQ ID NO: 8155201 - DNA, 22 bp, Homo sapiens
ggcatgggagtgagcaacctta

SEQ ID NO: 8155202 - DNA, 22 bp, Homo sapiens
ggcatgggccgaggtgcctcct

SEQ ID NO: 8155203 - DNA, 22 bp, Homo sapiens
ggcatgggccgaggtgcctcct

SEQ ID NO: 8155204 - DNA, 22 bp, Homo sapiens
ggcatggggtgtatgtggcacg

SEQ ID NO: 8155205 - DNA, 22 bp, Homo sapiens
ggcatggggtgtatgtggcacg

SEQ ID NO: 8155206 - DNA, 22 bp, Homo sapiens
ggcatggcctgtaagacggaga

SEQ ID NO: 8155207 - DNA, 22 bp, Homo sapiens
ggcatggcctgtaagacggaga

SEQ ID NO: 8155208 - DNA, 22 bp, Homo sapiens
ggcatggctcggagtcagaaca

SEQ ID NO: 8155209 - DNA, 21 bp, Homo sapiens
ggcatggcacctctgggcagg

SEQ ID NO: 8155210 - DNA, 21 bp, Homo sapiens
ggcatggcacctctgggcagg

SEQ ID NO: 8155211 - DNA, 21 bp, Homo sapiens
ggcatggcacctctgggcagg

SEQ ID NO: 8155212 - DNA, 22 bp, Homo sapiens
ggcatggcacgggaaacaccag

SEQ ID NO: 8155213 - DNA, 22 bp, Homo sapiens
ggcatggcacgggaaacaccag

SEQ ID NO: 8155214 - DNA, 22 bp, Homo sapiens
ggcatgggccgaggtgcctcct

SEQ ID NO: 8155215 - DNA, 22 bp, Homo sapiens
ggcatgggagtgagcaacctta

SEQ ID NO: 8155216 - DNA, 22 bp, Homo sapiens
ggcatggctgttggggatagag

SEQ ID NO: 8155217 - DNA, 22 bp, Homo sapiens
ggcatggctgggttctggtgag

SEQ ID NO: 8155218 - DNA, 22 bp, Homo sapiens
ggcatggctcggagtcagaaca

SEQ ID NO: 8155219 - DNA, 22 bp, Homo sapiens
ggcatggctgggttctggtgag

SEQ ID NO: 8155220 - DNA, 22 bp, Homo sapiens
ggcatggctgggttctggtgag

SEQ ID NO: 8155221 - DNA, 22 bp, Homo sapiens
ggcatggctgttggggatagag

SEQ ID NO: 8155222 - DNA, 22 bp, Homo sapiens
ggcagtgaatgaaacagaggct

SEQ ID NO: 8155223 - DNA, 22 bp, Homo sapiens
ggcagtgaatctgagagcctgg

SEQ ID NO: 8155224 - DNA, 22 bp, Homo sapiens
ggcagtgaatgaaacagaggct

SEQ ID NO: 8155225 - DNA, 22 bp, Homo sapiens
ggcatggacgtctctgaggcca

SEQ ID NO: 8155226 - DNA, 22 bp, Homo sapiens
ggcatggacgtctctgaggcca

SEQ ID NO: 8155227 - DNA, 21 bp, Homo sapiens
ggcatggcacctctgggcagg

SEQ ID NO: 8155228 - DNA, 20 bp, Homo sapiens
ggcatggcaaatgttcttgc

SEQ ID NO: 8155229 - DNA, 20 bp, Homo sapiens
ggcatggcaaatgttcttgc

SEQ ID NO: 8155230 - DNA, 22 bp, Homo sapiens
ggcatggacgtctctgaggcca

SEQ ID NO: 8155231 - DNA, 22 bp, Homo sapiens
ggcagtgaacagaaatgcagaa

SEQ ID NO: 8155232 - DNA, 22 bp, Homo sapiens
ggcagtgaacagaaatgcagaa

SEQ ID NO: 8155233 - DNA, 22 bp, Homo sapiens
ggccagggcctggggactgtcc

SEQ ID NO: 8155234 - DNA, 22 bp, Homo sapiens
ggccagggggcttcagactcca

SEQ ID NO: 8155235 - DNA, 22 bp, Homo sapiens
ggccagggggcttcagactcca

SEQ ID NO: 8155236 - DNA, 19 bp, Homo sapiens
ggccaggctgactgtggtc

SEQ ID NO: 8155237 - DNA, 22 bp, Homo sapiens
ggccagggcctggggactgtcc

SEQ ID NO: 8155238 - DNA, 22 bp, Homo sapiens
ggccagggcctggggactgtcc

SEQ ID NO: 8155239 - DNA, 22 bp, Homo sapiens
ggccaggtgcggtggctcacac

SEQ ID NO: 8155240 - DNA, 22 bp, Homo sapiens
ggccaggtccagtggaaggccc

SEQ ID NO: 8155241 - DNA, 23 bp, Homo sapiens
ggccaggtgcaccttagagagcc

SEQ ID NO: 8155242 - DNA, 22 bp, Homo sapiens
ggccaggtggctgtcctggcgt

SEQ ID NO: 8155243 - DNA, 22 bp, Homo sapiens
ggccaggtggctgtcctggcgt

SEQ ID NO: 8155244 - DNA, 22 bp, Homo sapiens
ggccaggtggctgtcctggcgt

SEQ ID NO: 8155245 - DNA, 22 bp, Homo sapiens
ggccaggtggctgtcctggcgt

SEQ ID NO: 8155246 - DNA, 22 bp, Homo sapiens
ggccagggggcttcagactcca

SEQ ID NO: 8155247 - DNA, 22 bp, Homo sapiens
ggccagggggcttcagactcca

SEQ ID NO: 8155248 - DNA, 22 bp, Homo sapiens
ggccagggggcttcagactcca

SEQ ID NO: 8155249 - DNA, 22 bp, Homo sapiens
ggccaggtccagtggaaggccc

SEQ ID NO: 8155250 - DNA, 22 bp, Homo sapiens
ggccaggtccagtggaaggccc

SEQ ID NO: 8155251 - DNA, 22 bp, Homo sapiens
ggccaggtaagagtgcagccgc

SEQ ID NO: 8155252 - DNA, 22 bp, Homo sapiens
ggccaggtaagagtgcagccgc

SEQ ID NO: 8155253 - DNA, 22 bp, Homo sapiens
ggccagggggcttcagactcca

SEQ ID NO: 8155254 - DNA, 21 bp, Homo sapiens
ggccagtggaattttatgtca

SEQ ID NO: 8155255 - DNA, 21 bp, Homo sapiens
ggccagtggccttgactttcc

SEQ ID NO: 8155256 - DNA, 22 bp, Homo sapiens
ggccagtggctctgtgcttggg

SEQ ID NO: 8155257 - DNA, 22 bp, Homo sapiens
ggccagtggctctgtgcttggg

SEQ ID NO: 8155258 - DNA, 22 bp, Homo sapiens
ggccagtgtgcaggtcagagat

SEQ ID NO: 8155259 - DNA, 22 bp, Homo sapiens
ggccagtgtgcaggtcagagat

SEQ ID NO: 8155260 - DNA, 22 bp, Homo sapiens
ggccagtgaccagtaaccagtg

SEQ ID NO: 8155261 - DNA, 22 bp, Homo sapiens
ggccagtaagagataggaggca

SEQ ID NO: 8155262 - DNA, 22 bp, Homo sapiens
ggccaggttgggtggaagtggc

SEQ ID NO: 8155263 - DNA, 22 bp, Homo sapiens
ggccaggttgggtggaagtggc

SEQ ID NO: 8155264 - DNA, 22 bp, Homo sapiens
ggccatgccaggctgcctggga

SEQ ID NO: 8155265 - DNA, 22 bp, Homo sapiens
ggccatgagaatgtgcaggtcc

SEQ ID NO: 8155266 - DNA, 22 bp, Homo sapiens
ggccagtgtgggagtagttctt

SEQ ID NO: 8155267 - DNA, 22 bp, Homo sapiens
ggccagtgtgggagtagttctt

SEQ ID NO: 8155268 - DNA, 20 bp, Homo sapiens
ggcatgggtggggctcccag

SEQ ID NO: 8155269 - DNA, 22 bp, Homo sapiens
ggcatggtctttgcttgcagga

SEQ ID NO: 8155270 - DNA, 22 bp, Homo sapiens
ggcatggtctttgcttgcagga

SEQ ID NO: 8155271 - DNA, 22 bp, Homo sapiens
ggcatggtctttgcttgcagga

SEQ ID NO: 8155272 - DNA, 20 bp, Homo sapiens
ggcatgggtggggctcccag

SEQ ID NO: 8155273 - DNA, 20 bp, Homo sapiens
ggcatgggtggggctcccag

SEQ ID NO: 8155274 - DNA, 22 bp, Homo sapiens
ggcatgtgcctgaggtcacaca

SEQ ID NO: 8155275 - DNA, 18 bp, Homo sapiens
ggcatgtgagtgctgagg

SEQ ID NO: 8155276 - DNA, 22 bp, Homo sapiens
ggcatggtttaagtggtgggga

SEQ ID NO: 8155277 - DNA, 18 bp, Homo sapiens
ggcatgtataagaagtag

SEQ ID NO: 8155278 - DNA, 22 bp, Homo sapiens
ggccaaggtggagaaggcactg

SEQ ID NO: 8155279 - DNA, 22 bp, Homo sapiens
ggccaaggtggagaaggcactg

SEQ ID NO: 8155280 - DNA, 22 bp, Homo sapiens
ggccaaggtggagaaggcactg

SEQ ID NO: 8155281 - DNA, 22 bp, Homo sapiens
ggccaaggtggagaaggcactg

SEQ ID NO: 8155282 - DNA, 22 bp, Homo sapiens
ggcattaactctgtttcaattt

SEQ ID NO: 8155283 - DNA, 22 bp, Homo sapiens
ggccacactctggtagaggtga

SEQ ID NO: 8155284 - DNA, 22 bp, Homo sapiens
ggccacagaacagctacaggac

SEQ ID NO: 8155285 - DNA, 22 bp, Homo sapiens
ggccacagaacagctacaggac

SEQ ID NO: 8155286 - DNA, 22 bp, Homo sapiens
ggccacagaacagctacaggac

SEQ ID NO: 8155287 - DNA, 19 bp, Homo sapiens
ggccaggctgactgtggtc

SEQ ID NO: 8155288 - DNA, 19 bp, Homo sapiens
ggccaggctgactgtggtc

SEQ ID NO: 8155289 - DNA, 19 bp, Homo sapiens
ggccaggctgactgtggtc

SEQ ID NO: 8155290 - DNA, 19 bp, Homo sapiens
ggccaggctgactgtggtc

SEQ ID NO: 8155291 - DNA, 19 bp, Homo sapiens
ggccaggctgactgtggtc

SEQ ID NO: 8155292 - DNA, 19 bp, Homo sapiens
ggccaggctgactgtggtc

SEQ ID NO: 8155293 - DNA, 22 bp, Homo sapiens
ggccacagaacagctacaggac

SEQ ID NO: 8155294 - DNA, 22 bp, Homo sapiens
ggccacagaacagctacaggac

SEQ ID NO: 8155295 - DNA, 22 bp, Homo sapiens
ggccacacggagaggctggtct

SEQ ID NO: 8155296 - DNA, 21 bp, Homo sapiens
ggccacaagcggaggagccgc

SEQ ID NO: 8155297 - DNA, 22 bp, Homo sapiens
ggccaatgggaatggccagtag

SEQ ID NO: 8155298 - DNA, 22 bp, Homo sapiens
ggccaattccaggagccggcgg

SEQ ID NO: 8155299 - DNA, 22 bp, Homo sapiens
ggctgaagaactgggagtctca

SEQ ID NO: 8155300 - DNA, 22 bp, Homo sapiens
ggctgaaggatgaaagctgcag

SEQ ID NO: 8155301 - DNA, 22 bp, Homo sapiens
ggctgaagaactgggagtctca

SEQ ID NO: 8155302 - DNA, 22 bp, Homo sapiens
ggctcttgggagctcagagttg

SEQ ID NO: 8155303 - DNA, 22 bp, Homo sapiens
ggctcttgcccgcccaggctgg

SEQ ID NO: 8155304 - DNA, 22 bp, Homo sapiens
ggctcttctgtttcacaggcca

SEQ ID NO: 8155305 - DNA, 22 bp, Homo sapiens
ggctcttgaaatgtggctggcg

SEQ ID NO: 8155306 - DNA, 22 bp, Homo sapiens
ggctcttgagaggcacaggttt

SEQ ID NO: 8155307 - DNA, 22 bp, Homo sapiens
ggctctgggccagagttggctt

SEQ ID NO: 8155308 - DNA, 22 bp, Homo sapiens
ggctctgggccagagttggctt

SEQ ID NO: 8155309 - DNA, 22 bp, Homo sapiens
ggctctgggccagagttggctt

SEQ ID NO: 8155310 - DNA, 22 bp, Homo sapiens
ggctcttctggttgtcacattt

SEQ ID NO: 8155311 - DNA, 22 bp, Homo sapiens
ggctcttctgtttcacaggcca

SEQ ID NO: 8155312 - DNA, 22 bp, Homo sapiens
ggctcttctgtggcagccaagg

SEQ ID NO: 8155313 - DNA, 22 bp, Homo sapiens
ggctgagactagagtgaggcat

SEQ ID NO: 8155314 - DNA, 22 bp, Homo sapiens
ggctgagactagagtgaggcat

SEQ ID NO: 8155315 - DNA, 23 bp, Homo sapiens
ggctgagactacaggcgcttgcc

SEQ ID NO: 8155316 - DNA, 23 bp, Homo sapiens
ggctgagactacaggcgcttgcc

SEQ ID NO: 8155317 - DNA, 22 bp, Homo sapiens
ggctgagactagagtgaggcat

SEQ ID NO: 8155318 - DNA, 22 bp, Homo sapiens
ggctgagactagagtgaggcat

SEQ ID NO: 8155319 - DNA, 22 bp, Homo sapiens
ggctgagactagagtgaggcat

SEQ ID NO: 8155320 - DNA, 22 bp, Homo sapiens
ggctgagaatcaacaacctgct

SEQ ID NO: 8155321 - DNA, 22 bp, Homo sapiens
ggctgagacaacctgggaccca

SEQ ID NO: 8155322 - DNA, 22 bp, Homo sapiens
ggctgagacaacctgggaccca

SEQ ID NO: 8155323 - DNA, 22 bp, Homo sapiens
ggctgagaaggagtgggtgagg

SEQ ID NO: 8155324 - DNA, 23 bp, Homo sapiens
ggctgagaagtcccatgataggt

SEQ ID NO: 8155325 - DNA, 22 bp, Homo sapiens
ggctgaagtgtagtggctcact

SEQ ID NO: 8155326 - DNA, 22 bp, Homo sapiens
ggctgaaggatgaaagctgcag

SEQ ID NO: 8155327 - DNA, 22 bp, Homo sapiens
ggctgaagttctttttgttcag

SEQ ID NO: 8155328 - DNA, 22 bp, Homo sapiens
ggctgaagtgtagtggctcact

SEQ ID NO: 8155329 - DNA, 22 bp, Homo sapiens
ggctgacttctccagatctaaa

SEQ ID NO: 8155330 - DNA, 22 bp, Homo sapiens
ggctgagaacaggcccagcctc

SEQ ID NO: 8155331 - DNA, 22 bp, Homo sapiens
ggctgagaacaggcccagcctc

SEQ ID NO: 8155332 - DNA, 22 bp, Homo sapiens
ggctgagaaggagtgggtgagg

SEQ ID NO: 8155333 - DNA, 22 bp, Homo sapiens
ggctgagaaggagtgggtgagg

SEQ ID NO: 8155334 - DNA, 22 bp, Homo sapiens
ggctgagaagacagtggggtgg

SEQ ID NO: 8155335 - DNA, 22 bp, Homo sapiens
ggctctgggcatagaaggaagc

SEQ ID NO: 8155336 - DNA, 22 bp, Homo sapiens
ggctctgggcatagaaggaagc

SEQ ID NO: 8155337 - DNA, 22 bp, Homo sapiens
ggctctgggccagagttggctt

SEQ ID NO: 8155338 - DNA, 22 bp, Homo sapiens
ggctctgggcatagaaggaagc

SEQ ID NO: 8155339 - DNA, 22 bp, Homo sapiens
ggctctggctcctggctttgtg

SEQ ID NO: 8155340 - DNA, 22 bp, Homo sapiens
ggctctggctcctggctttgtg

SEQ ID NO: 8155341 - DNA, 22 bp, Homo sapiens
ggctctggctactccaccctgt

SEQ ID NO: 8155342 - DNA, 22 bp, Homo sapiens
ggctctgggaaatggtcttcct

SEQ ID NO: 8155343 - DNA, 22 bp, Homo sapiens
ggctctgggaaatggtcttcct

SEQ ID NO: 8155344 - DNA, 22 bp, Homo sapiens
ggctctggctcctggctttgtg

SEQ ID NO: 8155345 - DNA, 22 bp, Homo sapiens
ggctctggctactccaccctgt

SEQ ID NO: 8155346 - DNA, 22 bp, Homo sapiens
ggctctggcgtccaatggagcg

SEQ ID NO: 8155347 - DNA, 22 bp, Homo sapiens
ggctctggcgtccaatggagcg

SEQ ID NO: 8155348 - DNA, 22 bp, Homo sapiens
ggctctggcgtccaatggagcg

SEQ ID NO: 8155349 - DNA, 19 bp, Homo sapiens
ggctctggcggctgtagcc

SEQ ID NO: 8155350 - DNA, 19 bp, Homo sapiens
ggctctggcggctgtagcc

SEQ ID NO: 8155351 - DNA, 19 bp, Homo sapiens
ggctctggcggctgtagcc

SEQ ID NO: 8155352 - DNA, 19 bp, Homo sapiens
ggctctggcggctgtagcc

SEQ ID NO: 8155353 - DNA, 19 bp, Homo sapiens
ggctctggcggctgtagcc

SEQ ID NO: 8155354 - DNA, 22 bp, Homo sapiens
ggctctggagatgtccgacctg

SEQ ID NO: 8155355 - DNA, 22 bp, Homo sapiens
ggctctggagacatgtggagag

SEQ ID NO: 8155356 - DNA, 22 bp, Homo sapiens
ggctctggagcacagacgtctg

SEQ ID NO: 8155357 - DNA, 22 bp, Homo sapiens
ggctctggagatgtccgacctg

SEQ ID NO: 8155358 - DNA, 22 bp, Homo sapiens
ggctctggagatgtccgacctg

SEQ ID NO: 8155359 - DNA, 22 bp, Homo sapiens
ggctctggagcacagacgtctg

SEQ ID NO: 8155360 - DNA, 22 bp, Homo sapiens
ggctctggagcacagacgtctg

SEQ ID NO: 8155361 - DNA, 22 bp, Homo sapiens
ggctctggagcacagacgtctg

SEQ ID NO: 8155362 - DNA, 22 bp, Homo sapiens
ggctctggcgagctttagtaca

SEQ ID NO: 8155363 - DNA, 22 bp, Homo sapiens
ggctctggcgagctttagtaca

SEQ ID NO: 8155364 - DNA, 22 bp, Homo sapiens
ggctctggcggctctttcaata

SEQ ID NO: 8155365 - DNA, 22 bp, Homo sapiens
ggctctggcaaggggaggctac

SEQ ID NO: 8155366 - DNA, 22 bp, Homo sapiens
ggctctggcaaggggaggctac

SEQ ID NO: 8155367 - DNA, 22 bp, Homo sapiens
ggctctggcaaggggaggctac

SEQ ID NO: 8155368 - DNA, 22 bp, Homo sapiens
ggctccaggagatgctgggcag

SEQ ID NO: 8155369 - DNA, 22 bp, Homo sapiens
ggctccaggagggccttggcca

SEQ ID NO: 8155370 - DNA, 22 bp, Homo sapiens
ggctccaggagatgctgggcag

SEQ ID NO: 8155371 - DNA, 22 bp, Homo sapiens
ggctccaggagatgctgggcag

SEQ ID NO: 8155372 - DNA, 22 bp, Homo sapiens
ggctccaggagatgctgggcag

SEQ ID NO: 8155373 - DNA, 22 bp, Homo sapiens
ggctccaggagatgctgggcag

SEQ ID NO: 8155374 - DNA, 23 bp, Homo sapiens
ggctccaggcctgacgggcgcgg

SEQ ID NO: 8155375 - DNA, 22 bp, Homo sapiens
ggctccaggagggccttggcca

SEQ ID NO: 8155376 - DNA, 23 bp, Homo sapiens
ggctccaggcctgacgggcgcgg

SEQ ID NO: 8155377 - DNA, 22 bp, Homo sapiens
ggctctgctcacagcccgcagc

SEQ ID NO: 8155378 - DNA, 22 bp, Homo sapiens
ggctccaggagggccttggcca

SEQ ID NO: 8155379 - DNA, 22 bp, Homo sapiens
ggctctgctcctggtgccagtg

SEQ ID NO: 8155380 - DNA, 22 bp, Homo sapiens
ggctctgctgcaagtcttcctc

SEQ ID NO: 8155381 - DNA, 23 bp, Homo sapiens
ggctccaggcctgacgggcgcgg

SEQ ID NO: 8155382 - DNA, 22 bp, Homo sapiens
ggctctgctcctggtgccagtg

SEQ ID NO: 8155383 - DNA, 22 bp, Homo sapiens
ggctctgctcacagcccgcagc

SEQ ID NO: 8155384 - DNA, 22 bp, Homo sapiens
ggctctggagacatgtggagag

SEQ ID NO: 8155385 - DNA, 22 bp, Homo sapiens
ggctctggagacatgtggagag

SEQ ID NO: 8155386 - DNA, 22 bp, Homo sapiens
ggctctggagacatgtggagag

SEQ ID NO: 8155387 - DNA, 22 bp, Homo sapiens
ggctccagctaatggtttctat

SEQ ID NO: 8155388 - DNA, 22 bp, Homo sapiens
ggctccagccctggctcttcac

SEQ ID NO: 8155389 - DNA, 22 bp, Homo sapiens
ggctccagccctggctcttcac

SEQ ID NO: 8155390 - DNA, 22 bp, Homo sapiens
ggctccagatgtctcctggcaa

SEQ ID NO: 8155391 - DNA, 22 bp, Homo sapiens
ggctccagatgtctcctggcaa

SEQ ID NO: 8155392 - DNA, 22 bp, Homo sapiens
ggctccagatgtctcctggcaa

SEQ ID NO: 8155393 - DNA, 22 bp, Homo sapiens
ggctccaggaacctcctctcct

SEQ ID NO: 8155394 - DNA, 22 bp, Homo sapiens
ggctccaggaacctcctctcct

SEQ ID NO: 8155395 - DNA, 22 bp, Homo sapiens
ggctccaggaacctcctctcct

SEQ ID NO: 8155396 - DNA, 22 bp, Homo sapiens
ggctccaggagatgctgggcag

SEQ ID NO: 8155397 - DNA, 18 bp, Homo sapiens
ggctccaggacctaccca

SEQ ID NO: 8155398 - DNA, 18 bp, Homo sapiens
ggctccaggacctaccca

SEQ ID NO: 8155399 - DNA, 18 bp, Homo sapiens
ggctccaggacctaccca

SEQ ID NO: 8155400 - DNA, 22 bp, Homo sapiens
ggctccagatgtcccctggcaa

SEQ ID NO: 8155401 - DNA, 22 bp, Homo sapiens
ggctccagatgtcccctggcaa

SEQ ID NO: 8155402 - DNA, 22 bp, Homo sapiens
ggctccagaggccttacctgca

SEQ ID NO: 8155403 - DNA, 16 bp, Homo sapiens
ggctccagaatagcga

SEQ ID NO: 8155404 - DNA, 22 bp, Homo sapiens
ggctccagaggccttacctgca

SEQ ID NO: 8155405 - DNA, 22 bp, Homo sapiens
ggctccagaggccttacctgca

SEQ ID NO: 8155406 - DNA, 22 bp, Homo sapiens
ggctccagaaatcatagagcag

SEQ ID NO: 8155407 - DNA, 22 bp, Homo sapiens
ggctccagaaatcatagagcag

SEQ ID NO: 8155408 - DNA, 22 bp, Homo sapiens
ggctccagaaatcatagagcag

SEQ ID NO: 8155409 - DNA, 22 bp, Homo sapiens
ggctccagaaacttcagtccat

SEQ ID NO: 8155410 - DNA, 22 bp, Homo sapiens
ggctccagaaacttcagtccat

SEQ ID NO: 8155411 - DNA, 22 bp, Homo sapiens
ggctccaccctgcttccagaag

SEQ ID NO: 8155412 - DNA, 22 bp, Homo sapiens
ggctccagaaacttcagtccat

SEQ ID NO: 8155413 - DNA, 22 bp, Homo sapiens
ggctccagaaacttcagtccat

SEQ ID NO: 8155414 - DNA, 22 bp, Homo sapiens
ggctccagaaacttcagtccat

SEQ ID NO: 8155415 - DNA, 22 bp, Homo sapiens
ggcgggagcagcagctctgagc

SEQ ID NO: 8155416 - DNA, 22 bp, Homo sapiens
ggcgggagcagcagctctgagc

SEQ ID NO: 8155417 - DNA, 22 bp, Homo sapiens
ggcggctactcctcctggtgag

SEQ ID NO: 8155418 - DNA, 22 bp, Homo sapiens
ggcgggaagttcttgcccactt

SEQ ID NO: 8155419 - DNA, 22 bp, Homo sapiens
ggcgggaagttcttgcccactt

SEQ ID NO: 8155420 - DNA, 22 bp, Homo sapiens
ggcggccgccttcggccacggc

SEQ ID NO: 8155421 - DNA, 21 bp, Homo sapiens
ggcggcgcagagctgcggctc

SEQ ID NO: 8155422 - DNA, 22 bp, Homo sapiens
ggcggaggttgcagtaagccga

SEQ ID NO: 8155423 - DNA, 22 bp, Homo sapiens
ggcggccctgcacgtgctgagg

SEQ ID NO: 8155424 - DNA, 22 bp, Homo sapiens
ggcgggggtccaggagcctgca

SEQ ID NO: 8155425 - DNA, 22 bp, Homo sapiens
ggcgggaggctgaggagttggt

SEQ ID NO: 8155426 - DNA, 22 bp, Homo sapiens
ggcgggaggctgaggagttggt

SEQ ID NO: 8155427 - DNA, 22 bp, Homo sapiens
ggcgggaggctgaggagttggt

SEQ ID NO: 8155428 - DNA, 22 bp, Homo sapiens
ggcgggaggctgaggagttggt

SEQ ID NO: 8155429 - DNA, 22 bp, Homo sapiens
ggctgggccagggcctgtggac

SEQ ID NO: 8155430 - DNA, 22 bp, Homo sapiens
ggctgggccagggcctgtggac

SEQ ID NO: 8155431 - DNA, 22 bp, Homo sapiens
ggctgggccagggcctgtggac

SEQ ID NO: 8155432 - DNA, 22 bp, Homo sapiens
ggctgggcatccatccatgaga

SEQ ID NO: 8155433 - DNA, 22 bp, Homo sapiens
ggctgggcatccatccatgaga

SEQ ID NO: 8155434 - DNA, 22 bp, Homo sapiens
ggctgggcatccatccatgaga

SEQ ID NO: 8155435 - DNA, 21 bp, Homo sapiens
ggctgggcaggacccacccct

SEQ ID NO: 8155436 - DNA, 22 bp, Homo sapiens
ggctgggcaggtctgcacaggg

SEQ ID NO: 8155437 - DNA, 22 bp, Homo sapiens
ggctgggcaggtctgcacaggg

SEQ ID NO: 8155438 - DNA, 22 bp, Homo sapiens
ggctgggcaggtctgcacaggg

SEQ ID NO: 8155439 - DNA, 22 bp, Homo sapiens
ggctgggcaggtctgcacaggg

SEQ ID NO: 8155440 - DNA, 22 bp, Homo sapiens
ggctgggcaggtctgcacaggg

SEQ ID NO: 8155441 - DNA, 22 bp, Homo sapiens
ggctgggctccgggagcatgcg

SEQ ID NO: 8155442 - DNA, 22 bp, Homo sapiens
ggctgggctccgggagcatgcg

SEQ ID NO: 8155443 - DNA, 22 bp, Homo sapiens
ggctgggccgcggctacccaga

SEQ ID NO: 8155444 - DNA, 19 bp, Homo sapiens
ggctgggccctgtttctcc

SEQ ID NO: 8155445 - DNA, 22 bp, Homo sapiens
ggctgggctccgggagcatgcg

SEQ ID NO: 8155446 - DNA, 22 bp, Homo sapiens
ggctgggctcgctgattggctg

SEQ ID NO: 8155447 - DNA, 22 bp, Homo sapiens
ggctgggctcgctgattggctg

SEQ ID NO: 8155448 - DNA, 22 bp, Homo sapiens
ggctgggctccgggagcatgcg

SEQ ID NO: 8155449 - DNA, 22 bp, Homo sapiens
ggctgggctccgggagcatgcg

SEQ ID NO: 8155450 - DNA, 22 bp, Homo sapiens
ggctgggctccgggagcatgcg

SEQ ID NO: 8155451 - DNA, 22 bp, Homo sapiens
ggcttctcctggaagtacagag

SEQ ID NO: 8155452 - DNA, 22 bp, Homo sapiens
ggcttctcccttcttctgattg

SEQ ID NO: 8155453 - DNA, 22 bp, Homo sapiens
ggcttctcccctttgagtcttc

SEQ ID NO: 8155454 - DNA, 22 bp, Homo sapiens
ggcttctcccctttgagtcttc

SEQ ID NO: 8155455 - DNA, 22 bp, Homo sapiens
ggcttctcccattcttcagggg

SEQ ID NO: 8155456 - DNA, 22 bp, Homo sapiens
ggcttctcccattcttcagggg

SEQ ID NO: 8155457 - DNA, 22 bp, Homo sapiens
ggcttctcccattcttcagggg

SEQ ID NO: 8155458 - DNA, 22 bp, Homo sapiens
ggcttctcctggaagtacagag

SEQ ID NO: 8155459 - DNA, 22 bp, Homo sapiens
ggcttctctaaagatcatgcgt

SEQ ID NO: 8155460 - DNA, 22 bp, Homo sapiens
ggcttctctaaagatcatgcgt

SEQ ID NO: 8155461 - DNA, 22 bp, Homo sapiens
ggcttctctccagtatgcattc

SEQ ID NO: 8155462 - DNA, 22 bp, Homo sapiens
ggcttctctcccccagctccac

SEQ ID NO: 8155463 - DNA, 22 bp, Homo sapiens
ggcttctctcttcacatggctt

SEQ ID NO: 8155464 - DNA, 22 bp, Homo sapiens
ggcttctctcttcacatggctt

SEQ ID NO: 8155465 - DNA, 22 bp, Homo sapiens
ggctgggctgcggctgtacctg

SEQ ID NO: 8155466 - DNA, 22 bp, Homo sapiens
ggctgggctgcggctgtacctg

SEQ ID NO: 8155467 - DNA, 22 bp, Homo sapiens
ggctgggctgcggctgtacctg

SEQ ID NO: 8155468 - DNA, 22 bp, Homo sapiens
ggctgggctgctgggtcagagc

SEQ ID NO: 8155469 - DNA, 22 bp, Homo sapiens
ggctgggctgctgggtcagagc

SEQ ID NO: 8155470 - DNA, 22 bp, Homo sapiens
ggcttctccaggtactgagcat

SEQ ID NO: 8155471 - DNA, 22 bp, Homo sapiens
ggctgggctgctgggtcagagc

SEQ ID NO: 8155472 - DNA, 22 bp, Homo sapiens
ggctgggctgctgggtcagagc

SEQ ID NO: 8155473 - DNA, 22 bp, Homo sapiens
ggcttctccaggtactgagcat

SEQ ID NO: 8155474 - DNA, 22 bp, Homo sapiens
ggcttctccaggtactgagcat

SEQ ID NO: 8155475 - DNA, 18 bp, Homo sapiens
ggcttctctgtttatttc

SEQ ID NO: 8155476 - DNA, 22 bp, Homo sapiens
ggcttctctgtctagtttctac

SEQ ID NO: 8155477 - DNA, 22 bp, Homo sapiens
ggcttctgaaatctctgtgcgt

SEQ ID NO: 8155478 - DNA, 22 bp, Homo sapiens
ggcttctgaaatctctgtgcgt

SEQ ID NO: 8155479 - DNA, 22 bp, Homo sapiens
ggcttctgaaccaggccctgga

SEQ ID NO: 8155480 - DNA, 22 bp, Homo sapiens
ggcttctgagtgctctgctgtt

SEQ ID NO: 8155481 - DNA, 22 bp, Homo sapiens
ggcttctgagtgctctgctgtt

SEQ ID NO: 8155482 - DNA, 22 bp, Homo sapiens
ggcttctgagtgctctgctgtt

SEQ ID NO: 8155483 - DNA, 22 bp, Homo sapiens
ggcttctgagtgctctgctgtt

SEQ ID NO: 8155484 - DNA, 22 bp, Homo sapiens
ggcttctggtaaagaccacacc

SEQ ID NO: 8155485 - DNA, 22 bp, Homo sapiens
ggcttctgtctcaagcaccagc

SEQ ID NO: 8155486 - DNA, 22 bp, Homo sapiens
ggcttctggtgggagcatgact

SEQ ID NO: 8155487 - DNA, 22 bp, Homo sapiens
ggcttctgctcagcctgcacgc

SEQ ID NO: 8155488 - DNA, 22 bp, Homo sapiens
ggcttctgctcagcctgcacgc

SEQ ID NO: 8155489 - DNA, 22 bp, Homo sapiens
ggcttctgctcagcctgcacgc

SEQ ID NO: 8155490 - DNA, 22 bp, Homo sapiens
ggcttctgctcagcctgcacgc

SEQ ID NO: 8155491 - DNA, 22 bp, Homo sapiens
ggcttctgctcagcctgcacgc

SEQ ID NO: 8155492 - DNA, 22 bp, Homo sapiens
ggcttctgccttgccagttctt

SEQ ID NO: 8155493 - DNA, 21 bp, Homo sapiens
ggctgctgggagagctgcgtg

SEQ ID NO: 8155494 - DNA, 21 bp, Homo sapiens
ggctgctgggagagctgcgtg

SEQ ID NO: 8155495 - DNA, 21 bp, Homo sapiens
ggctgctgggagagctgcgtg

SEQ ID NO: 8155496 - DNA, 22 bp, Homo sapiens
ggctgctggggacgtgggagag

SEQ ID NO: 8155497 - DNA, 22 bp, Homo sapiens
ggctggcttgcggagtcacaga

SEQ ID NO: 8155498 - DNA, 22 bp, Homo sapiens
ggctggcttggtgagctgtcac

SEQ ID NO: 8155499 - DNA, 22 bp, Homo sapiens
ggctggcttggtgagctgtcac

SEQ ID NO: 8155500 - DNA, 22 bp, Homo sapiens
ggctggcttgcggagtcacaga

SEQ ID NO: 8155501 - DNA, 22 bp, Homo sapiens
ggctggcttgcggagtcacaga

SEQ ID NO: 8155502 - DNA, 22 bp, Homo sapiens
ggctgggcagcagctgttaagc

SEQ ID NO: 8155503 - DNA, 22 bp, Homo sapiens
ggctgggcagcagctgttaagc

SEQ ID NO: 8155504 - DNA, 22 bp, Homo sapiens
ggctgggcaaacaagactcttc

SEQ ID NO: 8155505 - DNA, 22 bp, Homo sapiens
ggctgggcaaacaagactcttc

SEQ ID NO: 8155506 - DNA, 22 bp, Homo sapiens
ggctgggcaaacaagactcttc

SEQ ID NO: 8155507 - DNA, 22 bp, Homo sapiens
ggctgggcaaacaagactcttc

SEQ ID NO: 8155508 - DNA, 22 bp, Homo sapiens
ggctgggaggccgtgctgacct

SEQ ID NO: 8155509 - DNA, 22 bp, Homo sapiens
ggctgggaggccgtgctgacct

SEQ ID NO: 8155510 - DNA, 22 bp, Homo sapiens
ggctggcttggtgagctgtcac

SEQ ID NO: 8155511 - DNA, 22 bp, Homo sapiens
ggctgggaggccgtgctgacct

SEQ ID NO: 8155512 - DNA, 22 bp, Homo sapiens
ggctgggaggccgtgctgacct

SEQ ID NO: 8155513 - DNA, 22 bp, Homo sapiens
ggctgctggattgtgtatctgt

SEQ ID NO: 8155514 - DNA, 22 bp, Homo sapiens
ggctgctggcagatgtagttta

SEQ ID NO: 8155515 - DNA, 22 bp, Homo sapiens
ggctgctggcagatgtagttta

SEQ ID NO: 8155516 - DNA, 22 bp, Homo sapiens
ggctgctggcattgaggtaggt

SEQ ID NO: 8155517 - DNA, 22 bp, Homo sapiens
ggctgctggcattgaggtaggt

SEQ ID NO: 8155518 - DNA, 22 bp, Homo sapiens
ggctgctggcattgaggtaggt

SEQ ID NO: 8155519 - DNA, 22 bp, Homo sapiens
ggctgctggcattgaggtaggt

SEQ ID NO: 8155520 - DNA, 22 bp, Homo sapiens
ggctgctggcattgaggtaggt

SEQ ID NO: 8155521 - DNA, 22 bp, Homo sapiens
ggctgctggcattgaggtaggt

SEQ ID NO: 8155522 - DNA, 22 bp, Homo sapiens
ggctgctggcattgaggtaggt

SEQ ID NO: 8155523 - DNA, 22 bp, Homo sapiens
ggctgctggcctctccccggcc

SEQ ID NO: 8155524 - DNA, 22 bp, Homo sapiens
ggctgctgggaatatgccagct

SEQ ID NO: 8155525 - DNA, 22 bp, Homo sapiens
ggctgctggccagcctaggagt

SEQ ID NO: 8155526 - DNA, 22 bp, Homo sapiens
ggctgctgggaatatgccagct

SEQ ID NO: 8155527 - DNA, 22 bp, Homo sapiens
ggctgctgggaatatgccagct

SEQ ID NO: 8155528 - DNA, 22 bp, Homo sapiens
ggctgctgggaatatgccagct

SEQ ID NO: 8155529 - DNA, 22 bp, Homo sapiens
ggctgctgggaatatgccagct

SEQ ID NO: 8155530 - DNA, 22 bp, Homo sapiens
ggctgctgggaatatgccagct

SEQ ID NO: 8155531 - DNA, 22 bp, Homo sapiens
ggctgctgagtcacgacagtga

SEQ ID NO: 8155532 - DNA, 22 bp, Homo sapiens
ggctgctgagtcacgacagtga

SEQ ID NO: 8155533 - DNA, 22 bp, Homo sapiens
ggctgctgagtcacgacagtga

SEQ ID NO: 8155534 - DNA, 22 bp, Homo sapiens
ggctgctgcccacccctgcatg

SEQ ID NO: 8155535 - DNA, 22 bp, Homo sapiens
ggctgctgagttggccaggaga

SEQ ID NO: 8155536 - DNA, 22 bp, Homo sapiens
ggctgctgagttggccaggaga

SEQ ID NO: 8155537 - DNA, 22 bp, Homo sapiens
ggctgctgagttggccaggaga

SEQ ID NO: 8155538 - DNA, 22 bp, Homo sapiens
ggctgctgctgtgtaggcctgt

SEQ ID NO: 8155539 - DNA, 22 bp, Homo sapiens
ggctgctggaagactgaacaag

SEQ ID NO: 8155540 - DNA, 22 bp, Homo sapiens
ggctgctggaagactgaacaag

SEQ ID NO: 8155541 - DNA, 22 bp, Homo sapiens
ggctgctggagttgggtctctc

SEQ ID NO: 8155542 - DNA, 22 bp, Homo sapiens
ggctgctgctgtgtaggcctgt

SEQ ID NO: 8155543 - DNA, 22 bp, Homo sapiens
ggctgctgctgtgtaggcctgt

SEQ ID NO: 8155544 - DNA, 22 bp, Homo sapiens
ggctgctgccctcctaagtgca

SEQ ID NO: 8155545 - DNA, 22 bp, Homo sapiens
ggctgctgccctcctaagtgca

SEQ ID NO: 8155546 - DNA, 22 bp, Homo sapiens
ggctgctgcccacccctgcatg

SEQ ID NO: 8155547 - DNA, 22 bp, Homo sapiens
ggctgctgcccacccctgcatg

SEQ ID NO: 8155548 - DNA, 22 bp, Homo sapiens
ggctgagcaattttgatgacat

SEQ ID NO: 8155549 - DNA, 22 bp, Homo sapiens
ggctgagcaattttgatgacat

SEQ ID NO: 8155550 - DNA, 22 bp, Homo sapiens
ggctgagcaattttgatgacat

SEQ ID NO: 8155551 - DNA, 22 bp, Homo sapiens
ggctgagcactttaggcaggag

SEQ ID NO: 8155552 - DNA, 22 bp, Homo sapiens
ggctgagcaattttgatgacat

SEQ ID NO: 8155553 - DNA, 22 bp, Homo sapiens
ggctgagcactttaggcaggag

SEQ ID NO: 8155554 - DNA, 22 bp, Homo sapiens
ggctgagagtggatcccaggga

SEQ ID NO: 8155555 - DNA, 22 bp, Homo sapiens
ggctgagagtttcctctggggc

SEQ ID NO: 8155556 - DNA, 21 bp, Homo sapiens
ggctgagatggcagaatcacc

SEQ ID NO: 8155557 - DNA, 22 bp, Homo sapiens
ggctgagaggacgtcgggctca

SEQ ID NO: 8155558 - DNA, 22 bp, Homo sapiens
ggctgagagtggatcccaggga

SEQ ID NO: 8155559 - DNA, 22 bp, Homo sapiens
ggctgagagtggatcccaggga

SEQ ID NO: 8155560 - DNA, 22 bp, Homo sapiens
ggctgagaggacgtcgggctca

SEQ ID NO: 8155561 - DNA, 22 bp, Homo sapiens
ggctgctgaagtgtggcaatct

SEQ ID NO: 8155562 - DNA, 22 bp, Homo sapiens
ggctgctgaagtgtggcaatct

SEQ ID NO: 8155563 - DNA, 22 bp, Homo sapiens
ggctgagcactttaggcaggag

SEQ ID NO: 8155564 - DNA, 22 bp, Homo sapiens
ggctgagcactttaggcaggag

SEQ ID NO: 8155565 - DNA, 22 bp, Homo sapiens
ggctgagcactttaggcaggag

SEQ ID NO: 8155566 - DNA, 22 bp, Homo sapiens
ggctgagcactttaggcaggag

SEQ ID NO: 8155567 - DNA, 19 bp, Homo sapiens
ggctgctgaagagaattac

SEQ ID NO: 8155568 - DNA, 22 bp, Homo sapiens
ggctgctgaagtgtggcaatct

SEQ ID NO: 8155569 - DNA, 22 bp, Homo sapiens
ggctgctgacttcatccagctt

SEQ ID NO: 8155570 - DNA, 22 bp, Homo sapiens
ggctgctgacttcatccagctt

SEQ ID NO: 8155571 - DNA, 22 bp, Homo sapiens
ggctgctgacaaacatgatcat

SEQ ID NO: 8155572 - DNA, 22 bp, Homo sapiens
ggctgctgacaaacatgatcat

SEQ ID NO: 8155573 - DNA, 22 bp, Homo sapiens
gggacatctttctagtcagggt

SEQ ID NO: 8155574 - DNA, 22 bp, Homo sapiens
gggacatgaagcatcggaggca

SEQ ID NO: 8155575 - DNA, 22 bp, Homo sapiens
gggacatgaggccatagtgatt

SEQ ID NO: 8155576 - DNA, 22 bp, Homo sapiens
gggacatgaggccatagtgatt

SEQ ID NO: 8155577 - DNA, 22 bp, Homo sapiens
gggacatgcccctcagtgggtg

SEQ ID NO: 8155578 - DNA, 22 bp, Homo sapiens
gggacatgaggccatagtgatt

SEQ ID NO: 8155579 - DNA, 22 bp, Homo sapiens
gggacaggcccctcgctagctt

SEQ ID NO: 8155580 - DNA, 22 bp, Homo sapiens
gggacaggcccctcgctagctt

SEQ ID NO: 8155581 - DNA, 22 bp, Homo sapiens
gggacaggctgagacttgagct

SEQ ID NO: 8155582 - DNA, 22 bp, Homo sapiens
gggacaggctgagacttgagct

SEQ ID NO: 8155583 - DNA, 22 bp, Homo sapiens
gggacaggctgagacttgagct

SEQ ID NO: 8155584 - DNA, 22 bp, Homo sapiens
gggacaggctgagacttgagct

SEQ ID NO: 8155585 - DNA, 22 bp, Homo sapiens
gggacaggctgagacttgagct

SEQ ID NO: 8155586 - DNA, 22 bp, Homo sapiens
gggacatggctaggattccaat

SEQ ID NO: 8155587 - DNA, 22 bp, Homo sapiens
gggacatggaggcgcgcaggca

SEQ ID NO: 8155588 - DNA, 22 bp, Homo sapiens
gggacatgcccctcagtgggtg

SEQ ID NO: 8155589 - DNA, 22 bp, Homo sapiens
gggaccactccgacatgtaggg

SEQ ID NO: 8155590 - DNA, 22 bp, Homo sapiens
gggacatttgctatcggagttc

SEQ ID NO: 8155591 - DNA, 22 bp, Homo sapiens
gggacatttatcagatgaccat

SEQ ID NO: 8155592 - DNA, 22 bp, Homo sapiens
gggagaagtggaaatctcatta

SEQ ID NO: 8155593 - DNA, 23 bp, Homo sapiens
gggaccagctagggctgtgacct

SEQ ID NO: 8155594 - DNA, 23 bp, Homo sapiens
gggaccagctagggctgtgacct

SEQ ID NO: 8155595 - DNA, 23 bp, Homo sapiens
gggaccagctagggctgtgacct

SEQ ID NO: 8155596 - DNA, 22 bp, Homo sapiens
gggacaggcaaaggtatgcttc

SEQ ID NO: 8155597 - DNA, 22 bp, Homo sapiens
gggacaggcaaaggtatgcttc

SEQ ID NO: 8155598 - DNA, 22 bp, Homo sapiens
gggacagctggtctacctggta

SEQ ID NO: 8155599 - DNA, 22 bp, Homo sapiens
gggacagcagaaagaaggcaag

SEQ ID NO: 8155600 - DNA, 22 bp, Homo sapiens
ggctttaaggtttaggaagcaa

SEQ ID NO: 8155601 - DNA, 22 bp, Homo sapiens
gggaatgtaatcatggaatgct

SEQ ID NO: 8155602 - DNA, 22 bp, Homo sapiens
ggctttatagggtagaggatca

SEQ ID NO: 8155603 - DNA, 22 bp, Homo sapiens
gggaatgtgaaacagtaaggga

SEQ ID NO: 8155604 - DNA, 22 bp, Homo sapiens
gggaatgtagcaaatctgcaat

SEQ ID NO: 8155605 - DNA, 22 bp, Homo sapiens
gggaatgtacagaggacacagg

SEQ ID NO: 8155606 - DNA, 22 bp, Homo sapiens
gggaatgtaattaatctccttc

SEQ ID NO: 8155607 - DNA, 22 bp, Homo sapiens
gggaatgtgcctggagtgttca

SEQ ID NO: 8155608 - DNA, 20 bp, Homo sapiens
gggaatgtgccccttacccc

SEQ ID NO: 8155609 - DNA, 22 bp, Homo sapiens
gggaatgtgcaggatcgtgggc

SEQ ID NO: 8155610 - DNA, 22 bp, Homo sapiens
gggaatgtgcagccacagtgag

SEQ ID NO: 8155611 - DNA, 22 bp, Homo sapiens
gggaatgtgattgttgttttaa

SEQ ID NO: 8155612 - DNA, 22 bp, Homo sapiens
gggaatgtgagtagggtgagtt

SEQ ID NO: 8155613 - DNA, 22 bp, Homo sapiens
ggcttgggagcaggcatgtgac

SEQ ID NO: 8155614 - DNA, 22 bp, Homo sapiens
ggcttgggagcaggcatgtgac

SEQ ID NO: 8155615 - DNA, 22 bp, Homo sapiens
ggcttgggagcaggcatgtgac

SEQ ID NO: 8155616 - DNA, 22 bp, Homo sapiens
ggcttgggagcaggcatgtgac

SEQ ID NO: 8155617 - DNA, 22 bp, Homo sapiens
ggcttggcttgggctcagaggc

SEQ ID NO: 8155618 - DNA, 22 bp, Homo sapiens
ggcttggcttgggctcagaggc

SEQ ID NO: 8155619 - DNA, 22 bp, Homo sapiens
ggcttggcttgggctcagaggc

SEQ ID NO: 8155620 - DNA, 22 bp, Homo sapiens
ggcttgggagcaggcatgtgac

SEQ ID NO: 8155621 - DNA, 22 bp, Homo sapiens
ggcttggctacaagccatgggc

SEQ ID NO: 8155622 - DNA, 22 bp, Homo sapiens
ggcttcttagaatttgacttac

SEQ ID NO: 8155623 - DNA, 22 bp, Homo sapiens
ggcttggctgtctcccagccca

SEQ ID NO: 8155624 - DNA, 20 bp, Homo sapiens
ggcttgtctgagtccctggc

SEQ ID NO: 8155625 - DNA, 20 bp, Homo sapiens
ggcttgtctgagtccctggc

SEQ ID NO: 8155626 - DNA, 22 bp, Homo sapiens
ggctttaaacactgaaattgca

SEQ ID NO: 8155627 - DNA, 22 bp, Homo sapiens
ggctttaacaacagaaatttat

SEQ ID NO: 8155628 - DNA, 19 bp, Homo sapiens
ggcttgtctcggcagccgc

SEQ ID NO: 8155629 - DNA, 22 bp, Homo sapiens
ggcttgtccttgggctgtgcat

SEQ ID NO: 8155630 - DNA, 21 bp, Homo sapiens
ggcttgtcaccatagctactg

SEQ ID NO: 8155631 - DNA, 22 bp, Homo sapiens
ggcttgtcatgttgatgttctt

SEQ ID NO: 8155632 - DNA, 19 bp, Homo sapiens
gggagagccaggctcaccc

SEQ ID NO: 8155633 - DNA, 22 bp, Homo sapiens
gggagagcgcgctagggccgag

SEQ ID NO: 8155634 - DNA, 22 bp, Homo sapiens
gggagagcgcgctagggccgag

SEQ ID NO: 8155635 - DNA, 22 bp, Homo sapiens
gggagagcgcgctagggccgag

SEQ ID NO: 8155636 - DNA, 22 bp, Homo sapiens
gggagaggttacccgagcaact

SEQ ID NO: 8155637 - DNA, 22 bp, Homo sapiens
gggagaggttacccgagcaact

SEQ ID NO: 8155638 - DNA, 22 bp, Homo sapiens
gggagagcgcgctagggccgag

SEQ ID NO: 8155639 - DNA, 22 bp, Homo sapiens
gggagagagagctcatgttgaa

SEQ ID NO: 8155640 - DNA, 22 bp, Homo sapiens
gggagagagaaaacgtggcgca

SEQ ID NO: 8155641 - DNA, 22 bp, Homo sapiens
gggagagagaaaacgtggcgca

SEQ ID NO: 8155642 - DNA, 22 bp, Homo sapiens
gggagagagagctcatgttgaa

SEQ ID NO: 8155643 - DNA, 22 bp, Homo sapiens
gggagagagagctcatgttgaa

SEQ ID NO: 8155644 - DNA, 19 bp, Homo sapiens
gggagagccaggctcaccc

SEQ ID NO: 8155645 - DNA, 22 bp, Homo sapiens
gggagagaattattgccagacc

SEQ ID NO: 8155646 - DNA, 22 bp, Homo sapiens
gggagacagttcagatagtttc

SEQ ID NO: 8155647 - DNA, 22 bp, Homo sapiens
gggagacccccaatgccaggtc

SEQ ID NO: 8155648 - DNA, 22 bp, Homo sapiens
gggagctgtagtccagataccg

SEQ ID NO: 8155649 - DNA, 22 bp, Homo sapiens
gggagctgtaagggacaggtag

SEQ ID NO: 8155650 - DNA, 22 bp, Homo sapiens
gggagctgtaagggacaggtag

SEQ ID NO: 8155651 - DNA, 22 bp, Homo sapiens
gggagctgtaagggacaggtag

SEQ ID NO: 8155652 - DNA, 19 bp, Homo sapiens
gggagctgtctgcccgtgg

SEQ ID NO: 8155653 - DNA, 22 bp, Homo sapiens
gggagctgtagtccagataccg

SEQ ID NO: 8155654 - DNA, 22 bp, Homo sapiens
gggagctgtcatcagtgttgtc

SEQ ID NO: 8155655 - DNA, 22 bp, Homo sapiens
gggagctgtcatcagtgttgtc

SEQ ID NO: 8155656 - DNA, 22 bp, Homo sapiens
gggagctgtcatcagtgttgtc

SEQ ID NO: 8155657 - DNA, 22 bp, Homo sapiens
gggagctgtcatcagtgttgtc

SEQ ID NO: 8155658 - DNA, 22 bp, Homo sapiens
gggagctggttcctgccctcca

SEQ ID NO: 8155659 - DNA, 22 bp, Homo sapiens
gggagctggttcctgccctcca

SEQ ID NO: 8155660 - DNA, 22 bp, Homo sapiens
gggagctgggctggttttgctg

SEQ ID NO: 8155661 - DNA, 18 bp, Homo sapiens
gggagctgggaagctggt

SEQ ID NO: 8155662 - DNA, 22 bp, Homo sapiens
gggagctggggcatttataccc

SEQ ID NO: 8155663 - DNA, 22 bp, Homo sapiens
gggagaggttacccgagcaact

SEQ ID NO: 8155664 - DNA, 22 bp, Homo sapiens
gggagaggttacccgagcaact

SEQ ID NO: 8155665 - DNA, 22 bp, Homo sapiens
gggagaggttacccgagcaact

SEQ ID NO: 8155666 - DNA, 22 bp, Homo sapiens
gggagaggttacccgagcaact

SEQ ID NO: 8155667 - DNA, 22 bp, Homo sapiens
gggagatgaatcagaagtgatc

SEQ ID NO: 8155668 - DNA, 22 bp, Homo sapiens
gggagatgaatcagaagtgatc

SEQ ID NO: 8155669 - DNA, 17 bp, Homo sapiens
gggagatgaagggatat

SEQ ID NO: 8155670 - DNA, 18 bp, Homo sapiens
gggagctgggaagctggt

SEQ ID NO: 8155671 - DNA, 18 bp, Homo sapiens
gggagctgggaagctggt

SEQ ID NO: 8155672 - DNA, 18 bp, Homo sapiens
gggagctgggaagctggt

SEQ ID NO: 8155673 - DNA, 22 bp, Homo sapiens
gggagctggcggattccccagg

SEQ ID NO: 8155674 - DNA, 23 bp, Homo sapiens
gggcatggagtgtaggtggaagg

SEQ ID NO: 8155675 - DNA, 23 bp, Homo sapiens
gggcatggagtgtaggtggaagg

SEQ ID NO: 8155676 - DNA, 18 bp, Homo sapiens
gggcatggatgcagcatc

SEQ ID NO: 8155677 - DNA, 18 bp, Homo sapiens
gggcatggatgcagcatc

SEQ ID NO: 8155678 - DNA, 18 bp, Homo sapiens
gggcatggatgcagcatc

SEQ ID NO: 8155679 - DNA, 18 bp, Homo sapiens
gggcatggatgcagcatc

SEQ ID NO: 8155680 - DNA, 22 bp, Homo sapiens
gggcaggaggctaattctgcat

SEQ ID NO: 8155681 - DNA, 22 bp, Homo sapiens
gggcaggctgagcatgtcacct

SEQ ID NO: 8155682 - DNA, 17 bp, Homo sapiens
gggcagggactcctggg

SEQ ID NO: 8155683 - DNA, 22 bp, Homo sapiens
gggcatgcctgcgcagtgcatg

SEQ ID NO: 8155684 - DNA, 22 bp, Homo sapiens
gggcaggaggctaattctgcat

SEQ ID NO: 8155685 - DNA, 22 bp, Homo sapiens
gggcaggagagggccacctgga

SEQ ID NO: 8155686 - DNA, 22 bp, Homo sapiens
gggcaggagagggccacctgga

SEQ ID NO: 8155687 - DNA, 22 bp, Homo sapiens
gggcaggagagggccacctgga

SEQ ID NO: 8155688 - DNA, 22 bp, Homo sapiens
gggcaggagagaacagtcatgg

SEQ ID NO: 8155689 - DNA, 22 bp, Homo sapiens
gggcaggagaaggtggatgtcc

SEQ ID NO: 8155690 - DNA, 22 bp, Homo sapiens
gggcaggagagaacagtcatgg

SEQ ID NO: 8155691 - DNA, 22 bp, Homo sapiens
gggcaggagaaggtggatgtcc

SEQ ID NO: 8155692 - DNA, 22 bp, Homo sapiens
gggcaggagaaggtggatgtcc

SEQ ID NO: 8155693 - DNA, 22 bp, Homo sapiens
gggcaggagaaggtggatgtcc

SEQ ID NO: 8155694 - DNA, 16 bp, Homo sapiens
gggcaggaatcagggt

SEQ ID NO: 8155695 - DNA, 22 bp, Homo sapiens
gggcacaggaatttgggatgtg

SEQ ID NO: 8155696 - DNA, 22 bp, Homo sapiens
gggcacaggaatttgggatgtg

SEQ ID NO: 8155697 - DNA, 22 bp, Homo sapiens
gggcacaggaatttgggatgtg

SEQ ID NO: 8155698 - DNA, 22 bp, Homo sapiens
gggcacaggagaaggatctggc

SEQ ID NO: 8155699 - DNA, 22 bp, Homo sapiens
gggcacaggagaaggatctggc

SEQ ID NO: 8155700 - DNA, 22 bp, Homo sapiens
gggcagctgcagggatggtgac

SEQ ID NO: 8155701 - DNA, 22 bp, Homo sapiens
gggcagctctggctgtgggaag

SEQ ID NO: 8155702 - DNA, 22 bp, Homo sapiens
gggcagctctgcccatcagagg

SEQ ID NO: 8155703 - DNA, 22 bp, Homo sapiens
gggcagctgcccctctctgggc

SEQ ID NO: 8155704 - DNA, 22 bp, Homo sapiens
gggcagctgcagggatggtgac

SEQ ID NO: 8155705 - DNA, 22 bp, Homo sapiens
gggcagctggcttataggtttg

SEQ ID NO: 8155706 - DNA, 22 bp, Homo sapiens
gggcaggaacaaatcaaatgat

SEQ ID NO: 8155707 - DNA, 22 bp, Homo sapiens
gggattgaattgggggatcaca

SEQ ID NO: 8155708 - DNA, 22 bp, Homo sapiens
gggatttgaatcttgagttgag

SEQ ID NO: 8155709 - DNA, 22 bp, Homo sapiens
gggatttcaccatgttggttgg

SEQ ID NO: 8155710 - DNA, 22 bp, Homo sapiens
gggattaatgtctctttgaaag

SEQ ID NO: 8155711 - DNA, 22 bp, Homo sapiens
gggattaaacaccacttgaagg

SEQ ID NO: 8155712 - DNA, 21 bp, Homo sapiens
gggattaagtgacttgcctga

SEQ ID NO: 8155713 - DNA, 15 bp, Homo sapiens
gggattaaagagccc

SEQ ID NO: 8155714 - DNA, 22 bp, Homo sapiens
gggatttgtgggatggccagtg

SEQ ID NO: 8155715 - DNA, 22 bp, Homo sapiens
gggatggggtcaacatgtacct

SEQ ID NO: 8155716 - DNA, 22 bp, Homo sapiens
gggatggggtcgggaccctgct

SEQ ID NO: 8155717 - DNA, 22 bp, Homo sapiens
gggatgtcgtgggtggcagctg

SEQ ID NO: 8155718 - DNA, 22 bp, Homo sapiens
gggatgtcactgtgcctggcac

SEQ ID NO: 8155719 - DNA, 22 bp, Homo sapiens
gggatggggtcgggaccctgct

SEQ ID NO: 8155720 - DNA, 22 bp, Homo sapiens
gggcacagcctaactatggaga

SEQ ID NO: 8155721 - DNA, 22 bp, Homo sapiens
gggcacagcctaactatggaga

SEQ ID NO: 8155722 - DNA, 22 bp, Homo sapiens
gggcacagcctaactatggaga

SEQ ID NO: 8155723 - DNA, 22 bp, Homo sapiens
gggcacagcctaactatggaga

SEQ ID NO: 8155724 - DNA, 22 bp, Homo sapiens
gggcaagcacagcgagcgtgcg

SEQ ID NO: 8155725 - DNA, 22 bp, Homo sapiens
gggcaagaagctggaagcattc

SEQ ID NO: 8155726 - DNA, 22 bp, Homo sapiens
gggcaagcacagcgagcgtgcg

SEQ ID NO: 8155727 - DNA, 22 bp, Homo sapiens
gggcaagaagctggaagcattc

SEQ ID NO: 8155728 - DNA, 19 bp, Homo sapiens
gggcaaatcccttctttct

SEQ ID NO: 8155729 - DNA, 22 bp, Homo sapiens
gggcaagaagctggaagcattc

SEQ ID NO: 8155730 - DNA, 22 bp, Homo sapiens
gggcaaagtggtggaggcagtt

SEQ ID NO: 8155731 - DNA, 22 bp, Homo sapiens
gggatggggagctggaaagggg

SEQ ID NO: 8155732 - DNA, 22 bp, Homo sapiens
gggatggggagctggaaagggg

SEQ ID NO: 8155733 - DNA, 22 bp, Homo sapiens
gggatggggagctggaaagggg

SEQ ID NO: 8155734 - DNA, 22 bp, Homo sapiens
gggatggggagctggaaagggg

SEQ ID NO: 8155735 - DNA, 22 bp, Homo sapiens
gggatggggggaagcgtccatg

SEQ ID NO: 8155736 - DNA, 22 bp, Homo sapiens
gggaggagctgagtgtgtgtgc

SEQ ID NO: 8155737 - DNA, 22 bp, Homo sapiens
gggaggagctgagtgtgtgtgc

SEQ ID NO: 8155738 - DNA, 22 bp, Homo sapiens
gggaggagcttggagattcact

SEQ ID NO: 8155739 - DNA, 22 bp, Homo sapiens
gggaggagctgagtgtgtgtgc

SEQ ID NO: 8155740 - DNA, 22 bp, Homo sapiens
gggaggagctgagtgtgtgtgc

SEQ ID NO: 8155741 - DNA, 22 bp, Homo sapiens
gggaggagctgagtgtgtgtgc

SEQ ID NO: 8155742 - DNA, 22 bp, Homo sapiens
gggaggagctgagtgtgtgtgc

SEQ ID NO: 8155743 - DNA, 22 bp, Homo sapiens
gggaggacggtccagggcaaag

SEQ ID NO: 8155744 - DNA, 22 bp, Homo sapiens
gggaggacggtccagggcaaag

SEQ ID NO: 8155745 - DNA, 22 bp, Homo sapiens
gggaggaaatgtgcagcgaatt

SEQ ID NO: 8155746 - DNA, 22 bp, Homo sapiens
gggaggaaagagaagtggtcca

SEQ ID NO: 8155747 - DNA, 22 bp, Homo sapiens
gggaggaaagagaagtggtcca

SEQ ID NO: 8155748 - DNA, 22 bp, Homo sapiens
gggagcttctggaaggcaggaa

SEQ ID NO: 8155749 - DNA, 19 bp, Homo sapiens
gggagctgtctgcccgtgg

SEQ ID NO: 8155750 - DNA, 23 bp, Homo sapiens
gggagctgtggtgaaaagaggtg

SEQ ID NO: 8155751 - DNA, 23 bp, Homo sapiens
gggagctgtggtgaaaagaggtg

SEQ ID NO: 8155752 - DNA, 22 bp, Homo sapiens
gggagctgtgggattggttgag

SEQ ID NO: 8155753 - DNA, 22 bp, Homo sapiens
gggaggaatgcaacttatttag

SEQ ID NO: 8155754 - DNA, 22 bp, Homo sapiens
gggaggaaggcttgggtgagta

SEQ ID NO: 8155755 - DNA, 22 bp, Homo sapiens
gggaggaaggcttgggtgagta

SEQ ID NO: 8155756 - DNA, 22 bp, Homo sapiens
gggaggaaggcttgggtgagta

SEQ ID NO: 8155757 - DNA, 22 bp, Homo sapiens
gggaggaaggcttgggtgagta

SEQ ID NO: 8155758 - DNA, 22 bp, Homo sapiens
gggaggaaatgtgcagcgaatt

SEQ ID NO: 8155759 - DNA, 22 bp, Homo sapiens
gggaggaaatgtgcagcgaatt

SEQ ID NO: 8155760 - DNA, 23 bp, Homo sapiens
gggctgctccaggccaaggctgg

SEQ ID NO: 8155761 - DNA, 22 bp, Homo sapiens
gggctgctgccaatcacagcct

SEQ ID NO: 8155762 - DNA, 23 bp, Homo sapiens
gggctgctccaggccaaggctgg

SEQ ID NO: 8155763 - DNA, 22 bp, Homo sapiens
gggctgctataacaagatacct

SEQ ID NO: 8155764 - DNA, 22 bp, Homo sapiens
gggctgctacgagaactgaata

SEQ ID NO: 8155765 - DNA, 22 bp, Homo sapiens
gggctgcctttcttctgggagc

SEQ ID NO: 8155766 - DNA, 22 bp, Homo sapiens
gggctgcactagggcaaggtga

SEQ ID NO: 8155767 - DNA, 22 bp, Homo sapiens
gggctgcatcagcaggacccgg

SEQ ID NO: 8155768 - DNA, 22 bp, Homo sapiens
gggctgccaagcctgcctgcct

SEQ ID NO: 8155769 - DNA, 22 bp, Homo sapiens
gggctgccaagcctgcctgcct

SEQ ID NO: 8155770 - DNA, 22 bp, Homo sapiens
gggctgccaagcctgcctgcct

SEQ ID NO: 8155771 - DNA, 22 bp, Homo sapiens
gggctgcacgtattctgctcac

SEQ ID NO: 8155772 - DNA, 22 bp, Homo sapiens
gggctgcacagatcttcaaggg

SEQ ID NO: 8155773 - DNA, 22 bp, Homo sapiens
gggctgattcgatgggggtaga

SEQ ID NO: 8155774 - DNA, 22 bp, Homo sapiens
gggctgaggctaccactggtct

SEQ ID NO: 8155775 - DNA, 22 bp, Homo sapiens
gggctgaggctaccactggtct

SEQ ID NO: 8155776 - DNA, 22 bp, Homo sapiens
gggctgagggccaattcctact

SEQ ID NO: 8155777 - DNA, 22 bp, Homo sapiens
gggctgagggccaattcctact

SEQ ID NO: 8155778 - DNA, 22 bp, Homo sapiens
gggctgagtgtcccaggccgaa

SEQ ID NO: 8155779 - DNA, 22 bp, Homo sapiens
gggctgagggccaattcctact

SEQ ID NO: 8155780 - DNA, 22 bp, Homo sapiens
gggctgagtgtcccaggccgaa

SEQ ID NO: 8155781 - DNA, 22 bp, Homo sapiens
gggctgagtgtcccaggccgaa

SEQ ID NO: 8155782 - DNA, 22 bp, Homo sapiens
gggctgagttcctgcctcactc

SEQ ID NO: 8155783 - DNA, 22 bp, Homo sapiens
gggctgagtgtcccaggccgaa

SEQ ID NO: 8155784 - DNA, 22 bp, Homo sapiens
gggctgagtgtcccaggccgaa

SEQ ID NO: 8155785 - DNA, 22 bp, Homo sapiens
gggctgagtgtcccaggccgaa

SEQ ID NO: 8155786 - DNA, 22 bp, Homo sapiens
gggctgagtgtcccaggccgaa

SEQ ID NO: 8155787 - DNA, 22 bp, Homo sapiens
gggctgagtgtcccaggccgaa

SEQ ID NO: 8155788 - DNA, 22 bp, Homo sapiens
gggctgagttcctgcctcactc

SEQ ID NO: 8155789 - DNA, 22 bp, Homo sapiens
gggctgagttcctgcctcactc

SEQ ID NO: 8155790 - DNA, 22 bp, Homo sapiens
gggctgagttcctgcctcactc

SEQ ID NO: 8155791 - DNA, 22 bp, Homo sapiens
gggcttgctaagaagagcgcat

SEQ ID NO: 8155792 - DNA, 22 bp, Homo sapiens
gggcttgctaagaagagcgcat

SEQ ID NO: 8155793 - DNA, 22 bp, Homo sapiens
gggcttgaggtgaaggtaggga

SEQ ID NO: 8155794 - DNA, 22 bp, Homo sapiens
gggcttcttgccatggggacgg

SEQ ID NO: 8155795 - DNA, 22 bp, Homo sapiens
gggctgctgtgttcctgaggca

SEQ ID NO: 8155796 - DNA, 22 bp, Homo sapiens
gggcttcttgagctgccggccc

SEQ ID NO: 8155797 - DNA, 22 bp, Homo sapiens
gggctgctgtgttcctgaggca

SEQ ID NO: 8155798 - DNA, 22 bp, Homo sapiens
gggcttcttgagctgccggccc

SEQ ID NO: 8155799 - DNA, 22 bp, Homo sapiens
gggcttcttgagctgccggccc

SEQ ID NO: 8155800 - DNA, 22 bp, Homo sapiens
gggctgctgctgccagcgacac

SEQ ID NO: 8155801 - DNA, 22 bp, Homo sapiens
gggctgctgctgccagcgacac

SEQ ID NO: 8155802 - DNA, 22 bp, Homo sapiens
gggctgctgctgccagcgacac

SEQ ID NO: 8155803 - DNA, 22 bp, Homo sapiens
gggctgctgtagagaacatgtt

SEQ ID NO: 8155804 - DNA, 22 bp, Homo sapiens
gggctgctgggcaagaaacatt

SEQ ID NO: 8155805 - DNA, 22 bp, Homo sapiens
gggctgctgtagagaacatgtt

SEQ ID NO: 8155806 - DNA, 22 bp, Homo sapiens
gggctgctgcccaggaggcacc

SEQ ID NO: 8155807 - DNA, 22 bp, Homo sapiens
gggctgctgcccaggaggcacc

SEQ ID NO: 8155808 - DNA, 22 bp, Homo sapiens
gggctgctgccaccaggtggat

SEQ ID NO: 8155809 - DNA, 22 bp, Homo sapiens
gggctgctgccaccaggtggat

SEQ ID NO: 8155810 - DNA, 22 bp, Homo sapiens
gggctgctgccaatcacagcct

SEQ ID NO: 8155811 - DNA, 22 bp, Homo sapiens
gggcttggctcataagtggatg

SEQ ID NO: 8155812 - DNA, 22 bp, Homo sapiens
gggcttggctcataagtggatg

SEQ ID NO: 8155813 - DNA, 22 bp, Homo sapiens
gggcttggccccagaagagcta

SEQ ID NO: 8155814 - DNA, 22 bp, Homo sapiens
gggcttggccccagaagagcta

SEQ ID NO: 8155815 - DNA, 22 bp, Homo sapiens
gggcttggccccagaagagcta

SEQ ID NO: 8155816 - DNA, 22 bp, Homo sapiens
gggcttgggtattgtgagaggt

SEQ ID NO: 8155817 - DNA, 22 bp, Homo sapiens
gggcttgggtattgtgagaggt

SEQ ID NO: 8155818 - DNA, 22 bp, Homo sapiens
gggcttgggtattgtgagaggt

SEQ ID NO: 8155819 - DNA, 22 bp, Homo sapiens
gggcttgggtattgtgagaggt

SEQ ID NO: 8155820 - DNA, 19 bp, Homo sapiens
gggcttggggctgaagcct

SEQ ID NO: 8155821 - DNA, 19 bp, Homo sapiens
gggcttggggctgaagcct

SEQ ID NO: 8155822 - DNA, 20 bp, Homo sapiens
gggcttggaggactcgaggg

SEQ ID NO: 8155823 - DNA, 22 bp, Homo sapiens
gggcttgcttaaggtcacccgg

SEQ ID NO: 8155824 - DNA, 22 bp, Homo sapiens
gggcttgctgtttagttccatt

SEQ ID NO: 8155825 - DNA, 22 bp, Homo sapiens
gggcttggagtaggctgatgaa

SEQ ID NO: 8155826 - DNA, 22 bp, Homo sapiens
gggcttggagtaggctgatgaa

SEQ ID NO: 8155827 - DNA, 22 bp, Homo sapiens
gggcttggagtaggctgatgaa

SEQ ID NO: 8155828 - DNA, 22 bp, Homo sapiens
gggcttggagtaggctgatgaa

SEQ ID NO: 8155829 - DNA, 22 bp, Homo sapiens
gggcttggcacatgggctcagc

SEQ ID NO: 8155830 - DNA, 22 bp, Homo sapiens
gggcttggcacatgggctcagc

SEQ ID NO: 8155831 - DNA, 22 bp, Homo sapiens
gggcttggcacatgggctcagc

SEQ ID NO: 8155832 - DNA, 22 bp, Homo sapiens
gggcatgttttcgtaaactcag

SEQ ID NO: 8155833 - DNA, 22 bp, Homo sapiens
gggcatgtctctaggctggcta

SEQ ID NO: 8155834 - DNA, 22 bp, Homo sapiens
gggcatttcttgtcaatgtagg

SEQ ID NO: 8155835 - DNA, 22 bp, Homo sapiens
gggcatttaaacaagcatacaa

SEQ ID NO: 8155836 - DNA, 22 bp, Homo sapiens
gggccaaggggagctggaaggg

SEQ ID NO: 8155837 - DNA, 22 bp, Homo sapiens
gggccaaggggagctggaaggg

SEQ ID NO: 8155838 - DNA, 22 bp, Homo sapiens
gggcatgtaggaatccatggag

SEQ ID NO: 8155839 - DNA, 22 bp, Homo sapiens
gggcatgtaggaatccatggag

SEQ ID NO: 8155840 - DNA, 22 bp, Homo sapiens
gggcatgtagtgtgcatagaga

SEQ ID NO: 8155841 - DNA, 22 bp, Homo sapiens
gggcatggtggcaggcacctgt

SEQ ID NO: 8155842 - DNA, 22 bp, Homo sapiens
gggcatggtggcaggcacctgt

SEQ ID NO: 8155843 - DNA, 21 bp, Homo sapiens
gggccacaccttctgcagacc

SEQ ID NO: 8155844 - DNA, 22 bp, Homo sapiens
gggccacacagggcagctccct

SEQ ID NO: 8155845 - DNA, 22 bp, Homo sapiens
gggccacacagaacctcctggt

SEQ ID NO: 8155846 - DNA, 22 bp, Homo sapiens
gggcatggccaggtgaggggtc

SEQ ID NO: 8155847 - DNA, 18 bp, Homo sapiens
gggcatggatgcagcatc

SEQ ID NO: 8155848 - DNA, 22 bp, Homo sapiens
gggcatggcgtgtgctggattc

SEQ ID NO: 8155849 - DNA, 22 bp, Homo sapiens
gggcatggccaggtgaggggtc

SEQ ID NO: 8155850 - DNA, 22 bp, Homo sapiens
gggcatggcgtgtgctggattc

SEQ ID NO: 8155851 - DNA, 22 bp, Homo sapiens
gggcatggccaggtgaggggtc

SEQ ID NO: 8155852 - DNA, 22 bp, Homo sapiens
gggcatggccaggtgaggggtc

SEQ ID NO: 8155853 - DNA, 22 bp, Homo sapiens
gggcatggcgtgtgctggattc

SEQ ID NO: 8155854 - DNA, 22 bp, Homo sapiens
gggcatggggcggacctggttc

SEQ ID NO: 8155855 - DNA, 22 bp, Homo sapiens
gggcatggtgatgtgcacctgt

SEQ ID NO: 8155856 - DNA, 22 bp, Homo sapiens
gggctgagagctggaatctgag

SEQ ID NO: 8155857 - DNA, 22 bp, Homo sapiens
gggctgagagctggaatctgag

SEQ ID NO: 8155858 - DNA, 22 bp, Homo sapiens
gggctgagagctggaatctgag

SEQ ID NO: 8155859 - DNA, 21 bp, Homo sapiens
gggccacaccttctgcagacc

SEQ ID NO: 8155860 - DNA, 21 bp, Homo sapiens
gggccacaccttctgcagacc

SEQ ID NO: 8155861 - DNA, 22 bp, Homo sapiens
gggctgagagtgactgttctgt

SEQ ID NO: 8155862 - DNA, 22 bp, Homo sapiens
gggctgagagctggaatctgag

SEQ ID NO: 8155863 - DNA, 22 bp, Homo sapiens
gggctgagagctggaatctgag

SEQ ID NO: 8155864 - DNA, 22 bp, Homo sapiens
gggctgagagctggaatctgag

SEQ ID NO: 8155865 - DNA, 22 bp, Homo sapiens
gggctgagcacatactgacagc

SEQ ID NO: 8155866 - DNA, 22 bp, Homo sapiens
gggctgagcacatactgacagc

SEQ ID NO: 8155867 - DNA, 22 bp, Homo sapiens
gggctgagcacatactgacagc

SEQ ID NO: 8155868 - DNA, 22 bp, Homo sapiens
gggctgagattggtgccctgtc

SEQ ID NO: 8155869 - DNA, 22 bp, Homo sapiens
gggctgagattggtgccctgtc

SEQ ID NO: 8155870 - DNA, 22 bp, Homo sapiens
gggctgagattggtgccctgtc

SEQ ID NO: 8155871 - DNA, 22 bp, Homo sapiens
gggctgagattggtgccctgtc

SEQ ID NO: 8155872 - DNA, 22 bp, Homo sapiens
gggctgagattggtgccctgtc

SEQ ID NO: 8155873 - DNA, 22 bp, Homo sapiens
gggctgagagtgactgttctgt

SEQ ID NO: 8155874 - DNA, 22 bp, Homo sapiens
gggctgagagtgactgttctgt

SEQ ID NO: 8155875 - DNA, 22 bp, Homo sapiens
gggctgagagtgactgttctgt

SEQ ID NO: 8155876 - DNA, 22 bp, Homo sapiens
gggctgagattggtgccctgtc

SEQ ID NO: 8155877 - DNA, 22 bp, Homo sapiens
gggctgagagtgactgttctgt

SEQ ID NO: 8155878 - DNA, 22 bp, Homo sapiens
gggctgagagtgactgttctgt

SEQ ID NO: 8155879 - DNA, 22 bp, Homo sapiens
gggctgagagtgactgttctgt

SEQ ID NO: 8155880 - DNA, 22 bp, Homo sapiens
gggctgagccatttgaaccttg

SEQ ID NO: 8155881 - DNA, 22 bp, Homo sapiens
gggctgagccacagcttttgtt

SEQ ID NO: 8155882 - DNA, 22 bp, Homo sapiens
gggctgagctaagctgggttga

SEQ ID NO: 8155883 - DNA, 22 bp, Homo sapiens
gggctgagccatttgaaccttg

SEQ ID NO: 8155884 - DNA, 22 bp, Homo sapiens
gggctgagccatttgaaccttg

SEQ ID NO: 8155885 - DNA, 22 bp, Homo sapiens
gggctgagccacagcttttgtt

SEQ ID NO: 8155886 - DNA, 22 bp, Homo sapiens
gggctgagccacagcttttgtt

SEQ ID NO: 8155887 - DNA, 22 bp, Homo sapiens
gggctgagccacagcttttgtt

SEQ ID NO: 8155888 - DNA, 22 bp, Homo sapiens
gggctgagccacagcttttgtt

SEQ ID NO: 8155889 - DNA, 22 bp, Homo sapiens
gggctgagcacatactgacagc

SEQ ID NO: 8155890 - DNA, 22 bp, Homo sapiens
gggctgagcacatactgacagc

SEQ ID NO: 8155891 - DNA, 22 bp, Homo sapiens
gggctgagcacatactgacagc

SEQ ID NO: 8155892 - DNA, 22 bp, Homo sapiens
gggctgaggctaccactggtct

SEQ ID NO: 8155893 - DNA, 22 bp, Homo sapiens
gggctgaggaacatattttgtt

SEQ ID NO: 8155894 - DNA, 22 bp, Homo sapiens
gggctgaggaacatattttgtt

SEQ ID NO: 8155895 - DNA, 22 bp, Homo sapiens
gggctgagctgttctgagttta

SEQ ID NO: 8155896 - DNA, 22 bp, Homo sapiens
gggctgagctgttctgagttta

SEQ ID NO: 8155897 - DNA, 22 bp, Homo sapiens
gggctgagctgttctgagttta

SEQ ID NO: 8155898 - DNA, 22 bp, Homo sapiens
gggctgagctaagctgggttga

SEQ ID NO: 8155899 - DNA, 22 bp, Homo sapiens
gggctgagctaagctgggttga

SEQ ID NO: 8155900 - DNA, 22 bp, Homo sapiens
gggctgagctgttctgagttta

SEQ ID NO: 8155901 - DNA, 22 bp, Homo sapiens
gggctgagctgttctgagttta

SEQ ID NO: 8155902 - DNA, 22 bp, Homo sapiens
gggctgagctaagctgggttga

SEQ ID NO: 8155903 - DNA, 22 bp, Homo sapiens
gggctgagctaagctgggttga

SEQ ID NO: 8155904 - DNA, 22 bp, Homo sapiens
ggggcctccagcactaggcagc

SEQ ID NO: 8155905 - DNA, 22 bp, Homo sapiens
ggggcctccagcactaggcagc

SEQ ID NO: 8155906 - DNA, 22 bp, Homo sapiens
ggggccgaccgcggttcaggcc

SEQ ID NO: 8155907 - DNA, 22 bp, Homo sapiens
ggggccgaccgcggttcaggcc

SEQ ID NO: 8155908 - DNA, 22 bp, Homo sapiens
ggggccgaccgcggttcaggcc

SEQ ID NO: 8155909 - DNA, 22 bp, Homo sapiens
ggggccgaccgcggttcaggcc

SEQ ID NO: 8155910 - DNA, 22 bp, Homo sapiens
ggggaaggatatgattagacta

SEQ ID NO: 8155911 - DNA, 22 bp, Homo sapiens
ggggaagatggccctccatgtg

SEQ ID NO: 8155912 - DNA, 22 bp, Homo sapiens
ggggaaggaaagttattagcag

SEQ ID NO: 8155913 - DNA, 22 bp, Homo sapiens
ggggaagaggcgtgatggatcc

SEQ ID NO: 8155914 - DNA, 22 bp, Homo sapiens
ggggaagaggcgtgatggatcc

SEQ ID NO: 8155915 - DNA, 22 bp, Homo sapiens
ggggaagaggcgtgatggatcc

SEQ ID NO: 8155916 - DNA, 22 bp, Homo sapiens
ggggaagagcattgcacggtgt

SEQ ID NO: 8155917 - DNA, 17 bp, Homo sapiens
gggctttaggtggtgta

SEQ ID NO: 8155918 - DNA, 22 bp, Homo sapiens
gggctttaggggccagtgacca

SEQ ID NO: 8155919 - DNA, 22 bp, Homo sapiens
ggggaagaatgctctctagaga

SEQ ID NO: 8155920 - DNA, 22 bp, Homo sapiens
ggggaagaatggcagaaaacat

SEQ ID NO: 8155921 - DNA, 22 bp, Homo sapiens
gggctttagattgcagaggatt

SEQ ID NO: 8155922 - DNA, 19 bp, Homo sapiens
gggctttactccaagtggg

SEQ ID NO: 8155923 - DNA, 18 bp, Homo sapiens
gggctttacagagtggag

SEQ ID NO: 8155924 - DNA, 22 bp, Homo sapiens
gggctttaatcttgttaactag

SEQ ID NO: 8155925 - DNA, 22 bp, Homo sapiens
gggctttaacacccagtcaggg

SEQ ID NO: 8155926 - DNA, 22 bp, Homo sapiens
ggggctcaggggaagtgtccag

SEQ ID NO: 8155927 - DNA, 22 bp, Homo sapiens
ggggctcaggggaagtgtccag

SEQ ID NO: 8155928 - DNA, 22 bp, Homo sapiens
ggggctcagttcggacagcctg

SEQ ID NO: 8155929 - DNA, 22 bp, Homo sapiens
ggggctcagttcggacagcctg

SEQ ID NO: 8155930 - DNA, 22 bp, Homo sapiens
ggggctcagttcggacagcctg

SEQ ID NO: 8155931 - DNA, 22 bp, Homo sapiens
ggggctcagttcggacagcctg

SEQ ID NO: 8155932 - DNA, 22 bp, Homo sapiens
ggggctctgcctctcccacgcc

SEQ ID NO: 8155933 - DNA, 22 bp, Homo sapiens
ggggctctgcctctcccacgcc

SEQ ID NO: 8155934 - DNA, 22 bp, Homo sapiens
ggggctctcaggtctccccaaa

SEQ ID NO: 8155935 - DNA, 22 bp, Homo sapiens
ggggctctcaggtctccccaaa

SEQ ID NO: 8155936 - DNA, 22 bp, Homo sapiens
ggggctctcaggtctccccaaa

SEQ ID NO: 8155937 - DNA, 22 bp, Homo sapiens
ggggctctaggtaaagcaacat

SEQ ID NO: 8155938 - DNA, 22 bp, Homo sapiens
ggggctgacgggcatgtggctt

SEQ ID NO: 8155939 - DNA, 22 bp, Homo sapiens
ggggctgaacctggaggtggtc

SEQ ID NO: 8155940 - DNA, 22 bp, Homo sapiens
ggggctctgtgacagtaaccct

SEQ ID NO: 8155941 - DNA, 22 bp, Homo sapiens
ggggctcttagagagcctagtg

SEQ ID NO: 8155942 - DNA, 22 bp, Homo sapiens
ggggctgaacctggaggtggtc

SEQ ID NO: 8155943 - DNA, 22 bp, Homo sapiens
ggggctcttagagagcctagtg

SEQ ID NO: 8155944 - DNA, 22 bp, Homo sapiens
ggggctctgctctgagccgtgt

SEQ ID NO: 8155945 - DNA, 22 bp, Homo sapiens
ggggctctgctctgagccgtgt

SEQ ID NO: 8155946 - DNA, 22 bp, Homo sapiens
ggggctctgctctgagccgtgt

SEQ ID NO: 8155947 - DNA, 22 bp, Homo sapiens
ggggctctggagaaaggccagt

SEQ ID NO: 8155948 - DNA, 22 bp, Homo sapiens
ggggctctggagaaaggccagt

SEQ ID NO: 8155949 - DNA, 22 bp, Homo sapiens
ggggctggctcactaagagact

SEQ ID NO: 8155950 - DNA, 22 bp, Homo sapiens
ggggctgggatttgaacccagg

SEQ ID NO: 8155951 - DNA, 22 bp, Homo sapiens
ggggctggctcactaagagact

SEQ ID NO: 8155952 - DNA, 22 bp, Homo sapiens
ggggctggctcactaagagact

SEQ ID NO: 8155953 - DNA, 20 bp, Homo sapiens
ggggctgcatgcagagaaga

SEQ ID NO: 8155954 - DNA, 22 bp, Homo sapiens
ggggctgatggaactcaggcct

SEQ ID NO: 8155955 - DNA, 22 bp, Homo sapiens
ggggctgatggaactcaggcct

SEQ ID NO: 8155956 - DNA, 22 bp, Homo sapiens
gggtaggaaatccagaggtggc

SEQ ID NO: 8155957 - DNA, 22 bp, Homo sapiens
gggtaggatggtagaagggacc

SEQ ID NO: 8155958 - DNA, 22 bp, Homo sapiens
gggtaggagaggtgtctgtgtg

SEQ ID NO: 8155959 - DNA, 22 bp, Homo sapiens
gggtaggagaggtgtctgtgtg

SEQ ID NO: 8155960 - DNA, 22 bp, Homo sapiens
gggtaggagaggtgtctgtgtg

SEQ ID NO: 8155961 - DNA, 22 bp, Homo sapiens
gggtaggatggtagaagggacc

SEQ ID NO: 8155962 - DNA, 22 bp, Homo sapiens
gggtaggatggtagaagggacc

SEQ ID NO: 8155963 - DNA, 22 bp, Homo sapiens
gggtaggcaaagcaatgacgtt

SEQ ID NO: 8155964 - DNA, 22 bp, Homo sapiens
gggtaggcaaagcaatgacgtt

SEQ ID NO: 8155965 - DNA, 22 bp, Homo sapiens
gggtaggctctgcaggctgggt

SEQ ID NO: 8155966 - DNA, 22 bp, Homo sapiens
gggtaggctctgcaggctgggt

SEQ ID NO: 8155967 - DNA, 22 bp, Homo sapiens
gggtaggctctgcaggctgggt

SEQ ID NO: 8155968 - DNA, 22 bp, Homo sapiens
gggtaggcccctcttgcttggg

SEQ ID NO: 8155969 - DNA, 22 bp, Homo sapiens
gggtagggtgacttaggctggc

SEQ ID NO: 8155970 - DNA, 22 bp, Homo sapiens
gggtaggctgctcctggggccc

SEQ ID NO: 8155971 - DNA, 22 bp, Homo sapiens
gggtaggctgctcctggggccc

SEQ ID NO: 8155972 - DNA, 22 bp, Homo sapiens
gggtagggtgacttaggctggc

SEQ ID NO: 8155973 - DNA, 22 bp, Homo sapiens
gggtagggtgacttaggctggc

SEQ ID NO: 8155974 - DNA, 22 bp, Homo sapiens
gggtggagtgtgaaatctggct

SEQ ID NO: 8155975 - DNA, 20 bp, Homo sapiens
gggtggagttgcggtctgtg

SEQ ID NO: 8155976 - DNA, 22 bp, Homo sapiens
gggtggaggtgggttttgagat

SEQ ID NO: 8155977 - DNA, 22 bp, Homo sapiens
gggtggagtagaaagatgaatt

SEQ ID NO: 8155978 - DNA, 22 bp, Homo sapiens
gggtggagtagaaagatgaatt

SEQ ID NO: 8155979 - DNA, 22 bp, Homo sapiens
gggtggagtagaaagatgaatt

SEQ ID NO: 8155980 - DNA, 22 bp, Homo sapiens
gggtggaggagaacaggcccca

SEQ ID NO: 8155981 - DNA, 22 bp, Homo sapiens
gggtggaggagaacaggcccca

SEQ ID NO: 8155982 - DNA, 22 bp, Homo sapiens
gggtggagcttggacaccagta

SEQ ID NO: 8155983 - DNA, 22 bp, Homo sapiens
gggtggagcttggacaccagta

SEQ ID NO: 8155984 - DNA, 22 bp, Homo sapiens
gggtggagcctgagaatttgca

SEQ ID NO: 8155985 - DNA, 22 bp, Homo sapiens
gggtggagcttggacaccagta

SEQ ID NO: 8155986 - DNA, 22 bp, Homo sapiens
ggggtggggttactcattgtgc

SEQ ID NO: 8155987 - DNA, 22 bp, Homo sapiens
ggggtgtgagtagagctgggga

SEQ ID NO: 8155988 - DNA, 22 bp, Homo sapiens
ggggttaacagtattgctcatg

SEQ ID NO: 8155989 - DNA, 22 bp, Homo sapiens
ggggtgtggacggctgtgccag

SEQ ID NO: 8155990 - DNA, 22 bp, Homo sapiens
ggggtgtgtctgacaatggtat

SEQ ID NO: 8155991 - DNA, 22 bp, Homo sapiens
ggggtgtgagtagagctgggga

SEQ ID NO: 8155992 - DNA, 22 bp, Homo sapiens
ggggtgtgagtagagctgggga

SEQ ID NO: 8155993 - DNA, 22 bp, Homo sapiens
ggggtgtggacggctgtgccag

SEQ ID NO: 8155994 - DNA, 22 bp, Homo sapiens
ggggtgtggacggctgtgccag

SEQ ID NO: 8155995 - DNA, 22 bp, Homo sapiens
ggggttgatcacagaggggtct

SEQ ID NO: 8155996 - DNA, 21 bp, Homo sapiens
ggggttggcaagagcagagac

SEQ ID NO: 8155997 - DNA, 21 bp, Homo sapiens
ggggttggcaagagcagagac

SEQ ID NO: 8155998 - DNA, 21 bp, Homo sapiens
ggggttggcaagagcagagac

SEQ ID NO: 8155999 - DNA, 21 bp, Homo sapiens
ggggttggcaagagcagagac

SEQ ID NO: 8156000 - DNA, 21 bp, Homo sapiens
ggggttggcaagagcagagac

SEQ ID NO: 8156001 - DNA, 22 bp, Homo sapiens
ggggctgggatttgaacccagg

SEQ ID NO: 8156002 - DNA, 22 bp, Homo sapiens
ggggctggtggtggtttctcca

SEQ ID NO: 8156003 - DNA, 22 bp, Homo sapiens
ggggtgggcgtgcagggacacc

SEQ ID NO: 8156004 - DNA, 22 bp, Homo sapiens
ggggtgggcgtgcagggacacc

SEQ ID NO: 8156005 - DNA, 22 bp, Homo sapiens
ggggtgggcgtgcagggacacc

SEQ ID NO: 8156006 - DNA, 22 bp, Homo sapiens
ggggtgggcgtgcagggacacc

SEQ ID NO: 8156007 - DNA, 22 bp, Homo sapiens
ggggtgggcgtgcagggacacc

SEQ ID NO: 8156008 - DNA, 22 bp, Homo sapiens
ggggtgggcgtgcagggacacc

SEQ ID NO: 8156009 - DNA, 22 bp, Homo sapiens
ggggtgggcgtgcagggacacc

SEQ ID NO: 8156010 - DNA, 22 bp, Homo sapiens
ggtggcctcggtggtgcacagg

SEQ ID NO: 8156011 - DNA, 22 bp, Homo sapiens
ggtggcctcggtggtgcacagg

SEQ ID NO: 8156012 - DNA, 22 bp, Homo sapiens
ggtggcctcagcaaggctggca

SEQ ID NO: 8156013 - DNA, 22 bp, Homo sapiens
ggtggcctccagggcataggtg

SEQ ID NO: 8156014 - DNA, 22 bp, Homo sapiens
ggtggcctccagggcataggtg

SEQ ID NO: 8156015 - DNA, 22 bp, Homo sapiens
ggtggcctccagggcataggtg

SEQ ID NO: 8156016 - DNA, 22 bp, Homo sapiens
ggtggcctctcatgcaaggtag

SEQ ID NO: 8156017 - DNA, 22 bp, Homo sapiens
ggtggcctctgcaggcctcgac

SEQ ID NO: 8156018 - DNA, 22 bp, Homo sapiens
ggtggcctctgcaggcctcgac

SEQ ID NO: 8156019 - DNA, 18 bp, Homo sapiens
ggtggccttgacttctct

SEQ ID NO: 8156020 - DNA, 21 bp, Homo sapiens
ggtggccttggtgagagacct

SEQ ID NO: 8156021 - DNA, 21 bp, Homo sapiens
ggtggccttggtgagagacct

SEQ ID NO: 8156022 - DNA, 22 bp, Homo sapiens
ggtggccttttatgagcagggt

SEQ ID NO: 8156023 - DNA, 22 bp, Homo sapiens
ggtggccttttatgagcagggt

SEQ ID NO: 8156024 - DNA, 17 bp, Homo sapiens
ggtggcctgcagtggct

SEQ ID NO: 8156025 - DNA, 17 bp, Homo sapiens
ggtggcctgcagtggct

SEQ ID NO: 8156026 - DNA, 17 bp, Homo sapiens
ggtggcctgcagtggct

SEQ ID NO: 8156027 - DNA, 22 bp, Homo sapiens
ggtggcctgcaagtgcagatgg

SEQ ID NO: 8156028 - DNA, 22 bp, Homo sapiens
ggtggcctgaattagctcaggg

SEQ ID NO: 8156029 - DNA, 22 bp, Homo sapiens
ggtggctcagggctccaagcat

SEQ ID NO: 8156030 - DNA, 18 bp, Homo sapiens
ggtggctcagtcatgggg

SEQ ID NO: 8156031 - DNA, 18 bp, Homo sapiens
ggtggctcagtcatgggg

SEQ ID NO: 8156032 - DNA, 18 bp, Homo sapiens
ggtggctcagtcatgggg

SEQ ID NO: 8156033 - DNA, 18 bp, Homo sapiens
ggtggctcagtcatgggg

SEQ ID NO: 8156034 - DNA, 22 bp, Homo sapiens
ggtggctcagtgtcaggccctg

SEQ ID NO: 8156035 - DNA, 22 bp, Homo sapiens
ggtggctcagtgtcaggccctg

SEQ ID NO: 8156036 - DNA, 22 bp, Homo sapiens
ggtggctccgcttccatgggct

SEQ ID NO: 8156037 - DNA, 22 bp, Homo sapiens
ggtggctccgcttccatgggct

SEQ ID NO: 8156038 - DNA, 21 bp, Homo sapiens
ggtggctagaaagcagtgaga

SEQ ID NO: 8156039 - DNA, 22 bp, Homo sapiens
ggtggctcaaagagagcacaga

SEQ ID NO: 8156040 - DNA, 21 bp, Homo sapiens
ggtggctcacctgattggata

SEQ ID NO: 8156041 - DNA, 21 bp, Homo sapiens
ggtggctcacctgattggata

SEQ ID NO: 8156042 - DNA, 19 bp, Homo sapiens
ggtggctcagggcccagcc

SEQ ID NO: 8156043 - DNA, 19 bp, Homo sapiens
ggtggctcagggcccagcc

SEQ ID NO: 8156044 - DNA, 22 bp, Homo sapiens
ggtggctcacgcctgtaagccc

SEQ ID NO: 8156045 - DNA, 22 bp, Homo sapiens
ggtggctcaaagagagcacaga

SEQ ID NO: 8156046 - DNA, 21 bp, Homo sapiens
ggtggctagaaagcagtgaga

SEQ ID NO: 8156047 - DNA, 18 bp, Homo sapiens
ggtggcggggatggaggt

SEQ ID NO: 8156048 - DNA, 18 bp, Homo sapiens
ggtggcggggatggaggt

SEQ ID NO: 8156049 - DNA, 22 bp, Homo sapiens
ggtctctgtttggggctggcaa

SEQ ID NO: 8156050 - DNA, 22 bp, Homo sapiens
ggtctctgttgcctccatcaag

SEQ ID NO: 8156051 - DNA, 22 bp, Homo sapiens
ggtctctgtttggggctggcaa

SEQ ID NO: 8156052 - DNA, 22 bp, Homo sapiens
ggtctcttagtgcaacatacta

SEQ ID NO: 8156053 - DNA, 22 bp, Homo sapiens
ggtctcttcaggagcttgagcg

SEQ ID NO: 8156054 - DNA, 22 bp, Homo sapiens
ggtctctgtttggggctggcaa

SEQ ID NO: 8156055 - DNA, 22 bp, Homo sapiens
ggtctctgttgcctccatcaag

SEQ ID NO: 8156056 - DNA, 22 bp, Homo sapiens
ggtctctttgcttcagctacag

SEQ ID NO: 8156057 - DNA, 22 bp, Homo sapiens
ggtctctttgcttcagctacag

SEQ ID NO: 8156058 - DNA, 22 bp, Homo sapiens
ggtctctttgcttcagctacag

SEQ ID NO: 8156059 - DNA, 22 bp, Homo sapiens
ggtctcttcaggagcttgagcg

SEQ ID NO: 8156060 - DNA, 21 bp, Homo sapiens
ggtctcttcatctgtaacctg

SEQ ID NO: 8156061 - DNA, 22 bp, Homo sapiens
ggtctcttcaggagcttgagcg

SEQ ID NO: 8156062 - DNA, 22 bp, Homo sapiens
ggtctcttccagctttatcact

SEQ ID NO: 8156063 - DNA, 22 bp, Homo sapiens
ggtctcttgtccaaggtcacac

SEQ ID NO: 8156064 - DNA, 22 bp, Homo sapiens
ggtctcttgtccaaggtcacac

SEQ ID NO: 8156065 - DNA, 22 bp, Homo sapiens
ggtctctttccttggcttgcac

SEQ ID NO: 8156066 - DNA, 22 bp, Homo sapiens
ggtctggacagaatgtgacact

SEQ ID NO: 8156067 - DNA, 22 bp, Homo sapiens
ggtctggaccatggacgccggg

SEQ ID NO: 8156068 - DNA, 22 bp, Homo sapiens
ggtctggaccctcctggagtgg

SEQ ID NO: 8156069 - DNA, 22 bp, Homo sapiens
ggtctggagctaatcttgttgg

SEQ ID NO: 8156070 - DNA, 22 bp, Homo sapiens
ggtctggaccctcctggagtgg

SEQ ID NO: 8156071 - DNA, 22 bp, Homo sapiens
ggtctggaccctcctggagtgg

SEQ ID NO: 8156072 - DNA, 23 bp, Homo sapiens
ggtctggaattcgcggagttaac

SEQ ID NO: 8156073 - DNA, 22 bp, Homo sapiens
ggtctggaatggagtaggggtg

SEQ ID NO: 8156074 - DNA, 22 bp, Homo sapiens
ggtctggaatggagtaggggtg

SEQ ID NO: 8156075 - DNA, 22 bp, Homo sapiens
ggtctgaaattatgtcactgct

SEQ ID NO: 8156076 - DNA, 22 bp, Homo sapiens
ggtctgaattccagcccctctg

SEQ ID NO: 8156077 - DNA, 22 bp, Homo sapiens
ggtctggcctccgggcaggtgg

SEQ ID NO: 8156078 - DNA, 22 bp, Homo sapiens
ggtggcctcagcaaggctggca

SEQ ID NO: 8156079 - DNA, 22 bp, Homo sapiens
ggtggcctagggcccagcctgt

SEQ ID NO: 8156080 - DNA, 22 bp, Homo sapiens
ggtctggcactcatgcagcagg

SEQ ID NO: 8156081 - DNA, 16 bp, Homo sapiens
ggtctggaggatgtct

SEQ ID NO: 8156082 - DNA, 22 bp, Homo sapiens
ggtctggagcttggctaaggga

SEQ ID NO: 8156083 - DNA, 22 bp, Homo sapiens
ggtctggagtaggatgatggct

SEQ ID NO: 8156084 - DNA, 22 bp, Homo sapiens
ggtctggagtagatgagtcatg

SEQ ID NO: 8156085 - DNA, 22 bp, Homo sapiens
ggtctggataattccagtacct

SEQ ID NO: 8156086 - DNA, 22 bp, Homo sapiens
ggtctggattttatctactgta

SEQ ID NO: 8156087 - DNA, 22 bp, Homo sapiens
ggtctggattttgaacaaaatt

SEQ ID NO: 8156088 - DNA, 22 bp, Homo sapiens
ggtctggatttctgcttctttc

SEQ ID NO: 8156089 - DNA, 22 bp, Homo sapiens
ggtctggatgctgaggttccca

SEQ ID NO: 8156090 - DNA, 22 bp, Homo sapiens
ggtctggatattcaccagggcc

SEQ ID NO: 8156091 - DNA, 22 bp, Homo sapiens
ggtctggataattccagtacct

SEQ ID NO: 8156092 - DNA, 22 bp, Homo sapiens
ggtgtgtgtggattagcatgcc

SEQ ID NO: 8156093 - DNA, 20 bp, Homo sapiens
ggtgtgttggttcagcatgg

SEQ ID NO: 8156094 - DNA, 22 bp, Homo sapiens
ggtgtgtgtggattagcatgcc

SEQ ID NO: 8156095 - DNA, 22 bp, Homo sapiens
ggtgtgtggttttgatacagtc

SEQ ID NO: 8156096 - DNA, 19 bp, Homo sapiens
ggtgtgtgctggggcctgt

SEQ ID NO: 8156097 - DNA, 22 bp, Homo sapiens
ggtgtgtggtcctctcacttag

SEQ ID NO: 8156098 - DNA, 22 bp, Homo sapiens
ggtgtgtggtcctctcacttag

SEQ ID NO: 8156099 - DNA, 22 bp, Homo sapiens
ggtgtgtggttttgatacagtc

SEQ ID NO: 8156100 - DNA, 22 bp, Homo sapiens
ggtgtgtggttttgatacagtc

SEQ ID NO: 8156101 - DNA, 22 bp, Homo sapiens
ggtgtgtgaggagtcacttagt

SEQ ID NO: 8156102 - DNA, 19 bp, Homo sapiens
ggtgtgtgctggggcctgt

SEQ ID NO: 8156103 - DNA, 19 bp, Homo sapiens
ggtgtgtgctggggcctgt

SEQ ID NO: 8156104 - DNA, 19 bp, Homo sapiens
ggtgtgtgctggggcctgt

SEQ ID NO: 8156105 - DNA, 22 bp, Homo sapiens
ggtgtgtgaggagtcacttagt

SEQ ID NO: 8156106 - DNA, 22 bp, Homo sapiens
ggtgttgcagttgaagactggt

SEQ ID NO: 8156107 - DNA, 22 bp, Homo sapiens
ggtgttgcagttgaagactggt

SEQ ID NO: 8156108 - DNA, 22 bp, Homo sapiens
ggtgttaaacatgatccattac

SEQ ID NO: 8156109 - DNA, 22 bp, Homo sapiens
ggtgttaacaaagattgaaatg

SEQ ID NO: 8156110 - DNA, 22 bp, Homo sapiens
ggtgttgtacattctgtggatt

SEQ ID NO: 8156111 - DNA, 22 bp, Homo sapiens
ggtttaattacctgcatctcaa

SEQ ID NO: 8156112 - DNA, 22 bp, Homo sapiens
ggtgtttaaaggctcagcagga

SEQ ID NO: 8156113 - DNA, 22 bp, Homo sapiens
ggtttaattggtccaggatggg

SEQ ID NO: 8156114 - DNA, 22 bp, Homo sapiens
ggtttattaatgtgaactgtat

SEQ ID NO: 8156115 - DNA, 22 bp, Homo sapiens
ggtttattaatgtgaactgtat

SEQ ID NO: 8156116 - DNA, 22 bp, Homo sapiens
ggtttattgaaggccaccccac

SEQ ID NO: 8156117 - DNA, 22 bp, Homo sapiens
ggtttattgaaggccaccccac

SEQ ID NO: 8156118 - DNA, 22 bp, Homo sapiens
ggtttattgttaataagtttga

SEQ ID NO: 8156119 - DNA, 22 bp, Homo sapiens
ggtttattgttaataagtttga

SEQ ID NO: 8156120 - DNA, 22 bp, Homo sapiens
ggtgtccttcgtccgctggcat

SEQ ID NO: 8156121 - DNA, 22 bp, Homo sapiens
ggtgtccttgcagaaggcggcg

SEQ ID NO: 8156122 - DNA, 22 bp, Homo sapiens
ggtgtccttgctccttcagctt

SEQ ID NO: 8156123 - DNA, 22 bp, Homo sapiens
ggtgtccttgcagaaggcggcg

SEQ ID NO: 8156124 - DNA, 22 bp, Homo sapiens
ggtgtccttgctccttcagctt

SEQ ID NO: 8156125 - DNA, 22 bp, Homo sapiens
ggtgtccttcgtccgctggcat

SEQ ID NO: 8156126 - DNA, 22 bp, Homo sapiens
ggtgtccttagaaagcagacct

SEQ ID NO: 8156127 - DNA, 22 bp, Homo sapiens
ggtgtccttcgtccgctggcat

SEQ ID NO: 8156128 - DNA, 22 bp, Homo sapiens
ggtgtccttagaaagcagacct

SEQ ID NO: 8156129 - DNA, 22 bp, Homo sapiens
ggtggctctctgtcagtgacag

SEQ ID NO: 8156130 - DNA, 22 bp, Homo sapiens
ggtggctctccctggactcagc

SEQ ID NO: 8156131 - DNA, 22 bp, Homo sapiens
ggtggctctccctggactcagc

SEQ ID NO: 8156132 - DNA, 22 bp, Homo sapiens
ggtggctctcttaagggcagcg

SEQ ID NO: 8156133 - DNA, 22 bp, Homo sapiens
ggtggctctcttaagggcagcg

SEQ ID NO: 8156134 - DNA, 17 bp, Homo sapiens
ggtggctcgggcgcggc

SEQ ID NO: 8156135 - DNA, 17 bp, Homo sapiens
ggtggctcgggcgcggc

SEQ ID NO: 8156136 - DNA, 22 bp, Homo sapiens
ggtggctcggccagtgcaggcc

SEQ ID NO: 8156137 - DNA, 22 bp, Homo sapiens
ggtggctcggccagtgcaggcc

SEQ ID NO: 8156138 - DNA, 22 bp, Homo sapiens
ggtggctctccctggactcagc

SEQ ID NO: 8156139 - DNA, 19 bp, Homo sapiens
ggtggctctccctcaggga

SEQ ID NO: 8156140 - DNA, 19 bp, Homo sapiens
ggtggctctccctcaggga

SEQ ID NO: 8156141 - DNA, 22 bp, Homo sapiens
ggtggctctcaggcttctcgga

SEQ ID NO: 8156142 - DNA, 22 bp, Homo sapiens
ggtgtgggtccttgtgcttgct

SEQ ID NO: 8156143 - DNA, 22 bp, Homo sapiens
ggtgtgggtccttgtgcttgct

SEQ ID NO: 8156144 - DNA, 22 bp, Homo sapiens
ggtgtgggtcagctttattaat

SEQ ID NO: 8156145 - DNA, 22 bp, Homo sapiens
ggtgtgggggcaagtttgagat

SEQ ID NO: 8156146 - DNA, 22 bp, Homo sapiens
ggtgtgggggcagctctgatat

SEQ ID NO: 8156147 - DNA, 22 bp, Homo sapiens
ggtgtgggccctgatgtcagca

SEQ ID NO: 8156148 - DNA, 22 bp, Homo sapiens
ggtgtggggaggttctgcttct

SEQ ID NO: 8156149 - DNA, 22 bp, Homo sapiens
ggtgtggggaggttctgcttct

SEQ ID NO: 8156150 - DNA, 22 bp, Homo sapiens
ggtgtggggaggttctgcttct

SEQ ID NO: 8156151 - DNA, 22 bp, Homo sapiens
ggtgtgggagagattctttcct

SEQ ID NO: 8156152 - DNA, 21 bp, Homo sapiens
ggtgtgggatggactgaacca

SEQ ID NO: 8156153 - DNA, 22 bp, Homo sapiens
ggtgtgggccctgatgtcagca

SEQ ID NO: 8156154 - DNA, 22 bp, Homo sapiens
ggtgtgggcagatgccctactt

SEQ ID NO: 8156155 - DNA, 22 bp, Homo sapiens
ggtgtggatcatctgaggtcag

SEQ ID NO: 8156156 - DNA, 22 bp, Homo sapiens
ggtgtggatcatctgaggtcag

SEQ ID NO: 8156157 - DNA, 22 bp, Homo sapiens
ggtgtgggaactacaggttttt

SEQ ID NO: 8156158 - DNA, 22 bp, Homo sapiens
ggtgtggctgtgagtttttgat

SEQ ID NO: 8156159 - DNA, 22 bp, Homo sapiens
ggtgtggcagtggacctgtgaa

SEQ ID NO: 8156160 - DNA, 22 bp, Homo sapiens
ggtgtggcagtggacctgtgaa

SEQ ID NO: 8156161 - DNA, 22 bp, Homo sapiens
ggtcagagaaaagtagggtgtt

SEQ ID NO: 8156162 - DNA, 22 bp, Homo sapiens
ggtcagagaaaagtagggtgtt

SEQ ID NO: 8156163 - DNA, 22 bp, Homo sapiens
ggtcagagatgaggtctaaagt

SEQ ID NO: 8156164 - DNA, 19 bp, Homo sapiens
ggtcagagagatccaggct

SEQ ID NO: 8156165 - DNA, 22 bp, Homo sapiens
ggtcagagccatggagcaactg

SEQ ID NO: 8156166 - DNA, 22 bp, Homo sapiens
ggtcagagccgttagcattcag

SEQ ID NO: 8156167 - DNA, 22 bp, Homo sapiens
ggtcagagctggagagataggg

SEQ ID NO: 8156168 - DNA, 22 bp, Homo sapiens
ggtcagagctggagagataggg

SEQ ID NO: 8156169 - DNA, 22 bp, Homo sapiens
ggtcagagggtgggctgcctgt

SEQ ID NO: 8156170 - DNA, 22 bp, Homo sapiens
ggtcagaggaggaataggacat

SEQ ID NO: 8156171 - DNA, 22 bp, Homo sapiens
ggtcagaggaggaataggacat

SEQ ID NO: 8156172 - DNA, 22 bp, Homo sapiens
ggtcagaggggattccttggga

SEQ ID NO: 8156173 - DNA, 22 bp, Homo sapiens
ggtcagaggggattccttggga

SEQ ID NO: 8156174 - DNA, 18 bp, Homo sapiens
ggtcactgagatgctact

SEQ ID NO: 8156175 - DNA, 22 bp, Homo sapiens
ggtcactgagctgtaattctgt

SEQ ID NO: 8156176 - DNA, 22 bp, Homo sapiens
ggtcactccaccttctccacct

SEQ ID NO: 8156177 - DNA, 22 bp, Homo sapiens
ggtcactgccctcccttttgca

SEQ ID NO: 8156178 - DNA, 22 bp, Homo sapiens
ggtcactgagctgtaattctgt

SEQ ID NO: 8156179 - DNA, 22 bp, Homo sapiens
ggtcacttctttcatcgaaact

SEQ ID NO: 8156180 - DNA, 22 bp, Homo sapiens
ggtcacttcagataactggtgt

SEQ ID NO: 8156181 - DNA, 20 bp, Homo sapiens
ggtcactgtggctgcaggat

SEQ ID NO: 8156182 - DNA, 22 bp, Homo sapiens
ggtcactggtctctgcttccat

SEQ ID NO: 8156183 - DNA, 22 bp, Homo sapiens
ggtcactggtctctgcttccat

SEQ ID NO: 8156184 - DNA, 22 bp, Homo sapiens
ggtcactgtctgaggtactgga

SEQ ID NO: 8156185 - DNA, 22 bp, Homo sapiens
ggtagggtgggccgaagctcaa

SEQ ID NO: 8156186 - DNA, 22 bp, Homo sapiens
ggtagggcaaagtagggcacct

SEQ ID NO: 8156187 - DNA, 22 bp, Homo sapiens
gggtggctgagaacaggacccc

SEQ ID NO: 8156188 - DNA, 22 bp, Homo sapiens
ggtaggggaagacaagtgaaaa

SEQ ID NO: 8156189 - DNA, 22 bp, Homo sapiens
gggtggctaggtatcccccatt

SEQ ID NO: 8156190 - DNA, 22 bp, Homo sapiens
gggtggctcctatgggcatagc

SEQ ID NO: 8156191 - DNA, 22 bp, Homo sapiens
gggtggctcctatgggcatagc

SEQ ID NO: 8156192 - DNA, 22 bp, Homo sapiens
gggtggctcctatgggcatagc

SEQ ID NO: 8156193 - DNA, 22 bp, Homo sapiens
gggtggctcctatgggcatagc

SEQ ID NO: 8156194 - DNA, 22 bp, Homo sapiens
gggtggctcctatgggcatagc

SEQ ID NO: 8156195 - DNA, 22 bp, Homo sapiens
gggtggctgactgttttgtgga

SEQ ID NO: 8156196 - DNA, 22 bp, Homo sapiens
gggtggctcctatgggcatagc

SEQ ID NO: 8156197 - DNA, 21 bp, Homo sapiens
gggtggccgcatgggtgcgtg

SEQ ID NO: 8156198 - DNA, 22 bp, Homo sapiens
gggtggcatctctctgagctgt

SEQ ID NO: 8156199 - DNA, 22 bp, Homo sapiens
gggtggccttcatagctcaggg

SEQ ID NO: 8156200 - DNA, 22 bp, Homo sapiens
gggtggccttaggcaagtcact

SEQ ID NO: 8156201 - DNA, 22 bp, Homo sapiens
gggtggcatagggtgatggctt

SEQ ID NO: 8156202 - DNA, 22 bp, Homo sapiens
gggtggcatagggtgatggctt

SEQ ID NO: 8156203 - DNA, 22 bp, Homo sapiens
gggtggcatagggtgatggctt

SEQ ID NO: 8156204 - DNA, 22 bp, Homo sapiens
gggtggcatctctctgagctgt

SEQ ID NO: 8156205 - DNA, 22 bp, Homo sapiens
gggtggcacaggtgcagagggt

SEQ ID NO: 8156206 - DNA, 22 bp, Homo sapiens
gggtggcaaaggcgctgaaagg

SEQ ID NO: 8156207 - DNA, 22 bp, Homo sapiens
gggtggcaaaggcgctgaaagg

SEQ ID NO: 8156208 - DNA, 20 bp, Homo sapiens
gggtggagttgcggtctgtg

SEQ ID NO: 8156209 - DNA, 20 bp, Homo sapiens
gggtggagttgcggtctgtg

SEQ ID NO: 8156210 - DNA, 22 bp, Homo sapiens
gggtggcacaggtgcagagggt

SEQ ID NO: 8156211 - DNA, 22 bp, Homo sapiens
gggtggcacaggtgcagagggt

SEQ ID NO: 8156212 - DNA, 22 bp, Homo sapiens
gggtggcacaggtgcagagggt

SEQ ID NO: 8156213 - DNA, 22 bp, Homo sapiens
gggtggcagctgttgccaaggt

SEQ ID NO: 8156214 - DNA, 22 bp, Homo sapiens
gggtggcagctgttgccaaggt

SEQ ID NO: 8156215 - DNA, 22 bp, Homo sapiens
gggtggcagctgttgccaaggt

SEQ ID NO: 8156216 - DNA, 22 bp, Homo sapiens
gggtggcaggattggcaggagt

SEQ ID NO: 8156217 - DNA, 22 bp, Homo sapiens
gggtggcaggattggcaggagt

SEQ ID NO: 8156218 - DNA, 22 bp, Homo sapiens
gggtggcaggattggcaggagt

SEQ ID NO: 8156219 - DNA, 22 bp, Homo sapiens
gggtggcaggattggcaggagt

SEQ ID NO: 8156220 - DNA, 22 bp, Homo sapiens
ggtcgccagccctagtctgctg

SEQ ID NO: 8156221 - DNA, 22 bp, Homo sapiens
ggtcgagtcacttgttgccttt

SEQ ID NO: 8156222 - DNA, 22 bp, Homo sapiens
ggtccttgggtctcctgtgttt

SEQ ID NO: 8156223 - DNA, 22 bp, Homo sapiens
ggtctagagtggggcctggaaa

SEQ ID NO: 8156224 - DNA, 22 bp, Homo sapiens
ggtctacattgagagagctgct

SEQ ID NO: 8156225 - DNA, 22 bp, Homo sapiens
ggtctcagactggcaggcagtg

SEQ ID NO: 8156226 - DNA, 22 bp, Homo sapiens
ggtctcagactggcaggcagtg

SEQ ID NO: 8156227 - DNA, 22 bp, Homo sapiens
ggtctcagactggcaggcagtg

SEQ ID NO: 8156228 - DNA, 22 bp, Homo sapiens
ggtcagcagtgcagggcagagc

SEQ ID NO: 8156229 - DNA, 22 bp, Homo sapiens
ggtcagcaggtccagccagtgc

SEQ ID NO: 8156230 - DNA, 22 bp, Homo sapiens
ggtcagcagtgcagggcagagc

SEQ ID NO: 8156231 - DNA, 22 bp, Homo sapiens
ggtcagcagccatgccatgaat

SEQ ID NO: 8156232 - DNA, 22 bp, Homo sapiens
ggtcagaggtcccagaagaagc

SEQ ID NO: 8156233 - DNA, 22 bp, Homo sapiens
ggtcagcagccatgccatgaat

SEQ ID NO: 8156234 - DNA, 22 bp, Homo sapiens
ggtcagaggtcacaagctggca

SEQ ID NO: 8156235 - DNA, 22 bp, Homo sapiens
ggtcagaggtcccagaagaagc

SEQ ID NO: 8156236 - DNA, 19 bp, Homo sapiens
ggtcagcagtttagggtct

SEQ ID NO: 8156237 - DNA, 22 bp, Homo sapiens
ggtccctggggaactaggctgt

SEQ ID NO: 8156238 - DNA, 22 bp, Homo sapiens
ggtccctggggaactaggctgt

SEQ ID NO: 8156239 - DNA, 22 bp, Homo sapiens
ggtccctggaagtccctcttct

SEQ ID NO: 8156240 - DNA, 22 bp, Homo sapiens
ggtccctggaagtccctcttct

SEQ ID NO: 8156241 - DNA, 22 bp, Homo sapiens
ggtccctgggtcttcttacgtc

SEQ ID NO: 8156242 - DNA, 22 bp, Homo sapiens
ggtccctggttccctctgagct

SEQ ID NO: 8156243 - DNA, 22 bp, Homo sapiens
ggtccctggggaactaggctgt

SEQ ID NO: 8156244 - DNA, 18 bp, Homo sapiens
ggtcctgggcctggctca

SEQ ID NO: 8156245 - DNA, 22 bp, Homo sapiens
ggtccttctgtaggggtcccct

SEQ ID NO: 8156246 - DNA, 22 bp, Homo sapiens
ggtccttcagtaggttccagac

SEQ ID NO: 8156247 - DNA, 18 bp, Homo sapiens
ggtcctgggcctggctca

SEQ ID NO: 8156248 - DNA, 18 bp, Homo sapiens
ggtcctgggcctggctca

SEQ ID NO: 8156249 - DNA, 22 bp, Homo sapiens
ggtctctgtcactgagtggccc

SEQ ID NO: 8156250 - DNA, 22 bp, Homo sapiens
ggtctctgtcactgagtggccc

SEQ ID NO: 8156251 - DNA, 22 bp, Homo sapiens
ggtctctgtcactgagtggccc

SEQ ID NO: 8156252 - DNA, 22 bp, Homo sapiens
ggtctctggccttggagattga

SEQ ID NO: 8156253 - DNA, 22 bp, Homo sapiens
ggtctctggccttggagattga

SEQ ID NO: 8156254 - DNA, 22 bp, Homo sapiens
ggtctctgctcagatgccactt

SEQ ID NO: 8156255 - DNA, 22 bp, Homo sapiens
ggtctctgcagctcccggcccc

SEQ ID NO: 8156256 - DNA, 22 bp, Homo sapiens
ggtctctgagtgaggacctggg

SEQ ID NO: 8156257 - DNA, 22 bp, Homo sapiens
ggtctctgagtgaggacctggg

SEQ ID NO: 8156258 - DNA, 22 bp, Homo sapiens
ggtctctgacttagagatggat

SEQ ID NO: 8156259 - DNA, 22 bp, Homo sapiens
ggtctctgagtgaggacctggg

SEQ ID NO: 8156260 - DNA, 22 bp, Homo sapiens
ggtctctgacttagagatggat

SEQ ID NO: 8156261 - DNA, 22 bp, Homo sapiens
ggtctctgacttagagatggat

SEQ ID NO: 8156262 - DNA, 22 bp, Homo sapiens
ggtctctgagtgaggacctggg

SEQ ID NO: 8156263 - DNA, 22 bp, Homo sapiens
ggtctctctgctttcccccaga

SEQ ID NO: 8156264 - DNA, 20 bp, Homo sapiens
ggtctctgacagctggttgc

SEQ ID NO: 8156265 - DNA, 20 bp, Homo sapiens
ggtctctgacagctggttgc

SEQ ID NO: 8156266 - DNA, 20 bp, Homo sapiens
ggtctctgacagctggttgc

SEQ ID NO: 8156267 - DNA, 20 bp, Homo sapiens
ggtctctgacagctggttgc

SEQ ID NO: 8156268 - DNA, 22 bp, Homo sapiens
ggtctctgaagcttttagtccc

SEQ ID NO: 8156269 - DNA, 22 bp, Homo sapiens
ggtctctgaacttccactgcgc

SEQ ID NO: 8156270 - DNA, 22 bp, Homo sapiens
ggtctccagctgggaccctgca

SEQ ID NO: 8156271 - DNA, 22 bp, Homo sapiens
ggtctccaaagcttaggactac

SEQ ID NO: 8156272 - DNA, 22 bp, Homo sapiens
ggtctccaaagcttaggactac

SEQ ID NO: 8156273 - DNA, 19 bp, Homo sapiens
ggtctcagtgcagctgcag

SEQ ID NO: 8156274 - DNA, 19 bp, Homo sapiens
ggtctcagtgcagctgcag

SEQ ID NO: 8156275 - DNA, 22 bp, Homo sapiens
ggtctccaaagctgcattgatg

SEQ ID NO: 8156276 - DNA, 22 bp, Homo sapiens
ggtctcaggtagggcctaggaa

SEQ ID NO: 8156277 - DNA, 22 bp, Homo sapiens
ggtctcaggtagggcctaggaa

SEQ ID NO: 8156278 - DNA, 22 bp, Homo sapiens
ggtctcaggtagggcctaggaa

SEQ ID NO: 8156279 - DNA, 19 bp, Homo sapiens
ggtctcagtgcagctgcag

SEQ ID NO: 8156280 - DNA, 19 bp, Homo sapiens
ggtctcagtgcagctgcag

SEQ ID NO: 8156281 - DNA, 22 bp, Homo sapiens
ggtctcagtgaaggagtgtgct

SEQ ID NO: 8156282 - DNA, 22 bp, Homo sapiens
ggtctcagactggcaggcagtg

SEQ ID NO: 8156283 - DNA, 22 bp, Homo sapiens
ggtctcagaggtttctgctcag

SEQ ID NO: 8156284 - DNA, 22 bp, Homo sapiens
ggtctcagaggtttctgctcag

SEQ ID NO: 8156285 - DNA, 22 bp, Homo sapiens
ggtctcagaggtttctgctcag

SEQ ID NO: 8156286 - DNA, 22 bp, Homo sapiens
ggtctcagccctcgccagcagc

SEQ ID NO: 8156287 - DNA, 22 bp, Homo sapiens
ggtctcagccctcgccagcagc

SEQ ID NO: 8156288 - DNA, 22 bp, Homo sapiens
ggtctcagccctcgccagcagc

SEQ ID NO: 8156289 - DNA, 22 bp, Homo sapiens
ggtctcaggagactggagagca

SEQ ID NO: 8156290 - DNA, 22 bp, Homo sapiens
ggtctcaggagactggagagca

SEQ ID NO: 8156291 - DNA, 22 bp, Homo sapiens
ggtctcaggagactggagagca

SEQ ID NO: 8156292 - DNA, 22 bp, Homo sapiens
ggtctcagctggagtccttggt

SEQ ID NO: 8156293 - DNA, 22 bp, Homo sapiens
ggtctcagctggagtccttggt

SEQ ID NO: 8156294 - DNA, 22 bp, Homo sapiens
ggtctcagctggagtccttggt

SEQ ID NO: 8156295 - DNA, 22 bp, Homo sapiens
ggttttcaaagaggcatttcat

SEQ ID NO: 8156296 - DNA, 22 bp, Homo sapiens
ggttttctgctgaagatttcac

SEQ ID NO: 8156297 - DNA, 22 bp, Homo sapiens
ggttttatcctacccacacagc

SEQ ID NO: 8156298 - DNA, 22 bp, Homo sapiens
ggttttatagcagtactatcag

SEQ ID NO: 8156299 - DNA, 22 bp, Homo sapiens
ggttttattaactttaacatca

SEQ ID NO: 8156300 - DNA, 22 bp, Homo sapiens
ggttttattaactttaacatca

SEQ ID NO: 8156301 - DNA, 22 bp, Homo sapiens
ggttttattaccccttaaacac

SEQ ID NO: 8156302 - DNA, 22 bp, Homo sapiens
gtaaaacaagctttatggttcc

SEQ ID NO: 8156303 - DNA, 22 bp, Homo sapiens
gtaaaacatgttttaactagga

SEQ ID NO: 8156304 - DNA, 22 bp, Homo sapiens
gtaaaacatgttttaactagga

SEQ ID NO: 8156305 - DNA, 22 bp, Homo sapiens
ggtttgaacagctttggagaag

SEQ ID NO: 8156306 - DNA, 22 bp, Homo sapiens
ggtttgcacgatatttccatgg

SEQ ID NO: 8156307 - DNA, 19 bp, Homo sapiens
ggtttgaagaaaatcttgc

SEQ ID NO: 8156308 - DNA, 22 bp, Homo sapiens
ggttttaactacagaattgcaa

SEQ ID NO: 8156309 - DNA, 22 bp, Homo sapiens
ggtttgttggggtccaggccca

SEQ ID NO: 8156310 - DNA, 22 bp, Homo sapiens
ggtttgttggggtccaggccca

SEQ ID NO: 8156311 - DNA, 22 bp, Homo sapiens
ggtttgtggagctggaaacact

SEQ ID NO: 8156312 - DNA, 22 bp, Homo sapiens
ggtttcctttgcttctcctgag

SEQ ID NO: 8156313 - DNA, 22 bp, Homo sapiens
ggtttccaaagatagagtagta

SEQ ID NO: 8156314 - DNA, 22 bp, Homo sapiens
ggtttcaactcagctagtaagg

SEQ ID NO: 8156315 - DNA, 22 bp, Homo sapiens
gtacatttatttttgcagcata

SEQ ID NO: 8156316 - DNA, 22 bp, Homo sapiens
gtacatttcagtttccttaaga

SEQ ID NO: 8156317 - DNA, 22 bp, Homo sapiens
gtacatttcagtttccttaaga

SEQ ID NO: 8156318 - DNA, 23 bp, Homo sapiens
gtaaaatacgcagtgcagtgtga

SEQ ID NO: 8156319 - DNA, 22 bp, Homo sapiens
gtacatttatttttgcagcata

SEQ ID NO: 8156320 - DNA, 22 bp, Homo sapiens
gtaaaactgcagaacttggagg

SEQ ID NO: 8156321 - DNA, 22 bp, Homo sapiens
gtaaaactgtctaatggtatat

SEQ ID NO: 8156322 - DNA, 22 bp, Homo sapiens
gtaaaactgtctaatggtatat

SEQ ID NO: 8156323 - DNA, 22 bp, Homo sapiens
gtacattttactttgtttgaat

SEQ ID NO: 8156324 - DNA, 22 bp, Homo sapiens
gtacatttctcccaacactaaa

SEQ ID NO: 8156325 - DNA, 22 bp, Homo sapiens
gtacatttctcttgttcttatt

SEQ ID NO: 8156326 - DNA, 22 bp, Homo sapiens
gtacattttgaggttaaaacaa

SEQ ID NO: 8156327 - DNA, 22 bp, Homo sapiens
gtacattttgaggttaaaacaa

SEQ ID NO: 8156328 - DNA, 22 bp, Homo sapiens
gtaccatgttgtttggaaggct

SEQ ID NO: 8156329 - DNA, 21 bp, Homo sapiens
gtattctttatgaagtgaaaa

SEQ ID NO: 8156330 - DNA, 17 bp, Homo sapiens
gtattctttgccttcca

SEQ ID NO: 8156331 - DNA, 17 bp, Homo sapiens
gtattctttgccttcca

SEQ ID NO: 8156332 - DNA, 22 bp, Homo sapiens
gtattcttggttatcaaaatac

SEQ ID NO: 8156333 - DNA, 22 bp, Homo sapiens
gtattcttggttatcaaaatac

SEQ ID NO: 8156334 - DNA, 22 bp, Homo sapiens
gtattcttaaggattgagcaaa

SEQ ID NO: 8156335 - DNA, 22 bp, Homo sapiens
gtattcttaaggattgagcaaa

SEQ ID NO: 8156336 - DNA, 22 bp, Homo sapiens
gtattcttgagtggcaactagg

SEQ ID NO: 8156337 - DNA, 22 bp, Homo sapiens
gtattcttatactcagtgagct

SEQ ID NO: 8156338 - DNA, 22 bp, Homo sapiens
gtattcttatactcagtgagct

SEQ ID NO: 8156339 - DNA, 22 bp, Homo sapiens
gtattcaagcgagcagatgtct

SEQ ID NO: 8156340 - DNA, 22 bp, Homo sapiens
gtattcaaggattttgttctac

SEQ ID NO: 8156341 - DNA, 22 bp, Homo sapiens
gtattcatattaaacatatcaa

SEQ ID NO: 8156342 - DNA, 22 bp, Homo sapiens
gtattcagtttgattgtctaca

SEQ ID NO: 8156343 - DNA, 22 bp, Homo sapiens
gtattcagaaggatgatctagt

SEQ ID NO: 8156344 - DNA, 22 bp, Homo sapiens
gtattctgggccgattacaaaa

SEQ ID NO: 8156345 - DNA, 22 bp, Homo sapiens
gtattcctaagtcatgacaaat

SEQ ID NO: 8156346 - DNA, 22 bp, Homo sapiens
gtattcatttatttactcatcc

SEQ ID NO: 8156347 - DNA, 22 bp, Homo sapiens
gtattgtatttatttatgtgac

SEQ ID NO: 8156348 - DNA, 22 bp, Homo sapiens
gtattgtatatttgcaaataca

SEQ ID NO: 8156349 - DNA, 22 bp, Homo sapiens
gtattgtattgaacacatgtga

SEQ ID NO: 8156350 - DNA, 22 bp, Homo sapiens
gtatttcacatatggatatgct

SEQ ID NO: 8156351 - DNA, 22 bp, Homo sapiens
gtatttataggggaatgagagt

SEQ ID NO: 8156352 - DNA, 22 bp, Homo sapiens
gtatttataggggaatgagagt

SEQ ID NO: 8156353 - DNA, 22 bp, Homo sapiens
gtagaaattccatttactttga

SEQ ID NO: 8156354 - DNA, 22 bp, Homo sapiens
gtagaaattccatttactttga

SEQ ID NO: 8156355 - DNA, 22 bp, Homo sapiens
gtagaaattccatttactttga

SEQ ID NO: 8156356 - DNA, 22 bp, Homo sapiens
gtagaacactggggctctgttg

SEQ ID NO: 8156357 - DNA, 22 bp, Homo sapiens
gtagaacatggtagggcaggtg

SEQ ID NO: 8156358 - DNA, 22 bp, Homo sapiens
gtactaaaaaatgatcagtttg

SEQ ID NO: 8156359 - DNA, 22 bp, Homo sapiens
gtacctatgatctgcaggtagt

SEQ ID NO: 8156360 - DNA, 22 bp, Homo sapiens
gtacggtgaatcagtggatgaa

SEQ ID NO: 8156361 - DNA, 22 bp, Homo sapiens
gtacctgggggatccacttctt

SEQ ID NO: 8156362 - DNA, 22 bp, Homo sapiens
gtacctgggggatccacttctt

SEQ ID NO: 8156363 - DNA, 22 bp, Homo sapiens
gtagaataaatgtacacatctg

SEQ ID NO: 8156364 - DNA, 22 bp, Homo sapiens
gtagaataggggtattgcttca

SEQ ID NO: 8156365 - DNA, 22 bp, Homo sapiens
gtagaataggggtattgcttca

SEQ ID NO: 8156366 - DNA, 22 bp, Homo sapiens
gtagaactaggacttcaggtat

SEQ ID NO: 8156367 - DNA, 22 bp, Homo sapiens
gtagaactcccagtggtattgt

SEQ ID NO: 8156368 - DNA, 22 bp, Homo sapiens
gtagaactaggacttcaggtat

SEQ ID NO: 8156369 - DNA, 22 bp, Homo sapiens
gtagaatatatggttagtattg

SEQ ID NO: 8156370 - DNA, 22 bp, Homo sapiens
gtagaatattttgttctactat

SEQ ID NO: 8156371 - DNA, 22 bp, Homo sapiens
gtattattgtcatgaaataata

SEQ ID NO: 8156372 - DNA, 22 bp, Homo sapiens
gtattattaagtgtatttgacc

SEQ ID NO: 8156373 - DNA, 22 bp, Homo sapiens
gtattaggttggtgcaaaagta

SEQ ID NO: 8156374 - DNA, 22 bp, Homo sapiens
gtattagaagaaattataggta

SEQ ID NO: 8156375 - DNA, 22 bp, Homo sapiens
gtattagactgagaaatggagt

SEQ ID NO: 8156376 - DNA, 22 bp, Homo sapiens
gtattagggccaaaggcaggaa

SEQ ID NO: 8156377 - DNA, 22 bp, Homo sapiens
gtattaggaggaacacaggcct

SEQ ID NO: 8156378 - DNA, 18 bp, Homo sapiens
gtccacagccctcacagc

SEQ ID NO: 8156379 - DNA, 18 bp, Homo sapiens
gtccacagattcttcact

SEQ ID NO: 8156380 - DNA, 18 bp, Homo sapiens
gtccacagattcttcact

SEQ ID NO: 8156381 - DNA, 22 bp, Homo sapiens
gtccacagagggctgggcaggc

SEQ ID NO: 8156382 - DNA, 18 bp, Homo sapiens
gtccacagccctcacagc

SEQ ID NO: 8156383 - DNA, 22 bp, Homo sapiens
gtccacagctggccagggcctc

SEQ ID NO: 8156384 - DNA, 22 bp, Homo sapiens
gtccacagctggccagggcctc

SEQ ID NO: 8156385 - DNA, 22 bp, Homo sapiens
gtccacagggatggccacacat

SEQ ID NO: 8156386 - DNA, 22 bp, Homo sapiens
gtccacagggatggccacacat

SEQ ID NO: 8156387 - DNA, 22 bp, Homo sapiens
gtccacagctggccagggcctc

SEQ ID NO: 8156388 - DNA, 22 bp, Homo sapiens
gtccacataggaacccagcttc

SEQ ID NO: 8156389 - DNA, 22 bp, Homo sapiens
gtccacagggatggccacacat

SEQ ID NO: 8156390 - DNA, 21 bp, Homo sapiens
gtccacaggggtttgtcctgg

SEQ ID NO: 8156391 - DNA, 22 bp, Homo sapiens
gtccacagtgaggtgtttaaat

SEQ ID NO: 8156392 - DNA, 19 bp, Homo sapiens
gtccactccactcggtctc

SEQ ID NO: 8156393 - DNA, 22 bp, Homo sapiens
gtccactcccagtgcctgaggc

SEQ ID NO: 8156394 - DNA, 22 bp, Homo sapiens
gtccactcccagtgcctgaggc

SEQ ID NO: 8156395 - DNA, 22 bp, Homo sapiens
gtccaccttcttggtcaggccc

SEQ ID NO: 8156396 - DNA, 22 bp, Homo sapiens
gtccaccttcttggtcaggccc

SEQ ID NO: 8156397 - DNA, 22 bp, Homo sapiens
gtccacccatgacacctgcctg

SEQ ID NO: 8156398 - DNA, 22 bp, Homo sapiens
gtccactgctgtgtgcttcacc

SEQ ID NO: 8156399 - DNA, 22 bp, Homo sapiens
gtccactctctgccgtgcctgt

SEQ ID NO: 8156400 - DNA, 22 bp, Homo sapiens
gtccacttcaggactggccgct

SEQ ID NO: 8156401 - DNA, 22 bp, Homo sapiens
gtccacttctgcctttctggat

SEQ ID NO: 8156402 - DNA, 22 bp, Homo sapiens
gtccacttctgacttgttcaga

SEQ ID NO: 8156403 - DNA, 21 bp, Homo sapiens
gtccacttccttcctgcttct

SEQ ID NO: 8156404 - DNA, 22 bp, Homo sapiens
gtccacttggcacaaggcactt

SEQ ID NO: 8156405 - DNA, 22 bp, Homo sapiens
gtccacttgctgtgttcttaat

SEQ ID NO: 8156406 - DNA, 22 bp, Homo sapiens
gtccccagaaaggtgaggcagg

SEQ ID NO: 8156407 - DNA, 22 bp, Homo sapiens
gtccccagaaaggtgaggcagg

SEQ ID NO: 8156408 - DNA, 22 bp, Homo sapiens
gtcccattgttctgggcttggc

SEQ ID NO: 8156409 - DNA, 23 bp, Homo sapiens
gtatttcagcattctcagttaaa

SEQ ID NO: 8156410 - DNA, 22 bp, Homo sapiens
gtatttccattagtgtgtgcac

SEQ ID NO: 8156411 - DNA, 22 bp, Homo sapiens
gtatttccattagtgtgtgcac

SEQ ID NO: 8156412 - DNA, 22 bp, Homo sapiens
gtcattttgctgcatatttaga

SEQ ID NO: 8156413 - DNA, 22 bp, Homo sapiens
gtcatttttcactgcatataga

SEQ ID NO: 8156414 - DNA, 22 bp, Homo sapiens
gtcattttctagaattatttga

SEQ ID NO: 8156415 - DNA, 22 bp, Homo sapiens
gtcatttttgactttgaagtga

SEQ ID NO: 8156416 - DNA, 22 bp, Homo sapiens
gtcatttttgactttgaagtga

SEQ ID NO: 8156417 - DNA, 22 bp, Homo sapiens
gtccaagagtcaagaagggggc

SEQ ID NO: 8156418 - DNA, 22 bp, Homo sapiens
gtccaagagctcattatccgga

SEQ ID NO: 8156419 - DNA, 22 bp, Homo sapiens
gtccaagagtcaagaagggggc

SEQ ID NO: 8156420 - DNA, 22 bp, Homo sapiens
gtccaaaagagccagccgggcg

SEQ ID NO: 8156421 - DNA, 22 bp, Homo sapiens
gtcatttttttcgtaatagtgg

SEQ ID NO: 8156422 - DNA, 22 bp, Homo sapiens
gtccaaggcaagtgtgcagagt

SEQ ID NO: 8156423 - DNA, 22 bp, Homo sapiens
gtccaaggcaagtgtgcagagt

SEQ ID NO: 8156424 - DNA, 22 bp, Homo sapiens
gtccaagggtgcacaactagta

SEQ ID NO: 8156425 - DNA, 22 bp, Homo sapiens
gtccaaggatggggtctcccag

SEQ ID NO: 8156426 - DNA, 22 bp, Homo sapiens
gtccaaggatgcaggatgctgt

SEQ ID NO: 8156427 - DNA, 22 bp, Homo sapiens
gtccacaagcaggaagtgagcc

SEQ ID NO: 8156428 - DNA, 22 bp, Homo sapiens
gtccacaacatcagactaactg

SEQ ID NO: 8156429 - DNA, 22 bp, Homo sapiens
gtccaaggtctttggagataga

SEQ ID NO: 8156430 - DNA, 22 bp, Homo sapiens
gtccacaaaattactatcttac

SEQ ID NO: 8156431 - DNA, 22 bp, Homo sapiens
gtccctggaaaagagctggtga

SEQ ID NO: 8156432 - DNA, 22 bp, Homo sapiens
gtccctggaatggactctgcgc

SEQ ID NO: 8156433 - DNA, 22 bp, Homo sapiens
gtccctggaatggactctgcgc

SEQ ID NO: 8156434 - DNA, 22 bp, Homo sapiens
gtccctgcatctgcaggccatg

SEQ ID NO: 8156435 - DNA, 22 bp, Homo sapiens
gtccctgcatctgcaggccatg

SEQ ID NO: 8156436 - DNA, 22 bp, Homo sapiens
gtccctgcatctgcaggccatg

SEQ ID NO: 8156437 - DNA, 22 bp, Homo sapiens
gtccctgcatcaccacgggact

SEQ ID NO: 8156438 - DNA, 22 bp, Homo sapiens
gtccctggaaaagagctggtga

SEQ ID NO: 8156439 - DNA, 22 bp, Homo sapiens
gtccctgccctcctgggactca

SEQ ID NO: 8156440 - DNA, 22 bp, Homo sapiens
gtccctgccctcctgggactca

SEQ ID NO: 8156441 - DNA, 22 bp, Homo sapiens
gtccctgccctcctgggactca

SEQ ID NO: 8156442 - DNA, 22 bp, Homo sapiens
gtcctgggaaggaagccaggga

SEQ ID NO: 8156443 - DNA, 22 bp, Homo sapiens
gtcctgggaaggaagccaggga

SEQ ID NO: 8156444 - DNA, 22 bp, Homo sapiens
gtcctgggaaggaagccaggga

SEQ ID NO: 8156445 - DNA, 22 bp, Homo sapiens
gtcctgggaaggaagccaggga

SEQ ID NO: 8156446 - DNA, 22 bp, Homo sapiens
gtcctgggagatgggaccctga

SEQ ID NO: 8156447 - DNA, 20 bp, Homo sapiens
gtcctgggagccacagcaca

SEQ ID NO: 8156448 - DNA, 20 bp, Homo sapiens
gtcctgggagccacagcaca

SEQ ID NO: 8156449 - DNA, 20 bp, Homo sapiens
gtcctgggagccacagcaca

SEQ ID NO: 8156450 - DNA, 22 bp, Homo sapiens
gtcctgggcccaggggctgcct

SEQ ID NO: 8156451 - DNA, 22 bp, Homo sapiens
gtcctgggcccaggggctgcct

SEQ ID NO: 8156452 - DNA, 22 bp, Homo sapiens
gtcctgggcccaggggctgcct

SEQ ID NO: 8156453 - DNA, 22 bp, Homo sapiens
gtcctgggcccaggggctgcct

SEQ ID NO: 8156454 - DNA, 22 bp, Homo sapiens
gtcctgggcatgcagggctttc

SEQ ID NO: 8156455 - DNA, 22 bp, Homo sapiens
gtcctgggcatgcagggctttc

SEQ ID NO: 8156456 - DNA, 22 bp, Homo sapiens
gtcctgggcatgcagggctttc

SEQ ID NO: 8156457 - DNA, 22 bp, Homo sapiens
gtcctgggaggggctggtcctg

SEQ ID NO: 8156458 - DNA, 17 bp, Homo sapiens
gtcctgggaggagagag

SEQ ID NO: 8156459 - DNA, 17 bp, Homo sapiens
gtcctgggaggagagag

SEQ ID NO: 8156460 - DNA, 17 bp, Homo sapiens
gtcctgggaggagagag

SEQ ID NO: 8156461 - DNA, 17 bp, Homo sapiens
gtcctgggaggagagag

SEQ ID NO: 8156462 - DNA, 17 bp, Homo sapiens
gtcctgggaggagagag

SEQ ID NO: 8156463 - DNA, 17 bp, Homo sapiens
gtcctgggaggagagag

SEQ ID NO: 8156464 - DNA, 17 bp, Homo sapiens
gtcctgggaggagagag

SEQ ID NO: 8156465 - DNA, 17 bp, Homo sapiens
gtcctgggaggagagag

SEQ ID NO: 8156466 - DNA, 20 bp, Homo sapiens
gtcctgggagccacagcaca

SEQ ID NO: 8156467 - DNA, 22 bp, Homo sapiens
gtccccttggtaaccttcagct

SEQ ID NO: 8156468 - DNA, 22 bp, Homo sapiens
gtcccctgtccagggccagcca

SEQ ID NO: 8156469 - DNA, 22 bp, Homo sapiens
gtcccctcagccacccatgggg

SEQ ID NO: 8156470 - DNA, 22 bp, Homo sapiens
gtcccctcagccacccatgggg

SEQ ID NO: 8156471 - DNA, 22 bp, Homo sapiens
gtcccctggcccccagcgtcgg

SEQ ID NO: 8156472 - DNA, 22 bp, Homo sapiens
gtcccctggcccccagcgtcgg

SEQ ID NO: 8156473 - DNA, 22 bp, Homo sapiens
gtccccctgaaagcagccgcag

SEQ ID NO: 8156474 - DNA, 22 bp, Homo sapiens
gtccccctgaaagcagccgcag

SEQ ID NO: 8156475 - DNA, 22 bp, Homo sapiens
gtcccctcaaaattcatatgtt

SEQ ID NO: 8156476 - DNA, 22 bp, Homo sapiens
gtccccagctgtgacgagagcc

SEQ ID NO: 8156477 - DNA, 22 bp, Homo sapiens
gtccccagctgtgacgagagcc

SEQ ID NO: 8156478 - DNA, 22 bp, Homo sapiens
gtccctgagcctggcatttccc

SEQ ID NO: 8156479 - DNA, 22 bp, Homo sapiens
gtccctgacacccgggtggagg

SEQ ID NO: 8156480 - DNA, 22 bp, Homo sapiens
gtccctgcatcaccacgggact

SEQ ID NO: 8156481 - DNA, 22 bp, Homo sapiens
gtccctgcatcaccacgggact

SEQ ID NO: 8156482 - DNA, 22 bp, Homo sapiens
gtccctgagcctggcatttccc

SEQ ID NO: 8156483 - DNA, 22 bp, Homo sapiens
gtccctgataagagccatcgat

SEQ ID NO: 8156484 - DNA, 22 bp, Homo sapiens
gtccctctgtgtccctgcagtc

SEQ ID NO: 8156485 - DNA, 22 bp, Homo sapiens
gtccctctgtgtccctgcagtc

SEQ ID NO: 8156486 - DNA, 22 bp, Homo sapiens
gtccctctgtgtccctgcagtc

SEQ ID NO: 8156487 - DNA, 22 bp, Homo sapiens
gtccctctgtgtccctgcagtc

SEQ ID NO: 8156488 - DNA, 23 bp, Homo sapiens
gtccctcacccctaggcaatgcc

SEQ ID NO: 8156489 - DNA, 22 bp, Homo sapiens
gtccctcacccagatgctccca

SEQ ID NO: 8156490 - DNA, 22 bp, Homo sapiens
gtccctcaaggtccagtcatgg

SEQ ID NO: 8156491 - DNA, 22 bp, Homo sapiens
gtccctagtggaaagacatgat

SEQ ID NO: 8156492 - DNA, 22 bp, Homo sapiens
gtccctcactggaccatatgaa

SEQ ID NO: 8156493 - DNA, 22 bp, Homo sapiens
gtccctcagtagtgcacagtgg

SEQ ID NO: 8156494 - DNA, 22 bp, Homo sapiens
gtccctcagtagtgcacagtgg

SEQ ID NO: 8156495 - DNA, 22 bp, Homo sapiens
gtgcacatcgtgcaggtttgtt

SEQ ID NO: 8156496 - DNA, 22 bp, Homo sapiens
gtgcacatcgtgcaggtttgtt

SEQ ID NO: 8156497 - DNA, 19 bp, Homo sapiens
gtgcactgtcactttgctc

SEQ ID NO: 8156498 - DNA, 22 bp, Homo sapiens
gtgcactgtctggtcaagagca

SEQ ID NO: 8156499 - DNA, 22 bp, Homo sapiens
gtgcacttgatctagacagatt

SEQ ID NO: 8156500 - DNA, 22 bp, Homo sapiens
gtgcagacccacgtccagggcc

SEQ ID NO: 8156501 - DNA, 22 bp, Homo sapiens
gtgcagagcaagggctgagggc

SEQ ID NO: 8156502 - DNA, 22 bp, Homo sapiens
gtgcagagaggtggagggactt

SEQ ID NO: 8156503 - DNA, 22 bp, Homo sapiens
gtgcagagaaggagcagtagtt

SEQ ID NO: 8156504 - DNA, 22 bp, Homo sapiens
gtgcagagaaatgagaagtcga

SEQ ID NO: 8156505 - DNA, 22 bp, Homo sapiens
gtgcagagaaatgagaagtcga

SEQ ID NO: 8156506 - DNA, 21 bp, Homo sapiens
gtgcacagtcctgcacacagg

SEQ ID NO: 8156507 - DNA, 21 bp, Homo sapiens
gtgcacagtcctgcacacagg

SEQ ID NO: 8156508 - DNA, 23 bp, Homo sapiens
gtgcacagtcaagcccagcttag

SEQ ID NO: 8156509 - DNA, 21 bp, Homo sapiens
gtgcacagtcctgcacacagg

SEQ ID NO: 8156510 - DNA, 22 bp, Homo sapiens
gtgcacatatttgtgcatgcat

SEQ ID NO: 8156511 - DNA, 22 bp, Homo sapiens
gtgagcaggatttcatggtgta

SEQ ID NO: 8156512 - DNA, 22 bp, Homo sapiens
gtgagcaggatttcatggtgta

SEQ ID NO: 8156513 - DNA, 22 bp, Homo sapiens
gtgagcaggatttcatggtgta

SEQ ID NO: 8156514 - DNA, 22 bp, Homo sapiens
gtgagcaggatttcatggtgta

SEQ ID NO: 8156515 - DNA, 22 bp, Homo sapiens
gtgagcaggatttcatggtgta

SEQ ID NO: 8156516 - DNA, 22 bp, Homo sapiens
gtgagcaggatttcatggtgta

SEQ ID NO: 8156517 - DNA, 22 bp, Homo sapiens
gtgagcaggataggggctccct

SEQ ID NO: 8156518 - DNA, 22 bp, Homo sapiens
gtgcacagaagcagaagctaga

SEQ ID NO: 8156519 - DNA, 22 bp, Homo sapiens
gtgactttaacttcagattaga

SEQ ID NO: 8156520 - DNA, 22 bp, Homo sapiens
gtgagaaatgacaaatgtgtcg

SEQ ID NO: 8156521 - DNA, 22 bp, Homo sapiens
gtgagacaattcctcagtagac

SEQ ID NO: 8156522 - DNA, 22 bp, Homo sapiens
gtgagacaattcctcagtagac

SEQ ID NO: 8156523 - DNA, 22 bp, Homo sapiens
gtgagacaagatttgtaggcag

SEQ ID NO: 8156524 - DNA, 22 bp, Homo sapiens
gtgagaataccagcagtgagaa

SEQ ID NO: 8156525 - DNA, 22 bp, Homo sapiens
gtgaccttggcaatctctcaga

SEQ ID NO: 8156526 - DNA, 21 bp, Homo sapiens
gtgactctggcttcttccagt

SEQ ID NO: 8156527 - DNA, 22 bp, Homo sapiens
gtgactcttacctacccagcct

SEQ ID NO: 8156528 - DNA, 22 bp, Homo sapiens
gtgagactcgcctttgtgtagc

SEQ ID NO: 8156529 - DNA, 22 bp, Homo sapiens
gtgagacctccttgggctgact

SEQ ID NO: 8156530 - DNA, 19 bp, Homo sapiens
gtgagaccctgcatagggc

SEQ ID NO: 8156531 - DNA, 22 bp, Homo sapiens
gtgagagaatttgagttaaatt

SEQ ID NO: 8156532 - DNA, 22 bp, Homo sapiens
gtgagagaaattggagggaatg

SEQ ID NO: 8156533 - DNA, 22 bp, Homo sapiens
gtgagagaaattggagggaatg

SEQ ID NO: 8156534 - DNA, 22 bp, Homo sapiens
gtgagcaggataggggctccct

SEQ ID NO: 8156535 - DNA, 22 bp, Homo sapiens
gtgagcagctcagggtggtctc

SEQ ID NO: 8156536 - DNA, 22 bp, Homo sapiens
gtgagcagctcagggtggtctc

SEQ ID NO: 8156537 - DNA, 22 bp, Homo sapiens
gtgagcagctcagggtggtctc

SEQ ID NO: 8156538 - DNA, 22 bp, Homo sapiens
gtgagcaggataggggctccct

SEQ ID NO: 8156539 - DNA, 22 bp, Homo sapiens
gtgagcaggataggggctccct

SEQ ID NO: 8156540 - DNA, 22 bp, Homo sapiens
gtgagcagctcagggtggtctc

SEQ ID NO: 8156541 - DNA, 22 bp, Homo sapiens
gtgagcagcctcacctgagggt

SEQ ID NO: 8156542 - DNA, 22 bp, Homo sapiens
gtgagcagcctcacctgagggt

SEQ ID NO: 8156543 - DNA, 22 bp, Homo sapiens
gtgagcagcctcacctgagggt

SEQ ID NO: 8156544 - DNA, 22 bp, Homo sapiens
gtgccacagaccaccgtgctgg

SEQ ID NO: 8156545 - DNA, 22 bp, Homo sapiens
gtgctaggattacaggcatggg

SEQ ID NO: 8156546 - DNA, 22 bp, Homo sapiens
gtgctaggattacaggcatggg

SEQ ID NO: 8156547 - DNA, 22 bp, Homo sapiens
gtgctaggtactttgatcggtt

SEQ ID NO: 8156548 - DNA, 22 bp, Homo sapiens
gtgctagggacaaagcagtgaa

SEQ ID NO: 8156549 - DNA, 22 bp, Homo sapiens
gtgctagggttggagtggggct

SEQ ID NO: 8156550 - DNA, 22 bp, Homo sapiens
gtgcatttcaaggcacagctaa

SEQ ID NO: 8156551 - DNA, 22 bp, Homo sapiens
gtgcatttcaaggcacagctaa

SEQ ID NO: 8156552 - DNA, 20 bp, Homo sapiens
gtgcatttcacctgtactgt

SEQ ID NO: 8156553 - DNA, 20 bp, Homo sapiens
gtgcatttcacctgtactgt

SEQ ID NO: 8156554 - DNA, 22 bp, Homo sapiens
gtgcatttctcatacactaaat

SEQ ID NO: 8156555 - DNA, 22 bp, Homo sapiens
gtgcatttgacgaatactcact

SEQ ID NO: 8156556 - DNA, 22 bp, Homo sapiens
gtgcatttctcatacactaaat

SEQ ID NO: 8156557 - DNA, 22 bp, Homo sapiens
gtgcatttgtgcatgcacatgt

SEQ ID NO: 8156558 - DNA, 22 bp, Homo sapiens
gtgcatttggtgactctcaccc

SEQ ID NO: 8156559 - DNA, 22 bp, Homo sapiens
gtgcatttggtgactctcaccc

SEQ ID NO: 8156560 - DNA, 22 bp, Homo sapiens
gtgcatttggtgactctcaccc

SEQ ID NO: 8156561 - DNA, 22 bp, Homo sapiens
gtgcatttgacgaatactcact

SEQ ID NO: 8156562 - DNA, 22 bp, Homo sapiens
gtgcatttgacgaatactcact

SEQ ID NO: 8156563 - DNA, 22 bp, Homo sapiens
gtgcatttaggtcacatgatgt

SEQ ID NO: 8156564 - DNA, 22 bp, Homo sapiens
gtgcatttaggtcacatgatgt

SEQ ID NO: 8156565 - DNA, 22 bp, Homo sapiens
gtgcatttatatttgcctttgg

SEQ ID NO: 8156566 - DNA, 22 bp, Homo sapiens
gtgcatttaggtcacatgatgt

SEQ ID NO: 8156567 - DNA, 22 bp, Homo sapiens
gtgcatttaggtcacatgatgt

SEQ ID NO: 8156568 - DNA, 22 bp, Homo sapiens
gtgcattccaccgtgcaggttg

SEQ ID NO: 8156569 - DNA, 21 bp, Homo sapiens
gtgcagaggaatgtagggggc

SEQ ID NO: 8156570 - DNA, 21 bp, Homo sapiens
gtgcagaggaatgtagggggc

SEQ ID NO: 8156571 - DNA, 22 bp, Homo sapiens
gtgcagagcaagggctgagggc

SEQ ID NO: 8156572 - DNA, 22 bp, Homo sapiens
gtgcagagcaagggctgagggc

SEQ ID NO: 8156573 - DNA, 22 bp, Homo sapiens
gtgcagattcccgggcctctcc

SEQ ID NO: 8156574 - DNA, 20 bp, Homo sapiens
gtgcagatgtcctttcacac

SEQ ID NO: 8156575 - DNA, 22 bp, Homo sapiens
gtgcagatcctgattgcagttc

SEQ ID NO: 8156576 - DNA, 22 bp, Homo sapiens
gtgcagtgaccctggagagctg

SEQ ID NO: 8156577 - DNA, 22 bp, Homo sapiens
gtgcagtgaaaaaagaatgtcc

SEQ ID NO: 8156578 - DNA, 22 bp, Homo sapiens
gtgcagtatctctgggagtggg

SEQ ID NO: 8156579 - DNA, 22 bp, Homo sapiens
gtgcagtgaccctggagagctg

SEQ ID NO: 8156580 - DNA, 22 bp, Homo sapiens
gtgcagtggcagatcctagctc

SEQ ID NO: 8156581 - DNA, 22 bp, Homo sapiens
gtgcagtgagcagtgcagcacc

SEQ ID NO: 8156582 - DNA, 22 bp, Homo sapiens
gtgcaggtgacctaatccatgt

SEQ ID NO: 8156583 - DNA, 22 bp, Homo sapiens
gtgcaggtggatttgggctcaa

SEQ ID NO: 8156584 - DNA, 22 bp, Homo sapiens
gtgcaggtggatttgggctcaa

SEQ ID NO: 8156585 - DNA, 22 bp, Homo sapiens
gtgcaggtggctggtggcaccc

SEQ ID NO: 8156586 - DNA, 22 bp, Homo sapiens
gtgcaggtggctggtggcaccc

SEQ ID NO: 8156587 - DNA, 22 bp, Homo sapiens
gtgcaggtttaggaagcagctc

SEQ ID NO: 8156588 - DNA, 22 bp, Homo sapiens
gtgcaggtttaggaagcagctc

SEQ ID NO: 8156589 - DNA, 20 bp, Homo sapiens
gtgcaggttccccttgcact

SEQ ID NO: 8156590 - DNA, 20 bp, Homo sapiens
gtgcaggttccccttgcact

SEQ ID NO: 8156591 - DNA, 22 bp, Homo sapiens
gtgcaggtggcttctagcttct

SEQ ID NO: 8156592 - DNA, 22 bp, Homo sapiens
gtgcaggtggttggcccagccg

SEQ ID NO: 8156593 - DNA, 22 bp, Homo sapiens
gtgcaggtgttttggctgccag

SEQ ID NO: 8156594 - DNA, 22 bp, Homo sapiens
gtgcaggtgttttggctgccag

SEQ ID NO: 8156595 - DNA, 22 bp, Homo sapiens
gtcctgggcggagggctgctgt

SEQ ID NO: 8156596 - DNA, 22 bp, Homo sapiens
gtcctgggcggagggctgctgt

SEQ ID NO: 8156597 - DNA, 22 bp, Homo sapiens
gtcctggggaatacagaagccg

SEQ ID NO: 8156598 - DNA, 22 bp, Homo sapiens
gtcctggggaatacagaagccg

SEQ ID NO: 8156599 - DNA, 22 bp, Homo sapiens
gtcctggggaatacagaagccg

SEQ ID NO: 8156600 - DNA, 22 bp, Homo sapiens
gtcctggggaatacagaagccg

SEQ ID NO: 8156601 - DNA, 22 bp, Homo sapiens
gtcctgggcggagggctgctgt

SEQ ID NO: 8156602 - DNA, 22 bp, Homo sapiens
gtcctgggcggagggctgctgt

SEQ ID NO: 8156603 - DNA, 22 bp, Homo sapiens
gtcctgggcctgctgaggctga

SEQ ID NO: 8156604 - DNA, 22 bp, Homo sapiens
gtcctgggcctgctgaggctga

SEQ ID NO: 8156605 - DNA, 22 bp, Homo sapiens
gtcctgggcctgctgaggctga

SEQ ID NO: 8156606 - DNA, 22 bp, Homo sapiens
gtcctgggcctgctgaggctga

SEQ ID NO: 8156607 - DNA, 22 bp, Homo sapiens
gtcctggggattatagagtgtt

SEQ ID NO: 8156608 - DNA, 22 bp, Homo sapiens
gtcctggggattatagagtgtt

SEQ ID NO: 8156609 - DNA, 22 bp, Homo sapiens
gtcctggggatacagaagtgaa

SEQ ID NO: 8156610 - DNA, 22 bp, Homo sapiens
gtcctggggatacagaagtgaa

SEQ ID NO: 8156611 - DNA, 22 bp, Homo sapiens
gtcctggggatacagaagtgaa

SEQ ID NO: 8156612 - DNA, 22 bp, Homo sapiens
gtcctggggatacagaagtgaa

SEQ ID NO: 8156613 - DNA, 22 bp, Homo sapiens
gtcctggggatacagaagtgaa

SEQ ID NO: 8156614 - DNA, 22 bp, Homo sapiens
gtcctggggaatacagaagccg

SEQ ID NO: 8156615 - DNA, 22 bp, Homo sapiens
gtcctggggaatacagaagccg

SEQ ID NO: 8156616 - DNA, 22 bp, Homo sapiens
gtctgcccagaagacatcccct

SEQ ID NO: 8156617 - DNA, 22 bp, Homo sapiens
gtctgccccagaccctgaccca

SEQ ID NO: 8156618 - DNA, 22 bp, Homo sapiens
gtcctgggggcagctgtgtcca

SEQ ID NO: 8156619 - DNA, 22 bp, Homo sapiens
gtcctgggggcagctgtgtcca

SEQ ID NO: 8156620 - DNA, 22 bp, Homo sapiens
gtcctggggattatagagtgtt

SEQ ID NO: 8156621 - DNA, 22 bp, Homo sapiens
gtcctgggggcagctgtgtcca

SEQ ID NO: 8156622 - DNA, 22 bp, Homo sapiens
gtctgcccttcctctccacgat

SEQ ID NO: 8156623 - DNA, 22 bp, Homo sapiens
gtctgcccggccttcctccacc

SEQ ID NO: 8156624 - DNA, 22 bp, Homo sapiens
gtctgccctcacgccagctggg

SEQ ID NO: 8156625 - DNA, 22 bp, Homo sapiens
gtctggagcctgggtccctgct

SEQ ID NO: 8156626 - DNA, 22 bp, Homo sapiens
gtctggaggaggaagaaggcac

SEQ ID NO: 8156627 - DNA, 22 bp, Homo sapiens
gtctgctggtgcctggcctgcg

SEQ ID NO: 8156628 - DNA, 22 bp, Homo sapiens
gtctgctgcagtcgtggctcta

SEQ ID NO: 8156629 - DNA, 22 bp, Homo sapiens
gtctgctggtgcctggcctgcg

SEQ ID NO: 8156630 - DNA, 22 bp, Homo sapiens
gtctgctggtgcctggcctgcg

SEQ ID NO: 8156631 - DNA, 22 bp, Homo sapiens
gtctgctgcagagcatggcttt

SEQ ID NO: 8156632 - DNA, 22 bp, Homo sapiens
gtctgctgcagtcgtggctcta

SEQ ID NO: 8156633 - DNA, 22 bp, Homo sapiens
gtctgctcatgctaccgcgggc

SEQ ID NO: 8156634 - DNA, 22 bp, Homo sapiens
gtctgctcatgctaccgcgggc

SEQ ID NO: 8156635 - DNA, 22 bp, Homo sapiens
gtctgctcatgctaccgcgggc

SEQ ID NO: 8156636 - DNA, 22 bp, Homo sapiens
gtctgctcatgctaccgcgggc

SEQ ID NO: 8156637 - DNA, 22 bp, Homo sapiens
gtctgcctctttctttctgggt

SEQ ID NO: 8156638 - DNA, 22 bp, Homo sapiens
gtctgcccttggctcagccata

SEQ ID NO: 8156639 - DNA, 22 bp, Homo sapiens
gtctgcctggaggcagctgctg

SEQ ID NO: 8156640 - DNA, 22 bp, Homo sapiens
gtctgcctgggacgctgggagt

SEQ ID NO: 8156641 - DNA, 22 bp, Homo sapiens
gtgaaatattttgtttatgtca

SEQ ID NO: 8156642 - DNA, 22 bp, Homo sapiens
gtgaaatattttgtttatgtca

SEQ ID NO: 8156643 - DNA, 22 bp, Homo sapiens
gtgaaatattttgtttatgtca

SEQ ID NO: 8156644 - DNA, 22 bp, Homo sapiens
gtgaaatattttgtttatgtca

SEQ ID NO: 8156645 - DNA, 22 bp, Homo sapiens
gtgaaatatttaacgtccaggt

SEQ ID NO: 8156646 - DNA, 22 bp, Homo sapiens
gtgaaatatttaacgtccaggt

SEQ ID NO: 8156647 - DNA, 22 bp, Homo sapiens
gtgaaatatttaacgtccaggt

SEQ ID NO: 8156648 - DNA, 22 bp, Homo sapiens
gtgaacaggagaaagtgatgga

SEQ ID NO: 8156649 - DNA, 22 bp, Homo sapiens
gtgaacattttcttgcaaattg

SEQ ID NO: 8156650 - DNA, 22 bp, Homo sapiens
gtgaacatcagattacatgaga

SEQ ID NO: 8156651 - DNA, 22 bp, Homo sapiens
gtgaacattgaggcagaaagga

SEQ ID NO: 8156652 - DNA, 22 bp, Homo sapiens
gtgaacatcagattacatgaga

SEQ ID NO: 8156653 - DNA, 22 bp, Homo sapiens
gtctggaggcccgtcagcccta

SEQ ID NO: 8156654 - DNA, 22 bp, Homo sapiens
gtctggagggaagagatgtcag

SEQ ID NO: 8156655 - DNA, 22 bp, Homo sapiens
gtctggagtaccataaaaagga

SEQ ID NO: 8156656 - DNA, 18 bp, Homo sapiens
gtctggaggtcaggagct

SEQ ID NO: 8156657 - DNA, 22 bp, Homo sapiens
gtctggagtggggcctgagaat

SEQ ID NO: 8156658 - DNA, 22 bp, Homo sapiens
gtgaaaataaggctggttcttg

SEQ ID NO: 8156659 - DNA, 22 bp, Homo sapiens
gtgaaacttcacattttgatag

SEQ ID NO: 8156660 - DNA, 22 bp, Homo sapiens
gtgaccatcatctcagctagtt

SEQ ID NO: 8156661 - DNA, 22 bp, Homo sapiens
gtgaaggagttatcagtggtta

SEQ ID NO: 8156662 - DNA, 22 bp, Homo sapiens
gtgaccatcatctcagctagtt

SEQ ID NO: 8156663 - DNA, 22 bp, Homo sapiens
gtgaccatcatctcagctagtt

SEQ ID NO: 8156664 - DNA, 22 bp, Homo sapiens
gtgaaggactagcatggagggc

SEQ ID NO: 8156665 - DNA, 22 bp, Homo sapiens
gtgaaggactagcatggagggc

SEQ ID NO: 8156666 - DNA, 22 bp, Homo sapiens
gtgaaggactgaatgaaaatgt

SEQ ID NO: 8156667 - DNA, 22 bp, Homo sapiens
gtgaagcatatgcttctctgcc

SEQ ID NO: 8156668 - DNA, 19 bp, Homo sapiens
gtgaagctaagtatttgga

SEQ ID NO: 8156669 - DNA, 19 bp, Homo sapiens
gtgaagctaagtatttgga

SEQ ID NO: 8156670 - DNA, 18 bp, Homo sapiens
gtgaagctttattgaatg

SEQ ID NO: 8156671 - DNA, 18 bp, Homo sapiens
gtgaagctttattgaatg

SEQ ID NO: 8156672 - DNA, 22 bp, Homo sapiens
gtgaaggaccaatatgactcat

SEQ ID NO: 8156673 - DNA, 17 bp, Homo sapiens
gtgaagagtcattgaat

SEQ ID NO: 8156674 - DNA, 22 bp, Homo sapiens
gtgaagagctgttgcagagatt

SEQ ID NO: 8156675 - DNA, 22 bp, Homo sapiens
gtgaacttccagatgataaaca

SEQ ID NO: 8156676 - DNA, 22 bp, Homo sapiens
gagcagcagctgggccaggttc

SEQ ID NO: 8156677 - DNA, 22 bp, Homo sapiens
gagcagcacttgaggcatgtca

SEQ ID NO: 8156678 - DNA, 22 bp, Homo sapiens
gagcagcactgagttagcagct

SEQ ID NO: 8156679 - DNA, 22 bp, Homo sapiens
gagcagcagattgtctccatgg

SEQ ID NO: 8156680 - DNA, 22 bp, Homo sapiens
gagcagatctcaggccttctgt

SEQ ID NO: 8156681 - DNA, 22 bp, Homo sapiens
gagcagatgtgtgccaggatgc

SEQ ID NO: 8156682 - DNA, 22 bp, Homo sapiens
gagcagatgtgtgccaggatgc

SEQ ID NO: 8156683 - DNA, 22 bp, Homo sapiens
gagcagagtctatttccacact

SEQ ID NO: 8156684 - DNA, 18 bp, Homo sapiens
gagcagaggctcaactgg

SEQ ID NO: 8156685 - DNA, 22 bp, Homo sapiens
gagatttagagagacttaaaca

SEQ ID NO: 8156686 - DNA, 23 bp, Homo sapiens
gagatttagcagacaaagctctt

SEQ ID NO: 8156687 - DNA, 22 bp, Homo sapiens
gagcagcaggtggctgtgatgg

SEQ ID NO: 8156688 - DNA, 22 bp, Homo sapiens
gagcagcaggccaggttgcagg

SEQ ID NO: 8156689 - DNA, 18 bp, Homo sapiens
gagcagcaggatcaagaa

SEQ ID NO: 8156690 - DNA, 22 bp, Homo sapiens
gagcagcagctgggccaggttc

SEQ ID NO: 8156691 - DNA, 22 bp, Homo sapiens
gagcagcaggtggggctggctt

SEQ ID NO: 8156692 - DNA, 22 bp, Homo sapiens
gagcagcagttgttacaatgat

SEQ ID NO: 8156693 - DNA, 22 bp, Homo sapiens
gagcagcaggtggggctggctt

SEQ ID NO: 8156694 - DNA, 22 bp, Homo sapiens
gagatggaatctgtgtggaggg

SEQ ID NO: 8156695 - DNA, 22 bp, Homo sapiens
gagatggaatctgtgtggaggg

SEQ ID NO: 8156696 - DNA, 20 bp, Homo sapiens
gagatggacagatgaagggg

SEQ ID NO: 8156697 - DNA, 22 bp, Homo sapiens
gagatggaaaactgctggtagt

SEQ ID NO: 8156698 - DNA, 22 bp, Homo sapiens
gagatgctttgtgtatagacaa

SEQ ID NO: 8156699 - DNA, 22 bp, Homo sapiens
gagatggagtctttttctgtca

SEQ ID NO: 8156700 - DNA, 22 bp, Homo sapiens
gagatggagtctttttctgtca

SEQ ID NO: 8156701 - DNA, 22 bp, Homo sapiens
gagatggagtctttttctgtca

SEQ ID NO: 8156702 - DNA, 22 bp, Homo sapiens
gagatgtacaatgtgtattaat

SEQ ID NO: 8156703 - DNA, 22 bp, Homo sapiens
gagatggtgttccactgccagt

SEQ ID NO: 8156704 - DNA, 22 bp, Homo sapiens
gagatgtgatcctttgctgtgt

SEQ ID NO: 8156705 - DNA, 22 bp, Homo sapiens
gagatgtgatcctttgctgtgt

SEQ ID NO: 8156706 - DNA, 23 bp, Homo sapiens
gagatgtgggtttgttcagtgtc

SEQ ID NO: 8156707 - DNA, 22 bp, Homo sapiens
gagatgtttagggtggggagag

SEQ ID NO: 8156708 - DNA, 22 bp, Homo sapiens
gagatgtttagggtggggagag

SEQ ID NO: 8156709 - DNA, 22 bp, Homo sapiens
gagattgggtcttgctctgtca

SEQ ID NO: 8156710 - DNA, 22 bp, Homo sapiens
gagatttaattggattaactta

SEQ ID NO: 8156711 - DNA, 22 bp, Homo sapiens
gagattctggttaggtgtattt

SEQ ID NO: 8156712 - DNA, 16 bp, Homo sapiens
gagccaggtgccttga

SEQ ID NO: 8156713 - DNA, 22 bp, Homo sapiens
gagccaggtcgggccgcggcga

SEQ ID NO: 8156714 - DNA, 22 bp, Homo sapiens
gagccaggttggaggctgcagt

SEQ ID NO: 8156715 - DNA, 22 bp, Homo sapiens
gagccaggttggaggctgcagt

SEQ ID NO: 8156716 - DNA, 22 bp, Homo sapiens
gagccaggttggaggctgcagt

SEQ ID NO: 8156717 - DNA, 22 bp, Homo sapiens
gagccagggctgtgagctgagc

SEQ ID NO: 8156718 - DNA, 22 bp, Homo sapiens
gagccagggctgtgagctgagc

SEQ ID NO: 8156719 - DNA, 22 bp, Homo sapiens
gagccagggtttgaaactagac

SEQ ID NO: 8156720 - DNA, 22 bp, Homo sapiens
gagccagggtttgaaactagac

SEQ ID NO: 8156721 - DNA, 22 bp, Homo sapiens
gagccaggggtcagctccgagg

SEQ ID NO: 8156722 - DNA, 22 bp, Homo sapiens
gagccaggggtcagctccgagg

SEQ ID NO: 8156723 - DNA, 22 bp, Homo sapiens
gagccaggggtcagctccgagg

SEQ ID NO: 8156724 - DNA, 22 bp, Homo sapiens
gagccagcagccggcaccacca

SEQ ID NO: 8156725 - DNA, 22 bp, Homo sapiens
gagccagagctacaagtgtctg

SEQ ID NO: 8156726 - DNA, 22 bp, Homo sapiens
gagccagcagccggcaccacca

SEQ ID NO: 8156727 - DNA, 22 bp, Homo sapiens
gagccagcaggacttaagccag

SEQ ID NO: 8156728 - DNA, 22 bp, Homo sapiens
gagccagaaaagctgcctgact

SEQ ID NO: 8156729 - DNA, 22 bp, Homo sapiens
gagccaccttcaactcaggaat

SEQ ID NO: 8156730 - DNA, 22 bp, Homo sapiens
gagccaccttcaactcaggaat

SEQ ID NO: 8156731 - DNA, 17 bp, Homo sapiens
gagccaccctgtgcgag

SEQ ID NO: 8156732 - DNA, 22 bp, Homo sapiens
gagccagaaaagctgcctgact

SEQ ID NO: 8156733 - DNA, 22 bp, Homo sapiens
gagccagagatccaggatggct

SEQ ID NO: 8156734 - DNA, 22 bp, Homo sapiens
gagccagacaggctagagcggg

SEQ ID NO: 8156735 - DNA, 22 bp, Homo sapiens
gagccacagtggattgattcca

SEQ ID NO: 8156736 - DNA, 22 bp, Homo sapiens
gagccacagtggattgattcca

SEQ ID NO: 8156737 - DNA, 22 bp, Homo sapiens
gagccaccttcaactcaggaat

SEQ ID NO: 8156738 - DNA, 17 bp, Homo sapiens
gagccaccctgtgcgag

SEQ ID NO: 8156739 - DNA, 22 bp, Homo sapiens
gagccacagtggtggcccacgt

SEQ ID NO: 8156740 - DNA, 22 bp, Homo sapiens
gagccacagcaacctcaaagga

SEQ ID NO: 8156741 - DNA, 22 bp, Homo sapiens
gagccacagaaggaaattgggg

SEQ ID NO: 8156742 - DNA, 22 bp, Homo sapiens
gagccaagctcttctccatgag

SEQ ID NO: 8156743 - DNA, 22 bp, Homo sapiens
gagccaagattgtgtccctgca

SEQ ID NO: 8156744 - DNA, 22 bp, Homo sapiens
gagcagccctagggcataagca

SEQ ID NO: 8156745 - DNA, 22 bp, Homo sapiens
gagcagctgcagtgcagaccct

SEQ ID NO: 8156746 - DNA, 22 bp, Homo sapiens
gagcagctggctgtattggttt

SEQ ID NO: 8156747 - DNA, 22 bp, Homo sapiens
gagcagctggaggccttgttgg

SEQ ID NO: 8156748 - DNA, 20 bp, Homo sapiens
gagcagctgtttgcattgca

SEQ ID NO: 8156749 - DNA, 22 bp, Homo sapiens
gagcagctgttctgacttgtct

SEQ ID NO: 8156750 - DNA, 22 bp, Homo sapiens
gagcagctgtggggttgaccat

SEQ ID NO: 8156751 - DNA, 22 bp, Homo sapiens
gagcagctgtccccaaagcttc

SEQ ID NO: 8156752 - DNA, 22 bp, Homo sapiens
gagcagctggtaggtgaaccca

SEQ ID NO: 8156753 - DNA, 22 bp, Homo sapiens
gagacacaaacacatttagagg

SEQ ID NO: 8156754 - DNA, 22 bp, Homo sapiens
gagaggcatggaacagattctt

SEQ ID NO: 8156755 - DNA, 22 bp, Homo sapiens
gagaggcatggaacagattctt

SEQ ID NO: 8156756 - DNA, 22 bp, Homo sapiens
gagaggcatggaacagattctt

SEQ ID NO: 8156757 - DNA, 22 bp, Homo sapiens
gagaggcatggaacagattctt

SEQ ID NO: 8156758 - DNA, 22 bp, Homo sapiens
gagaggcatggaacagattctt

SEQ ID NO: 8156759 - DNA, 22 bp, Homo sapiens
gagaggcatggaacagattctt

SEQ ID NO: 8156760 - DNA, 22 bp, Homo sapiens
gagaggcatggaacagattctt

SEQ ID NO: 8156761 - DNA, 22 bp, Homo sapiens
gagaggccaaaatccctgcccc

SEQ ID NO: 8156762 - DNA, 22 bp, Homo sapiens
gagaggccaagggatccgtgag

SEQ ID NO: 8156763 - DNA, 22 bp, Homo sapiens
gagaggccacctgacgagcagt

SEQ ID NO: 8156764 - DNA, 22 bp, Homo sapiens
gagaggccatggctgtgcagtg

SEQ ID NO: 8156765 - DNA, 22 bp, Homo sapiens
gagaggccatggctgtgcagtg

SEQ ID NO: 8156766 - DNA, 22 bp, Homo sapiens
gagaggccatggggtgggatgc

SEQ ID NO: 8156767 - DNA, 18 bp, Homo sapiens
gagaggcccggctgtgcc

SEQ ID NO: 8156768 - DNA, 18 bp, Homo sapiens
gagaggcccggctgtgcc

SEQ ID NO: 8156769 - DNA, 22 bp, Homo sapiens
gagaggcctgagaggctgcgga

SEQ ID NO: 8156770 - DNA, 22 bp, Homo sapiens
gagaggccctgtggtcccagct

SEQ ID NO: 8156771 - DNA, 22 bp, Homo sapiens
gagaggccctgtggtcccagct

SEQ ID NO: 8156772 - DNA, 22 bp, Homo sapiens
gagaggccctgtggtcccagct

SEQ ID NO: 8156773 - DNA, 19 bp, Homo sapiens
gagaggcctgtgcttgaag

SEQ ID NO: 8156774 - DNA, 22 bp, Homo sapiens
gagaggcctgggcccgtgagct

SEQ ID NO: 8156775 - DNA, 22 bp, Homo sapiens
gagaggcctgagaggctgcgga

SEQ ID NO: 8156776 - DNA, 22 bp, Homo sapiens
gagaggctcagggacttgctga

SEQ ID NO: 8156777 - DNA, 22 bp, Homo sapiens
gagaggctcagggacttgctga

SEQ ID NO: 8156778 - DNA, 22 bp, Homo sapiens
gagaggctatgaggttctgtgt

SEQ ID NO: 8156779 - DNA, 22 bp, Homo sapiens
gagatgaatgtaaacaaaggca

SEQ ID NO: 8156780 - DNA, 22 bp, Homo sapiens
gagatcttcctgagattcattt

SEQ ID NO: 8156781 - DNA, 22 bp, Homo sapiens
gagatcttcctgagattcattt

SEQ ID NO: 8156782 - DNA, 22 bp, Homo sapiens
gagatcttcaaggttttagata

SEQ ID NO: 8156783 - DNA, 20 bp, Homo sapiens
gagatgcaagtgtatctgac

SEQ ID NO: 8156784 - DNA, 22 bp, Homo sapiens
gagatgatctttcctgtagtcc

SEQ ID NO: 8156785 - DNA, 22 bp, Homo sapiens
gagatgcaagcaagtctatttt

SEQ ID NO: 8156786 - DNA, 22 bp, Homo sapiens
gagatgctatggctattcccct

SEQ ID NO: 8156787 - DNA, 22 bp, Homo sapiens
gagatgctgtcaggctatctgt

SEQ ID NO: 8156788 - DNA, 22 bp, Homo sapiens
gagatgcttgtctgtcttatca

SEQ ID NO: 8156789 - DNA, 22 bp, Homo sapiens
gagagggagccagccaggaacc

SEQ ID NO: 8156790 - DNA, 22 bp, Homo sapiens
gagagggagccagccaggaacc

SEQ ID NO: 8156791 - DNA, 22 bp, Homo sapiens
gagagggatactgagttttggt

SEQ ID NO: 8156792 - DNA, 22 bp, Homo sapiens
gagatcctgtaggcagctaaga

SEQ ID NO: 8156793 - DNA, 22 bp, Homo sapiens
gagagggatactgagttttggt

SEQ ID NO: 8156794 - DNA, 22 bp, Homo sapiens
gagaggcttaagggctgtgaag

SEQ ID NO: 8156795 - DNA, 22 bp, Homo sapiens
gagaggcttaagggctgtgaag

SEQ ID NO: 8156796 - DNA, 22 bp, Homo sapiens
gagaggcttgtgtgaagaacaa

SEQ ID NO: 8156797 - DNA, 22 bp, Homo sapiens
gagaggctccatgaccccggca

SEQ ID NO: 8156798 - DNA, 22 bp, Homo sapiens
gagaggctgggttggagatcga

SEQ ID NO: 8156799 - DNA, 22 bp, Homo sapiens
gagaggctggtaaagtctgaac

SEQ ID NO: 8156800 - DNA, 22 bp, Homo sapiens
gagaggctgggttggagatcga

SEQ ID NO: 8156801 - DNA, 22 bp, Homo sapiens
gagaggctgtgtgccattgttg

SEQ ID NO: 8156802 - DNA, 22 bp, Homo sapiens
gagaggcttaagggctgtgaag

SEQ ID NO: 8156803 - DNA, 22 bp, Homo sapiens
gagaattagggcgtaattcaga

SEQ ID NO: 8156804 - DNA, 22 bp, Homo sapiens
gagaattactgtttttataaca

SEQ ID NO: 8156805 - DNA, 22 bp, Homo sapiens
gagaattactgtttttataaca

SEQ ID NO: 8156806 - DNA, 22 bp, Homo sapiens
gagaattttctagtagtttcat

SEQ ID NO: 8156807 - DNA, 22 bp, Homo sapiens
gagaatgggaatgaaagtagca

SEQ ID NO: 8156808 - DNA, 22 bp, Homo sapiens
gagaatgtggagcctgtggttg

SEQ ID NO: 8156809 - DNA, 22 bp, Homo sapiens
gagaatgttaatgttgaagtat

SEQ ID NO: 8156810 - DNA, 22 bp, Homo sapiens
gagaatgccttggaagaagtcc

SEQ ID NO: 8156811 - DNA, 22 bp, Homo sapiens
gagaaggggtgatgtgggtaat

SEQ ID NO: 8156812 - DNA, 22 bp, Homo sapiens
gagaagggggctcgagtgtcct

SEQ ID NO: 8156813 - DNA, 22 bp, Homo sapiens
gagaagggggctcgagtgtcct

SEQ ID NO: 8156814 - DNA, 22 bp, Homo sapiens
gagaaggctgatccttggagtt

SEQ ID NO: 8156815 - DNA, 22 bp, Homo sapiens
gagaaggctggtcttaagtcga

SEQ ID NO: 8156816 - DNA, 22 bp, Homo sapiens
gagaagggatatgccactctcg

SEQ ID NO: 8156817 - DNA, 22 bp, Homo sapiens
gagaagggatatgccactctcg

SEQ ID NO: 8156818 - DNA, 22 bp, Homo sapiens
gagaagggatatgccactctcg

SEQ ID NO: 8156819 - DNA, 22 bp, Homo sapiens
gagaagggggctcgagtgtcct

SEQ ID NO: 8156820 - DNA, 22 bp, Homo sapiens
gagaagggggctcgagtgtcct

SEQ ID NO: 8156821 - DNA, 22 bp, Homo sapiens
gagaagggggctcgagtgtcct

SEQ ID NO: 8156822 - DNA, 22 bp, Homo sapiens
gagaagggcttgggagtcaaca

SEQ ID NO: 8156823 - DNA, 22 bp, Homo sapiens
gagaaggatgaggaaatggtat

SEQ ID NO: 8156824 - DNA, 22 bp, Homo sapiens
gagaaggatgtggctcatagct

SEQ ID NO: 8156825 - DNA, 22 bp, Homo sapiens
gagaaggaggcgaagcgtgtgc

SEQ ID NO: 8156826 - DNA, 22 bp, Homo sapiens
gagaaggaggcgaagcgtgtgc

SEQ ID NO: 8156827 - DNA, 22 bp, Homo sapiens
gagaaggactacacatctggcc

SEQ ID NO: 8156828 - DNA, 22 bp, Homo sapiens
gagaaggactacacatctggcc

SEQ ID NO: 8156829 - DNA, 22 bp, Homo sapiens
gacctctgaaggcagagcaggg

SEQ ID NO: 8156830 - DNA, 22 bp, Homo sapiens
gacctctgggtgatgcccaggc

SEQ ID NO: 8156831 - DNA, 22 bp, Homo sapiens
gacctcatgatccacctgcctt

SEQ ID NO: 8156832 - DNA, 22 bp, Homo sapiens
gacctcatgatccacctgcctt

SEQ ID NO: 8156833 - DNA, 22 bp, Homo sapiens
gacctcagtgaatggtcatgta

SEQ ID NO: 8156834 - DNA, 16 bp, Homo sapiens
gacctcagtgctggct

SEQ ID NO: 8156835 - DNA, 22 bp, Homo sapiens
gacctcagctgtggggatgctg

SEQ ID NO: 8156836 - DNA, 22 bp, Homo sapiens
gacctcagtattgttcaggatg

SEQ ID NO: 8156837 - DNA, 22 bp, Homo sapiens
gacctcatgatccacctgcctt

SEQ ID NO: 8156838 - DNA, 22 bp, Homo sapiens
gacctccagcggccctgcagag

SEQ ID NO: 8156839 - DNA, 22 bp, Homo sapiens
gacctccgtgtacacctcccag

SEQ ID NO: 8156840 - DNA, 22 bp, Homo sapiens
gacctccgtgtacacctcccag

SEQ ID NO: 8156841 - DNA, 22 bp, Homo sapiens
gagctcttgcttctagtccagg

SEQ ID NO: 8156842 - DNA, 22 bp, Homo sapiens
gagctcttgtagtatgcggtaa

SEQ ID NO: 8156843 - DNA, 22 bp, Homo sapiens
gagctcttgcttctagtccagg

SEQ ID NO: 8156844 - DNA, 22 bp, Homo sapiens
gagctcttctggttagatgttg

SEQ ID NO: 8156845 - DNA, 22 bp, Homo sapiens
gagctcttctggggtaagggac

SEQ ID NO: 8156846 - DNA, 22 bp, Homo sapiens
gagctcttctaaagatggcaat

SEQ ID NO: 8156847 - DNA, 22 bp, Homo sapiens
gagctcttatagttctagcagt

SEQ ID NO: 8156848 - DNA, 22 bp, Homo sapiens
gagctcttccccatcttacatc

SEQ ID NO: 8156849 - DNA, 22 bp, Homo sapiens
gagctcttatagttctagcagt

SEQ ID NO: 8156850 - DNA, 22 bp, Homo sapiens
gagctcttccccatcttacatc

SEQ ID NO: 8156851 - DNA, 18 bp, Homo sapiens
gagctcttcccttttctc

SEQ ID NO: 8156852 - DNA, 18 bp, Homo sapiens
gagctcttcccttttctc

SEQ ID NO: 8156853 - DNA, 22 bp, Homo sapiens
gagctcttcctttcaggaggcc

SEQ ID NO: 8156854 - DNA, 22 bp, Homo sapiens
gagctcttcgcctgtcgctgag

SEQ ID NO: 8156855 - DNA, 22 bp, Homo sapiens
gagctgaaatatgaagccaatt

SEQ ID NO: 8156856 - DNA, 22 bp, Homo sapiens
gagctgaacaaattgcgagtgg

SEQ ID NO: 8156857 - DNA, 22 bp, Homo sapiens
gagctgaacaaattgcgagtgg

SEQ ID NO: 8156858 - DNA, 22 bp, Homo sapiens
gagctctttcctgcccatactg

SEQ ID NO: 8156859 - DNA, 22 bp, Homo sapiens
gagctctttcatggttctgtga

SEQ ID NO: 8156860 - DNA, 22 bp, Homo sapiens
gagctctttaccaggtcaggac

SEQ ID NO: 8156861 - DNA, 22 bp, Homo sapiens
gagctctttcagttgactccta

SEQ ID NO: 8156862 - DNA, 22 bp, Homo sapiens
gagctcttttgccagtcactgc

SEQ ID NO: 8156863 - DNA, 22 bp, Homo sapiens
gagctcttttgatgaaggtagt

SEQ ID NO: 8156864 - DNA, 22 bp, Homo sapiens
gagctctttcggttgttttcga

SEQ ID NO: 8156865 - DNA, 22 bp, Homo sapiens
gagctctttgaacctgggcagt

SEQ ID NO: 8156866 - DNA, 22 bp, Homo sapiens
gagctgaattacggtgagtcat

SEQ ID NO: 8156867 - DNA, 18 bp, Homo sapiens
gagctgagaagaggatgc

SEQ ID NO: 8156868 - DNA, 18 bp, Homo sapiens
gagctgagaagaggatgc

SEQ ID NO: 8156869 - DNA, 19 bp, Homo sapiens
gagctgagagtagcactgg

SEQ ID NO: 8156870 - DNA, 22 bp, Homo sapiens
gagctgagacacactttggcaa

SEQ ID NO: 8156871 - DNA, 22 bp, Homo sapiens
gagctgagacacactttggcaa

SEQ ID NO: 8156872 - DNA, 22 bp, Homo sapiens
gagctgagacacactttggcaa

SEQ ID NO: 8156873 - DNA, 22 bp, Homo sapiens
gagctgagacacactttggcaa

SEQ ID NO: 8156874 - DNA, 22 bp, Homo sapiens
gagctgagaagcagcgcttgat

SEQ ID NO: 8156875 - DNA, 22 bp, Homo sapiens
gagctgagaagcagcgcttgat

SEQ ID NO: 8156876 - DNA, 22 bp, Homo sapiens
gagctgagaagcagcgcttgat

SEQ ID NO: 8156877 - DNA, 22 bp, Homo sapiens
gagctgagatcatgtacactag

SEQ ID NO: 8156878 - DNA, 22 bp, Homo sapiens
gagctgtgttcatgaggagaaa

SEQ ID NO: 8156879 - DNA, 22 bp, Homo sapiens
gagctgtgttcatgaggagaaa

SEQ ID NO: 8156880 - DNA, 22 bp, Homo sapiens
gagctgagatcatgtacactag

SEQ ID NO: 8156881 - DNA, 19 bp, Homo sapiens
gagctgagagtagcactgg

SEQ ID NO: 8156882 - DNA, 19 bp, Homo sapiens
gagctgagagtagcactgg

SEQ ID NO: 8156883 - DNA, 19 bp, Homo sapiens
gagctgagagtagcactgg

SEQ ID NO: 8156884 - DNA, 22 bp, Homo sapiens
gagcttctgccatagagggact

SEQ ID NO: 8156885 - DNA, 22 bp, Homo sapiens
gagcttctcaacagttatctct

SEQ ID NO: 8156886 - DNA, 22 bp, Homo sapiens
gagcttctgccatagagggact

SEQ ID NO: 8156887 - DNA, 22 bp, Homo sapiens
gagcttctcaacagttatctct

SEQ ID NO: 8156888 - DNA, 22 bp, Homo sapiens
gagcttctcaacagttatctct

SEQ ID NO: 8156889 - DNA, 22 bp, Homo sapiens
gagcttcttgtttcttcatctg

SEQ ID NO: 8156890 - DNA, 21 bp, Homo sapiens
gagcttgcaagcattatggga

SEQ ID NO: 8156891 - DNA, 22 bp, Homo sapiens
gagcttcctgatgccgaccagt

SEQ ID NO: 8156892 - DNA, 22 bp, Homo sapiens
gagcttccctctgcagtccctg

SEQ ID NO: 8156893 - DNA, 23 bp, Homo sapiens
gagcttttgtagtagtcactgtg

SEQ ID NO: 8156894 - DNA, 22 bp, Homo sapiens
gagcttttcccgtctttctcgt

SEQ ID NO: 8156895 - DNA, 22 bp, Homo sapiens
gagcttggctggacctcacgga

SEQ ID NO: 8156896 - DNA, 22 bp, Homo sapiens
gagcttggcagtgtcactaggg

SEQ ID NO: 8156897 - DNA, 22 bp, Homo sapiens
gagcttccatccttactgtgtg

SEQ ID NO: 8156898 - DNA, 22 bp, Homo sapiens
gagcttccatccttactgtgtg

SEQ ID NO: 8156899 - DNA, 22 bp, Homo sapiens
gagcttccctctgcagtccctg

SEQ ID NO: 8156900 - DNA, 22 bp, Homo sapiens
gagcttccatccttactgtgtg

SEQ ID NO: 8156901 - DNA, 22 bp, Homo sapiens
gagcttccactctagaaggagt

SEQ ID NO: 8156902 - DNA, 22 bp, Homo sapiens
gagcttccagagacatcagagt

SEQ ID NO: 8156903 - DNA, 22 bp, Homo sapiens
gagcttcatatgttgcagagaa

SEQ ID NO: 8156904 - DNA, 22 bp, Homo sapiens
gagcttcatatgttgcagagaa

SEQ ID NO: 8156905 - DNA, 22 bp, Homo sapiens
gagcttcagctgccatgactgt

SEQ ID NO: 8156906 - DNA, 22 bp, Homo sapiens
gagcttcaaatggacgaccttt

SEQ ID NO: 8156907 - DNA, 22 bp, Homo sapiens
gagcttcacgggggacagcatt

SEQ ID NO: 8156908 - DNA, 22 bp, Homo sapiens
gagcttcagaatttaacagact

SEQ ID NO: 8156909 - DNA, 22 bp, Homo sapiens
gagcttaaatggctaaatataa

SEQ ID NO: 8156910 - DNA, 22 bp, Homo sapiens
gagctcttagatagggcaggaa

SEQ ID NO: 8156911 - DNA, 22 bp, Homo sapiens
gagctcttatagttctagcagt

SEQ ID NO: 8156912 - DNA, 22 bp, Homo sapiens
gagctctgttctcgtcctgctg

SEQ ID NO: 8156913 - DNA, 22 bp, Homo sapiens
gagctctgttctcgtcctgctg

SEQ ID NO: 8156914 - DNA, 22 bp, Homo sapiens
gagctctgttctcgtcctgctg

SEQ ID NO: 8156915 - DNA, 22 bp, Homo sapiens
gagctctgtgtagcctgagggt

SEQ ID NO: 8156916 - DNA, 22 bp, Homo sapiens
gagctctgtgtggcttgggtgg

SEQ ID NO: 8156917 - DNA, 22 bp, Homo sapiens
gagctatagatgtttacatact

SEQ ID NO: 8156918 - DNA, 22 bp, Homo sapiens
gagctatagatgtttacatact

SEQ ID NO: 8156919 - DNA, 21 bp, Homo sapiens
gagctctctacttgcacattt

SEQ ID NO: 8156920 - DNA, 22 bp, Homo sapiens
gagctctgaaaaagcttgcctt

SEQ ID NO: 8156921 - DNA, 22 bp, Homo sapiens
gagctctgaaaaagcttgcctt

SEQ ID NO: 8156922 - DNA, 22 bp, Homo sapiens
gagctctgactgctgggtgaca

SEQ ID NO: 8156923 - DNA, 22 bp, Homo sapiens
gagctctgactgctgggtgaca

SEQ ID NO: 8156924 - DNA, 22 bp, Homo sapiens
gagctctgactgctgggtgaca

SEQ ID NO: 8156925 - DNA, 22 bp, Homo sapiens
gagctctgaaaaagcttgcctt

SEQ ID NO: 8156926 - DNA, 22 bp, Homo sapiens
gagctctgaaaaagcttgcctt

SEQ ID NO: 8156927 - DNA, 22 bp, Homo sapiens
gagctctgaaaaagcttgcctt

SEQ ID NO: 8156928 - DNA, 22 bp, Homo sapiens
gagctctgatgtttagtggaga

SEQ ID NO: 8156929 - DNA, 22 bp, Homo sapiens
gagctctgactgctgggtgaca

SEQ ID NO: 8156930 - DNA, 22 bp, Homo sapiens
gagcgggaggaacggctcgggc

SEQ ID NO: 8156931 - DNA, 22 bp, Homo sapiens
gagcgggaggaacggctcgggc

SEQ ID NO: 8156932 - DNA, 22 bp, Homo sapiens
gagctaagacctgagggcaagt

SEQ ID NO: 8156933 - DNA, 22 bp, Homo sapiens
gagctaagaagcaaataaatca

SEQ ID NO: 8156934 - DNA, 22 bp, Homo sapiens
gagctaagagtctagaaaggct

SEQ ID NO: 8156935 - DNA, 22 bp, Homo sapiens
gagctactgaaatattgatttt

SEQ ID NO: 8156936 - DNA, 22 bp, Homo sapiens
gagctactgaaatattgatttt

SEQ ID NO: 8156937 - DNA, 22 bp, Homo sapiens
gagctactgaaatattgatttt

SEQ ID NO: 8156938 - DNA, 22 bp, Homo sapiens
gagctagagggagaagggcact

SEQ ID NO: 8156939 - DNA, 22 bp, Homo sapiens
gagctagagggagaagggcact

SEQ ID NO: 8156940 - DNA, 22 bp, Homo sapiens
gagctagcttcttccaggtttc

SEQ ID NO: 8156941 - DNA, 22 bp, Homo sapiens
gagctagggaggaggcttgctc

SEQ ID NO: 8156942 - DNA, 22 bp, Homo sapiens
gagctaggggtagtcaggagac

SEQ ID NO: 8156943 - DNA, 22 bp, Homo sapiens
gagctaggttgagactcactta

SEQ ID NO: 8156944 - DNA, 22 bp, Homo sapiens
gagcctcgtggcggccactgcg

SEQ ID NO: 8156945 - DNA, 22 bp, Homo sapiens
gagcctcgtggcggccactgcg

SEQ ID NO: 8156946 - DNA, 22 bp, Homo sapiens
gagcctcgtggcggccactgcg

SEQ ID NO: 8156947 - DNA, 22 bp, Homo sapiens
gagcctgaatttgacctgctta

SEQ ID NO: 8156948 - DNA, 22 bp, Homo sapiens
gagcctgaaatacaggtcactg

SEQ ID NO: 8156949 - DNA, 22 bp, Homo sapiens
gagcctgatgaaacaggcagac

SEQ ID NO: 8156950 - DNA, 22 bp, Homo sapiens
gagcctgatgaaacaggcagac

SEQ ID NO: 8156951 - DNA, 22 bp, Homo sapiens
gagcctcctcctggtgtgccga

SEQ ID NO: 8156952 - DNA, 22 bp, Homo sapiens
gagccaggtttgaatctcagtc

SEQ ID NO: 8156953 - DNA, 22 bp, Homo sapiens
gagccaggtttgaatctcagtc

SEQ ID NO: 8156954 - DNA, 22 bp, Homo sapiens
gagcctggattgtcaccgactt

SEQ ID NO: 8156955 - DNA, 22 bp, Homo sapiens
gagcctggattgtcaccgactt

SEQ ID NO: 8156956 - DNA, 22 bp, Homo sapiens
gagcctggattgtcaccgactt

SEQ ID NO: 8156957 - DNA, 22 bp, Homo sapiens
gagcctggattgaagtgggtgg

SEQ ID NO: 8156958 - DNA, 22 bp, Homo sapiens
gagcctggattgaagtgggtgg

SEQ ID NO: 8156959 - DNA, 22 bp, Homo sapiens
gagcctggattgaagtgggtgg

SEQ ID NO: 8156960 - DNA, 22 bp, Homo sapiens
gagcctggagctggaacgaagc

SEQ ID NO: 8156961 - DNA, 22 bp, Homo sapiens
gagcctggattgaagtgggtgg

SEQ ID NO: 8156962 - DNA, 22 bp, Homo sapiens
gagcctggattgaagtgggtgg

SEQ ID NO: 8156963 - DNA, 22 bp, Homo sapiens
gagcctgcccctccaccaggat

SEQ ID NO: 8156964 - DNA, 22 bp, Homo sapiens
gagcctgcgagggagtaaggca

SEQ ID NO: 8156965 - DNA, 22 bp, Homo sapiens
gagcctggacatctcaggccca

SEQ ID NO: 8156966 - DNA, 22 bp, Homo sapiens
gagcctggagctggaacgaagc

SEQ ID NO: 8156967 - DNA, 22 bp, Homo sapiens
gagcctggagctggaacgaagc

SEQ ID NO: 8156968 - DNA, 22 bp, Homo sapiens
gaggcacaatacatgtctcaag

SEQ ID NO: 8156969 - DNA, 22 bp, Homo sapiens
gaggcaatgggctatagcattg

SEQ ID NO: 8156970 - DNA, 22 bp, Homo sapiens
gaggcacatcacttggtgcatt

SEQ ID NO: 8156971 - DNA, 22 bp, Homo sapiens
gaggcacatcacttggtgcatt

SEQ ID NO: 8156972 - DNA, 22 bp, Homo sapiens
gaggcaccagacatggcctcat

SEQ ID NO: 8156973 - DNA, 22 bp, Homo sapiens
gaggcaccagacatggcctcat

SEQ ID NO: 8156974 - DNA, 22 bp, Homo sapiens
gaggcaccagccccgctagcct

SEQ ID NO: 8156975 - DNA, 22 bp, Homo sapiens
gaggcactgaatacttgagggt

SEQ ID NO: 8156976 - DNA, 22 bp, Homo sapiens
gaggcactctcgacaagggtgg

SEQ ID NO: 8156977 - DNA, 22 bp, Homo sapiens
gaggcacctcgcgggaggaggc

SEQ ID NO: 8156978 - DNA, 22 bp, Homo sapiens
gaggcactgagagtgggggatg

SEQ ID NO: 8156979 - DNA, 22 bp, Homo sapiens
gaggcagaagttgcagtgagca

SEQ ID NO: 8156980 - DNA, 22 bp, Homo sapiens
gaggcagaagttgcagtgagca

SEQ ID NO: 8156981 - DNA, 22 bp, Homo sapiens
gaggcagaagttgcagtgagca

SEQ ID NO: 8156982 - DNA, 22 bp, Homo sapiens
gaggcagaagttgcagtgagca

SEQ ID NO: 8156983 - DNA, 22 bp, Homo sapiens
gaggcagaagttgcagtgagca

SEQ ID NO: 8156984 - DNA, 22 bp, Homo sapiens
gaggcactgctgggcccctgta

SEQ ID NO: 8156985 - DNA, 22 bp, Homo sapiens
gaggcactgctgggcccctgta

SEQ ID NO: 8156986 - DNA, 22 bp, Homo sapiens
gaggcagaagttgcagtgagca

SEQ ID NO: 8156987 - DNA, 22 bp, Homo sapiens
gaggcactggaggaaaggagaa

SEQ ID NO: 8156988 - DNA, 22 bp, Homo sapiens
gaggcagagaccttcaggacct

SEQ ID NO: 8156989 - DNA, 22 bp, Homo sapiens
gaggcagagaccttcaggacct

SEQ ID NO: 8156990 - DNA, 22 bp, Homo sapiens
gaggcagaagttgcagtgagca

SEQ ID NO: 8156991 - DNA, 22 bp, Homo sapiens
gaggcagagaccttcaggacct

SEQ ID NO: 8156992 - DNA, 22 bp, Homo sapiens
gaggcagagaccttcaggacct

SEQ ID NO: 8156993 - DNA, 22 bp, Homo sapiens
gaggcagagactccaccttcag

SEQ ID NO: 8156994 - DNA, 22 bp, Homo sapiens
gaggcagaggaaggtggtctct

SEQ ID NO: 8156995 - DNA, 22 bp, Homo sapiens
gaggcagagactccaccttcag

SEQ ID NO: 8156996 - DNA, 22 bp, Homo sapiens
gaggccaggacatgaaagctga

SEQ ID NO: 8156997 - DNA, 22 bp, Homo sapiens
gaggccaggaagcccaagatca

SEQ ID NO: 8156998 - DNA, 22 bp, Homo sapiens
gaggccaggaagcccaagatca

SEQ ID NO: 8156999 - DNA, 22 bp, Homo sapiens
gaggccaggaagcccaagatca

SEQ ID NO: 8157000 - DNA, 22 bp, Homo sapiens
gaggccaggaagcccaagatca

SEQ ID NO: 8157001 - DNA, 22 bp, Homo sapiens
gaggccaggaagcccaagatca

SEQ ID NO: 8157002 - DNA, 22 bp, Homo sapiens
gaggccaggaggatctctctaa

SEQ ID NO: 8157003 - DNA, 22 bp, Homo sapiens
gaggccaggacatgaaagctga

SEQ ID NO: 8157004 - DNA, 22 bp, Homo sapiens
gaggccaggacatgaaagctga

SEQ ID NO: 8157005 - DNA, 22 bp, Homo sapiens
gaggccaggacatgaaagctga

SEQ ID NO: 8157006 - DNA, 22 bp, Homo sapiens
gaggccaggacatgaaagctga

SEQ ID NO: 8157007 - DNA, 22 bp, Homo sapiens
gaggccaggacatgaaagctga

SEQ ID NO: 8157008 - DNA, 22 bp, Homo sapiens
gaggccaggacatgaaagctga

SEQ ID NO: 8157009 - DNA, 22 bp, Homo sapiens
gaggccagctagtccaggaagt

SEQ ID NO: 8157010 - DNA, 22 bp, Homo sapiens
gaggccagctagtccaggaagt

SEQ ID NO: 8157011 - DNA, 22 bp, Homo sapiens
gaggccagctagtccaggaagt

SEQ ID NO: 8157012 - DNA, 22 bp, Homo sapiens
gaggccagctagtccaggaagt

SEQ ID NO: 8157013 - DNA, 22 bp, Homo sapiens
gaggccagctagtccaggaagt

SEQ ID NO: 8157014 - DNA, 22 bp, Homo sapiens
gaggccagctagtccaggaagt

SEQ ID NO: 8157015 - DNA, 22 bp, Homo sapiens
gaggccagctacccaagggtca

SEQ ID NO: 8157016 - DNA, 22 bp, Homo sapiens
gaggccagctacccaagggtca

SEQ ID NO: 8157017 - DNA, 22 bp, Homo sapiens
gaggccagctacccaagggtca

SEQ ID NO: 8157018 - DNA, 22 bp, Homo sapiens
gaggccagctacccaagggtca

SEQ ID NO: 8157019 - DNA, 22 bp, Homo sapiens
gaggccagctacccaagggtca

SEQ ID NO: 8157020 - DNA, 22 bp, Homo sapiens
gaggcagaggaaggtggtctct

SEQ ID NO: 8157021 - DNA, 22 bp, Homo sapiens
gaggcagaggaaggtggtctct

SEQ ID NO: 8157022 - DNA, 22 bp, Homo sapiens
gaggcagaggaaggtggtctct

SEQ ID NO: 8157023 - DNA, 22 bp, Homo sapiens
gaggccagatgtcatgtcttat

SEQ ID NO: 8157024 - DNA, 22 bp, Homo sapiens
gaggccagatgtcatgtcttat

SEQ ID NO: 8157025 - DNA, 22 bp, Homo sapiens
gaggccagatgtcatgtcttat

SEQ ID NO: 8157026 - DNA, 22 bp, Homo sapiens
gaggccagatgtcatgtcttat

SEQ ID NO: 8157027 - DNA, 22 bp, Homo sapiens
gaggccagatgtcatgtcttat

SEQ ID NO: 8157028 - DNA, 22 bp, Homo sapiens
gaggccagatgtcatgtcttat

SEQ ID NO: 8157029 - DNA, 22 bp, Homo sapiens
gaggcagaggttgcagtgagct

SEQ ID NO: 8157030 - DNA, 22 bp, Homo sapiens
gaggccagatactctcttctgc

SEQ ID NO: 8157031 - DNA, 22 bp, Homo sapiens
gaggccagcgcgcagcactttt

SEQ ID NO: 8157032 - DNA, 22 bp, Homo sapiens
gaggccagcgcgcagcactttt

SEQ ID NO: 8157033 - DNA, 22 bp, Homo sapiens
gaggccagcgcgcagcactttt

SEQ ID NO: 8157034 - DNA, 22 bp, Homo sapiens
gaggccagcgcgcagcactttt

SEQ ID NO: 8157035 - DNA, 22 bp, Homo sapiens
gaggccagcgcgcagcactttt

SEQ ID NO: 8157036 - DNA, 22 bp, Homo sapiens
gaggccagcgcgcagcactttt

SEQ ID NO: 8157037 - DNA, 22 bp, Homo sapiens
gaggccagcgcgcagcactttt

SEQ ID NO: 8157038 - DNA, 22 bp, Homo sapiens
gaggccagcccctcttgaaggc

SEQ ID NO: 8157039 - DNA, 22 bp, Homo sapiens
gaggccagcccctcttgaaggc

SEQ ID NO: 8157040 - DNA, 22 bp, Homo sapiens
gaggccagcccctcttgaaggc

SEQ ID NO: 8157041 - DNA, 22 bp, Homo sapiens
gaggccagcccctcttgaaggc

SEQ ID NO: 8157042 - DNA, 22 bp, Homo sapiens
gaggccagcccctcttgaaggc

SEQ ID NO: 8157043 - DNA, 22 bp, Homo sapiens
gaggccagcccctcttgaaggc

SEQ ID NO: 8157044 - DNA, 22 bp, Homo sapiens
gaggccagcccctcttgaaggc

SEQ ID NO: 8157045 - DNA, 19 bp, Homo sapiens
gaggagctatcggagacag

SEQ ID NO: 8157046 - DNA, 22 bp, Homo sapiens
gaggagctgtctttgtgatctt

SEQ ID NO: 8157047 - DNA, 18 bp, Homo sapiens
gaggagccgtccctacta

SEQ ID NO: 8157048 - DNA, 18 bp, Homo sapiens
gaggagccgtccctacta

SEQ ID NO: 8157049 - DNA, 18 bp, Homo sapiens
gaggagccgtccctacta

SEQ ID NO: 8157050 - DNA, 22 bp, Homo sapiens
gaggagccctgttccccaggcc

SEQ ID NO: 8157051 - DNA, 22 bp, Homo sapiens
gaggagctgttccctcacctct

SEQ ID NO: 8157052 - DNA, 22 bp, Homo sapiens
gaggagcttcagaggaatctta

SEQ ID NO: 8157053 - DNA, 22 bp, Homo sapiens
gaggagcttcagaggaatctta

SEQ ID NO: 8157054 - DNA, 22 bp, Homo sapiens
gaggagcttgaggctaggagcc

SEQ ID NO: 8157055 - DNA, 22 bp, Homo sapiens
gaggagcttgaggctaggagcc

SEQ ID NO: 8157056 - DNA, 22 bp, Homo sapiens
gaggagcttgaggctaggagcc

SEQ ID NO: 8157057 - DNA, 22 bp, Homo sapiens
gaggagcttgtgagaagatgtc

SEQ ID NO: 8157058 - DNA, 22 bp, Homo sapiens
gaggagcttgcatttaagtgcc

SEQ ID NO: 8157059 - DNA, 22 bp, Homo sapiens
gaggagcttgaggctaggagcc

SEQ ID NO: 8157060 - DNA, 22 bp, Homo sapiens
gaggagcttgtgagaagatgtc

SEQ ID NO: 8157061 - DNA, 22 bp, Homo sapiens
gaggagcttgtgagaagatgtc

SEQ ID NO: 8157062 - DNA, 22 bp, Homo sapiens
gaggaaaataacaactaagggc

SEQ ID NO: 8157063 - DNA, 22 bp, Homo sapiens
gaggaaaataacaactaagggc

SEQ ID NO: 8157064 - DNA, 22 bp, Homo sapiens
gaggaaaataacaactaagggc

SEQ ID NO: 8157065 - DNA, 22 bp, Homo sapiens
gaggaaaatattcagggaggtt

SEQ ID NO: 8157066 - DNA, 22 bp, Homo sapiens
gaggaaaatattcagggaggtt

SEQ ID NO: 8157067 - DNA, 22 bp, Homo sapiens
gaggaaaatattcagggaggtt

SEQ ID NO: 8157068 - DNA, 22 bp, Homo sapiens
gaggagccctgttccccaggcc

SEQ ID NO: 8157069 - DNA, 22 bp, Homo sapiens
gaggagccctgttccccaggcc

SEQ ID NO: 8157070 - DNA, 22 bp, Homo sapiens
gaggagccctgttccccaggcc

SEQ ID NO: 8157071 - DNA, 22 bp, Homo sapiens
gaggaggctaagtgggctctgg

SEQ ID NO: 8157072 - DNA, 22 bp, Homo sapiens
gaggaggctatcagcaatcagg

SEQ ID NO: 8157073 - DNA, 22 bp, Homo sapiens
gaggcaagagaagccagctttc

SEQ ID NO: 8157074 - DNA, 22 bp, Homo sapiens
gaggcaaggccgcacgtctcag

SEQ ID NO: 8157075 - DNA, 22 bp, Homo sapiens
gaggcaaggccgcacgtctcag

SEQ ID NO: 8157076 - DNA, 22 bp, Homo sapiens
gaggaggctaagtgggctctgg

SEQ ID NO: 8157077 - DNA, 22 bp, Homo sapiens
gaggaggctaagtgggctctgg

SEQ ID NO: 8157078 - DNA, 22 bp, Homo sapiens
gaggaggctaagtgggctctgg

SEQ ID NO: 8157079 - DNA, 22 bp, Homo sapiens
gaggaggccagtggaaggaagc

SEQ ID NO: 8157080 - DNA, 19 bp, Homo sapiens
gaggaggaaaactagtgta

SEQ ID NO: 8157081 - DNA, 22 bp, Homo sapiens
gaggaggaaaccctgttcctct

SEQ ID NO: 8157082 - DNA, 19 bp, Homo sapiens
gaggaggaaaactagtgta

SEQ ID NO: 8157083 - DNA, 19 bp, Homo sapiens
gaggaggaaaactagtgta

SEQ ID NO: 8157084 - DNA, 22 bp, Homo sapiens
gaggaggaagttctctgtaggc

SEQ ID NO: 8157085 - DNA, 22 bp, Homo sapiens
gaggaggaaaccctgttcctct

SEQ ID NO: 8157086 - DNA, 22 bp, Homo sapiens
gaggaggaagttctctgtaggc

SEQ ID NO: 8157087 - DNA, 22 bp, Homo sapiens
gaggaggaagttctctgtaggc

SEQ ID NO: 8157088 - DNA, 22 bp, Homo sapiens
gaggaggaaaggagttgaaatg

SEQ ID NO: 8157089 - DNA, 22 bp, Homo sapiens
gaggaggaggaagtggaaccca

SEQ ID NO: 8157090 - DNA, 22 bp, Homo sapiens
gaggaggaagttctctgtaggc

SEQ ID NO: 8157091 - DNA, 22 bp, Homo sapiens
gaggaggaggaagtggaaccca

SEQ ID NO: 8157092 - DNA, 22 bp, Homo sapiens
gaggaggaagttctctgtaggc

SEQ ID NO: 8157093 - DNA, 22 bp, Homo sapiens
gaggaggcacttgagcagatgt

SEQ ID NO: 8157094 - DNA, 22 bp, Homo sapiens
gaggaggcacttgagcagatgt

SEQ ID NO: 8157095 - DNA, 22 bp, Homo sapiens
gaggaggcactagttagtgaca

SEQ ID NO: 8157096 - DNA, 22 bp, Homo sapiens
gaggaggcactagttagtgaca

SEQ ID NO: 8157097 - DNA, 22 bp, Homo sapiens
gaggaggagtatatattagaat

SEQ ID NO: 8157098 - DNA, 20 bp, Homo sapiens
gaagacacagagttcatctc

SEQ ID NO: 8157099 - DNA, 21 bp, Homo sapiens
gaagacacataacctctctcc

SEQ ID NO: 8157100 - DNA, 22 bp, Homo sapiens
gaagacacaattggtgggtcca

SEQ ID NO: 8157101 - DNA, 22 bp, Homo sapiens
gaagacaagctgagtgttgtcc

SEQ ID NO: 8157102 - DNA, 22 bp, Homo sapiens
gaagacaattctgggtggagga

SEQ ID NO: 8157103 - DNA, 22 bp, Homo sapiens
gaagacaattctgggtggagga

SEQ ID NO: 8157104 - DNA, 20 bp, Homo sapiens
gaacatttggccatactgag

SEQ ID NO: 8157105 - DNA, 21 bp, Homo sapiens
gaacatttgggttgtttctac

SEQ ID NO: 8157106 - DNA, 20 bp, Homo sapiens
gaacatttggccatactgag

SEQ ID NO: 8157107 - DNA, 20 bp, Homo sapiens
gaacatttggccatactgag

SEQ ID NO: 8157108 - DNA, 21 bp, Homo sapiens
gaacatttgggttgtttctac

SEQ ID NO: 8157109 - DNA, 22 bp, Homo sapiens
gaagacatgtttttaatatgta

SEQ ID NO: 8157110 - DNA, 22 bp, Homo sapiens
gaagacatgtggattctagttt

SEQ ID NO: 8157111 - DNA, 22 bp, Homo sapiens
gaagacatgtggattctagttt

SEQ ID NO: 8157112 - DNA, 22 bp, Homo sapiens
gaagacctgtttatgctgcatt

SEQ ID NO: 8157113 - DNA, 22 bp, Homo sapiens
gaagaccactgtgaaatgccat

SEQ ID NO: 8157114 - DNA, 22 bp, Homo sapiens
gaagaccatattcagcaggcat

SEQ ID NO: 8157115 - DNA, 22 bp, Homo sapiens
gaagacctcataattcacatgc

SEQ ID NO: 8157116 - DNA, 22 bp, Homo sapiens
gaagaccaatttgggccatggc

SEQ ID NO: 8157117 - DNA, 22 bp, Homo sapiens
gaagacattttatgcatactct

SEQ ID NO: 8157118 - DNA, 22 bp, Homo sapiens
gaagacattttatgcatactct

SEQ ID NO: 8157119 - DNA, 22 bp, Homo sapiens
gaagaccaatttgggccatggc

SEQ ID NO: 8157120 - DNA, 22 bp, Homo sapiens
gaagaccaccccctacagcaca

SEQ ID NO: 8157121 - DNA, 22 bp, Homo sapiens
gaagacactaaactggggcttc

SEQ ID NO: 8157122 - DNA, 22 bp, Homo sapiens
gaagacacctactgtcatttct

SEQ ID NO: 8157123 - DNA, 22 bp, Homo sapiens
gaagacactaaggcccagggag

SEQ ID NO: 8157124 - DNA, 22 bp, Homo sapiens
gaagacagaaacctgtttggct

SEQ ID NO: 8157125 - DNA, 22 bp, Homo sapiens
gaagacactctgcagagttatc

SEQ ID NO: 8157126 - DNA, 22 bp, Homo sapiens
gaagacatcatggagaggatag

SEQ ID NO: 8157127 - DNA, 22 bp, Homo sapiens
gaagagcttagttgtcctagaa

SEQ ID NO: 8157128 - DNA, 22 bp, Homo sapiens
gaagaggatgacaggagccggt

SEQ ID NO: 8157129 - DNA, 22 bp, Homo sapiens
gaagaggatgacaggagccggt

SEQ ID NO: 8157130 - DNA, 22 bp, Homo sapiens
gaagaggatgacaggagccggt

SEQ ID NO: 8157131 - DNA, 22 bp, Homo sapiens
gaagaggcaattgaataagcta

SEQ ID NO: 8157132 - DNA, 22 bp, Homo sapiens
gaagaggctttcctagggcaag

SEQ ID NO: 8157133 - DNA, 22 bp, Homo sapiens
gaagaggctttcctagggcaag

SEQ ID NO: 8157134 - DNA, 22 bp, Homo sapiens
gaagaggctttcctagggcaag

SEQ ID NO: 8157135 - DNA, 22 bp, Homo sapiens
gaagaggatgacaggagccggt

SEQ ID NO: 8157136 - DNA, 22 bp, Homo sapiens
gaagaggatgacaggagccggt

SEQ ID NO: 8157137 - DNA, 22 bp, Homo sapiens
gaagaggactgtggcatcctag

SEQ ID NO: 8157138 - DNA, 22 bp, Homo sapiens
gaagaggactgtggcatcctag

SEQ ID NO: 8157139 - DNA, 22 bp, Homo sapiens
gaagaggactgtggcatcctag

SEQ ID NO: 8157140 - DNA, 22 bp, Homo sapiens
gaagagctccaaaaacagtgag

SEQ ID NO: 8157141 - DNA, 22 bp, Homo sapiens
gaagagctgacagtgtcatcct

SEQ ID NO: 8157142 - DNA, 22 bp, Homo sapiens
gaagagctgcacactggggact

SEQ ID NO: 8157143 - DNA, 22 bp, Homo sapiens
gaagagaagcatcaataggtaa

SEQ ID NO: 8157144 - DNA, 22 bp, Homo sapiens
gaagattgaaggctgggaatta

SEQ ID NO: 8157145 - DNA, 22 bp, Homo sapiens
gaagattgaaggctgggaatta

SEQ ID NO: 8157146 - DNA, 22 bp, Homo sapiens
gaagattgaaggctgggaatta

SEQ ID NO: 8157147 - DNA, 22 bp, Homo sapiens
gaagattgaaggctgggaatta

SEQ ID NO: 8157148 - DNA, 22 bp, Homo sapiens
gaagattgaaggctgggaatta

SEQ ID NO: 8157149 - DNA, 22 bp, Homo sapiens
gaagatacctcaattctttgaa

SEQ ID NO: 8157150 - DNA, 22 bp, Homo sapiens
gaagatctgcagcctcaggcga

SEQ ID NO: 8157151 - DNA, 22 bp, Homo sapiens
gaagatacacagagctgtcttt

SEQ ID NO: 8157152 - DNA, 22 bp, Homo sapiens
gaagatacaaatttcttagatg

SEQ ID NO: 8157153 - DNA, 22 bp, Homo sapiens
gaagatgggaatgatgagtggg

SEQ ID NO: 8157154 - DNA, 22 bp, Homo sapiens
gaagatgggaatgatgagtggg

SEQ ID NO: 8157155 - DNA, 22 bp, Homo sapiens
gaagagtggttatccctgctgt

SEQ ID NO: 8157156 - DNA, 22 bp, Homo sapiens
gaagataactttaaaaagtggc

SEQ ID NO: 8157157 - DNA, 22 bp, Homo sapiens
gaagaggtagcattggcaggtg

SEQ ID NO: 8157158 - DNA, 22 bp, Homo sapiens
gaagccaggggcctgacaggca

SEQ ID NO: 8157159 - DNA, 22 bp, Homo sapiens
gaagccaggggcctgacaggca

SEQ ID NO: 8157160 - DNA, 22 bp, Homo sapiens
gaagccaggggcctgacaggca

SEQ ID NO: 8157161 - DNA, 22 bp, Homo sapiens
gaagccagccttgtctgcctct

SEQ ID NO: 8157162 - DNA, 22 bp, Homo sapiens
gaagccagcatccctctcccat

SEQ ID NO: 8157163 - DNA, 22 bp, Homo sapiens
gaagccagcagtggagaaagga

SEQ ID NO: 8157164 - DNA, 22 bp, Homo sapiens
gaagcccatttgtacagcacat

SEQ ID NO: 8157165 - DNA, 22 bp, Homo sapiens
gaagccccaaaccctcgccatc

SEQ ID NO: 8157166 - DNA, 22 bp, Homo sapiens
gaagccccaaaccctcgccatc

SEQ ID NO: 8157167 - DNA, 22 bp, Homo sapiens
gaagcctcaacatctctgcgtc

SEQ ID NO: 8157168 - DNA, 22 bp, Homo sapiens
gaagccctatcctctcctggga

SEQ ID NO: 8157169 - DNA, 22 bp, Homo sapiens
gaagccagtgtttgaagaattt

SEQ ID NO: 8157170 - DNA, 22 bp, Homo sapiens
gaagcccagcaaactgtgatca

SEQ ID NO: 8157171 - DNA, 22 bp, Homo sapiens
gaagcccaggcttccttggctt

SEQ ID NO: 8157172 - DNA, 22 bp, Homo sapiens
gaagccagtactgtgctctgca

SEQ ID NO: 8157173 - DNA, 22 bp, Homo sapiens
gaagccagtgtttgaagaattt

SEQ ID NO: 8157174 - DNA, 22 bp, Homo sapiens
gaagccagtactgtgctctgca

SEQ ID NO: 8157175 - DNA, 22 bp, Homo sapiens
gaagccagtactgtgctctgca

SEQ ID NO: 8157176 - DNA, 22 bp, Homo sapiens
ctttcacaagatttgagatgct

SEQ ID NO: 8157177 - DNA, 22 bp, Homo sapiens
ctttcaatgtcatctgtgaatg

SEQ ID NO: 8157178 - DNA, 22 bp, Homo sapiens
ctttcaatcaaagtttctagtg

SEQ ID NO: 8157179 - DNA, 22 bp, Homo sapiens
ctttcactttaatctgacacct

SEQ ID NO: 8157180 - DNA, 22 bp, Homo sapiens
ctttcagaagaggacctttcca

SEQ ID NO: 8157181 - DNA, 22 bp, Homo sapiens
ctttcacagcttgaaaagtatt

SEQ ID NO: 8157182 - DNA, 22 bp, Homo sapiens
ctttcagaggttactcaggaaa

SEQ ID NO: 8157183 - DNA, 22 bp, Homo sapiens
ctttcagttacagttacacaca

SEQ ID NO: 8157184 - DNA, 22 bp, Homo sapiens
ctttcagttaatgactccatag

SEQ ID NO: 8157185 - DNA, 22 bp, Homo sapiens
ctttcagtctttacaaggttgc

SEQ ID NO: 8157186 - DNA, 22 bp, Homo sapiens
ctttcagtcagttaactcagaa

SEQ ID NO: 8157187 - DNA, 18 bp, Homo sapiens
ctttcagtaatttcagcc

SEQ ID NO: 8157188 - DNA, 18 bp, Homo sapiens
ctttcagtaatttcagcc

SEQ ID NO: 8157189 - DNA, 22 bp, Homo sapiens
ctttcataaaggaaatgatgag

SEQ ID NO: 8157190 - DNA, 22 bp, Homo sapiens
ctttcataaggggttttataat

SEQ ID NO: 8157191 - DNA, 22 bp, Homo sapiens
ctttcagttacagttacacaca

SEQ ID NO: 8157192 - DNA, 22 bp, Homo sapiens
ctttcagttacagttacacaca

SEQ ID NO: 8157193 - DNA, 22 bp, Homo sapiens
ctttcagttagtacctagtggc

SEQ ID NO: 8157194 - DNA, 22 bp, Homo sapiens
ctttcagttagtacctagtggc

SEQ ID NO: 8157195 - DNA, 22 bp, Homo sapiens
gaaatcaaggctacattcaggt

SEQ ID NO: 8157196 - DNA, 22 bp, Homo sapiens
gaaatcaatttcttggttgata

SEQ ID NO: 8157197 - DNA, 22 bp, Homo sapiens
gaaatcaaggctacattcaggt

SEQ ID NO: 8157198 - DNA, 20 bp, Homo sapiens
gaaatcagttaatgatggtt

SEQ ID NO: 8157199 - DNA, 22 bp, Homo sapiens
gaaatcaatttcttggttgata

SEQ ID NO: 8157200 - DNA, 22 bp, Homo sapiens
gaaatcacttttttcatagttg

SEQ ID NO: 8157201 - DNA, 22 bp, Homo sapiens
gaaatcaaacccttttctgata

SEQ ID NO: 8157202 - DNA, 22 bp, Homo sapiens
gaaatcaaacccttttctgata

SEQ ID NO: 8157203 - DNA, 22 bp, Homo sapiens
gaaatatttctcttgagcccct

SEQ ID NO: 8157204 - DNA, 22 bp, Homo sapiens
gaaatatttctcttgagcccct

SEQ ID NO: 8157205 - DNA, 22 bp, Homo sapiens
gaaatatttctcttgagcccct

SEQ ID NO: 8157206 - DNA, 22 bp, Homo sapiens
gaaatatttctcttgagcccct

SEQ ID NO: 8157207 - DNA, 22 bp, Homo sapiens
gaaatatttctcttgagcccct

SEQ ID NO: 8157208 - DNA, 22 bp, Homo sapiens
gaaatatttctcttgagcccct

SEQ ID NO: 8157209 - DNA, 22 bp, Homo sapiens
ctttccaactgggtgggcagct

SEQ ID NO: 8157210 - DNA, 22 bp, Homo sapiens
gaaatatttctcttgagcccct

SEQ ID NO: 8157211 - DNA, 22 bp, Homo sapiens
gaaatatttctcttgagcccct

SEQ ID NO: 8157212 - DNA, 22 bp, Homo sapiens
ctttcattcttagatattagtg

SEQ ID NO: 8157213 - DNA, 22 bp, Homo sapiens
ctttcattcttagatattagtg

SEQ ID NO: 8157214 - DNA, 23 bp, Homo sapiens
ctttcattgtggtttcacagagc

SEQ ID NO: 8157215 - DNA, 23 bp, Homo sapiens
ctttcattgtggtttcacagagc

SEQ ID NO: 8157216 - DNA, 23 bp, Homo sapiens
ctttcattgtggtttcacagagc

SEQ ID NO: 8157217 - DNA, 22 bp, Homo sapiens
ctttccaactctagtgaaattt

SEQ ID NO: 8157218 - DNA, 22 bp, Homo sapiens
ctttcatttgataagaatgcca

SEQ ID NO: 8157219 - DNA, 22 bp, Homo sapiens
ctttcatttgataagaatgcca

SEQ ID NO: 8157220 - DNA, 22 bp, Homo sapiens
ctttcattcttagatattagtg

SEQ ID NO: 8157221 - DNA, 22 bp, Homo sapiens
gaaatgtaattctcttgaagat

SEQ ID NO: 8157222 - DNA, 22 bp, Homo sapiens
gaaatggtgtgctgtgcaatga

SEQ ID NO: 8157223 - DNA, 22 bp, Homo sapiens
gaaatgcatggatcttggcaga

SEQ ID NO: 8157224 - DNA, 20 bp, Homo sapiens
gaaatgtacacattaccaca

SEQ ID NO: 8157225 - DNA, 20 bp, Homo sapiens
gaaatgtacacattaccaca

SEQ ID NO: 8157226 - DNA, 20 bp, Homo sapiens
gaaatgtacacattaccaca

SEQ ID NO: 8157227 - DNA, 22 bp, Homo sapiens
gaaatgtactttaaagccatcc

SEQ ID NO: 8157228 - DNA, 22 bp, Homo sapiens
gaaatgtactttaaagccatcc

SEQ ID NO: 8157229 - DNA, 22 bp, Homo sapiens
gaaatgtactttaaagccatcc

SEQ ID NO: 8157230 - DNA, 22 bp, Homo sapiens
gaacagcagcttcctgggaatt

SEQ ID NO: 8157231 - DNA, 22 bp, Homo sapiens
gaacagcagcttcctgggaatt

SEQ ID NO: 8157232 - DNA, 22 bp, Homo sapiens
gaaatgtactttaaagccatcc

SEQ ID NO: 8157233 - DNA, 22 bp, Homo sapiens
gaaatgtagaattgcttaactg

SEQ ID NO: 8157234 - DNA, 22 bp, Homo sapiens
gaaatctacgattagtgaaaat

SEQ ID NO: 8157235 - DNA, 22 bp, Homo sapiens
gaaatccagttccctactctta

SEQ ID NO: 8157236 - DNA, 22 bp, Homo sapiens
gaaatcattatatggtattgct

SEQ ID NO: 8157237 - DNA, 22 bp, Homo sapiens
gaaatgcaaattctctctcgct

SEQ ID NO: 8157238 - DNA, 22 bp, Homo sapiens
gaaatgcaggcttggattcagc

SEQ ID NO: 8157239 - DNA, 22 bp, Homo sapiens
gaaatgcagaacctgagaccat

SEQ ID NO: 8157240 - DNA, 22 bp, Homo sapiens
gaaatgcagaacctgagaccat

SEQ ID NO: 8157241 - DNA, 22 bp, Homo sapiens
gaaatcattatatggtattgct

SEQ ID NO: 8157242 - DNA, 22 bp, Homo sapiens
gaaatcattagcaaagatatgt

SEQ ID NO: 8157243 - DNA, 22 bp, Homo sapiens
gaaatcattagcaaagatatgt

SEQ ID NO: 8157244 - DNA, 22 bp, Homo sapiens
gaaatcattagcaaagatatgt

SEQ ID NO: 8157245 - DNA, 22 bp, Homo sapiens
gaaatcattagcaaagatatgt

SEQ ID NO: 8157246 - DNA, 22 bp, Homo sapiens
gaaatcattagcaaagatatgt

SEQ ID NO: 8157247 - DNA, 22 bp, Homo sapiens
gaaatcattagcaaagatatgt

SEQ ID NO: 8157248 - DNA, 22 bp, Homo sapiens
gaaatcattagcaaagatatgt

SEQ ID NO: 8157249 - DNA, 22 bp, Homo sapiens
gaaatcatctgagtaataatct

SEQ ID NO: 8157250 - DNA, 22 bp, Homo sapiens
gaaatcatctgagtaataatct

SEQ ID NO: 8157251 - DNA, 22 bp, Homo sapiens
gaaatcatctgagtaataatct

SEQ ID NO: 8157252 - DNA, 22 bp, Homo sapiens
gaaatcatctgagtaataatct

SEQ ID NO: 8157253 - DNA, 22 bp, Homo sapiens
gaaatcatgagatctcttggac

SEQ ID NO: 8157254 - DNA, 22 bp, Homo sapiens
gaaatcatgagatctcttggac

SEQ ID NO: 8157255 - DNA, 22 bp, Homo sapiens
gaaatcatagcacatggggctg

SEQ ID NO: 8157256 - DNA, 22 bp, Homo sapiens
gaaatcatattctcagtccttc

SEQ ID NO: 8157257 - DNA, 22 bp, Homo sapiens
gaaatcatagcacatggggctg

SEQ ID NO: 8157258 - DNA, 22 bp, Homo sapiens
gaaatcatctgagtaataatct

SEQ ID NO: 8157259 - DNA, 22 bp, Homo sapiens
gaaatcatattctcagtccttc

SEQ ID NO: 8157260 - DNA, 22 bp, Homo sapiens
gaacagtttccctgtagaaaat

SEQ ID NO: 8157261 - DNA, 22 bp, Homo sapiens
gaacatttggatttgtaaattt

SEQ ID NO: 8157262 - DNA, 22 bp, Homo sapiens
gaacatttggcatgagaatttg

SEQ ID NO: 8157263 - DNA, 22 bp, Homo sapiens
gaacatttggatttgtaaattt

SEQ ID NO: 8157264 - DNA, 22 bp, Homo sapiens
gaacatttggatttgtaaattt

SEQ ID NO: 8157265 - DNA, 22 bp, Homo sapiens
gaacatttggatttgtaaattt

SEQ ID NO: 8157266 - DNA, 22 bp, Homo sapiens
gaacatttggatttgtaaattt

SEQ ID NO: 8157267 - DNA, 22 bp, Homo sapiens
gaacaggtaatcagtaaaatgt

SEQ ID NO: 8157268 - DNA, 22 bp, Homo sapiens
gaacagggtttgagaggcttag

SEQ ID NO: 8157269 - DNA, 22 bp, Homo sapiens
gaacagcttcttgggagctggg

SEQ ID NO: 8157270 - DNA, 22 bp, Homo sapiens
gaacagggagtacggcacattt

SEQ ID NO: 8157271 - DNA, 22 bp, Homo sapiens
gaacagggagtacggcacattt

SEQ ID NO: 8157272 - DNA, 22 bp, Homo sapiens
gaacagctataatcatctgtcc

SEQ ID NO: 8157273 - DNA, 22 bp, Homo sapiens
gaacagctctgaagcagtaaat

SEQ ID NO: 8157274 - DNA, 22 bp, Homo sapiens
gaacagctataatcatctgtcc

SEQ ID NO: 8157275 - DNA, 22 bp, Homo sapiens
gaacagctgctagagatctgtg

SEQ ID NO: 8157276 - DNA, 22 bp, Homo sapiens
gaacagcatgtaagaagctact

SEQ ID NO: 8157277 - DNA, 22 bp, Homo sapiens
gaaggaaaaatactctgtaagg

SEQ ID NO: 8157278 - DNA, 22 bp, Homo sapiens
gaaggaaaacagatctgcctga

SEQ ID NO: 8157279 - DNA, 22 bp, Homo sapiens
gaaggaaaacagatctgcctga

SEQ ID NO: 8157280 - DNA, 22 bp, Homo sapiens
gaaggaaaacagatctgcctga

SEQ ID NO: 8157281 - DNA, 22 bp, Homo sapiens
gaagcttcgtggctcttcaaat

SEQ ID NO: 8157282 - DNA, 22 bp, Homo sapiens
gaagcctcaacatctctgcgtc

SEQ ID NO: 8157283 - DNA, 22 bp, Homo sapiens
gaagcctcaacatctctgcgtc

SEQ ID NO: 8157284 - DNA, 22 bp, Homo sapiens
gaagttgatagagtacatgatt

SEQ ID NO: 8157285 - DNA, 22 bp, Homo sapiens
gaagtttacctctgccttgctt

SEQ ID NO: 8157286 - DNA, 22 bp, Homo sapiens
gaagtttagaagtgacaggttt

SEQ ID NO: 8157287 - DNA, 22 bp, Homo sapiens
gaagtttagaagtgacaggttt

SEQ ID NO: 8157288 - DNA, 23 bp, Homo sapiens
gaagttctgttcagccagacaag

SEQ ID NO: 8157289 - DNA, 22 bp, Homo sapiens
gaaggaagattctgttggaatc

SEQ ID NO: 8157290 - DNA, 22 bp, Homo sapiens
gaaggaaatctgtgatttatgc

SEQ ID NO: 8157291 - DNA, 22 bp, Homo sapiens
gaatacaagccaggcacaaggc

SEQ ID NO: 8157292 - DNA, 22 bp, Homo sapiens
gaataacattggaaccctgaag

SEQ ID NO: 8157293 - DNA, 22 bp, Homo sapiens
gaataaactcctcagcttcctt

SEQ ID NO: 8157294 - DNA, 22 bp, Homo sapiens
gaataacattggaaccctgaag

SEQ ID NO: 8157295 - DNA, 22 bp, Homo sapiens
gaataacagcaagtttgcaggc

SEQ ID NO: 8157296 - DNA, 22 bp, Homo sapiens
gaagttttagtcaaaatgtaga

SEQ ID NO: 8157297 - DNA, 22 bp, Homo sapiens
gaataaactcctcagcttcctt

SEQ ID NO: 8157298 - DNA, 22 bp, Homo sapiens
gaagttttctgaggctgtagct

SEQ ID NO: 8157299 - DNA, 22 bp, Homo sapiens
gaagtttatggtgcttgtaagg

SEQ ID NO: 8157300 - DNA, 22 bp, Homo sapiens
gaagtttattttacacatccat

SEQ ID NO: 8157301 - DNA, 22 bp, Homo sapiens
gaagtttatttcaatctattca

SEQ ID NO: 8157302 - DNA, 22 bp, Homo sapiens
gaagtttatttcaatctattca

SEQ ID NO: 8157303 - DNA, 22 bp, Homo sapiens
gaagtttagagtgttgtaattt

SEQ ID NO: 8157304 - DNA, 22 bp, Homo sapiens
gaagtttaggttcttatgttta

SEQ ID NO: 8157305 - DNA, 22 bp, Homo sapiens
gaagtttaggttcttatgttta

SEQ ID NO: 8157306 - DNA, 22 bp, Homo sapiens
gaagtttagagtttggagtcct

SEQ ID NO: 8157307 - DNA, 22 bp, Homo sapiens
gaatacatccagagcagggctg

SEQ ID NO: 8157308 - DNA, 22 bp, Homo sapiens
gaatacatctgaaggctatgaa

SEQ ID NO: 8157309 - DNA, 22 bp, Homo sapiens
gaatacatgaaccctcctgtgg

SEQ ID NO: 8157310 - DNA, 22 bp, Homo sapiens
gaatacatgatacatgaactgc

SEQ ID NO: 8157311 - DNA, 22 bp, Homo sapiens
gaatacatatcagatgtgtttc

SEQ ID NO: 8157312 - DNA, 22 bp, Homo sapiens
gaatacatatcagatgtgtttc

SEQ ID NO: 8157313 - DNA, 22 bp, Homo sapiens
gaatacaagccaggcacaaggc

SEQ ID NO: 8157314 - DNA, 22 bp, Homo sapiens
gacaagctcttgtttcatggtt

SEQ ID NO: 8157315 - DNA, 22 bp, Homo sapiens
gacaagctcttgtttcatggtt

SEQ ID NO: 8157316 - DNA, 22 bp, Homo sapiens
gacaagctcccggtggccctcc

SEQ ID NO: 8157317 - DNA, 22 bp, Homo sapiens
gacaagctcccggtggccctcc

SEQ ID NO: 8157318 - DNA, 22 bp, Homo sapiens
gacaagctcgcctgccccggaa

SEQ ID NO: 8157319 - DNA, 22 bp, Homo sapiens
gacaagatttagagtctgctaa

SEQ ID NO: 8157320 - DNA, 22 bp, Homo sapiens
gacaagcaagagtttgctgggc

SEQ ID NO: 8157321 - DNA, 22 bp, Homo sapiens
gaatattagtatcagttatacc

SEQ ID NO: 8157322 - DNA, 22 bp, Homo sapiens
gaatattagtatcagttatacc

SEQ ID NO: 8157323 - DNA, 22 bp, Homo sapiens
gacaacagtggtttcaggttcc

SEQ ID NO: 8157324 - DNA, 22 bp, Homo sapiens
gaatatcccgctatgcaaagta

SEQ ID NO: 8157325 - DNA, 22 bp, Homo sapiens
gaatatctgggagtgggaagct

SEQ ID NO: 8157326 - DNA, 22 bp, Homo sapiens
gaatatctgtctggttgaggaa

SEQ ID NO: 8157327 - DNA, 22 bp, Homo sapiens
gaatatatttctcttaccttta

SEQ ID NO: 8157328 - DNA, 22 bp, Homo sapiens
gaatatatttctcttaccttta

SEQ ID NO: 8157329 - DNA, 22 bp, Homo sapiens
gaatatcccgctatgcaaagta

SEQ ID NO: 8157330 - DNA, 22 bp, Homo sapiens
gaatacttttgttaggaaaacg

SEQ ID NO: 8157331 - DNA, 22 bp, Homo sapiens
gaatacatttgccgtggttctc

SEQ ID NO: 8157332 - DNA, 22 bp, Homo sapiens
gaatacattggaaatcagaata

SEQ ID NO: 8157333 - DNA, 22 bp, Homo sapiens
gaatacattggaaatcagaata

SEQ ID NO: 8157334 - DNA, 22 bp, Homo sapiens
gaatacattggaaatcagaata

SEQ ID NO: 8157335 - DNA, 22 bp, Homo sapiens
gaatacatgattaaagtttgat

SEQ ID NO: 8157336 - DNA, 22 bp, Homo sapiens
gaatacatgcacgacacggggg

SEQ ID NO: 8157337 - DNA, 22 bp, Homo sapiens
gaatacatggcagggagtcatc

SEQ ID NO: 8157338 - DNA, 22 bp, Homo sapiens
gaatacatgttgtttccctgga

SEQ ID NO: 8157339 - DNA, 22 bp, Homo sapiens
gaatacattggaaatcagaata

SEQ ID NO: 8157340 - DNA, 22 bp, Homo sapiens
gaatacatgtgtgtatagaggt

SEQ ID NO: 8157341 - DNA, 22 bp, Homo sapiens
gaatacatgtgtgtatagaggt

SEQ ID NO: 8157342 - DNA, 22 bp, Homo sapiens
gaatatattggtgaaaatagtt

SEQ ID NO: 8157343 - DNA, 22 bp, Homo sapiens
gaatatattggtgaaaatagtt

SEQ ID NO: 8157344 - DNA, 22 bp, Homo sapiens
gaatatattggtgaaaatagtt

SEQ ID NO: 8157345 - DNA, 22 bp, Homo sapiens
gaatatattggtgaaaatagtt

SEQ ID NO: 8157346 - DNA, 23 bp, Homo sapiens
gaatagttttagaaattggagaa

SEQ ID NO: 8157347 - DNA, 22 bp, Homo sapiens
gaatatattattcagcttttca

SEQ ID NO: 8157348 - DNA, 22 bp, Homo sapiens
gaatatattattcagcttttca

SEQ ID NO: 8157349 - DNA, 22 bp, Homo sapiens
gaatatattattcagcttttca

SEQ ID NO: 8157350 - DNA, 22 bp, Homo sapiens
gaatagctgtaggctagtgtct

SEQ ID NO: 8157351 - DNA, 22 bp, Homo sapiens
gaatagcttccttttttccaaa

SEQ ID NO: 8157352 - DNA, 22 bp, Homo sapiens
gaatagattatacttgaagcat

SEQ ID NO: 8157353 - DNA, 22 bp, Homo sapiens
gaatagataagtgactatttgg

SEQ ID NO: 8157354 - DNA, 22 bp, Homo sapiens
gaatagatatccttgagggtct

SEQ ID NO: 8157355 - DNA, 22 bp, Homo sapiens
gaatagatagcttggatggttg

SEQ ID NO: 8157356 - DNA, 22 bp, Homo sapiens
gacacagaaggtcacatgttca

SEQ ID NO: 8157357 - DNA, 22 bp, Homo sapiens
gacacagaaggtcacatgttca

SEQ ID NO: 8157358 - DNA, 22 bp, Homo sapiens
gacaataaaatgatcttacagt

SEQ ID NO: 8157359 - DNA, 22 bp, Homo sapiens
gacaataaaatgatcttacagt

SEQ ID NO: 8157360 - DNA, 22 bp, Homo sapiens
gacacagaatgggtgctcagta

SEQ ID NO: 8157361 - DNA, 22 bp, Homo sapiens
gacacagaatgggtgctcagta

SEQ ID NO: 8157362 - DNA, 22 bp, Homo sapiens
gacacagaatgggtgctcagta

SEQ ID NO: 8157363 - DNA, 22 bp, Homo sapiens
gacaagggttctgcagagcctg

SEQ ID NO: 8157364 - DNA, 22 bp, Homo sapiens
gacaagtgggctgcagcttttg

SEQ ID NO: 8157365 - DNA, 16 bp, Homo sapiens
gacaagtggaggggcc

SEQ ID NO: 8157366 - DNA, 22 bp, Homo sapiens
gacaagtgggctgcagcttttg

SEQ ID NO: 8157367 - DNA, 22 bp, Homo sapiens
gacaagtgctgatttatctccc

SEQ ID NO: 8157368 - DNA, 22 bp, Homo sapiens
gacaagtgcatgatttctatct

SEQ ID NO: 8157369 - DNA, 22 bp, Homo sapiens
gacaagtgcccattattcttta

SEQ ID NO: 8157370 - DNA, 22 bp, Homo sapiens
gacaagtgatgattataattca

SEQ ID NO: 8157371 - DNA, 22 bp, Homo sapiens
gacacagacagttagaggtaat

SEQ ID NO: 8157372 - DNA, 22 bp, Homo sapiens
gacacagaccaccaggccctgg

SEQ ID NO: 8157373 - DNA, 22 bp, Homo sapiens
gacacagagacttgcagttgta

SEQ ID NO: 8157374 - DNA, 22 bp, Homo sapiens
gacacagagacttgcagttgta

SEQ ID NO: 8157375 - DNA, 22 bp, Homo sapiens
gacacagagacttgcagttgta

SEQ ID NO: 8157376 - DNA, 17 bp, Homo sapiens
gacaggctcagtgacga

SEQ ID NO: 8157377 - DNA, 22 bp, Homo sapiens
gacaggctaggttgctgtcctc

SEQ ID NO: 8157378 - DNA, 22 bp, Homo sapiens
gacaggctaggttgctgtcctc

SEQ ID NO: 8157379 - DNA, 22 bp, Homo sapiens
gacaggccccctcaggactgat

SEQ ID NO: 8157380 - DNA, 22 bp, Homo sapiens
gacaggcccgagtagctgatga

SEQ ID NO: 8157381 - DNA, 22 bp, Homo sapiens
gacaggccccctcaggactgat

SEQ ID NO: 8157382 - DNA, 22 bp, Homo sapiens
gacaggccaggggctgaggtgg

SEQ ID NO: 8157383 - DNA, 22 bp, Homo sapiens
gacaggccaggggctgaggtgg

SEQ ID NO: 8157384 - DNA, 22 bp, Homo sapiens
gacaggccaggggctgaggtgg

SEQ ID NO: 8157385 - DNA, 22 bp, Homo sapiens
gacacagagataggcctgtgtt

SEQ ID NO: 8157386 - DNA, 21 bp, Homo sapiens
gacaggggaagaagcaaggag

SEQ ID NO: 8157387 - DNA, 22 bp, Homo sapiens
gacagggctgtgggaggagcag

SEQ ID NO: 8157388 - DNA, 22 bp, Homo sapiens
gacagggctgtgggaggagcag

SEQ ID NO: 8157389 - DNA, 22 bp, Homo sapiens
gacagggctgtgggaggagcag

SEQ ID NO: 8157390 - DNA, 22 bp, Homo sapiens
gacagggacacagccagtgagg

SEQ ID NO: 8157391 - DNA, 22 bp, Homo sapiens
gacagggacgaggcttcaggca

SEQ ID NO: 8157392 - DNA, 22 bp, Homo sapiens
gacagggaacttcattagctgt

SEQ ID NO: 8157393 - DNA, 22 bp, Homo sapiens
gacagggacacagccagtgagg

SEQ ID NO: 8157394 - DNA, 22 bp, Homo sapiens
gacaggggtccctctgggctgt

SEQ ID NO: 8157395 - DNA, 22 bp, Homo sapiens
gacaggctttgagtcccagaac

SEQ ID NO: 8157396 - DNA, 22 bp, Homo sapiens
gacagggaaacattgaagtgtc

SEQ ID NO: 8157397 - DNA, 22 bp, Homo sapiens
gacaggcttcctaagtgccaga

SEQ ID NO: 8157398 - DNA, 22 bp, Homo sapiens
gacaggcttcctaagtgccaga

SEQ ID NO: 8157399 - DNA, 22 bp, Homo sapiens
gacaggctttctcaggatgagc

SEQ ID NO: 8157400 - DNA, 22 bp, Homo sapiens
gacaggctttctcaggatgagc

SEQ ID NO: 8157401 - DNA, 22 bp, Homo sapiens
gacaggcttcatgatggcagga

SEQ ID NO: 8157402 - DNA, 22 bp, Homo sapiens
gacaggcttcatgatggcagga

SEQ ID NO: 8157403 - DNA, 22 bp, Homo sapiens
gacaggcttcatcctcagagtt

SEQ ID NO: 8157404 - DNA, 22 bp, Homo sapiens
gacaggcttcatcctcagagtt

SEQ ID NO: 8157405 - DNA, 22 bp, Homo sapiens
gacaggcttcatcctcagagtt

SEQ ID NO: 8157406 - DNA, 17 bp, Homo sapiens
gacaggctcagtgacga

SEQ ID NO: 8157407 - DNA, 22 bp, Homo sapiens
gacaggctggcaatgccctgct

SEQ ID NO: 8157408 - DNA, 22 bp, Homo sapiens
gacaggctgtgatggccgggag

SEQ ID NO: 8157409 - DNA, 22 bp, Homo sapiens
gacaggcttagggagggtgctc

SEQ ID NO: 8157410 - DNA, 22 bp, Homo sapiens
gacagtaagaccttaccagcct

SEQ ID NO: 8157411 - DNA, 22 bp, Homo sapiens
gacccagtcacacttgtgcttt

SEQ ID NO: 8157412 - DNA, 22 bp, Homo sapiens
gacccagtgactcgtctctgtg

SEQ ID NO: 8157413 - DNA, 22 bp, Homo sapiens
gacccagtgactcgtctctgtg

SEQ ID NO: 8157414 - DNA, 22 bp, Homo sapiens
gacccagtgggggcctgatctg

SEQ ID NO: 8157415 - DNA, 22 bp, Homo sapiens
gaccccaaaccctgtattcttc

SEQ ID NO: 8157416 - DNA, 22 bp, Homo sapiens
gaccctggctggagctggcctg

SEQ ID NO: 8157417 - DNA, 22 bp, Homo sapiens
gaccctggctgccgcggtctgg

SEQ ID NO: 8157418 - DNA, 22 bp, Homo sapiens
gaccctggtgtccaggtcctgc

SEQ ID NO: 8157419 - DNA, 22 bp, Homo sapiens
gaccctggtgtccaggtcctgc

SEQ ID NO: 8157420 - DNA, 22 bp, Homo sapiens
gaccctggtgggcactggcacc

SEQ ID NO: 8157421 - DNA, 22 bp, Homo sapiens
gacctcagctgtggggatgctg

SEQ ID NO: 8157422 - DNA, 22 bp, Homo sapiens
gaccctgtttctacaaataatt

SEQ ID NO: 8157423 - DNA, 22 bp, Homo sapiens
gaccctgtttctacaaataatt

SEQ ID NO: 8157424 - DNA, 22 bp, Homo sapiens
gacccttagaatgtgatcttat

SEQ ID NO: 8157425 - DNA, 22 bp, Homo sapiens
gacccttagaatgtgatcttat

SEQ ID NO: 8157426 - DNA, 22 bp, Homo sapiens
gacccttagaatgtgatcttat

SEQ ID NO: 8157427 - DNA, 22 bp, Homo sapiens
gacagggtggctgatagggctc

SEQ ID NO: 8157428 - DNA, 22 bp, Homo sapiens
gacagggttgagtaaactggga

SEQ ID NO: 8157429 - DNA, 22 bp, Homo sapiens
gacaggtaccggtcagactacg

SEQ ID NO: 8157430 - DNA, 22 bp, Homo sapiens
gacagggtacgggctaggcaca

SEQ ID NO: 8157431 - DNA, 22 bp, Homo sapiens
gacagggtccaaaggcagggga

SEQ ID NO: 8157432 - DNA, 22 bp, Homo sapiens
gacagggtccaaaggcagggga

SEQ ID NO: 8157433 - DNA, 22 bp, Homo sapiens
gacagggtccaaaggcagggga

SEQ ID NO: 8157434 - DNA, 20 bp, Homo sapiens
gacaggtgctaaagaggggc

SEQ ID NO: 8157435 - DNA, 21 bp, Homo sapiens
gacaggtgattcagagcaggg

SEQ ID NO: 8157436 - DNA, 20 bp, Homo sapiens
gacaggtgctaaagaggggc

SEQ ID NO: 8157437 - DNA, 21 bp, Homo sapiens
gacaggtgattcagagcaggg

SEQ ID NO: 8157438 - DNA, 21 bp, Homo sapiens
gacaggtgattcagagcaggg

SEQ ID NO: 8157439 - DNA, 21 bp, Homo sapiens
gacaggtgattcagagcaggg

SEQ ID NO: 8157440 - DNA, 21 bp, Homo sapiens
gacaggtgattcagagcaggg

SEQ ID NO: 8157441 - DNA, 21 bp, Homo sapiens
gacaggtgattcagagcaggg

SEQ ID NO: 8157442 - DNA, 22 bp, Homo sapiens
gacaggtgagatgaggaacacc

SEQ ID NO: 8157443 - DNA, 22 bp, Homo sapiens
gacaggtgagatgaggaacacc

SEQ ID NO: 8157444 - DNA, 22 bp, Homo sapiens
gacaggtgaaacagcaaggtaa

SEQ ID NO: 8157445 - DNA, 22 bp, Homo sapiens
gacaggtgaaacagcaaggtaa

SEQ ID NO: 8157446 - DNA, 22 bp, Homo sapiens
gacaggtatttgagagctggga

SEQ ID NO: 8157447 - DNA, 22 bp, Homo sapiens
gacaggtgagatgaggaacacc

SEQ ID NO: 8157448 - DNA, 22 bp, Homo sapiens
gacaggtgaaacagcaaggtaa

SEQ ID NO: 8157449 - DNA, 22 bp, Homo sapiens
gacaggtgaaacagcaaggtaa

SEQ ID NO: 8157450 - DNA, 18 bp, Homo sapiens
gacaggtgggtgagacca

SEQ ID NO: 8157451 - DNA, 18 bp, Homo sapiens
gacaggtgggtgagacca

SEQ ID NO: 8157452 - DNA, 22 bp, Homo sapiens
gacaggtgggttctcgtatctg

SEQ ID NO: 8157453 - DNA, 22 bp, Homo sapiens
gacaggtgggttctcgtatctg

SEQ ID NO: 8157454 - DNA, 22 bp, Homo sapiens
gacaggtgtgtgtatattaggg

SEQ ID NO: 8157455 - DNA, 22 bp, Homo sapiens
gacaggtgtgatgatttaggct

SEQ ID NO: 8157456 - DNA, 22 bp, Homo sapiens
gacaggtgtgatgatttaggct

SEQ ID NO: 8157457 - DNA, 22 bp, Homo sapiens
gacaggtggggaaactaaggta

SEQ ID NO: 8157458 - DNA, 22 bp, Homo sapiens
gacaggtggggaaactaaggta

SEQ ID NO: 8157459 - DNA, 18 bp, Homo sapiens
gacaggtgggtgagacca

SEQ ID NO: 8157460 - DNA, 18 bp, Homo sapiens
gacaggtgggtgagacca

SEQ ID NO: 8157461 - DNA, 22 bp, Homo sapiens
gacaggtgggtacctttatgga

SEQ ID NO: 8157462 - DNA, 22 bp, Homo sapiens
gacaggtgggtacctttatgga

SEQ ID NO: 8157463 - DNA, 22 bp, Homo sapiens
gacaggtgctaagggacctggc

SEQ ID NO: 8157464 - DNA, 22 bp, Homo sapiens
gacaggtgctaagggacctggc

SEQ ID NO: 8157465 - DNA, 20 bp, Homo sapiens
gacaggtgctaaagaggggc

SEQ ID NO: 8157466 - DNA, 22 bp, Homo sapiens
gacaggtgctaagggacctggc

SEQ ID NO: 8157467 - DNA, 22 bp, Homo sapiens
gacaggtggggaaactaaggta

SEQ ID NO: 8157468 - DNA, 22 bp, Homo sapiens
gacaggtgctaagggacctggc

SEQ ID NO: 8157469 - DNA, 22 bp, Homo sapiens
cttgcacatttcacacaatagg

SEQ ID NO: 8157470 - DNA, 23 bp, Homo sapiens
cttgcaggaagcagatggcacac

SEQ ID NO: 8157471 - DNA, 23 bp, Homo sapiens
cttgcaggaagcagatggcacac

SEQ ID NO: 8157472 - DNA, 22 bp, Homo sapiens
cttgcaggattttgctgctgta

SEQ ID NO: 8157473 - DNA, 23 bp, Homo sapiens
cttgcagggctggaggcttagaa

SEQ ID NO: 8157474 - DNA, 22 bp, Homo sapiens
cttgcagggctgatgggaagtg

SEQ ID NO: 8157475 - DNA, 22 bp, Homo sapiens
cttgcagggctgatgggaagtg

SEQ ID NO: 8157476 - DNA, 22 bp, Homo sapiens
cttgcaggctacatggaacctg

SEQ ID NO: 8157477 - DNA, 22 bp, Homo sapiens
cttgcaggcctttctagctcta

SEQ ID NO: 8157478 - DNA, 22 bp, Homo sapiens
cttgcaggcctttctagctcta

SEQ ID NO: 8157479 - DNA, 22 bp, Homo sapiens
cttgcaggcagggcctcctgga

SEQ ID NO: 8157480 - DNA, 22 bp, Homo sapiens
cttgcaggcagggcctcctgga

SEQ ID NO: 8157481 - DNA, 22 bp, Homo sapiens
cttgcacaaagtcacctagtca

SEQ ID NO: 8157482 - DNA, 22 bp, Homo sapiens
cttgcacacgtgtatgtacatg

SEQ ID NO: 8157483 - DNA, 22 bp, Homo sapiens
cttgatttattacccactatat

SEQ ID NO: 8157484 - DNA, 22 bp, Homo sapiens
cttgatttcagccttgtgatat

SEQ ID NO: 8157485 - DNA, 22 bp, Homo sapiens
cttgcaaacactcaaagccatc

SEQ ID NO: 8157486 - DNA, 22 bp, Homo sapiens
cttgcaaacactcaaagccatc

SEQ ID NO: 8157487 - DNA, 22 bp, Homo sapiens
cttgatttattacccactatat

SEQ ID NO: 8157488 - DNA, 22 bp, Homo sapiens
cttgatgtataagttgatatgt

SEQ ID NO: 8157489 - DNA, 22 bp, Homo sapiens
cttgatggtggcagaagagtga

SEQ ID NO: 8157490 - DNA, 22 bp, Homo sapiens
cttgatgtataagttgatatgt

SEQ ID NO: 8157491 - DNA, 22 bp, Homo sapiens
cttgactttgccttttaaatgt

SEQ ID NO: 8157492 - DNA, 22 bp, Homo sapiens
cttgatggaggggccaggcttt

SEQ ID NO: 8157493 - DNA, 22 bp, Homo sapiens
cttgatggggtgatccagcacc

SEQ ID NO: 8157494 - DNA, 22 bp, Homo sapiens
cttgatgatagcaggcagggaa

SEQ ID NO: 8157495 - DNA, 22 bp, Homo sapiens
cttgatgagtcagaactgaagg

SEQ ID NO: 8157496 - DNA, 22 bp, Homo sapiens
cttgacactgtcactcaggcca

SEQ ID NO: 8157497 - DNA, 22 bp, Homo sapiens
cttcctgggtcagcctggaggt

SEQ ID NO: 8157498 - DNA, 22 bp, Homo sapiens
cttcctgggtctggagactgga

SEQ ID NO: 8157499 - DNA, 22 bp, Homo sapiens
cttcctggccattgccatggca

SEQ ID NO: 8157500 - DNA, 22 bp, Homo sapiens
cttcctggctcggtgcctcacc

SEQ ID NO: 8157501 - DNA, 22 bp, Homo sapiens
cttcctggccattgccatggca

SEQ ID NO: 8157502 - DNA, 22 bp, Homo sapiens
cttcctggccattgccatggca

SEQ ID NO: 8157503 - DNA, 22 bp, Homo sapiens
cttcctggcatgggtctcatga

SEQ ID NO: 8157504 - DNA, 22 bp, Homo sapiens
cttcctggcatgggtctcatga

SEQ ID NO: 8157505 - DNA, 22 bp, Homo sapiens
cttcctgggacacctaactcta

SEQ ID NO: 8157506 - DNA, 22 bp, Homo sapiens
cttcctgggccctgcttaagca

SEQ ID NO: 8157507 - DNA, 22 bp, Homo sapiens
cttcctgcccacttcctgctgg

SEQ ID NO: 8157508 - DNA, 22 bp, Homo sapiens
cttcctgcccacttcctgctgg

SEQ ID NO: 8157509 - DNA, 22 bp, Homo sapiens
cttcctgcattgtgccagagtt

SEQ ID NO: 8157510 - DNA, 22 bp, Homo sapiens
cttcctgcccacttcctgctgg

SEQ ID NO: 8157511 - DNA, 22 bp, Homo sapiens
cttcctgcattgtgccagagtt

SEQ ID NO: 8157512 - DNA, 22 bp, Homo sapiens
cttcctgcattgtgccagagtt

SEQ ID NO: 8157513 - DNA, 22 bp, Homo sapiens
cttcctgcaggacagccatctg

SEQ ID NO: 8157514 - DNA, 22 bp, Homo sapiens
cttcctgcaacacctgtgttgc

SEQ ID NO: 8157515 - DNA, 22 bp, Homo sapiens
cttcctggatgaagcccagcat

SEQ ID NO: 8157516 - DNA, 22 bp, Homo sapiens
cttcctgctcccctgccaattc

SEQ ID NO: 8157517 - DNA, 22 bp, Homo sapiens
cttcctggatgagcaggctgat

SEQ ID NO: 8157518 - DNA, 22 bp, Homo sapiens
cttcctggatgaagcccagcat

SEQ ID NO: 8157519 - DNA, 22 bp, Homo sapiens
cttcctggatgagcaggctgat

SEQ ID NO: 8157520 - DNA, 22 bp, Homo sapiens
cttgcctaacaaattccccctt

SEQ ID NO: 8157521 - DNA, 22 bp, Homo sapiens
cttgggtgctggaggctgccgc

SEQ ID NO: 8157522 - DNA, 22 bp, Homo sapiens
cttgggtgctcagggaaagctt

SEQ ID NO: 8157523 - DNA, 22 bp, Homo sapiens
cttgggtgctcagggaaagctt

SEQ ID NO: 8157524 - DNA, 20 bp, Homo sapiens
cttgccagttccctggcaga

SEQ ID NO: 8157525 - DNA, 22 bp, Homo sapiens
cttgccatctaaccagactgcc

SEQ ID NO: 8157526 - DNA, 22 bp, Homo sapiens
cttgccagcacttggccagctg

SEQ ID NO: 8157527 - DNA, 22 bp, Homo sapiens
cttgccagtgttgcagaagctc

SEQ ID NO: 8157528 - DNA, 22 bp, Homo sapiens
cttgccaaattaacatacagaa

SEQ ID NO: 8157529 - DNA, 22 bp, Homo sapiens
cttgtagaattgaaatggtctc

SEQ ID NO: 8157530 - DNA, 22 bp, Homo sapiens
cttgtagaattgaaatggtctc

SEQ ID NO: 8157531 - DNA, 22 bp, Homo sapiens
cttgtacatgataatctcactc

SEQ ID NO: 8157532 - DNA, 22 bp, Homo sapiens
cttgtacattgatttctgcatt

SEQ ID NO: 8157533 - DNA, 22 bp, Homo sapiens
cttgtatacagtgtacacattg

SEQ ID NO: 8157534 - DNA, 22 bp, Homo sapiens
cttgtagacccctggactcacg

SEQ ID NO: 8157535 - DNA, 22 bp, Homo sapiens
cttgggtgctggaggctgccgc

SEQ ID NO: 8157536 - DNA, 22 bp, Homo sapiens
cttgggtgctggaggctgccgc

SEQ ID NO: 8157537 - DNA, 22 bp, Homo sapiens
cttgggtgtgaccttggcattg

SEQ ID NO: 8157538 - DNA, 22 bp, Homo sapiens
cttgtacactcagtacttctag

SEQ ID NO: 8157539 - DNA, 20 bp, Homo sapiens
cttgtacatgataaagattt

SEQ ID NO: 8157540 - DNA, 22 bp, Homo sapiens
cttgtcacagcacctcagtctc

SEQ ID NO: 8157541 - DNA, 21 bp, Homo sapiens
cttgtcacttcctcactgacc

SEQ ID NO: 8157542 - DNA, 22 bp, Homo sapiens
cttgtcagcactttgccgaaaa

SEQ ID NO: 8157543 - DNA, 22 bp, Homo sapiens
cttgtattgctgttttgcatct

SEQ ID NO: 8157544 - DNA, 22 bp, Homo sapiens
cttgtattcttgtacctttcaa

SEQ ID NO: 8157545 - DNA, 22 bp, Homo sapiens
cttgtattcccctatctctaaa

SEQ ID NO: 8157546 - DNA, 22 bp, Homo sapiens
cttgtattcagcatcttaacta

SEQ ID NO: 8157547 - DNA, 22 bp, Homo sapiens
cttgtattatggttcgcttagt

SEQ ID NO: 8157548 - DNA, 22 bp, Homo sapiens
ctttatgtccaccagactgcaa

SEQ ID NO: 8157549 - DNA, 22 bp, Homo sapiens
cttgtctgtgtcggataaaact

SEQ ID NO: 8157550 - DNA, 22 bp, Homo sapiens
cttgtctttatttcatattcca

SEQ ID NO: 8157551 - DNA, 22 bp, Homo sapiens
cttgtcagccaattgtggattt

SEQ ID NO: 8157552 - DNA, 22 bp, Homo sapiens
cttgtccagatgtttgttaggt

SEQ ID NO: 8157553 - DNA, 22 bp, Homo sapiens
cttgtcagtgtactttcttttg

SEQ ID NO: 8157554 - DNA, 22 bp, Homo sapiens
cttgtcctttacttgagactca

SEQ ID NO: 8157555 - DNA, 22 bp, Homo sapiens
cttgtcctttacttgagactca

SEQ ID NO: 8157556 - DNA, 21 bp, Homo sapiens
cttgtctgcagtgtttatagc

SEQ ID NO: 8157557 - DNA, 22 bp, Homo sapiens
ctgttgtttgctagtgtactct

SEQ ID NO: 8157558 - DNA, 22 bp, Homo sapiens
ctgttgttccgggagctgcagc

SEQ ID NO: 8157559 - DNA, 22 bp, Homo sapiens
ctgtttaaccagatctcatatc

SEQ ID NO: 8157560 - DNA, 22 bp, Homo sapiens
cttatattttaggaacagacaa

SEQ ID NO: 8157561 - DNA, 22 bp, Homo sapiens
cttatattttaggaacagacaa

SEQ ID NO: 8157562 - DNA, 22 bp, Homo sapiens
cttatattttaggaacagacaa

SEQ ID NO: 8157563 - DNA, 22 bp, Homo sapiens
cttatcagattatctgggctgt

SEQ ID NO: 8157564 - DNA, 22 bp, Homo sapiens
cttatcagattatctgggctgt

SEQ ID NO: 8157565 - DNA, 22 bp, Homo sapiens
ctgttgtgaaatgtccatcaac

SEQ ID NO: 8157566 - DNA, 22 bp, Homo sapiens
ctgttgttcatcatctgtcatt

SEQ ID NO: 8157567 - DNA, 22 bp, Homo sapiens
cttattgaaagcccctgtgcct

SEQ ID NO: 8157568 - DNA, 22 bp, Homo sapiens
cttattgaaagcccctgtgcct

SEQ ID NO: 8157569 - DNA, 22 bp, Homo sapiens
cttattggagagttgggccctt

SEQ ID NO: 8157570 - DNA, 22 bp, Homo sapiens
cttattggtggagtcaggccct

SEQ ID NO: 8157571 - DNA, 22 bp, Homo sapiens
cttattggtgctttttctcata

SEQ ID NO: 8157572 - DNA, 22 bp, Homo sapiens
cttattggtcccaggaggagaa

SEQ ID NO: 8157573 - DNA, 22 bp, Homo sapiens
cttattgggatgagaggatgca

SEQ ID NO: 8157574 - DNA, 22 bp, Homo sapiens
cttatttaatgagggttagaat

SEQ ID NO: 8157575 - DNA, 22 bp, Homo sapiens
cttattttgctgatgacccagg

SEQ ID NO: 8157576 - DNA, 22 bp, Homo sapiens
cttattttgctgatgacccagg

SEQ ID NO: 8157577 - DNA, 22 bp, Homo sapiens
cttattttgctgatgacccagg

SEQ ID NO: 8157578 - DNA, 22 bp, Homo sapiens
cttattttgctgatgacccagg

SEQ ID NO: 8157579 - DNA, 22 bp, Homo sapiens
cttattttgctgatgacccagg

SEQ ID NO: 8157580 - DNA, 22 bp, Homo sapiens
cttattttgctgatgacccagg

SEQ ID NO: 8157581 - DNA, 22 bp, Homo sapiens
cttcagaagaaaagcagtgtgt

SEQ ID NO: 8157582 - DNA, 22 bp, Homo sapiens
cttcagaagaaaagcagtgtgt

SEQ ID NO: 8157583 - DNA, 22 bp, Homo sapiens
cttcagaagcctgcagcctttg

SEQ ID NO: 8157584 - DNA, 22 bp, Homo sapiens
cttcagaagcctgcagcctttg

SEQ ID NO: 8157585 - DNA, 22 bp, Homo sapiens
cttcagaagagttaagtgtgag

SEQ ID NO: 8157586 - DNA, 22 bp, Homo sapiens
cttcagccctgagtgccagcag

SEQ ID NO: 8157587 - DNA, 22 bp, Homo sapiens
cttcagccagctggggatgcgg

SEQ ID NO: 8157588 - DNA, 22 bp, Homo sapiens
cttattttaagtcagtttgggt

SEQ ID NO: 8157589 - DNA, 22 bp, Homo sapiens
cttattttaagtcagtttgggt

SEQ ID NO: 8157590 - DNA, 22 bp, Homo sapiens
cttattttaagtcagtttgggt

SEQ ID NO: 8157591 - DNA, 22 bp, Homo sapiens
cttattttgctgatgacccagg

SEQ ID NO: 8157592 - DNA, 22 bp, Homo sapiens
cttattttgctgatgacccagg

SEQ ID NO: 8157593 - DNA, 22 bp, Homo sapiens
cttattttaagtcagtttgggt

SEQ ID NO: 8157594 - DNA, 22 bp, Homo sapiens
cttatttatgtctgtctctaat

SEQ ID NO: 8157595 - DNA, 22 bp, Homo sapiens
cttatttcagccctgggcaccc

SEQ ID NO: 8157596 - DNA, 22 bp, Homo sapiens
cttatttcagccctgggcaccc

SEQ ID NO: 8157597 - DNA, 22 bp, Homo sapiens
cttatttcctgacatggaaaga

SEQ ID NO: 8157598 - DNA, 22 bp, Homo sapiens
cttatttactgatccacagatg

SEQ ID NO: 8157599 - DNA, 22 bp, Homo sapiens
cttatttactgatccacagatg

SEQ ID NO: 8157600 - DNA, 19 bp, Homo sapiens
cttatttctggttttgggt

SEQ ID NO: 8157601 - DNA, 19 bp, Homo sapiens
cttatttctggttttgggt

SEQ ID NO: 8157602 - DNA, 19 bp, Homo sapiens
cttatttctggttttgggt

SEQ ID NO: 8157603 - DNA, 22 bp, Homo sapiens
cttatttctccatccagagtca

SEQ ID NO: 8157604 - DNA, 22 bp, Homo sapiens
cttatttctccatccagagtca

SEQ ID NO: 8157605 - DNA, 22 bp, Homo sapiens
cttatttcctgacatggaaaga

SEQ ID NO: 8157606 - DNA, 22 bp, Homo sapiens
cttatttatgtctgtctctaat

SEQ ID NO: 8157607 - DNA, 22 bp, Homo sapiens
cttatttcagccctgggcaccc

SEQ ID NO: 8157608 - DNA, 22 bp, Homo sapiens
cttatttctccatccagagtca

SEQ ID NO: 8157609 - DNA, 22 bp, Homo sapiens
cttcctaaaagcttcaagagaa

SEQ ID NO: 8157610 - DNA, 22 bp, Homo sapiens
cttcctctgcggcgccgggcgc

SEQ ID NO: 8157611 - DNA, 22 bp, Homo sapiens
cttcctctgcctcccgtgctca

SEQ ID NO: 8157612 - DNA, 22 bp, Homo sapiens
cttcctctgcctcccgtgctca

SEQ ID NO: 8157613 - DNA, 22 bp, Homo sapiens
cttcctctgaggcttctgagtc

SEQ ID NO: 8157614 - DNA, 22 bp, Homo sapiens
cttcctctgaggcttctgagtc

SEQ ID NO: 8157615 - DNA, 22 bp, Homo sapiens
cttcctctgcctcccgtgctca

SEQ ID NO: 8157616 - DNA, 22 bp, Homo sapiens
cttcctctgcctcccgtgctca

SEQ ID NO: 8157617 - DNA, 19 bp, Homo sapiens
cttcagtgttcacctggcc

SEQ ID NO: 8157618 - DNA, 22 bp, Homo sapiens
cttcagtgttcccatctgtaaa

SEQ ID NO: 8157619 - DNA, 22 bp, Homo sapiens
cttccctttctggtgacttctc

SEQ ID NO: 8157620 - DNA, 22 bp, Homo sapiens
cttccctttttatgtcttcagc

SEQ ID NO: 8157621 - DNA, 18 bp, Homo sapiens
cttcagtggctgctctgc

SEQ ID NO: 8157622 - DNA, 22 bp, Homo sapiens
cttcagtggtcatttgtgataa

SEQ ID NO: 8157623 - DNA, 23 bp, Homo sapiens
cttcagtgtgggactgcagcgtg

SEQ ID NO: 8157624 - DNA, 23 bp, Homo sapiens
cttcagtgtgggactgcagcgtg

SEQ ID NO: 8157625 - DNA, 22 bp, Homo sapiens
cttcagtgtcctctctagtaga

SEQ ID NO: 8157626 - DNA, 22 bp, Homo sapiens
cttcctctgtggccagagtgta

SEQ ID NO: 8157627 - DNA, 22 bp, Homo sapiens
cttcctctgtgtcctgggcttc

SEQ ID NO: 8157628 - DNA, 22 bp, Homo sapiens
cttcctctgtgtcctgggcttg

SEQ ID NO: 8157629 - DNA, 22 bp, Homo sapiens
cttcctgaaggatggcagcctc

SEQ ID NO: 8157630 - DNA, 22 bp, Homo sapiens
cttcctgaaatgtctcaccagt

SEQ ID NO: 8157631 - DNA, 18 bp, Homo sapiens
cttcctcttctggagaaa

SEQ ID NO: 8157632 - DNA, 22 bp, Homo sapiens
cttcagctgcagttatgtttag

SEQ ID NO: 8157633 - DNA, 22 bp, Homo sapiens
cttcagcctcgttactcctgcg

SEQ ID NO: 8157634 - DNA, 22 bp, Homo sapiens
cttcagcctcatctcagcccgt

SEQ ID NO: 8157635 - DNA, 22 bp, Homo sapiens
cttcagccctgagtgccagcag

SEQ ID NO: 8157636 - DNA, 20 bp, Homo sapiens
cttcaggacccatcctcccc

SEQ ID NO: 8157637 - DNA, 22 bp, Homo sapiens
cttcaggagtagttacctagca

SEQ ID NO: 8157638 - DNA, 22 bp, Homo sapiens
cttcaggattaatttggggcct

SEQ ID NO: 8157639 - DNA, 22 bp, Homo sapiens
cttcagctgcagttatgtttag

SEQ ID NO: 8157640 - DNA, 22 bp, Homo sapiens
cttcagctgtggtctccaaggc

SEQ ID NO: 8157641 - DNA, 22 bp, Homo sapiens
cttcagctttcagcttccctga

SEQ ID NO: 8157642 - DNA, 22 bp, Homo sapiens
cttcagctgttagacgtggaaa

SEQ ID NO: 8157643 - DNA, 22 bp, Homo sapiens
cttcagggaggagcatgggttc

SEQ ID NO: 8157644 - DNA, 22 bp, Homo sapiens
cttcaggggtgttagttttgtg

SEQ ID NO: 8157645 - DNA, 22 bp, Homo sapiens
cttcagggcatattattggctc

SEQ ID NO: 8157646 - DNA, 22 bp, Homo sapiens
cttcagtctccaatgctctgtg

SEQ ID NO: 8157647 - DNA, 22 bp, Homo sapiens
cttcagtctccaatgctctgtg

SEQ ID NO: 8157648 - DNA, 22 bp, Homo sapiens
cttcagtctagggtgcacttga

SEQ ID NO: 8157649 - DNA, 22 bp, Homo sapiens
cttcagtgatataggcttctcc

SEQ ID NO: 8157650 - DNA, 22 bp, Homo sapiens
cttcagtgatataggcttctcc

SEQ ID NO: 8157651 - DNA, 22 bp, Homo sapiens
cttcagtgcatgtttataatca

SEQ ID NO: 8157652 - DNA, 22 bp, Homo sapiens
cttcagtgattgcagaaagcct

SEQ ID NO: 8157653 - DNA, 22 bp, Homo sapiens
cttcagtgaatgttgagtaagg

SEQ ID NO: 8157654 - DNA, 22 bp, Homo sapiens
cttcagtgaatgttgagtaagg

SEQ ID NO: 8157655 - DNA, 22 bp, Homo sapiens
cttcagtgaatgttgagtaagg

SEQ ID NO: 8157656 - DNA, 22 bp, Homo sapiens
cttcagtgacagccacccaggc

SEQ ID NO: 8157657 - DNA, 22 bp, Homo sapiens
cttcagtgacattccttccctc

SEQ ID NO: 8157658 - DNA, 18 bp, Homo sapiens
cttcagtgacagtctggc

SEQ ID NO: 8157659 - DNA, 22 bp, Homo sapiens
ctgtgtcttcaatgtactggga

SEQ ID NO: 8157660 - DNA, 22 bp, Homo sapiens
ctgtgtctgcctgggatccatt

SEQ ID NO: 8157661 - DNA, 22 bp, Homo sapiens
ctgtgtcttcaatgtactggga

SEQ ID NO: 8157662 - DNA, 22 bp, Homo sapiens
ctgtgtcttcaatgtactggga

SEQ ID NO: 8157663 - DNA, 22 bp, Homo sapiens
ctgtgtcttcacatttgtgtgc

SEQ ID NO: 8157664 - DNA, 22 bp, Homo sapiens
ctgtgtcttcacatttgtgtgc

SEQ ID NO: 8157665 - DNA, 22 bp, Homo sapiens
ctgtgtctctccttacaagact

SEQ ID NO: 8157666 - DNA, 22 bp, Homo sapiens
ctgtgtctctccttacaagact

SEQ ID NO: 8157667 - DNA, 22 bp, Homo sapiens
ctgtgtctctacctccccatcc

SEQ ID NO: 8157668 - DNA, 22 bp, Homo sapiens
ctgtgtctgaataactctgtgt

SEQ ID NO: 8157669 - DNA, 22 bp, Homo sapiens
ctgtgtctgaataactctgtgt

SEQ ID NO: 8157670 - DNA, 22 bp, Homo sapiens
ctgtgtctgaataactctgtgt

SEQ ID NO: 8157671 - DNA, 22 bp, Homo sapiens
ctgtgtctgaataactctgtgt

SEQ ID NO: 8157672 - DNA, 22 bp, Homo sapiens
ctgtgtctgcctgggatccatt

SEQ ID NO: 8157673 - DNA, 22 bp, Homo sapiens
ctgtgtctcatccgcctctggc

SEQ ID NO: 8157674 - DNA, 22 bp, Homo sapiens
ctgtgtctcatccgcctctggc

SEQ ID NO: 8157675 - DNA, 22 bp, Homo sapiens
ctgtgtctcatccgcctctggc

SEQ ID NO: 8157676 - DNA, 22 bp, Homo sapiens
ctgtgtctccttggtgggatat

SEQ ID NO: 8157677 - DNA, 22 bp, Homo sapiens
ctgtgtctccttggtgggatat

SEQ ID NO: 8157678 - DNA, 22 bp, Homo sapiens
ctgttctggagacactgatgaa

SEQ ID NO: 8157679 - DNA, 22 bp, Homo sapiens
ctgttcttctagtccactgaca

SEQ ID NO: 8157680 - DNA, 18 bp, Homo sapiens
ctgttgagatgtggctga

SEQ ID NO: 8157681 - DNA, 18 bp, Homo sapiens
ctgttgagatgtggctga

SEQ ID NO: 8157682 - DNA, 22 bp, Homo sapiens
ctgttgctccagggaacacaga

SEQ ID NO: 8157683 - DNA, 22 bp, Homo sapiens
ctgttgcttcaggaaacagtaa

SEQ ID NO: 8157684 - DNA, 22 bp, Homo sapiens
ctgttctgaactgcctgcatgc

SEQ ID NO: 8157685 - DNA, 22 bp, Homo sapiens
ctgttctctggcggtggctgtt

SEQ ID NO: 8157686 - DNA, 22 bp, Homo sapiens
ctgttctctggcggtggctgtt

SEQ ID NO: 8157687 - DNA, 20 bp, Homo sapiens
ctgttcctgtcccatgaagc

SEQ ID NO: 8157688 - DNA, 22 bp, Homo sapiens
ctgttctatcattaaaagctat

SEQ ID NO: 8157689 - DNA, 22 bp, Homo sapiens
ctgttctctggcggtggctgtt

SEQ ID NO: 8157690 - DNA, 17 bp, Homo sapiens
ctgttccccactactca

SEQ ID NO: 8157691 - DNA, 20 bp, Homo sapiens
ctgttcctgtcccatgaagc

SEQ ID NO: 8157692 - DNA, 21 bp, Homo sapiens
ctgttcactgtgctgtgcaaa

SEQ ID NO: 8157693 - DNA, 22 bp, Homo sapiens
ctgttcagaaaaaatcttcatg

SEQ ID NO: 8157694 - DNA, 22 bp, Homo sapiens
ctgtggctctcagaggctgctg

SEQ ID NO: 8157695 - DNA, 22 bp, Homo sapiens
ctgtggctctcagaggctgctg

SEQ ID NO: 8157696 - DNA, 22 bp, Homo sapiens
ctgtggctctcagaggctgctg

SEQ ID NO: 8157697 - DNA, 22 bp, Homo sapiens
ctgtggctctccaatggaggga

SEQ ID NO: 8157698 - DNA, 22 bp, Homo sapiens
ctgtggctctctgcagggtccc

SEQ ID NO: 8157699 - DNA, 22 bp, Homo sapiens
ctgtggctctctgcagggtccc

SEQ ID NO: 8157700 - DNA, 20 bp, Homo sapiens
ctgtggctcatgcatctgcc

SEQ ID NO: 8157701 - DNA, 20 bp, Homo sapiens
ctgtggctcatgcatctgcc

SEQ ID NO: 8157702 - DNA, 22 bp, Homo sapiens
ctgtggctccatagaagttgca

SEQ ID NO: 8157703 - DNA, 22 bp, Homo sapiens
ctgtggctctttagttgagcac

SEQ ID NO: 8157704 - DNA, 22 bp, Homo sapiens
ctgtggctgaactctgaagagg

SEQ ID NO: 8157705 - DNA, 23 bp, Homo sapiens
ctgtggctgagtcctgttggagt

SEQ ID NO: 8157706 - DNA, 22 bp, Homo sapiens
ctgtggctgcagccttggtcct

SEQ ID NO: 8157707 - DNA, 22 bp, Homo sapiens
ctgtggctgcgtaggtctggca

SEQ ID NO: 8157708 - DNA, 22 bp, Homo sapiens
ctgtggctgcgtaggtctggca

SEQ ID NO: 8157709 - DNA, 22 bp, Homo sapiens
ctgtgtagctctgggtgcaagt

SEQ ID NO: 8157710 - DNA, 22 bp, Homo sapiens
ctgtgtcctcccgctgcaccca

SEQ ID NO: 8157711 - DNA, 22 bp, Homo sapiens
ctgtgtcctcccgctgcaccca

SEQ ID NO: 8157712 - DNA, 22 bp, Homo sapiens
ctgtgtcctcccgctgcaccca

SEQ ID NO: 8157713 - DNA, 22 bp, Homo sapiens
ctgtgtcctccccatcacttct

SEQ ID NO: 8157714 - DNA, 22 bp, Homo sapiens
ctgtgtcctgcgtcaagccaat

SEQ ID NO: 8157715 - DNA, 22 bp, Homo sapiens
ctgtgtcctgcgtcaagccaat

SEQ ID NO: 8157716 - DNA, 22 bp, Homo sapiens
ctgtgtcctgtctcctaaggtg

SEQ ID NO: 8157717 - DNA, 22 bp, Homo sapiens
ctgtgtcctttaaaaaagacac

SEQ ID NO: 8157718 - DNA, 22 bp, Homo sapiens
ctgtgtcctgtctcctaaggtg

SEQ ID NO: 8157719 - DNA, 22 bp, Homo sapiens
ctgtgtccttttagttgctgtg

SEQ ID NO: 8157720 - DNA, 22 bp, Homo sapiens
ctgtgtctaatcaggtcagtca

SEQ ID NO: 8157721 - DNA, 22 bp, Homo sapiens
ctgtgtctaatcaggtcagtca

SEQ ID NO: 8157722 - DNA, 22 bp, Homo sapiens
ctgtggctgtatttggccagag

SEQ ID NO: 8157723 - DNA, 22 bp, Homo sapiens
ctgtggctgtatttggccagag

SEQ ID NO: 8157724 - DNA, 22 bp, Homo sapiens
ctgtggctggctcatcataggt

SEQ ID NO: 8157725 - DNA, 22 bp, Homo sapiens
ctgtggctgtgaaacttctcag

SEQ ID NO: 8157726 - DNA, 22 bp, Homo sapiens
ctgtgtagagcggctgcgagcg

SEQ ID NO: 8157727 - DNA, 22 bp, Homo sapiens
ctgtgtagcctcatgtgggctt

SEQ ID NO: 8157728 - DNA, 22 bp, Homo sapiens
ctgtgcattgttgagtgtttag

SEQ ID NO: 8157729 - DNA, 22 bp, Homo sapiens
ctgtgcattgtcttgtctgtag

SEQ ID NO: 8157730 - DNA, 22 bp, Homo sapiens
ctgtgcatggcagatgctgtta

SEQ ID NO: 8157731 - DNA, 22 bp, Homo sapiens
ctgtgcatgcgcggagctgaaa

SEQ ID NO: 8157732 - DNA, 22 bp, Homo sapiens
ctgtgcagtgtggggtaggcct

SEQ ID NO: 8157733 - DNA, 22 bp, Homo sapiens
ctgtgcagtgtggggtaggcct

SEQ ID NO: 8157734 - DNA, 22 bp, Homo sapiens
ctgtgcagtgtggggtaggcct

SEQ ID NO: 8157735 - DNA, 22 bp, Homo sapiens
ctgtgccaggcccagctgactt

SEQ ID NO: 8157736 - DNA, 22 bp, Homo sapiens
ctgtgccagcctgtcccaggag

SEQ ID NO: 8157737 - DNA, 22 bp, Homo sapiens
ctgtgccagagggtgaccaagg

SEQ ID NO: 8157738 - DNA, 22 bp, Homo sapiens
ctgtgccactgccccaggcctc

SEQ ID NO: 8157739 - DNA, 22 bp, Homo sapiens
ctgtgccactgccccaggcctc

SEQ ID NO: 8157740 - DNA, 22 bp, Homo sapiens
ctgtgcagtggcagcgtgtggg

SEQ ID NO: 8157741 - DNA, 22 bp, Homo sapiens
ctgtgcagtccagccctggaca

SEQ ID NO: 8157742 - DNA, 22 bp, Homo sapiens
ctgtgcagtggcagcgtgtggg

SEQ ID NO: 8157743 - DNA, 22 bp, Homo sapiens
ctgtgagggtcacagccatgcc

SEQ ID NO: 8157744 - DNA, 22 bp, Homo sapiens
ctgtgagtcttcagcaagtgtt

SEQ ID NO: 8157745 - DNA, 22 bp, Homo sapiens
ctgtgagtgaccctggtcagca

SEQ ID NO: 8157746 - DNA, 22 bp, Homo sapiens
ctgtgcagtaggtcagggctgg

SEQ ID NO: 8157747 - DNA, 22 bp, Homo sapiens
ctgtcctgtgctttttactgtc

SEQ ID NO: 8157748 - DNA, 22 bp, Homo sapiens
ctgtcctgtggacctgaggacg

SEQ ID NO: 8157749 - DNA, 22 bp, Homo sapiens
ctgtcctgtgcattgtcagatg

SEQ ID NO: 8157750 - DNA, 22 bp, Homo sapiens
ctgtcctgtctgcttttaattt

SEQ ID NO: 8157751 - DNA, 23 bp, Homo sapiens
ctgtcctgtagttcacgttggcc

SEQ ID NO: 8157752 - DNA, 22 bp, Homo sapiens
ctgtcctgtagctccatcagtc

SEQ ID NO: 8157753 - DNA, 22 bp, Homo sapiens
ctgtcctgtggacctgaggacg

SEQ ID NO: 8157754 - DNA, 22 bp, Homo sapiens
ctgtcctgtggacctgaggacg

SEQ ID NO: 8157755 - DNA, 22 bp, Homo sapiens
ctgtgagggccagagtcagggc

SEQ ID NO: 8157756 - DNA, 22 bp, Homo sapiens
ctgtgccatctgcactctcgtc

SEQ ID NO: 8157757 - DNA, 22 bp, Homo sapiens
ctgtgccatcctagggctgctg

SEQ ID NO: 8157758 - DNA, 22 bp, Homo sapiens
ctgtgccaggcccgggtgggtg

SEQ ID NO: 8157759 - DNA, 22 bp, Homo sapiens
ctgtgccaggcccagctgactt

SEQ ID NO: 8157760 - DNA, 22 bp, Homo sapiens
ctgtgccaggcccagctgactt

SEQ ID NO: 8157761 - DNA, 22 bp, Homo sapiens
ctgtgcccacctggctctgagg

SEQ ID NO: 8157762 - DNA, 22 bp, Homo sapiens
ctgtgcccacctggctctgagg

SEQ ID NO: 8157763 - DNA, 22 bp, Homo sapiens
ctgtgccattctttgtagcatg

SEQ ID NO: 8157764 - DNA, 22 bp, Homo sapiens
ctgtgcccagctccctgactgc

SEQ ID NO: 8157765 - DNA, 22 bp, Homo sapiens
ctgtgcccaggctggagtgcag

SEQ ID NO: 8157766 - DNA, 22 bp, Homo sapiens
ctgtgcccaggctggagtgcag

SEQ ID NO: 8157767 - DNA, 22 bp, Homo sapiens
ctgtggccccaccctcttggcc

SEQ ID NO: 8157768 - DNA, 22 bp, Homo sapiens
ctgtggctcatatctgtaatct

SEQ ID NO: 8157769 - DNA, 23 bp, Homo sapiens
ctgtggccctgcttcatgcagcc

SEQ ID NO: 8157770 - DNA, 22 bp, Homo sapiens
ctgtggccagatggtgccagtt

SEQ ID NO: 8157771 - DNA, 22 bp, Homo sapiens
ctgtggccagatggtgccagtt

SEQ ID NO: 8157772 - DNA, 17 bp, Homo sapiens
ctgtggccacctggatg

SEQ ID NO: 8157773 - DNA, 17 bp, Homo sapiens
ctgtggccacctggatg

SEQ ID NO: 8157774 - DNA, 22 bp, Homo sapiens
ctgtgcccataatctggtattt

SEQ ID NO: 8157775 - DNA, 23 bp, Homo sapiens
ctgtgcccggggctccacctgat

SEQ ID NO: 8157776 - DNA, 19 bp, Homo sapiens
ctgtgccctatgacttgta

SEQ ID NO: 8157777 - DNA, 23 bp, Homo sapiens
ctgtgcccggggctccacctgat

SEQ ID NO: 8157778 - DNA, 22 bp, Homo sapiens
ctgtgccctctttgctggcctt

SEQ ID NO: 8157779 - DNA, 22 bp, Homo sapiens
ctgtgccctctttgctggcctt

SEQ ID NO: 8157780 - DNA, 22 bp, Homo sapiens
ctgtcctgccagtcctggactc

SEQ ID NO: 8157781 - DNA, 22 bp, Homo sapiens
ctgtcctgcagttgggggcagg

SEQ ID NO: 8157782 - DNA, 22 bp, Homo sapiens
ctgtcctgccagtcctggactc

SEQ ID NO: 8157783 - DNA, 23 bp, Homo sapiens
ctgtcctgccatccacagcggcc

SEQ ID NO: 8157784 - DNA, 22 bp, Homo sapiens
ctgtcctgcccaccctgcaggg

SEQ ID NO: 8157785 - DNA, 22 bp, Homo sapiens
ctgtcctgcccaccctgcaggg

SEQ ID NO: 8157786 - DNA, 22 bp, Homo sapiens
ctgtcctgcccaccctgcaggg

SEQ ID NO: 8157787 - DNA, 22 bp, Homo sapiens
ctgtcctgcccaccctgcaggg

SEQ ID NO: 8157788 - DNA, 22 bp, Homo sapiens
ctgtcctgatggtgccactggt

SEQ ID NO: 8157789 - DNA, 22 bp, Homo sapiens
ctgtcctgatggtgccactggt

SEQ ID NO: 8157790 - DNA, 22 bp, Homo sapiens
ctgtcctgatggtgccactggt

SEQ ID NO: 8157791 - DNA, 22 bp, Homo sapiens
ctgtcctgagttcttggaggtc

SEQ ID NO: 8157792 - DNA, 20 bp, Homo sapiens
ctgtcctgatcttttcagaa

SEQ ID NO: 8157793 - DNA, 22 bp, Homo sapiens
ctgtcctgagataaagatgagg

SEQ ID NO: 8157794 - DNA, 22 bp, Homo sapiens
ctgtcctgaggcaggtggcctg

SEQ ID NO: 8157795 - DNA, 22 bp, Homo sapiens
ctgtcctggagggcataggacg

SEQ ID NO: 8157796 - DNA, 22 bp, Homo sapiens
ctgtcctggagggcataggacg

SEQ ID NO: 8157797 - DNA, 22 bp, Homo sapiens
ctgtcctggagggcataggacg

SEQ ID NO: 8157798 - DNA, 22 bp, Homo sapiens
ctgtcctgggggtggtccttgc

SEQ ID NO: 8157799 - DNA, 22 bp, Homo sapiens
ctgtcctggtactttgaggttc

SEQ ID NO: 8157800 - DNA, 22 bp, Homo sapiens
ctgtcctggccgcccttgtgag

SEQ ID NO: 8157801 - DNA, 22 bp, Homo sapiens
ctgtcctggccgcccttgtgag

SEQ ID NO: 8157802 - DNA, 22 bp, Homo sapiens
ctgtcctggggaaagccagccc

SEQ ID NO: 8157803 - DNA, 22 bp, Homo sapiens
ctgtcctggccgcccttgtgag

SEQ ID NO: 8157804 - DNA, 19 bp, Homo sapiens
ctgtcctggtttggtccct

SEQ ID NO: 8157805 - DNA, 22 bp, Homo sapiens
ctgtcctggtgctggggatccc

SEQ ID NO: 8157806 - DNA, 21 bp, Homo sapiens
ctgtcctggtctagaggcaca

SEQ ID NO: 8157807 - DNA, 21 bp, Homo sapiens
ctgtcctggtctagaggcaca

SEQ ID NO: 8157808 - DNA, 22 bp, Homo sapiens
ctgtcctgtagctccatcagtc

SEQ ID NO: 8157809 - DNA, 22 bp, Homo sapiens
ctgtcctgtagctccatcagtc

SEQ ID NO: 8157810 - DNA, 22 bp, Homo sapiens
ctgtcctgtagctccatcagtc

SEQ ID NO: 8157811 - DNA, 22 bp, Homo sapiens
ctgtcctgtactttgaggccct

SEQ ID NO: 8157812 - DNA, 22 bp, Homo sapiens
ctgggtgagttgatgaaggaga

SEQ ID NO: 8157813 - DNA, 22 bp, Homo sapiens
ctgggtgagttgatgaaggaga

SEQ ID NO: 8157814 - DNA, 22 bp, Homo sapiens
ctgggtgattcctgtccaggca

SEQ ID NO: 8157815 - DNA, 22 bp, Homo sapiens
ctgggtgagtataggaaaggga

SEQ ID NO: 8157816 - DNA, 22 bp, Homo sapiens
ctgggtgagttgatgaaggaga

SEQ ID NO: 8157817 - DNA, 22 bp, Homo sapiens
ctgggtgacagagtgagatggt

SEQ ID NO: 8157818 - DNA, 22 bp, Homo sapiens
ctgggtgaatttgaaggaaagg

SEQ ID NO: 8157819 - DNA, 22 bp, Homo sapiens
ctgggtcttcagcagcaggcgg

SEQ ID NO: 8157820 - DNA, 19 bp, Homo sapiens
ctgggtcttattctgtgaa

SEQ ID NO: 8157821 - DNA, 22 bp, Homo sapiens
ctgggtcttcagcagcaggcgg

SEQ ID NO: 8157822 - DNA, 22 bp, Homo sapiens
ctgggtctgtgcccagggacct

SEQ ID NO: 8157823 - DNA, 22 bp, Homo sapiens
ctgggtctgtgcccagggacct

SEQ ID NO: 8157824 - DNA, 22 bp, Homo sapiens
ctgggtctgtgcccagggacct

SEQ ID NO: 8157825 - DNA, 22 bp, Homo sapiens
ctgggtgccagcatggctgagt

SEQ ID NO: 8157826 - DNA, 22 bp, Homo sapiens
ctgggtgccacgggcaccctgg

SEQ ID NO: 8157827 - DNA, 22 bp, Homo sapiens
ctgggtgccacgggcaccctgg

SEQ ID NO: 8157828 - DNA, 22 bp, Homo sapiens
ctgggtgccagcatggctgagt

SEQ ID NO: 8157829 - DNA, 22 bp, Homo sapiens
ctgggtgccagcatggctgagt

SEQ ID NO: 8157830 - DNA, 22 bp, Homo sapiens
ctgggtgcgtgagcgcatgcgt

SEQ ID NO: 8157831 - DNA, 22 bp, Homo sapiens
ctgggtgcgtgagcgcatgcgt

SEQ ID NO: 8157832 - DNA, 22 bp, Homo sapiens
ctgtccctgagcaactcctgtt

SEQ ID NO: 8157833 - DNA, 22 bp, Homo sapiens
ctgggtgctgtgggctcagagg

SEQ ID NO: 8157834 - DNA, 22 bp, Homo sapiens
ctgtccctgagcaactcctgtt

SEQ ID NO: 8157835 - DNA, 22 bp, Homo sapiens
ctgtccctgagcaactcctgtt

SEQ ID NO: 8157836 - DNA, 22 bp, Homo sapiens
ctgtccctgagcaactcctgtt

SEQ ID NO: 8157837 - DNA, 22 bp, Homo sapiens
ctgtcctgaaagggagattggg

SEQ ID NO: 8157838 - DNA, 22 bp, Homo sapiens
ctgtcctctgtcctcagcagga

SEQ ID NO: 8157839 - DNA, 22 bp, Homo sapiens
ctgtcctgaaagggagattggg

SEQ ID NO: 8157840 - DNA, 22 bp, Homo sapiens
ctgtcctgaagttttcatgaga

SEQ ID NO: 8157841 - DNA, 22 bp, Homo sapiens
ctgtcctgaagttttcatgaga

SEQ ID NO: 8157842 - DNA, 22 bp, Homo sapiens
ctgtcctgaagttttcatgaga

SEQ ID NO: 8157843 - DNA, 22 bp, Homo sapiens
ctgtcccttcattattcactac

SEQ ID NO: 8157844 - DNA, 22 bp, Homo sapiens
ctgtcctctgtcctcagcagga

SEQ ID NO: 8157845 - DNA, 22 bp, Homo sapiens
ctgtcccttcattattcactac

SEQ ID NO: 8157846 - DNA, 22 bp, Homo sapiens
ctgtcccttcattattcactac

SEQ ID NO: 8157847 - DNA, 22 bp, Homo sapiens
ctggctggagcaggcatcttgt

SEQ ID NO: 8157848 - DNA, 22 bp, Homo sapiens
ctggctggagcaggcatcttgt

SEQ ID NO: 8157849 - DNA, 22 bp, Homo sapiens
ctggctggagaaatgaaattct

SEQ ID NO: 8157850 - DNA, 22 bp, Homo sapiens
ctggctggacttgtgcatgtca

SEQ ID NO: 8157851 - DNA, 22 bp, Homo sapiens
ctggctggacttgtgcatgtca

SEQ ID NO: 8157852 - DNA, 22 bp, Homo sapiens
ctggctggacttgtgcatgtca

SEQ ID NO: 8157853 - DNA, 22 bp, Homo sapiens
ctggctggacttgtgcatgtca

SEQ ID NO: 8157854 - DNA, 22 bp, Homo sapiens
ctggctgtgcagtcttccagaa

SEQ ID NO: 8157855 - DNA, 22 bp, Homo sapiens
ctggctgtgcagtcttccagaa

SEQ ID NO: 8157856 - DNA, 22 bp, Homo sapiens
ctggctgtgcagtcttccagaa

SEQ ID NO: 8157857 - DNA, 22 bp, Homo sapiens
ctggctgcttgttttgatgggt

SEQ ID NO: 8157858 - DNA, 20 bp, Homo sapiens
ctggctggaaacttagcctt

SEQ ID NO: 8157859 - DNA, 20 bp, Homo sapiens
ctggctggaaacttagcctt

SEQ ID NO: 8157860 - DNA, 22 bp, Homo sapiens
ctggctggaacgccgaggcggc

SEQ ID NO: 8157861 - DNA, 16 bp, Homo sapiens
ctggctggaagcctgg

SEQ ID NO: 8157862 - DNA, 22 bp, Homo sapiens
ctggctggaacgccgaggcggc

SEQ ID NO: 8157863 - DNA, 22 bp, Homo sapiens
ctggctggaacgccgaggcggc

SEQ ID NO: 8157864 - DNA, 22 bp, Homo sapiens
ctggctggaacgccgaggcggc

SEQ ID NO: 8157865 - DNA, 16 bp, Homo sapiens
ctggctggaagcctgg

SEQ ID NO: 8157866 - DNA, 22 bp, Homo sapiens
ctggctggaagttagagaactt

SEQ ID NO: 8157867 - DNA, 22 bp, Homo sapiens
ctggctggaagttagagaactt

SEQ ID NO: 8157868 - DNA, 22 bp, Homo sapiens
ctggctgcgctagtccagaaga

SEQ ID NO: 8157869 - DNA, 22 bp, Homo sapiens
ctggctgcgtctgctctgacag

SEQ ID NO: 8157870 - DNA, 22 bp, Homo sapiens
ctggctgcgtctgctctgacag

SEQ ID NO: 8157871 - DNA, 22 bp, Homo sapiens
ctggctgctggcctgaggatgc

SEQ ID NO: 8157872 - DNA, 22 bp, Homo sapiens
ctggctgctggcctgaggatgc

SEQ ID NO: 8157873 - DNA, 22 bp, Homo sapiens
ctggctgcttgtagactcgact

SEQ ID NO: 8157874 - DNA, 22 bp, Homo sapiens
ctggctgcttgtagactcgact

SEQ ID NO: 8157875 - DNA, 22 bp, Homo sapiens
ctggctgcttgggacagccatg

SEQ ID NO: 8157876 - DNA, 22 bp, Homo sapiens
ctggctgcttgggacagccatg

SEQ ID NO: 8157877 - DNA, 22 bp, Homo sapiens
ctggctgcattggcaagtcaat

SEQ ID NO: 8157878 - DNA, 22 bp, Homo sapiens
ctggctgccacttcagggtctt

SEQ ID NO: 8157879 - DNA, 22 bp, Homo sapiens
ctggctgcattggcaagtcaat

SEQ ID NO: 8157880 - DNA, 22 bp, Homo sapiens
ctggctgccacttcagggtctt

SEQ ID NO: 8157881 - DNA, 22 bp, Homo sapiens
ctggctgccagcatttggggga

SEQ ID NO: 8157882 - DNA, 22 bp, Homo sapiens
ctggctgcctatagtctccctt

SEQ ID NO: 8157883 - DNA, 22 bp, Homo sapiens
ctggctgccagcatttggggga

SEQ ID NO: 8157884 - DNA, 22 bp, Homo sapiens
ctggctgccagcatttggggga

SEQ ID NO: 8157885 - DNA, 22 bp, Homo sapiens
ctggctgcctatagtctccctt

SEQ ID NO: 8157886 - DNA, 22 bp, Homo sapiens
ctggctgcctggagtgagggag

SEQ ID NO: 8157887 - DNA, 22 bp, Homo sapiens
ctggctgcctggagtgagggag

SEQ ID NO: 8157888 - DNA, 22 bp, Homo sapiens
ctggctgcctggagtgagggag

SEQ ID NO: 8157889 - DNA, 22 bp, Homo sapiens
ctggctgcagtagcaagagact

SEQ ID NO: 8157890 - DNA, 22 bp, Homo sapiens
ctggctgcagtagcaagagact

SEQ ID NO: 8157891 - DNA, 22 bp, Homo sapiens
ctggctgcaggatgaggctgcc

SEQ ID NO: 8157892 - DNA, 22 bp, Homo sapiens
ctggctgcaggatgaggctgcc

SEQ ID NO: 8157893 - DNA, 22 bp, Homo sapiens
ctggctgcaggatgaggctgcc

SEQ ID NO: 8157894 - DNA, 22 bp, Homo sapiens
ctggctgcaggaaggagtgggc

SEQ ID NO: 8157895 - DNA, 22 bp, Homo sapiens
ctggctgcaggaaggagtgggc

SEQ ID NO: 8157896 - DNA, 22 bp, Homo sapiens
ctggctcttgcgactcagcttg

SEQ ID NO: 8157897 - DNA, 22 bp, Homo sapiens
ctggctccaaggaagaggtttt

SEQ ID NO: 8157898 - DNA, 22 bp, Homo sapiens
ctggctccaaggaagaggtttt

SEQ ID NO: 8157899 - DNA, 22 bp, Homo sapiens
ctggctcttcagtgcttggttc

SEQ ID NO: 8157900 - DNA, 22 bp, Homo sapiens
ctggctcttcagtgcttggttc

SEQ ID NO: 8157901 - DNA, 21 bp, Homo sapiens
ctggctctgttgtcacccggc

SEQ ID NO: 8157902 - DNA, 22 bp, Homo sapiens
ctggctcttctgggttctgtgt

SEQ ID NO: 8157903 - DNA, 22 bp, Homo sapiens
ctggctcatccaggtgttgctc

SEQ ID NO: 8157904 - DNA, 22 bp, Homo sapiens
ctggctcatagagcagctccaa

SEQ ID NO: 8157905 - DNA, 22 bp, Homo sapiens
ctggctcatagagcagctccaa

SEQ ID NO: 8157906 - DNA, 23 bp, Homo sapiens
ctggctcatcctggttgcagtgg

SEQ ID NO: 8157907 - DNA, 23 bp, Homo sapiens
ctggctcatcctggttgcagtgg

SEQ ID NO: 8157908 - DNA, 22 bp, Homo sapiens
ctggctcatgtgatgagggcaa

SEQ ID NO: 8157909 - DNA, 22 bp, Homo sapiens
ctggctcatgtgatgagggcaa

SEQ ID NO: 8157910 - DNA, 23 bp, Homo sapiens
ctggctcatcctggttgcagtgg

SEQ ID NO: 8157911 - DNA, 22 bp, Homo sapiens
ctggctcatccaggtgttgctc

SEQ ID NO: 8157912 - DNA, 22 bp, Homo sapiens
ctggctcattttagcatcaggt

SEQ ID NO: 8157913 - DNA, 22 bp, Homo sapiens
ctggctcattttagcatcaggt

SEQ ID NO: 8157914 - DNA, 22 bp, Homo sapiens
ctggctcattttagcatcaggt

SEQ ID NO: 8157915 - DNA, 22 bp, Homo sapiens
ctggctcactagccctgccctg

SEQ ID NO: 8157916 - DNA, 22 bp, Homo sapiens
ctggctcactagccctgccctg

SEQ ID NO: 8157917 - DNA, 22 bp, Homo sapiens
ctggctcactagccctgccctg

SEQ ID NO: 8157918 - DNA, 22 bp, Homo sapiens
ctggctcacctccgctccagca

SEQ ID NO: 8157919 - DNA, 22 bp, Homo sapiens
ctggcctgtgggctgtctccgg

SEQ ID NO: 8157920 - DNA, 22 bp, Homo sapiens
ctggctcacctccgctccagca

SEQ ID NO: 8157921 - DNA, 22 bp, Homo sapiens
ctggcctgtgggctgtctccgg

SEQ ID NO: 8157922 - DNA, 22 bp, Homo sapiens
ctggcctgtcctgacccagcct

SEQ ID NO: 8157923 - DNA, 22 bp, Homo sapiens
ctggctcaggaaagttgctgct

SEQ ID NO: 8157924 - DNA, 22 bp, Homo sapiens
ctggctcaggaaagttgctgct

SEQ ID NO: 8157925 - DNA, 22 bp, Homo sapiens
ctggctcagacagctgtgcagt

SEQ ID NO: 8157926 - DNA, 22 bp, Homo sapiens
ctggctcagacagctgtgcagt

SEQ ID NO: 8157927 - DNA, 22 bp, Homo sapiens
ctggccctgtggaggcaggaac

SEQ ID NO: 8157928 - DNA, 22 bp, Homo sapiens
ctggccctgtggaggcaggaac

SEQ ID NO: 8157929 - DNA, 22 bp, Homo sapiens
ctggccctgtggaggcaggaac

SEQ ID NO: 8157930 - DNA, 22 bp, Homo sapiens
ctggccctgtcagcacagaatc

SEQ ID NO: 8157931 - DNA, 22 bp, Homo sapiens
ctggccctgtaggatgtgagtt

SEQ ID NO: 8157932 - DNA, 22 bp, Homo sapiens
ctggccctggtaaggacaccca

SEQ ID NO: 8157933 - DNA, 22 bp, Homo sapiens
ctggccctggtaaggacaccca

SEQ ID NO: 8157934 - DNA, 22 bp, Homo sapiens
ctggccctggctggagcccagg

SEQ ID NO: 8157935 - DNA, 22 bp, Homo sapiens
ctggccctggctggagcccagg

SEQ ID NO: 8157936 - DNA, 22 bp, Homo sapiens
ctggccctggagggctgtgcga

SEQ ID NO: 8157937 - DNA, 23 bp, Homo sapiens
ctggccctggctctgtgatcatg

SEQ ID NO: 8157938 - DNA, 22 bp, Homo sapiens
ctggccctcggagtccagctgc

SEQ ID NO: 8157939 - DNA, 22 bp, Homo sapiens
ctggccctcggagtccagctgc

SEQ ID NO: 8157940 - DNA, 22 bp, Homo sapiens
ctggccctcgtcagtttcactg

SEQ ID NO: 8157941 - DNA, 22 bp, Homo sapiens
ctggccctcggagtccagctgc

SEQ ID NO: 8157942 - DNA, 22 bp, Homo sapiens
ctggccctcggagtccagctgc

SEQ ID NO: 8157943 - DNA, 22 bp, Homo sapiens
ctggccctcagactcatgggca

SEQ ID NO: 8157944 - DNA, 22 bp, Homo sapiens
ctggccctcagactcatgggca

SEQ ID NO: 8157945 - DNA, 22 bp, Homo sapiens
ctggccctcagactcatgggca

SEQ ID NO: 8157946 - DNA, 22 bp, Homo sapiens
ctggccctcagactcatgggca

SEQ ID NO: 8157947 - DNA, 22 bp, Homo sapiens
ctggccctggagggctgtgcga

SEQ ID NO: 8157948 - DNA, 22 bp, Homo sapiens
ctggccctggagggctgtgcga

SEQ ID NO: 8157949 - DNA, 22 bp, Homo sapiens
ctggccctggagggctgtgcga

SEQ ID NO: 8157950 - DNA, 16 bp, Homo sapiens
ctggccctggctctgg

SEQ ID NO: 8157951 - DNA, 22 bp, Homo sapiens
ctggccctgcctaatgtacttg

SEQ ID NO: 8157952 - DNA, 22 bp, Homo sapiens
ctggccctgctccgcgccgcgg

SEQ ID NO: 8157953 - DNA, 22 bp, Homo sapiens
ctggccctgccagagatcaaca

SEQ ID NO: 8157954 - DNA, 22 bp, Homo sapiens
ctggccctatgagcctcctgat

SEQ ID NO: 8157955 - DNA, 22 bp, Homo sapiens
ctggccctattccaggccttcc

SEQ ID NO: 8157956 - DNA, 22 bp, Homo sapiens
ctggccctattccaggccttcc

SEQ ID NO: 8157957 - DNA, 22 bp, Homo sapiens
ctggccaggccccttgcagggc

SEQ ID NO: 8157958 - DNA, 22 bp, Homo sapiens
ctggcccagtctcagagtgtca

SEQ ID NO: 8157959 - DNA, 22 bp, Homo sapiens
ctggcccagtctcagagtgtca

SEQ ID NO: 8157960 - DNA, 19 bp, Homo sapiens
ctggccaggccaggggccc

SEQ ID NO: 8157961 - DNA, 19 bp, Homo sapiens
ctggccaggccaggggccc

SEQ ID NO: 8157962 - DNA, 22 bp, Homo sapiens
ctggccaggcatcccctgatcc

SEQ ID NO: 8157963 - DNA, 22 bp, Homo sapiens
ctggccaggcatcccctgatcc

SEQ ID NO: 8157964 - DNA, 22 bp, Homo sapiens
ctggccaggcatcccctgatcc

SEQ ID NO: 8157965 - DNA, 19 bp, Homo sapiens
ctggccaggccaggggccc

SEQ ID NO: 8157966 - DNA, 19 bp, Homo sapiens
ctggccaggccaggggccc

SEQ ID NO: 8157967 - DNA, 22 bp, Homo sapiens
ctggccaggccccttgcagggc

SEQ ID NO: 8157968 - DNA, 22 bp, Homo sapiens
ctggccaggccccttgcagggc

SEQ ID NO: 8157969 - DNA, 22 bp, Homo sapiens
ctggccaggccccttgcagggc

SEQ ID NO: 8157970 - DNA, 22 bp, Homo sapiens
ctggcaggatctaaccagggaa

SEQ ID NO: 8157971 - DNA, 22 bp, Homo sapiens
ctggcaggatctaaccagggaa

SEQ ID NO: 8157972 - DNA, 22 bp, Homo sapiens
ctggcaggatctaaccagggaa

SEQ ID NO: 8157973 - DNA, 22 bp, Homo sapiens
ctggcaggcaaattggtgggag

SEQ ID NO: 8157974 - DNA, 22 bp, Homo sapiens
ctggcaggcaaattggtgggag

SEQ ID NO: 8157975 - DNA, 22 bp, Homo sapiens
ctggcaggcaaattggtgggag

SEQ ID NO: 8157976 - DNA, 22 bp, Homo sapiens
ctggcaggcaaattggtgggag

SEQ ID NO: 8157977 - DNA, 22 bp, Homo sapiens
ctggcaggcactcatgaaataa

SEQ ID NO: 8157978 - DNA, 22 bp, Homo sapiens
ctggcaggcagacttctgcaag

SEQ ID NO: 8157979 - DNA, 22 bp, Homo sapiens
ctggcaggcagacttctgcaag

SEQ ID NO: 8157980 - DNA, 22 bp, Homo sapiens
ctggcaggcaaattggtgggag

SEQ ID NO: 8157981 - DNA, 22 bp, Homo sapiens
ctggcaggcaaattggtgggag

SEQ ID NO: 8157982 - DNA, 22 bp, Homo sapiens
ctggcaggcaaattggtgggag

SEQ ID NO: 8157983 - DNA, 20 bp, Homo sapiens
ctggcaggagcgagtctacc

SEQ ID NO: 8157984 - DNA, 20 bp, Homo sapiens
ctggcaggagcgagtctacc

SEQ ID NO: 8157985 - DNA, 20 bp, Homo sapiens
ctggcaggagcgagtctacc

SEQ ID NO: 8157986 - DNA, 22 bp, Homo sapiens
ctggcaggagttgggattttga

SEQ ID NO: 8157987 - DNA, 22 bp, Homo sapiens
ctggcaggatctaaccagggaa

SEQ ID NO: 8157988 - DNA, 22 bp, Homo sapiens
ctggcaggagttgggattttga

SEQ ID NO: 8157989 - DNA, 22 bp, Homo sapiens
ctggcaggagctgtggccgtag

SEQ ID NO: 8157990 - DNA, 22 bp, Homo sapiens
ctggcaggagctgtggccgtag

SEQ ID NO: 8157991 - DNA, 22 bp, Homo sapiens
ctggcaggagctgtggccgtag

SEQ ID NO: 8157992 - DNA, 22 bp, Homo sapiens
ctggcaggctctctggtcggtt

SEQ ID NO: 8157993 - DNA, 22 bp, Homo sapiens
ctggcaggctctctggtcggtt

SEQ ID NO: 8157994 - DNA, 22 bp, Homo sapiens
ctggcaggctctctggtcggtt

SEQ ID NO: 8157995 - DNA, 22 bp, Homo sapiens
ctggcaggctctctggtcggtt

SEQ ID NO: 8157996 - DNA, 22 bp, Homo sapiens
ctggccactgattcctcccctg

SEQ ID NO: 8157997 - DNA, 22 bp, Homo sapiens
ctggccacccatgcctccctga

SEQ ID NO: 8157998 - DNA, 22 bp, Homo sapiens
ctggcagggctctttgggtgct

SEQ ID NO: 8157999 - DNA, 22 bp, Homo sapiens
ctggcagggcaggggtttgtgc

SEQ ID NO: 8158000 - DNA, 22 bp, Homo sapiens
ctggcagggcaggggtttgtgc

SEQ ID NO: 8158001 - DNA, 22 bp, Homo sapiens
ctggcaggcggaggttgcagtg

SEQ ID NO: 8158002 - DNA, 22 bp, Homo sapiens
ctggcaggcggaggttgcagtg

SEQ ID NO: 8158003 - DNA, 22 bp, Homo sapiens
ctggcaggcggaggttgcagtg

SEQ ID NO: 8158004 - DNA, 22 bp, Homo sapiens
ctggcaggcggaggttgcagtg

SEQ ID NO: 8158005 - DNA, 22 bp, Homo sapiens
ctggcaggcggaggttgcagtg

SEQ ID NO: 8158006 - DNA, 22 bp, Homo sapiens
ctggcaggcggaggttgcagtg

SEQ ID NO: 8158007 - DNA, 22 bp, Homo sapiens
ctggcaggcggcagagcccagg

SEQ ID NO: 8158008 - DNA, 22 bp, Homo sapiens
ctggcaggcggcagagcccagg

SEQ ID NO: 8158009 - DNA, 22 bp, Homo sapiens
ctggcaggcggcagagcccagg

SEQ ID NO: 8158010 - DNA, 22 bp, Homo sapiens
ctggcaggcggcagagcccagg

SEQ ID NO: 8158011 - DNA, 22 bp, Homo sapiens
ctggccagctgacagcagggct

SEQ ID NO: 8158012 - DNA, 22 bp, Homo sapiens
ctggccagctgacagcagggct

SEQ ID NO: 8158013 - DNA, 22 bp, Homo sapiens
ctggccagctgacagcagggct

SEQ ID NO: 8158014 - DNA, 22 bp, Homo sapiens
ctggccagctgacagcagggct

SEQ ID NO: 8158015 - DNA, 22 bp, Homo sapiens
ctggccaggaggtaaccagatg

SEQ ID NO: 8158016 - DNA, 22 bp, Homo sapiens
ctggccaggaggtaaccagatg

SEQ ID NO: 8158017 - DNA, 22 bp, Homo sapiens
ctggccaggaggtaaccagatg

SEQ ID NO: 8158018 - DNA, 22 bp, Homo sapiens
ctggccagcctgtcgatgccct

SEQ ID NO: 8158019 - DNA, 22 bp, Homo sapiens
ctggccagcctgtcgatgccct

SEQ ID NO: 8158020 - DNA, 22 bp, Homo sapiens
ctggccagctgacagcagggct

SEQ ID NO: 8158021 - DNA, 22 bp, Homo sapiens
ctggccagcctgtcgatgccct

SEQ ID NO: 8158022 - DNA, 22 bp, Homo sapiens
ctggccagcctcccaggtaccc

SEQ ID NO: 8158023 - DNA, 22 bp, Homo sapiens
ctggccagcctcccaggtaccc

SEQ ID NO: 8158024 - DNA, 22 bp, Homo sapiens
ctggccagcctcccaggtaccc

SEQ ID NO: 8158025 - DNA, 22 bp, Homo sapiens
ctggccagagttggagggtgtg

SEQ ID NO: 8158026 - DNA, 22 bp, Homo sapiens
ctggccagagttggagggtgtg

SEQ ID NO: 8158027 - DNA, 22 bp, Homo sapiens
ctggccagagttggagggtgtg

SEQ ID NO: 8158028 - DNA, 22 bp, Homo sapiens
ctggccactgcacctcttcctt

SEQ ID NO: 8158029 - DNA, 21 bp, Homo sapiens
ctggccactgcacctcttcct

SEQ ID NO: 8158030 - DNA, 22 bp, Homo sapiens
ctggccagatgttacgtccaat

SEQ ID NO: 8158031 - DNA, 22 bp, Homo sapiens
ctggccagatgttacgtccaat

SEQ ID NO: 8158032 - DNA, 22 bp, Homo sapiens
ctggccagatgttacgtccaat

SEQ ID NO: 8158033 - DNA, 22 bp, Homo sapiens
ctggccagcatggctgaagtac

SEQ ID NO: 8158034 - DNA, 22 bp, Homo sapiens
ctggccagatgttacgtccaat

SEQ ID NO: 8158035 - DNA, 22 bp, Homo sapiens
ctggccagatgttacgtccaat

SEQ ID NO: 8158036 - DNA, 22 bp, Homo sapiens
ctggccagcatggctgaagtac

SEQ ID NO: 8158037 - DNA, 22 bp, Homo sapiens
ctggccagcatggctgaagtac

SEQ ID NO: 8158038 - DNA, 22 bp, Homo sapiens
ctggccagcatttttgctttag

SEQ ID NO: 8158039 - DNA, 22 bp, Homo sapiens
ctggccagcatttttgctttag

SEQ ID NO: 8158040 - DNA, 22 bp, Homo sapiens
ctgccagaaggttcctgctgca

SEQ ID NO: 8158041 - DNA, 22 bp, Homo sapiens
ctgccagaaggttcctgctgca

SEQ ID NO: 8158042 - DNA, 22 bp, Homo sapiens
ctgccagaagagaacaccagtt

SEQ ID NO: 8158043 - DNA, 22 bp, Homo sapiens
ctgccagaagagaacaccagtt

SEQ ID NO: 8158044 - DNA, 22 bp, Homo sapiens
ctgccagaagagaacaccagtt

SEQ ID NO: 8158045 - DNA, 22 bp, Homo sapiens
ctgccagacacgttatgctcat

SEQ ID NO: 8158046 - DNA, 22 bp, Homo sapiens
ctgccagagtacttgtaagaat

SEQ ID NO: 8158047 - DNA, 22 bp, Homo sapiens
ctgccagcaagctaccctggca

SEQ ID NO: 8158048 - DNA, 22 bp, Homo sapiens
ctgccacttactaggcatggtg

SEQ ID NO: 8158049 - DNA, 22 bp, Homo sapiens
ctgccactttcacccagtgctc

SEQ ID NO: 8158050 - DNA, 22 bp, Homo sapiens
ctgccactttcacccagtgctc

SEQ ID NO: 8158051 - DNA, 22 bp, Homo sapiens
ctgccactttcacccagtgctc

SEQ ID NO: 8158052 - DNA, 22 bp, Homo sapiens
ctgccactttcacccagtgctc

SEQ ID NO: 8158053 - DNA, 21 bp, Homo sapiens
ctgccacctgctccatcagca

SEQ ID NO: 8158054 - DNA, 22 bp, Homo sapiens
ctgccactagctttcacatctt

SEQ ID NO: 8158055 - DNA, 22 bp, Homo sapiens
ctgccaccaaatagctgcatga

SEQ ID NO: 8158056 - DNA, 22 bp, Homo sapiens
ctgccacaggggagcaggcaga

SEQ ID NO: 8158057 - DNA, 22 bp, Homo sapiens
ctgccacaggggagcaggcaga

SEQ ID NO: 8158058 - DNA, 22 bp, Homo sapiens
ctgccacaagctggccctgtgt

SEQ ID NO: 8158059 - DNA, 22 bp, Homo sapiens
ctgccaagtaatgcctgggctc

SEQ ID NO: 8158060 - DNA, 22 bp, Homo sapiens
ctgccaccatgccccagcagag

SEQ ID NO: 8158061 - DNA, 22 bp, Homo sapiens
ctgccaccatgccccagcagag

SEQ ID NO: 8158062 - DNA, 22 bp, Homo sapiens
ctgcatccatctcctagcacag

SEQ ID NO: 8158063 - DNA, 22 bp, Homo sapiens
ctgcatccatgttgctgcaaag

SEQ ID NO: 8158064 - DNA, 22 bp, Homo sapiens
ctgccaaggctggggaggacaa

SEQ ID NO: 8158065 - DNA, 22 bp, Homo sapiens
ctgccaaggctggggaggacaa

SEQ ID NO: 8158066 - DNA, 22 bp, Homo sapiens
ctgccaaggctggggaggacaa

SEQ ID NO: 8158067 - DNA, 22 bp, Homo sapiens
ctgcatccatgttgctgcaaag

SEQ ID NO: 8158068 - DNA, 22 bp, Homo sapiens
ctgccagcagaggccagcgctg

SEQ ID NO: 8158069 - DNA, 22 bp, Homo sapiens
ctgccagcagaggccagcgctg

SEQ ID NO: 8158070 - DNA, 22 bp, Homo sapiens
ctgccagcagaggccagcgctg

SEQ ID NO: 8158071 - DNA, 22 bp, Homo sapiens
ctgccagctagctcctagttga

SEQ ID NO: 8158072 - DNA, 22 bp, Homo sapiens
ctgccagccaggccaggtaggc

SEQ ID NO: 8158073 - DNA, 22 bp, Homo sapiens
ctgccagccaggccaggtaggc

SEQ ID NO: 8158074 - DNA, 22 bp, Homo sapiens
ctgccagcagaggccagcgctg

SEQ ID NO: 8158075 - DNA, 22 bp, Homo sapiens
ctgccagcactgcctcctgagg

SEQ ID NO: 8158076 - DNA, 22 bp, Homo sapiens
ctgccagcactgcctcctgagg

SEQ ID NO: 8158077 - DNA, 22 bp, Homo sapiens
ctgccagcactgcctcctgagg

SEQ ID NO: 8158078 - DNA, 22 bp, Homo sapiens
ctgccagcaagctaccctggca

SEQ ID NO: 8158079 - DNA, 22 bp, Homo sapiens
ctgccagctctctggaggctct

SEQ ID NO: 8158080 - DNA, 22 bp, Homo sapiens
ctggcagccaagtgggatactc

SEQ ID NO: 8158081 - DNA, 22 bp, Homo sapiens
ctggcagccaagtgggatactc

SEQ ID NO: 8158082 - DNA, 22 bp, Homo sapiens
ctggcagcccaacctagagtct

SEQ ID NO: 8158083 - DNA, 22 bp, Homo sapiens
ctgccagctcaaagcgcagcta

SEQ ID NO: 8158084 - DNA, 22 bp, Homo sapiens
ctgccagctcaaagcgcagcta

SEQ ID NO: 8158085 - DNA, 19 bp, Homo sapiens
ctggcagcctgtctgtgtc

SEQ ID NO: 8158086 - DNA, 22 bp, Homo sapiens
ctggcagcccaacctagagtct

SEQ ID NO: 8158087 - DNA, 22 bp, Homo sapiens
ctggcagcccaacctagagtct

SEQ ID NO: 8158088 - DNA, 19 bp, Homo sapiens
ctggcagcctgtctgtgtc

SEQ ID NO: 8158089 - DNA, 19 bp, Homo sapiens
ctggcagcctgtctgtgtc

SEQ ID NO: 8158090 - DNA, 22 bp, Homo sapiens
ctggcagcttcaggacactcgg

SEQ ID NO: 8158091 - DNA, 22 bp, Homo sapiens
ctggcagcttcaggacactcgg

SEQ ID NO: 8158092 - DNA, 22 bp, Homo sapiens
ctggcagcttcaggacactcgg

SEQ ID NO: 8158093 - DNA, 22 bp, Homo sapiens
ctggcagcttcctttgcatctg

SEQ ID NO: 8158094 - DNA, 22 bp, Homo sapiens
ctggcaggaagaggaaaggtca

SEQ ID NO: 8158095 - DNA, 22 bp, Homo sapiens
ctggcaggaagaggaaaggtca

SEQ ID NO: 8158096 - DNA, 22 bp, Homo sapiens
ctggcaggaagaggaaaggtca

SEQ ID NO: 8158097 - DNA, 22 bp, Homo sapiens
ctggcagcttcctttgcatctg

SEQ ID NO: 8158098 - DNA, 22 bp, Homo sapiens
ctggcaggaagaggaaaggtca

SEQ ID NO: 8158099 - DNA, 22 bp, Homo sapiens
ctggcaggaagaggaaaggtca

SEQ ID NO: 8158100 - DNA, 22 bp, Homo sapiens
ctggcaggaaggcatttagaca

SEQ ID NO: 8158101 - DNA, 22 bp, Homo sapiens
ctggcaggaagttagatggtaa

SEQ ID NO: 8158102 - DNA, 22 bp, Homo sapiens
ctggcaggaagttagatggtaa

SEQ ID NO: 8158103 - DNA, 22 bp, Homo sapiens
ctggcaggaagttagatggtaa

SEQ ID NO: 8158104 - DNA, 22 bp, Homo sapiens
ctggcaggaagttagatggtaa

SEQ ID NO: 8158105 - DNA, 22 bp, Homo sapiens
ctggcaggaagttagatggtaa

SEQ ID NO: 8158106 - DNA, 22 bp, Homo sapiens
ctggcaggagcattcacagagg

SEQ ID NO: 8158107 - DNA, 22 bp, Homo sapiens
ctggcaggagcattcacagagg

SEQ ID NO: 8158108 - DNA, 22 bp, Homo sapiens
ctggcaggagcattcacagagg

SEQ ID NO: 8158109 - DNA, 19 bp, Homo sapiens
ctgggccagagctgtcctc

SEQ ID NO: 8158110 - DNA, 18 bp, Homo sapiens
ctgggccagagtttctgc

SEQ ID NO: 8158111 - DNA, 19 bp, Homo sapiens
ctgggccagagctgtcctc

SEQ ID NO: 8158112 - DNA, 22 bp, Homo sapiens
ctgggctctgcagttgatgttt

SEQ ID NO: 8158113 - DNA, 22 bp, Homo sapiens
ctgggctctaggaaccattcct

SEQ ID NO: 8158114 - DNA, 22 bp, Homo sapiens
ctgggctctgcagttgatgttt

SEQ ID NO: 8158115 - DNA, 22 bp, Homo sapiens
ctgggctctgcagttgatgttt

SEQ ID NO: 8158116 - DNA, 22 bp, Homo sapiens
ctgggctctgcggtgtcgctct

SEQ ID NO: 8158117 - DNA, 22 bp, Homo sapiens
ctgggccagatccagcctcaca

SEQ ID NO: 8158118 - DNA, 22 bp, Homo sapiens
ctgggccagatccagcctcaca

SEQ ID NO: 8158119 - DNA, 22 bp, Homo sapiens
ctgggccagatccagcctcaca

SEQ ID NO: 8158120 - DNA, 22 bp, Homo sapiens
ctgggccagatccagcctcaca

SEQ ID NO: 8158121 - DNA, 22 bp, Homo sapiens
ctgggctgcaggagtggggcaa

SEQ ID NO: 8158122 - DNA, 22 bp, Homo sapiens
ctgggctgcaggagtggggcaa

SEQ ID NO: 8158123 - DNA, 22 bp, Homo sapiens
ctgggctgcaggagtggggcaa

SEQ ID NO: 8158124 - DNA, 22 bp, Homo sapiens
ctgggctgcaggagtggggcaa

SEQ ID NO: 8158125 - DNA, 22 bp, Homo sapiens
ctgggctgcaggagtggggcaa

SEQ ID NO: 8158126 - DNA, 22 bp, Homo sapiens
ctgggctgcagcgggagcgacg

SEQ ID NO: 8158127 - DNA, 22 bp, Homo sapiens
ctgggctgcagcgggagcgacg

SEQ ID NO: 8158128 - DNA, 22 bp, Homo sapiens
ctgggctgcagcgggagcgacg

SEQ ID NO: 8158129 - DNA, 22 bp, Homo sapiens
ctgggctctgcagttgatgttt

SEQ ID NO: 8158130 - DNA, 22 bp, Homo sapiens
ctgggctgcagcgggagcgacg

SEQ ID NO: 8158131 - DNA, 22 bp, Homo sapiens
ctgggctgcaggcactaattgg

SEQ ID NO: 8158132 - DNA, 22 bp, Homo sapiens
ctgggctgcaggagtggggcaa

SEQ ID NO: 8158133 - DNA, 22 bp, Homo sapiens
ctgggctgcagttcctggtcct

SEQ ID NO: 8158134 - DNA, 22 bp, Homo sapiens
ctgggctgcagttcctggtcct

SEQ ID NO: 8158135 - DNA, 22 bp, Homo sapiens
ctgggctgcatcaaagaggcat

SEQ ID NO: 8158136 - DNA, 22 bp, Homo sapiens
ctgggctgcatcaaagaggcat

SEQ ID NO: 8158137 - DNA, 22 bp, Homo sapiens
ctgggctgcatcaaagaggcat

SEQ ID NO: 8158138 - DNA, 22 bp, Homo sapiens
ctgggctgcatcaaagaggcat

SEQ ID NO: 8158139 - DNA, 22 bp, Homo sapiens
ctgggctgctgtccactagggt

SEQ ID NO: 8158140 - DNA, 22 bp, Homo sapiens
ctgggctgctgtccactagggt

SEQ ID NO: 8158141 - DNA, 22 bp, Homo sapiens
ctgggctgctgtccactagggt

SEQ ID NO: 8158142 - DNA, 22 bp, Homo sapiens
ctgggctgcttgctgaaggggt

SEQ ID NO: 8158143 - DNA, 22 bp, Homo sapiens
ctgggctgcttgctgaaggggt

SEQ ID NO: 8158144 - DNA, 22 bp, Homo sapiens
ctgggctgcttgctgaaggggt

SEQ ID NO: 8158145 - DNA, 23 bp, Homo sapiens
ctgggctgcttgagtccctggct

SEQ ID NO: 8158146 - DNA, 23 bp, Homo sapiens
ctgggctgcttgagtccctggct

SEQ ID NO: 8158147 - DNA, 23 bp, Homo sapiens
ctgggctgcttgagtccctggct

SEQ ID NO: 8158148 - DNA, 20 bp, Homo sapiens
ctggggaggaggatgtgttc

SEQ ID NO: 8158149 - DNA, 20 bp, Homo sapiens
ctggggaggaggatgtgttc

SEQ ID NO: 8158150 - DNA, 20 bp, Homo sapiens
ctggggaggaggatgtgttc

SEQ ID NO: 8158151 - DNA, 22 bp, Homo sapiens
ctgggctggacacacttaacct

SEQ ID NO: 8158152 - DNA, 22 bp, Homo sapiens
ctgggctggacacacttaacct

SEQ ID NO: 8158153 - DNA, 22 bp, Homo sapiens
ctgggctgcttgctgaaggggt

SEQ ID NO: 8158154 - DNA, 22 bp, Homo sapiens
ctgggctgcttgctgaaggggt

SEQ ID NO: 8158155 - DNA, 22 bp, Homo sapiens
ctgggctgcttgctgaaggggt

SEQ ID NO: 8158156 - DNA, 22 bp, Homo sapiens
ctgggctgcgggcgcccctcca

SEQ ID NO: 8158157 - DNA, 22 bp, Homo sapiens
ctgggctgcgggcgcccctcca

SEQ ID NO: 8158158 - DNA, 22 bp, Homo sapiens
ctgggctgcgggcgcccctcca

SEQ ID NO: 8158159 - DNA, 22 bp, Homo sapiens
ctgggctgcggtggtaggttgt

SEQ ID NO: 8158160 - DNA, 22 bp, Homo sapiens
ctgggctgcggtggtaggttgt

SEQ ID NO: 8158161 - DNA, 22 bp, Homo sapiens
ctgggctgcgggcgcccctcca

SEQ ID NO: 8158162 - DNA, 22 bp, Homo sapiens
ctgggctgcggtggtaggttgt

SEQ ID NO: 8158163 - DNA, 22 bp, Homo sapiens
ctgggctgctgtccactagggt

SEQ ID NO: 8158164 - DNA, 22 bp, Homo sapiens
ctgggctgctcagccccctcgc

SEQ ID NO: 8158165 - DNA, 22 bp, Homo sapiens
ctgggctgctcagccccctcgc

SEQ ID NO: 8158166 - DNA, 22 bp, Homo sapiens
ctgggctgctcagccccctcgc

SEQ ID NO: 8158167 - DNA, 22 bp, Homo sapiens
ctgggctgcggttctctgaagc

SEQ ID NO: 8158168 - DNA, 20 bp, Homo sapiens
ctgggctgcccagctatggg

SEQ ID NO: 8158169 - DNA, 20 bp, Homo sapiens
ctgggctgcccagctatggg

SEQ ID NO: 8158170 - DNA, 20 bp, Homo sapiens
ctgggctgcccagctatggg

SEQ ID NO: 8158171 - DNA, 20 bp, Homo sapiens
ctgggctgcccagctatggg

SEQ ID NO: 8158172 - DNA, 20 bp, Homo sapiens
ctgggctgcccagctatggg

SEQ ID NO: 8158173 - DNA, 22 bp, Homo sapiens
ctgggctgccaggtaggcacac

SEQ ID NO: 8158174 - DNA, 20 bp, Homo sapiens
ctgggctgcccagctatggg

SEQ ID NO: 8158175 - DNA, 22 bp, Homo sapiens
ctgggctgccaggtaggcacac

SEQ ID NO: 8158176 - DNA, 22 bp, Homo sapiens
ctgggctgccaggtaggcacac

SEQ ID NO: 8158177 - DNA, 22 bp, Homo sapiens
ctgggctgcatcaaagaggcat

SEQ ID NO: 8158178 - DNA, 22 bp, Homo sapiens
ctgggctgcatcaaagaggcat

SEQ ID NO: 8158179 - DNA, 22 bp, Homo sapiens
ctgggctgccaggtaggcacac

SEQ ID NO: 8158180 - DNA, 22 bp, Homo sapiens
ctgggctgccaggtaggcacac

SEQ ID NO: 8158181 - DNA, 22 bp, Homo sapiens
ctggggctgcggacgggagccc

SEQ ID NO: 8158182 - DNA, 22 bp, Homo sapiens
ctggggctgcggacgggagccc

SEQ ID NO: 8158183 - DNA, 22 bp, Homo sapiens
ctggggctgcagcgatcttcat

SEQ ID NO: 8158184 - DNA, 22 bp, Homo sapiens
ctggggctgcagcgatcttcat

SEQ ID NO: 8158185 - DNA, 22 bp, Homo sapiens
ctggggctgcagcgatcttcat

SEQ ID NO: 8158186 - DNA, 22 bp, Homo sapiens
ctggggctgcggtggaggagcc

SEQ ID NO: 8158187 - DNA, 22 bp, Homo sapiens
ctggggctgcggacgggagccc

SEQ ID NO: 8158188 - DNA, 22 bp, Homo sapiens
ctggggctgcagcgatcttcat

SEQ ID NO: 8158189 - DNA, 22 bp, Homo sapiens
ctggggctgcggacgggagccc

SEQ ID NO: 8158190 - DNA, 22 bp, Homo sapiens
ctggggtgtgctcagagcaggg

SEQ ID NO: 8158191 - DNA, 22 bp, Homo sapiens
ctggggctgcggtggaggagcc

SEQ ID NO: 8158192 - DNA, 22 bp, Homo sapiens
ctggggctgcggtggaggagcc

SEQ ID NO: 8158193 - DNA, 22 bp, Homo sapiens
ctggggctgcggtggaggagcc

SEQ ID NO: 8158194 - DNA, 22 bp, Homo sapiens
ctggggtgtgctcagagcaggg

SEQ ID NO: 8158195 - DNA, 22 bp, Homo sapiens
ctggggtgtgctcagagcaggg

SEQ ID NO: 8158196 - DNA, 22 bp, Homo sapiens
ctggggtgtgctcagagcaggg

SEQ ID NO: 8158197 - DNA, 22 bp, Homo sapiens
ctggggtgtgctcagagcaggg

SEQ ID NO: 8158198 - DNA, 22 bp, Homo sapiens
ctggggtgtgctcagagcaggg

SEQ ID NO: 8158199 - DNA, 22 bp, Homo sapiens
ctggggtgtgctcagagcaggg

SEQ ID NO: 8158200 - DNA, 22 bp, Homo sapiens
ctgggtctggccacaggaagta

SEQ ID NO: 8158201 - DNA, 22 bp, Homo sapiens
ctgggtctggaggccaagggtg

SEQ ID NO: 8158202 - DNA, 22 bp, Homo sapiens
ctgggtctccggcagcctcggg

SEQ ID NO: 8158203 - DNA, 22 bp, Homo sapiens
ctgggtctccggcagcctcggg

SEQ ID NO: 8158204 - DNA, 22 bp, Homo sapiens
ctgggtctccggcagcctcggg

SEQ ID NO: 8158205 - DNA, 22 bp, Homo sapiens
ctggggttggccagggccctag

SEQ ID NO: 8158206 - DNA, 22 bp, Homo sapiens
ctgggtctccggcagcctcggg

SEQ ID NO: 8158207 - DNA, 22 bp, Homo sapiens
ctgggtctggtgtcaggcgacg

SEQ ID NO: 8158208 - DNA, 22 bp, Homo sapiens
ctgggtctggtgtcaggcgacg

SEQ ID NO: 8158209 - DNA, 22 bp, Homo sapiens
ctgggtctggtgtcaggcgacg

SEQ ID NO: 8158210 - DNA, 22 bp, Homo sapiens
ctgggtctggccacaggaagta

SEQ ID NO: 8158211 - DNA, 22 bp, Homo sapiens
ctggggccacaacggcgcacgc

SEQ ID NO: 8158212 - DNA, 22 bp, Homo sapiens
ctggggccagtgaggaggcttt

SEQ ID NO: 8158213 - DNA, 22 bp, Homo sapiens
ctggggccacaacggcgcacgc

SEQ ID NO: 8158214 - DNA, 22 bp, Homo sapiens
ctggggcattgggagaggcctg

SEQ ID NO: 8158215 - DNA, 22 bp, Homo sapiens
ctggggcattgggagaggcctg

SEQ ID NO: 8158216 - DNA, 22 bp, Homo sapiens
ctggggcattgggagaggcctg

SEQ ID NO: 8158217 - DNA, 22 bp, Homo sapiens
ctggggcattgggagaggcctg

SEQ ID NO: 8158218 - DNA, 22 bp, Homo sapiens
ctggggcccatcgagggctgag

SEQ ID NO: 8158219 - DNA, 22 bp, Homo sapiens
ctggggcccatcgagggctgag

SEQ ID NO: 8158220 - DNA, 22 bp, Homo sapiens
ctggggcccatcgagggctgag

SEQ ID NO: 8158221 - DNA, 22 bp, Homo sapiens
ctggggccagtgaggaggcttt

SEQ ID NO: 8158222 - DNA, 22 bp, Homo sapiens
ctggggctctctggaatgcttg

SEQ ID NO: 8158223 - DNA, 22 bp, Homo sapiens
ctggggctctctggaatgcttg

SEQ ID NO: 8158224 - DNA, 22 bp, Homo sapiens
ctggggctctctggaatgcttg

SEQ ID NO: 8158225 - DNA, 22 bp, Homo sapiens
ctggggctgcagcgatcttcat

SEQ ID NO: 8158226 - DNA, 23 bp, Homo sapiens
ctggggctcattgcagtagccat

SEQ ID NO: 8158227 - DNA, 22 bp, Homo sapiens
ctggggctcactttggtcaggc

SEQ ID NO: 8158228 - DNA, 22 bp, Homo sapiens
ctggggctcactttggtcaggc

SEQ ID NO: 8158229 - DNA, 22 bp, Homo sapiens
ctggggctcactttggtcaggc

SEQ ID NO: 8158230 - DNA, 22 bp, Homo sapiens
ctggggctcactttggtcaggc

SEQ ID NO: 8158231 - DNA, 22 bp, Homo sapiens
ctggggcccgagccttgggcca

SEQ ID NO: 8158232 - DNA, 22 bp, Homo sapiens
ctggggcccgagccttgggcca

SEQ ID NO: 8158233 - DNA, 22 bp, Homo sapiens
ctggggccctgggtctgccctc

SEQ ID NO: 8158234 - DNA, 22 bp, Homo sapiens
ctggggccctgggtctgccctc

SEQ ID NO: 8158235 - DNA, 22 bp, Homo sapiens
ctggggctcactttggtcaggc

SEQ ID NO: 8158236 - DNA, 22 bp, Homo sapiens
ctggggctcactccagccctgg

SEQ ID NO: 8158237 - DNA, 22 bp, Homo sapiens
ctgggaggcaccgcgtcgtgct

SEQ ID NO: 8158238 - DNA, 22 bp, Homo sapiens
ctgggaggcaccgcgtcgtgct

SEQ ID NO: 8158239 - DNA, 22 bp, Homo sapiens
ctgggagctgaggctgacgctg

SEQ ID NO: 8158240 - DNA, 22 bp, Homo sapiens
ctgggaggattcattgaggtga

SEQ ID NO: 8158241 - DNA, 22 bp, Homo sapiens
ctgggaggattcattgaggtga

SEQ ID NO: 8158242 - DNA, 22 bp, Homo sapiens
ctgggaggattcattgaggtga

SEQ ID NO: 8158243 - DNA, 22 bp, Homo sapiens
ctgggaagaaattgtgggaggc

SEQ ID NO: 8158244 - DNA, 22 bp, Homo sapiens
ctgggaagaaattgtgggaggc

SEQ ID NO: 8158245 - DNA, 22 bp, Homo sapiens
ctgggagctagctctgagctga

SEQ ID NO: 8158246 - DNA, 22 bp, Homo sapiens
ctgggagctagctctgagctga

SEQ ID NO: 8158247 - DNA, 22 bp, Homo sapiens
ctgggagctcagccctggggtg

SEQ ID NO: 8158248 - DNA, 22 bp, Homo sapiens
ctgggagctcagccctggggtg

SEQ ID NO: 8158249 - DNA, 22 bp, Homo sapiens
ctgggagctcagccctggggtg

SEQ ID NO: 8158250 - DNA, 22 bp, Homo sapiens
ctgggaactgtactgccttgaa

SEQ ID NO: 8158251 - DNA, 22 bp, Homo sapiens
ctggcttttgcaggtgttgcta

SEQ ID NO: 8158252 - DNA, 22 bp, Homo sapiens
ctggcttttggaaacaggctca

SEQ ID NO: 8158253 - DNA, 22 bp, Homo sapiens
ctggcttttcaaactgttcagt

SEQ ID NO: 8158254 - DNA, 22 bp, Homo sapiens
ctggctttgtatagttccctga

SEQ ID NO: 8158255 - DNA, 22 bp, Homo sapiens
ctggctttggtcatgtgatcat

SEQ ID NO: 8158256 - DNA, 22 bp, Homo sapiens
ctggctttacctcactggggct

SEQ ID NO: 8158257 - DNA, 22 bp, Homo sapiens
ctggcttggcttattcatggaa

SEQ ID NO: 8158258 - DNA, 22 bp, Homo sapiens
ctggcttggcttattcatggaa

SEQ ID NO: 8158259 - DNA, 22 bp, Homo sapiens
ctggcttgcagctcatcataaa

SEQ ID NO: 8158260 - DNA, 22 bp, Homo sapiens
ctggctgtgctggagttgagga

SEQ ID NO: 8158261 - DNA, 22 bp, Homo sapiens
ctggctgtgctggagttgagga

SEQ ID NO: 8158262 - DNA, 22 bp, Homo sapiens
ctggctgtgctgcaggctttgg

SEQ ID NO: 8158263 - DNA, 22 bp, Homo sapiens
ctggctgtgctgcaggctttgg

SEQ ID NO: 8158264 - DNA, 22 bp, Homo sapiens
ctggctgtgctgactgagaggg

SEQ ID NO: 8158265 - DNA, 22 bp, Homo sapiens
ctggctgtgctgactgagaggg

SEQ ID NO: 8158266 - DNA, 22 bp, Homo sapiens
ctggctttcattcattcaggcc

SEQ ID NO: 8158267 - DNA, 22 bp, Homo sapiens
ctggctttaggttggagagctg

SEQ ID NO: 8158268 - DNA, 22 bp, Homo sapiens
ctggctttcatttcaagcacgt

SEQ ID NO: 8158269 - DNA, 22 bp, Homo sapiens
ctggctttgaaggtctttccta

SEQ ID NO: 8158270 - DNA, 18 bp, Homo sapiens
ctggctttcttatccatc

SEQ ID NO: 8158271 - DNA, 22 bp, Homo sapiens
ctggctttgaaatgcatttcag

SEQ ID NO: 8158272 - DNA, 22 bp, Homo sapiens
ctggctttgctggactgggagt

SEQ ID NO: 8158273 - DNA, 22 bp, Homo sapiens
ctggctttctatttggtgctat

SEQ ID NO: 8158274 - DNA, 22 bp, Homo sapiens
ctggctttctctgtggtgttca

SEQ ID NO: 8158275 - DNA, 22 bp, Homo sapiens
ctggctttctgcacagaattgg

SEQ ID NO: 8158276 - DNA, 22 bp, Homo sapiens
ctggctttctgcaaatctccat

SEQ ID NO: 8158277 - DNA, 22 bp, Homo sapiens
ctgggaggcggagcttgcagtg

SEQ ID NO: 8158278 - DNA, 22 bp, Homo sapiens
ctgggcaggagaggtggttgga

SEQ ID NO: 8158279 - DNA, 22 bp, Homo sapiens
ctgggaggcggagcttgcagtg

SEQ ID NO: 8158280 - DNA, 22 bp, Homo sapiens
ctgggcaggagaggtggttgga

SEQ ID NO: 8158281 - DNA, 22 bp, Homo sapiens
ctgggaggcggagcttgcagtg

SEQ ID NO: 8158282 - DNA, 22 bp, Homo sapiens
ctgggaggcggagcttgcagtg

SEQ ID NO: 8158283 - DNA, 22 bp, Homo sapiens
ctgggaggcggagcttgcagtg

SEQ ID NO: 8158284 - DNA, 22 bp, Homo sapiens
ctgggaggcggagcttgcagtg

SEQ ID NO: 8158285 - DNA, 22 bp, Homo sapiens
ctgggaggcggagcttgcagtg

SEQ ID NO: 8158286 - DNA, 22 bp, Homo sapiens
ctgggaggcagtctctctagaa

SEQ ID NO: 8158287 - DNA, 22 bp, Homo sapiens
ctgggaggcccacgttgggaag

SEQ ID NO: 8158288 - DNA, 22 bp, Homo sapiens
ctgggaggcccacgttgggaag

SEQ ID NO: 8158289 - DNA, 22 bp, Homo sapiens
ctgggaggcccacgttgggaag

SEQ ID NO: 8158290 - DNA, 22 bp, Homo sapiens
ctgggaggcagaggttgcagtg

SEQ ID NO: 8158291 - DNA, 22 bp, Homo sapiens
ctgggaggcagaggttgcagtg

SEQ ID NO: 8158292 - DNA, 22 bp, Homo sapiens
ctgggaggcactattcaggagg

SEQ ID NO: 8158293 - DNA, 22 bp, Homo sapiens
ctgggaggcactattcaggagg

SEQ ID NO: 8158294 - DNA, 22 bp, Homo sapiens
ctgggaggcactattcaggagg

SEQ ID NO: 8158295 - DNA, 22 bp, Homo sapiens
ctgggaggcactattcaggagg

SEQ ID NO: 8158296 - DNA, 22 bp, Homo sapiens
ctgggaggcactattcaggagg

SEQ ID NO: 8158297 - DNA, 22 bp, Homo sapiens
ctgggaggcagaggttgtagtg

SEQ ID NO: 8158298 - DNA, 22 bp, Homo sapiens
ctgggaggcagaggttgcagtg

SEQ ID NO: 8158299 - DNA, 22 bp, Homo sapiens
ctgggaggcagaggttgcagtg

SEQ ID NO: 8158300 - DNA, 22 bp, Homo sapiens
ctgggaggcagtctctctagaa

SEQ ID NO: 8158301 - DNA, 22 bp, Homo sapiens
ctgggaggcagtctctctagaa

SEQ ID NO: 8158302 - DNA, 22 bp, Homo sapiens
ctgggaggcagtctctctagaa

SEQ ID NO: 8158303 - DNA, 22 bp, Homo sapiens
ctgggaggcagaggttgtagtg

SEQ ID NO: 8158304 - DNA, 22 bp, Homo sapiens
ctgggaggcagaggttgtagtg

SEQ ID NO: 8158305 - DNA, 22 bp, Homo sapiens
ctgggccagaagacatttagga

SEQ ID NO: 8158306 - DNA, 22 bp, Homo sapiens
ctgggccactccagatgcccac

SEQ ID NO: 8158307 - DNA, 22 bp, Homo sapiens
ctgggccacttcctcaggggaa

SEQ ID NO: 8158308 - DNA, 22 bp, Homo sapiens
ctgggccacaagcctgtgtgat

SEQ ID NO: 8158309 - DNA, 22 bp, Homo sapiens
ctgggccacaagcctgtgtgat

SEQ ID NO: 8158310 - DNA, 22 bp, Homo sapiens
ctgggccacaaaaaactcctgt

SEQ ID NO: 8158311 - DNA, 22 bp, Homo sapiens
ctgggccacaaaaaactcctgt

SEQ ID NO: 8158312 - DNA, 22 bp, Homo sapiens
ctgggccacatcagatgaagac

SEQ ID NO: 8158313 - DNA, 22 bp, Homo sapiens
ctgggccacagactcaaggcag

SEQ ID NO: 8158314 - DNA, 22 bp, Homo sapiens
ctgggccacagactcaaggcag

SEQ ID NO: 8158315 - DNA, 22 bp, Homo sapiens
ctgggcaggagggctctatgga

SEQ ID NO: 8158316 - DNA, 22 bp, Homo sapiens
ctgggcagtttattcagttctg

SEQ ID NO: 8158317 - DNA, 22 bp, Homo sapiens
ctgggcagtttattcagttctg

SEQ ID NO: 8158318 - DNA, 22 bp, Homo sapiens
ctgggcatgaaaaggatgccag

SEQ ID NO: 8158319 - DNA, 22 bp, Homo sapiens
ctgggcatatacgtgcaagtca

SEQ ID NO: 8158320 - DNA, 22 bp, Homo sapiens
ctgggcatggacagctgcacag

SEQ ID NO: 8158321 - DNA, 23 bp, Homo sapiens
ctgggcatggagcttcagaggct

SEQ ID NO: 8158322 - DNA, 23 bp, Homo sapiens
ctgggcatggagcttcagaggct

SEQ ID NO: 8158323 - DNA, 23 bp, Homo sapiens
ctgggcatggagcttcagaggct

SEQ ID NO: 8158324 - DNA, 22 bp, Homo sapiens
ctgggccacaaaaaactcctgt

SEQ ID NO: 8158325 - DNA, 22 bp, Homo sapiens
ttcagatatcattaatttagta

SEQ ID NO: 8158326 - DNA, 22 bp, Homo sapiens
ttcagatatcattaatttagta

SEQ ID NO: 8158327 - DNA, 22 bp, Homo sapiens
ttcagattttttaataggtaat

SEQ ID NO: 8158328 - DNA, 22 bp, Homo sapiens
ttcagcaaaatatctcagatag

SEQ ID NO: 8158329 - DNA, 22 bp, Homo sapiens
ttcagcaaacacgatgcttgtt

SEQ ID NO: 8158330 - DNA, 22 bp, Homo sapiens
ttcaggattatactctcttccc

SEQ ID NO: 8158331 - DNA, 22 bp, Homo sapiens
cggtcaggtgcagcgttggcac

SEQ ID NO: 8158332 - DNA, 22 bp, Homo sapiens
cgggggagttgaggcacatggg

SEQ ID NO: 8158333 - DNA, 22 bp, Homo sapiens
cggtcaggtgcagcgttggcac

SEQ ID NO: 8158334 - DNA, 22 bp, Homo sapiens
ttcagggcatgagggacacatc

SEQ ID NO: 8158335 - DNA, 22 bp, Homo sapiens
ttcagggcagctagaaccagga

SEQ ID NO: 8158336 - DNA, 22 bp, Homo sapiens
ttcagggcagacagaagagatg

SEQ ID NO: 8158337 - DNA, 22 bp, Homo sapiens
ttcagggcagacagaagagatg

SEQ ID NO: 8158338 - DNA, 22 bp, Homo sapiens
ttcagggcagacagaagagatg

SEQ ID NO: 8158339 - DNA, 22 bp, Homo sapiens
ttcagggacttagtgtcagttt

SEQ ID NO: 8158340 - DNA, 22 bp, Homo sapiens
ttcagggagagcgggacgggtg

SEQ ID NO: 8158341 - DNA, 22 bp, Homo sapiens
ttcagggagagcgggacgggtg

SEQ ID NO: 8158342 - DNA, 22 bp, Homo sapiens
ttcagggagagcgggacgggtg

SEQ ID NO: 8158343 - DNA, 22 bp, Homo sapiens
ttcaggcccagcacagcgcgtg

SEQ ID NO: 8158344 - DNA, 22 bp, Homo sapiens
ttcaggcccaacgcacagcttc

SEQ ID NO: 8158345 - DNA, 22 bp, Homo sapiens
ttcagataaactacaaataatt

SEQ ID NO: 8158346 - DNA, 22 bp, Homo sapiens
ttcagataaattgttttgtgat

SEQ ID NO: 8158347 - DNA, 22 bp, Homo sapiens
ttcagagtcagggatctcagag

SEQ ID NO: 8158348 - DNA, 22 bp, Homo sapiens
ttcagagggttcagagggttcg

SEQ ID NO: 8158349 - DNA, 22 bp, Homo sapiens
ttcagagggttttagggtcaga

SEQ ID NO: 8158350 - DNA, 20 bp, Homo sapiens
ttcagaggtgaagttgtggt

SEQ ID NO: 8158351 - DNA, 22 bp, Homo sapiens
ttcagaggtaagggtctcagaa

SEQ ID NO: 8158352 - DNA, 22 bp, Homo sapiens
ttcagagtaggatactagctta

SEQ ID NO: 8158353 - DNA, 21 bp, Homo sapiens
ttcagaggatgccaaggtcca

SEQ ID NO: 8158354 - DNA, 22 bp, Homo sapiens
ttcagaggctctgccaatgtgt

SEQ ID NO: 8158355 - DNA, 22 bp, Homo sapiens
ttcagagggacattcaagggaa

SEQ ID NO: 8158356 - DNA, 22 bp, Homo sapiens
ttcagaaagtgaatcttgttat

SEQ ID NO: 8158357 - DNA, 22 bp, Homo sapiens
ttcacagacattgcagactgaa

SEQ ID NO: 8158358 - DNA, 22 bp, Homo sapiens
ttcacacagcaactgtatgaat

SEQ ID NO: 8158359 - DNA, 22 bp, Homo sapiens
ttcacactgtttttcatagtgg

SEQ ID NO: 8158360 - DNA, 22 bp, Homo sapiens
ttcacactgtcccgggtggaaa

SEQ ID NO: 8158361 - DNA, 22 bp, Homo sapiens
ttcacagaagaggtcacatttc

SEQ ID NO: 8158362 - DNA, 22 bp, Homo sapiens
ttcacacttgttaggatggctt

SEQ ID NO: 8158363 - DNA, 22 bp, Homo sapiens
ttcatgaacgaacatatgtata

SEQ ID NO: 8158364 - DNA, 22 bp, Homo sapiens
ttcatgaacgaacatatgtata

SEQ ID NO: 8158365 - DNA, 22 bp, Homo sapiens
ttcatgaagggtgaatatagtc

SEQ ID NO: 8158366 - DNA, 22 bp, Homo sapiens
ttcatgaatatattgaattagc

SEQ ID NO: 8158367 - DNA, 22 bp, Homo sapiens
ttcatgaatggaatcaatgctc

SEQ ID NO: 8158368 - DNA, 22 bp, Homo sapiens
ttcatgaatgttccatgtgagt

SEQ ID NO: 8158369 - DNA, 22 bp, Homo sapiens
ttcatgaatgttccatgtgagt

SEQ ID NO: 8158370 - DNA, 15 bp, Homo sapiens
ctaaaatccctgggc

SEQ ID NO: 8158371 - DNA, 22 bp, Homo sapiens
ctaaacttttataacattgaga

SEQ ID NO: 8158372 - DNA, 22 bp, Homo sapiens
ctaaaattatcaagataattcc

SEQ ID NO: 8158373 - DNA, 22 bp, Homo sapiens
ctaaaattacctaccagtttag

SEQ ID NO: 8158374 - DNA, 22 bp, Homo sapiens
ctaaataatccctctggtctta

SEQ ID NO: 8158375 - DNA, 22 bp, Homo sapiens
ctaaataatccctctggtctta

SEQ ID NO: 8158376 - DNA, 22 bp, Homo sapiens
ctaaataatccctctggtctta

SEQ ID NO: 8158377 - DNA, 22 bp, Homo sapiens
ctaaatactagccttcagattt

SEQ ID NO: 8158378 - DNA, 22 bp, Homo sapiens
ctaaatactagccttcagattt

SEQ ID NO: 8158379 - DNA, 17 bp, Homo sapiens
ctaaatacttgcgtttc

SEQ ID NO: 8158380 - DNA, 22 bp, Homo sapiens
ctaaagataaggaaagtatcct

SEQ ID NO: 8158381 - DNA, 22 bp, Homo sapiens
ctaaaggattcttagttcctgg

SEQ ID NO: 8158382 - DNA, 22 bp, Homo sapiens
cgtaggtggctcagcacctggg

SEQ ID NO: 8158383 - DNA, 22 bp, Homo sapiens
cgtaggtggctcagcacctggg

SEQ ID NO: 8158384 - DNA, 19 bp, Homo sapiens
cgtacctgacacagaacag

SEQ ID NO: 8158385 - DNA, 22 bp, Homo sapiens
cgtacccaaacactgatgacca

SEQ ID NO: 8158386 - DNA, 22 bp, Homo sapiens
cgtagctcacgccccctctccc

SEQ ID NO: 8158387 - DNA, 21 bp, Homo sapiens
cggtggctcccgggatggctc

SEQ ID NO: 8158388 - DNA, 22 bp, Homo sapiens
cggtggctcaggcccccagcag

SEQ ID NO: 8158389 - DNA, 21 bp, Homo sapiens
cggtggctcccgggatggctc

SEQ ID NO: 8158390 - DNA, 19 bp, Homo sapiens
cggtggcttgcagggaggt

SEQ ID NO: 8158391 - DNA, 19 bp, Homo sapiens
cggtggcttgcagggaggt

SEQ ID NO: 8158392 - DNA, 22 bp, Homo sapiens
cggtggtcccaagagggtggca

SEQ ID NO: 8158393 - DNA, 22 bp, Homo sapiens
cggtggtctcctgcgacatgaa

SEQ ID NO: 8158394 - DNA, 22 bp, Homo sapiens
cggtggtcacaaacaatgacta

SEQ ID NO: 8158395 - DNA, 22 bp, Homo sapiens
cggtggtcataagtggctggcg

SEQ ID NO: 8158396 - DNA, 22 bp, Homo sapiens
cggtggtcattatactcctttc

SEQ ID NO: 8158397 - DNA, 22 bp, Homo sapiens
cggtggccaacaagaggccggg

SEQ ID NO: 8158398 - DNA, 22 bp, Homo sapiens
cggtctcccgtgtgtgtgcgct

SEQ ID NO: 8158399 - DNA, 22 bp, Homo sapiens
ttcatgaaacttaactgttggg

SEQ ID NO: 8158400 - DNA, 22 bp, Homo sapiens
ttcatctggaagttcccaaggc

SEQ ID NO: 8158401 - DNA, 22 bp, Homo sapiens
ttcatctgtacgccaagtactc

SEQ ID NO: 8158402 - DNA, 22 bp, Homo sapiens
cgtcacttcttagtctattttc

SEQ ID NO: 8158403 - DNA, 22 bp, Homo sapiens
cgtcaggtttgtggcacctggg

SEQ ID NO: 8158404 - DNA, 22 bp, Homo sapiens
cgtcaggtgtgattatttttca

SEQ ID NO: 8158405 - DNA, 22 bp, Homo sapiens
cgtcaggtccccagtgaagttg

SEQ ID NO: 8158406 - DNA, 22 bp, Homo sapiens
ttcatccatatgcagagagctt

SEQ ID NO: 8158407 - DNA, 22 bp, Homo sapiens
cgtcactggcgtgaagtgagga

SEQ ID NO: 8158408 - DNA, 22 bp, Homo sapiens
cgtcacttcttagtctattttc

SEQ ID NO: 8158409 - DNA, 22 bp, Homo sapiens
cgtatttagaaggctgctgaaa

SEQ ID NO: 8158410 - DNA, 22 bp, Homo sapiens
cctttctctttgctgatcatgt

SEQ ID NO: 8158411 - DNA, 20 bp, Homo sapiens
ttaggaagtcacaatttcag

SEQ ID NO: 8158412 - DNA, 22 bp, Homo sapiens
cctttctctggcagcaggacag

SEQ ID NO: 8158413 - DNA, 17 bp, Homo sapiens
cctttctctttcatctc

SEQ ID NO: 8158414 - DNA, 22 bp, Homo sapiens
cctttctcttggataccgattg

SEQ ID NO: 8158415 - DNA, 22 bp, Homo sapiens
ttaggaagtttcagaaaatgca

SEQ ID NO: 8158416 - DNA, 22 bp, Homo sapiens
ttaggaagtgtgtccagaagcg

SEQ ID NO: 8158417 - DNA, 22 bp, Homo sapiens
ttaggaagttatagtggaaatg

SEQ ID NO: 8158418 - DNA, 22 bp, Homo sapiens
cctttctcattttaagcattag

SEQ ID NO: 8158419 - DNA, 22 bp, Homo sapiens
cctttctctatcgacccatcgc

SEQ ID NO: 8158420 - DNA, 16 bp, Homo sapiens
cctttctctgccttcc

SEQ ID NO: 8158421 - DNA, 22 bp, Homo sapiens
cctttctctatcgacccatcgc

SEQ ID NO: 8158422 - DNA, 22 bp, Homo sapiens
cctttctctatcgacccatcgc

SEQ ID NO: 8158423 - DNA, 22 bp, Homo sapiens
cctttctcattttaagcattag

SEQ ID NO: 8158424 - DNA, 22 bp, Homo sapiens
cctttcctttttagtgtgggag

SEQ ID NO: 8158425 - DNA, 19 bp, Homo sapiens
cctttcagaacagaagcca

SEQ ID NO: 8158426 - DNA, 19 bp, Homo sapiens
cctttcagaacagaagcca

SEQ ID NO: 8158427 - DNA, 18 bp, Homo sapiens
cctttcctcccctcagct

SEQ ID NO: 8158428 - DNA, 22 bp, Homo sapiens
cgccaggcttggtagctcatgc

SEQ ID NO: 8158429 - DNA, 22 bp, Homo sapiens
cgccagaactgtaagagaataa

SEQ ID NO: 8158430 - DNA, 22 bp, Homo sapiens
cgccagtggcagctggaacagg

SEQ ID NO: 8158431 - DNA, 22 bp, Homo sapiens
cgccaggcttggtagctcatgc

SEQ ID NO: 8158432 - DNA, 22 bp, Homo sapiens
cgcatacatagaaacacacaga

SEQ ID NO: 8158433 - DNA, 22 bp, Homo sapiens
cgcagctggatatcatgtgcct

SEQ ID NO: 8158434 - DNA, 22 bp, Homo sapiens
cgcagctgtccatgtgtggggg

SEQ ID NO: 8158435 - DNA, 22 bp, Homo sapiens
cgcagctgtccatgtgtggggg

SEQ ID NO: 8158436 - DNA, 19 bp, Homo sapiens
cgcaggtggaaggagccgc

SEQ ID NO: 8158437 - DNA, 22 bp, Homo sapiens
cgcaggtgccggcagatggggt

SEQ ID NO: 8158438 - DNA, 22 bp, Homo sapiens
cgcaggtgccggcagatggggt

SEQ ID NO: 8158439 - DNA, 19 bp, Homo sapiens
cgcaggtggaaggagccgc

SEQ ID NO: 8158440 - DNA, 22 bp, Homo sapiens
cgcatacatagaaacacacaga

SEQ ID NO: 8158441 - DNA, 22 bp, Homo sapiens
cgcaggtgttcagtaaatgtat

SEQ ID NO: 8158442 - DNA, 22 bp, Homo sapiens
cgcaggtgtgttttcaggacta

SEQ ID NO: 8158443 - DNA, 22 bp, Homo sapiens
cgcaggtgggcccttcattgat

SEQ ID NO: 8158444 - DNA, 22 bp, Homo sapiens
cgcaggtgttcagtaaatgtat

SEQ ID NO: 8158445 - DNA, 22 bp, Homo sapiens
cgcaggtgggcccttcattgat

SEQ ID NO: 8158446 - DNA, 22 bp, Homo sapiens
cgcaggtgtgttttcaggacta

SEQ ID NO: 8158447 - DNA, 22 bp, Homo sapiens
cgcaggtgtgttttcaggacta

SEQ ID NO: 8158448 - DNA, 22 bp, Homo sapiens
ttaggccaatcaggaaaactca

SEQ ID NO: 8158449 - DNA, 22 bp, Homo sapiens
ttaggcattggaaggtcagctt

SEQ ID NO: 8158450 - DNA, 22 bp, Homo sapiens
ttaggcatgaacaggattcatt

SEQ ID NO: 8158451 - DNA, 22 bp, Homo sapiens
ttaggctgttcttgtgttgtta

SEQ ID NO: 8158452 - DNA, 22 bp, Homo sapiens
ttaggcatagttttgataaata

SEQ ID NO: 8158453 - DNA, 22 bp, Homo sapiens
ttaggatttgaaaaggggcaga

SEQ ID NO: 8158454 - DNA, 22 bp, Homo sapiens
ttaggatttgaaaaggggcaga

SEQ ID NO: 8158455 - DNA, 22 bp, Homo sapiens
ttaggatttgaaaaggggcaga

SEQ ID NO: 8158456 - DNA, 22 bp, Homo sapiens
ttaggattaaaagttaatgcaa

SEQ ID NO: 8158457 - DNA, 22 bp, Homo sapiens
ttaggagtccagatgtcttggg

SEQ ID NO: 8158458 - DNA, 22 bp, Homo sapiens
ttcacaattaactttatactta

SEQ ID NO: 8158459 - DNA, 19 bp, Homo sapiens
ttcacaattatgaaattag

SEQ ID NO: 8158460 - DNA, 20 bp, Homo sapiens
ttcaatacattactttgatt

SEQ ID NO: 8158461 - DNA, 22 bp, Homo sapiens
ttcacacacagcttcctattgt

SEQ ID NO: 8158462 - DNA, 22 bp, Homo sapiens
ttcacaatttcccttcatcagg

SEQ ID NO: 8158463 - DNA, 22 bp, Homo sapiens
ttcacaatttcccttcatcagg

SEQ ID NO: 8158464 - DNA, 22 bp, Homo sapiens
ttcacacagaatctgaggagct

SEQ ID NO: 8158465 - DNA, 22 bp, Homo sapiens
ttcacacagcaactgtatgaat

SEQ ID NO: 8158466 - DNA, 22 bp, Homo sapiens
ttcacacagcaactgtatgaat

SEQ ID NO: 8158467 - DNA, 22 bp, Homo sapiens
ttcaagttaatgattctggttt

SEQ ID NO: 8158468 - DNA, 22 bp, Homo sapiens
ttcaagttagagatatatttag

SEQ ID NO: 8158469 - DNA, 20 bp, Homo sapiens
ttcaagttgggtctctggct

SEQ ID NO: 8158470 - DNA, 22 bp, Homo sapiens
ttcaagttgtgttttccgggct

SEQ ID NO: 8158471 - DNA, 20 bp, Homo sapiens
ttcaagttgggtctctggct

SEQ ID NO: 8158472 - DNA, 22 bp, Homo sapiens
ttcaagttctgtggagagctgt

SEQ ID NO: 8158473 - DNA, 22 bp, Homo sapiens
ttcaagttctagtgttcacttc

SEQ ID NO: 8158474 - DNA, 22 bp, Homo sapiens
ttcaagtttactttgaagttta

SEQ ID NO: 8158475 - DNA, 22 bp, Homo sapiens
ttcaagtttgtatttctgtatt

SEQ ID NO: 8158476 - DNA, 22 bp, Homo sapiens
ttcaagtttactttgaagttta

SEQ ID NO: 8158477 - DNA, 22 bp, Homo sapiens
ttcaagtttactttgaagttta

SEQ ID NO: 8158478 - DNA, 22 bp, Homo sapiens
ttcaagttttatatccatggct

SEQ ID NO: 8158479 - DNA, 22 bp, Homo sapiens
ttcaagttttatatccatggct

SEQ ID NO: 8158480 - DNA, 22 bp, Homo sapiens
ttcaagttttatattgaagcaa

SEQ ID NO: 8158481 - DNA, 22 bp, Homo sapiens
ttcaagttttatattgaagcaa

SEQ ID NO: 8158482 - DNA, 18 bp, Homo sapiens
cgccctgctataaatgac

SEQ ID NO: 8158483 - DNA, 22 bp, Homo sapiens
cgccgcctgctgcagcagctgt

SEQ ID NO: 8158484 - DNA, 22 bp, Homo sapiens
cgccgcctgctgcagcagctgt

SEQ ID NO: 8158485 - DNA, 22 bp, Homo sapiens
cgccgcgccttgggagttccct

SEQ ID NO: 8158486 - DNA, 22 bp, Homo sapiens
cgccgcgcgttgattttctgtt

SEQ ID NO: 8158487 - DNA, 22 bp, Homo sapiens
cgccccggacgtctgaccaaac

SEQ ID NO: 8158488 - DNA, 22 bp, Homo sapiens
cgccccctcggccacctgcggg

SEQ ID NO: 8158489 - DNA, 22 bp, Homo sapiens
cgccccagtctgtaggtgcccc

SEQ ID NO: 8158490 - DNA, 22 bp, Homo sapiens
ttcaagtctgaagaggactaat

SEQ ID NO: 8158491 - DNA, 22 bp, Homo sapiens
cgccggcttgaggcaggcggca

SEQ ID NO: 8158492 - DNA, 22 bp, Homo sapiens
ttcaaattaccacatttgctta

SEQ ID NO: 8158493 - DNA, 22 bp, Homo sapiens
ttcaaatttggtatgcaagcca

SEQ ID NO: 8158494 - DNA, 22 bp, Homo sapiens
cgcccagggcaggaggccgctc

SEQ ID NO: 8158495 - DNA, 22 bp, Homo sapiens
cgcccagggcaggaggccgctc

SEQ ID NO: 8158496 - DNA, 22 bp, Homo sapiens
cgcccagggcaggaggccgctc

SEQ ID NO: 8158497 - DNA, 22 bp, Homo sapiens
cgcccagggcaggaggccgctc

SEQ ID NO: 8158498 - DNA, 22 bp, Homo sapiens
cgcccaggctggagagcagtgg

SEQ ID NO: 8158499 - DNA, 22 bp, Homo sapiens
cgcccaggctggagagcagtgg

SEQ ID NO: 8158500 - DNA, 20 bp, Homo sapiens
cgcccaggagggcccatgtg

SEQ ID NO: 8158501 - DNA, 20 bp, Homo sapiens
cgcccaggagggcccatgtg

SEQ ID NO: 8158502 - DNA, 22 bp, Homo sapiens
ctcaagaggatatgtccagaaa

SEQ ID NO: 8158503 - DNA, 22 bp, Homo sapiens
ctcaagatattccagctctcaa

SEQ ID NO: 8158504 - DNA, 22 bp, Homo sapiens
ctcaagataatgacaaaaagag

SEQ ID NO: 8158505 - DNA, 22 bp, Homo sapiens
ctcaaaatccataaaatcaggt

SEQ ID NO: 8158506 - DNA, 22 bp, Homo sapiens
ctcaaggaaagtctggagaaga

SEQ ID NO: 8158507 - DNA, 22 bp, Homo sapiens
ctcaagatattccagctctcaa

SEQ ID NO: 8158508 - DNA, 22 bp, Homo sapiens
ctcaagtccatagaatcaggaa

SEQ ID NO: 8158509 - DNA, 22 bp, Homo sapiens
ctcaagtcagaaataaaagcat

SEQ ID NO: 8158510 - DNA, 22 bp, Homo sapiens
ctcaagtctgatgggttaggtt

SEQ ID NO: 8158511 - DNA, 22 bp, Homo sapiens
ctcaagtctgagtactggctct

SEQ ID NO: 8158512 - DNA, 22 bp, Homo sapiens
ctcaagtctattgataagtgca

SEQ ID NO: 8158513 - DNA, 22 bp, Homo sapiens
ctattattatcctaatttctgt

SEQ ID NO: 8158514 - DNA, 22 bp, Homo sapiens
ctattattatgttaactggact

SEQ ID NO: 8158515 - DNA, 22 bp, Homo sapiens
ctattattatgttaactggact

SEQ ID NO: 8158516 - DNA, 22 bp, Homo sapiens
ctattatttcctcatctataaa

SEQ ID NO: 8158517 - DNA, 22 bp, Homo sapiens
ctattatttcctcatctataaa

SEQ ID NO: 8158518 - DNA, 22 bp, Homo sapiens
ctcaaaatccataaaatcaggt

SEQ ID NO: 8158519 - DNA, 22 bp, Homo sapiens
ctattagacacaattagtgatt

SEQ ID NO: 8158520 - DNA, 22 bp, Homo sapiens
ctattagacacaattagtgatt

SEQ ID NO: 8158521 - DNA, 22 bp, Homo sapiens
ctattagaaagcatcttctata

SEQ ID NO: 8158522 - DNA, 22 bp, Homo sapiens
ctattagaaagcatcttctata

SEQ ID NO: 8158523 - DNA, 22 bp, Homo sapiens
ctattactgacttctgtattta

SEQ ID NO: 8158524 - DNA, 22 bp, Homo sapiens
ctattaggttggtgcaaaagta

SEQ ID NO: 8158525 - DNA, 22 bp, Homo sapiens
ctattattagcaaaaggtggat

SEQ ID NO: 8158526 - DNA, 22 bp, Homo sapiens
ctattattagcaaaaggtggat

SEQ ID NO: 8158527 - DNA, 22 bp, Homo sapiens
ctattattagataatctacttg

SEQ ID NO: 8158528 - DNA, 22 bp, Homo sapiens
ctcacagggttctatcgaagag

SEQ ID NO: 8158529 - DNA, 22 bp, Homo sapiens
ctcacaggtcatgtggtggctt

SEQ ID NO: 8158530 - DNA, 22 bp, Homo sapiens
ctcacaggagaaagtcatggtc

SEQ ID NO: 8158531 - DNA, 22 bp, Homo sapiens
ctcacagctgcttcaggatcca

SEQ ID NO: 8158532 - DNA, 22 bp, Homo sapiens
ctcacagatctgtgcctgaacc

SEQ ID NO: 8158533 - DNA, 22 bp, Homo sapiens
ctcacagatgatgtctatgtgg

SEQ ID NO: 8158534 - DNA, 22 bp, Homo sapiens
ctcacagatgttctcctttagg

SEQ ID NO: 8158535 - DNA, 22 bp, Homo sapiens
ctcacagatgctgtgggtcagg

SEQ ID NO: 8158536 - DNA, 22 bp, Homo sapiens
ctcacaccagcttacaagactt

SEQ ID NO: 8158537 - DNA, 22 bp, Homo sapiens
ctagcacagtatggtatcagat

SEQ ID NO: 8158538 - DNA, 22 bp, Homo sapiens
ctagatttctagttcattatcc

SEQ ID NO: 8158539 - DNA, 22 bp, Homo sapiens
ctagatgccaatttttatggat

SEQ ID NO: 8158540 - DNA, 21 bp, Homo sapiens
ttctctggcttctgtagctgg

SEQ ID NO: 8158541 - DNA, 22 bp, Homo sapiens
ttctctggcgcgctgtgctatg

SEQ ID NO: 8158542 - DNA, 22 bp, Homo sapiens
ttctctggcctgaggcgaggcc

SEQ ID NO: 8158543 - DNA, 22 bp, Homo sapiens
ttctctggccatagctggctag

SEQ ID NO: 8158544 - DNA, 22 bp, Homo sapiens
ttctctggcctgaggcgaggcc

SEQ ID NO: 8158545 - DNA, 22 bp, Homo sapiens
ttctctggccatagctggctag

SEQ ID NO: 8158546 - DNA, 22 bp, Homo sapiens
ctagccagatgattcccaaata

SEQ ID NO: 8158547 - DNA, 22 bp, Homo sapiens
ctagccagactcaagggccacc

SEQ ID NO: 8158548 - DNA, 22 bp, Homo sapiens
ctatatacttttcacagatgtt

SEQ ID NO: 8158549 - DNA, 22 bp, Homo sapiens
ctagccagatttaaagagagac

SEQ ID NO: 8158550 - DNA, 22 bp, Homo sapiens
ctatatacttttcacagatgtt

SEQ ID NO: 8158551 - DNA, 22 bp, Homo sapiens
ctatatacttttcacagatgtt

SEQ ID NO: 8158552 - DNA, 22 bp, Homo sapiens
ctagcagggtcgacgtctggcg

SEQ ID NO: 8158553 - DNA, 22 bp, Homo sapiens
ctagcaggtcaaaccagctgat

SEQ ID NO: 8158554 - DNA, 22 bp, Homo sapiens
ctagcaggtcaaaccagctgat

SEQ ID NO: 8158555 - DNA, 22 bp, Homo sapiens
ctagcagggtcgacgtctggcg

SEQ ID NO: 8158556 - DNA, 22 bp, Homo sapiens
ctagcaggtcaaaccagctgat

SEQ ID NO: 8158557 - DNA, 22 bp, Homo sapiens
ctagcagggtcgacgtctggcg

SEQ ID NO: 8158558 - DNA, 22 bp, Homo sapiens
ctagcagggattgggcactggg

SEQ ID NO: 8158559 - DNA, 22 bp, Homo sapiens
ctagcagggattgggcactggg

SEQ ID NO: 8158560 - DNA, 22 bp, Homo sapiens
ctagcaggctaatgtaagcttg

SEQ ID NO: 8158561 - DNA, 22 bp, Homo sapiens
ctattacagggaagccttggga

SEQ ID NO: 8158562 - DNA, 22 bp, Homo sapiens
ctattacaattctgcaaggagt

SEQ ID NO: 8158563 - DNA, 22 bp, Homo sapiens
ctattacatttctggacattca

SEQ ID NO: 8158564 - DNA, 18 bp, Homo sapiens
ctattacaatgcagtggt

SEQ ID NO: 8158565 - DNA, 22 bp, Homo sapiens
ctattacaatctgctactatga

SEQ ID NO: 8158566 - DNA, 22 bp, Homo sapiens
ctattacaatctgctactatga

SEQ ID NO: 8158567 - DNA, 22 bp, Homo sapiens
ctattaaatactcttcaaattg

SEQ ID NO: 8158568 - DNA, 22 bp, Homo sapiens
ctattaaatactcttcaaattg

SEQ ID NO: 8158569 - DNA, 22 bp, Homo sapiens
ctattaaatactcttcaaattg

SEQ ID NO: 8158570 - DNA, 22 bp, Homo sapiens
ctattaaatactcttcaaattg

SEQ ID NO: 8158571 - DNA, 22 bp, Homo sapiens
ctattaaacactactgtgcact

SEQ ID NO: 8158572 - DNA, 22 bp, Homo sapiens
ctattaaacactactgtgcact

SEQ ID NO: 8158573 - DNA, 22 bp, Homo sapiens
ctattaaacactactgtgcact

SEQ ID NO: 8158574 - DNA, 22 bp, Homo sapiens
ctattaaacactactgtgcact

SEQ ID NO: 8158575 - DNA, 22 bp, Homo sapiens
ctattaaatactcttcaaattg

SEQ ID NO: 8158576 - DNA, 22 bp, Homo sapiens
ctatgtttatctgtatttctgt

SEQ ID NO: 8158577 - DNA, 22 bp, Homo sapiens
ctatgtttatctgtatttctgt

SEQ ID NO: 8158578 - DNA, 22 bp, Homo sapiens
ctatgtttatctgtatttctgt

SEQ ID NO: 8158579 - DNA, 19 bp, Homo sapiens
ctatgtttatatatccagt

SEQ ID NO: 8158580 - DNA, 22 bp, Homo sapiens
ctatgtgtcttgaaacaagact

SEQ ID NO: 8158581 - DNA, 22 bp, Homo sapiens
ctatgtactggattagctccca

SEQ ID NO: 8158582 - DNA, 22 bp, Homo sapiens
ctatgtatgcgattagaatttt

SEQ ID NO: 8158583 - DNA, 22 bp, Homo sapiens
ctatgtatgcgattagaatttt

SEQ ID NO: 8158584 - DNA, 23 bp, Homo sapiens
ctatggttttaaaggtggatatc

SEQ ID NO: 8158585 - DNA, 22 bp, Homo sapiens
ctatgtaccatgcctgatgtta

SEQ ID NO: 8158586 - DNA, 22 bp, Homo sapiens
ctatggtgatagaaatcagaat

SEQ ID NO: 8158587 - DNA, 22 bp, Homo sapiens
ctatggtctggaccgaggtcct

SEQ ID NO: 8158588 - DNA, 22 bp, Homo sapiens
ctatatatatcatcttccagtt

SEQ ID NO: 8158589 - DNA, 22 bp, Homo sapiens
ctatgagaagaaaacaagatta

SEQ ID NO: 8158590 - DNA, 22 bp, Homo sapiens
ctatatatatcatcttccagtt

SEQ ID NO: 8158591 - DNA, 22 bp, Homo sapiens
ctatatatatcatcttccagtt

SEQ ID NO: 8158592 - DNA, 22 bp, Homo sapiens
ctatgcttcagagttccaggtg

SEQ ID NO: 8158593 - DNA, 22 bp, Homo sapiens
ctatgctttagtaatattctca

SEQ ID NO: 8158594 - DNA, 22 bp, Homo sapiens
ctatggaaactcaacatttgtt

SEQ ID NO: 8158595 - DNA, 22 bp, Homo sapiens
ctatggaaacctaatcaggaga

SEQ ID NO: 8158596 - DNA, 23 bp, Homo sapiens
ctatggaataccaatgattctca

SEQ ID NO: 8158597 - DNA, 23 bp, Homo sapiens
ctatggaataccaatgattctca

SEQ ID NO: 8158598 - DNA, 22 bp, Homo sapiens
ctatggcatgtcacctgctgag

SEQ ID NO: 8158599 - DNA, 23 bp, Homo sapiens
ctatggaataccaatgattctca

SEQ ID NO: 8158600 - DNA, 22 bp, Homo sapiens
ctacttctgtgatgaaactaca

SEQ ID NO: 8158601 - DNA, 22 bp, Homo sapiens
ctacttcttgatctgtcgacct

SEQ ID NO: 8158602 - DNA, 17 bp, Homo sapiens
ctacttcttctattctt

SEQ ID NO: 8158603 - DNA, 22 bp, Homo sapiens
ctacttgttcactgtaggtcgc

SEQ ID NO: 8158604 - DNA, 21 bp, Homo sapiens
ctacttaagtaggggattagg

SEQ ID NO: 8158605 - DNA, 22 bp, Homo sapiens
ctacttctaagtacatggtgat

SEQ ID NO: 8158606 - DNA, 22 bp, Homo sapiens
ctacttctaagtacatggtgat

SEQ ID NO: 8158607 - DNA, 22 bp, Homo sapiens
ctacttgttcactgtaggtcgc

SEQ ID NO: 8158608 - DNA, 22 bp, Homo sapiens
ctactttaacaattcgcaagaa

SEQ ID NO: 8158609 - DNA, 22 bp, Homo sapiens
ctacttctgtgatgaaactaca

SEQ ID NO: 8158610 - DNA, 22 bp, Homo sapiens
ctacttgttcactgtaggtcgc

SEQ ID NO: 8158611 - DNA, 22 bp, Homo sapiens
ctactttaattttctgcagaga

SEQ ID NO: 8158612 - DNA, 22 bp, Homo sapiens
ctactttaacaattcgcaagaa

SEQ ID NO: 8158613 - DNA, 22 bp, Homo sapiens
ctactttaacatggaggcactt

SEQ ID NO: 8158614 - DNA, 22 bp, Homo sapiens
ctactttacctccatcagactg

SEQ ID NO: 8158615 - DNA, 22 bp, Homo sapiens
ctactttaattttctgcagaga

SEQ ID NO: 8158616 - DNA, 20 bp, Homo sapiens
ctactttaggcactgagaat

SEQ ID NO: 8158617 - DNA, 22 bp, Homo sapiens
ctactttacctccatcagactg

SEQ ID NO: 8158618 - DNA, 19 bp, Homo sapiens
ctactttataatatgcctc

SEQ ID NO: 8158619 - DNA, 20 bp, Homo sapiens
ctactttaggcactgagaat

SEQ ID NO: 8158620 - DNA, 20 bp, Homo sapiens
ctactttaggcactgagaat

SEQ ID NO: 8158621 - DNA, 19 bp, Homo sapiens
ctactttataatatgcctc

SEQ ID NO: 8158622 - DNA, 22 bp, Homo sapiens
ttctctggagagtatcttctta

SEQ ID NO: 8158623 - DNA, 22 bp, Homo sapiens
ttctctggactatttgcactcc

SEQ ID NO: 8158624 - DNA, 22 bp, Homo sapiens
ttctctggagagtatcttctta

SEQ ID NO: 8158625 - DNA, 22 bp, Homo sapiens
ttctctggatgtttctcagtca

SEQ ID NO: 8158626 - DNA, 22 bp, Homo sapiens
ttctctggatgtttctcagtca

SEQ ID NO: 8158627 - DNA, 21 bp, Homo sapiens
ttctctggataggccagtcct

SEQ ID NO: 8158628 - DNA, 22 bp, Homo sapiens
ttctcggctcagtctcagcgaa

SEQ ID NO: 8158629 - DNA, 22 bp, Homo sapiens
ttctctaaacatattggatctg

SEQ ID NO: 8158630 - DNA, 22 bp, Homo sapiens
ctactgtattatggacattacg

SEQ ID NO: 8158631 - DNA, 22 bp, Homo sapiens
ctactgtagtggcctatttacc

SEQ ID NO: 8158632 - DNA, 22 bp, Homo sapiens
ctactgtagttaaagttttgta

SEQ ID NO: 8158633 - DNA, 22 bp, Homo sapiens
ctactgtaatagatgaatttga

SEQ ID NO: 8158634 - DNA, 22 bp, Homo sapiens
ctactgccattgtctctgccat

SEQ ID NO: 8158635 - DNA, 22 bp, Homo sapiens
ctactgccattgtctctgccat

SEQ ID NO: 8158636 - DNA, 22 bp, Homo sapiens
ctactctcccatgattctctgt

SEQ ID NO: 8158637 - DNA, 22 bp, Homo sapiens
ctactatttgtcctttataagc

SEQ ID NO: 8158638 - DNA, 22 bp, Homo sapiens
ctactactccaccacttaccag

SEQ ID NO: 8158639 - DNA, 22 bp, Homo sapiens
ctactatttgtcctttataagc

SEQ ID NO: 8158640 - DNA, 22 bp, Homo sapiens
ctactagatcagtatgcctcaa

SEQ ID NO: 8158641 - DNA, 22 bp, Homo sapiens
ctaccttatcagagtggtaagg

SEQ ID NO: 8158642 - DNA, 22 bp, Homo sapiens
ctactctgtggtgtatttgcat

SEQ ID NO: 8158643 - DNA, 22 bp, Homo sapiens
ctactctgaattgaagtgatat

SEQ ID NO: 8158644 - DNA, 22 bp, Homo sapiens
ctactgagtccttcagctgcca

SEQ ID NO: 8158645 - DNA, 22 bp, Homo sapiens
ctaccttcaagttcctccctct

SEQ ID NO: 8158646 - DNA, 22 bp, Homo sapiens
ctaccttactttaaccctgcaa

SEQ ID NO: 8158647 - DNA, 22 bp, Homo sapiens
ctacccttaagtttctgtgggg

SEQ ID NO: 8158648 - DNA, 22 bp, Homo sapiens
ctacccttaagtttctgtgggg

SEQ ID NO: 8158649 - DNA, 21 bp, Homo sapiens
ttcctggggaaggagctgcct

SEQ ID NO: 8158650 - DNA, 21 bp, Homo sapiens
ttcctggggaaggagctgcct

SEQ ID NO: 8158651 - DNA, 22 bp, Homo sapiens
ctacccaggctggagtgcagta

SEQ ID NO: 8158652 - DNA, 22 bp, Homo sapiens
ctacatttcatccagggagagc

SEQ ID NO: 8158653 - DNA, 22 bp, Homo sapiens
ttcctgggctgcagagagcacc

SEQ ID NO: 8158654 - DNA, 22 bp, Homo sapiens
ttcctgggctgcagagagcacc

SEQ ID NO: 8158655 - DNA, 22 bp, Homo sapiens
ttcctgggctttcccctctggt

SEQ ID NO: 8158656 - DNA, 21 bp, Homo sapiens
ttcctggggaaggagctgcct

SEQ ID NO: 8158657 - DNA, 22 bp, Homo sapiens
ttcctgggctttcccctctggt

SEQ ID NO: 8158658 - DNA, 22 bp, Homo sapiens
ctacagagtatctaaagaggta

SEQ ID NO: 8158659 - DNA, 22 bp, Homo sapiens
ctacagagtatctaaagaggta

SEQ ID NO: 8158660 - DNA, 22 bp, Homo sapiens
ctacagctgtgtgtttatgtgc

SEQ ID NO: 8158661 - DNA, 22 bp, Homo sapiens
ctacaggaaggatcttgctcaa

SEQ ID NO: 8158662 - DNA, 22 bp, Homo sapiens
ctacaggctcagggagccctct

SEQ ID NO: 8158663 - DNA, 22 bp, Homo sapiens
ctacaggctcagggagccctct

SEQ ID NO: 8158664 - DNA, 22 bp, Homo sapiens
ctacaggtatgtgcatgacatc

SEQ ID NO: 8158665 - DNA, 22 bp, Homo sapiens
ctacaggctcagggagccctct

SEQ ID NO: 8158666 - DNA, 22 bp, Homo sapiens
ctacaggctcagggagccctct

SEQ ID NO: 8158667 - DNA, 22 bp, Homo sapiens
ctacaggtcagtaagacctaga

SEQ ID NO: 8158668 - DNA, 22 bp, Homo sapiens
ctacaggtcaagcagtagctct

SEQ ID NO: 8158669 - DNA, 22 bp, Homo sapiens
ttcctggctgtcatgccctagt

SEQ ID NO: 8158670 - DNA, 22 bp, Homo sapiens
ttcctggcttcatactttgtac

SEQ ID NO: 8158671 - DNA, 22 bp, Homo sapiens
ttcctggcttttgggctaattc

SEQ ID NO: 8158672 - DNA, 22 bp, Homo sapiens
ttcctggcttgtcacatctacg

SEQ ID NO: 8158673 - DNA, 22 bp, Homo sapiens
ttcctgggagctagccacatct

SEQ ID NO: 8158674 - DNA, 22 bp, Homo sapiens
ttcctgggactggagcagccca

SEQ ID NO: 8158675 - DNA, 22 bp, Homo sapiens
ttcctgggactggagcagccca

SEQ ID NO: 8158676 - DNA, 22 bp, Homo sapiens
ttcctgggactggagcagccca

SEQ ID NO: 8158677 - DNA, 22 bp, Homo sapiens
ttcctggctctctgttgcacag

SEQ ID NO: 8158678 - DNA, 20 bp, Homo sapiens
ttcctggctctaggaccttg

SEQ ID NO: 8158679 - DNA, 20 bp, Homo sapiens
ttcctggctctaggaccttg

SEQ ID NO: 8158680 - DNA, 19 bp, Homo sapiens
ttcctggctcttctgtttt

SEQ ID NO: 8158681 - DNA, 19 bp, Homo sapiens
ttcctggctcttctgtttt

SEQ ID NO: 8158682 - DNA, 22 bp, Homo sapiens
ttcctggctgaactgaactcct

SEQ ID NO: 8158683 - DNA, 22 bp, Homo sapiens
ttcctggctggcggttttggtg

SEQ ID NO: 8158684 - DNA, 22 bp, Homo sapiens
ttcctggctgatctaccaaagt

SEQ ID NO: 8158685 - DNA, 22 bp, Homo sapiens
ttcctgggattattgtcaagca

SEQ ID NO: 8158686 - DNA, 22 bp, Homo sapiens
ttcctgggattattgtcaagca

SEQ ID NO: 8158687 - DNA, 22 bp, Homo sapiens
ttcctgggattattgtcaagca

SEQ ID NO: 8158688 - DNA, 22 bp, Homo sapiens
ttcctgggaggctgtgtacttg

SEQ ID NO: 8158689 - DNA, 22 bp, Homo sapiens
ttcctgggaggctgtgtacttg

SEQ ID NO: 8158690 - DNA, 22 bp, Homo sapiens
ttcctgggagctagccacatct

SEQ ID NO: 8158691 - DNA, 22 bp, Homo sapiens
ttcctgggctgcagagagcacc

SEQ ID NO: 8158692 - DNA, 22 bp, Homo sapiens
ttcctgggctctggctggccta

SEQ ID NO: 8158693 - DNA, 22 bp, Homo sapiens
ttcctgggccttaaatcttttg

SEQ ID NO: 8158694 - DNA, 22 bp, Homo sapiens
ttcctgggccttaaatcttttg

SEQ ID NO: 8158695 - DNA, 22 bp, Homo sapiens
ttcctgggcaggacgagagtct

SEQ ID NO: 8158696 - DNA, 22 bp, Homo sapiens
ttcctgggcaggacgagagtct

SEQ ID NO: 8158697 - DNA, 22 bp, Homo sapiens
ctacagaggacacaaagatctt

SEQ ID NO: 8158698 - DNA, 21 bp, Homo sapiens
ctacagaggagagggaaaggc

SEQ ID NO: 8158699 - DNA, 22 bp, Homo sapiens
ctacagagtatctaaagaggta

SEQ ID NO: 8158700 - DNA, 22 bp, Homo sapiens
ctacagagaactcagctgccct

SEQ ID NO: 8158701 - DNA, 22 bp, Homo sapiens
ctacaacatagtcttctacaga

SEQ ID NO: 8158702 - DNA, 22 bp, Homo sapiens
ttccaggatggcaataatgaat

SEQ ID NO: 8158703 - DNA, 22 bp, Homo sapiens
ctacaacatagtcttctacaga

SEQ ID NO: 8158704 - DNA, 22 bp, Homo sapiens
ctacaacaccaggcacggagtg

SEQ ID NO: 8158705 - DNA, 22 bp, Homo sapiens
ttccaggatggagacactagta

SEQ ID NO: 8158706 - DNA, 22 bp, Homo sapiens
ttccaggaggtcaaaggcctgt

SEQ ID NO: 8158707 - DNA, 22 bp, Homo sapiens
ttccaggaggcttggcgggagg

SEQ ID NO: 8158708 - DNA, 22 bp, Homo sapiens
ttccaggaggcactgacagagg

SEQ ID NO: 8158709 - DNA, 22 bp, Homo sapiens
ttccaggaggaggtactagagg

SEQ ID NO: 8158710 - DNA, 22 bp, Homo sapiens
ttccaggagaggaaacctgatt

SEQ ID NO: 8158711 - DNA, 22 bp, Homo sapiens
ttccaggagccacacaggggcg

SEQ ID NO: 8158712 - DNA, 22 bp, Homo sapiens
ttccaggaggaaagtttgggtg

SEQ ID NO: 8158713 - DNA, 22 bp, Homo sapiens
ttccaggactcgttctggctca

SEQ ID NO: 8158714 - DNA, 22 bp, Homo sapiens
ttccaggactcgttctggctca

SEQ ID NO: 8158715 - DNA, 22 bp, Homo sapiens
ttccaggacttcatggctctga

SEQ ID NO: 8158716 - DNA, 22 bp, Homo sapiens
ctaaatcaggccttacagcttc

SEQ ID NO: 8158717 - DNA, 22 bp, Homo sapiens
ctaaatcatcatttatgtttgt

SEQ ID NO: 8158718 - DNA, 22 bp, Homo sapiens
ctaaatcatcatttatgtttgt

SEQ ID NO: 8158719 - DNA, 22 bp, Homo sapiens
ctaaatcatcatttatgtttgt

SEQ ID NO: 8158720 - DNA, 22 bp, Homo sapiens
ctaaatgacttccagtggttat

SEQ ID NO: 8158721 - DNA, 22 bp, Homo sapiens
ctaaatgacaggtaccatagtg

SEQ ID NO: 8158722 - DNA, 22 bp, Homo sapiens
ttccaggaccaggaagagggga

SEQ ID NO: 8158723 - DNA, 22 bp, Homo sapiens
ctaaatgatattttggtttcct

SEQ ID NO: 8158724 - DNA, 22 bp, Homo sapiens
tgtttagatgcaaagtctcaca

SEQ ID NO: 8158725 - DNA, 22 bp, Homo sapiens
tgtttactttccttctcacagg

SEQ ID NO: 8158726 - DNA, 22 bp, Homo sapiens
tgtttactttccttctcacagg

SEQ ID NO: 8158727 - DNA, 22 bp, Homo sapiens
tgtttacttttaattacctgtc

SEQ ID NO: 8158728 - DNA, 22 bp, Homo sapiens
cctgtcagccccacttctgcct

SEQ ID NO: 8158729 - DNA, 22 bp, Homo sapiens
cctgtcagccccacttctgcct

SEQ ID NO: 8158730 - DNA, 22 bp, Homo sapiens
cctgtctctgcagggccctgcc

SEQ ID NO: 8158731 - DNA, 22 bp, Homo sapiens
cctgtctctgttaccacatttg

SEQ ID NO: 8158732 - DNA, 22 bp, Homo sapiens
cctgtctctttcaatctgagag

SEQ ID NO: 8158733 - DNA, 22 bp, Homo sapiens
cctgtctctttcaatctgagag

SEQ ID NO: 8158734 - DNA, 22 bp, Homo sapiens
tgtttataaattttcttgccat

SEQ ID NO: 8158735 - DNA, 22 bp, Homo sapiens
tgtttataaattttcttgccat

SEQ ID NO: 8158736 - DNA, 22 bp, Homo sapiens
tgtttataaattttcttgccat

SEQ ID NO: 8158737 - DNA, 18 bp, Homo sapiens
cctgtcacgtccaggcct

SEQ ID NO: 8158738 - DNA, 22 bp, Homo sapiens
cctgtcactgttgcagccagct

SEQ ID NO: 8158739 - DNA, 22 bp, Homo sapiens
cctgtcagatgaagtaattgtg

SEQ ID NO: 8158740 - DNA, 22 bp, Homo sapiens
cctgtcagatgaagtaattgtg

SEQ ID NO: 8158741 - DNA, 22 bp, Homo sapiens
cctgtctgcagatatctcaggt

SEQ ID NO: 8158742 - DNA, 22 bp, Homo sapiens
cctgtctgcagatatctcaggt

SEQ ID NO: 8158743 - DNA, 22 bp, Homo sapiens
cctgtctgcaaggggtggatcc

SEQ ID NO: 8158744 - DNA, 22 bp, Homo sapiens
cctgtctgagccagggtgggca

SEQ ID NO: 8158745 - DNA, 22 bp, Homo sapiens
cctgtctgaatcatgatttcct

SEQ ID NO: 8158746 - DNA, 22 bp, Homo sapiens
cctgtctgaatcatgatttcct

SEQ ID NO: 8158747 - DNA, 22 bp, Homo sapiens
cctgtctgcatgatccctgcca

SEQ ID NO: 8158748 - DNA, 22 bp, Homo sapiens
cctgtctgcatgatccctgcca

SEQ ID NO: 8158749 - DNA, 22 bp, Homo sapiens
cctgtctgcagatatctcaggt

SEQ ID NO: 8158750 - DNA, 22 bp, Homo sapiens
cctgtctgcatgagtgagcata

SEQ ID NO: 8158751 - DNA, 22 bp, Homo sapiens
cctgtctgcatgagtgagcata

SEQ ID NO: 8158752 - DNA, 22 bp, Homo sapiens
cctgtctgcatgatccctgcca

SEQ ID NO: 8158753 - DNA, 22 bp, Homo sapiens
cctgtctgtcctttgcattctt

SEQ ID NO: 8158754 - DNA, 19 bp, Homo sapiens
cctgtctgtcttcagctag

SEQ ID NO: 8158755 - DNA, 23 bp, Homo sapiens
cctgtctgtgctgggtggacaca

SEQ ID NO: 8158756 - DNA, 22 bp, Homo sapiens
cctgtctgttctgactggtcag

SEQ ID NO: 8158757 - DNA, 23 bp, Homo sapiens
cctgtctgtgctgggtggacaca

SEQ ID NO: 8158758 - DNA, 22 bp, Homo sapiens
cctgtctgttctgactggtcag

SEQ ID NO: 8158759 - DNA, 22 bp, Homo sapiens
cctgtctgtttgcccattcttg

SEQ ID NO: 8158760 - DNA, 22 bp, Homo sapiens
cctgtctgtttgcccattcttg

SEQ ID NO: 8158761 - DNA, 22 bp, Homo sapiens
cctgtctgtttgcccattcttg

SEQ ID NO: 8158762 - DNA, 23 bp, Homo sapiens
cctgtgacactgtttgtggtaag

SEQ ID NO: 8158763 - DNA, 22 bp, Homo sapiens
cctgtgccatcctgagcatccc

SEQ ID NO: 8158764 - DNA, 22 bp, Homo sapiens
cctgtgccatcctgagcatccc

SEQ ID NO: 8158765 - DNA, 22 bp, Homo sapiens
cctgtctggccaccagggcgat

SEQ ID NO: 8158766 - DNA, 22 bp, Homo sapiens
cctgtctggccttccacggggg

SEQ ID NO: 8158767 - DNA, 22 bp, Homo sapiens
cctgtctggggactccctgggt

SEQ ID NO: 8158768 - DNA, 22 bp, Homo sapiens
cctgtctggccttccacggggg

SEQ ID NO: 8158769 - DNA, 22 bp, Homo sapiens
cctgtctggccaccagggcgat

SEQ ID NO: 8158770 - DNA, 20 bp, Homo sapiens
cctgtctggagacaaagaga

SEQ ID NO: 8158771 - DNA, 22 bp, Homo sapiens
cctgtctgtatcggttcagagt

SEQ ID NO: 8158772 - DNA, 22 bp, Homo sapiens
cctgtctgtattattcaccact

SEQ ID NO: 8158773 - DNA, 22 bp, Homo sapiens
cctgtctggtgagggggttgca

SEQ ID NO: 8158774 - DNA, 22 bp, Homo sapiens
cctgtctgtattggtttgctat

SEQ ID NO: 8158775 - DNA, 22 bp, Homo sapiens
cctgtctgtcctctcatgagcc

SEQ ID NO: 8158776 - DNA, 22 bp, Homo sapiens
cctgtctgtcctttgcattctt

SEQ ID NO: 8158777 - DNA, 22 bp, Homo sapiens
ttaaagtatagaggacaaaaac

SEQ ID NO: 8158778 - DNA, 22 bp, Homo sapiens
ttaaagtatggtttaagggctt

SEQ ID NO: 8158779 - DNA, 19 bp, Homo sapiens
ttaaagtgcgagaagtctt

SEQ ID NO: 8158780 - DNA, 22 bp, Homo sapiens
ttaaagtaatctgtgtgaattt

SEQ ID NO: 8158781 - DNA, 22 bp, Homo sapiens
ttaaagtaatctgtgtgaattt

SEQ ID NO: 8158782 - DNA, 22 bp, Homo sapiens
cctgtgggaaaggtctgctctc

SEQ ID NO: 8158783 - DNA, 22 bp, Homo sapiens
cctgtgggaaaggtctgctctc

SEQ ID NO: 8158784 - DNA, 22 bp, Homo sapiens
cctgtggctggtcaggccagca

SEQ ID NO: 8158785 - DNA, 22 bp, Homo sapiens
cctgtgggttttcaagatgcta

SEQ ID NO: 8158786 - DNA, 22 bp, Homo sapiens
cctgtgggttttcaagatgcta

SEQ ID NO: 8158787 - DNA, 22 bp, Homo sapiens
cctgtgggttttctgtagaaat

SEQ ID NO: 8158788 - DNA, 22 bp, Homo sapiens
cctgtgggttttctgtagaaat

SEQ ID NO: 8158789 - DNA, 22 bp, Homo sapiens
cctgtgggttttctgtagaaat

SEQ ID NO: 8158790 - DNA, 22 bp, Homo sapiens
cctgtgggtcacatgggtgact

SEQ ID NO: 8158791 - DNA, 22 bp, Homo sapiens
cctgtgggtcacatgggtgact

SEQ ID NO: 8158792 - DNA, 21 bp, Homo sapiens
cctgtggtctggagggagcac

SEQ ID NO: 8158793 - DNA, 22 bp, Homo sapiens
cctgtgtccagttccaggttgt

SEQ ID NO: 8158794 - DNA, 22 bp, Homo sapiens
cctgtgtcatcagctgtggcta

SEQ ID NO: 8158795 - DNA, 22 bp, Homo sapiens
cctgtgtcagcccctgcctcca

SEQ ID NO: 8158796 - DNA, 22 bp, Homo sapiens
cctgtgtcaccggaacggagga

SEQ ID NO: 8158797 - DNA, 22 bp, Homo sapiens
cctgtgtcagcccctgcctcca

SEQ ID NO: 8158798 - DNA, 22 bp, Homo sapiens
cctgtgtcatcagctgtggcta

SEQ ID NO: 8158799 - DNA, 22 bp, Homo sapiens
cctgtgcttcactcaacaagcc

SEQ ID NO: 8158800 - DNA, 20 bp, Homo sapiens
cctgtgcttatcacttgctg

SEQ ID NO: 8158801 - DNA, 22 bp, Homo sapiens
cctgtgcttcagctggaggagg

SEQ ID NO: 8158802 - DNA, 21 bp, Homo sapiens
ttaaagctatggtagtgggct

SEQ ID NO: 8158803 - DNA, 22 bp, Homo sapiens
ttaaagctgagccctcagaagc

SEQ ID NO: 8158804 - DNA, 22 bp, Homo sapiens
cctgtgctggacagggctgggc

SEQ ID NO: 8158805 - DNA, 22 bp, Homo sapiens
ttaaagctgagccctcagaagc

SEQ ID NO: 8158806 - DNA, 22 bp, Homo sapiens
ttaaagctggcgttacagtttg

SEQ ID NO: 8158807 - DNA, 22 bp, Homo sapiens
cctgtgctccctatgtatctgg

SEQ ID NO: 8158808 - DNA, 22 bp, Homo sapiens
cctgtgctccctatgtatctgg

SEQ ID NO: 8158809 - DNA, 22 bp, Homo sapiens
cctgtgctcccatagcttctgt

SEQ ID NO: 8158810 - DNA, 22 bp, Homo sapiens
cctgtgccttccttaggcacct

SEQ ID NO: 8158811 - DNA, 19 bp, Homo sapiens
cctgtgctaggagctgacc

SEQ ID NO: 8158812 - DNA, 21 bp, Homo sapiens
cctgtgctatcagcttgggtt

SEQ ID NO: 8158813 - DNA, 22 bp, Homo sapiens
cctgtgccttaaccctttaggc

SEQ ID NO: 8158814 - DNA, 22 bp, Homo sapiens
cctgtgccctggaaggagagag

SEQ ID NO: 8158815 - DNA, 22 bp, Homo sapiens
cctgtgccctcagcctggctct

SEQ ID NO: 8158816 - DNA, 22 bp, Homo sapiens
cctgtgccctcagcctggctct

SEQ ID NO: 8158817 - DNA, 22 bp, Homo sapiens
cctgtgccctacacctttccag

SEQ ID NO: 8158818 - DNA, 22 bp, Homo sapiens
cctgtgccatcctgagcatccc

SEQ ID NO: 8158819 - DNA, 22 bp, Homo sapiens
ttagaatttctgctcactttga

SEQ ID NO: 8158820 - DNA, 22 bp, Homo sapiens
cctttacagtatggttgtatca

SEQ ID NO: 8158821 - DNA, 22 bp, Homo sapiens
cctttacatctgacttctttca

SEQ ID NO: 8158822 - DNA, 20 bp, Homo sapiens
cctttagaaactcatatgta

SEQ ID NO: 8158823 - DNA, 20 bp, Homo sapiens
ttagaagtggctatttcctc

SEQ ID NO: 8158824 - DNA, 22 bp, Homo sapiens
ttagaagtgggcctatagtcct

SEQ ID NO: 8158825 - DNA, 22 bp, Homo sapiens
ttagaagtgggcctatagtcct

SEQ ID NO: 8158826 - DNA, 22 bp, Homo sapiens
ttagaagtggtaagtagaaaga

SEQ ID NO: 8158827 - DNA, 22 bp, Homo sapiens
ttagaagtggtaagtagaaaga

SEQ ID NO: 8158828 - DNA, 22 bp, Homo sapiens
ttagaagttcaggtctgtaatc

SEQ ID NO: 8158829 - DNA, 22 bp, Homo sapiens
ttagaagttcaggtctgtaatc

SEQ ID NO: 8158830 - DNA, 22 bp, Homo sapiens
ttagaatcaggtgttataatca

SEQ ID NO: 8158831 - DNA, 22 bp, Homo sapiens
ttagaatctaacattcttatct

SEQ ID NO: 8158832 - DNA, 22 bp, Homo sapiens
ttagaaaaatgttcagtagttt

SEQ ID NO: 8158833 - DNA, 22 bp, Homo sapiens
ttagaaaaatgttcagtagttt

SEQ ID NO: 8158834 - DNA, 22 bp, Homo sapiens
ttagaagtacatttagaacata

SEQ ID NO: 8158835 - DNA, 21 bp, Homo sapiens
ttagaagtaattttctccagc

SEQ ID NO: 8158836 - DNA, 22 bp, Homo sapiens
ttagaagtacataagacaagga

SEQ ID NO: 8158837 - DNA, 21 bp, Homo sapiens
ttagaagtaattttctccagc

SEQ ID NO: 8158838 - DNA, 22 bp, Homo sapiens
ttagaagtcagtatataggtgg

SEQ ID NO: 8158839 - DNA, 22 bp, Homo sapiens
ttagaagtcagtatataggtgg

SEQ ID NO: 8158840 - DNA, 22 bp, Homo sapiens
ttagaagtcatctagtctaaaa

SEQ ID NO: 8158841 - DNA, 22 bp, Homo sapiens
ttagaagtcatctagtctaaaa

SEQ ID NO: 8158842 - DNA, 22 bp, Homo sapiens
ttagaagtgaaatagctgtaca

SEQ ID NO: 8158843 - DNA, 22 bp, Homo sapiens
ttagaagtcatctagtctaaaa

SEQ ID NO: 8158844 - DNA, 22 bp, Homo sapiens
ttagaagtgaaatagctgtaca

SEQ ID NO: 8158845 - DNA, 20 bp, Homo sapiens
ttagaagtggctatttcctc

SEQ ID NO: 8158846 - DNA, 22 bp, Homo sapiens
ttagaagtgaaatgctgcagag

SEQ ID NO: 8158847 - DNA, 22 bp, Homo sapiens
ccttctagcaaatcaacataaa

SEQ ID NO: 8158848 - DNA, 22 bp, Homo sapiens
ccttctagcaaatcaacataaa

SEQ ID NO: 8158849 - DNA, 22 bp, Homo sapiens
ccttctagcaaatcaacataaa

SEQ ID NO: 8158850 - DNA, 21 bp, Homo sapiens
ccttctccacagggtctccgg

SEQ ID NO: 8158851 - DNA, 21 bp, Homo sapiens
ttactaaacaaaacatgcagg

SEQ ID NO: 8158852 - DNA, 22 bp, Homo sapiens
ccttccttttactgtctccgga

SEQ ID NO: 8158853 - DNA, 22 bp, Homo sapiens
ccttcctttgcatcatttctag

SEQ ID NO: 8158854 - DNA, 22 bp, Homo sapiens
ccttccttttactgtctccgga

SEQ ID NO: 8158855 - DNA, 22 bp, Homo sapiens
ccttcctttgcatcatttctag

SEQ ID NO: 8158856 - DNA, 22 bp, Homo sapiens
ccttcctttgcaggtcaggtca

SEQ ID NO: 8158857 - DNA, 22 bp, Homo sapiens
ccttcctttcagggctatgcct

SEQ ID NO: 8158858 - DNA, 22 bp, Homo sapiens
ccttcctttcagggctatgcct

SEQ ID NO: 8158859 - DNA, 22 bp, Homo sapiens
ccttcctttcagggctatgcct

SEQ ID NO: 8158860 - DNA, 22 bp, Homo sapiens
ccttccttgtctacaaaagctc

SEQ ID NO: 8158861 - DNA, 22 bp, Homo sapiens
ccttccttgagaagcaattcct

SEQ ID NO: 8158862 - DNA, 22 bp, Homo sapiens
ccttccttgagaagcaattcct

SEQ ID NO: 8158863 - DNA, 22 bp, Homo sapiens
ccttccttgagaagcaattcct

SEQ ID NO: 8158864 - DNA, 22 bp, Homo sapiens
ttagaaaaaacgtcttctagtg

SEQ ID NO: 8158865 - DNA, 22 bp, Homo sapiens
ttacttttgcaccaaactaata

SEQ ID NO: 8158866 - DNA, 22 bp, Homo sapiens
ttactaaggactctaagttcta

SEQ ID NO: 8158867 - DNA, 22 bp, Homo sapiens
ttactaagccagtggtatagat

SEQ ID NO: 8158868 - DNA, 20 bp, Homo sapiens
ttactaatctcaatgacctg

SEQ ID NO: 8158869 - DNA, 22 bp, Homo sapiens
ttacttttgcaccaaactaata

SEQ ID NO: 8158870 - DNA, 19 bp, Homo sapiens
ccttcctccccagggccat

SEQ ID NO: 8158871 - DNA, 19 bp, Homo sapiens
ccttcctccccagggccat

SEQ ID NO: 8158872 - DNA, 19 bp, Homo sapiens
ccttcctccccagggccat

SEQ ID NO: 8158873 - DNA, 22 bp, Homo sapiens
ccttcctggagcccatgcagat

SEQ ID NO: 8158874 - DNA, 22 bp, Homo sapiens
ccttcctggagcccatgcagat

SEQ ID NO: 8158875 - DNA, 22 bp, Homo sapiens
ccttcctggagcccatgcagat

SEQ ID NO: 8158876 - DNA, 22 bp, Homo sapiens
ccttcctggctgtccgcctgat

SEQ ID NO: 8158877 - DNA, 22 bp, Homo sapiens
ccttccttcaagcacacatcta

SEQ ID NO: 8158878 - DNA, 22 bp, Homo sapiens
ccttcctggctgtccgcctgat

SEQ ID NO: 8158879 - DNA, 17 bp, Homo sapiens
ccttcctcatctccttc

SEQ ID NO: 8158880 - DNA, 22 bp, Homo sapiens
ccttcctcatccatttctcttg

SEQ ID NO: 8158881 - DNA, 17 bp, Homo sapiens
ccttcctcatctccttc

SEQ ID NO: 8158882 - DNA, 17 bp, Homo sapiens
ccttcctcatctccttc

SEQ ID NO: 8158883 - DNA, 17 bp, Homo sapiens
ccttcctcatctccttc

SEQ ID NO: 8158884 - DNA, 22 bp, Homo sapiens
ccttccctaaagcgtcgcttag

SEQ ID NO: 8158885 - DNA, 22 bp, Homo sapiens
ccttcctcatccatttctcttg

SEQ ID NO: 8158886 - DNA, 22 bp, Homo sapiens
ccttcatgtcattggacacctt

SEQ ID NO: 8158887 - DNA, 22 bp, Homo sapiens
ccttcattattcctgaactgtt

SEQ ID NO: 8158888 - DNA, 22 bp, Homo sapiens
ccttcattattcctgaactgtt

SEQ ID NO: 8158889 - DNA, 22 bp, Homo sapiens
ccttcccaggctagaccaacat

SEQ ID NO: 8158890 - DNA, 22 bp, Homo sapiens
ccttcccatgcagcctgtctga

SEQ ID NO: 8158891 - DNA, 22 bp, Homo sapiens
ccttccccaggtgctcactgtc

SEQ ID NO: 8158892 - DNA, 20 bp, Homo sapiens
ccttccccacccgctgaggt

SEQ ID NO: 8158893 - DNA, 20 bp, Homo sapiens
ccttccccacccgctgaggt

SEQ ID NO: 8158894 - DNA, 19 bp, Homo sapiens
ccttccccttcagcctctg

SEQ ID NO: 8158895 - DNA, 19 bp, Homo sapiens
ccttccccttcagcctctg

SEQ ID NO: 8158896 - DNA, 22 bp, Homo sapiens
cctgtgtggaaaccgcatgacg

SEQ ID NO: 8158897 - DNA, 22 bp, Homo sapiens
cctgtgtggaaaccgcatgacg

SEQ ID NO: 8158898 - DNA, 22 bp, Homo sapiens
cctgtgtgcctggccgcgggag

SEQ ID NO: 8158899 - DNA, 23 bp, Homo sapiens
cctgtgtgcccttaattcacagc

SEQ ID NO: 8158900 - DNA, 23 bp, Homo sapiens
cctgtgtgcccttaattcacagc

SEQ ID NO: 8158901 - DNA, 22 bp, Homo sapiens
cctgtgtgctgatgacgacaga

SEQ ID NO: 8158902 - DNA, 22 bp, Homo sapiens
cctgtgtgctgatgacgacaga

SEQ ID NO: 8158903 - DNA, 22 bp, Homo sapiens
cctgtgtgcacacgaggccatg

SEQ ID NO: 8158904 - DNA, 22 bp, Homo sapiens
cctgtgtgcacacgaggccatg

SEQ ID NO: 8158905 - DNA, 22 bp, Homo sapiens
cctgtgtgcacacgaggccatg

SEQ ID NO: 8158906 - DNA, 22 bp, Homo sapiens
cctgtgtctttgcctcagggtc

SEQ ID NO: 8158907 - DNA, 22 bp, Homo sapiens
cctgtgtcttccccactggtgt

SEQ ID NO: 8158908 - DNA, 22 bp, Homo sapiens
cctgtgtcttccccactggtgt

SEQ ID NO: 8158909 - DNA, 22 bp, Homo sapiens
cctgtgtcttccccactggtgt

SEQ ID NO: 8158910 - DNA, 23 bp, Homo sapiens
cctgtgtctgttgctgaataatg

SEQ ID NO: 8158911 - DNA, 22 bp, Homo sapiens
cctgtgtcctaatccatcaggc

SEQ ID NO: 8158912 - DNA, 22 bp, Homo sapiens
cctgtgtccttggcagatatcc

SEQ ID NO: 8158913 - DNA, 22 bp, Homo sapiens
cctgtgtgtctgtcactgcaca

SEQ ID NO: 8158914 - DNA, 21 bp, Homo sapiens
cctgtgtgtctgactgggcta

SEQ ID NO: 8158915 - DNA, 21 bp, Homo sapiens
cctgtgtgtctgactgggcta

SEQ ID NO: 8158916 - DNA, 22 bp, Homo sapiens
cctgtgtgtaggccaggggagt

SEQ ID NO: 8158917 - DNA, 22 bp, Homo sapiens
cctgtgtgtaggccaggggagt

SEQ ID NO: 8158918 - DNA, 20 bp, Homo sapiens
cctgtgtggtttgcactaca

SEQ ID NO: 8158919 - DNA, 22 bp, Homo sapiens
cctgtgtggccgcactgctccc

SEQ ID NO: 8158920 - DNA, 22 bp, Homo sapiens
cctgtgtggccaggctggagtc

SEQ ID NO: 8158921 - DNA, 22 bp, Homo sapiens
cctgtgtggccaggctggagtc

SEQ ID NO: 8158922 - DNA, 19 bp, Homo sapiens
cctgtgtggggtagagatc

SEQ ID NO: 8158923 - DNA, 20 bp, Homo sapiens
cctgtgtggccagctgaggc

SEQ ID NO: 8158924 - DNA, 20 bp, Homo sapiens
cctgtgtggccagctgaggc

SEQ ID NO: 8158925 - DNA, 22 bp, Homo sapiens
cctgtgtggaaggcaggaggcc

SEQ ID NO: 8158926 - DNA, 23 bp, Homo sapiens
tgttccagatacgccttttcctc

SEQ ID NO: 8158927 - DNA, 23 bp, Homo sapiens
tgttccagatacgccttttcctc

SEQ ID NO: 8158928 - DNA, 23 bp, Homo sapiens
tgttccagatacgccttttcctc

SEQ ID NO: 8158929 - DNA, 22 bp, Homo sapiens
tgttccagattcggcgtgggac

SEQ ID NO: 8158930 - DNA, 22 bp, Homo sapiens
tgttccagatttagccaaccga

SEQ ID NO: 8158931 - DNA, 22 bp, Homo sapiens
tgttccagattcggcgtgggac

SEQ ID NO: 8158932 - DNA, 22 bp, Homo sapiens
tgttccagggcgcgaaggtggt

SEQ ID NO: 8158933 - DNA, 22 bp, Homo sapiens
tgttccataagtggtgctttgt

SEQ ID NO: 8158934 - DNA, 22 bp, Homo sapiens
tgttcattcgctattgtctatg

SEQ ID NO: 8158935 - DNA, 22 bp, Homo sapiens
tgttcattattcttcatctgcc

SEQ ID NO: 8158936 - DNA, 22 bp, Homo sapiens
tgttcatttggcccttttgtat

SEQ ID NO: 8158937 - DNA, 22 bp, Homo sapiens
tgttcattctgtatatgctgta

SEQ ID NO: 8158938 - DNA, 19 bp, Homo sapiens
tgttcagatatgtcagctt

SEQ ID NO: 8158939 - DNA, 22 bp, Homo sapiens
tgttcatattcctgtccgctga

SEQ ID NO: 8158940 - DNA, 22 bp, Homo sapiens
tgttcatatcattttgaaagct

SEQ ID NO: 8158941 - DNA, 22 bp, Homo sapiens
tgttcatagctatcattgtgtc

SEQ ID NO: 8158942 - DNA, 22 bp, Homo sapiens
tgttcattactgctgtttgcca

SEQ ID NO: 8158943 - DNA, 22 bp, Homo sapiens
tgttacagggataaatgaggta

SEQ ID NO: 8158944 - DNA, 22 bp, Homo sapiens
tgttacaggaaatagaattacc

SEQ ID NO: 8158945 - DNA, 22 bp, Homo sapiens
tgttacagtcattgttttctga

SEQ ID NO: 8158946 - DNA, 22 bp, Homo sapiens
tgttacagtactacaattctgc

SEQ ID NO: 8158947 - DNA, 22 bp, Homo sapiens
tgttacaagtcttgaggtactt

SEQ ID NO: 8158948 - DNA, 22 bp, Homo sapiens
tgttacagaaagtttatgaatg

SEQ ID NO: 8158949 - DNA, 22 bp, Homo sapiens
tgttacagaatgaatttccgga

SEQ ID NO: 8158950 - DNA, 22 bp, Homo sapiens
tgttacagaaatattgcttctt

SEQ ID NO: 8158951 - DNA, 22 bp, Homo sapiens
tgttacacagcagaatagcaag

SEQ ID NO: 8158952 - DNA, 22 bp, Homo sapiens
tgttacacccacaaaaaattcc

SEQ ID NO: 8158953 - DNA, 22 bp, Homo sapiens
cctggtggcgaatggtggtagg

SEQ ID NO: 8158954 - DNA, 22 bp, Homo sapiens
cctggtgggcaggagtgagacc

SEQ ID NO: 8158955 - DNA, 22 bp, Homo sapiens
cctggtggccttcagcccacaa

SEQ ID NO: 8158956 - DNA, 22 bp, Homo sapiens
cctggtggacagcagccagcag

SEQ ID NO: 8158957 - DNA, 22 bp, Homo sapiens
cctgggtgtcatgggcagctgg

SEQ ID NO: 8158958 - DNA, 22 bp, Homo sapiens
cctgggtgtcatgggcagctgg

SEQ ID NO: 8158959 - DNA, 22 bp, Homo sapiens
cctggtgcttaccagagctttt

SEQ ID NO: 8158960 - DNA, 22 bp, Homo sapiens
cctggtgcttaccagagctttt

SEQ ID NO: 8158961 - DNA, 22 bp, Homo sapiens
cctgggtgtcatgggcagctgg

SEQ ID NO: 8158962 - DNA, 22 bp, Homo sapiens
cctgggtgtcatgggcagctgg

SEQ ID NO: 8158963 - DNA, 22 bp, Homo sapiens
tgtttacttcatcgagtacttc

SEQ ID NO: 8158964 - DNA, 22 bp, Homo sapiens
tgtttacttatgtgggtcacat

SEQ ID NO: 8158965 - DNA, 22 bp, Homo sapiens
tgtttacttctttccatggctt

SEQ ID NO: 8158966 - DNA, 22 bp, Homo sapiens
tgtttacttgaggtggaaacaa

SEQ ID NO: 8158967 - DNA, 22 bp, Homo sapiens
tgtttacttaaatgttttcata

SEQ ID NO: 8158968 - DNA, 22 bp, Homo sapiens
tgtttactggctcctgtggttc

SEQ ID NO: 8158969 - DNA, 22 bp, Homo sapiens
cctggtttgggtgccagtgagt

SEQ ID NO: 8158970 - DNA, 22 bp, Homo sapiens
tgtttactggaccagggagggg

SEQ ID NO: 8158971 - DNA, 22 bp, Homo sapiens
cctggtttctccatgtctcatt

SEQ ID NO: 8158972 - DNA, 22 bp, Homo sapiens
cctggtttcaggaacataatct

SEQ ID NO: 8158973 - DNA, 22 bp, Homo sapiens
cctggttgagggaggtgtggac

SEQ ID NO: 8158974 - DNA, 21 bp, Homo sapiens
cctggttggcgtagctcagtc

SEQ ID NO: 8158975 - DNA, 22 bp, Homo sapiens
cctggtttaatgctcactgttg

SEQ ID NO: 8158976 - DNA, 22 bp, Homo sapiens
cctggtttatgccagatcctgt

SEQ ID NO: 8158977 - DNA, 22 bp, Homo sapiens
cctggtgttgtgaagtagccgt

SEQ ID NO: 8158978 - DNA, 22 bp, Homo sapiens
cctgggctgtacctgtgcgcgg

SEQ ID NO: 8158979 - DNA, 22 bp, Homo sapiens
cctgggctgtacctgtgcgcgg

SEQ ID NO: 8158980 - DNA, 21 bp, Homo sapiens
cctgggctgtggtttggagac

SEQ ID NO: 8158981 - DNA, 21 bp, Homo sapiens
cctgggctgtggtttggagac

SEQ ID NO: 8158982 - DNA, 22 bp, Homo sapiens
cctgggctggagtacagcagtg

SEQ ID NO: 8158983 - DNA, 22 bp, Homo sapiens
cctgggctgggcgtctcatggg

SEQ ID NO: 8158984 - DNA, 22 bp, Homo sapiens
cctgggctgggcgtctcatggg

SEQ ID NO: 8158985 - DNA, 22 bp, Homo sapiens
cctgggctgggcgtctcatggg

SEQ ID NO: 8158986 - DNA, 22 bp, Homo sapiens
cctgggcttacgacctctgact

SEQ ID NO: 8158987 - DNA, 22 bp, Homo sapiens
cctgggcttacgacctctgact

SEQ ID NO: 8158988 - DNA, 22 bp, Homo sapiens
cctgggctgttgcatcatcctt

SEQ ID NO: 8158989 - DNA, 22 bp, Homo sapiens
cctgggctgttgcatcatcctt

SEQ ID NO: 8158990 - DNA, 22 bp, Homo sapiens
cctgggcttccacgagcagagg

SEQ ID NO: 8158991 - DNA, 22 bp, Homo sapiens
cctgggcttacgacctctgact

SEQ ID NO: 8158992 - DNA, 22 bp, Homo sapiens
cctgggcttacgacctctgact

SEQ ID NO: 8158993 - DNA, 22 bp, Homo sapiens
cctgggcttacgacctctgact

SEQ ID NO: 8158994 - DNA, 22 bp, Homo sapiens
tgttacaaggaagaatgtaggt

SEQ ID NO: 8158995 - DNA, 22 bp, Homo sapiens
tgttacaaatgcggagtttgtg

SEQ ID NO: 8158996 - DNA, 22 bp, Homo sapiens
tgttacaaactgttgtttctat

SEQ ID NO: 8158997 - DNA, 22 bp, Homo sapiens
tgttacaagtcttgaggtactt

SEQ ID NO: 8158998 - DNA, 22 bp, Homo sapiens
tgttaatgctgtgctcctgtga

SEQ ID NO: 8158999 - DNA, 22 bp, Homo sapiens
tgtgttctgaaggagaagagtg

SEQ ID NO: 8159000 - DNA, 22 bp, Homo sapiens
cctgggctctgaggagggagtc

SEQ ID NO: 8159001 - DNA, 22 bp, Homo sapiens
cctgggctctgaggagggagtc

SEQ ID NO: 8159002 - DNA, 22 bp, Homo sapiens
cctgggctctatcctgacccag

SEQ ID NO: 8159003 - DNA, 22 bp, Homo sapiens
cctgggctctatcctgacccag

SEQ ID NO: 8159004 - DNA, 22 bp, Homo sapiens
cctgggctctgtcagaattggg

SEQ ID NO: 8159005 - DNA, 22 bp, Homo sapiens
cctgggctctgaggagggagtc

SEQ ID NO: 8159006 - DNA, 22 bp, Homo sapiens
cctgggctctgaggagggagtc

SEQ ID NO: 8159007 - DNA, 22 bp, Homo sapiens
cctgggctctgaggagggagtc

SEQ ID NO: 8159008 - DNA, 22 bp, Homo sapiens
cctgggctctgaggagggagtc

SEQ ID NO: 8159009 - DNA, 22 bp, Homo sapiens
cctgggctctatcctgacccag

SEQ ID NO: 8159010 - DNA, 22 bp, Homo sapiens
cctgggctcaagtgatcctcct

SEQ ID NO: 8159011 - DNA, 22 bp, Homo sapiens
cctgggctcgcgcacttcaccc

SEQ ID NO: 8159012 - DNA, 22 bp, Homo sapiens
cctgggctcaagtgatcctcct

SEQ ID NO: 8159013 - DNA, 22 bp, Homo sapiens
cctgggctcaagtgatcctcct

SEQ ID NO: 8159014 - DNA, 22 bp, Homo sapiens
tgtgtctgcccttagtacatct

SEQ ID NO: 8159015 - DNA, 22 bp, Homo sapiens
tgtgtctgcccttagtacatct

SEQ ID NO: 8159016 - DNA, 22 bp, Homo sapiens
tgtgtctggataggtaatggat

SEQ ID NO: 8159017 - DNA, 22 bp, Homo sapiens
tgtgtctggataggtaatggat

SEQ ID NO: 8159018 - DNA, 22 bp, Homo sapiens
cctgggctggagtacagcagtg

SEQ ID NO: 8159019 - DNA, 22 bp, Homo sapiens
cctgggctgctcatggggatga

SEQ ID NO: 8159020 - DNA, 22 bp, Homo sapiens
cctgggctggagtacagcagtg

SEQ ID NO: 8159021 - DNA, 22 bp, Homo sapiens
cctgggctggagtacagcagtg

SEQ ID NO: 8159022 - DNA, 22 bp, Homo sapiens
cctgggctgcatgatggcattt

SEQ ID NO: 8159023 - DNA, 22 bp, Homo sapiens
cctgggctgaagtcaagtgtgg

SEQ ID NO: 8159024 - DNA, 22 bp, Homo sapiens
cctgggctgcatgatggcattt

SEQ ID NO: 8159025 - DNA, 22 bp, Homo sapiens
cctgggctgcatgatggcattt

SEQ ID NO: 8159026 - DNA, 16 bp, Homo sapiens
cctgggctctgttgga

SEQ ID NO: 8159027 - DNA, 16 bp, Homo sapiens
cctgggctctgttgga

SEQ ID NO: 8159028 - DNA, 22 bp, Homo sapiens
cctgggctctgtcagaattggg

SEQ ID NO: 8159029 - DNA, 22 bp, Homo sapiens
cctgggctctgtcagaattggg

SEQ ID NO: 8159030 - DNA, 22 bp, Homo sapiens
cctgggctctgaggagggagtc

SEQ ID NO: 8159031 - DNA, 23 bp, Homo sapiens
tggggccaagtgaggaagggtct

SEQ ID NO: 8159032 - DNA, 22 bp, Homo sapiens
tggggctgtgagactacaggat

SEQ ID NO: 8159033 - DNA, 22 bp, Homo sapiens
tggggctgtccttagtctgaga

SEQ ID NO: 8159034 - DNA, 22 bp, Homo sapiens
tggggccacactgatctcccag

SEQ ID NO: 8159035 - DNA, 22 bp, Homo sapiens
tggggccaagaaggtctcatgt

SEQ ID NO: 8159036 - DNA, 23 bp, Homo sapiens
tggggccaagtgaggaagggtct

SEQ ID NO: 8159037 - DNA, 23 bp, Homo sapiens
tggggccaagtgaggaagggtct

SEQ ID NO: 8159038 - DNA, 22 bp, Homo sapiens
tggggctgtggattctcacgaa

SEQ ID NO: 8159039 - DNA, 22 bp, Homo sapiens
tggggctgtgagactacaggat

SEQ ID NO: 8159040 - DNA, 22 bp, Homo sapiens
tggggctgtgagactacaggat

SEQ ID NO: 8159041 - DNA, 22 bp, Homo sapiens
tggggctgtggattctcacgaa

SEQ ID NO: 8159042 - DNA, 22 bp, Homo sapiens
tggggctgtggattctcacgaa

SEQ ID NO: 8159043 - DNA, 22 bp, Homo sapiens
tggggcttctcctgtaggctca

SEQ ID NO: 8159044 - DNA, 19 bp, Homo sapiens
tggggctgtgttttgaccc

SEQ ID NO: 8159045 - DNA, 22 bp, Homo sapiens
tggggcagttaataaacattct

SEQ ID NO: 8159046 - DNA, 22 bp, Homo sapiens
tggggcagtggcttttcaccct

SEQ ID NO: 8159047 - DNA, 22 bp, Homo sapiens
tggggcagggatgggaaactat

SEQ ID NO: 8159048 - DNA, 22 bp, Homo sapiens
tggggcagggatgggaaactat

SEQ ID NO: 8159049 - DNA, 22 bp, Homo sapiens
tggggcagctccatctattcca

SEQ ID NO: 8159050 - DNA, 22 bp, Homo sapiens
tggggcagctccatctattcca

SEQ ID NO: 8159051 - DNA, 22 bp, Homo sapiens
tggggcagccacatagacaaca

SEQ ID NO: 8159052 - DNA, 22 bp, Homo sapiens
tggggcagccacatagacaaca

SEQ ID NO: 8159053 - DNA, 22 bp, Homo sapiens
cctgggaggtggatgttgcggt

SEQ ID NO: 8159054 - DNA, 22 bp, Homo sapiens
cctgggaggtggatgttgcggt

SEQ ID NO: 8159055 - DNA, 22 bp, Homo sapiens
cctgggaggtggatgttgcggt

SEQ ID NO: 8159056 - DNA, 19 bp, Homo sapiens
cctgggagtcagctgaagg

SEQ ID NO: 8159057 - DNA, 22 bp, Homo sapiens
cctgggaggctgaggctgcagt

SEQ ID NO: 8159058 - DNA, 22 bp, Homo sapiens
cctgggaggctgaggctgcagt

SEQ ID NO: 8159059 - DNA, 21 bp, Homo sapiens
tgggggagaattggttgcttt

SEQ ID NO: 8159060 - DNA, 22 bp, Homo sapiens
tgggggaactgttgcgcgcggg

SEQ ID NO: 8159061 - DNA, 22 bp, Homo sapiens
tgggggaaattcagccagatat

SEQ ID NO: 8159062 - DNA, 22 bp, Homo sapiens
tgggggaagagcttgttaaagt

SEQ ID NO: 8159063 - DNA, 22 bp, Homo sapiens
tgggggaagagcttgttaaagt

SEQ ID NO: 8159064 - DNA, 21 bp, Homo sapiens
tgggggagaattggttgcttt

SEQ ID NO: 8159065 - DNA, 21 bp, Homo sapiens
tgggggagaattggttgcttt

SEQ ID NO: 8159066 - DNA, 21 bp, Homo sapiens
tgggggagaattggttgcttt

SEQ ID NO: 8159067 - DNA, 21 bp, Homo sapiens
tgggggagaattggttgcttt

SEQ ID NO: 8159068 - DNA, 22 bp, Homo sapiens
cctgggagtgtgccatctctgt

SEQ ID NO: 8159069 - DNA, 22 bp, Homo sapiens
cctgggagtgtgccatctctgt

SEQ ID NO: 8159070 - DNA, 22 bp, Homo sapiens
cctgggagtgtgccatctctgt

SEQ ID NO: 8159071 - DNA, 22 bp, Homo sapiens
cctgggagtgtgccatctctgt

SEQ ID NO: 8159072 - DNA, 22 bp, Homo sapiens
cctgggatttcctgagcactct

SEQ ID NO: 8159073 - DNA, 22 bp, Homo sapiens
cctgggagtgtcagacttgctt

SEQ ID NO: 8159074 - DNA, 22 bp, Homo sapiens
cctgggagtgtcagacttgctt

SEQ ID NO: 8159075 - DNA, 22 bp, Homo sapiens
cctgggagtgtcagacttgctt

SEQ ID NO: 8159076 - DNA, 22 bp, Homo sapiens
cctgggagtgtgccatctctgt

SEQ ID NO: 8159077 - DNA, 22 bp, Homo sapiens
cctgggagtgtcagacttgctt

SEQ ID NO: 8159078 - DNA, 22 bp, Homo sapiens
cctgggagtgtgccatctctgt

SEQ ID NO: 8159079 - DNA, 19 bp, Homo sapiens
cctgggagtcagctgaagg

SEQ ID NO: 8159080 - DNA, 19 bp, Homo sapiens
cctgggagtcagctgaagg

SEQ ID NO: 8159081 - DNA, 19 bp, Homo sapiens
cctgggagtcagctgaagg

SEQ ID NO: 8159082 - DNA, 19 bp, Homo sapiens
cctgggagtcagctgaagg

SEQ ID NO: 8159083 - DNA, 22 bp, Homo sapiens
cctgggagtggcactcacagca

SEQ ID NO: 8159084 - DNA, 22 bp, Homo sapiens
cctgggagtgcacaggtttcgt

SEQ ID NO: 8159085 - DNA, 22 bp, Homo sapiens
cctgggagtgcacaggtttcgt

SEQ ID NO: 8159086 - DNA, 19 bp, Homo sapiens
cctgggagtcagctgaagg

SEQ ID NO: 8159087 - DNA, 22 bp, Homo sapiens
cctgggagtggcactcacagca

SEQ ID NO: 8159088 - DNA, 22 bp, Homo sapiens
cctgggagtggcactcacagca

SEQ ID NO: 8159089 - DNA, 22 bp, Homo sapiens
cctgggagtggcactcacagca

SEQ ID NO: 8159090 - DNA, 22 bp, Homo sapiens
cctgggagtggcactcacagca

SEQ ID NO: 8159091 - DNA, 22 bp, Homo sapiens
tgtgtctgaactagttgctctc

SEQ ID NO: 8159092 - DNA, 22 bp, Homo sapiens
tgtgtctgaactagttgctctc

SEQ ID NO: 8159093 - DNA, 22 bp, Homo sapiens
tgtgtctgcactgagtcctcac

SEQ ID NO: 8159094 - DNA, 23 bp, Homo sapiens
tgtgtctgaggatatatgtgcat

SEQ ID NO: 8159095 - DNA, 23 bp, Homo sapiens
tgtgtctgaggatatatgtgcat

SEQ ID NO: 8159096 - DNA, 23 bp, Homo sapiens
tgtgtctgaggatatatgtgcat

SEQ ID NO: 8159097 - DNA, 22 bp, Homo sapiens
tgtgtctgcactgagtcctcac

SEQ ID NO: 8159098 - DNA, 22 bp, Homo sapiens
tgtgtctgaacatgctttgtaa

SEQ ID NO: 8159099 - DNA, 22 bp, Homo sapiens
tgtgtctgaacatgctttgtaa

SEQ ID NO: 8159100 - DNA, 22 bp, Homo sapiens
tgtgtctctttgtcctagagct

SEQ ID NO: 8159101 - DNA, 22 bp, Homo sapiens
tgtgtctctttgtcctagagct

SEQ ID NO: 8159102 - DNA, 22 bp, Homo sapiens
tgtgtctcctttccctgtctaa

SEQ ID NO: 8159103 - DNA, 22 bp, Homo sapiens
tgtgtctccatagccagctagc

SEQ ID NO: 8159104 - DNA, 19 bp, Homo sapiens
tgtgtctctgtgtagcctg

SEQ ID NO: 8159105 - DNA, 19 bp, Homo sapiens
tgtgtctctgtgtagcctg

SEQ ID NO: 8159106 - DNA, 23 bp, Homo sapiens
tgtgtatgtatctatgcataggt

SEQ ID NO: 8159107 - DNA, 22 bp, Homo sapiens
tgtgtatgtaagcatgtgcata

SEQ ID NO: 8159108 - DNA, 22 bp, Homo sapiens
tgtgtatgtaagcatgtgcata

SEQ ID NO: 8159109 - DNA, 22 bp, Homo sapiens
tgtgtatattaggacacattct

SEQ ID NO: 8159110 - DNA, 22 bp, Homo sapiens
tgtgtatgcatacacacataga

SEQ ID NO: 8159111 - DNA, 22 bp, Homo sapiens
tgtgtatgcatacacacataga

SEQ ID NO: 8159112 - DNA, 22 bp, Homo sapiens
tgtgtatgcatacacacataga

SEQ ID NO: 8159113 - DNA, 22 bp, Homo sapiens
tgtgtatattaggacacattct

SEQ ID NO: 8159114 - DNA, 22 bp, Homo sapiens
tgtgtatatgtaaatatagttg

SEQ ID NO: 8159115 - DNA, 22 bp, Homo sapiens
tgtgtatgtctgtatgcacaca

SEQ ID NO: 8159116 - DNA, 22 bp, Homo sapiens
tgtgtatgtgtatacactatat

SEQ ID NO: 8159117 - DNA, 22 bp, Homo sapiens
tgtgtatgtgtatacactatat

SEQ ID NO: 8159118 - DNA, 22 bp, Homo sapiens
tgtgtatgttttgaggttgcta

SEQ ID NO: 8159119 - DNA, 22 bp, Homo sapiens
tgtgtattaatgtttgtatatg

SEQ ID NO: 8159120 - DNA, 22 bp, Homo sapiens
tgtgtattaatgtttgtatatg

SEQ ID NO: 8159121 - DNA, 22 bp, Homo sapiens
tgtgtctcaagtcagagcatca

SEQ ID NO: 8159122 - DNA, 22 bp, Homo sapiens
cctgggcaacatagtgagaccc

SEQ ID NO: 8159123 - DNA, 22 bp, Homo sapiens
cctgggcaacatagtgagaccc

SEQ ID NO: 8159124 - DNA, 22 bp, Homo sapiens
cctgggcaacatagtgagaccc

SEQ ID NO: 8159125 - DNA, 22 bp, Homo sapiens
cctgggcaacatagggagaccc

SEQ ID NO: 8159126 - DNA, 22 bp, Homo sapiens
cctgggcaacatagtgagacct

SEQ ID NO: 8159127 - DNA, 22 bp, Homo sapiens
cctgggcaacatagtgagacct

SEQ ID NO: 8159128 - DNA, 22 bp, Homo sapiens
cctgggcaacatagtgagacct

SEQ ID NO: 8159129 - DNA, 22 bp, Homo sapiens
cctgggcaaatgccagagacaa

SEQ ID NO: 8159130 - DNA, 22 bp, Homo sapiens
cctgggcaaattatgttactca

SEQ ID NO: 8159131 - DNA, 22 bp, Homo sapiens
cctgggcaacatagggagaccc

SEQ ID NO: 8159132 - DNA, 22 bp, Homo sapiens
cctgggcaacatagggagaccc

SEQ ID NO: 8159133 - DNA, 22 bp, Homo sapiens
cctgggcaacatagggagaccc

SEQ ID NO: 8159134 - DNA, 22 bp, Homo sapiens
cctgggcaaatgccagagacaa

SEQ ID NO: 8159135 - DNA, 22 bp, Homo sapiens
cctgggatttgcgccagacctt

SEQ ID NO: 8159136 - DNA, 22 bp, Homo sapiens
cctgggcaaatgccagagacaa

SEQ ID NO: 8159137 - DNA, 22 bp, Homo sapiens
cctgggatttcctgagcactct

SEQ ID NO: 8159138 - DNA, 22 bp, Homo sapiens
cctgggatttgcgccagacctt

SEQ ID NO: 8159139 - DNA, 22 bp, Homo sapiens
cctgggcaatatagtgaggccc

SEQ ID NO: 8159140 - DNA, 22 bp, Homo sapiens
cctgggcaatatagtgaggccc

SEQ ID NO: 8159141 - DNA, 22 bp, Homo sapiens
tgtgggtcttccaaagaagggc

SEQ ID NO: 8159142 - DNA, 22 bp, Homo sapiens
tgtgggtcctcctgtgtgcccg

SEQ ID NO: 8159143 - DNA, 22 bp, Homo sapiens
tgtgggtcctcctgtgtgcccg

SEQ ID NO: 8159144 - DNA, 22 bp, Homo sapiens
tgtgggtcatagtatcgtgtta

SEQ ID NO: 8159145 - DNA, 22 bp, Homo sapiens
tgtgtataaaagcagtgcagga

SEQ ID NO: 8159146 - DNA, 20 bp, Homo sapiens
tgtgtataaatatatgtttc

SEQ ID NO: 8159147 - DNA, 20 bp, Homo sapiens
tgtgtataaatatatgtttc

SEQ ID NO: 8159148 - DNA, 22 bp, Homo sapiens
tgtgtatacgagtatgaatatg

SEQ ID NO: 8159149 - DNA, 22 bp, Homo sapiens
tgtgtatacgagtatgaatatg

SEQ ID NO: 8159150 - DNA, 22 bp, Homo sapiens
tgtgtatacatacatacacacg

SEQ ID NO: 8159151 - DNA, 22 bp, Homo sapiens
tgtgtatacaacttataggagc

SEQ ID NO: 8159152 - DNA, 22 bp, Homo sapiens
tgtgtataattagaccatttac

SEQ ID NO: 8159153 - DNA, 22 bp, Homo sapiens
tgtgtataactcttaattcatt

SEQ ID NO: 8159154 - DNA, 22 bp, Homo sapiens
tgtgtataactcttaattcatt

SEQ ID NO: 8159155 - DNA, 22 bp, Homo sapiens
tgtgtataggttgtgctaatag

SEQ ID NO: 8159156 - DNA, 22 bp, Homo sapiens
tgtgtatatatgtttaagtcat

SEQ ID NO: 8159157 - DNA, 22 bp, Homo sapiens
tgtgtatatatgtgcacatgta

SEQ ID NO: 8159158 - DNA, 22 bp, Homo sapiens
tgtgtatagaaagtaggaaagg

SEQ ID NO: 8159159 - DNA, 22 bp, Homo sapiens
tgtgtatagatgcatgcatata

SEQ ID NO: 8159160 - DNA, 22 bp, Homo sapiens
tgtgtatagatgcatgcatata

SEQ ID NO: 8159161 - DNA, 22 bp, Homo sapiens
ctgacatttactgagcacttac

SEQ ID NO: 8159162 - DNA, 22 bp, Homo sapiens
ctgacatgttgacaagaaataa

SEQ ID NO: 8159163 - DNA, 22 bp, Homo sapiens
ctgacatttactgagcacttac

SEQ ID NO: 8159164 - DNA, 22 bp, Homo sapiens
ctgaccaacatggtgaaacctt

SEQ ID NO: 8159165 - DNA, 22 bp, Homo sapiens
ctgacaggttggtagctttgga

SEQ ID NO: 8159166 - DNA, 22 bp, Homo sapiens
ctgacagtctcattgatttgct

SEQ ID NO: 8159167 - DNA, 22 bp, Homo sapiens
ctgaccagggtagaggtgagag

SEQ ID NO: 8159168 - DNA, 22 bp, Homo sapiens
ctgacccttgctcgggccctgt

SEQ ID NO: 8159169 - DNA, 19 bp, Homo sapiens
ctgacccaggacaccacgg

SEQ ID NO: 8159170 - DNA, 22 bp, Homo sapiens
ctgacagatacttatgacataa

SEQ ID NO: 8159171 - DNA, 22 bp, Homo sapiens
ctgacagatacttatgacataa

SEQ ID NO: 8159172 - DNA, 22 bp, Homo sapiens
ctgacagatgctgctggcagta

SEQ ID NO: 8159173 - DNA, 22 bp, Homo sapiens
ctgacagatgctgctggcagta

SEQ ID NO: 8159174 - DNA, 22 bp, Homo sapiens
ctgacagatctggatctgaact

SEQ ID NO: 8159175 - DNA, 22 bp, Homo sapiens
ctgacagatacttatgacataa

SEQ ID NO: 8159176 - DNA, 22 bp, Homo sapiens
ctgaatcatggtcattagttta

SEQ ID NO: 8159177 - DNA, 22 bp, Homo sapiens
ctgaatcatgccattttgctta

SEQ ID NO: 8159178 - DNA, 22 bp, Homo sapiens
ctgaatattagtcatgtctgat

SEQ ID NO: 8159179 - DNA, 22 bp, Homo sapiens
ctgaatatcatttatcattggc

SEQ ID NO: 8159180 - DNA, 22 bp, Homo sapiens
ctgacagctgttgcagtgaatg

SEQ ID NO: 8159181 - DNA, 22 bp, Homo sapiens
ctgacaggctgagatccctggt

SEQ ID NO: 8159182 - DNA, 22 bp, Homo sapiens
ctgacagattagatgtgcatat

SEQ ID NO: 8159183 - DNA, 17 bp, Homo sapiens
ctctttataaagagtta

SEQ ID NO: 8159184 - DNA, 17 bp, Homo sapiens
ctctttataaagagtta

SEQ ID NO: 8159185 - DNA, 17 bp, Homo sapiens
ctctttataaagagtta

SEQ ID NO: 8159186 - DNA, 22 bp, Homo sapiens
ctctttccagggtaccccaggt

SEQ ID NO: 8159187 - DNA, 19 bp, Homo sapiens
ctctttccattgtatttgc

SEQ ID NO: 8159188 - DNA, 21 bp, Homo sapiens
ctctttatatagtaaagatat

SEQ ID NO: 8159189 - DNA, 21 bp, Homo sapiens
ctctttatatagtaaagatat

SEQ ID NO: 8159190 - DNA, 22 bp, Homo sapiens
ctctttcctcgatgggctcctg

SEQ ID NO: 8159191 - DNA, 22 bp, Homo sapiens
ctctttctcattgtcagcagaa

SEQ ID NO: 8159192 - DNA, 22 bp, Homo sapiens
ctctttctcattgtcagcagaa

SEQ ID NO: 8159193 - DNA, 22 bp, Homo sapiens
ctctttcctcagccacagtcta

SEQ ID NO: 8159194 - DNA, 22 bp, Homo sapiens
ctctttctgattcgctgggacc

SEQ ID NO: 8159195 - DNA, 22 bp, Homo sapiens
ctctttctgattcgctgggacc

SEQ ID NO: 8159196 - DNA, 22 bp, Homo sapiens
ctctttctgattcgctgggacc

SEQ ID NO: 8159197 - DNA, 22 bp, Homo sapiens
ctctttctgattcgctgggacc

SEQ ID NO: 8159198 - DNA, 22 bp, Homo sapiens
ctgaatatcatttatcattggc

SEQ ID NO: 8159199 - DNA, 22 bp, Homo sapiens
ctgactccctgattctgggttt

SEQ ID NO: 8159200 - DNA, 22 bp, Homo sapiens
ctgactctcctcaagcataaat

SEQ ID NO: 8159201 - DNA, 22 bp, Homo sapiens
ctgactccttaccatatgcttt

SEQ ID NO: 8159202 - DNA, 22 bp, Homo sapiens
ctgagccaaccacagcaggagc

SEQ ID NO: 8159203 - DNA, 23 bp, Homo sapiens
ctgactcatcccaccacctcctc

SEQ ID NO: 8159204 - DNA, 22 bp, Homo sapiens
ctgactcccaagctagtgctct

SEQ ID NO: 8159205 - DNA, 23 bp, Homo sapiens
ctgactcatcccaccacctcctc

SEQ ID NO: 8159206 - DNA, 22 bp, Homo sapiens
ctgactcagcagctgatgatcc

SEQ ID NO: 8159207 - DNA, 23 bp, Homo sapiens
ctgactcatcccaccacctcctc

SEQ ID NO: 8159208 - DNA, 22 bp, Homo sapiens
ctgactatctttctcaaagtgg

SEQ ID NO: 8159209 - DNA, 22 bp, Homo sapiens
ctgactcagcagctgatgatcc

SEQ ID NO: 8159210 - DNA, 22 bp, Homo sapiens
ctgacctgcccttaggcttctc

SEQ ID NO: 8159211 - DNA, 22 bp, Homo sapiens
ctgagccatgggtctaagcact

SEQ ID NO: 8159212 - DNA, 22 bp, Homo sapiens
ctgagccatccataccagctta

SEQ ID NO: 8159213 - DNA, 22 bp, Homo sapiens
ctgagccaaggggacagtgaca

SEQ ID NO: 8159214 - DNA, 20 bp, Homo sapiens
ctgagccaactctcttcttg

SEQ ID NO: 8159215 - DNA, 20 bp, Homo sapiens
ctgagccaactctcttcttg

SEQ ID NO: 8159216 - DNA, 22 bp, Homo sapiens
ctgagccataagggaggctggg

SEQ ID NO: 8159217 - DNA, 22 bp, Homo sapiens
ctgagccataagggaggctggg

SEQ ID NO: 8159218 - DNA, 22 bp, Homo sapiens
ctgagccagtagtcagggacaa

SEQ ID NO: 8159219 - DNA, 22 bp, Homo sapiens
ctgagcccttgtcttcctggtc

SEQ ID NO: 8159220 - DNA, 22 bp, Homo sapiens
ctgagcctccaggaggggggtg

SEQ ID NO: 8159221 - DNA, 22 bp, Homo sapiens
ctgagcccttgaacccaagtcc

SEQ ID NO: 8159222 - DNA, 22 bp, Homo sapiens
ctgagccctggctcgcctggag

SEQ ID NO: 8159223 - DNA, 22 bp, Homo sapiens
ctgagccctgcctcttgtcact

SEQ ID NO: 8159224 - DNA, 22 bp, Homo sapiens
ctgaggcagagggcagaccaga

SEQ ID NO: 8159225 - DNA, 22 bp, Homo sapiens
ctgagcctgtgtttctctggca

SEQ ID NO: 8159226 - DNA, 22 bp, Homo sapiens
ctgagcctcctgcttctatttc

SEQ ID NO: 8159227 - DNA, 21 bp, Homo sapiens
ctgaggcagcacagctagtca

SEQ ID NO: 8159228 - DNA, 21 bp, Homo sapiens
ctgaggcagcacagctagtca

SEQ ID NO: 8159229 - DNA, 22 bp, Homo sapiens
ctgaggcagagggcagaccaga

SEQ ID NO: 8159230 - DNA, 22 bp, Homo sapiens
ctgaggcagagggcagaccaga

SEQ ID NO: 8159231 - DNA, 22 bp, Homo sapiens
ctgaggcagagggcagaccaga

SEQ ID NO: 8159232 - DNA, 22 bp, Homo sapiens
ctgagcccattgggtgctgtta

SEQ ID NO: 8159233 - DNA, 20 bp, Homo sapiens
ctgagcccccagcctgcagg

SEQ ID NO: 8159234 - DNA, 22 bp, Homo sapiens
ctgagccccatctgaggtgccc

SEQ ID NO: 8159235 - DNA, 22 bp, Homo sapiens
ctgagccccatctgaggtgccc

SEQ ID NO: 8159236 - DNA, 22 bp, Homo sapiens
ctgagcccaggcgggagctgag

SEQ ID NO: 8159237 - DNA, 20 bp, Homo sapiens
ctgagcccagatcccaggtc

SEQ ID NO: 8159238 - DNA, 20 bp, Homo sapiens
ctgagcccagatcccaggtc

SEQ ID NO: 8159239 - DNA, 20 bp, Homo sapiens
ctgagcccccagcctgcagg

SEQ ID NO: 8159240 - DNA, 20 bp, Homo sapiens
ctgagcccccagcctgcagg

SEQ ID NO: 8159241 - DNA, 22 bp, Homo sapiens
ctgagcccgggtgctctacccc

SEQ ID NO: 8159242 - DNA, 22 bp, Homo sapiens
ctgagccctcctgcttgctgag

SEQ ID NO: 8159243 - DNA, 22 bp, Homo sapiens
ctgagcccctctgacctcagag

SEQ ID NO: 8159244 - DNA, 22 bp, Homo sapiens
ctgagcccctctgacctcagag

SEQ ID NO: 8159245 - DNA, 22 bp, Homo sapiens
ctgagcccctctgacctcagag

SEQ ID NO: 8159246 - DNA, 22 bp, Homo sapiens
ctgcaccacagcctgaggcagc

SEQ ID NO: 8159247 - DNA, 22 bp, Homo sapiens
ctgcacagtgttggaagctgcc

SEQ ID NO: 8159248 - DNA, 22 bp, Homo sapiens
ctgcacagtttgatttcttgct

SEQ ID NO: 8159249 - DNA, 22 bp, Homo sapiens
ctgcaccatccttcatgctctg

SEQ ID NO: 8159250 - DNA, 19 bp, Homo sapiens
ctgcactgagaaaaggagg

SEQ ID NO: 8159251 - DNA, 22 bp, Homo sapiens
ctgcactgagcatctaacctta

SEQ ID NO: 8159252 - DNA, 22 bp, Homo sapiens
ctgcactgagcatctaacctta

SEQ ID NO: 8159253 - DNA, 22 bp, Homo sapiens
ctgcagggagcagatggcgtgt

SEQ ID NO: 8159254 - DNA, 22 bp, Homo sapiens
ctgcaggctcgaagacacggat

SEQ ID NO: 8159255 - DNA, 22 bp, Homo sapiens
ctgcaggcccccttcctggagt

SEQ ID NO: 8159256 - DNA, 22 bp, Homo sapiens
ctgcagggagcagatggcgtgt

SEQ ID NO: 8159257 - DNA, 22 bp, Homo sapiens
ctgcaggctcgaagacacggat

SEQ ID NO: 8159258 - DNA, 22 bp, Homo sapiens
ctgcagggagcagatggcgtgt

SEQ ID NO: 8159259 - DNA, 22 bp, Homo sapiens
ctgcagggatgtgaggcccgtt

SEQ ID NO: 8159260 - DNA, 22 bp, Homo sapiens
ctgcaggcccccttcctggagt

SEQ ID NO: 8159261 - DNA, 22 bp, Homo sapiens
ctgcaggcatttattcatgcaa

SEQ ID NO: 8159262 - DNA, 18 bp, Homo sapiens
ctgcacttcagcttgggc

SEQ ID NO: 8159263 - DNA, 22 bp, Homo sapiens
ctgcaggcatctaactgtgggc

SEQ ID NO: 8159264 - DNA, 22 bp, Homo sapiens
ctgcactgagctctcccagccc

SEQ ID NO: 8159265 - DNA, 22 bp, Homo sapiens
ctgcactgagctctcccagccc

SEQ ID NO: 8159266 - DNA, 21 bp, Homo sapiens
ctgcactgtgatttaaaatgt

SEQ ID NO: 8159267 - DNA, 22 bp, Homo sapiens
ctgcactgtgtattccttggct

SEQ ID NO: 8159268 - DNA, 22 bp, Homo sapiens
ctgcagggcagggcctcctggc

SEQ ID NO: 8159269 - DNA, 22 bp, Homo sapiens
ctgcagggattgcttctgtata

SEQ ID NO: 8159270 - DNA, 22 bp, Homo sapiens
ctgcagggcattgtaactcttt

SEQ ID NO: 8159271 - DNA, 22 bp, Homo sapiens
ctgcagggcagggcctcctggc

SEQ ID NO: 8159272 - DNA, 22 bp, Homo sapiens
ctgcagggcagggcctcctggc

SEQ ID NO: 8159273 - DNA, 19 bp, Homo sapiens
ctgcagggatgtgcagagt

SEQ ID NO: 8159274 - DNA, 22 bp, Homo sapiens
ctgcagggatgtgaggcccgtt

SEQ ID NO: 8159275 - DNA, 22 bp, Homo sapiens
ctgcagggatgtgaggcccgtt

SEQ ID NO: 8159276 - DNA, 19 bp, Homo sapiens
ctgcagggatgtgcagagt

SEQ ID NO: 8159277 - DNA, 19 bp, Homo sapiens
ctgcagggatgtgcagagt

SEQ ID NO: 8159278 - DNA, 19 bp, Homo sapiens
ctgcagggatgtgcagagt

SEQ ID NO: 8159279 - DNA, 22 bp, Homo sapiens
ctgcagggcttaccttgctctg

SEQ ID NO: 8159280 - DNA, 22 bp, Homo sapiens
ctgcagggcttaccttgctctg

SEQ ID NO: 8159281 - DNA, 22 bp, Homo sapiens
ctgcaggggaccaaagtctgac

SEQ ID NO: 8159282 - DNA, 22 bp, Homo sapiens
ctgcaggggcagtccacttcct

SEQ ID NO: 8159283 - DNA, 22 bp, Homo sapiens
ctgcaggggcagtccacttcct

SEQ ID NO: 8159284 - DNA, 22 bp, Homo sapiens
ctgcaggggcagtccacttcct

SEQ ID NO: 8159285 - DNA, 22 bp, Homo sapiens
ctgcaggggcctcgagcacagg

SEQ ID NO: 8159286 - DNA, 22 bp, Homo sapiens
ctgcaggggcctcgagcacagg

SEQ ID NO: 8159287 - DNA, 22 bp, Homo sapiens
ctgcagggcccgcctgagccct

SEQ ID NO: 8159288 - DNA, 22 bp, Homo sapiens
ctgcagggcccgcctgagccct

SEQ ID NO: 8159289 - DNA, 22 bp, Homo sapiens
ctgcagggcccgcctgagccct

SEQ ID NO: 8159290 - DNA, 22 bp, Homo sapiens
ctgcagggcccgcctgagccct

SEQ ID NO: 8159291 - DNA, 22 bp, Homo sapiens
ctgcagggcccaaggtcaacgg

SEQ ID NO: 8159292 - DNA, 22 bp, Homo sapiens
ctgcagggccatgggttctata

SEQ ID NO: 8159293 - DNA, 22 bp, Homo sapiens
ctgaggccagaacccgaccctg

SEQ ID NO: 8159294 - DNA, 22 bp, Homo sapiens
ctgaggccagagtgggcctctt

SEQ ID NO: 8159295 - DNA, 22 bp, Homo sapiens
ctgaggccagagtgggcctctt

SEQ ID NO: 8159296 - DNA, 22 bp, Homo sapiens
ctgaggccagagtgggcctctt

SEQ ID NO: 8159297 - DNA, 18 bp, Homo sapiens
ctgaggccaactacactg

SEQ ID NO: 8159298 - DNA, 22 bp, Homo sapiens
ctgaggccagctgcagagctct

SEQ ID NO: 8159299 - DNA, 22 bp, Homo sapiens
ctgaggccagctgcagagctct

SEQ ID NO: 8159300 - DNA, 22 bp, Homo sapiens
ctgaggccagctgcagagctct

SEQ ID NO: 8159301 - DNA, 22 bp, Homo sapiens
ctgaggccagagtgggcctctt

SEQ ID NO: 8159302 - DNA, 22 bp, Homo sapiens
ctgaggcatgttacaggacata

SEQ ID NO: 8159303 - DNA, 22 bp, Homo sapiens
ctgaggcatgttacaggacata

SEQ ID NO: 8159304 - DNA, 22 bp, Homo sapiens
ctgaggcatgggaagttgggtg

SEQ ID NO: 8159305 - DNA, 22 bp, Homo sapiens
ctgaggcatgggaagttgggtg

SEQ ID NO: 8159306 - DNA, 22 bp, Homo sapiens
ctgaggcatgggaagttgggtg

SEQ ID NO: 8159307 - DNA, 22 bp, Homo sapiens
ctgaggcatgggaagttgggtg

SEQ ID NO: 8159308 - DNA, 22 bp, Homo sapiens
ctgaggcatgttacaggacata

SEQ ID NO: 8159309 - DNA, 22 bp, Homo sapiens
ctgaggcatgttacaggacata

SEQ ID NO: 8159310 - DNA, 22 bp, Homo sapiens
ctgaggcatgttacaggacata

SEQ ID NO: 8159311 - DNA, 22 bp, Homo sapiens
ctgaggcatgttacaggacata

SEQ ID NO: 8159312 - DNA, 22 bp, Homo sapiens
ctgaggcatgttacaggacata

SEQ ID NO: 8159313 - DNA, 22 bp, Homo sapiens
ctgaggcccctctcttgagctt

SEQ ID NO: 8159314 - DNA, 22 bp, Homo sapiens
ctgaggcccctctcttgagctt

SEQ ID NO: 8159315 - DNA, 22 bp, Homo sapiens
ctgaggcccctctcttgagctt

SEQ ID NO: 8159316 - DNA, 19 bp, Homo sapiens
ctgaggcccatgtaccatg

SEQ ID NO: 8159317 - DNA, 19 bp, Homo sapiens
ctgaggcccatgtaccatg

SEQ ID NO: 8159318 - DNA, 19 bp, Homo sapiens
ctgaggcccatgtaccatg

SEQ ID NO: 8159319 - DNA, 22 bp, Homo sapiens
ctgaggcccctcttgtgagcat

SEQ ID NO: 8159320 - DNA, 22 bp, Homo sapiens
ctgaggcccctcttgtgagcat

SEQ ID NO: 8159321 - DNA, 22 bp, Homo sapiens
ctgaggcccctcttgtgagcat

SEQ ID NO: 8159322 - DNA, 22 bp, Homo sapiens
ctgaggccagctgcagagctct

SEQ ID NO: 8159323 - DNA, 18 bp, Homo sapiens
ctgaggcccagagagggc

SEQ ID NO: 8159324 - DNA, 18 bp, Homo sapiens
ctgaggcccagagagggc

SEQ ID NO: 8159325 - DNA, 18 bp, Homo sapiens
ctgaggcccagagagggc

SEQ ID NO: 8159326 - DNA, 17 bp, Homo sapiens
ctgaggcccagggccca

SEQ ID NO: 8159327 - DNA, 17 bp, Homo sapiens
ctgaggcccagggccca

SEQ ID NO: 8159328 - DNA, 17 bp, Homo sapiens
ctgaggcccagggccca

SEQ ID NO: 8159329 - DNA, 17 bp, Homo sapiens
ctgaggcccagggccca

SEQ ID NO: 8159330 - DNA, 22 bp, Homo sapiens
ctgcacagtggacagtgaagat

SEQ ID NO: 8159331 - DNA, 22 bp, Homo sapiens
ctgcacagtggacagtgaagat

SEQ ID NO: 8159332 - DNA, 22 bp, Homo sapiens
ctgcacagggatatggggagct

SEQ ID NO: 8159333 - DNA, 22 bp, Homo sapiens
ctgcacagctggccagggagag

SEQ ID NO: 8159334 - DNA, 22 bp, Homo sapiens
ctgcacagcatgctctgattta

SEQ ID NO: 8159335 - DNA, 22 bp, Homo sapiens
ctgcacagctggccagggagag

SEQ ID NO: 8159336 - DNA, 22 bp, Homo sapiens
ctgcacagctggccagggagag

SEQ ID NO: 8159337 - DNA, 22 bp, Homo sapiens
ctgcacagctggccagggagag

SEQ ID NO: 8159338 - DNA, 22 bp, Homo sapiens
ctgcaaaattgttctttgctcc

SEQ ID NO: 8159339 - DNA, 22 bp, Homo sapiens
ctgcaaagctgttcacaaattt

SEQ ID NO: 8159340 - DNA, 22 bp, Homo sapiens
ctgaggccggagcactgaagag

SEQ ID NO: 8159341 - DNA, 22 bp, Homo sapiens
ctgaggccggagcactgaagag

SEQ ID NO: 8159342 - DNA, 22 bp, Homo sapiens
ctgaggccggagcactgaagag

SEQ ID NO: 8159343 - DNA, 22 bp, Homo sapiens
ctgaggccgtctgggtctgcag

SEQ ID NO: 8159344 - DNA, 22 bp, Homo sapiens
ctgaggccgtctgggtctgcag

SEQ ID NO: 8159345 - DNA, 22 bp, Homo sapiens
ctgaggccgtctgggtctgcag

SEQ ID NO: 8159346 - DNA, 22 bp, Homo sapiens
ctgcacagagcggcagttctta

SEQ ID NO: 8159347 - DNA, 22 bp, Homo sapiens
ctgcacagagcagggcagacac

SEQ ID NO: 8159348 - DNA, 22 bp, Homo sapiens
ctgcacagccctcaagagcctg

SEQ ID NO: 8159349 - DNA, 22 bp, Homo sapiens
ctgcacagagcagggcagacac

SEQ ID NO: 8159350 - DNA, 22 bp, Homo sapiens
ctgcacagagcagggcagacac

SEQ ID NO: 8159351 - DNA, 22 bp, Homo sapiens
ctgcacacatcgcactgcccgt

SEQ ID NO: 8159352 - DNA, 22 bp, Homo sapiens
ctgcacacatatggcttctctc

SEQ ID NO: 8159353 - DNA, 22 bp, Homo sapiens
ctctgccaagatgacaggtaag

SEQ ID NO: 8159354 - DNA, 20 bp, Homo sapiens
ctctgcagcaaggcctgggt

SEQ ID NO: 8159355 - DNA, 22 bp, Homo sapiens
ctctgccactcgaagtcaagga

SEQ ID NO: 8159356 - DNA, 22 bp, Homo sapiens
ctctgcagaggcccaaggctga

SEQ ID NO: 8159357 - DNA, 20 bp, Homo sapiens
ctctgcagcaaggcctgggt

SEQ ID NO: 8159358 - DNA, 22 bp, Homo sapiens
tttcctttatgacatcaccact

SEQ ID NO: 8159359 - DNA, 20 bp, Homo sapiens
tttcctttcattttagtacc

SEQ ID NO: 8159360 - DNA, 22 bp, Homo sapiens
tttccttgttattatttgtcct

SEQ ID NO: 8159361 - DNA, 22 bp, Homo sapiens
tttccttgttcatttgccctat

SEQ ID NO: 8159362 - DNA, 22 bp, Homo sapiens
ctctgccatcttggagctcaag

SEQ ID NO: 8159363 - DNA, 22 bp, Homo sapiens
ctctgccatttatcagaactgt

SEQ ID NO: 8159364 - DNA, 22 bp, Homo sapiens
ctctgcccacgtcttgcccaga

SEQ ID NO: 8159365 - DNA, 21 bp, Homo sapiens
ctctgcccagggcctcctgcc

SEQ ID NO: 8159366 - DNA, 22 bp, Homo sapiens
ctctgccagtttctggcctcag

SEQ ID NO: 8159367 - DNA, 22 bp, Homo sapiens
ctctgccatcttggagctcaag

SEQ ID NO: 8159368 - DNA, 22 bp, Homo sapiens
ctctgccactcgaagtcaagga

SEQ ID NO: 8159369 - DNA, 22 bp, Homo sapiens
ctctgccagccaaagtcatcac

SEQ ID NO: 8159370 - DNA, 22 bp, Homo sapiens
ctctgccagtttctggcctcag

SEQ ID NO: 8159371 - DNA, 21 bp, Homo sapiens
ctctgcccagggcctcctgcc

SEQ ID NO: 8159372 - DNA, 22 bp, Homo sapiens
ctctgcccagtgcccacaggag

SEQ ID NO: 8159373 - DNA, 22 bp, Homo sapiens
ctctgcccagtgcccacaggag

SEQ ID NO: 8159374 - DNA, 22 bp, Homo sapiens
ctctgcccagtgcccacaggag

SEQ ID NO: 8159375 - DNA, 22 bp, Homo sapiens
ctctgcccgcggatgccacgtc

SEQ ID NO: 8159376 - DNA, 22 bp, Homo sapiens
ctctgcccccagctggtgcttg

SEQ ID NO: 8159377 - DNA, 22 bp, Homo sapiens
ctctgcccgcggatgccacgtc

SEQ ID NO: 8159378 - DNA, 19 bp, Homo sapiens
ctctgccctacagaaagct

SEQ ID NO: 8159379 - DNA, 22 bp, Homo sapiens
ctctgccctcgcacatctgcca

SEQ ID NO: 8159380 - DNA, 22 bp, Homo sapiens
ctctgcccgcggatgccacgtc

SEQ ID NO: 8159381 - DNA, 22 bp, Homo sapiens
ctctgcccgcggatgccacgtc

SEQ ID NO: 8159382 - DNA, 22 bp, Homo sapiens
ctctgcccgcggatgccacgtc

SEQ ID NO: 8159383 - DNA, 22 bp, Homo sapiens
tttgccacattctatacatttg

SEQ ID NO: 8159384 - DNA, 22 bp, Homo sapiens
tttgcattttagatttaggcct

SEQ ID NO: 8159385 - DNA, 22 bp, Homo sapiens
tttgcattttagatttaggcct

SEQ ID NO: 8159386 - DNA, 19 bp, Homo sapiens
ctctgcctccctcctgggt

SEQ ID NO: 8159387 - DNA, 19 bp, Homo sapiens
ctctgcctccctcctgggt

SEQ ID NO: 8159388 - DNA, 19 bp, Homo sapiens
ctctgcctccctcctgggt

SEQ ID NO: 8159389 - DNA, 19 bp, Homo sapiens
ctctgcctccctcctgggt

SEQ ID NO: 8159390 - DNA, 19 bp, Homo sapiens
ctctgcctccctcctgggt

SEQ ID NO: 8159391 - DNA, 19 bp, Homo sapiens
ctctgcctccctcctgggt

SEQ ID NO: 8159392 - DNA, 22 bp, Homo sapiens
ctctgccctcgcacatctgcca

SEQ ID NO: 8159393 - DNA, 22 bp, Homo sapiens
ctctgccctcgcacatctgcca

SEQ ID NO: 8159394 - DNA, 22 bp, Homo sapiens
tttgggcaattcagtgggacct

SEQ ID NO: 8159395 - DNA, 22 bp, Homo sapiens
tttgggaataattgcacagatt

SEQ ID NO: 8159396 - DNA, 22 bp, Homo sapiens
tttgggaaccagaagttcaaaa

SEQ ID NO: 8159397 - DNA, 22 bp, Homo sapiens
tttgggaacttaattatgtctg

SEQ ID NO: 8159398 - DNA, 22 bp, Homo sapiens
tttggaattggcattctattct

SEQ ID NO: 8159399 - DNA, 22 bp, Homo sapiens
ctctggaattaaggaagcctgt

SEQ ID NO: 8159400 - DNA, 22 bp, Homo sapiens
ctctggaagatgacctgggtaa

SEQ ID NO: 8159401 - DNA, 22 bp, Homo sapiens
ctctggaagatgacctgggtaa

SEQ ID NO: 8159402 - DNA, 22 bp, Homo sapiens
ctctggaagatgacctgggtaa

SEQ ID NO: 8159403 - DNA, 22 bp, Homo sapiens
ctctggaagtgatggcaggtca

SEQ ID NO: 8159404 - DNA, 22 bp, Homo sapiens
ctctggaagtgatggcaggtca

SEQ ID NO: 8159405 - DNA, 22 bp, Homo sapiens
ctctggaagtgatggcaggtca

SEQ ID NO: 8159406 - DNA, 20 bp, Homo sapiens
ctctggaagagtttaaatgg

SEQ ID NO: 8159407 - DNA, 20 bp, Homo sapiens
ctctggaagagtttaaatgg

SEQ ID NO: 8159408 - DNA, 20 bp, Homo sapiens
ctctggaagagtttaaatgg

SEQ ID NO: 8159409 - DNA, 22 bp, Homo sapiens
ctctggaagaatacacttagaa

SEQ ID NO: 8159410 - DNA, 22 bp, Homo sapiens
ctctggaagaatacacttagaa

SEQ ID NO: 8159411 - DNA, 22 bp, Homo sapiens
ctctggaagaatacacttagaa

SEQ ID NO: 8159412 - DNA, 22 bp, Homo sapiens
ctctggaatgggtgtttctaac

SEQ ID NO: 8159413 - DNA, 22 bp, Homo sapiens
ctctggaatgggtgtttctaac

SEQ ID NO: 8159414 - DNA, 22 bp, Homo sapiens
ctctggaatgggtgtttctaac

SEQ ID NO: 8159415 - DNA, 22 bp, Homo sapiens
ctctggaatgtttacatgccct

SEQ ID NO: 8159416 - DNA, 22 bp, Homo sapiens
ctctggaatgtttacatgccct

SEQ ID NO: 8159417 - DNA, 20 bp, Homo sapiens
ctctgctttaggagagtcag

SEQ ID NO: 8159418 - DNA, 22 bp, Homo sapiens
tttgctctgacagtgccagaga

SEQ ID NO: 8159419 - DNA, 22 bp, Homo sapiens
ctctgctttttagggagcctag

SEQ ID NO: 8159420 - DNA, 22 bp, Homo sapiens
ctctggaaaaccactagcagga

SEQ ID NO: 8159421 - DNA, 22 bp, Homo sapiens
ctctggaaaaccactagcagga

SEQ ID NO: 8159422 - DNA, 22 bp, Homo sapiens
ctctggaaatggccatagtcat

SEQ ID NO: 8159423 - DNA, 22 bp, Homo sapiens
ctctggaaatggccatagtcat

SEQ ID NO: 8159424 - DNA, 22 bp, Homo sapiens
ctctggaaaattgtgtgggggt

SEQ ID NO: 8159425 - DNA, 22 bp, Homo sapiens
ctctggaaatggccatagtcat

SEQ ID NO: 8159426 - DNA, 22 bp, Homo sapiens
ctctggaaaattgtgtgggggt

SEQ ID NO: 8159427 - DNA, 22 bp, Homo sapiens
ctctggaaaaccactagcagga

SEQ ID NO: 8159428 - DNA, 22 bp, Homo sapiens
tttgccattgcctgtcagttgt

SEQ ID NO: 8159429 - DNA, 22 bp, Homo sapiens
tttgccctcaggtttttatgtg

SEQ ID NO: 8159430 - DNA, 22 bp, Homo sapiens
tttgccttctctgaacctattt

SEQ ID NO: 8159431 - DNA, 19 bp, Homo sapiens
tttgcctgtataccctgtg

SEQ ID NO: 8159432 - DNA, 21 bp, Homo sapiens
tttgccttcacgaagcatcct

SEQ ID NO: 8159433 - DNA, 22 bp, Homo sapiens
tttgctattgtgaatagtgcca

SEQ ID NO: 8159434 - DNA, 22 bp, Homo sapiens
tttgctatttttctgtgcagct

SEQ ID NO: 8159435 - DNA, 22 bp, Homo sapiens
tttgctataaaagggtcacacg

SEQ ID NO: 8159436 - DNA, 19 bp, Homo sapiens
ttttaagtcctctctattc

SEQ ID NO: 8159437 - DNA, 19 bp, Homo sapiens
ttttaagtgccctttcttc

SEQ ID NO: 8159438 - DNA, 22 bp, Homo sapiens
ttttaagttaatataattgagg

SEQ ID NO: 8159439 - DNA, 22 bp, Homo sapiens
ttttaagttaatataattgagg

SEQ ID NO: 8159440 - DNA, 22 bp, Homo sapiens
ttttaagttggattgctaagta

SEQ ID NO: 8159441 - DNA, 22 bp, Homo sapiens
ttttaatactgctattgtagga

SEQ ID NO: 8159442 - DNA, 22 bp, Homo sapiens
ttttaatactgctattgtagga

SEQ ID NO: 8159443 - DNA, 22 bp, Homo sapiens
ttttaatactgctattgtagga

SEQ ID NO: 8159444 - DNA, 22 bp, Homo sapiens
ttttagaatcaggttgtctggg

SEQ ID NO: 8159445 - DNA, 22 bp, Homo sapiens
ttttaatactgctattgtagga

SEQ ID NO: 8159446 - DNA, 22 bp, Homo sapiens
ttttagatagtttaactgcact

SEQ ID NO: 8159447 - DNA, 22 bp, Homo sapiens
ttttagatagtttaactgcact

SEQ ID NO: 8159448 - DNA, 22 bp, Homo sapiens
ttttagattataagtctaattc

SEQ ID NO: 8159449 - DNA, 22 bp, Homo sapiens
ttttagcacactttctttagcg

SEQ ID NO: 8159450 - DNA, 22 bp, Homo sapiens
ttttagcactaagtgatatgct

SEQ ID NO: 8159451 - DNA, 22 bp, Homo sapiens
ttttagattgggaaatgtaaag

SEQ ID NO: 8159452 - DNA, 22 bp, Homo sapiens
ttttagattgggaaatgtaaag

SEQ ID NO: 8159453 - DNA, 20 bp, Homo sapiens
ttttagcacttgttatggtg

SEQ ID NO: 8159454 - DNA, 22 bp, Homo sapiens
ttttagctgttgattgttcccc

SEQ ID NO: 8159455 - DNA, 22 bp, Homo sapiens
ttttagcactaagtgatatgct

SEQ ID NO: 8159456 - DNA, 22 bp, Homo sapiens
tttgtacatatataaaatctgt

SEQ ID NO: 8159457 - DNA, 22 bp, Homo sapiens
tttgtacatatataaaatctgt

SEQ ID NO: 8159458 - DNA, 22 bp, Homo sapiens
tttgtacatatataaaatctgt

SEQ ID NO: 8159459 - DNA, 22 bp, Homo sapiens
tttgtacatatataaaatctgt

SEQ ID NO: 8159460 - DNA, 22 bp, Homo sapiens
tttgtacatataaatcttgtat

SEQ ID NO: 8159461 - DNA, 22 bp, Homo sapiens
tttgtacatataaatcttgtat

SEQ ID NO: 8159462 - DNA, 22 bp, Homo sapiens
ttttaagatgctagtatttcag

SEQ ID NO: 8159463 - DNA, 22 bp, Homo sapiens
ttttaagatgctagtatttcag

SEQ ID NO: 8159464 - DNA, 22 bp, Homo sapiens
ttttaagaggaggctgtttgaa

SEQ ID NO: 8159465 - DNA, 22 bp, Homo sapiens
ttttaagaggaggctgtttgaa

SEQ ID NO: 8159466 - DNA, 22 bp, Homo sapiens
ttttaagatgctagtatttcag

SEQ ID NO: 8159467 - DNA, 22 bp, Homo sapiens
ttttaagaactgttctgtgctt

SEQ ID NO: 8159468 - DNA, 22 bp, Homo sapiens
ttttaagaactgttctgtgctt

SEQ ID NO: 8159469 - DNA, 22 bp, Homo sapiens
ttttaagaactgttctgtgctt

SEQ ID NO: 8159470 - DNA, 22 bp, Homo sapiens
tttgttctattttagagatgaa

SEQ ID NO: 8159471 - DNA, 22 bp, Homo sapiens
tttgttctattttagagatgaa

SEQ ID NO: 8159472 - DNA, 22 bp, Homo sapiens
tttgttctgaaaactcaagtcc

SEQ ID NO: 8159473 - DNA, 22 bp, Homo sapiens
tttgtacactgtctactatgaa

SEQ ID NO: 8159474 - DNA, 22 bp, Homo sapiens
tttgtacactgtctactatgaa

SEQ ID NO: 8159475 - DNA, 22 bp, Homo sapiens
tttgtacactgtctactatgaa

SEQ ID NO: 8159476 - DNA, 22 bp, Homo sapiens
tttgtacagtgaaagcgaggtt

SEQ ID NO: 8159477 - DNA, 22 bp, Homo sapiens
tttgtacagtgatgttgtatgc

SEQ ID NO: 8159478 - DNA, 23 bp, Homo sapiens
tttgtacagaattttgccttcag

SEQ ID NO: 8159479 - DNA, 22 bp, Homo sapiens
tttgtacacaggtcattcaggg

SEQ ID NO: 8159480 - DNA, 22 bp, Homo sapiens
tttgtacacctacctaatacag

SEQ ID NO: 8159481 - DNA, 22 bp, Homo sapiens
ctctttactgctactacaaaga

SEQ ID NO: 8159482 - DNA, 22 bp, Homo sapiens
ctctttagtggtgatgatgcta

SEQ ID NO: 8159483 - DNA, 22 bp, Homo sapiens
ctctttactgctactacaaaga

SEQ ID NO: 8159484 - DNA, 20 bp, Homo sapiens
ctctttacatgtctcttcct

SEQ ID NO: 8159485 - DNA, 22 bp, Homo sapiens
ctctttaagctcctaacagcca

SEQ ID NO: 8159486 - DNA, 22 bp, Homo sapiens
ctctttaagctcctaacagcca

SEQ ID NO: 8159487 - DNA, 22 bp, Homo sapiens
ctcttgtttcctttctgcagtc

SEQ ID NO: 8159488 - DNA, 22 bp, Homo sapiens
ctcttgtggtttataaagatat

SEQ ID NO: 8159489 - DNA, 22 bp, Homo sapiens
ctcttgtggtttataaagatat

SEQ ID NO: 8159490 - DNA, 22 bp, Homo sapiens
ctcttcttgaaagaggaattca

SEQ ID NO: 8159491 - DNA, 22 bp, Homo sapiens
ctcttcttgcctgatgaggcag

SEQ ID NO: 8159492 - DNA, 22 bp, Homo sapiens
ttttcagtggtatctttgtaaa

SEQ ID NO: 8159493 - DNA, 22 bp, Homo sapiens
ttttcagttactgtttatgtga

SEQ ID NO: 8159494 - DNA, 22 bp, Homo sapiens
ttttcagttatagaatggtaga

SEQ ID NO: 8159495 - DNA, 22 bp, Homo sapiens
ttttcagttactgtttatgtga

SEQ ID NO: 8159496 - DNA, 22 bp, Homo sapiens
ttttcagagagcttttatgtcc

SEQ ID NO: 8159497 - DNA, 22 bp, Homo sapiens
ttttcagaattagcataccatt

SEQ ID NO: 8159498 - DNA, 22 bp, Homo sapiens
ttttcagaaagatgagaaatta

SEQ ID NO: 8159499 - DNA, 22 bp, Homo sapiens
ttttcacttaaggaatttcatg

SEQ ID NO: 8159500 - DNA, 22 bp, Homo sapiens
ttttcagaaagatgagaaatta

SEQ ID NO: 8159501 - DNA, 22 bp, Homo sapiens
ttttcaccatagacactggtcc

SEQ ID NO: 8159502 - DNA, 22 bp, Homo sapiens
ttttcaccagcttgctacaatt

SEQ ID NO: 8159503 - DNA, 22 bp, Homo sapiens
ttttcagtaatgtctacataat

SEQ ID NO: 8159504 - DNA, 22 bp, Homo sapiens
ttttcagtaatgtctacataat

SEQ ID NO: 8159505 - DNA, 22 bp, Homo sapiens
ttttcagtgggcaatgatgtga

SEQ ID NO: 8159506 - DNA, 22 bp, Homo sapiens
ttttcagtggcttgcatatgtt

SEQ ID NO: 8159507 - DNA, 22 bp, Homo sapiens
ttttcaggtgcagtaatcatat

SEQ ID NO: 8159508 - DNA, 22 bp, Homo sapiens
ttttcagaggcctaagaggttt

SEQ ID NO: 8159509 - DNA, 22 bp, Homo sapiens
ttttcagaggcctaagaggttt

SEQ ID NO: 8159510 - DNA, 22 bp, Homo sapiens
ttttagtaccaaccagaagatg

SEQ ID NO: 8159511 - DNA, 22 bp, Homo sapiens
ttttagtaccaaccagaagatg

SEQ ID NO: 8159512 - DNA, 23 bp, Homo sapiens
ttttagtgactcctttatctgcc

SEQ ID NO: 8159513 - DNA, 22 bp, Homo sapiens
ctctgtttctcagcctatttcc

SEQ ID NO: 8159514 - DNA, 18 bp, Homo sapiens
ctctgtgttggtgtgaag

SEQ ID NO: 8159515 - DNA, 20 bp, Homo sapiens
ctcttcaaatattttattct

SEQ ID NO: 8159516 - DNA, 20 bp, Homo sapiens
ctcttattgcattagtttct

SEQ ID NO: 8159517 - DNA, 22 bp, Homo sapiens
ctcttattcctacagtaacagg

SEQ ID NO: 8159518 - DNA, 22 bp, Homo sapiens
ctcttattcctacagtaacagg

SEQ ID NO: 8159519 - DNA, 22 bp, Homo sapiens
ctcttagtttgtaaaaataatt

SEQ ID NO: 8159520 - DNA, 22 bp, Homo sapiens
ctcttccatattactcagggta

SEQ ID NO: 8159521 - DNA, 22 bp, Homo sapiens
ctcttccatttctacttcacag

SEQ ID NO: 8159522 - DNA, 22 bp, Homo sapiens
ctcttccatattactcagggta

SEQ ID NO: 8159523 - DNA, 22 bp, Homo sapiens
ctcttccacctccttcaggaga

SEQ ID NO: 8159524 - DNA, 22 bp, Homo sapiens
ctcttccacctccttcaggaga

SEQ ID NO: 8159525 - DNA, 22 bp, Homo sapiens
ctcttcattagttcctgtccca

SEQ ID NO: 8159526 - DNA, 22 bp, Homo sapiens
ctcttcattagttcctgtccca

SEQ ID NO: 8159527 - DNA, 22 bp, Homo sapiens
ctcttcatgtgtttaattttta

SEQ ID NO: 8159528 - DNA, 22 bp, Homo sapiens
ctcttcagttcacccctaagca

SEQ ID NO: 8159529 - DNA, 22 bp, Homo sapiens
ctcttcagttgttgcatattct

SEQ ID NO: 8159530 - DNA, 22 bp, Homo sapiens
ctcttcagttggtcactattct

SEQ ID NO: 8159531 - DNA, 22 bp, Homo sapiens
ctcttcagttcacccctaagca

SEQ ID NO: 8159532 - DNA, 22 bp, Homo sapiens
ctcttcagcctatttgagtgca

SEQ ID NO: 8159533 - DNA, 22 bp, Homo sapiens
ctcttcagcaatgctttagtcc

SEQ ID NO: 8159534 - DNA, 22 bp, Homo sapiens
ctcttcagatatacagtactct

SEQ ID NO: 8159535 - DNA, 22 bp, Homo sapiens
ctcttcagatatacagtactct

SEQ ID NO: 8159536 - DNA, 22 bp, Homo sapiens
ctcttcaggtttctgctctgga

SEQ ID NO: 8159537 - DNA, 22 bp, Homo sapiens
tttcacaggtacaaacactcct

SEQ ID NO: 8159538 - DNA, 22 bp, Homo sapiens
tttcacaggtaagcaatacagg

SEQ ID NO: 8159539 - DNA, 22 bp, Homo sapiens
tttcacaggtaagcaatacagg

SEQ ID NO: 8159540 - DNA, 22 bp, Homo sapiens
tttcacaaatgtctttaacttg

SEQ ID NO: 8159541 - DNA, 22 bp, Homo sapiens
tttcacaaactgaggagacaat

SEQ ID NO: 8159542 - DNA, 21 bp, Homo sapiens
tttcacaaaagtatgtgacaa

SEQ ID NO: 8159543 - DNA, 21 bp, Homo sapiens
tttcacaaaagtatgtgacaa

SEQ ID NO: 8159544 - DNA, 22 bp, Homo sapiens
tttcaattccaccaaagcgccc

SEQ ID NO: 8159545 - DNA, 22 bp, Homo sapiens
tttcaattccaccaaagcgccc

SEQ ID NO: 8159546 - DNA, 22 bp, Homo sapiens
tttcaattaggatgtttccatg

SEQ ID NO: 8159547 - DNA, 22 bp, Homo sapiens
tttcaattgactttggaagaaa

SEQ ID NO: 8159548 - DNA, 22 bp, Homo sapiens
tttcaatttccaggctagaatt

SEQ ID NO: 8159549 - DNA, 22 bp, Homo sapiens
tttcaattgactttggaagaaa

SEQ ID NO: 8159550 - DNA, 22 bp, Homo sapiens
tttcaattgactttggaagaaa

SEQ ID NO: 8159551 - DNA, 21 bp, Homo sapiens
tttcaatttgccttgagtcat

SEQ ID NO: 8159552 - DNA, 21 bp, Homo sapiens
tttcaatttgccttgagtcat

SEQ ID NO: 8159553 - DNA, 21 bp, Homo sapiens
tttcaatttgccttgagtcat

SEQ ID NO: 8159554 - DNA, 22 bp, Homo sapiens
tttcaatttccaggctagaatt

SEQ ID NO: 8159555 - DNA, 22 bp, Homo sapiens
tttcaatttccaggctagaatt

SEQ ID NO: 8159556 - DNA, 21 bp, Homo sapiens
tttcaatttgccttgagtcat

SEQ ID NO: 8159557 - DNA, 22 bp, Homo sapiens
tttcaatttccaggctagaatt

SEQ ID NO: 8159558 - DNA, 22 bp, Homo sapiens
tttcaattaggatgtttccatg

SEQ ID NO: 8159559 - DNA, 22 bp, Homo sapiens
tttcaaatggagtcgtgaaatg

SEQ ID NO: 8159560 - DNA, 22 bp, Homo sapiens
ctcctggccctgagctcccagg

SEQ ID NO: 8159561 - DNA, 22 bp, Homo sapiens
ctcctggccctgagctcccagg

SEQ ID NO: 8159562 - DNA, 22 bp, Homo sapiens
ctcctggccctgagctcccagg

SEQ ID NO: 8159563 - DNA, 22 bp, Homo sapiens
tttcacagtcaatttggagtca

SEQ ID NO: 8159564 - DNA, 22 bp, Homo sapiens
tttcacagtgctctgtaagtat

SEQ ID NO: 8159565 - DNA, 22 bp, Homo sapiens
tttcacagttagcatgaggact

SEQ ID NO: 8159566 - DNA, 22 bp, Homo sapiens
tttcacatagaaagtgatttac

SEQ ID NO: 8159567 - DNA, 22 bp, Homo sapiens
tttcctaatcccaatgacattt

SEQ ID NO: 8159568 - DNA, 20 bp, Homo sapiens
tttcctaagtggtttgctga

SEQ ID NO: 8159569 - DNA, 22 bp, Homo sapiens
tttcctaaggtagtgataattt

SEQ ID NO: 8159570 - DNA, 22 bp, Homo sapiens
tttcctaagggatgcggctcaa

SEQ ID NO: 8159571 - DNA, 22 bp, Homo sapiens
tttcctacccttccaggcagag

SEQ ID NO: 8159572 - DNA, 22 bp, Homo sapiens
tttcctaggctctagagttcta

SEQ ID NO: 8159573 - DNA, 22 bp, Homo sapiens
tttcctactgccctatacacac

SEQ ID NO: 8159574 - DNA, 22 bp, Homo sapiens
tttcctactgccctatacacac

SEQ ID NO: 8159575 - DNA, 20 bp, Homo sapiens
tttccactgtaatgtatgat

SEQ ID NO: 8159576 - DNA, 22 bp, Homo sapiens
tttccactgtagagatgttgaa

SEQ ID NO: 8159577 - DNA, 22 bp, Homo sapiens
tttcctaaggctcattttaaaa

SEQ ID NO: 8159578 - DNA, 22 bp, Homo sapiens
tttcctaactcatcggatgtac

SEQ ID NO: 8159579 - DNA, 22 bp, Homo sapiens
tttcctaagatagatacttcag

SEQ ID NO: 8159580 - DNA, 22 bp, Homo sapiens
ctctccaggagagcactttgag

SEQ ID NO: 8159581 - DNA, 22 bp, Homo sapiens
tttcctatgatattctatgtgt

SEQ ID NO: 8159582 - DNA, 22 bp, Homo sapiens
tttcctcaactgtcaaatgggg

SEQ ID NO: 8159583 - DNA, 22 bp, Homo sapiens
ctctccaggcgaggtcctactg

SEQ ID NO: 8159584 - DNA, 22 bp, Homo sapiens
ctctcctggtgtggaggacagg

SEQ ID NO: 8159585 - DNA, 22 bp, Homo sapiens
ctctcctggggagcacacacac

SEQ ID NO: 8159586 - DNA, 22 bp, Homo sapiens
ctctcctggtgtggaggacagg

SEQ ID NO: 8159587 - DNA, 22 bp, Homo sapiens
ctctccagtcatattctcagtc

SEQ ID NO: 8159588 - DNA, 22 bp, Homo sapiens
ctctccaggttagagcacttat

SEQ ID NO: 8159589 - DNA, 22 bp, Homo sapiens
ctctccagggcatgagttccac

SEQ ID NO: 8159590 - DNA, 22 bp, Homo sapiens
ctctccaggggtagatgccttc

SEQ ID NO: 8159591 - DNA, 22 bp, Homo sapiens
tttccttgggtctcttagtggc

SEQ ID NO: 8159592 - DNA, 22 bp, Homo sapiens
tttccttgttattatttgtcct

SEQ ID NO: 8159593 - DNA, 18 bp, Homo sapiens
tttccttgtatgaacata

SEQ ID NO: 8159594 - DNA, 18 bp, Homo sapiens
tttccttgtatgaacata

SEQ ID NO: 8159595 - DNA, 22 bp, Homo sapiens
ctctctgagtggctgtactttc

SEQ ID NO: 8159596 - DNA, 22 bp, Homo sapiens
ctctctgagtgagggacaagct

SEQ ID NO: 8159597 - DNA, 22 bp, Homo sapiens
ctctctgagtgagggacaagct

SEQ ID NO: 8159598 - DNA, 22 bp, Homo sapiens
ctctctgatgtcaggtcgctga

SEQ ID NO: 8159599 - DNA, 22 bp, Homo sapiens
ctctctgagtggctgtactttc

SEQ ID NO: 8159600 - DNA, 22 bp, Homo sapiens
ctctctgatgtcaggtcgctga

SEQ ID NO: 8159601 - DNA, 22 bp, Homo sapiens
ctctctgctgtatccttaggct

SEQ ID NO: 8159602 - DNA, 22 bp, Homo sapiens
ctctctggaagggggagctgat

SEQ ID NO: 8159603 - DNA, 22 bp, Homo sapiens
ctctctggaagggggagctgat

SEQ ID NO: 8159604 - DNA, 22 bp, Homo sapiens
ctctctgctgtatccttaggct

SEQ ID NO: 8159605 - DNA, 22 bp, Homo sapiens
ctctctgctgtatccttaggct

SEQ ID NO: 8159606 - DNA, 20 bp, Homo sapiens
ctctctctccattcccaggg

SEQ ID NO: 8159607 - DNA, 20 bp, Homo sapiens
ctctctctccattcccaggg

SEQ ID NO: 8159608 - DNA, 22 bp, Homo sapiens
ctctctctatgcgttgttccta

SEQ ID NO: 8159609 - DNA, 20 bp, Homo sapiens
ctctctctccattcccaggg

SEQ ID NO: 8159610 - DNA, 20 bp, Homo sapiens
ctctctctccattcccaggg

SEQ ID NO: 8159611 - DNA, 22 bp, Homo sapiens
ctctcctggtgtggaggacagg

SEQ ID NO: 8159612 - DNA, 17 bp, Homo sapiens
ctctccttcctctgagg

SEQ ID NO: 8159613 - DNA, 22 bp, Homo sapiens
ctctctctatgcgttgttccta

SEQ ID NO: 8159614 - DNA, 23 bp, Homo sapiens
ctctctctaccatgtgaggacac

SEQ ID NO: 8159615 - DNA, 20 bp, Homo sapiens
ctctctctccattcccaggg

SEQ ID NO: 8159616 - DNA, 22 bp, Homo sapiens
ctctctctatgcgttgttccta

SEQ ID NO: 8159617 - DNA, 22 bp, Homo sapiens
ctctctctatgcgttgttccta

SEQ ID NO: 8159618 - DNA, 22 bp, Homo sapiens
ctctctgaggaaggagcatctg

SEQ ID NO: 8159619 - DNA, 22 bp, Homo sapiens
ctctctgaggaaggagcatctg

SEQ ID NO: 8159620 - DNA, 22 bp, Homo sapiens
ctctctgaaactggagagtctc

SEQ ID NO: 8159621 - DNA, 22 bp, Homo sapiens
ctctctctttagaagcgtctgg

SEQ ID NO: 8159622 - DNA, 22 bp, Homo sapiens
ctctctctttagaagcgtctgg

SEQ ID NO: 8159623 - DNA, 22 bp, Homo sapiens
ctctctcttgtgttgctgcaga

SEQ ID NO: 8159624 - DNA, 22 bp, Homo sapiens
ctctctcttgtgttgctgcaga

SEQ ID NO: 8159625 - DNA, 22 bp, Homo sapiens
ctctctcttgtgttgctgcaga

SEQ ID NO: 8159626 - DNA, 22 bp, Homo sapiens
ctctctcttgtgttgctgcaga

SEQ ID NO: 8159627 - DNA, 22 bp, Homo sapiens
ctctctcttgtgttgctgcaga

SEQ ID NO: 8159628 - DNA, 22 bp, Homo sapiens
ctctctctttagaagcgtctgg

SEQ ID NO: 8159629 - DNA, 22 bp, Homo sapiens
ctctctcttgtgttgctgcaga

SEQ ID NO: 8159630 - DNA, 22 bp, Homo sapiens
tttagtatataaaaagagaagt

SEQ ID NO: 8159631 - DNA, 22 bp, Homo sapiens
tttagtatataaaaagagaagt

SEQ ID NO: 8159632 - DNA, 22 bp, Homo sapiens
tttagtagaatgatacagggca

SEQ ID NO: 8159633 - DNA, 22 bp, Homo sapiens
tttagtagctacagttagaagg

SEQ ID NO: 8159634 - DNA, 22 bp, Homo sapiens
tttagtactgtttaaaaatgga

SEQ ID NO: 8159635 - DNA, 22 bp, Homo sapiens
tttagtagaatagtatatcaaa

SEQ ID NO: 8159636 - DNA, 22 bp, Homo sapiens
tttagtaagttcactgcaaagc

SEQ ID NO: 8159637 - DNA, 22 bp, Homo sapiens
tttagtactcaggggagaagtt

SEQ ID NO: 8159638 - DNA, 22 bp, Homo sapiens
tttaggtaagctgaatatgaag

SEQ ID NO: 8159639 - DNA, 22 bp, Homo sapiens
tttaggttttttcacgtggcta

SEQ ID NO: 8159640 - DNA, 22 bp, Homo sapiens
tttaggttcttggaatcagtct

SEQ ID NO: 8159641 - DNA, 18 bp, Homo sapiens
ctcctccacagcccctgc

SEQ ID NO: 8159642 - DNA, 18 bp, Homo sapiens
ctcctccacagcccctgc

SEQ ID NO: 8159643 - DNA, 18 bp, Homo sapiens
ctcctccacagcccctgc

SEQ ID NO: 8159644 - DNA, 18 bp, Homo sapiens
ctcctccacagcccctgc

SEQ ID NO: 8159645 - DNA, 18 bp, Homo sapiens
ctcctccacagcccctgc

SEQ ID NO: 8159646 - DNA, 22 bp, Homo sapiens
ctcctccacagagtccttgcca

SEQ ID NO: 8159647 - DNA, 22 bp, Homo sapiens
ctcctccacagagtccttgcca

SEQ ID NO: 8159648 - DNA, 22 bp, Homo sapiens
ctcctccacagagtccttgcca

SEQ ID NO: 8159649 - DNA, 22 bp, Homo sapiens
tttagtgcctgggccagttcca

SEQ ID NO: 8159650 - DNA, 22 bp, Homo sapiens
ctcctccacagacctactgaat

SEQ ID NO: 8159651 - DNA, 22 bp, Homo sapiens
ctcctccacagagtccttgcca

SEQ ID NO: 8159652 - DNA, 22 bp, Homo sapiens
ctcctccacagacctactgaat

SEQ ID NO: 8159653 - DNA, 22 bp, Homo sapiens
ctcctccacagacctactgaat

SEQ ID NO: 8159654 - DNA, 22 bp, Homo sapiens
ctcctccacagacctactgaat

SEQ ID NO: 8159655 - DNA, 22 bp, Homo sapiens
ctcctccacagacctactgaat

SEQ ID NO: 8159656 - DNA, 22 bp, Homo sapiens
tttagtcaggtaagatgcaggg

SEQ ID NO: 8159657 - DNA, 22 bp, Homo sapiens
tttagtcatagatacccaaggt

SEQ ID NO: 8159658 - DNA, 22 bp, Homo sapiens
tttagtctgactattacctcca

SEQ ID NO: 8159659 - DNA, 22 bp, Homo sapiens
tttagtgagtgtgaatcaaatg

SEQ ID NO: 8159660 - DNA, 22 bp, Homo sapiens
tttagtgattcatttagaaaaa

SEQ ID NO: 8159661 - DNA, 22 bp, Homo sapiens
tttagtgataagaattatgaaa

SEQ ID NO: 8159662 - DNA, 22 bp, Homo sapiens
tttagtgataagaattatgaaa

SEQ ID NO: 8159663 - DNA, 22 bp, Homo sapiens
ctcccgtgccactggctcctgc

SEQ ID NO: 8159664 - DNA, 22 bp, Homo sapiens
ctcccgtgatcctggaggagag

SEQ ID NO: 8159665 - DNA, 22 bp, Homo sapiens
ctcccgtggatgttcttcagtc

SEQ ID NO: 8159666 - DNA, 22 bp, Homo sapiens
ctcccgtggatgttcttcagtc

SEQ ID NO: 8159667 - DNA, 22 bp, Homo sapiens
ctccctcacaaagcattctctt

SEQ ID NO: 8159668 - DNA, 21 bp, Homo sapiens
tttagagaatactcactattt

SEQ ID NO: 8159669 - DNA, 22 bp, Homo sapiens
tttaggcagtcattgaacaagt

SEQ ID NO: 8159670 - DNA, 22 bp, Homo sapiens
tttagactaattcctaaagggc

SEQ ID NO: 8159671 - DNA, 22 bp, Homo sapiens
ctccccttcttgccagatcctt

SEQ ID NO: 8159672 - DNA, 22 bp, Homo sapiens
ctcccggcacttggcatgtcat

SEQ ID NO: 8159673 - DNA, 22 bp, Homo sapiens
ctccccatggcaacagttatgg

SEQ ID NO: 8159674 - DNA, 22 bp, Homo sapiens
ctccccattatgcagtcattat

SEQ ID NO: 8159675 - DNA, 22 bp, Homo sapiens
ctccccatccaggcagcaggtg

SEQ ID NO: 8159676 - DNA, 22 bp, Homo sapiens
ctccccattgtgacctcatcca

SEQ ID NO: 8159677 - DNA, 22 bp, Homo sapiens
ctccccattatgcagtcattat

SEQ ID NO: 8159678 - DNA, 22 bp, Homo sapiens
ctccccattgtgacctcatcca

SEQ ID NO: 8159679 - DNA, 22 bp, Homo sapiens
ctccccattgtgacctcatcca

SEQ ID NO: 8159680 - DNA, 22 bp, Homo sapiens
ctccccattgtgacctcatcca

SEQ ID NO: 8159681 - DNA, 22 bp, Homo sapiens
ctcccctccttaggtcttctag

SEQ ID NO: 8159682 - DNA, 22 bp, Homo sapiens
tttaatctattccctaaacacc

SEQ ID NO: 8159683 - DNA, 23 bp, Homo sapiens
ctccccagtgtcctcatgcatct

SEQ ID NO: 8159684 - DNA, 23 bp, Homo sapiens
ctccccagtgtcctcatgcatct

SEQ ID NO: 8159685 - DNA, 22 bp, Homo sapiens
tttaatctattccctaaacacc

SEQ ID NO: 8159686 - DNA, 23 bp, Homo sapiens
ctccccagtgtcctcatgcatct

SEQ ID NO: 8159687 - DNA, 22 bp, Homo sapiens
ctcctccacccgctggggccca

SEQ ID NO: 8159688 - DNA, 18 bp, Homo sapiens
ctcctccacagcccctgc

SEQ ID NO: 8159689 - DNA, 22 bp, Homo sapiens
ctcctccacccgctggggccca

SEQ ID NO: 8159690 - DNA, 22 bp, Homo sapiens
ctcctccagacttactgaatcc

SEQ ID NO: 8159691 - DNA, 22 bp, Homo sapiens
ctcctccagctctccctggggg

SEQ ID NO: 8159692 - DNA, 22 bp, Homo sapiens
ctcctccagctctccctggggg

SEQ ID NO: 8159693 - DNA, 22 bp, Homo sapiens
ctcctccagctctccctggggg

SEQ ID NO: 8159694 - DNA, 22 bp, Homo sapiens
ctcctccagctctccctggggg

SEQ ID NO: 8159695 - DNA, 22 bp, Homo sapiens
ctcctccagcttccagtggctc

SEQ ID NO: 8159696 - DNA, 22 bp, Homo sapiens
ctcctccagcttccagtggctc

SEQ ID NO: 8159697 - DNA, 22 bp, Homo sapiens
ctcctccagtgggtccctcagg

SEQ ID NO: 8159698 - DNA, 22 bp, Homo sapiens
ctcctccagtgggtccctcagg

SEQ ID NO: 8159699 - DNA, 22 bp, Homo sapiens
ctcctcccaattgccaagtgct

SEQ ID NO: 8159700 - DNA, 22 bp, Homo sapiens
ctcctcccaattgccaagtgct

SEQ ID NO: 8159701 - DNA, 22 bp, Homo sapiens
ctcctccagtgggtccctcagg

SEQ ID NO: 8159702 - DNA, 22 bp, Homo sapiens
ctcctccagtgggtccctcagg

SEQ ID NO: 8159703 - DNA, 22 bp, Homo sapiens
ctcctccagtgggtccctcagg

SEQ ID NO: 8159704 - DNA, 22 bp, Homo sapiens
ctcctccagtcctccaaggaca

SEQ ID NO: 8159705 - DNA, 22 bp, Homo sapiens
ctcctccagtcctccaaggaca

SEQ ID NO: 8159706 - DNA, 22 bp, Homo sapiens
tttattgtgttgaaactgaatt

SEQ ID NO: 8159707 - DNA, 22 bp, Homo sapiens
tttattgttgggtcttaagctg

SEQ ID NO: 8159708 - DNA, 22 bp, Homo sapiens
tttattgttatcatgggtgagt

SEQ ID NO: 8159709 - DNA, 22 bp, Homo sapiens
tttattgttgttagtcataagt

SEQ ID NO: 8159710 - DNA, 22 bp, Homo sapiens
tttattgttgttagtcataagt

SEQ ID NO: 8159711 - DNA, 22 bp, Homo sapiens
tttattgttgttagtcataagt

SEQ ID NO: 8159712 - DNA, 22 bp, Homo sapiens
tttattgtttagaagggggctg

SEQ ID NO: 8159713 - DNA, 22 bp, Homo sapiens
ctcctggccccagatcccaatc

SEQ ID NO: 8159714 - DNA, 22 bp, Homo sapiens
ctcctggccccagatcccaatc

SEQ ID NO: 8159715 - DNA, 22 bp, Homo sapiens
ctcctggccacgttcttgctgg

SEQ ID NO: 8159716 - DNA, 22 bp, Homo sapiens
ctcctggccacgttcttgctgg

SEQ ID NO: 8159717 - DNA, 17 bp, Homo sapiens
ctcctggccacccctct

SEQ ID NO: 8159718 - DNA, 22 bp, Homo sapiens
ctcctggccacgttcttgctgg

SEQ ID NO: 8159719 - DNA, 22 bp, Homo sapiens
ctcctggccacgttcttgctgg

SEQ ID NO: 8159720 - DNA, 22 bp, Homo sapiens
ctcctggccacgttcttgctgg

SEQ ID NO: 8159721 - DNA, 17 bp, Homo sapiens
ctcctggccacccctct

SEQ ID NO: 8159722 - DNA, 17 bp, Homo sapiens
ctcctggccacccctct

SEQ ID NO: 8159723 - DNA, 17 bp, Homo sapiens
ctcctggccacccctct

SEQ ID NO: 8159724 - DNA, 22 bp, Homo sapiens
ctcctggcagttccccttgtca

SEQ ID NO: 8159725 - DNA, 22 bp, Homo sapiens
ctcctggcagttccccttgtca

SEQ ID NO: 8159726 - DNA, 22 bp, Homo sapiens
ctcctggcagttccccttgtca

SEQ ID NO: 8159727 - DNA, 22 bp, Homo sapiens
ctcctggcaggctgagtgaaat

SEQ ID NO: 8159728 - DNA, 22 bp, Homo sapiens
ctcctggcaggctgagtgaaat

SEQ ID NO: 8159729 - DNA, 17 bp, Homo sapiens
ctcctggcagcctcagg

SEQ ID NO: 8159730 - DNA, 17 bp, Homo sapiens
ctcctggcagcctcagg

SEQ ID NO: 8159731 - DNA, 22 bp, Homo sapiens
ctcctggcactgtcttgaccca

SEQ ID NO: 8159732 - DNA, 22 bp, Homo sapiens
ctcctggcactgtcttgaccca

SEQ ID NO: 8159733 - DNA, 22 bp, Homo sapiens
ctcctggcagcaacatttatat

SEQ ID NO: 8159734 - DNA, 22 bp, Homo sapiens
ctcctggcactgtcttgaccca

SEQ ID NO: 8159735 - DNA, 17 bp, Homo sapiens
ctcctggcagcctcagg

SEQ ID NO: 8159736 - DNA, 17 bp, Homo sapiens
ctcctggcagcctcagg

SEQ ID NO: 8159737 - DNA, 22 bp, Homo sapiens
ctcctggcagcaacatttatat

SEQ ID NO: 8159738 - DNA, 22 bp, Homo sapiens
tttatttaaagtcgtgtgttaa

SEQ ID NO: 8159739 - DNA, 22 bp, Homo sapiens
tttatttaaagtcgtgtgttaa

SEQ ID NO: 8159740 - DNA, 22 bp, Homo sapiens
tttatttaaagtcgtgtgttaa

SEQ ID NO: 8159741 - DNA, 22 bp, Homo sapiens
tttatttaaagtcgtgtgttaa

SEQ ID NO: 8159742 - DNA, 22 bp, Homo sapiens
tttatttaaagtcgtgtgttaa

SEQ ID NO: 8159743 - DNA, 22 bp, Homo sapiens
tttatttaaagtcgtgtgttaa

SEQ ID NO: 8159744 - DNA, 22 bp, Homo sapiens
tttatttaaagtcgtgtgttaa

SEQ ID NO: 8159745 - DNA, 22 bp, Homo sapiens
tttatttaccttatgtcctcca

SEQ ID NO: 8159746 - DNA, 22 bp, Homo sapiens
tttatttaccttatgtcctcca

SEQ ID NO: 8159747 - DNA, 22 bp, Homo sapiens
tttatttaccttatgtcctcca

SEQ ID NO: 8159748 - DNA, 22 bp, Homo sapiens
tttatttaccttatgtcctcca

SEQ ID NO: 8159749 - DNA, 22 bp, Homo sapiens
tttatttaccttatgtcctcca

SEQ ID NO: 8159750 - DNA, 22 bp, Homo sapiens
tttatttaccttatgtcctcca

SEQ ID NO: 8159751 - DNA, 16 bp, Homo sapiens
tttatttactagtgtt

SEQ ID NO: 8159752 - DNA, 22 bp, Homo sapiens
ctcctggcactcagtgtggaag

SEQ ID NO: 8159753 - DNA, 22 bp, Homo sapiens
ctcctggcactcagtgtggaag

SEQ ID NO: 8159754 - DNA, 22 bp, Homo sapiens
ctcctggcactcagtgtggaag

SEQ ID NO: 8159755 - DNA, 22 bp, Homo sapiens
ctcctggatgcaggctgtctgc

SEQ ID NO: 8159756 - DNA, 22 bp, Homo sapiens
ctcctggatgcaggctgtctgc

SEQ ID NO: 8159757 - DNA, 22 bp, Homo sapiens
ctcctggatgcaggctgtctgc

SEQ ID NO: 8159758 - DNA, 22 bp, Homo sapiens
ttgtcttttgtgggaaatatgg

SEQ ID NO: 8159759 - DNA, 22 bp, Homo sapiens
ttgtctttggaaatttaatgtt

SEQ ID NO: 8159760 - DNA, 22 bp, Homo sapiens
ttgtctttcccagcttctagag

SEQ ID NO: 8159761 - DNA, 22 bp, Homo sapiens
ttgtctttcccagcttctagag

SEQ ID NO: 8159762 - DNA, 22 bp, Homo sapiens
ttgtctttcccagcttctagag

SEQ ID NO: 8159763 - DNA, 22 bp, Homo sapiens
ttgtcttattttatcataagca

SEQ ID NO: 8159764 - DNA, 20 bp, Homo sapiens
ctccagcccctgccctggtc

SEQ ID NO: 8159765 - DNA, 23 bp, Homo sapiens
ttgtatttttagtagagacaggg

SEQ ID NO: 8159766 - DNA, 22 bp, Homo sapiens
ttgtattttgttatgctactgc

SEQ ID NO: 8159767 - DNA, 22 bp, Homo sapiens
ctccagccagagtgcctctgtt

SEQ ID NO: 8159768 - DNA, 22 bp, Homo sapiens
ctccagccagagtgcctctgtt

SEQ ID NO: 8159769 - DNA, 20 bp, Homo sapiens
ctccagcccctgccctggtc

SEQ ID NO: 8159770 - DNA, 20 bp, Homo sapiens
ctccagcccctgccctggtc

SEQ ID NO: 8159771 - DNA, 22 bp, Homo sapiens
ctccagccagagtgcctctgtt

SEQ ID NO: 8159772 - DNA, 22 bp, Homo sapiens
ctccagccagagtgcctctgtt

SEQ ID NO: 8159773 - DNA, 22 bp, Homo sapiens
ttgtgtaacttgagcaaacaca

SEQ ID NO: 8159774 - DNA, 20 bp, Homo sapiens
ttgtggtttagattatctga

SEQ ID NO: 8159775 - DNA, 22 bp, Homo sapiens
ttgtggttgactaaatttgtaa

SEQ ID NO: 8159776 - DNA, 22 bp, Homo sapiens
ttgtggggttggcagttcttta

SEQ ID NO: 8159777 - DNA, 22 bp, Homo sapiens
ttgtggggttggcagttcttta

SEQ ID NO: 8159778 - DNA, 22 bp, Homo sapiens
ttgtggttaaccgcacattttt

SEQ ID NO: 8159779 - DNA, 22 bp, Homo sapiens
ttgtgggggctgccctgtacgg

SEQ ID NO: 8159780 - DNA, 22 bp, Homo sapiens
ttgtgggggctgccctgtacgg

SEQ ID NO: 8159781 - DNA, 22 bp, Homo sapiens
ttgtggggtgatttgccacggg

SEQ ID NO: 8159782 - DNA, 22 bp, Homo sapiens
ttgtggggtgatttgccacggg

SEQ ID NO: 8159783 - DNA, 22 bp, Homo sapiens
ttgtggggtgatttgccacggg

SEQ ID NO: 8159784 - DNA, 20 bp, Homo sapiens
ttgtgggggcaatggtatgc

SEQ ID NO: 8159785 - DNA, 22 bp, Homo sapiens
ttgtggggttggcagttcttta

SEQ ID NO: 8159786 - DNA, 22 bp, Homo sapiens
ctccagtgcgtcttagtaaacc

SEQ ID NO: 8159787 - DNA, 22 bp, Homo sapiens
ctccatggctttcgcatctgca

SEQ ID NO: 8159788 - DNA, 22 bp, Homo sapiens
ctccatggaaccggggctgctt

SEQ ID NO: 8159789 - DNA, 22 bp, Homo sapiens
ctccatggggaaatgaaggtgg

SEQ ID NO: 8159790 - DNA, 22 bp, Homo sapiens
ctccatggctttcgcatctgca

SEQ ID NO: 8159791 - DNA, 22 bp, Homo sapiens
ctccagtgctgtcatcccttcc

SEQ ID NO: 8159792 - DNA, 22 bp, Homo sapiens
ctccatggaaccggggctgctt

SEQ ID NO: 8159793 - DNA, 22 bp, Homo sapiens
ctccatggaaccggggctgctt

SEQ ID NO: 8159794 - DNA, 22 bp, Homo sapiens
ttgtgaaaagccgcaagtatag

SEQ ID NO: 8159795 - DNA, 22 bp, Homo sapiens
ttgtcttttgtgggaaatatgg

SEQ ID NO: 8159796 - DNA, 22 bp, Homo sapiens
ttgtgaaaagccgcaagtatag

SEQ ID NO: 8159797 - DNA, 22 bp, Homo sapiens
ttgtgaaaagccgcaagtatag

SEQ ID NO: 8159798 - DNA, 22 bp, Homo sapiens
ttgtgaaacattcatggatttg

SEQ ID NO: 8159799 - DNA, 23 bp, Homo sapiens
ttgtgggcagattccatggggag

SEQ ID NO: 8159800 - DNA, 22 bp, Homo sapiens
ttgtgaaatcgtgtttggaagc

SEQ ID NO: 8159801 - DNA, 22 bp, Homo sapiens
ttgtggggaacccctgtcccac

SEQ ID NO: 8159802 - DNA, 22 bp, Homo sapiens
ttgtggggaacccctgtcccac

SEQ ID NO: 8159803 - DNA, 22 bp, Homo sapiens
ttgtggggaggatttgatgaga

SEQ ID NO: 8159804 - DNA, 22 bp, Homo sapiens
ttgtgggcttgcctggctcttg

SEQ ID NO: 8159805 - DNA, 22 bp, Homo sapiens
ttgtggggaaacactgtttctt

SEQ ID NO: 8159806 - DNA, 22 bp, Homo sapiens
ttgtggggaaacactgtttctt

SEQ ID NO: 8159807 - DNA, 22 bp, Homo sapiens
ttgtggggaaacactgtttctt

SEQ ID NO: 8159808 - DNA, 22 bp, Homo sapiens
ttgtggggcaacagcaggtgaa

SEQ ID NO: 8159809 - DNA, 22 bp, Homo sapiens
ttgtggggcaacagcaggtgaa

SEQ ID NO: 8159810 - DNA, 22 bp, Homo sapiens
ttgtggggcaacagcaggtgaa

SEQ ID NO: 8159811 - DNA, 22 bp, Homo sapiens
ttgtggggaggatttgatgaga

SEQ ID NO: 8159812 - DNA, 20 bp, Homo sapiens
ttgtgggggcaatggtatgc

SEQ ID NO: 8159813 - DNA, 20 bp, Homo sapiens
ttgtgggggcaatggtatgc

SEQ ID NO: 8159814 - DNA, 22 bp, Homo sapiens
ttgtggggccccaatgttgctg

SEQ ID NO: 8159815 - DNA, 22 bp, Homo sapiens
ttgtggggccccaatgttgctg

SEQ ID NO: 8159816 - DNA, 22 bp, Homo sapiens
ttgtggggcaacagcaggtgaa

SEQ ID NO: 8159817 - DNA, 22 bp, Homo sapiens
ctcccaggactcagaggagaag

SEQ ID NO: 8159818 - DNA, 22 bp, Homo sapiens
ctcccaggactcagaggagaag

SEQ ID NO: 8159819 - DNA, 22 bp, Homo sapiens
ctcccagccttcgccagtctga

SEQ ID NO: 8159820 - DNA, 22 bp, Homo sapiens
ctcccagccttcgccagtctga

SEQ ID NO: 8159821 - DNA, 22 bp, Homo sapiens
ctcccagccttcgccagtctga

SEQ ID NO: 8159822 - DNA, 22 bp, Homo sapiens
ctcccagattcctgctgtggga

SEQ ID NO: 8159823 - DNA, 22 bp, Homo sapiens
ctcccagccttcgccagtctga

SEQ ID NO: 8159824 - DNA, 22 bp, Homo sapiens
ctcccagccttcgccagtctga

SEQ ID NO: 8159825 - DNA, 22 bp, Homo sapiens
ctcccagagaccaagctgagaa

SEQ ID NO: 8159826 - DNA, 22 bp, Homo sapiens
ctcccagattcctgctgtggga

SEQ ID NO: 8159827 - DNA, 22 bp, Homo sapiens
ctccattgttcgcgcagctgca

SEQ ID NO: 8159828 - DNA, 22 bp, Homo sapiens
ctccatgggggctggcctgtgt

SEQ ID NO: 8159829 - DNA, 22 bp, Homo sapiens
ctccatgggggctggcctgtgt

SEQ ID NO: 8159830 - DNA, 22 bp, Homo sapiens
ctccatggggaaatgaaggtgg

SEQ ID NO: 8159831 - DNA, 22 bp, Homo sapiens
ctccatggggaaatgaaggtgg

SEQ ID NO: 8159832 - DNA, 22 bp, Homo sapiens
ctccatgggggctggcctgtgt

SEQ ID NO: 8159833 - DNA, 22 bp, Homo sapiens
ctcccaaggggtaagggagctg

SEQ ID NO: 8159834 - DNA, 22 bp, Homo sapiens
ctcccaagctgtgctgaactgt

SEQ ID NO: 8159835 - DNA, 22 bp, Homo sapiens
ctcccagacatgtgcctccttg

SEQ ID NO: 8159836 - DNA, 22 bp, Homo sapiens
ctcccagacatgtgcctccttg

SEQ ID NO: 8159837 - DNA, 22 bp, Homo sapiens
ctcccagaaaattctcagacaa

SEQ ID NO: 8159838 - DNA, 22 bp, Homo sapiens
ctcccagaaaattctcagacaa

SEQ ID NO: 8159839 - DNA, 22 bp, Homo sapiens
ctcccaggcagggctgcccact

SEQ ID NO: 8159840 - DNA, 22 bp, Homo sapiens
ctcccaggcagggctgcccact

SEQ ID NO: 8159841 - DNA, 22 bp, Homo sapiens
ctcccaggcagggctgcccact

SEQ ID NO: 8159842 - DNA, 22 bp, Homo sapiens
ctcccaggcacagggaggagcc

SEQ ID NO: 8159843 - DNA, 22 bp, Homo sapiens
tttaacagatgctatgtctacc

SEQ ID NO: 8159844 - DNA, 22 bp, Homo sapiens
ctcccaggccatgctctagcca

SEQ ID NO: 8159845 - DNA, 22 bp, Homo sapiens
ctcccaggccatgctctagcca

SEQ ID NO: 8159846 - DNA, 22 bp, Homo sapiens
tttaacagatgtgaaattttca

SEQ ID NO: 8159847 - DNA, 22 bp, Homo sapiens
tttaagttccttttcaacaact

SEQ ID NO: 8159848 - DNA, 22 bp, Homo sapiens
tttaatatccagtggatacaaa

SEQ ID NO: 8159849 - DNA, 22 bp, Homo sapiens
tttaatatccagtggatacaaa

SEQ ID NO: 8159850 - DNA, 22 bp, Homo sapiens
tttaatatccagtggatacaaa

SEQ ID NO: 8159851 - DNA, 22 bp, Homo sapiens
tttaatatctcacacttccatg

SEQ ID NO: 8159852 - DNA, 22 bp, Homo sapiens
tttaatatccagtggatacaaa

SEQ ID NO: 8159853 - DNA, 22 bp, Homo sapiens
tttaatatccagtggatacaaa

SEQ ID NO: 8159854 - DNA, 22 bp, Homo sapiens
tttaatatctcacacttccatg

SEQ ID NO: 8159855 - DNA, 22 bp, Homo sapiens
tttaatattctgcattctcctt

SEQ ID NO: 8159856 - DNA, 22 bp, Homo sapiens
tttaatcaggcaaagcataata

SEQ ID NO: 8159857 - DNA, 22 bp, Homo sapiens
tttaatatttctttcctgaagc

SEQ ID NO: 8159858 - DNA, 22 bp, Homo sapiens
tttaatatttctttcctgaagc

SEQ ID NO: 8159859 - DNA, 22 bp, Homo sapiens
ttgtaattagtttttgatctgg

SEQ ID NO: 8159860 - DNA, 22 bp, Homo sapiens
ttgtaattagtttttgatctgg

SEQ ID NO: 8159861 - DNA, 22 bp, Homo sapiens
ctccaccccgtgccggtgctgg

SEQ ID NO: 8159862 - DNA, 22 bp, Homo sapiens
ttgtacaaataggaacctctga

SEQ ID NO: 8159863 - DNA, 22 bp, Homo sapiens
ttgtacaaataggaacctctga

SEQ ID NO: 8159864 - DNA, 22 bp, Homo sapiens
ttgtacaaaggatttggaagag

SEQ ID NO: 8159865 - DNA, 22 bp, Homo sapiens
ttgtacaaagatttcacagctc

SEQ ID NO: 8159866 - DNA, 22 bp, Homo sapiens
ttgtacaaaggatttggaagag

SEQ ID NO: 8159867 - DNA, 22 bp, Homo sapiens
ttgtaatttgttcccaagcaga

SEQ ID NO: 8159868 - DNA, 22 bp, Homo sapiens
ttgtacaaagatttcacagctc

SEQ ID NO: 8159869 - DNA, 22 bp, Homo sapiens
ttgtacaaagatttcacagctc

SEQ ID NO: 8159870 - DNA, 22 bp, Homo sapiens
ttgtacaacgttttaaatttga

SEQ ID NO: 8159871 - DNA, 22 bp, Homo sapiens
ttgtacaacgttttaaatttga

SEQ ID NO: 8159872 - DNA, 22 bp, Homo sapiens
ttgtacaacgttttaaatttga

SEQ ID NO: 8159873 - DNA, 22 bp, Homo sapiens
ttgtacaacgttttaaatttga

SEQ ID NO: 8159874 - DNA, 22 bp, Homo sapiens
ttgtacaacacatattctacag

SEQ ID NO: 8159875 - DNA, 22 bp, Homo sapiens
ttgtacaacacatattctacag

SEQ ID NO: 8159876 - DNA, 22 bp, Homo sapiens
ttgtacaacacatattctacag

SEQ ID NO: 8159877 - DNA, 22 bp, Homo sapiens
ttgtacaacacatattctacag

SEQ ID NO: 8159878 - DNA, 22 bp, Homo sapiens
ttgtacaaatgcatattcctgg

SEQ ID NO: 8159879 - DNA, 22 bp, Homo sapiens
ttgtacaaatgcatattcctgg

SEQ ID NO: 8159880 - DNA, 22 bp, Homo sapiens
ttgtacaaatgcatattcctgg

SEQ ID NO: 8159881 - DNA, 22 bp, Homo sapiens
ttgtacaaataggaacctctga

SEQ ID NO: 8159882 - DNA, 22 bp, Homo sapiens
ttgtacaaatgcatattcctgg

SEQ ID NO: 8159883 - DNA, 22 bp, Homo sapiens
ctccagatccagctgagctgca

SEQ ID NO: 8159884 - DNA, 22 bp, Homo sapiens
ctccagatccagctgagctgca

SEQ ID NO: 8159885 - DNA, 22 bp, Homo sapiens
ttgtacaagtattatgtgaaca

SEQ ID NO: 8159886 - DNA, 22 bp, Homo sapiens
ctccagcagaaagggcgagtgg

SEQ ID NO: 8159887 - DNA, 22 bp, Homo sapiens
ctccagattctggatgactggg

SEQ ID NO: 8159888 - DNA, 22 bp, Homo sapiens
ctccagattccgtttattcagg

SEQ ID NO: 8159889 - DNA, 22 bp, Homo sapiens
ctccagattccgtttattcagg

SEQ ID NO: 8159890 - DNA, 22 bp, Homo sapiens
ctccagattccgtttattcagg

SEQ ID NO: 8159891 - DNA, 22 bp, Homo sapiens
ctccaaggtggttatttgagat

SEQ ID NO: 8159892 - DNA, 22 bp, Homo sapiens
ctccaagggtcttccaccagga

SEQ ID NO: 8159893 - DNA, 22 bp, Homo sapiens
ctccaagggttgtgggtggtca

SEQ ID NO: 8159894 - DNA, 22 bp, Homo sapiens
ctccaagggctcccagacgtct

SEQ ID NO: 8159895 - DNA, 20 bp, Homo sapiens
ctccaaggcttgcaggaggc

SEQ ID NO: 8159896 - DNA, 22 bp, Homo sapiens
ctccaaggctctggtgctgagg

SEQ ID NO: 8159897 - DNA, 23 bp, Homo sapiens
ctccaaggcccaactgtctaggc

SEQ ID NO: 8159898 - DNA, 23 bp, Homo sapiens
ctccaaggcccaactgtctaggc

SEQ ID NO: 8159899 - DNA, 22 bp, Homo sapiens
ctccaaggctaggagcatgttc

SEQ ID NO: 8159900 - DNA, 22 bp, Homo sapiens
ctccaaggctaggagcatgttc

SEQ ID NO: 8159901 - DNA, 22 bp, Homo sapiens
ctccaaggagaaatgggcaaca

SEQ ID NO: 8159902 - DNA, 22 bp, Homo sapiens
ctccaaggagaaatgggcaaca

SEQ ID NO: 8159903 - DNA, 22 bp, Homo sapiens
ctccaaggaagccccaagggat

SEQ ID NO: 8159904 - DNA, 22 bp, Homo sapiens
ctccaactgatctcacagcaga

SEQ ID NO: 8159905 - DNA, 22 bp, Homo sapiens
ctccacagcccctccagtggca

SEQ ID NO: 8159906 - DNA, 22 bp, Homo sapiens
ctccacagagatgctgattgta

SEQ ID NO: 8159907 - DNA, 22 bp, Homo sapiens
ctccaaggtttcagaacaaatg

SEQ ID NO: 8159908 - DNA, 22 bp, Homo sapiens
ctccaaggtttcagaacaaatg

SEQ ID NO: 8159909 - DNA, 22 bp, Homo sapiens
ctccaaggttttccctgtcctt

SEQ ID NO: 8159910 - DNA, 22 bp, Homo sapiens
ctccaagtccgagggctctcaa

SEQ ID NO: 8159911 - DNA, 22 bp, Homo sapiens
ctccaagtcggctgcagctgga

SEQ ID NO: 8159912 - DNA, 22 bp, Homo sapiens
ctccacaggtggtgtttgcttc

SEQ ID NO: 8159913 - DNA, 22 bp, Homo sapiens
ctccacaggtgtactgtacctt

SEQ ID NO: 8159914 - DNA, 22 bp, Homo sapiens
ctccacaggtgtactgtacctt

SEQ ID NO: 8159915 - DNA, 22 bp, Homo sapiens
ctccacagctcaggctcagagt

SEQ ID NO: 8159916 - DNA, 22 bp, Homo sapiens
ctccacagcccctccagtggca

SEQ ID NO: 8159917 - DNA, 22 bp, Homo sapiens
ctccacagcccctccagtggca

SEQ ID NO: 8159918 - DNA, 22 bp, Homo sapiens
ttcttttacattaagatttcag

SEQ ID NO: 8159919 - DNA, 22 bp, Homo sapiens
ttcttttacattaagatttcag

SEQ ID NO: 8159920 - DNA, 22 bp, Homo sapiens
ttcttttacattaagatttcag

SEQ ID NO: 8159921 - DNA, 22 bp, Homo sapiens
ttcttttacattaagatttcag

SEQ ID NO: 8159922 - DNA, 22 bp, Homo sapiens
ttcttttacattaagatttcag

SEQ ID NO: 8159923 - DNA, 22 bp, Homo sapiens
ttcttttcaagaggggcaagga

SEQ ID NO: 8159924 - DNA, 22 bp, Homo sapiens
ttcttttagtcattcagggaag

SEQ ID NO: 8159925 - DNA, 22 bp, Homo sapiens
ttcttttagtcattcagggaag

SEQ ID NO: 8159926 - DNA, 22 bp, Homo sapiens
ttcttttagaatttcctaaggt

SEQ ID NO: 8159927 - DNA, 22 bp, Homo sapiens
ttcttttagaatttcctaaggt

SEQ ID NO: 8159928 - DNA, 22 bp, Homo sapiens
ttcttttaatttctgtctgcag

SEQ ID NO: 8159929 - DNA, 22 bp, Homo sapiens
ttctttcttagcaatctatggt

SEQ ID NO: 8159930 - DNA, 22 bp, Homo sapiens
ttcttttaattgtgggggagtg

SEQ ID NO: 8159931 - DNA, 22 bp, Homo sapiens
ttcttttaatttctgtctgcag

SEQ ID NO: 8159932 - DNA, 22 bp, Homo sapiens
ttcttttaatttctgtctgcag

SEQ ID NO: 8159933 - DNA, 22 bp, Homo sapiens
ttctttcttagcaatctatggt

SEQ ID NO: 8159934 - DNA, 22 bp, Homo sapiens
ttctttcttagcaatctatggt

SEQ ID NO: 8159935 - DNA, 22 bp, Homo sapiens
ttctttcttagcaatctatggt

SEQ ID NO: 8159936 - DNA, 22 bp, Homo sapiens
ttctttctgtccataatgagac

SEQ ID NO: 8159937 - DNA, 22 bp, Homo sapiens
ctcacaggttagttgtgtggat

SEQ ID NO: 8159938 - DNA, 22 bp, Homo sapiens
ctcacaggtcatgtggtggctt

SEQ ID NO: 8159939 - DNA, 22 bp, Homo sapiens
ttcttttcctacacagcgattt

SEQ ID NO: 8159940 - DNA, 22 bp, Homo sapiens
ttcttttcctgtggctcatcca

SEQ ID NO: 8159941 - DNA, 22 bp, Homo sapiens
ttcttttcctacacagcgattt

SEQ ID NO: 8159942 - DNA, 22 bp, Homo sapiens
ttcttttcctacacagcgattt

SEQ ID NO: 8159943 - DNA, 22 bp, Homo sapiens
ttcttttcctacacagcgattt

SEQ ID NO: 8159944 - DNA, 18 bp, Homo sapiens
ttcttttcatgtgatctc

SEQ ID NO: 8159945 - DNA, 18 bp, Homo sapiens
ttcttttcatgtgatctc

SEQ ID NO: 8159946 - DNA, 23 bp, Homo sapiens
ttgaaaggtagctggcagctaga

SEQ ID NO: 8159947 - DNA, 23 bp, Homo sapiens
ttgaaaggtagctggcagctaga

SEQ ID NO: 8159948 - DNA, 22 bp, Homo sapiens
ttcttttcggcctgtgagaagg

SEQ ID NO: 8159949 - DNA, 22 bp, Homo sapiens
ttcttttcggcctgtgagaagg

SEQ ID NO: 8159950 - DNA, 22 bp, Homo sapiens
ttgaaaggtgctgtgtgctgat

SEQ ID NO: 8159951 - DNA, 22 bp, Homo sapiens
ttgaaaggtgctgtgtgctgat

SEQ ID NO: 8159952 - DNA, 22 bp, Homo sapiens
ttgaaaggtgaacatgatgcac

SEQ ID NO: 8159953 - DNA, 22 bp, Homo sapiens
ttgaaaggtgacattgttagag

SEQ ID NO: 8159954 - DNA, 22 bp, Homo sapiens
ttgaaaggtgaacatgatgcac

SEQ ID NO: 8159955 - DNA, 22 bp, Homo sapiens
ctcatttacctttgcaatcaag

SEQ ID NO: 8159956 - DNA, 22 bp, Homo sapiens
ctcatttaacagattaaaaagt

SEQ ID NO: 8159957 - DNA, 22 bp, Homo sapiens
ctcatttactactcatgtgacc

SEQ ID NO: 8159958 - DNA, 22 bp, Homo sapiens
ctcatttactgtagaacagtta

SEQ ID NO: 8159959 - DNA, 22 bp, Homo sapiens
ctcatttagggggcatggtaca

SEQ ID NO: 8159960 - DNA, 22 bp, Homo sapiens
ctcatttatccaaaagccagtt

SEQ ID NO: 8159961 - DNA, 22 bp, Homo sapiens
ctcatttatgtaatgattaagg

SEQ ID NO: 8159962 - DNA, 21 bp, Homo sapiens
ctcatttatttttgtgtccaa

SEQ ID NO: 8159963 - DNA, 22 bp, Homo sapiens
ctcatttatttctcccaaaaca

SEQ ID NO: 8159964 - DNA, 22 bp, Homo sapiens
ttgaaagtcacaatggcattaa

SEQ ID NO: 8159965 - DNA, 22 bp, Homo sapiens
ttgaaagttatctagattctga

SEQ ID NO: 8159966 - DNA, 22 bp, Homo sapiens
ttgaaagttaggatttagctgg

SEQ ID NO: 8159967 - DNA, 22 bp, Homo sapiens
ttgaaatactgcattgttcagt

SEQ ID NO: 8159968 - DNA, 22 bp, Homo sapiens
ttgaaatagatgcgtcagagat

SEQ ID NO: 8159969 - DNA, 22 bp, Homo sapiens
ttgaaatactgcattgttcagt

SEQ ID NO: 8159970 - DNA, 22 bp, Homo sapiens
ttgaaatactgcattgttcagt

SEQ ID NO: 8159971 - DNA, 22 bp, Homo sapiens
ctcatctggcttcagtaacagt

SEQ ID NO: 8159972 - DNA, 22 bp, Homo sapiens
ttgaaatagatgcgtcagagat

SEQ ID NO: 8159973 - DNA, 22 bp, Homo sapiens
ttgaaatatcaagttattagtg

SEQ ID NO: 8159974 - DNA, 22 bp, Homo sapiens
ctcatctgtctgggctggtttt

SEQ ID NO: 8159975 - DNA, 22 bp, Homo sapiens
ctcatctgtatatagtgaatga

SEQ ID NO: 8159976 - DNA, 22 bp, Homo sapiens
cattacgagctctaaaatacta

SEQ ID NO: 8159977 - DNA, 22 bp, Homo sapiens
tcccaaagaactgaatagtaat

SEQ ID NO: 8159978 - DNA, 22 bp, Homo sapiens
cattacagaatatgtaatgatc

SEQ ID NO: 8159979 - DNA, 22 bp, Homo sapiens
cattacagaatatgtaatgatc

SEQ ID NO: 8159980 - DNA, 22 bp, Homo sapiens
cattacatctttgatgcagtat

SEQ ID NO: 8159981 - DNA, 22 bp, Homo sapiens
cattacagtgtcagaggaactg

SEQ ID NO: 8159982 - DNA, 22 bp, Homo sapiens
cattagaagaacagttatatta

SEQ ID NO: 8159983 - DNA, 22 bp, Homo sapiens
cattagattggtgcaaaaataa

SEQ ID NO: 8159984 - DNA, 23 bp, Homo sapiens
cattagaaggtagagtggaatga

SEQ ID NO: 8159985 - DNA, 18 bp, Homo sapiens
cattagcaccacgtagag

SEQ ID NO: 8159986 - DNA, 22 bp, Homo sapiens
cattagcaggcactaagaaggt

SEQ ID NO: 8159987 - DNA, 22 bp, Homo sapiens
cattctctacactcctgccctg

SEQ ID NO: 8159988 - DNA, 22 bp, Homo sapiens
cattctattgtagcaccctgta

SEQ ID NO: 8159989 - DNA, 22 bp, Homo sapiens
cattctcaatagtagatgagta

SEQ ID NO: 8159990 - DNA, 22 bp, Homo sapiens
cattcatttatgaaatatctat

SEQ ID NO: 8159991 - DNA, 22 bp, Homo sapiens
cattcatttatgaaatatctat

SEQ ID NO: 8159992 - DNA, 22 bp, Homo sapiens
cattctatgaaaactaggcaat

SEQ ID NO: 8159993 - DNA, 22 bp, Homo sapiens
cattctctctacttgttttcaa

SEQ ID NO: 8159994 - DNA, 22 bp, Homo sapiens
cattctgagtcactctttagca

SEQ ID NO: 8159995 - DNA, 22 bp, Homo sapiens
cattctgagctaatatgcttat

SEQ ID NO: 8159996 - DNA, 22 bp, Homo sapiens
cattctgagtcactctttagca

SEQ ID NO: 8159997 - DNA, 22 bp, Homo sapiens
cattcttacacaatattttaat

SEQ ID NO: 8159998 - DNA, 22 bp, Homo sapiens
cattcttatatttactcattca

SEQ ID NO: 8159999 - DNA, 22 bp, Homo sapiens
cattcttctggatagttagttg

SEQ ID NO: 8160000 - DNA, 22 bp, Homo sapiens
cattcttctggatagttagttg

SEQ ID NO: 8160001 - DNA, 22 bp, Homo sapiens
cattcttctggatagttagttg

SEQ ID NO: 8160002 - DNA, 22 bp, Homo sapiens
cattcttctcccttaccttcca

SEQ ID NO: 8160003 - DNA, 22 bp, Homo sapiens
cattcttctcccttaccttcca

SEQ ID NO: 8160004 - DNA, 17 bp, Homo sapiens
cattctgtaatctttct

SEQ ID NO: 8160005 - DNA, 22 bp, Homo sapiens
cattctgggtctggctcaggga

SEQ ID NO: 8160006 - DNA, 22 bp, Homo sapiens
tcccacccatcctgcatctctt

SEQ ID NO: 8160007 - DNA, 22 bp, Homo sapiens
cattcttgcaccgtgatggctt

SEQ ID NO: 8160008 - DNA, 22 bp, Homo sapiens
tcccaccaggtgaccatttcat

SEQ ID NO: 8160009 - DNA, 22 bp, Homo sapiens
tcccaccttccgtggaacccgt

SEQ ID NO: 8160010 - DNA, 22 bp, Homo sapiens
tcccaccccggtcaagggctga

SEQ ID NO: 8160011 - DNA, 22 bp, Homo sapiens
tcccaccccctccaaggaggaa

SEQ ID NO: 8160012 - DNA, 22 bp, Homo sapiens
tcccaccccggtcaagggctga

SEQ ID NO: 8160013 - DNA, 22 bp, Homo sapiens
tccaggagaggcctgaccaggt

SEQ ID NO: 8160014 - DNA, 17 bp, Homo sapiens
tccaggagaggcaatgg

SEQ ID NO: 8160015 - DNA, 22 bp, Homo sapiens
tccaggagaccagatgtaggcc

SEQ ID NO: 8160016 - DNA, 22 bp, Homo sapiens
tccaggagacacaaggtacata

SEQ ID NO: 8160017 - DNA, 22 bp, Homo sapiens
tccaggagaggcctgaccaggt

SEQ ID NO: 8160018 - DNA, 22 bp, Homo sapiens
tccaggagatacactgcaccag

SEQ ID NO: 8160019 - DNA, 22 bp, Homo sapiens
catgggaggttggcttggcatg

SEQ ID NO: 8160020 - DNA, 22 bp, Homo sapiens
catgggaggtctgcaaggtgct

SEQ ID NO: 8160021 - DNA, 22 bp, Homo sapiens
catgggaggtctgcaaggtgct

SEQ ID NO: 8160022 - DNA, 22 bp, Homo sapiens
catgggaggtctgcaaggtgct

SEQ ID NO: 8160023 - DNA, 22 bp, Homo sapiens
catgggcaccttaaaatgaggc

SEQ ID NO: 8160024 - DNA, 22 bp, Homo sapiens
catgggcaccttaaaatgaggc

SEQ ID NO: 8160025 - DNA, 23 bp, Homo sapiens
catgggagtgagaatgccagctc

SEQ ID NO: 8160026 - DNA, 23 bp, Homo sapiens
catgggagtgagaatgccagctc

SEQ ID NO: 8160027 - DNA, 19 bp, Homo sapiens
tccaggagcaaagccagtt

SEQ ID NO: 8160028 - DNA, 22 bp, Homo sapiens
catgggaggcctgctgctggtg

SEQ ID NO: 8160029 - DNA, 21 bp, Homo sapiens
tccaggagcacgggactagga

SEQ ID NO: 8160030 - DNA, 22 bp, Homo sapiens
catgggcccgtgagaggcaggg

SEQ ID NO: 8160031 - DNA, 22 bp, Homo sapiens
catgggctacagaagcatgctg

SEQ ID NO: 8160032 - DNA, 22 bp, Homo sapiens
catgggccagagctcctctggg

SEQ ID NO: 8160033 - DNA, 22 bp, Homo sapiens
catgggcagttggcagggctca

SEQ ID NO: 8160034 - DNA, 22 bp, Homo sapiens
catgggcagaagtggcatcatt

SEQ ID NO: 8160035 - DNA, 22 bp, Homo sapiens
catgggcagaagtggcatcatt

SEQ ID NO: 8160036 - DNA, 22 bp, Homo sapiens
catgggctctctgagctccagg

SEQ ID NO: 8160037 - DNA, 22 bp, Homo sapiens
tccatcaccacagaggacagag

SEQ ID NO: 8160038 - DNA, 22 bp, Homo sapiens
tccatcaccacagaggacagag

SEQ ID NO: 8160039 - DNA, 22 bp, Homo sapiens
tccatttaggttccactagtta

SEQ ID NO: 8160040 - DNA, 22 bp, Homo sapiens
tccattttagaagaaaatccac

SEQ ID NO: 8160041 - DNA, 22 bp, Homo sapiens
tccattttagaagaaaatccac

SEQ ID NO: 8160042 - DNA, 22 bp, Homo sapiens
tccattttctaagtatcactta

SEQ ID NO: 8160043 - DNA, 22 bp, Homo sapiens
tccattttctcttccggaggtg

SEQ ID NO: 8160044 - DNA, 22 bp, Homo sapiens
tccattttgtaggtatgctaca

SEQ ID NO: 8160045 - DNA, 22 bp, Homo sapiens
tccattttcttgctctaggtaa

SEQ ID NO: 8160046 - DNA, 22 bp, Homo sapiens
tccattttgtaggtatgctaca

SEQ ID NO: 8160047 - DNA, 22 bp, Homo sapiens
tccattttgtaggtatgctaca

SEQ ID NO: 8160048 - DNA, 22 bp, Homo sapiens
tccatttttcatgactcctcaa

SEQ ID NO: 8160049 - DNA, 22 bp, Homo sapiens
tccatttttcatgactcctcaa

SEQ ID NO: 8160050 - DNA, 22 bp, Homo sapiens
tccattttctaagtatcactta

SEQ ID NO: 8160051 - DNA, 22 bp, Homo sapiens
tccattttcatctcatgtataa

SEQ ID NO: 8160052 - DNA, 22 bp, Homo sapiens
tccattttcatctcatgtataa

SEQ ID NO: 8160053 - DNA, 22 bp, Homo sapiens
tccattttcatctcatgtataa

SEQ ID NO: 8160054 - DNA, 22 bp, Homo sapiens
tccattttagagatgaagaaac

SEQ ID NO: 8160055 - DNA, 22 bp, Homo sapiens
tccattttagagatgaagaaac

SEQ ID NO: 8160056 - DNA, 22 bp, Homo sapiens
tccattttagagatgaagaaac

SEQ ID NO: 8160057 - DNA, 22 bp, Homo sapiens
tccattttagagatgaagaaac

SEQ ID NO: 8160058 - DNA, 22 bp, Homo sapiens
cattgttcaacactgacttgca

SEQ ID NO: 8160059 - DNA, 22 bp, Homo sapiens
cattgttatagcattacacacc

SEQ ID NO: 8160060 - DNA, 22 bp, Homo sapiens
cattgttatagcattacacacc

SEQ ID NO: 8160061 - DNA, 22 bp, Homo sapiens
cattgttatagcattacacacc

SEQ ID NO: 8160062 - DNA, 22 bp, Homo sapiens
cattgttgctgcttcaagatat

SEQ ID NO: 8160063 - DNA, 22 bp, Homo sapiens
cattgttggcagagggacagag

SEQ ID NO: 8160064 - DNA, 22 bp, Homo sapiens
cattgttggtaatgctcagagg

SEQ ID NO: 8160065 - DNA, 22 bp, Homo sapiens
cattgttgaacacctgctggat

SEQ ID NO: 8160066 - DNA, 22 bp, Homo sapiens
cattgttaattggtatcttaca

SEQ ID NO: 8160067 - DNA, 22 bp, Homo sapiens
cattgttaccatcttttaccta

SEQ ID NO: 8160068 - DNA, 22 bp, Homo sapiens
cattgtgcagggataatgcagc

SEQ ID NO: 8160069 - DNA, 22 bp, Homo sapiens
catttaaaggttgtgggtaaaa

SEQ ID NO: 8160070 - DNA, 22 bp, Homo sapiens
catttaaaggttgtgggtaaaa

SEQ ID NO: 8160071 - DNA, 22 bp, Homo sapiens
catttaaaggttgtgggtaaaa

SEQ ID NO: 8160072 - DNA, 22 bp, Homo sapiens
cattgttgtgagatcaagcagt

SEQ ID NO: 8160073 - DNA, 22 bp, Homo sapiens
cattgttgttaaacatagtaat

SEQ ID NO: 8160074 - DNA, 22 bp, Homo sapiens
cattgttggtcattgtcggttg

SEQ ID NO: 8160075 - DNA, 22 bp, Homo sapiens
cattgcacgggcgtctgtctgt

SEQ ID NO: 8160076 - DNA, 22 bp, Homo sapiens
tcccactcccaggcaggcctct

SEQ ID NO: 8160077 - DNA, 22 bp, Homo sapiens
tcccactcactgtctctgacac

SEQ ID NO: 8160078 - DNA, 22 bp, Homo sapiens
tcccactcagtccttttcagtt

SEQ ID NO: 8160079 - DNA, 22 bp, Homo sapiens
tcccactcccaggcaggcctct

SEQ ID NO: 8160080 - DNA, 22 bp, Homo sapiens
cattgtattgaggatacttaag

SEQ ID NO: 8160081 - DNA, 22 bp, Homo sapiens
cattgtattgaggatacttaag

SEQ ID NO: 8160082 - DNA, 18 bp, Homo sapiens
cattgtacaatgctttat

SEQ ID NO: 8160083 - DNA, 22 bp, Homo sapiens
cattgtcacccaaagctcatag

SEQ ID NO: 8160084 - DNA, 22 bp, Homo sapiens
cattgtctggtaggaagtgggc

SEQ ID NO: 8160085 - DNA, 22 bp, Homo sapiens
catttacacttctaaccacaag

SEQ ID NO: 8160086 - DNA, 22 bp, Homo sapiens
catttacacttctaaccacaag

SEQ ID NO: 8160087 - DNA, 22 bp, Homo sapiens
tccctcagaaattctctctgaa

SEQ ID NO: 8160088 - DNA, 22 bp, Homo sapiens
tccctcagaaattctctctgaa

SEQ ID NO: 8160089 - DNA, 22 bp, Homo sapiens
tccctcctgcatgaggctcggc

SEQ ID NO: 8160090 - DNA, 22 bp, Homo sapiens
tccctcctgcatgaggctcggc

SEQ ID NO: 8160091 - DNA, 22 bp, Homo sapiens
tccctcagaaattctctctgaa

SEQ ID NO: 8160092 - DNA, 18 bp, Homo sapiens
tccctcctgcctgcttcc

SEQ ID NO: 8160093 - DNA, 18 bp, Homo sapiens
tccctcctgcctgcttcc

SEQ ID NO: 8160094 - DNA, 18 bp, Homo sapiens
tccctcctgcctgcttcc

SEQ ID NO: 8160095 - DNA, 22 bp, Homo sapiens
tccctcctggccgtcaccgctg

SEQ ID NO: 8160096 - DNA, 22 bp, Homo sapiens
tccctcctggccgtcaccgctg

SEQ ID NO: 8160097 - DNA, 22 bp, Homo sapiens
tccctcctggtgagcaggggct

SEQ ID NO: 8160098 - DNA, 22 bp, Homo sapiens
tccctcctggtgatgatgcaaa

SEQ ID NO: 8160099 - DNA, 22 bp, Homo sapiens
tccctccttaataagaggtctg

SEQ ID NO: 8160100 - DNA, 22 bp, Homo sapiens
catttacacacagaggtgtgct

SEQ ID NO: 8160101 - DNA, 22 bp, Homo sapiens
catttacacacagaggtgtgct

SEQ ID NO: 8160102 - DNA, 22 bp, Homo sapiens
catttacacacagaggtgtgct

SEQ ID NO: 8160103 - DNA, 22 bp, Homo sapiens
catttacaatgtacaggttgtg

SEQ ID NO: 8160104 - DNA, 22 bp, Homo sapiens
catttacaatgtacaggttgtg

SEQ ID NO: 8160105 - DNA, 22 bp, Homo sapiens
catttacaatgtacaggttgtg

SEQ ID NO: 8160106 - DNA, 22 bp, Homo sapiens
catttaatgcacggatgtagcc

SEQ ID NO: 8160107 - DNA, 22 bp, Homo sapiens
catttaagagaaatatttagtt

SEQ ID NO: 8160108 - DNA, 22 bp, Homo sapiens
catttaatagatgctgtttcag

SEQ ID NO: 8160109 - DNA, 22 bp, Homo sapiens
catttaatagatgctgtttcag

SEQ ID NO: 8160110 - DNA, 22 bp, Homo sapiens
tccctgggttcccgtggaagtg

SEQ ID NO: 8160111 - DNA, 23 bp, Homo sapiens
tcctaactcaattcaggggtgtc

SEQ ID NO: 8160112 - DNA, 20 bp, Homo sapiens
tcctaactataaagtggctc

SEQ ID NO: 8160113 - DNA, 22 bp, Homo sapiens
tcctaactaatttgtagcaaaa

SEQ ID NO: 8160114 - DNA, 22 bp, Homo sapiens
tcctaactccactagccttggg

SEQ ID NO: 8160115 - DNA, 23 bp, Homo sapiens
tcctaactgattctgcagtctct

SEQ ID NO: 8160116 - DNA, 23 bp, Homo sapiens
tcctaactgattctgcagtctct

SEQ ID NO: 8160117 - DNA, 22 bp, Homo sapiens
tcctaactgccctgggcaaggt

SEQ ID NO: 8160118 - DNA, 18 bp, Homo sapiens
tcctaacttagatactcc

SEQ ID NO: 8160119 - DNA, 16 bp, Homo sapiens
tcctaactggcagttc

SEQ ID NO: 8160120 - DNA, 22 bp, Homo sapiens
tccctgggttacctttcaaggt

SEQ ID NO: 8160121 - DNA, 22 bp, Homo sapiens
tccctgggttcccgtggaagtg

SEQ ID NO: 8160122 - DNA, 22 bp, Homo sapiens
tccctgggtcctgcttgctctc

SEQ ID NO: 8160123 - DNA, 22 bp, Homo sapiens
tccctgggtcattctctggcac

SEQ ID NO: 8160124 - DNA, 22 bp, Homo sapiens
tccctgggtcattctctggcac

SEQ ID NO: 8160125 - DNA, 22 bp, Homo sapiens
tccctgggtcattctctggcac

SEQ ID NO: 8160126 - DNA, 22 bp, Homo sapiens
tccctgggtcctgcttgctctc

SEQ ID NO: 8160127 - DNA, 22 bp, Homo sapiens
tccctgggtcctgcttgctctc

SEQ ID NO: 8160128 - DNA, 22 bp, Homo sapiens
tccctgggtcctgcttgctctc

SEQ ID NO: 8160129 - DNA, 22 bp, Homo sapiens
tccctggggtaacattagaggg

SEQ ID NO: 8160130 - DNA, 18 bp, Homo sapiens
tccctggggctgccaccc

SEQ ID NO: 8160131 - DNA, 18 bp, Homo sapiens
tccctggggctgccaccc

SEQ ID NO: 8160132 - DNA, 22 bp, Homo sapiens
tccctgctttcttgtgagggga

SEQ ID NO: 8160133 - DNA, 22 bp, Homo sapiens
catttattgagtggccacagtg

SEQ ID NO: 8160134 - DNA, 22 bp, Homo sapiens
catttattgagtggccacagtg

SEQ ID NO: 8160135 - DNA, 22 bp, Homo sapiens
tccctgctttcttgtgagggga

SEQ ID NO: 8160136 - DNA, 22 bp, Homo sapiens
tccctggggtatcgctgaggca

SEQ ID NO: 8160137 - DNA, 22 bp, Homo sapiens
tccctggggtatcgctgaggca

SEQ ID NO: 8160138 - DNA, 22 bp, Homo sapiens
tccctgggtcattctctggcac

SEQ ID NO: 8160139 - DNA, 22 bp, Homo sapiens
tccctggggttcctccagccac

SEQ ID NO: 8160140 - DNA, 22 bp, Homo sapiens
tccctggggttcctccagccac

SEQ ID NO: 8160141 - DNA, 22 bp, Homo sapiens
tccctctctggctggggtgcgg

SEQ ID NO: 8160142 - DNA, 22 bp, Homo sapiens
tccctctctagcctgttcagta

SEQ ID NO: 8160143 - DNA, 22 bp, Homo sapiens
tccctctcttgggcgtggctca

SEQ ID NO: 8160144 - DNA, 22 bp, Homo sapiens
catttattagttagttcgatgt

SEQ ID NO: 8160145 - DNA, 22 bp, Homo sapiens
catttattagttagttcgatgt

SEQ ID NO: 8160146 - DNA, 22 bp, Homo sapiens
catttattcagctcagtcggtt

SEQ ID NO: 8160147 - DNA, 22 bp, Homo sapiens
catttattcagctcagtcggtt

SEQ ID NO: 8160148 - DNA, 22 bp, Homo sapiens
catttattcagctcagtcggtt

SEQ ID NO: 8160149 - DNA, 22 bp, Homo sapiens
tccctctccctattgcctggag

SEQ ID NO: 8160150 - DNA, 22 bp, Homo sapiens
tccctctccctattgcctggag

SEQ ID NO: 8160151 - DNA, 22 bp, Homo sapiens
tccctctccctattgcctggag

SEQ ID NO: 8160152 - DNA, 22 bp, Homo sapiens
tccctctccctattgcctggag

SEQ ID NO: 8160153 - DNA, 22 bp, Homo sapiens
tccctcctttatcaaaaagaga

SEQ ID NO: 8160154 - DNA, 22 bp, Homo sapiens
tccctcgaagagcttattcttt

SEQ ID NO: 8160155 - DNA, 22 bp, Homo sapiens
tccctctccctattgcctggag

SEQ ID NO: 8160156 - DNA, 22 bp, Homo sapiens
tccctctctagcctgttcagta

SEQ ID NO: 8160157 - DNA, 22 bp, Homo sapiens
catttattcatgatctgtagct

SEQ ID NO: 8160158 - DNA, 22 bp, Homo sapiens
catttattcatgatctgtagct

SEQ ID NO: 8160159 - DNA, 22 bp, Homo sapiens
catttattcatttgctagggct

SEQ ID NO: 8160160 - DNA, 22 bp, Homo sapiens
catttattcatgatctgtagct

SEQ ID NO: 8160161 - DNA, 22 bp, Homo sapiens
catttattcatgatctgtagct

SEQ ID NO: 8160162 - DNA, 22 bp, Homo sapiens
catttattgagtggccacagtg

SEQ ID NO: 8160163 - DNA, 22 bp, Homo sapiens
catttattctcagatccttgtc

SEQ ID NO: 8160164 - DNA, 22 bp, Homo sapiens
catttattctcagatccttgtc

SEQ ID NO: 8160165 - DNA, 22 bp, Homo sapiens
catttattctcagatccttgtc

SEQ ID NO: 8160166 - DNA, 22 bp, Homo sapiens
catttattctcagatccttgtc

SEQ ID NO: 8160167 - DNA, 22 bp, Homo sapiens
catttattcatttgctagggct

SEQ ID NO: 8160168 - DNA, 22 bp, Homo sapiens
catttattcatttgctagggct

SEQ ID NO: 8160169 - DNA, 22 bp, Homo sapiens
catttattctcagatccttgtc

SEQ ID NO: 8160170 - DNA, 22 bp, Homo sapiens
ccactgtcttttccaggctgaa

SEQ ID NO: 8160171 - DNA, 22 bp, Homo sapiens
ccactgtcttttccaggctgaa

SEQ ID NO: 8160172 - DNA, 22 bp, Homo sapiens
ccactgtcttttccaggctgaa

SEQ ID NO: 8160173 - DNA, 22 bp, Homo sapiens
ccactgtcttttccaggctgaa

SEQ ID NO: 8160174 - DNA, 22 bp, Homo sapiens
ccactgtctgtgacatcagaaa

SEQ ID NO: 8160175 - DNA, 22 bp, Homo sapiens
ccactgtctgtgacatcagaaa

SEQ ID NO: 8160176 - DNA, 22 bp, Homo sapiens
ccactgtctgcaggcctcagca

SEQ ID NO: 8160177 - DNA, 22 bp, Homo sapiens
ccactgtctgcaggcctcagca

SEQ ID NO: 8160178 - DNA, 22 bp, Homo sapiens
ccactgtcagaggggctgtgcc

SEQ ID NO: 8160179 - DNA, 22 bp, Homo sapiens
ccactgtctgcaggcctcagca

SEQ ID NO: 8160180 - DNA, 22 bp, Homo sapiens
ccactgtctgcaggcctcagca

SEQ ID NO: 8160181 - DNA, 22 bp, Homo sapiens
ccactgtcagaggggctgtgcc

SEQ ID NO: 8160182 - DNA, 22 bp, Homo sapiens
ccactgtaaccattatcaccat

SEQ ID NO: 8160183 - DNA, 22 bp, Homo sapiens
ccactgctagagatgcatcccc

SEQ ID NO: 8160184 - DNA, 22 bp, Homo sapiens
ccactgtataagcaaaatgaaa

SEQ ID NO: 8160185 - DNA, 22 bp, Homo sapiens
ccactgtaagtttgaaaataac

SEQ ID NO: 8160186 - DNA, 22 bp, Homo sapiens
ccactgtaagtttgaaaataac

SEQ ID NO: 8160187 - DNA, 22 bp, Homo sapiens
tctaagaggcatcaagacaagc

SEQ ID NO: 8160188 - DNA, 22 bp, Homo sapiens
tctaagaaatcagatgatgagg

SEQ ID NO: 8160189 - DNA, 22 bp, Homo sapiens
ccacttgaaacttagtggcata

SEQ ID NO: 8160190 - DNA, 22 bp, Homo sapiens
ccacttcctgcaggtaaggagc

SEQ ID NO: 8160191 - DNA, 22 bp, Homo sapiens
ccactgtggaaagcagttcaga

SEQ ID NO: 8160192 - DNA, 22 bp, Homo sapiens
ccactgtggaaagcagttcaga

SEQ ID NO: 8160193 - DNA, 22 bp, Homo sapiens
ccactgtgcccagcctcatggg

SEQ ID NO: 8160194 - DNA, 22 bp, Homo sapiens
ccactgtgagcatgaacaggac

SEQ ID NO: 8160195 - DNA, 22 bp, Homo sapiens
ccactgtgtccaccaggaatgc

SEQ ID NO: 8160196 - DNA, 22 bp, Homo sapiens
ccactgtgtccaccaggaatgc

SEQ ID NO: 8160197 - DNA, 22 bp, Homo sapiens
ccacttcatcccagctcagata

SEQ ID NO: 8160198 - DNA, 22 bp, Homo sapiens
tctaatccttgctacctgggtg

SEQ ID NO: 8160199 - DNA, 22 bp, Homo sapiens
tctaatccttgctacctgggtg

SEQ ID NO: 8160200 - DNA, 22 bp, Homo sapiens
tctaataaataaatgctctagg

SEQ ID NO: 8160201 - DNA, 22 bp, Homo sapiens
tctaataaataaatgctctagg

SEQ ID NO: 8160202 - DNA, 22 bp, Homo sapiens
tctaataaataaatgctctagg

SEQ ID NO: 8160203 - DNA, 22 bp, Homo sapiens
tctaaggacattggctttggag

SEQ ID NO: 8160204 - DNA, 22 bp, Homo sapiens
tctaaggacagttattactggg

SEQ ID NO: 8160205 - DNA, 22 bp, Homo sapiens
tctaaggacaaggtcttggaga

SEQ ID NO: 8160206 - DNA, 22 bp, Homo sapiens
tctaagtttggtgattaccaat

SEQ ID NO: 8160207 - DNA, 22 bp, Homo sapiens
tctaaggagcgctccagaaaaa

SEQ ID NO: 8160208 - DNA, 22 bp, Homo sapiens
tctaaggagccaggactattag

SEQ ID NO: 8160209 - DNA, 22 bp, Homo sapiens
ccagagaaccttgagctgtgag

SEQ ID NO: 8160210 - DNA, 22 bp, Homo sapiens
ccagacagttccttgaggttca

SEQ ID NO: 8160211 - DNA, 22 bp, Homo sapiens
ccagagaagtcttgcctggatt

SEQ ID NO: 8160212 - DNA, 22 bp, Homo sapiens
ccagagaattttagacaaaaat

SEQ ID NO: 8160213 - DNA, 22 bp, Homo sapiens
ccagagacaaggagctggagtc

SEQ ID NO: 8160214 - DNA, 19 bp, Homo sapiens
ccagagacattggcatctt

SEQ ID NO: 8160215 - DNA, 22 bp, Homo sapiens
tcctgggcttagtggctaggtc

SEQ ID NO: 8160216 - DNA, 22 bp, Homo sapiens
tcctgggcttcacagactctgt

SEQ ID NO: 8160217 - DNA, 22 bp, Homo sapiens
tcctgggcttcacagactctgt

SEQ ID NO: 8160218 - DNA, 22 bp, Homo sapiens
tcctgggcttcacagactctgt

SEQ ID NO: 8160219 - DNA, 22 bp, Homo sapiens
tcctgggcttgctcctccagct

SEQ ID NO: 8160220 - DNA, 22 bp, Homo sapiens
tcctgggcttgctcctccagct

SEQ ID NO: 8160221 - DNA, 22 bp, Homo sapiens
tcctgggcttgctcctccagct

SEQ ID NO: 8160222 - DNA, 22 bp, Homo sapiens
tcctgggcttgctcctccagct

SEQ ID NO: 8160223 - DNA, 22 bp, Homo sapiens
tcctgggcttgctcctccagct

SEQ ID NO: 8160224 - DNA, 22 bp, Homo sapiens
tcctgggctttgtttctctcct

SEQ ID NO: 8160225 - DNA, 22 bp, Homo sapiens
tcctgggctttgtttctctcct

SEQ ID NO: 8160226 - DNA, 19 bp, Homo sapiens
tcctggggaggggcatggc

SEQ ID NO: 8160227 - DNA, 19 bp, Homo sapiens
tcctggggaggggcatggc

SEQ ID NO: 8160228 - DNA, 19 bp, Homo sapiens
tcctggggaggggcatggc

SEQ ID NO: 8160229 - DNA, 22 bp, Homo sapiens
tccttaaagttggggtgctgca

SEQ ID NO: 8160230 - DNA, 22 bp, Homo sapiens
tccttcagtgtcccgctcaggt

SEQ ID NO: 8160231 - DNA, 17 bp, Homo sapiens
tccttcagtgcctctgc

SEQ ID NO: 8160232 - DNA, 22 bp, Homo sapiens
tccttcatgatgcttagcagag

SEQ ID NO: 8160233 - DNA, 21 bp, Homo sapiens
tccttcagttctgcactttct

SEQ ID NO: 8160234 - DNA, 22 bp, Homo sapiens
tccttcagttaaagatctcaca

SEQ ID NO: 8160235 - DNA, 22 bp, Homo sapiens
tccttccatggtggggctgctt

SEQ ID NO: 8160236 - DNA, 22 bp, Homo sapiens
tccttccaggtccagggatgtg

SEQ ID NO: 8160237 - DNA, 23 bp, Homo sapiens
tcctttaatgctggaatggctag

SEQ ID NO: 8160238 - DNA, 23 bp, Homo sapiens
tcctttaagatatcttattcctt

SEQ ID NO: 8160239 - DNA, 20 bp, Homo sapiens
tcctttactgttggggttgg

SEQ ID NO: 8160240 - DNA, 22 bp, Homo sapiens
ccactgctaacttgctgcagct

SEQ ID NO: 8160241 - DNA, 22 bp, Homo sapiens
ccactgctaacttgctgcagct

SEQ ID NO: 8160242 - DNA, 22 bp, Homo sapiens
tcctttaaagaactgtgctttt

SEQ ID NO: 8160243 - DNA, 22 bp, Homo sapiens
tcctttaaactcctttcaagtc

SEQ ID NO: 8160244 - DNA, 22 bp, Homo sapiens
tcctttaactagttaccatgtt

SEQ ID NO: 8160245 - DNA, 22 bp, Homo sapiens
tcctttaacttgattattttca

SEQ ID NO: 8160246 - DNA, 22 bp, Homo sapiens
tccttgggtcagtgagtgaggt

SEQ ID NO: 8160247 - DNA, 22 bp, Homo sapiens
tccttgtaaaggagctctaaca

SEQ ID NO: 8160248 - DNA, 22 bp, Homo sapiens
tcctttaaacaaccagctctca

SEQ ID NO: 8160249 - DNA, 19 bp, Homo sapiens
tccttccccccagcacaga

SEQ ID NO: 8160250 - DNA, 19 bp, Homo sapiens
tccttccccccagcacaga

SEQ ID NO: 8160251 - DNA, 19 bp, Homo sapiens
tccttccccccagcacaga

SEQ ID NO: 8160252 - DNA, 21 bp, Homo sapiens
tccttcccccttggcctggga

SEQ ID NO: 8160253 - DNA, 22 bp, Homo sapiens
tccttcctccatggtcttggtt

SEQ ID NO: 8160254 - DNA, 22 bp, Homo sapiens
tccttcctccatggtcttggtt

SEQ ID NO: 8160255 - DNA, 22 bp, Homo sapiens
tccttcctgcaggccaagtcct

SEQ ID NO: 8160256 - DNA, 22 bp, Homo sapiens
tccttcctgcaggccaagtcct

SEQ ID NO: 8160257 - DNA, 22 bp, Homo sapiens
tccttcctcggggacccagatc

SEQ ID NO: 8160258 - DNA, 22 bp, Homo sapiens
tccttcctcggggacccagatc

SEQ ID NO: 8160259 - DNA, 23 bp, Homo sapiens
tccttgggcctgcccagagtggt

SEQ ID NO: 8160260 - DNA, 22 bp, Homo sapiens
tccttcctgctctaacattcag

SEQ ID NO: 8160261 - DNA, 22 bp, Homo sapiens
tccttcctgctctaacattcag

SEQ ID NO: 8160262 - DNA, 22 bp, Homo sapiens
tccttcctgcaggccaagtcct

SEQ ID NO: 8160263 - DNA, 22 bp, Homo sapiens
tccttcctgcaggccaagtcct

SEQ ID NO: 8160264 - DNA, 23 bp, Homo sapiens
tccttgggcctgcccagagtggt

SEQ ID NO: 8160265 - DNA, 22 bp, Homo sapiens
tccttggggacgctgacatcgt

SEQ ID NO: 8160266 - DNA, 22 bp, Homo sapiens
tccttggggtaactccagcctg

SEQ ID NO: 8160267 - DNA, 22 bp, Homo sapiens
tccttggggtaactccagcctg

SEQ ID NO: 8160268 - DNA, 22 bp, Homo sapiens
tccttggggtaactccagcctg

SEQ ID NO: 8160269 - DNA, 22 bp, Homo sapiens
tccttgggtcagtgagtgaggt

SEQ ID NO: 8160270 - DNA, 18 bp, Homo sapiens
tcctggcagtcagagagg

SEQ ID NO: 8160271 - DNA, 22 bp, Homo sapiens
ccacacagtcagtttccaagaa

SEQ ID NO: 8160272 - DNA, 17 bp, Homo sapiens
ccacaccctttccttcc

SEQ ID NO: 8160273 - DNA, 22 bp, Homo sapiens
ccacaccatcgtttttacctta

SEQ ID NO: 8160274 - DNA, 22 bp, Homo sapiens
ccacactttgagatgactagga

SEQ ID NO: 8160275 - DNA, 22 bp, Homo sapiens
ccacactgcctgttatctccca

SEQ ID NO: 8160276 - DNA, 22 bp, Homo sapiens
ccacactttgagatgactagga

SEQ ID NO: 8160277 - DNA, 22 bp, Homo sapiens
ccacactgtctaacaaggcata

SEQ ID NO: 8160278 - DNA, 22 bp, Homo sapiens
ccacactgaacctcagtgtctt

SEQ ID NO: 8160279 - DNA, 22 bp, Homo sapiens
ccacactgaccagctgtgagac

SEQ ID NO: 8160280 - DNA, 22 bp, Homo sapiens
ccacactgaccagctgtgagac

SEQ ID NO: 8160281 - DNA, 22 bp, Homo sapiens
ccacactgaccagctgtgagac

SEQ ID NO: 8160282 - DNA, 22 bp, Homo sapiens
ccacactggcatgggatggagg

SEQ ID NO: 8160283 - DNA, 22 bp, Homo sapiens
tcctggcagtaatttgatgttg

SEQ ID NO: 8160284 - DNA, 22 bp, Homo sapiens
tcctggcagtaatttgatgttg

SEQ ID NO: 8160285 - DNA, 22 bp, Homo sapiens
tcctggcagtcaaataaccttg

SEQ ID NO: 8160286 - DNA, 22 bp, Homo sapiens
tcctggcagtcaaataaccttg

SEQ ID NO: 8160287 - DNA, 22 bp, Homo sapiens
tcctggcagtcaaataaccttg

SEQ ID NO: 8160288 - DNA, 18 bp, Homo sapiens
tcctggcagtcagagagg

SEQ ID NO: 8160289 - DNA, 18 bp, Homo sapiens
tcctggcagtcagagagg

SEQ ID NO: 8160290 - DNA, 22 bp, Homo sapiens
tcctggcaggtgtattggctgt

SEQ ID NO: 8160291 - DNA, 22 bp, Homo sapiens
tcctggcaggtgtattggctgt

SEQ ID NO: 8160292 - DNA, 22 bp, Homo sapiens
tcctggcaggtctgagaggtct

SEQ ID NO: 8160293 - DNA, 22 bp, Homo sapiens
tcctggcaggtctgagaggtct

SEQ ID NO: 8160294 - DNA, 22 bp, Homo sapiens
tcctggcaggtctgagaggtct

SEQ ID NO: 8160295 - DNA, 22 bp, Homo sapiens
tcctggcaggtcagcaggagca

SEQ ID NO: 8160296 - DNA, 22 bp, Homo sapiens
tcctggcaggtcagcaggagca

SEQ ID NO: 8160297 - DNA, 22 bp, Homo sapiens
tcctggcaggtcagcaggagca

SEQ ID NO: 8160298 - DNA, 22 bp, Homo sapiens
tcctggcaggtcagcaggagca

SEQ ID NO: 8160299 - DNA, 22 bp, Homo sapiens
tcctggcagggtggcagcgggt

SEQ ID NO: 8160300 - DNA, 22 bp, Homo sapiens
tcctggcagggtggcagcgggt

SEQ ID NO: 8160301 - DNA, 22 bp, Homo sapiens
tcctggcagggtggcagcgggt

SEQ ID NO: 8160302 - DNA, 22 bp, Homo sapiens
tcctggcagggtggcagcgggt

SEQ ID NO: 8160303 - DNA, 21 bp, Homo sapiens
tcctggcaggcccaggaccct

SEQ ID NO: 8160304 - DNA, 22 bp, Homo sapiens
tcctggcagcccgcaggtgctg

SEQ ID NO: 8160305 - DNA, 21 bp, Homo sapiens
tcctggcaggcccaggaccct

SEQ ID NO: 8160306 - DNA, 21 bp, Homo sapiens
tcctggcaggcccaggaccct

SEQ ID NO: 8160307 - DNA, 21 bp, Homo sapiens
tcctggcaggcccaggaccct

SEQ ID NO: 8160308 - DNA, 22 bp, Homo sapiens
tcctggcagcccgcaggtgctg

SEQ ID NO: 8160309 - DNA, 22 bp, Homo sapiens
tcctggcagcccgcaggtgctg

SEQ ID NO: 8160310 - DNA, 22 bp, Homo sapiens
tcctggcagcccgcaggtgctg

SEQ ID NO: 8160311 - DNA, 22 bp, Homo sapiens
tcctggcagcccgcaggtgctg

SEQ ID NO: 8160312 - DNA, 22 bp, Homo sapiens
tcctggcagggaacttgtcagc

SEQ ID NO: 8160313 - DNA, 22 bp, Homo sapiens
tcctggcagggaacttgtcagc

SEQ ID NO: 8160314 - DNA, 22 bp, Homo sapiens
tcctggcagggaacttgtcagc

SEQ ID NO: 8160315 - DNA, 22 bp, Homo sapiens
tcctggcagggtctaggtctag

SEQ ID NO: 8160316 - DNA, 22 bp, Homo sapiens
tcctggcagggtctaggtctag

SEQ ID NO: 8160317 - DNA, 22 bp, Homo sapiens
tcctggcagggtggcagcgggt

SEQ ID NO: 8160318 - DNA, 22 bp, Homo sapiens
tcctggcagggtctaggtctag

SEQ ID NO: 8160319 - DNA, 22 bp, Homo sapiens
tcctgggcttaagtgatcctcc

SEQ ID NO: 8160320 - DNA, 22 bp, Homo sapiens
tcctgggcttagtggctaggtc

SEQ ID NO: 8160321 - DNA, 22 bp, Homo sapiens
tcctgggcttagtggctaggtc

SEQ ID NO: 8160322 - DNA, 22 bp, Homo sapiens
tcctgggcttaagtgatcctcc

SEQ ID NO: 8160323 - DNA, 22 bp, Homo sapiens
tcctgggcttaagtgatcctcc

SEQ ID NO: 8160324 - DNA, 22 bp, Homo sapiens
tcctgggcttaagtgatcctcc

SEQ ID NO: 8160325 - DNA, 22 bp, Homo sapiens
tcctgggagcccttgctccacc

SEQ ID NO: 8160326 - DNA, 22 bp, Homo sapiens
tcctgggagcccttgctccacc

SEQ ID NO: 8160327 - DNA, 22 bp, Homo sapiens
tcctgggagcccttgctccacc

SEQ ID NO: 8160328 - DNA, 22 bp, Homo sapiens
tcctgggagcccttgctccacc

SEQ ID NO: 8160329 - DNA, 22 bp, Homo sapiens
tcctgggagcccttgctccacc

SEQ ID NO: 8160330 - DNA, 22 bp, Homo sapiens
tcctgggagcccttgctccacc

SEQ ID NO: 8160331 - DNA, 22 bp, Homo sapiens
tcctgggagcatggtgccgtga

SEQ ID NO: 8160332 - DNA, 22 bp, Homo sapiens
tcctgggagcatggtgccgtga

SEQ ID NO: 8160333 - DNA, 22 bp, Homo sapiens
tcctgggagcatggtgccgtga

SEQ ID NO: 8160334 - DNA, 22 bp, Homo sapiens
tcctgggagagtttgattcatt

SEQ ID NO: 8160335 - DNA, 22 bp, Homo sapiens
tcctgggagcacatggtcctgc

SEQ ID NO: 8160336 - DNA, 22 bp, Homo sapiens
tcctgggagcacatggtcctgc

SEQ ID NO: 8160337 - DNA, 22 bp, Homo sapiens
tcctgggagcacatggtcctgc

SEQ ID NO: 8160338 - DNA, 22 bp, Homo sapiens
tcctgggagcacatggtcctgc

SEQ ID NO: 8160339 - DNA, 22 bp, Homo sapiens
tcctgggactctttatcagaga

SEQ ID NO: 8160340 - DNA, 22 bp, Homo sapiens
tcctgggactctttatcagaga

SEQ ID NO: 8160341 - DNA, 22 bp, Homo sapiens
tcctggctccagcagctcttcc

SEQ ID NO: 8160342 - DNA, 22 bp, Homo sapiens
ccacagaaagttgtctagagta

SEQ ID NO: 8160343 - DNA, 22 bp, Homo sapiens
tcctgggagagtgggactgtat

SEQ ID NO: 8160344 - DNA, 22 bp, Homo sapiens
tcctgggagagtgggactgtat

SEQ ID NO: 8160345 - DNA, 22 bp, Homo sapiens
tcctgggagagtgggactgtat

SEQ ID NO: 8160346 - DNA, 22 bp, Homo sapiens
tcctgggagagtgggactgtat

SEQ ID NO: 8160347 - DNA, 22 bp, Homo sapiens
tcctgggagacccagctgtgga

SEQ ID NO: 8160348 - DNA, 22 bp, Homo sapiens
tcctgggagacccagctgtgga

SEQ ID NO: 8160349 - DNA, 22 bp, Homo sapiens
tcctgggagacccagctgtgga

SEQ ID NO: 8160350 - DNA, 22 bp, Homo sapiens
tcctgggagacccagctgtgga

SEQ ID NO: 8160351 - DNA, 22 bp, Homo sapiens
tcctgggagacccagctgtgga

SEQ ID NO: 8160352 - DNA, 22 bp, Homo sapiens
tcctgggactttcaaggctagg

SEQ ID NO: 8160353 - DNA, 22 bp, Homo sapiens
ccaagggaaaccgagaggctgg

SEQ ID NO: 8160354 - DNA, 22 bp, Homo sapiens
ccaagggaaaccgagaggctgg

SEQ ID NO: 8160355 - DNA, 22 bp, Homo sapiens
tcctggaggacagaggcatctc

SEQ ID NO: 8160356 - DNA, 22 bp, Homo sapiens
tcctggaggacagaggcatctc

SEQ ID NO: 8160357 - DNA, 22 bp, Homo sapiens
ccaagggaaaccgagaggctgg

SEQ ID NO: 8160358 - DNA, 22 bp, Homo sapiens
ccaaggcttcctgacctacatg

SEQ ID NO: 8160359 - DNA, 22 bp, Homo sapiens
ccaaggcttcccagagatgctc

SEQ ID NO: 8160360 - DNA, 22 bp, Homo sapiens
ccaaggcttcccagagatgctc

SEQ ID NO: 8160361 - DNA, 22 bp, Homo sapiens
ccaaggcttcccagagatgctc

SEQ ID NO: 8160362 - DNA, 22 bp, Homo sapiens
ccaaggcttcccagagatgctc

SEQ ID NO: 8160363 - DNA, 22 bp, Homo sapiens
tcctggcagaaatggggctgtg

SEQ ID NO: 8160364 - DNA, 22 bp, Homo sapiens
tcctggcagaaatggggctgtg

SEQ ID NO: 8160365 - DNA, 22 bp, Homo sapiens
tcctggcagaaatggggctgtg

SEQ ID NO: 8160366 - DNA, 22 bp, Homo sapiens
tcctggcagagagcatgaggcc

SEQ ID NO: 8160367 - DNA, 22 bp, Homo sapiens
tcctggcagagagcatgaggcc

SEQ ID NO: 8160368 - DNA, 22 bp, Homo sapiens
tcctggcagagagcatgaggcc

SEQ ID NO: 8160369 - DNA, 22 bp, Homo sapiens
tcctggcagagggcggcctcga

SEQ ID NO: 8160370 - DNA, 22 bp, Homo sapiens
tcctggcagagggcggcctcga

SEQ ID NO: 8160371 - DNA, 22 bp, Homo sapiens
tcctggcagcccgcaggtgctg

SEQ ID NO: 8160372 - DNA, 22 bp, Homo sapiens
tcctggaggagatccaatctga

SEQ ID NO: 8160373 - DNA, 22 bp, Homo sapiens
tcctggcacccttgggttggag

SEQ ID NO: 8160374 - DNA, 22 bp, Homo sapiens
tcctggcactttgggggctcgc

SEQ ID NO: 8160375 - DNA, 22 bp, Homo sapiens
tcctggcactttgggggctcgc

SEQ ID NO: 8160376 - DNA, 22 bp, Homo sapiens
tcctggcactttgggggctcgc

SEQ ID NO: 8160377 - DNA, 22 bp, Homo sapiens
tcctggaggacagaggcatctc

SEQ ID NO: 8160378 - DNA, 22 bp, Homo sapiens
tcctggaggacagaggcatctc

SEQ ID NO: 8160379 - DNA, 18 bp, Homo sapiens
ccaaggcccctgctgggg

SEQ ID NO: 8160380 - DNA, 18 bp, Homo sapiens
ccaaggcccctgctgggg

SEQ ID NO: 8160381 - DNA, 18 bp, Homo sapiens
ccaaggcccctgctgggg

SEQ ID NO: 8160382 - DNA, 22 bp, Homo sapiens
ccaaggcccctgtggtctagcc

SEQ ID NO: 8160383 - DNA, 18 bp, Homo sapiens
ccaaggcccctgctgggg

SEQ ID NO: 8160384 - DNA, 22 bp, Homo sapiens
ccaaggcccctgtggtctagcc

SEQ ID NO: 8160385 - DNA, 22 bp, Homo sapiens
ccaaggctcctcagctggtctt

SEQ ID NO: 8160386 - DNA, 22 bp, Homo sapiens
ccaaggctcctcagctggtctt

SEQ ID NO: 8160387 - DNA, 22 bp, Homo sapiens
ccaaggctggagggcttatgta

SEQ ID NO: 8160388 - DNA, 22 bp, Homo sapiens
ccaaggctggagtgcagtggcg

SEQ ID NO: 8160389 - DNA, 22 bp, Homo sapiens
ccaaggctggagtgcagtggcg

SEQ ID NO: 8160390 - DNA, 22 bp, Homo sapiens
ccaaggctgtggggctgtgcag

SEQ ID NO: 8160391 - DNA, 22 bp, Homo sapiens
ccaaggctgtggggctgtgcag

SEQ ID NO: 8160392 - DNA, 22 bp, Homo sapiens
ccaaggctggagtgcagtggcg

SEQ ID NO: 8160393 - DNA, 22 bp, Homo sapiens
ccaaggctgtcattcagtagct

SEQ ID NO: 8160394 - DNA, 22 bp, Homo sapiens
ccaaggctgtcattcagtagct

SEQ ID NO: 8160395 - DNA, 22 bp, Homo sapiens
tcctagaactccaggacagtcc

SEQ ID NO: 8160396 - DNA, 22 bp, Homo sapiens
tcctagaacagcccacctggaa

SEQ ID NO: 8160397 - DNA, 22 bp, Homo sapiens
tcctagaactccaggacagtcc

SEQ ID NO: 8160398 - DNA, 22 bp, Homo sapiens
tcctacagatactaaggagatc

SEQ ID NO: 8160399 - DNA, 20 bp, Homo sapiens
tcctaataacctgaagaaat

SEQ ID NO: 8160400 - DNA, 22 bp, Homo sapiens
tcctacaatgcacagaatagcc

SEQ ID NO: 8160401 - DNA, 22 bp, Homo sapiens
tcctaattgcttcatgtgttgt

SEQ ID NO: 8160402 - DNA, 22 bp, Homo sapiens
ccaagaggttgtgaggcaggca

SEQ ID NO: 8160403 - DNA, 22 bp, Homo sapiens
ccaaggagaatgacaccatgga

SEQ ID NO: 8160404 - DNA, 22 bp, Homo sapiens
ccaaggagaatgacaccatgga

SEQ ID NO: 8160405 - DNA, 22 bp, Homo sapiens
tcctagaactccaggacagtcc

SEQ ID NO: 8160406 - DNA, 22 bp, Homo sapiens
ccaaggagcaagtttacacctg

SEQ ID NO: 8160407 - DNA, 22 bp, Homo sapiens
ccaaggagctgcaggcacttgt

SEQ ID NO: 8160408 - DNA, 22 bp, Homo sapiens
ccaaggccatcaggtaggtcct

SEQ ID NO: 8160409 - DNA, 22 bp, Homo sapiens
ccaaggccacaaacagcctggc

SEQ ID NO: 8160410 - DNA, 22 bp, Homo sapiens
ccaaggccacaaacagcctggc

SEQ ID NO: 8160411 - DNA, 22 bp, Homo sapiens
ccaaggcacactctgcaaggtt

SEQ ID NO: 8160412 - DNA, 22 bp, Homo sapiens
ccaaggcaatgtgcagctggtg

SEQ ID NO: 8160413 - DNA, 22 bp, Homo sapiens
ccaaggcacactctgcaaggtt

SEQ ID NO: 8160414 - DNA, 22 bp, Homo sapiens
ccaaggcacactctgcaaggtt

SEQ ID NO: 8160415 - DNA, 22 bp, Homo sapiens
ccaaggcaacgttggtgtcagg

SEQ ID NO: 8160416 - DNA, 22 bp, Homo sapiens
ccaaggagctgcaggcacttgt

SEQ ID NO: 8160417 - DNA, 22 bp, Homo sapiens
ccaaggagtagagcaggaagct

SEQ ID NO: 8160418 - DNA, 22 bp, Homo sapiens
tcagatatagtcatttaaataa

SEQ ID NO: 8160419 - DNA, 22 bp, Homo sapiens
tcagatagtgataatagcatgt

SEQ ID NO: 8160420 - DNA, 22 bp, Homo sapiens
tcagatagtgataatagcatgt

SEQ ID NO: 8160421 - DNA, 22 bp, Homo sapiens
tcagatatgaattcatatctct

SEQ ID NO: 8160422 - DNA, 22 bp, Homo sapiens
tcagatatagtcatttaaataa

SEQ ID NO: 8160423 - DNA, 22 bp, Homo sapiens
tcagatatagtcatttaaataa

SEQ ID NO: 8160424 - DNA, 22 bp, Homo sapiens
tcagatatagtcatttaaataa

SEQ ID NO: 8160425 - DNA, 22 bp, Homo sapiens
tcagatattcaattaagttaaa

SEQ ID NO: 8160426 - DNA, 22 bp, Homo sapiens
tcagatatggagtctaaaacca

SEQ ID NO: 8160427 - DNA, 22 bp, Homo sapiens
tcagatattcaattaagttaaa

SEQ ID NO: 8160428 - DNA, 22 bp, Homo sapiens
tcagatatgaattcatatctct

SEQ ID NO: 8160429 - DNA, 22 bp, Homo sapiens
tcagatatgaattcatatctct

SEQ ID NO: 8160430 - DNA, 20 bp, Homo sapiens
tcagataaggtgatctgtgg

SEQ ID NO: 8160431 - DNA, 22 bp, Homo sapiens
tcagaggatgctgttctttaat

SEQ ID NO: 8160432 - DNA, 22 bp, Homo sapiens
tcagaggatcatgtccctactc

SEQ ID NO: 8160433 - DNA, 23 bp, Homo sapiens
tcagaggatcatcaaacgttttc

SEQ ID NO: 8160434 - DNA, 22 bp, Homo sapiens
tcagaggatagaaatacttatt

SEQ ID NO: 8160435 - DNA, 22 bp, Homo sapiens
tcagaggagctgcagaacgctg

SEQ ID NO: 8160436 - DNA, 22 bp, Homo sapiens
tcagaggaggcatttaaacaga

SEQ ID NO: 8160437 - DNA, 22 bp, Homo sapiens
tcagaggaggcatttaaacaga

SEQ ID NO: 8160438 - DNA, 22 bp, Homo sapiens
tcagaggagggactcagaccca

SEQ ID NO: 8160439 - DNA, 22 bp, Homo sapiens
tcagaggagcaaaagaggggat

SEQ ID NO: 8160440 - DNA, 22 bp, Homo sapiens
tcagaggagccaaagttctgag

SEQ ID NO: 8160441 - DNA, 23 bp, Homo sapiens
tcagagcaagatgatgtatgagc

SEQ ID NO: 8160442 - DNA, 22 bp, Homo sapiens
tcagaggagcaaaagaggggat

SEQ ID NO: 8160443 - DNA, 22 bp, Homo sapiens
tcagaggagatggttaccaggg

SEQ ID NO: 8160444 - DNA, 22 bp, Homo sapiens
cagtttttgccattaagagtaa

SEQ ID NO: 8160445 - DNA, 22 bp, Homo sapiens
cagtttttcaaaattacatgat

SEQ ID NO: 8160446 - DNA, 23 bp, Homo sapiens
cataaaatattagtatggtagca

SEQ ID NO: 8160447 - DNA, 22 bp, Homo sapiens
cataaaaggtagcagtttgaaa

SEQ ID NO: 8160448 - DNA, 22 bp, Homo sapiens
cataaaagccacctatttaaag

SEQ ID NO: 8160449 - DNA, 23 bp, Homo sapiens
cataaaatattagtatggtagca

SEQ ID NO: 8160450 - DNA, 23 bp, Homo sapiens
cataaaatattagtatggtagca

SEQ ID NO: 8160451 - DNA, 23 bp, Homo sapiens
cataaaatattagtatggtagca

SEQ ID NO: 8160452 - DNA, 23 bp, Homo sapiens
cataaaatattagtatggtagca

SEQ ID NO: 8160453 - DNA, 22 bp, Homo sapiens
tcagatgagtgctttcagctgc

SEQ ID NO: 8160454 - DNA, 22 bp, Homo sapiens
tcagatgagtgctttcagctgc

SEQ ID NO: 8160455 - DNA, 22 bp, Homo sapiens
tcagatattctctaagaacaat

SEQ ID NO: 8160456 - DNA, 22 bp, Homo sapiens
tcagatcaggatgcagcaacat

SEQ ID NO: 8160457 - DNA, 22 bp, Homo sapiens
tcagatattcaattaagttaaa

SEQ ID NO: 8160458 - DNA, 22 bp, Homo sapiens
tcagatccgagtgtgccaagga

SEQ ID NO: 8160459 - DNA, 22 bp, Homo sapiens
cagtttttagattagttggtgg

SEQ ID NO: 8160460 - DNA, 22 bp, Homo sapiens
cagttttggtgatatttgagaa

SEQ ID NO: 8160461 - DNA, 22 bp, Homo sapiens
cagttttggtgatatttgagaa

SEQ ID NO: 8160462 - DNA, 22 bp, Homo sapiens
cagttttctaaagtctctttaa

SEQ ID NO: 8160463 - DNA, 22 bp, Homo sapiens
tcagagagttttcactagggtg

SEQ ID NO: 8160464 - DNA, 22 bp, Homo sapiens
tcagagatctggagtacaactg

SEQ ID NO: 8160465 - DNA, 22 bp, Homo sapiens
tcagagatcttcaggatgggac

SEQ ID NO: 8160466 - DNA, 22 bp, Homo sapiens
tcagagagtgcaaaatatagct

SEQ ID NO: 8160467 - DNA, 22 bp, Homo sapiens
tcagagcaaattcctgtgagcc

SEQ ID NO: 8160468 - DNA, 22 bp, Homo sapiens
tcagagcaacttttcctgcttt

SEQ ID NO: 8160469 - DNA, 22 bp, Homo sapiens
tcagagatgcagtgccacctac

SEQ ID NO: 8160470 - DNA, 22 bp, Homo sapiens
tcagagatcttcaggatgggac

SEQ ID NO: 8160471 - DNA, 22 bp, Homo sapiens
tcagagattcacgtcagtccca

SEQ ID NO: 8160472 - DNA, 23 bp, Homo sapiens
tcagagatggaaagcagaccacg

SEQ ID NO: 8160473 - DNA, 22 bp, Homo sapiens
cagttgatttttatggtgtgaa

SEQ ID NO: 8160474 - DNA, 22 bp, Homo sapiens
cagttgattgacttaagtacct

SEQ ID NO: 8160475 - DNA, 22 bp, Homo sapiens
cagttgatttttatggtgtgaa

SEQ ID NO: 8160476 - DNA, 22 bp, Homo sapiens
cagttgcctgtttccttgtgtg

SEQ ID NO: 8160477 - DNA, 22 bp, Homo sapiens
cagttgcctactacatggcagg

SEQ ID NO: 8160478 - DNA, 22 bp, Homo sapiens
cagttgccttatttccttgctg

SEQ ID NO: 8160479 - DNA, 22 bp, Homo sapiens
cagttgctggatgtgcagctct

SEQ ID NO: 8160480 - DNA, 22 bp, Homo sapiens
tcagagaggttggtgataagaa

SEQ ID NO: 8160481 - DNA, 22 bp, Homo sapiens
tcagagaggttggtgataagaa

SEQ ID NO: 8160482 - DNA, 22 bp, Homo sapiens
cagttggttttgaggctgtact

SEQ ID NO: 8160483 - DNA, 22 bp, Homo sapiens
cagttggttttgaggctgtact

SEQ ID NO: 8160484 - DNA, 22 bp, Homo sapiens
cagttggtgatgaggctagtag

SEQ ID NO: 8160485 - DNA, 22 bp, Homo sapiens
cagttggtgatgaggctagtag

SEQ ID NO: 8160486 - DNA, 22 bp, Homo sapiens
cagttggtcttcccttggagca

SEQ ID NO: 8160487 - DNA, 22 bp, Homo sapiens
tcagagagtgcaaaatatagct

SEQ ID NO: 8160488 - DNA, 21 bp, Homo sapiens
tcagagagtcacagtgaactg

SEQ ID NO: 8160489 - DNA, 22 bp, Homo sapiens
tcaatatattccatgttttctc

SEQ ID NO: 8160490 - DNA, 22 bp, Homo sapiens
tcaatattcttctttagtagga

SEQ ID NO: 8160491 - DNA, 22 bp, Homo sapiens
tcaatatattccatgttttctc

SEQ ID NO: 8160492 - DNA, 22 bp, Homo sapiens
tcaatatagcagtgtacttgag

SEQ ID NO: 8160493 - DNA, 22 bp, Homo sapiens
tcaatcacgtgttccatgttct

SEQ ID NO: 8160494 - DNA, 22 bp, Homo sapiens
tcaatcattcttgccatttatt

SEQ ID NO: 8160495 - DNA, 22 bp, Homo sapiens
tcaatcatagtccttctctaga

SEQ ID NO: 8160496 - DNA, 22 bp, Homo sapiens
tcaatcataatgaagtgaagaa

SEQ ID NO: 8160497 - DNA, 22 bp, Homo sapiens
cagttctggagtttcattcttt

SEQ ID NO: 8160498 - DNA, 22 bp, Homo sapiens
cagttagcactcagtttccaga

SEQ ID NO: 8160499 - DNA, 22 bp, Homo sapiens
cagttataagactaagctattc

SEQ ID NO: 8160500 - DNA, 22 bp, Homo sapiens
cagttataagactaagctattc

SEQ ID NO: 8160501 - DNA, 22 bp, Homo sapiens
cagttctttgtggggagttctc

SEQ ID NO: 8160502 - DNA, 22 bp, Homo sapiens
cagttgaaaagattttattctg

SEQ ID NO: 8160503 - DNA, 20 bp, Homo sapiens
cagttgaaataatttgtttg

SEQ ID NO: 8160504 - DNA, 22 bp, Homo sapiens
cagttgattgacttaagtacct

SEQ ID NO: 8160505 - DNA, 22 bp, Homo sapiens
cagttgatgtttagactctgca

SEQ ID NO: 8160506 - DNA, 23 bp, Homo sapiens
cagttgatgttaccttccttaga

SEQ ID NO: 8160507 - DNA, 22 bp, Homo sapiens
cagttgatgggactcatgtggg

SEQ ID NO: 8160508 - DNA, 22 bp, Homo sapiens
cagttgatattgcagacaagca

SEQ ID NO: 8160509 - DNA, 22 bp, Homo sapiens
cagttgatcactataggcttca

SEQ ID NO: 8160510 - DNA, 22 bp, Homo sapiens
cagttgatattgcagacaagca

SEQ ID NO: 8160511 - DNA, 22 bp, Homo sapiens
cagttgatatagaaaaaagtga

SEQ ID NO: 8160512 - DNA, 22 bp, Homo sapiens
cagttgataataccagagagag

SEQ ID NO: 8160513 - DNA, 21 bp, Homo sapiens
cagttgatagagatcttgagc

SEQ ID NO: 8160514 - DNA, 22 bp, Homo sapiens
catagaaagtattatggaattt

SEQ ID NO: 8160515 - DNA, 22 bp, Homo sapiens
catagaaactgagacaaggatt

SEQ ID NO: 8160516 - DNA, 22 bp, Homo sapiens
catagaaactgagacaaggatt

SEQ ID NO: 8160517 - DNA, 22 bp, Homo sapiens
tcaggcctagggagaaaattca

SEQ ID NO: 8160518 - DNA, 22 bp, Homo sapiens
tcaggcctagaacacagcagat

SEQ ID NO: 8160519 - DNA, 22 bp, Homo sapiens
tcaggccctttgctgctgcccc

SEQ ID NO: 8160520 - DNA, 22 bp, Homo sapiens
tcaggcctagggagccacacca

SEQ ID NO: 8160521 - DNA, 22 bp, Homo sapiens
tcaggcctagggagccacacca

SEQ ID NO: 8160522 - DNA, 22 bp, Homo sapiens
tcaggcctcagcagcccacagg

SEQ ID NO: 8160523 - DNA, 22 bp, Homo sapiens
tcaggcctcaagctgctttaag

SEQ ID NO: 8160524 - DNA, 22 bp, Homo sapiens
tcaggccccttgtcagctctgt

SEQ ID NO: 8160525 - DNA, 22 bp, Homo sapiens
tcaggccccttgtcagctctgt

SEQ ID NO: 8160526 - DNA, 22 bp, Homo sapiens
tcaggccccatcccagacttat

SEQ ID NO: 8160527 - DNA, 22 bp, Homo sapiens
tcaggcccagagtcacggatcc

SEQ ID NO: 8160528 - DNA, 22 bp, Homo sapiens
tcaggccccatcccagacttat

SEQ ID NO: 8160529 - DNA, 22 bp, Homo sapiens
tcaggcccttctcccaggactc

SEQ ID NO: 8160530 - DNA, 22 bp, Homo sapiens
tcaggccctttgctgctgcccc

SEQ ID NO: 8160531 - DNA, 22 bp, Homo sapiens
tcaggccctttgctgctgcccc

SEQ ID NO: 8160532 - DNA, 22 bp, Homo sapiens
tcaggccccttgtcagctctgt

SEQ ID NO: 8160533 - DNA, 22 bp, Homo sapiens
tcaggcccttctcccaggactc

SEQ ID NO: 8160534 - DNA, 22 bp, Homo sapiens
tcaggctgcctatcagactgtg

SEQ ID NO: 8160535 - DNA, 22 bp, Homo sapiens
tcaggctgcctatcagactgtg

SEQ ID NO: 8160536 - DNA, 22 bp, Homo sapiens
catagaaatcaggtgagaatct

SEQ ID NO: 8160537 - DNA, 21 bp, Homo sapiens
tcaggctgtctgctggttcca

SEQ ID NO: 8160538 - DNA, 17 bp, Homo sapiens
tcaggctgtgcctggta

SEQ ID NO: 8160539 - DNA, 21 bp, Homo sapiens
tcaggctgtctgctggttcca

SEQ ID NO: 8160540 - DNA, 21 bp, Homo sapiens
tcaggctgtctgctggttcca

SEQ ID NO: 8160541 - DNA, 21 bp, Homo sapiens
tcaggctgtctgctggttcca

SEQ ID NO: 8160542 - DNA, 22 bp, Homo sapiens
tcaggctgtatatcttgcactc

SEQ ID NO: 8160543 - DNA, 22 bp, Homo sapiens
tcaggctgtatatcttgcactc

SEQ ID NO: 8160544 - DNA, 22 bp, Homo sapiens
tcaggctgtatatcttgcactc

SEQ ID NO: 8160545 - DNA, 17 bp, Homo sapiens
tcaggctgtgcctggta

SEQ ID NO: 8160546 - DNA, 17 bp, Homo sapiens
tcaggctgtgcctggta

SEQ ID NO: 8160547 - DNA, 17 bp, Homo sapiens
tcaggctgtgcctggta

SEQ ID NO: 8160548 - DNA, 22 bp, Homo sapiens
tcaggctgtgtctttaaacaat

SEQ ID NO: 8160549 - DNA, 22 bp, Homo sapiens
tcaggctgtgggcactggccat

SEQ ID NO: 8160550 - DNA, 22 bp, Homo sapiens
tcaggctgttagccacctcctc

SEQ ID NO: 8160551 - DNA, 22 bp, Homo sapiens
tcaggctgtgtctttaaacaat

SEQ ID NO: 8160552 - DNA, 22 bp, Homo sapiens
tcaggctgttagccacctcctc

SEQ ID NO: 8160553 - DNA, 22 bp, Homo sapiens
tcagggagaggtgagagcctgt

SEQ ID NO: 8160554 - DNA, 22 bp, Homo sapiens
tcagggagaggtgagagcctgt

SEQ ID NO: 8160555 - DNA, 22 bp, Homo sapiens
tcaggctgtggcttcagttctt

SEQ ID NO: 8160556 - DNA, 17 bp, Homo sapiens
tcaggctgtgcctggta

SEQ ID NO: 8160557 - DNA, 17 bp, Homo sapiens
tcaggctgtgcctggta

SEQ ID NO: 8160558 - DNA, 22 bp, Homo sapiens
tcaggctgtggctttgaccgca

SEQ ID NO: 8160559 - DNA, 22 bp, Homo sapiens
tcaggctgtggcttcagttctt

SEQ ID NO: 8160560 - DNA, 22 bp, Homo sapiens
tcaggctgtggcttcagttctt

SEQ ID NO: 8160561 - DNA, 22 bp, Homo sapiens
tcaggctgtgggcactggccat

SEQ ID NO: 8160562 - DNA, 22 bp, Homo sapiens
tcaggctgtgggcactggccat

SEQ ID NO: 8160563 - DNA, 22 bp, Homo sapiens
tcaggctgtggctttgaccgca

SEQ ID NO: 8160564 - DNA, 22 bp, Homo sapiens
tcaggctgtgggcactggccat

SEQ ID NO: 8160565 - DNA, 22 bp, Homo sapiens
tcaggctgtgggcactggccat

SEQ ID NO: 8160566 - DNA, 22 bp, Homo sapiens
tcaggctgtgggcactggccat

SEQ ID NO: 8160567 - DNA, 22 bp, Homo sapiens
cataatttcccaagagattgaa

SEQ ID NO: 8160568 - DNA, 22 bp, Homo sapiens
cataatttcccaagagattgaa

SEQ ID NO: 8160569 - DNA, 22 bp, Homo sapiens
cataatttcactgtcgtatggc

SEQ ID NO: 8160570 - DNA, 22 bp, Homo sapiens
cataattataaacgcaagttca

SEQ ID NO: 8160571 - DNA, 22 bp, Homo sapiens
cataattagtcatgttatgcat

SEQ ID NO: 8160572 - DNA, 22 bp, Homo sapiens
cataattataaacgcaagttca

SEQ ID NO: 8160573 - DNA, 22 bp, Homo sapiens
cataattaggcagttgatcatt

SEQ ID NO: 8160574 - DNA, 22 bp, Homo sapiens
cataattaggcagttgatcatt

SEQ ID NO: 8160575 - DNA, 22 bp, Homo sapiens
cataattagtcatgttatgcat

SEQ ID NO: 8160576 - DNA, 22 bp, Homo sapiens
cataattaggcagttgatcatt

SEQ ID NO: 8160577 - DNA, 22 bp, Homo sapiens
cataattagagaattcatgtta

SEQ ID NO: 8160578 - DNA, 22 bp, Homo sapiens
cataattagagaattcatgtta

SEQ ID NO: 8160579 - DNA, 22 bp, Homo sapiens
cataattactgatatgctgatt

SEQ ID NO: 8160580 - DNA, 22 bp, Homo sapiens
cataattactgatatgctgatt

SEQ ID NO: 8160581 - DNA, 22 bp, Homo sapiens
cataattactgatatgctgatt

SEQ ID NO: 8160582 - DNA, 22 bp, Homo sapiens
cataattaaattctgggcaaga

SEQ ID NO: 8160583 - DNA, 22 bp, Homo sapiens
cataattaaattctgggcaaga

SEQ ID NO: 8160584 - DNA, 22 bp, Homo sapiens
cataatgttaatcttgactcca

SEQ ID NO: 8160585 - DNA, 18 bp, Homo sapiens
cataattttctttcttta

SEQ ID NO: 8160586 - DNA, 22 bp, Homo sapiens
tcaggcagagtggaagctgcaa

SEQ ID NO: 8160587 - DNA, 22 bp, Homo sapiens
tcaggcagagtggaagctgcaa

SEQ ID NO: 8160588 - DNA, 22 bp, Homo sapiens
tcaggcagagtggaagctgcaa

SEQ ID NO: 8160589 - DNA, 22 bp, Homo sapiens
tcaggcagagttaatttgctcc

SEQ ID NO: 8160590 - DNA, 22 bp, Homo sapiens
tcaggcccagagtcacggatcc

SEQ ID NO: 8160591 - DNA, 22 bp, Homo sapiens
cataatttgatatgcttgatgg

SEQ ID NO: 8160592 - DNA, 22 bp, Homo sapiens
cataatttctgtatcagcacca

SEQ ID NO: 8160593 - DNA, 22 bp, Homo sapiens
cataatttctaccagggccata

SEQ ID NO: 8160594 - DNA, 22 bp, Homo sapiens
cataatttgtggtagtggggga

SEQ ID NO: 8160595 - DNA, 22 bp, Homo sapiens
cataattttccatggtttgcta

SEQ ID NO: 8160596 - DNA, 22 bp, Homo sapiens
cataattttccatggtttgcta

SEQ ID NO: 8160597 - DNA, 18 bp, Homo sapiens
cataattttctttcttta

SEQ ID NO: 8160598 - DNA, 22 bp, Homo sapiens
cataatatctccgattacttgc

SEQ ID NO: 8160599 - DNA, 22 bp, Homo sapiens
cataatatctccgattacttgc

SEQ ID NO: 8160600 - DNA, 22 bp, Homo sapiens
cataatatctccgattacttgc

SEQ ID NO: 8160601 - DNA, 22 bp, Homo sapiens
cataacatccttgctactttga

SEQ ID NO: 8160602 - DNA, 22 bp, Homo sapiens
cataacagtggcttcagcaagt

SEQ ID NO: 8160603 - DNA, 22 bp, Homo sapiens
tcagcagtcctccaggatcaag

SEQ ID NO: 8160604 - DNA, 22 bp, Homo sapiens
cataatgtatgcattttccagc

SEQ ID NO: 8160605 - DNA, 22 bp, Homo sapiens
cataatgtatgcattttccagc

SEQ ID NO: 8160606 - DNA, 22 bp, Homo sapiens
tcagcagggtttgacttctaat

SEQ ID NO: 8160607 - DNA, 22 bp, Homo sapiens
tcagcaggggccgttgggtgga

SEQ ID NO: 8160608 - DNA, 22 bp, Homo sapiens
tcagcaggtctgaggcggggcc

SEQ ID NO: 8160609 - DNA, 22 bp, Homo sapiens
tcagcagggtttgacttctaat

SEQ ID NO: 8160610 - DNA, 22 bp, Homo sapiens
tcagcaggtctgaggcggggcc

SEQ ID NO: 8160611 - DNA, 22 bp, Homo sapiens
tcagcaggtgaacatcatgcca

SEQ ID NO: 8160612 - DNA, 22 bp, Homo sapiens
tcagcaggtgaacatcatgcca

SEQ ID NO: 8160613 - DNA, 22 bp, Homo sapiens
tcagcaggtgcctcagattctt

SEQ ID NO: 8160614 - DNA, 22 bp, Homo sapiens
tcagcaggtgcctcagattctt

SEQ ID NO: 8160615 - DNA, 22 bp, Homo sapiens
tcagcaggtgctttgtttactc

SEQ ID NO: 8160616 - DNA, 22 bp, Homo sapiens
tcagcaggtggtgggcaggtga

SEQ ID NO: 8160617 - DNA, 22 bp, Homo sapiens
tcagcaggtgctttgtttactc

SEQ ID NO: 8160618 - DNA, 22 bp, Homo sapiens
tcagcaggtggtgggcaggtga

SEQ ID NO: 8160619 - DNA, 22 bp, Homo sapiens
tcagcaggtggtgggcaggtga

SEQ ID NO: 8160620 - DNA, 22 bp, Homo sapiens
tcagcagtagagggggcacagt

SEQ ID NO: 8160621 - DNA, 17 bp, Homo sapiens
tcagcagtaatggtggg

SEQ ID NO: 8160622 - DNA, 22 bp, Homo sapiens
tcagcaggtggtgggcaggtga

SEQ ID NO: 8160623 - DNA, 22 bp, Homo sapiens
catgaatacggatgctcggaga

SEQ ID NO: 8160624 - DNA, 22 bp, Homo sapiens
catgaatatttagtatttactt

SEQ ID NO: 8160625 - DNA, 22 bp, Homo sapiens
catgaagtcactggagctttca

SEQ ID NO: 8160626 - DNA, 22 bp, Homo sapiens
catgaatatttagtatttactt

SEQ ID NO: 8160627 - DNA, 22 bp, Homo sapiens
catgaatatacatcctgatggc

SEQ ID NO: 8160628 - DNA, 22 bp, Homo sapiens
catgaaggaccatttcacggtc

SEQ ID NO: 8160629 - DNA, 23 bp, Homo sapiens
catgaaggtagcacaaagcctct

SEQ ID NO: 8160630 - DNA, 22 bp, Homo sapiens
catgaaggctgccagcaggcat

SEQ ID NO: 8160631 - DNA, 22 bp, Homo sapiens
catgaaggctgccagcaggcat

SEQ ID NO: 8160632 - DNA, 22 bp, Homo sapiens
catgaaggaattaaggtaagga

SEQ ID NO: 8160633 - DNA, 22 bp, Homo sapiens
catgaaggaataattgtttaga

SEQ ID NO: 8160634 - DNA, 22 bp, Homo sapiens
catgaaggaattaaggtaagga

SEQ ID NO: 8160635 - DNA, 22 bp, Homo sapiens
catgaaggaattaaggtaagga

SEQ ID NO: 8160636 - DNA, 22 bp, Homo sapiens
catgacacccaggcatagcacc

SEQ ID NO: 8160637 - DNA, 22 bp, Homo sapiens
catgaatttatattattagtga

SEQ ID NO: 8160638 - DNA, 22 bp, Homo sapiens
catgacaataagccagcagaaa

SEQ ID NO: 8160639 - DNA, 22 bp, Homo sapiens
catgaattatttttcacaagat

SEQ ID NO: 8160640 - DNA, 22 bp, Homo sapiens
catgaattagcaatggtgtgca

SEQ ID NO: 8160641 - DNA, 22 bp, Homo sapiens
catgaatttatattattagtga

SEQ ID NO: 8160642 - DNA, 22 bp, Homo sapiens
catgaattttaagactgttttt

SEQ ID NO: 8160643 - DNA, 22 bp, Homo sapiens
catgcacacacgtgcatgtacg

SEQ ID NO: 8160644 - DNA, 22 bp, Homo sapiens
catgcaggcctatggagcagtg

SEQ ID NO: 8160645 - DNA, 22 bp, Homo sapiens
catgcaggcctatggagcagtg

SEQ ID NO: 8160646 - DNA, 22 bp, Homo sapiens
catgcacacacagttctaatta

SEQ ID NO: 8160647 - DNA, 22 bp, Homo sapiens
catgcacacacagttctaatta

SEQ ID NO: 8160648 - DNA, 22 bp, Homo sapiens
catgcacacacagttctaatta

SEQ ID NO: 8160649 - DNA, 20 bp, Homo sapiens
catgacactgttcctctgcc

SEQ ID NO: 8160650 - DNA, 22 bp, Homo sapiens
catgacacccaggcatagcacc

SEQ ID NO: 8160651 - DNA, 22 bp, Homo sapiens
catgaccagagaggacggccag

SEQ ID NO: 8160652 - DNA, 22 bp, Homo sapiens
catgacatctgcttagtatgaa

SEQ ID NO: 8160653 - DNA, 22 bp, Homo sapiens
catgcatacacaggtcaggcag

SEQ ID NO: 8160654 - DNA, 22 bp, Homo sapiens
catgcatagctttggagctagg

SEQ ID NO: 8160655 - DNA, 22 bp, Homo sapiens
catgcatatgtcaaaaaagcta

SEQ ID NO: 8160656 - DNA, 22 bp, Homo sapiens
catgcatatatgctacatgcaa

SEQ ID NO: 8160657 - DNA, 20 bp, Homo sapiens
catgcatgacactggaaagg

SEQ ID NO: 8160658 - DNA, 22 bp, Homo sapiens
catgcatattactagcacagca

SEQ ID NO: 8160659 - DNA, 22 bp, Homo sapiens
catgcatattactagcacagca

SEQ ID NO: 8160660 - DNA, 22 bp, Homo sapiens
catgcatcagaatcacctagag

SEQ ID NO: 8160661 - DNA, 22 bp, Homo sapiens
catgcatcagaatcacctagag

SEQ ID NO: 8160662 - DNA, 22 bp, Homo sapiens
catgcagtgactcagacacagg

SEQ ID NO: 8160663 - DNA, 22 bp, Homo sapiens
catgcaggttatatgtgcttct

SEQ ID NO: 8160664 - DNA, 22 bp, Homo sapiens
catgcaggtgaccaggtgtggg

SEQ ID NO: 8160665 - DNA, 22 bp, Homo sapiens
catgcaggtgaccaggtgtggg

SEQ ID NO: 8160666 - DNA, 22 bp, Homo sapiens
catgcagggagcagaggagaca

SEQ ID NO: 8160667 - DNA, 22 bp, Homo sapiens
catgcaggtctggagcttgggg

SEQ ID NO: 8160668 - DNA, 22 bp, Homo sapiens
catgcagggacttgtgctccat

SEQ ID NO: 8160669 - DNA, 22 bp, Homo sapiens
catgcagggacttgtgctccat

SEQ ID NO: 8160670 - DNA, 22 bp, Homo sapiens
catgcagggagcagaggagaca

SEQ ID NO: 8160671 - DNA, 22 bp, Homo sapiens
catgcagggactagagaacagg

SEQ ID NO: 8160672 - DNA, 22 bp, Homo sapiens
catgcagggactagagaacagg

SEQ ID NO: 8160673 - DNA, 22 bp, Homo sapiens
catggcaggaaaatgaacaggc

SEQ ID NO: 8160674 - DNA, 22 bp, Homo sapiens
catggcagctttgggaggagga

SEQ ID NO: 8160675 - DNA, 22 bp, Homo sapiens
catggcagctttgggaggagga

SEQ ID NO: 8160676 - DNA, 22 bp, Homo sapiens
catggcagctttgggaggagga

SEQ ID NO: 8160677 - DNA, 22 bp, Homo sapiens
catggcagcctgccctgcttgc

SEQ ID NO: 8160678 - DNA, 22 bp, Homo sapiens
catggcagctcctccagtgtga

SEQ ID NO: 8160679 - DNA, 22 bp, Homo sapiens
catggcagagcctgcaggtggg

SEQ ID NO: 8160680 - DNA, 23 bp, Homo sapiens
catggcagcaagagctcatggcc

SEQ ID NO: 8160681 - DNA, 23 bp, Homo sapiens
catggcagcaagagctcatggcc

SEQ ID NO: 8160682 - DNA, 22 bp, Homo sapiens
catgcattacaattgcatagta

SEQ ID NO: 8160683 - DNA, 22 bp, Homo sapiens
catgcatgtttactacagtgac

SEQ ID NO: 8160684 - DNA, 22 bp, Homo sapiens
catgcattacaattgcatagta

SEQ ID NO: 8160685 - DNA, 22 bp, Homo sapiens
catgcattcctcctctgcctta

SEQ ID NO: 8160686 - DNA, 22 bp, Homo sapiens
catgcattgtaatttttagtct

SEQ ID NO: 8160687 - DNA, 22 bp, Homo sapiens
catgcattcagaatctctcaca

SEQ ID NO: 8160688 - DNA, 22 bp, Homo sapiens
catgcattcagaatctctcaca

SEQ ID NO: 8160689 - DNA, 22 bp, Homo sapiens
catgcatgtcagggatcctgga

SEQ ID NO: 8160690 - DNA, 22 bp, Homo sapiens
catgcatgtgcagaaaggggtt

SEQ ID NO: 8160691 - DNA, 22 bp, Homo sapiens
catgcatggtcatgctgggact

SEQ ID NO: 8160692 - DNA, 22 bp, Homo sapiens
catggaaggcaaaagacacaga

SEQ ID NO: 8160693 - DNA, 22 bp, Homo sapiens
catggaaggcaaaagacacaga

SEQ ID NO: 8160694 - DNA, 22 bp, Homo sapiens
catggcagagaaggggaactgg

SEQ ID NO: 8160695 - DNA, 22 bp, Homo sapiens
catggcagagcctgcaggtggg

SEQ ID NO: 8160696 - DNA, 22 bp, Homo sapiens
catggcagagcctgcaggtggg

SEQ ID NO: 8160697 - DNA, 22 bp, Homo sapiens
catggaaggcaaaagacacaga

SEQ ID NO: 8160698 - DNA, 22 bp, Homo sapiens
catgcattttctattcactcag

SEQ ID NO: 8160699 - DNA, 22 bp, Homo sapiens
catgcattgtaatttttagtct

SEQ ID NO: 8160700 - DNA, 22 bp, Homo sapiens
catgcatttctaccaaggaata

SEQ ID NO: 8160701 - DNA, 22 bp, Homo sapiens
catgcatttggagttttcaagt

SEQ ID NO: 8160702 - DNA, 22 bp, Homo sapiens
catggcaggaaggacatgcact

SEQ ID NO: 8160703 - DNA, 22 bp, Homo sapiens
catggcaggaggctgctggcag

SEQ ID NO: 8160704 - DNA, 22 bp, Homo sapiens
catggcaggaggctgctggcag

SEQ ID NO: 8160705 - DNA, 22 bp, Homo sapiens
catggcaggcttcttcagcctt

SEQ ID NO: 8160706 - DNA, 22 bp, Homo sapiens
catggcagggctgtgggcaggt

SEQ ID NO: 8160707 - DNA, 22 bp, Homo sapiens
catggcaggatctgggcccaca

SEQ ID NO: 8160708 - DNA, 22 bp, Homo sapiens
catggcaggatctgggcccaca

SEQ ID NO: 8160709 - DNA, 22 bp, Homo sapiens
catggcagtgattcagcctttg

SEQ ID NO: 8160710 - DNA, 22 bp, Homo sapiens
catggcagtgattcagcctttg

SEQ ID NO: 8160711 - DNA, 22 bp, Homo sapiens
catggcagtgattcagcctttg

SEQ ID NO: 8160712 - DNA, 22 bp, Homo sapiens
catggcagggctgtgggcaggt

SEQ ID NO: 8160713 - DNA, 22 bp, Homo sapiens
catggcagggctgtgggcaggt

SEQ ID NO: 8160714 - DNA, 22 bp, Homo sapiens
catggcaggtgcagattctgtg

SEQ ID NO: 8160715 - DNA, 22 bp, Homo sapiens
tccaggagaaggccatccagcg

SEQ ID NO: 8160716 - DNA, 22 bp, Homo sapiens
tccaggagaaggccatccagcg

SEQ ID NO: 8160717 - DNA, 22 bp, Homo sapiens
tccaggagaaggccatccagcg

SEQ ID NO: 8160718 - DNA, 20 bp, Homo sapiens
tccagctgggaacagctgat

SEQ ID NO: 8160719 - DNA, 20 bp, Homo sapiens
tccagctgggaacagctgat

SEQ ID NO: 8160720 - DNA, 20 bp, Homo sapiens
tccagctgggaacagctgat

SEQ ID NO: 8160721 - DNA, 22 bp, Homo sapiens
catggccagcccccagttcctc

SEQ ID NO: 8160722 - DNA, 22 bp, Homo sapiens
tccagctggggacatgggcttc

SEQ ID NO: 8160723 - DNA, 22 bp, Homo sapiens
catggccacatctagctgcaag

SEQ ID NO: 8160724 - DNA, 22 bp, Homo sapiens
catggccaaggatgctcaacca

SEQ ID NO: 8160725 - DNA, 22 bp, Homo sapiens
catggccacatctagctgcaag

SEQ ID NO: 8160726 - DNA, 22 bp, Homo sapiens
catggcattttttcatggagac

SEQ ID NO: 8160727 - DNA, 22 bp, Homo sapiens
catggccaaagaattatatttt

SEQ ID NO: 8160728 - DNA, 22 bp, Homo sapiens
catggccacatctagctgcaag

SEQ ID NO: 8160729 - DNA, 22 bp, Homo sapiens
catggccacatctagctgcaag

SEQ ID NO: 8160730 - DNA, 22 bp, Homo sapiens
catggccacatctagctgcaag

SEQ ID NO: 8160731 - DNA, 22 bp, Homo sapiens
catggccacatgataatcaagt

SEQ ID NO: 8160732 - DNA, 22 bp, Homo sapiens
catggccacattggaccgaagc

SEQ ID NO: 8160733 - DNA, 22 bp, Homo sapiens
catggccagcccccagttcctc

SEQ ID NO: 8160734 - DNA, 22 bp, Homo sapiens
catggccagcccccagttcctc

SEQ ID NO: 8160735 - DNA, 22 bp, Homo sapiens
catggccagattctttcttctc

SEQ ID NO: 8160736 - DNA, 22 bp, Homo sapiens
catctcacttccctgcagcatc

SEQ ID NO: 8160737 - DNA, 22 bp, Homo sapiens
catctcacagcaaactgctgaa

SEQ ID NO: 8160738 - DNA, 22 bp, Homo sapiens
catctcacttccctgcagcatc

SEQ ID NO: 8160739 - DNA, 22 bp, Homo sapiens
tcagtgctgctttatgacagtt

SEQ ID NO: 8160740 - DNA, 22 bp, Homo sapiens
tcagtgctgagtagcgtgcacc

SEQ ID NO: 8160741 - DNA, 22 bp, Homo sapiens
tcagtgctgccatggcagggcc

SEQ ID NO: 8160742 - DNA, 22 bp, Homo sapiens
tcagtgctgctttatgacagtt

SEQ ID NO: 8160743 - DNA, 22 bp, Homo sapiens
tcagtgctgccatggcagggcc

SEQ ID NO: 8160744 - DNA, 19 bp, Homo sapiens
tcagtgctcctatgtcctt

SEQ ID NO: 8160745 - DNA, 22 bp, Homo sapiens
tcagtgctctgaggtccagggt

SEQ ID NO: 8160746 - DNA, 22 bp, Homo sapiens
tcagtgctgagtagcgtgcacc

SEQ ID NO: 8160747 - DNA, 22 bp, Homo sapiens
tcagtgcctactttgatcaatt

SEQ ID NO: 8160748 - DNA, 22 bp, Homo sapiens
tcagtgctaaaagagctggtgt

SEQ ID NO: 8160749 - DNA, 22 bp, Homo sapiens
tcagtgctaaaagagctggtgt

SEQ ID NO: 8160750 - DNA, 22 bp, Homo sapiens
tcagtgctaaaagagctggtgt

SEQ ID NO: 8160751 - DNA, 20 bp, Homo sapiens
tcagtgctcaggcaccaggt

SEQ ID NO: 8160752 - DNA, 20 bp, Homo sapiens
tcagtgctcaggcaccaggt

SEQ ID NO: 8160753 - DNA, 22 bp, Homo sapiens
tcagtgctaaaagagctggtgt

SEQ ID NO: 8160754 - DNA, 19 bp, Homo sapiens
tcagtgctcctatgtcctt

SEQ ID NO: 8160755 - DNA, 22 bp, Homo sapiens
tcagtgctcctaaagtgaatgc

SEQ ID NO: 8160756 - DNA, 22 bp, Homo sapiens
tcagtgctcctaaagtgaatgc

SEQ ID NO: 8160757 - DNA, 22 bp, Homo sapiens
tcagtgctcctaaagtgaatgc

SEQ ID NO: 8160758 - DNA, 22 bp, Homo sapiens
tcagtgctcaggggagccgagg

SEQ ID NO: 8160759 - DNA, 22 bp, Homo sapiens
tcagtgctcaggggagccgagg

SEQ ID NO: 8160760 - DNA, 22 bp, Homo sapiens
tcagtccctaaggatatgggct

SEQ ID NO: 8160761 - DNA, 21 bp, Homo sapiens
tcagtccctgggtgtgtccca

SEQ ID NO: 8160762 - DNA, 22 bp, Homo sapiens
tcagtcccttaaaggtggcagc

SEQ ID NO: 8160763 - DNA, 22 bp, Homo sapiens
tcagtcccttctccaggtcagc

SEQ ID NO: 8160764 - DNA, 22 bp, Homo sapiens
tcagtgcattcatgggtggctg

SEQ ID NO: 8160765 - DNA, 22 bp, Homo sapiens
tcagtgccaattctgccatggg

SEQ ID NO: 8160766 - DNA, 22 bp, Homo sapiens
tcagtgccatgggcagacaggc

SEQ ID NO: 8160767 - DNA, 22 bp, Homo sapiens
tcagtgccatgggcagacaggc

SEQ ID NO: 8160768 - DNA, 22 bp, Homo sapiens
tcagtgccaattctgccatggg

SEQ ID NO: 8160769 - DNA, 22 bp, Homo sapiens
tcagtccaggggctgtgatgtc

SEQ ID NO: 8160770 - DNA, 22 bp, Homo sapiens
tcagtccaggattgggagtgac

SEQ ID NO: 8160771 - DNA, 23 bp, Homo sapiens
tcagtcccaacagcttctcctgg

SEQ ID NO: 8160772 - DNA, 22 bp, Homo sapiens
tcagtccataggtgggcctgag

SEQ ID NO: 8160773 - DNA, 22 bp, Homo sapiens
tcagtcccaaggtcctgaggtg

SEQ ID NO: 8160774 - DNA, 22 bp, Homo sapiens
tcagtcccaaggtcctgaggtg

SEQ ID NO: 8160775 - DNA, 22 bp, Homo sapiens
tcagtccccagatgtgtgctgt

SEQ ID NO: 8160776 - DNA, 22 bp, Homo sapiens
tcagggattgcaaaattcatcc

SEQ ID NO: 8160777 - DNA, 22 bp, Homo sapiens
tcagggattaaggtcaaaggtg

SEQ ID NO: 8160778 - DNA, 22 bp, Homo sapiens
tcaggtgtatcatggagttgaa

SEQ ID NO: 8160779 - DNA, 22 bp, Homo sapiens
tcaggtgtatcatggagttgaa

SEQ ID NO: 8160780 - DNA, 22 bp, Homo sapiens
tcaggtgtattgatgtctgtga

SEQ ID NO: 8160781 - DNA, 22 bp, Homo sapiens
tcaggtgtatcatggagttgaa

SEQ ID NO: 8160782 - DNA, 22 bp, Homo sapiens
tcagtcaacataaatccaaggt

SEQ ID NO: 8160783 - DNA, 22 bp, Homo sapiens
tcagtcaatgccttcctgggca

SEQ ID NO: 8160784 - DNA, 22 bp, Homo sapiens
tcagtcaccttgactatagctg

SEQ ID NO: 8160785 - DNA, 22 bp, Homo sapiens
tcagtcaccttgactatagctg

SEQ ID NO: 8160786 - DNA, 22 bp, Homo sapiens
tcagtcaccaatgggaggagga

SEQ ID NO: 8160787 - DNA, 22 bp, Homo sapiens
tcagtcacactcactgaggtag

SEQ ID NO: 8160788 - DNA, 22 bp, Homo sapiens
tcagtcacactcactgaggtag

SEQ ID NO: 8160789 - DNA, 22 bp, Homo sapiens
tcagtcaggttctgatttctgg

SEQ ID NO: 8160790 - DNA, 22 bp, Homo sapiens
tcagtcagaatcaccagacttt

SEQ ID NO: 8160791 - DNA, 22 bp, Homo sapiens
tcagtcaggagatgccagagat

SEQ ID NO: 8160792 - DNA, 22 bp, Homo sapiens
tcagtcacttttgcctgctaca

SEQ ID NO: 8160793 - DNA, 22 bp, Homo sapiens
tcagtcattgtccttaaaacac

SEQ ID NO: 8160794 - DNA, 21 bp, Homo sapiens
tcagtcattgcctccttctgg

SEQ ID NO: 8160795 - DNA, 19 bp, Homo sapiens
tcagtcatatatctgcacc

SEQ ID NO: 8160796 - DNA, 22 bp, Homo sapiens
tcagtcatcccagctttcatct

SEQ ID NO: 8160797 - DNA, 19 bp, Homo sapiens
tcagtcatatatctgcacc

SEQ ID NO: 8160798 - DNA, 22 bp, Homo sapiens
tcagtcatcccagctttcatct

SEQ ID NO: 8160799 - DNA, 22 bp, Homo sapiens
tcagtccaatgattgtaggaca

SEQ ID NO: 8160800 - DNA, 21 bp, Homo sapiens
tcagtcattgcctccttctgg

SEQ ID NO: 8160801 - DNA, 22 bp, Homo sapiens
tcagggagggacctgaggctgg

SEQ ID NO: 8160802 - DNA, 22 bp, Homo sapiens
tcagggagggacctgaggctgg

SEQ ID NO: 8160803 - DNA, 22 bp, Homo sapiens
tcagggagcctggacttcaagg

SEQ ID NO: 8160804 - DNA, 22 bp, Homo sapiens
tcagggagatttggggactcaa

SEQ ID NO: 8160805 - DNA, 22 bp, Homo sapiens
tcagggaggtgtctgccagaga

SEQ ID NO: 8160806 - DNA, 22 bp, Homo sapiens
tcagggaggtgtctgccagaga

SEQ ID NO: 8160807 - DNA, 22 bp, Homo sapiens
tcagggaggtgtctgccagaga

SEQ ID NO: 8160808 - DNA, 22 bp, Homo sapiens
tcagggagtgttggcaggatca

SEQ ID NO: 8160809 - DNA, 19 bp, Homo sapiens
tcagggagtttacagcatg

SEQ ID NO: 8160810 - DNA, 22 bp, Homo sapiens
catgaacaccaggcatgaacaa

SEQ ID NO: 8160811 - DNA, 22 bp, Homo sapiens
catgaacaatttgctcactgat

SEQ ID NO: 8160812 - DNA, 22 bp, Homo sapiens
catgaacaaattctgtttgagg

SEQ ID NO: 8160813 - DNA, 22 bp, Homo sapiens
catgaagcatgttttgtcatga

SEQ ID NO: 8160814 - DNA, 22 bp, Homo sapiens
catgaagatcctgtatgttttt

SEQ ID NO: 8160815 - DNA, 22 bp, Homo sapiens
catgaaattgctcctttggtgc

SEQ ID NO: 8160816 - DNA, 22 bp, Homo sapiens
catgaaattgctcctttggtgc

SEQ ID NO: 8160817 - DNA, 22 bp, Homo sapiens
catgaaatttgaagtacagcaa

SEQ ID NO: 8160818 - DNA, 22 bp, Homo sapiens
catgaaattgtattggcctcaa

SEQ ID NO: 8160819 - DNA, 22 bp, Homo sapiens
catgaaattgtattggcctcaa

SEQ ID NO: 8160820 - DNA, 22 bp, Homo sapiens
catctgttgcttcctaacaagt

SEQ ID NO: 8160821 - DNA, 22 bp, Homo sapiens
catcttaaattaaagcttaagg

SEQ ID NO: 8160822 - DNA, 22 bp, Homo sapiens
catctgaagtgaattgcttttt

SEQ ID NO: 8160823 - DNA, 22 bp, Homo sapiens
catctgaaatctgcctacaagc

SEQ ID NO: 8160824 - DNA, 22 bp, Homo sapiens
catctgaatttgccttagtttc

SEQ ID NO: 8160825 - DNA, 22 bp, Homo sapiens
catctgcaggggaagccagttt

SEQ ID NO: 8160826 - DNA, 22 bp, Homo sapiens
catctgcaggggaagccagttt

SEQ ID NO: 8160827 - DNA, 22 bp, Homo sapiens
catctgccactctctcccacca

SEQ ID NO: 8160828 - DNA, 22 bp, Homo sapiens
catctgccactctctcccacca

SEQ ID NO: 8160829 - DNA, 20 bp, Homo sapiens
catctgagcccacagaagtc

SEQ ID NO: 8160830 - DNA, 22 bp, Homo sapiens
catctgctctgtctgccatgtt

SEQ ID NO: 8160831 - DNA, 22 bp, Homo sapiens
catctgctgacttgacaagtac

SEQ ID NO: 8160832 - DNA, 22 bp, Homo sapiens
catctgctgttccttggactca

SEQ ID NO: 8160833 - DNA, 22 bp, Homo sapiens
catctgctgtaattaacaagcc

SEQ ID NO: 8160834 - DNA, 22 bp, Homo sapiens
catctgcctaagtggccctgtt

SEQ ID NO: 8160835 - DNA, 22 bp, Homo sapiens
catctgcctaagtggccctgtt

SEQ ID NO: 8160836 - DNA, 17 bp, Homo sapiens
catctgctctgcccctt

SEQ ID NO: 8160837 - DNA, 17 bp, Homo sapiens
catctgctctgcccctt

SEQ ID NO: 8160838 - DNA, 22 bp, Homo sapiens
catctgtagctccatgacaatt

SEQ ID NO: 8160839 - DNA, 22 bp, Homo sapiens
catctgtcaggcagaacccaga

SEQ ID NO: 8160840 - DNA, 19 bp, Homo sapiens
catctgtaaggacagaaac

SEQ ID NO: 8160841 - DNA, 22 bp, Homo sapiens
catctgtaaagtaggaatattg

SEQ ID NO: 8160842 - DNA, 22 bp, Homo sapiens
catctggtttaaaagaagaaag

SEQ ID NO: 8160843 - DNA, 22 bp, Homo sapiens
catctggttagttgatgaaact

SEQ ID NO: 8160844 - DNA, 22 bp, Homo sapiens
catctggttagttgatgaaact

SEQ ID NO: 8160845 - DNA, 22 bp, Homo sapiens
catctggtttaaaagaagaaag

SEQ ID NO: 8160846 - DNA, 22 bp, Homo sapiens
catctggggctgtctgctaatc

SEQ ID NO: 8160847 - DNA, 22 bp, Homo sapiens
catctgggttctcagatggata

SEQ ID NO: 8160848 - DNA, 22 bp, Homo sapiens
catctgggttctcagatggata

SEQ ID NO: 8160849 - DNA, 22 bp, Homo sapiens
catctggacaaaactctgaagg

SEQ ID NO: 8160850 - DNA, 19 bp, Homo sapiens
catctggatgattctcctg

SEQ ID NO: 8160851 - DNA, 22 bp, Homo sapiens
catctggacaaaactctgaagg

SEQ ID NO: 8160852 - DNA, 22 bp, Homo sapiens
catctgctgttccttggactca

SEQ ID NO: 8160853 - DNA, 19 bp, Homo sapiens
catctggatgattctcctg

SEQ ID NO: 8160854 - DNA, 19 bp, Homo sapiens
cagtatcattgcacatagt

SEQ ID NO: 8160855 - DNA, 21 bp, Homo sapiens
cagtattttaagcagtgagtt

SEQ ID NO: 8160856 - DNA, 22 bp, Homo sapiens
cagtatttttaagctgctttgt

SEQ ID NO: 8160857 - DNA, 22 bp, Homo sapiens
cagtattttccttgttaactta

SEQ ID NO: 8160858 - DNA, 22 bp, Homo sapiens
caggtgggtgtatgaatgcaaa

SEQ ID NO: 8160859 - DNA, 22 bp, Homo sapiens
caggtgggtgtatgaatgcaaa

SEQ ID NO: 8160860 - DNA, 19 bp, Homo sapiens
caggtggtaatctgagcct

SEQ ID NO: 8160861 - DNA, 19 bp, Homo sapiens
caggtggtaatctgagcct

SEQ ID NO: 8160862 - DNA, 22 bp, Homo sapiens
caggtggtacttaaagtcagaa

SEQ ID NO: 8160863 - DNA, 22 bp, Homo sapiens
caggtggtacttaaagtcagaa

SEQ ID NO: 8160864 - DNA, 22 bp, Homo sapiens
caggtggtcaggcaaggacacg

SEQ ID NO: 8160865 - DNA, 23 bp, Homo sapiens
caggtggtagagaaaaatccaga

SEQ ID NO: 8160866 - DNA, 23 bp, Homo sapiens
caggtggtagagaaaaatccaga

SEQ ID NO: 8160867 - DNA, 22 bp, Homo sapiens
cagtcaccaccaggtggcagta

SEQ ID NO: 8160868 - DNA, 22 bp, Homo sapiens
cagtcaccaccaggtggcagta

SEQ ID NO: 8160869 - DNA, 22 bp, Homo sapiens
cagtcacatttcgacataacta

SEQ ID NO: 8160870 - DNA, 22 bp, Homo sapiens
cagtcacatttcgacataacta

SEQ ID NO: 8160871 - DNA, 22 bp, Homo sapiens
cagtcacatggatgatggatag

SEQ ID NO: 8160872 - DNA, 22 bp, Homo sapiens
cagtcactggaatagctgagga

SEQ ID NO: 8160873 - DNA, 22 bp, Homo sapiens
cagtcactccagcctgcctcag

SEQ ID NO: 8160874 - DNA, 22 bp, Homo sapiens
cagtcactccagcctgcctcag

SEQ ID NO: 8160875 - DNA, 22 bp, Homo sapiens
cagtcaccttgaggactcagac

SEQ ID NO: 8160876 - DNA, 22 bp, Homo sapiens
cagtcaccatagaataaaacat

SEQ ID NO: 8160877 - DNA, 22 bp, Homo sapiens
cagtcacctagacagaacttac

SEQ ID NO: 8160878 - DNA, 22 bp, Homo sapiens
cagtcacctgaagacttgacca

SEQ ID NO: 8160879 - DNA, 22 bp, Homo sapiens
cagtcacctagacagaacttac

SEQ ID NO: 8160880 - DNA, 22 bp, Homo sapiens
cagtcacaagcgtacctaattt

SEQ ID NO: 8160881 - DNA, 22 bp, Homo sapiens
cagtcaacagagagcccgtcag

SEQ ID NO: 8160882 - DNA, 22 bp, Homo sapiens
cagtcacataggtatacacata

SEQ ID NO: 8160883 - DNA, 22 bp, Homo sapiens
cagtcacataggtatacacata

SEQ ID NO: 8160884 - DNA, 22 bp, Homo sapiens
cagtcacaggtggagaaccgag

SEQ ID NO: 8160885 - DNA, 22 bp, Homo sapiens
tatttgaagacagggtctttaa

SEQ ID NO: 8160886 - DNA, 20 bp, Homo sapiens
tatttgaaatggccaagtgt

SEQ ID NO: 8160887 - DNA, 22 bp, Homo sapiens
tattttaaagactgccagccta

SEQ ID NO: 8160888 - DNA, 22 bp, Homo sapiens
tattttaaagactgccagccta

SEQ ID NO: 8160889 - DNA, 22 bp, Homo sapiens
tattttaaagtgaagggtcttg

SEQ ID NO: 8160890 - DNA, 22 bp, Homo sapiens
tattttacagactactttagat

SEQ ID NO: 8160891 - DNA, 22 bp, Homo sapiens
tattttacagactactttagat

SEQ ID NO: 8160892 - DNA, 22 bp, Homo sapiens
tattttacagactactttagat

SEQ ID NO: 8160893 - DNA, 22 bp, Homo sapiens
tattttacaaatgggaatgctg

SEQ ID NO: 8160894 - DNA, 22 bp, Homo sapiens
cagtcacttacaaaaatataat

SEQ ID NO: 8160895 - DNA, 22 bp, Homo sapiens
cagtcactggaatagctgagga

SEQ ID NO: 8160896 - DNA, 22 bp, Homo sapiens
cagtcaggctgcgcttctctga

SEQ ID NO: 8160897 - DNA, 22 bp, Homo sapiens
cagtcagggacaccagctagga

SEQ ID NO: 8160898 - DNA, 22 bp, Homo sapiens
cagtcagggacaccagctagga

SEQ ID NO: 8160899 - DNA, 22 bp, Homo sapiens
cagtcagtaatgtggcacctgt

SEQ ID NO: 8160900 - DNA, 22 bp, Homo sapiens
cagtcattatgggagttaatcc

SEQ ID NO: 8160901 - DNA, 22 bp, Homo sapiens
cagtcagttatccacacaccag

SEQ ID NO: 8160902 - DNA, 22 bp, Homo sapiens
tcaaaacccagccatcaggact

SEQ ID NO: 8160903 - DNA, 22 bp, Homo sapiens
tcaaaacactattacctttaat

SEQ ID NO: 8160904 - DNA, 22 bp, Homo sapiens
tcaagcaagtgtttggtgtaaa

SEQ ID NO: 8160905 - DNA, 22 bp, Homo sapiens
tcaagcaagttgcatattgcta

SEQ ID NO: 8160906 - DNA, 22 bp, Homo sapiens
tcaagcaaagtttagctggtta

SEQ ID NO: 8160907 - DNA, 22 bp, Homo sapiens
tcaagcaaagatacaaatggaa

SEQ ID NO: 8160908 - DNA, 22 bp, Homo sapiens
tcaagatgtgatgtaacttttg

SEQ ID NO: 8160909 - DNA, 22 bp, Homo sapiens
tcaagcagcagatcaagagcta

SEQ ID NO: 8160910 - DNA, 22 bp, Homo sapiens
tcaatagattaggtattagatt

SEQ ID NO: 8160911 - DNA, 22 bp, Homo sapiens
tcaatagagccttctttcaggt

SEQ ID NO: 8160912 - DNA, 22 bp, Homo sapiens
tcaagctgcatcagtgcagtga

SEQ ID NO: 8160913 - DNA, 22 bp, Homo sapiens
tcaagctgcatcagtgcagtga

SEQ ID NO: 8160914 - DNA, 22 bp, Homo sapiens
tcaagcagggtagcaagctggt

SEQ ID NO: 8160915 - DNA, 22 bp, Homo sapiens
tcaagccatcaggcagcgggtt

SEQ ID NO: 8160916 - DNA, 22 bp, Homo sapiens
tcaagccactggcagaagatta

SEQ ID NO: 8160917 - DNA, 19 bp, Homo sapiens
tcaagcagtctgatttagg

SEQ ID NO: 8160918 - DNA, 22 bp, Homo sapiens
tcaagctattggctgaggctgc

SEQ ID NO: 8160919 - DNA, 22 bp, Homo sapiens
tcaagctcattcctctaacctc

SEQ ID NO: 8160920 - DNA, 22 bp, Homo sapiens
tcaagctcattcctctaacctc

SEQ ID NO: 8160921 - DNA, 22 bp, Homo sapiens
tcaaaacactattacctttaat

SEQ ID NO: 8160922 - DNA, 19 bp, Homo sapiens
tcaaaacacaaatggttga

SEQ ID NO: 8160923 - DNA, 19 bp, Homo sapiens
tcaaaacacaaatggttga

SEQ ID NO: 8160924 - DNA, 22 bp, Homo sapiens
tcaaaaattttctgaggatgag

SEQ ID NO: 8160925 - DNA, 22 bp, Homo sapiens
tcaaaaattttctgaggatgag

SEQ ID NO: 8160926 - DNA, 22 bp, Homo sapiens
tcaaaacaacactcaggtgtaa

SEQ ID NO: 8160927 - DNA, 22 bp, Homo sapiens
tcaaaacaatcattggatgtgc

SEQ ID NO: 8160928 - DNA, 22 bp, Homo sapiens
tattttcaccatgtatccctgt

SEQ ID NO: 8160929 - DNA, 22 bp, Homo sapiens
tattttatctgccagagtggag

SEQ ID NO: 8160930 - DNA, 22 bp, Homo sapiens
tattttatctgccagagtggag

SEQ ID NO: 8160931 - DNA, 22 bp, Homo sapiens
tattttcaccatgtatccctgt

SEQ ID NO: 8160932 - DNA, 22 bp, Homo sapiens
tcaaaaatgttttatattggta

SEQ ID NO: 8160933 - DNA, 22 bp, Homo sapiens
tcaaaaatgttttatattggta

SEQ ID NO: 8160934 - DNA, 22 bp, Homo sapiens
tattttaggtaatatccattgt

SEQ ID NO: 8160935 - DNA, 22 bp, Homo sapiens
tattttactttaaagcgagaga

SEQ ID NO: 8160936 - DNA, 22 bp, Homo sapiens
tattttatctgccagagtggag

SEQ ID NO: 8160937 - DNA, 22 bp, Homo sapiens
tattttatctgccagagtggag

SEQ ID NO: 8160938 - DNA, 22 bp, Homo sapiens
tattttaggtaatatccattgt

SEQ ID NO: 8160939 - DNA, 22 bp, Homo sapiens
tattttacagactactttagat

SEQ ID NO: 8160940 - DNA, 22 bp, Homo sapiens
tattttacatgacaggtgttta

SEQ ID NO: 8160941 - DNA, 22 bp, Homo sapiens
tattttactatttggcaaagtc

SEQ ID NO: 8160942 - DNA, 22 bp, Homo sapiens
tattttacatgatccagagttg

SEQ ID NO: 8160943 - DNA, 18 bp, Homo sapiens
caggtgggtctcctgccc

SEQ ID NO: 8160944 - DNA, 22 bp, Homo sapiens
caggtgggtacatcacagagac

SEQ ID NO: 8160945 - DNA, 18 bp, Homo sapiens
caggtgggtctcctgccc

SEQ ID NO: 8160946 - DNA, 22 bp, Homo sapiens
caggtgggtacatcacagagac

SEQ ID NO: 8160947 - DNA, 22 bp, Homo sapiens
tattattaaatggcagaatttt

SEQ ID NO: 8160948 - DNA, 22 bp, Homo sapiens
tattatggttgtaggttaacaa

SEQ ID NO: 8160949 - DNA, 22 bp, Homo sapiens
tattatggggggaacatcactc

SEQ ID NO: 8160950 - DNA, 22 bp, Homo sapiens
tattatggcagcattcagtatg

SEQ ID NO: 8160951 - DNA, 22 bp, Homo sapiens
tattatggggggaacatcactc

SEQ ID NO: 8160952 - DNA, 22 bp, Homo sapiens
tattataaaattactggcaggg

SEQ ID NO: 8160953 - DNA, 22 bp, Homo sapiens
tattagttgcaaaacattgact

SEQ ID NO: 8160954 - DNA, 22 bp, Homo sapiens
tattatatttagtaatgtggag

SEQ ID NO: 8160955 - DNA, 22 bp, Homo sapiens
tattatatttagtaatgtggag

SEQ ID NO: 8160956 - DNA, 22 bp, Homo sapiens
tattatcattaactgttgaatt

SEQ ID NO: 8160957 - DNA, 22 bp, Homo sapiens
tattatcattggtaatatggtc

SEQ ID NO: 8160958 - DNA, 22 bp, Homo sapiens
caggtggcattgtcccgccagc

SEQ ID NO: 8160959 - DNA, 22 bp, Homo sapiens
caggtggcatgactgcctacaa

SEQ ID NO: 8160960 - DNA, 22 bp, Homo sapiens
caggtggcatgactgcctacaa

SEQ ID NO: 8160961 - DNA, 22 bp, Homo sapiens
caggtggccttgccatctcctg

SEQ ID NO: 8160962 - DNA, 22 bp, Homo sapiens
caggtggccttgccatctcctg

SEQ ID NO: 8160963 - DNA, 22 bp, Homo sapiens
caggtggccagtactcaaggat

SEQ ID NO: 8160964 - DNA, 22 bp, Homo sapiens
caggtggccagtactcaaggat

SEQ ID NO: 8160965 - DNA, 22 bp, Homo sapiens
caggtggccagtactcaaggat

SEQ ID NO: 8160966 - DNA, 22 bp, Homo sapiens
caggtggcaaatgagtagcatt

SEQ ID NO: 8160967 - DNA, 22 bp, Homo sapiens
caggtggcaaatgagtagcatt

SEQ ID NO: 8160968 - DNA, 22 bp, Homo sapiens
caggtggatctctaaggactga

SEQ ID NO: 8160969 - DNA, 22 bp, Homo sapiens
caggtggatctctaaggactga

SEQ ID NO: 8160970 - DNA, 22 bp, Homo sapiens
caggtggagctgactgagggca

SEQ ID NO: 8160971 - DNA, 22 bp, Homo sapiens
caggtggcagtgcctgcattct

SEQ ID NO: 8160972 - DNA, 22 bp, Homo sapiens
caggtggcagaggtctctggaa

SEQ ID NO: 8160973 - DNA, 22 bp, Homo sapiens
caggtggcagaggtctctggaa

SEQ ID NO: 8160974 - DNA, 22 bp, Homo sapiens
caggtggcagaggtctctggaa

SEQ ID NO: 8160975 - DNA, 22 bp, Homo sapiens
caggtggcagaggtctctggaa

SEQ ID NO: 8160976 - DNA, 19 bp, Homo sapiens
caggtggcgctctacaggg

SEQ ID NO: 8160977 - DNA, 22 bp, Homo sapiens
caggtggctaacggcctcatag

SEQ ID NO: 8160978 - DNA, 22 bp, Homo sapiens
caggtggctaacggcctcatag

SEQ ID NO: 8160979 - DNA, 22 bp, Homo sapiens
tattaaatgttatttgggttgt

SEQ ID NO: 8160980 - DNA, 22 bp, Homo sapiens
caggtggctgagctgacctttg

SEQ ID NO: 8160981 - DNA, 22 bp, Homo sapiens
caggtggctgagctgacctttg

SEQ ID NO: 8160982 - DNA, 22 bp, Homo sapiens
tattaaatgttatttgggttgt

SEQ ID NO: 8160983 - DNA, 20 bp, Homo sapiens
tattaggtagcactgggata

SEQ ID NO: 8160984 - DNA, 22 bp, Homo sapiens
caggtgctgcagggctggcgtc

SEQ ID NO: 8160985 - DNA, 22 bp, Homo sapiens
caggtgctctgctgcaggtaag

SEQ ID NO: 8160986 - DNA, 22 bp, Homo sapiens
caggtgctctgctgcaggtaag

SEQ ID NO: 8160987 - DNA, 22 bp, Homo sapiens
caggtgctgtcctgcacatgtc

SEQ ID NO: 8160988 - DNA, 22 bp, Homo sapiens
caggtgctgcgtggcggagctg

SEQ ID NO: 8160989 - DNA, 22 bp, Homo sapiens
caggtgctgtcctgcacatgtc

SEQ ID NO: 8160990 - DNA, 22 bp, Homo sapiens
caggtgcctcaggatgagacaa

SEQ ID NO: 8160991 - DNA, 22 bp, Homo sapiens
caggtgccgggaatgcagcaat

SEQ ID NO: 8160992 - DNA, 22 bp, Homo sapiens
caggtgcctcaggatgagacaa

SEQ ID NO: 8160993 - DNA, 16 bp, Homo sapiens
caggtgcctctcccga

SEQ ID NO: 8160994 - DNA, 22 bp, Homo sapiens
caggtgcctcaggatgagacaa

SEQ ID NO: 8160995 - DNA, 22 bp, Homo sapiens
caggtgcctcaggatgagacaa

SEQ ID NO: 8160996 - DNA, 22 bp, Homo sapiens
caggtgcccaggggacagtggc

SEQ ID NO: 8160997 - DNA, 22 bp, Homo sapiens
caggtgcccagctcctgctgtg

SEQ ID NO: 8160998 - DNA, 22 bp, Homo sapiens
caggtgcccagctcctgctgtg

SEQ ID NO: 8160999 - DNA, 22 bp, Homo sapiens
caggtgcccagctcctgctgtg

SEQ ID NO: 8161000 - DNA, 22 bp, Homo sapiens
caggtgccgggaatgcagcaat

SEQ ID NO: 8161001 - DNA, 22 bp, Homo sapiens
caggtgcccaggggacagtggc

SEQ ID NO: 8161002 - DNA, 22 bp, Homo sapiens
caggtgccgggaatgcagcaat

SEQ ID NO: 8161003 - DNA, 22 bp, Homo sapiens
caggtgccgggaatgcagcaat

SEQ ID NO: 8161004 - DNA, 22 bp, Homo sapiens
caggtcagctggtgccccaggt

SEQ ID NO: 8161005 - DNA, 22 bp, Homo sapiens
caggtccaactatttatctgtg

SEQ ID NO: 8161006 - DNA, 18 bp, Homo sapiens
caggtcagcctggcctca

SEQ ID NO: 8161007 - DNA, 18 bp, Homo sapiens
caggtcagcctggcctca

SEQ ID NO: 8161008 - DNA, 22 bp, Homo sapiens
caggtcagcacttggaggtgca

SEQ ID NO: 8161009 - DNA, 22 bp, Homo sapiens
caggtcagcacttggaggtgca

SEQ ID NO: 8161010 - DNA, 22 bp, Homo sapiens
caggtcagcacttggaggtgca

SEQ ID NO: 8161011 - DNA, 22 bp, Homo sapiens
caggtgcccagctcctgctgtg

SEQ ID NO: 8161012 - DNA, 22 bp, Homo sapiens
caggtgaagaggataaaaagtt

SEQ ID NO: 8161013 - DNA, 22 bp, Homo sapiens
caggtccacagcccatcactgc

SEQ ID NO: 8161014 - DNA, 22 bp, Homo sapiens
caggtccacagcccatcactgc

SEQ ID NO: 8161015 - DNA, 22 bp, Homo sapiens
caggtccaattgcgctaaaatc

SEQ ID NO: 8161016 - DNA, 22 bp, Homo sapiens
caggtccacagcccatcactgc

SEQ ID NO: 8161017 - DNA, 22 bp, Homo sapiens
caggtccaaggttcctgaatag

SEQ ID NO: 8161018 - DNA, 22 bp, Homo sapiens
caggtccaattgcgctaaaatc

SEQ ID NO: 8161019 - DNA, 22 bp, Homo sapiens
caggtccaagagatcctcctac

SEQ ID NO: 8161020 - DNA, 22 bp, Homo sapiens
caggtaagaccgtttaggcagt

SEQ ID NO: 8161021 - DNA, 22 bp, Homo sapiens
caggtaagagacggattggccc

SEQ ID NO: 8161022 - DNA, 22 bp, Homo sapiens
caggtaaggtcacattctgaag

SEQ ID NO: 8161023 - DNA, 22 bp, Homo sapiens
caggtaaggtcacattctgaag

SEQ ID NO: 8161024 - DNA, 22 bp, Homo sapiens
cagggtggggctggctatcaaa

SEQ ID NO: 8161025 - DNA, 22 bp, Homo sapiens
cagggtggggctggctatcaaa

SEQ ID NO: 8161026 - DNA, 22 bp, Homo sapiens
cagggtggggctggctatcaaa

SEQ ID NO: 8161027 - DNA, 22 bp, Homo sapiens
cagggtttcaccatgttagcag

SEQ ID NO: 8161028 - DNA, 22 bp, Homo sapiens
cagggtttcaccatgttagcag

SEQ ID NO: 8161029 - DNA, 22 bp, Homo sapiens
caggtaggaaaagggtgtcagg

SEQ ID NO: 8161030 - DNA, 22 bp, Homo sapiens
caggtaggatggaagggctcaa

SEQ ID NO: 8161031 - DNA, 22 bp, Homo sapiens
caggtaggcagccggtctctgg

SEQ ID NO: 8161032 - DNA, 22 bp, Homo sapiens
caggtagctgctggccatgtac

SEQ ID NO: 8161033 - DNA, 22 bp, Homo sapiens
caggtagaggctgccatcagct

SEQ ID NO: 8161034 - DNA, 22 bp, Homo sapiens
caggtacattcgtagacccatt

SEQ ID NO: 8161035 - DNA, 22 bp, Homo sapiens
caggtcagaggtagatgagatg

SEQ ID NO: 8161036 - DNA, 22 bp, Homo sapiens
caggtcagaggtagatgagatg

SEQ ID NO: 8161037 - DNA, 22 bp, Homo sapiens
caggtcagaggcgcagccccca

SEQ ID NO: 8161038 - DNA, 22 bp, Homo sapiens
caggtcagaggtagatgagatg

SEQ ID NO: 8161039 - DNA, 22 bp, Homo sapiens
caggtcagaggcgcagccccca

SEQ ID NO: 8161040 - DNA, 22 bp, Homo sapiens
caggtattttcaaggcttgtgt

SEQ ID NO: 8161041 - DNA, 22 bp, Homo sapiens
caggtagtccacagtgagggag

SEQ ID NO: 8161042 - DNA, 22 bp, Homo sapiens
caggtaggtatggtgcagtctt

SEQ ID NO: 8161043 - DNA, 22 bp, Homo sapiens
caggtaggtatggtgcagtctt

SEQ ID NO: 8161044 - DNA, 22 bp, Homo sapiens
caggtagtccagctctgggacc

SEQ ID NO: 8161045 - DNA, 22 bp, Homo sapiens
caggtatatgtgcatccataga

SEQ ID NO: 8161046 - DNA, 22 bp, Homo sapiens
caggtataacgtgcatgttgta

SEQ ID NO: 8161047 - DNA, 22 bp, Homo sapiens
caggtagggatatgatggtgat

SEQ ID NO: 8161048 - DNA, 22 bp, Homo sapiens
caggtagggatatgatggtgat

SEQ ID NO: 8161049 - DNA, 22 bp, Homo sapiens
cagggctgtctccaaaggcccc

SEQ ID NO: 8161050 - DNA, 22 bp, Homo sapiens
cagggctgtctccaaaggcccc

SEQ ID NO: 8161051 - DNA, 17 bp, Homo sapiens
cagggctgtctgcctag

SEQ ID NO: 8161052 - DNA, 17 bp, Homo sapiens
cagggctgtctgcctag

SEQ ID NO: 8161053 - DNA, 17 bp, Homo sapiens
cagggctgtctgcctag

SEQ ID NO: 8161054 - DNA, 17 bp, Homo sapiens
cagggctgtctgcctag

SEQ ID NO: 8161055 - DNA, 22 bp, Homo sapiens
cagggctgtgcccatcttcccc

SEQ ID NO: 8161056 - DNA, 22 bp, Homo sapiens
cagggctgtgcccatcttcccc

SEQ ID NO: 8161057 - DNA, 22 bp, Homo sapiens
cagggctgtgcccatcttcccc

SEQ ID NO: 8161058 - DNA, 17 bp, Homo sapiens
cagggctgtctgcctag

SEQ ID NO: 8161059 - DNA, 17 bp, Homo sapiens
cagggctgtctgcctag

SEQ ID NO: 8161060 - DNA, 22 bp, Homo sapiens
cagggctgtgcccatcttcccc

SEQ ID NO: 8161061 - DNA, 22 bp, Homo sapiens
cagggctgtggctttgtgctgt

SEQ ID NO: 8161062 - DNA, 22 bp, Homo sapiens
cagggctgtggaaaactggtgc

SEQ ID NO: 8161063 - DNA, 22 bp, Homo sapiens
cagggctgtggaaaactggtgc

SEQ ID NO: 8161064 - DNA, 22 bp, Homo sapiens
cagggctgtggaaaactggtgc

SEQ ID NO: 8161065 - DNA, 22 bp, Homo sapiens
cagggctgtggctttgtgctgt

SEQ ID NO: 8161066 - DNA, 22 bp, Homo sapiens
caggggcttaagtgacagaagg

SEQ ID NO: 8161067 - DNA, 22 bp, Homo sapiens
caggggcttaagtgacagaagg

SEQ ID NO: 8161068 - DNA, 22 bp, Homo sapiens
caggggctgtttgcctcaggcc

SEQ ID NO: 8161069 - DNA, 22 bp, Homo sapiens
caggggctgtttgcctcaggcc

SEQ ID NO: 8161070 - DNA, 22 bp, Homo sapiens
caggggggcaggagtcattgat

SEQ ID NO: 8161071 - DNA, 22 bp, Homo sapiens
cagggggctgtggctgtccagt

SEQ ID NO: 8161072 - DNA, 22 bp, Homo sapiens
cagggtagacagtaggtgtctg

SEQ ID NO: 8161073 - DNA, 22 bp, Homo sapiens
caggggtgtttttggccaggag

SEQ ID NO: 8161074 - DNA, 22 bp, Homo sapiens
caggggtgtttttggccaggag

SEQ ID NO: 8161075 - DNA, 22 bp, Homo sapiens
cagggtagggcaagggaacctg

SEQ ID NO: 8161076 - DNA, 22 bp, Homo sapiens
caggggtgtttttggccaggag

SEQ ID NO: 8161077 - DNA, 22 bp, Homo sapiens
caggggtggctgcagcagaggt

SEQ ID NO: 8161078 - DNA, 22 bp, Homo sapiens
caggggtggctgcagcagaggt

SEQ ID NO: 8161079 - DNA, 22 bp, Homo sapiens
caggggtggctgcagcagaggt

SEQ ID NO: 8161080 - DNA, 22 bp, Homo sapiens
cagggggtggtccaggctgcgc

SEQ ID NO: 8161081 - DNA, 22 bp, Homo sapiens
cagggtcaggctgctagaagct

SEQ ID NO: 8161082 - DNA, 22 bp, Homo sapiens
cagggtagtaatttaatacaag

SEQ ID NO: 8161083 - DNA, 22 bp, Homo sapiens
cagggtcccaggagctgctttc

SEQ ID NO: 8161084 - DNA, 22 bp, Homo sapiens
cagggtcaggctgctagaagct

SEQ ID NO: 8161085 - DNA, 22 bp, Homo sapiens
cagggtcatggcacctgcacgg

SEQ ID NO: 8161086 - DNA, 22 bp, Homo sapiens
cagggtggggctggctatcaaa

SEQ ID NO: 8161087 - DNA, 22 bp, Homo sapiens
cagggtctgatggtcctcactt

SEQ ID NO: 8161088 - DNA, 22 bp, Homo sapiens
cagggtccccgggtctcctgtg

SEQ ID NO: 8161089 - DNA, 22 bp, Homo sapiens
cagggtccccgggtctcctgtg

SEQ ID NO: 8161090 - DNA, 22 bp, Homo sapiens
cagggtccggctgcctggctgt

SEQ ID NO: 8161091 - DNA, 23 bp, Homo sapiens
cagggctggtagggaagagcgtg

SEQ ID NO: 8161092 - DNA, 23 bp, Homo sapiens
cagggctggtagggaagagcgtg

SEQ ID NO: 8161093 - DNA, 23 bp, Homo sapiens
cagggctggtagggaagagcgtg

SEQ ID NO: 8161094 - DNA, 23 bp, Homo sapiens
cagggctggtagggaagagcgtg

SEQ ID NO: 8161095 - DNA, 22 bp, Homo sapiens
cagggctggtttgtcgaagaaa

SEQ ID NO: 8161096 - DNA, 22 bp, Homo sapiens
cagggctggtttgtcgaagaaa

SEQ ID NO: 8161097 - DNA, 22 bp, Homo sapiens
cagggctggtttgtcgaagaaa

SEQ ID NO: 8161098 - DNA, 22 bp, Homo sapiens
cagggctggtttgtcgaagaaa

SEQ ID NO: 8161099 - DNA, 22 bp, Homo sapiens
cagggctggtttgtcgaagaaa

SEQ ID NO: 8161100 - DNA, 22 bp, Homo sapiens
cagggctgtctccaaaggcccc

SEQ ID NO: 8161101 - DNA, 22 bp, Homo sapiens
cagggctgtctccaaaggcccc

SEQ ID NO: 8161102 - DNA, 22 bp, Homo sapiens
cagggctgtaaattagtgctga

SEQ ID NO: 8161103 - DNA, 22 bp, Homo sapiens
cagggctgtaaattagtgctga

SEQ ID NO: 8161104 - DNA, 22 bp, Homo sapiens
cagggctgtctccaaaggcccc

SEQ ID NO: 8161105 - DNA, 22 bp, Homo sapiens
cagggctgtaaattagtgctga

SEQ ID NO: 8161106 - DNA, 22 bp, Homo sapiens
cagggctgtaaattagtgctga

SEQ ID NO: 8161107 - DNA, 22 bp, Homo sapiens
cagggctgtaaattagtgctga

SEQ ID NO: 8161108 - DNA, 22 bp, Homo sapiens
tagggaaatatagatttagggc

SEQ ID NO: 8161109 - DNA, 22 bp, Homo sapiens
cagggctggatttcatttctag

SEQ ID NO: 8161110 - DNA, 23 bp, Homo sapiens
cagggctggtagggaagagcgtg

SEQ ID NO: 8161111 - DNA, 22 bp, Homo sapiens
cagggctgggttaaaagcaggg

SEQ ID NO: 8161112 - DNA, 23 bp, Homo sapiens
cagggctggtagggaagagcgtg

SEQ ID NO: 8161113 - DNA, 23 bp, Homo sapiens
cagggctggtagggaagagcgtg

SEQ ID NO: 8161114 - DNA, 22 bp, Homo sapiens
cagggctgggttaaaagcaggg

SEQ ID NO: 8161115 - DNA, 22 bp, Homo sapiens
cagggctgggttaaaagcaggg

SEQ ID NO: 8161116 - DNA, 22 bp, Homo sapiens
tagggaaaagacttcactgttt

SEQ ID NO: 8161117 - DNA, 20 bp, Homo sapiens
cagggctctgggcctggcct

SEQ ID NO: 8161118 - DNA, 20 bp, Homo sapiens
cagggctctgggcctggcct

SEQ ID NO: 8161119 - DNA, 20 bp, Homo sapiens
cagggctctgggcctggcct

SEQ ID NO: 8161120 - DNA, 20 bp, Homo sapiens
cagggctctgggcctggcct

SEQ ID NO: 8161121 - DNA, 20 bp, Homo sapiens
cagggctctgggcctggcct

SEQ ID NO: 8161122 - DNA, 22 bp, Homo sapiens
cagggctcttccggagcaggga

SEQ ID NO: 8161123 - DNA, 22 bp, Homo sapiens
cagggctcttccggagcaggga

SEQ ID NO: 8161124 - DNA, 22 bp, Homo sapiens
cagggctcttccggagcaggga

SEQ ID NO: 8161125 - DNA, 22 bp, Homo sapiens
cagggctcttcatcacacagta

SEQ ID NO: 8161126 - DNA, 22 bp, Homo sapiens
cagggctcttccggagcaggga

SEQ ID NO: 8161127 - DNA, 22 bp, Homo sapiens
cagggctgaaatcaaggtgtag

SEQ ID NO: 8161128 - DNA, 22 bp, Homo sapiens
cagggctgaaatcaaggtgtag

SEQ ID NO: 8161129 - DNA, 22 bp, Homo sapiens
cagggctgaaatcaaggtgtag

SEQ ID NO: 8161130 - DNA, 22 bp, Homo sapiens
cagggctgaaatcaaggtgtag

SEQ ID NO: 8161131 - DNA, 22 bp, Homo sapiens
cagggctcttccggagcaggga

SEQ ID NO: 8161132 - DNA, 22 bp, Homo sapiens
cagggctgaactgagcttgtga

SEQ ID NO: 8161133 - DNA, 22 bp, Homo sapiens
cagggctgaactgagcttgtga

SEQ ID NO: 8161134 - DNA, 22 bp, Homo sapiens
cagggctgaactgagcttgtga

SEQ ID NO: 8161135 - DNA, 22 bp, Homo sapiens
cagggctgaaatcaaggtgtag

SEQ ID NO: 8161136 - DNA, 22 bp, Homo sapiens
cagggctgaactgagcttgtga

SEQ ID NO: 8161137 - DNA, 22 bp, Homo sapiens
cagggctgaaatcaaggtgtag

SEQ ID NO: 8161138 - DNA, 22 bp, Homo sapiens
cagggctgaagaaattcaaaag

SEQ ID NO: 8161139 - DNA, 22 bp, Homo sapiens
cagggctgaagaaattcaaaag

SEQ ID NO: 8161140 - DNA, 22 bp, Homo sapiens
cagggctgagaatttagagaca

SEQ ID NO: 8161141 - DNA, 22 bp, Homo sapiens
cagggctgaagaaattcaaaag

SEQ ID NO: 8161142 - DNA, 22 bp, Homo sapiens
taggctgggctgagctggacgg

SEQ ID NO: 8161143 - DNA, 22 bp, Homo sapiens
cagggctgagaatttagagaca

SEQ ID NO: 8161144 - DNA, 22 bp, Homo sapiens
taggctgggctgagctggacgg

SEQ ID NO: 8161145 - DNA, 22 bp, Homo sapiens
taggctgggctgagctggacgg

SEQ ID NO: 8161146 - DNA, 22 bp, Homo sapiens
taggctgggctgagctggacgg

SEQ ID NO: 8161147 - DNA, 18 bp, Homo sapiens
taggctgggggctgtagt

SEQ ID NO: 8161148 - DNA, 22 bp, Homo sapiens
taggctgggctgagctggacgg

SEQ ID NO: 8161149 - DNA, 18 bp, Homo sapiens
taggctgggggctgtagt

SEQ ID NO: 8161150 - DNA, 22 bp, Homo sapiens
taggctgggggtaggaattgag

SEQ ID NO: 8161151 - DNA, 22 bp, Homo sapiens
cagggccatatcttgtgcacca

SEQ ID NO: 8161152 - DNA, 22 bp, Homo sapiens
cagggccatatcttgtgcacca

SEQ ID NO: 8161153 - DNA, 22 bp, Homo sapiens
cagggccatatcttgtgcacca

SEQ ID NO: 8161154 - DNA, 22 bp, Homo sapiens
cagggccatgaggcacagggtc

SEQ ID NO: 8161155 - DNA, 22 bp, Homo sapiens
cagggccatgaggcacagggtc

SEQ ID NO: 8161156 - DNA, 22 bp, Homo sapiens
tagcttaaaccaatctgaataa

SEQ ID NO: 8161157 - DNA, 22 bp, Homo sapiens
tagcttaacagcaaaactgttg

SEQ ID NO: 8161158 - DNA, 22 bp, Homo sapiens
tagcttaaggagtaccagatca

SEQ ID NO: 8161159 - DNA, 22 bp, Homo sapiens
tagcttaacagcaaaactgttg

SEQ ID NO: 8161160 - DNA, 22 bp, Homo sapiens
tagcttaatatgaaacacataa

SEQ ID NO: 8161161 - DNA, 22 bp, Homo sapiens
cagggccatgaggcacagggtc

SEQ ID NO: 8161162 - DNA, 22 bp, Homo sapiens
cagggccattggcgtggctgtc

SEQ ID NO: 8161163 - DNA, 22 bp, Homo sapiens
cagggagcaggctctgtccatc

SEQ ID NO: 8161164 - DNA, 22 bp, Homo sapiens
cagggccactgtagatgaggag

SEQ ID NO: 8161165 - DNA, 22 bp, Homo sapiens
cagggccaggctgatggcctgg

SEQ ID NO: 8161166 - DNA, 22 bp, Homo sapiens
cagggccagttctcgcagcagt

SEQ ID NO: 8161167 - DNA, 22 bp, Homo sapiens
cagggccagttctcgcagcagt

SEQ ID NO: 8161168 - DNA, 22 bp, Homo sapiens
cagggccaggctgatggcctgg

SEQ ID NO: 8161169 - DNA, 22 bp, Homo sapiens
cagggccagggctatggtgaag

SEQ ID NO: 8161170 - DNA, 22 bp, Homo sapiens
tagattctttgctagatcattg

SEQ ID NO: 8161171 - DNA, 22 bp, Homo sapiens
tagatttaagaccctgaatttg

SEQ ID NO: 8161172 - DNA, 22 bp, Homo sapiens
tagatttcaggagacaaaatgg

SEQ ID NO: 8161173 - DNA, 22 bp, Homo sapiens
tagatttcaggagacaaaatgg

SEQ ID NO: 8161174 - DNA, 22 bp, Homo sapiens
tagatttcaggagacaaaatgg

SEQ ID NO: 8161175 - DNA, 22 bp, Homo sapiens
tagatttcgctgcatctcaatc

SEQ ID NO: 8161176 - DNA, 22 bp, Homo sapiens
tagatttcctcttcctcattcc

SEQ ID NO: 8161177 - DNA, 20 bp, Homo sapiens
tagatttcatacttctcttt

SEQ ID NO: 8161178 - DNA, 22 bp, Homo sapiens
tagatttcaggctggcttgcgg

SEQ ID NO: 8161179 - DNA, 20 bp, Homo sapiens
tagatttcatacttctcttt

SEQ ID NO: 8161180 - DNA, 22 bp, Homo sapiens
tagatttctaacagtgtgcttg

SEQ ID NO: 8161181 - DNA, 22 bp, Homo sapiens
tagatttctaacagtgtgcttg

SEQ ID NO: 8161182 - DNA, 22 bp, Homo sapiens
tagatttctcattcatagattg

SEQ ID NO: 8161183 - DNA, 19 bp, Homo sapiens
tagatttgatcatctggat

SEQ ID NO: 8161184 - DNA, 22 bp, Homo sapiens
cagggagcagcccctagaagta

SEQ ID NO: 8161185 - DNA, 22 bp, Homo sapiens
cagggagcagcgctggggcctc

SEQ ID NO: 8161186 - DNA, 22 bp, Homo sapiens
cagggagcagcgctggggcctc

SEQ ID NO: 8161187 - DNA, 22 bp, Homo sapiens
cagggagcagcgctggggcctc

SEQ ID NO: 8161188 - DNA, 22 bp, Homo sapiens
cagggagcaggctctgtccatc

SEQ ID NO: 8161189 - DNA, 22 bp, Homo sapiens
cagggagcagcgctggggcctc

SEQ ID NO: 8161190 - DNA, 22 bp, Homo sapiens
cagggagcaggctctgtccatc

SEQ ID NO: 8161191 - DNA, 22 bp, Homo sapiens
cagggagatcttggctcctggt

SEQ ID NO: 8161192 - DNA, 22 bp, Homo sapiens
cagggagatcttggctcctggt

SEQ ID NO: 8161193 - DNA, 22 bp, Homo sapiens
cagggagcactgcgagcggcag

SEQ ID NO: 8161194 - DNA, 22 bp, Homo sapiens
cagggagcactgcgagcggcag

SEQ ID NO: 8161195 - DNA, 22 bp, Homo sapiens
cagggagcagcccctagaagta

SEQ ID NO: 8161196 - DNA, 22 bp, Homo sapiens
cagggagcactgcgagcggcag

SEQ ID NO: 8161197 - DNA, 22 bp, Homo sapiens
cagggcccatggctcaggtagg

SEQ ID NO: 8161198 - DNA, 22 bp, Homo sapiens
cagggcccatggctcaggtagg

SEQ ID NO: 8161199 - DNA, 22 bp, Homo sapiens
cagggccccagggatgtctgct

SEQ ID NO: 8161200 - DNA, 23 bp, Homo sapiens
cagggccctgctcaatttctcca

SEQ ID NO: 8161201 - DNA, 20 bp, Homo sapiens
cagggcctaagagctgaaaa

SEQ ID NO: 8161202 - DNA, 20 bp, Homo sapiens
cagggcctatgattgagctt

SEQ ID NO: 8161203 - DNA, 20 bp, Homo sapiens
cagggcctatgattgagctt

SEQ ID NO: 8161204 - DNA, 20 bp, Homo sapiens
cagggcctaagagctgaaaa

SEQ ID NO: 8161205 - DNA, 22 bp, Homo sapiens
cagggctccatgcagggactcc

SEQ ID NO: 8161206 - DNA, 22 bp, Homo sapiens
cagggctccatgcagggactcc

SEQ ID NO: 8161207 - DNA, 22 bp, Homo sapiens
cagggcctcattgtcagtcctg

SEQ ID NO: 8161208 - DNA, 20 bp, Homo sapiens
cagggcctatgattgagctt

SEQ ID NO: 8161209 - DNA, 22 bp, Homo sapiens
cagggcctcatcctcagagatt

SEQ ID NO: 8161210 - DNA, 22 bp, Homo sapiens
cagggcctcatcctcagagatt

SEQ ID NO: 8161211 - DNA, 22 bp, Homo sapiens
cagggcctcatcctcagagatt

SEQ ID NO: 8161212 - DNA, 22 bp, Homo sapiens
cagggcctcatggccggggtgc

SEQ ID NO: 8161213 - DNA, 22 bp, Homo sapiens
cagggcctcatggccggggtgc

SEQ ID NO: 8161214 - DNA, 22 bp, Homo sapiens
taggccagaggagcagctttgg

SEQ ID NO: 8161215 - DNA, 22 bp, Homo sapiens
cagggcccagtccctgctgtca

SEQ ID NO: 8161216 - DNA, 22 bp, Homo sapiens
taggccacaaataagatcctgt

SEQ ID NO: 8161217 - DNA, 19 bp, Homo sapiens
taggccagaagttttccac

SEQ ID NO: 8161218 - DNA, 19 bp, Homo sapiens
taggccagaagttttccac

SEQ ID NO: 8161219 - DNA, 22 bp, Homo sapiens
taggccagaggagcagctttgg

SEQ ID NO: 8161220 - DNA, 22 bp, Homo sapiens
taggccagaggagcagctttgg

SEQ ID NO: 8161221 - DNA, 22 bp, Homo sapiens
taggcatgcaaataaatgtgca

SEQ ID NO: 8161222 - DNA, 22 bp, Homo sapiens
taggcatgcaaataaatgtgca

SEQ ID NO: 8161223 - DNA, 22 bp, Homo sapiens
taggcaggtgtgcactgcccac

SEQ ID NO: 8161224 - DNA, 22 bp, Homo sapiens
taggcattacctaacattacct

SEQ ID NO: 8161225 - DNA, 22 bp, Homo sapiens
taggaggcttaaagctgctcag

SEQ ID NO: 8161226 - DNA, 22 bp, Homo sapiens
taggcagggattagggttgatt

SEQ ID NO: 8161227 - DNA, 22 bp, Homo sapiens
taggcagggattagggttgatt

SEQ ID NO: 8161228 - DNA, 18 bp, Homo sapiens
taggaggctcctgggggc

SEQ ID NO: 8161229 - DNA, 22 bp, Homo sapiens
taggaggcatttgctcccaggg

SEQ ID NO: 8161230 - DNA, 22 bp, Homo sapiens
taggcaggtgtgcactgcccac

SEQ ID NO: 8161231 - DNA, 22 bp, Homo sapiens
taggcaggtgtgcactgcccac

SEQ ID NO: 8161232 - DNA, 22 bp, Homo sapiens
taggcaggtgtgcactgcccac

SEQ ID NO: 8161233 - DNA, 22 bp, Homo sapiens
taggcaggtgtgcactgcccac

SEQ ID NO: 8161234 - DNA, 22 bp, Homo sapiens
taggcagggattagggttgatt

SEQ ID NO: 8161235 - DNA, 22 bp, Homo sapiens
taggcagggattagggttgatt

SEQ ID NO: 8161236 - DNA, 22 bp, Homo sapiens
taggcagggattagggttgatt

SEQ ID NO: 8161237 - DNA, 22 bp, Homo sapiens
tagcttctggagtgtttgaaaa

SEQ ID NO: 8161238 - DNA, 22 bp, Homo sapiens
taggaggcagtcgttcttcagt

SEQ ID NO: 8161239 - DNA, 18 bp, Homo sapiens
taggaggatactgagatg

SEQ ID NO: 8161240 - DNA, 22 bp, Homo sapiens
tagcttatctatacagactttt

SEQ ID NO: 8161241 - DNA, 22 bp, Homo sapiens
tagcttatggtctctagggaat

SEQ ID NO: 8161242 - DNA, 22 bp, Homo sapiens
tagcttataaaggttttcaaag

SEQ ID NO: 8161243 - DNA, 22 bp, Homo sapiens
tagcttctaatacttaccaatt

SEQ ID NO: 8161244 - DNA, 22 bp, Homo sapiens
tagcttctcataatttatgctg

SEQ ID NO: 8161245 - DNA, 22 bp, Homo sapiens
tagcttctcataatttatgctg

SEQ ID NO: 8161246 - DNA, 22 bp, Homo sapiens
tagaaacaaagacctgggtgct

SEQ ID NO: 8161247 - DNA, 22 bp, Homo sapiens
tagaaacaaaatctgatgactc

SEQ ID NO: 8161248 - DNA, 22 bp, Homo sapiens
tagaaacaaaatctgatgactc

SEQ ID NO: 8161249 - DNA, 22 bp, Homo sapiens
tagaaaatggccaagcaggact

SEQ ID NO: 8161250 - DNA, 22 bp, Homo sapiens
tagaaaatggccaagcaggact

SEQ ID NO: 8161251 - DNA, 22 bp, Homo sapiens
tagaaaatagggcctgtggagc

SEQ ID NO: 8161252 - DNA, 22 bp, Homo sapiens
tagaaaatagggcctgtggagc

SEQ ID NO: 8161253 - DNA, 22 bp, Homo sapiens
caggctgggaacgccacccgct

SEQ ID NO: 8161254 - DNA, 22 bp, Homo sapiens
caggctggcaatgcgtcaagca

SEQ ID NO: 8161255 - DNA, 22 bp, Homo sapiens
caggctgggactgacccctgct

SEQ ID NO: 8161256 - DNA, 22 bp, Homo sapiens
caggctgggaacgccacccgct

SEQ ID NO: 8161257 - DNA, 22 bp, Homo sapiens
caggctgggactgacccctgct

SEQ ID NO: 8161258 - DNA, 22 bp, Homo sapiens
caggctgggactgacccctgct

SEQ ID NO: 8161259 - DNA, 22 bp, Homo sapiens
caggctgggactgacccctgct

SEQ ID NO: 8161260 - DNA, 22 bp, Homo sapiens
caggctgggactgacccctgct

SEQ ID NO: 8161261 - DNA, 22 bp, Homo sapiens
caggctgggcagcctccccggc

SEQ ID NO: 8161262 - DNA, 22 bp, Homo sapiens
caggctggagtgcagtggtgcc

SEQ ID NO: 8161263 - DNA, 22 bp, Homo sapiens
caggctggagttcagtggtgtg

SEQ ID NO: 8161264 - DNA, 22 bp, Homo sapiens
caggctgccgtggggtccaggc

SEQ ID NO: 8161265 - DNA, 22 bp, Homo sapiens
caggctgccgtggggtccaggc

SEQ ID NO: 8161266 - DNA, 22 bp, Homo sapiens
caggctgccgtggggtccaggc

SEQ ID NO: 8161267 - DNA, 22 bp, Homo sapiens
caggctggcaatgcgtcaagca

SEQ ID NO: 8161268 - DNA, 22 bp, Homo sapiens
caggctggagttcagtggtgtg

SEQ ID NO: 8161269 - DNA, 22 bp, Homo sapiens
caggctggagtgcagtggtgcc

SEQ ID NO: 8161270 - DNA, 22 bp, Homo sapiens
caggctggagttcagtggtgtg

SEQ ID NO: 8161271 - DNA, 22 bp, Homo sapiens
caggctggagttcagtggtgtg

SEQ ID NO: 8161272 - DNA, 22 bp, Homo sapiens
caggctgccgaggctgcagaat

SEQ ID NO: 8161273 - DNA, 22 bp, Homo sapiens
caggctgccgaggctgcagaat

SEQ ID NO: 8161274 - DNA, 22 bp, Homo sapiens
caggctgccgtgaagcaggcct

SEQ ID NO: 8161275 - DNA, 22 bp, Homo sapiens
caggctgccgtgaagcaggcct

SEQ ID NO: 8161276 - DNA, 22 bp, Homo sapiens
caggctgccgtgaagcaggcct

SEQ ID NO: 8161277 - DNA, 22 bp, Homo sapiens
caggctgccgtgaagcaggcct

SEQ ID NO: 8161278 - DNA, 22 bp, Homo sapiens
caggctgccgtgaagcaggcct

SEQ ID NO: 8161279 - DNA, 22 bp, Homo sapiens
caggctgccgtgaagcaggcct

SEQ ID NO: 8161280 - DNA, 22 bp, Homo sapiens
caggctgccgtgaagcaggcct

SEQ ID NO: 8161281 - DNA, 22 bp, Homo sapiens
caggctgccctagcttggacat

SEQ ID NO: 8161282 - DNA, 22 bp, Homo sapiens
caggctgcccggcaagttgcgc

SEQ ID NO: 8161283 - DNA, 22 bp, Homo sapiens
caggctgccctagcttggacat

SEQ ID NO: 8161284 - DNA, 22 bp, Homo sapiens
caggctgccgaggctgcagaat

SEQ ID NO: 8161285 - DNA, 22 bp, Homo sapiens
caggctgccgaggctgcagaat

SEQ ID NO: 8161286 - DNA, 22 bp, Homo sapiens
caggctgccgaggctgcagaat

SEQ ID NO: 8161287 - DNA, 22 bp, Homo sapiens
caggctgccaaggctggggagg

SEQ ID NO: 8161288 - DNA, 22 bp, Homo sapiens
caggctgccaaggctggggagg

SEQ ID NO: 8161289 - DNA, 22 bp, Homo sapiens
caggctgcagtgcagtggctat

SEQ ID NO: 8161290 - DNA, 22 bp, Homo sapiens
caggctgcagtgcagtggctat

SEQ ID NO: 8161291 - DNA, 22 bp, Homo sapiens
caggctgcagtgcagtggctat

SEQ ID NO: 8161292 - DNA, 22 bp, Homo sapiens
caggctgcagtgcagtggctat

SEQ ID NO: 8161293 - DNA, 22 bp, Homo sapiens
caggctgcagtgcagtggctat

SEQ ID NO: 8161294 - DNA, 22 bp, Homo sapiens
caggctgcagtgcagtggctat

SEQ ID NO: 8161295 - DNA, 22 bp, Homo sapiens
caggctgtctgaatggaggccc

SEQ ID NO: 8161296 - DNA, 22 bp, Homo sapiens
tagaaacaagggagaggattct

SEQ ID NO: 8161297 - DNA, 22 bp, Homo sapiens
caggcttggagggcagtggcat

SEQ ID NO: 8161298 - DNA, 22 bp, Homo sapiens
caggcttgctgctagagcactt

SEQ ID NO: 8161299 - DNA, 22 bp, Homo sapiens
caggctgtctgaatggaggccc

SEQ ID NO: 8161300 - DNA, 22 bp, Homo sapiens
caggcttggcagggaggctggt

SEQ ID NO: 8161301 - DNA, 22 bp, Homo sapiens
caggcttgtgtctcagctgcag

SEQ ID NO: 8161302 - DNA, 22 bp, Homo sapiens
caggcttgtgtctcagctgcag

SEQ ID NO: 8161303 - DNA, 22 bp, Homo sapiens
caggctttactttctctctgaa

SEQ ID NO: 8161304 - DNA, 22 bp, Homo sapiens
caggctttactttctctctgaa

SEQ ID NO: 8161305 - DNA, 22 bp, Homo sapiens
caggcttggcagggaggctggt

SEQ ID NO: 8161306 - DNA, 22 bp, Homo sapiens
caggcttggcagggaggctggt

SEQ ID NO: 8161307 - DNA, 22 bp, Homo sapiens
caggcttgggttctctgagtta

SEQ ID NO: 8161308 - DNA, 22 bp, Homo sapiens
caggcttgggagcagagccact

SEQ ID NO: 8161309 - DNA, 22 bp, Homo sapiens
caggcttgggagcagagccact

SEQ ID NO: 8161310 - DNA, 22 bp, Homo sapiens
caggcttgggagcagagccact

SEQ ID NO: 8161311 - DNA, 22 bp, Homo sapiens
cagggaagagccgatgctgcag

SEQ ID NO: 8161312 - DNA, 22 bp, Homo sapiens
cagggaaggctgcaaatgttaa

SEQ ID NO: 8161313 - DNA, 22 bp, Homo sapiens
cagggaagaatagttagcaaag

SEQ ID NO: 8161314 - DNA, 22 bp, Homo sapiens
cagggaagaatagttagcaaag

SEQ ID NO: 8161315 - DNA, 22 bp, Homo sapiens
caggctttcaggacagcgagcc

SEQ ID NO: 8161316 - DNA, 22 bp, Homo sapiens
caggctttcaggacagcgagcc

SEQ ID NO: 8161317 - DNA, 22 bp, Homo sapiens
caggcttttatgaatttcagtg

SEQ ID NO: 8161318 - DNA, 22 bp, Homo sapiens
caggcttttgcatagcactggg

SEQ ID NO: 8161319 - DNA, 22 bp, Homo sapiens
caggcttttgcatagcactggg

SEQ ID NO: 8161320 - DNA, 22 bp, Homo sapiens
caggcttttgcatagcactggg

SEQ ID NO: 8161321 - DNA, 22 bp, Homo sapiens
caggcttttatgaatttcagtg

SEQ ID NO: 8161322 - DNA, 22 bp, Homo sapiens
cagggaaactaggaaataagct

SEQ ID NO: 8161323 - DNA, 22 bp, Homo sapiens
cagggaaagtcccaccccacac

SEQ ID NO: 8161324 - DNA, 22 bp, Homo sapiens
caggctttttctgctgtcctct

SEQ ID NO: 8161325 - DNA, 22 bp, Homo sapiens
caggctttttctgctgtcctct

SEQ ID NO: 8161326 - DNA, 22 bp, Homo sapiens
cagggacaaagtgagaaaggaa

SEQ ID NO: 8161327 - DNA, 22 bp, Homo sapiens
cagggacaaacaaggttgggga

SEQ ID NO: 8161328 - DNA, 22 bp, Homo sapiens
cagggacaaacaaggttgggga

SEQ ID NO: 8161329 - DNA, 22 bp, Homo sapiens
cagggacaatggcagagcctga

SEQ ID NO: 8161330 - DNA, 22 bp, Homo sapiens
cagggacaaagtgagaaaggaa

SEQ ID NO: 8161331 - DNA, 22 bp, Homo sapiens
cagggacaaggaataagattag

SEQ ID NO: 8161332 - DNA, 22 bp, Homo sapiens
cagggacaatggcagagcctga

SEQ ID NO: 8161333 - DNA, 22 bp, Homo sapiens
cagggacaatggcagagcctga

SEQ ID NO: 8161334 - DNA, 22 bp, Homo sapiens
cagggacaatggcagagcctga

SEQ ID NO: 8161335 - DNA, 20 bp, Homo sapiens
cagggacagcagtgggtttt

SEQ ID NO: 8161336 - DNA, 20 bp, Homo sapiens
cagggacagcagtgggtttt

SEQ ID NO: 8161337 - DNA, 22 bp, Homo sapiens
cagggacagcactaaactcttg

SEQ ID NO: 8161338 - DNA, 22 bp, Homo sapiens
cagggacagcactaaactcttg

SEQ ID NO: 8161339 - DNA, 22 bp, Homo sapiens
cagggacagacagatatatttg

SEQ ID NO: 8161340 - DNA, 22 bp, Homo sapiens
cagggacagagactgcaccttg

SEQ ID NO: 8161341 - DNA, 22 bp, Homo sapiens
cagggacagagactgcaccttg

SEQ ID NO: 8161342 - DNA, 22 bp, Homo sapiens
cagggacagagactgcaccttg

SEQ ID NO: 8161343 - DNA, 22 bp, Homo sapiens
tagattctgtttcctctggttt

SEQ ID NO: 8161344 - DNA, 22 bp, Homo sapiens
tagattctgtatgtctgctctc

SEQ ID NO: 8161345 - DNA, 22 bp, Homo sapiens
tagattcatgcagtatgctagt

SEQ ID NO: 8161346 - DNA, 22 bp, Homo sapiens
tagattcatgcagtatgctagt

SEQ ID NO: 8161347 - DNA, 22 bp, Homo sapiens
tagattcagatatttaggacaa

SEQ ID NO: 8161348 - DNA, 22 bp, Homo sapiens
tagattcagatatttaggacaa

SEQ ID NO: 8161349 - DNA, 22 bp, Homo sapiens
tagattcagatatttaggacaa

SEQ ID NO: 8161350 - DNA, 22 bp, Homo sapiens
tagatacaggctctctgagcct

SEQ ID NO: 8161351 - DNA, 22 bp, Homo sapiens
tagattcaagtattcagtttgg

SEQ ID NO: 8161352 - DNA, 22 bp, Homo sapiens
tagatacacacacagtcatgtg

SEQ ID NO: 8161353 - DNA, 22 bp, Homo sapiens
cagggacagccttggggtggcg

SEQ ID NO: 8161354 - DNA, 22 bp, Homo sapiens
tacatgtttactccaagtcagg

SEQ ID NO: 8161355 - DNA, 22 bp, Homo sapiens
tacattgtacttacaaatagtg

SEQ ID NO: 8161356 - DNA, 22 bp, Homo sapiens
tacattgtacttacaaatagtg

SEQ ID NO: 8161357 - DNA, 20 bp, Homo sapiens
tacattgtagaaatattcaa

SEQ ID NO: 8161358 - DNA, 22 bp, Homo sapiens
caggcctgcttcttacccttca

SEQ ID NO: 8161359 - DNA, 22 bp, Homo sapiens
caggcctgcaggaaaggctccc

SEQ ID NO: 8161360 - DNA, 22 bp, Homo sapiens
caggcctgcaggaaaggctccc

SEQ ID NO: 8161361 - DNA, 22 bp, Homo sapiens
caggcctggagtgcaatggcac

SEQ ID NO: 8161362 - DNA, 22 bp, Homo sapiens
caggcctgcaggaaaggctccc

SEQ ID NO: 8161363 - DNA, 22 bp, Homo sapiens
caggcctgagtgtggaagtctt

SEQ ID NO: 8161364 - DNA, 22 bp, Homo sapiens
caggcctcttccatgcagcagc

SEQ ID NO: 8161365 - DNA, 22 bp, Homo sapiens
caggcctcttccatgcagcagc

SEQ ID NO: 8161366 - DNA, 19 bp, Homo sapiens
caggcctcttaccctctct

SEQ ID NO: 8161367 - DNA, 22 bp, Homo sapiens
caggcctgaccctgagcttcac

SEQ ID NO: 8161368 - DNA, 18 bp, Homo sapiens
caggcctcttgatcttcc

SEQ ID NO: 8161369 - DNA, 18 bp, Homo sapiens
caggcctcttgatcttcc

SEQ ID NO: 8161370 - DNA, 22 bp, Homo sapiens
caggcctcttccatgcagcagc

SEQ ID NO: 8161371 - DNA, 22 bp, Homo sapiens
caggcctgagacatctgagata

SEQ ID NO: 8161372 - DNA, 22 bp, Homo sapiens
caggcctgaccctgagcttcac

SEQ ID NO: 8161373 - DNA, 22 bp, Homo sapiens
caggcctgaccctgagcttcac

SEQ ID NO: 8161374 - DNA, 22 bp, Homo sapiens
caggcctgaccctgagcttcac

SEQ ID NO: 8161375 - DNA, 22 bp, Homo sapiens
caggcctgagtgtggaagtctt

SEQ ID NO: 8161376 - DNA, 22 bp, Homo sapiens
caggcctgagacatctgagata

SEQ ID NO: 8161377 - DNA, 22 bp, Homo sapiens
caggcctgagacatctgagata

SEQ ID NO: 8161378 - DNA, 22 bp, Homo sapiens
caggcctgagacatctgagata

SEQ ID NO: 8161379 - DNA, 22 bp, Homo sapiens
caggcctgagacatctgagata

SEQ ID NO: 8161380 - DNA, 22 bp, Homo sapiens
caggcctgagacatctgagata

SEQ ID NO: 8161381 - DNA, 20 bp, Homo sapiens
caggcctctgggggccctgg

SEQ ID NO: 8161382 - DNA, 22 bp, Homo sapiens
caggcctctccttagtctggca

SEQ ID NO: 8161383 - DNA, 22 bp, Homo sapiens
caggcctctccttagtctggca

SEQ ID NO: 8161384 - DNA, 22 bp, Homo sapiens
caggcctctccttagtctggca

SEQ ID NO: 8161385 - DNA, 19 bp, Homo sapiens
caggcctctggtctgctgt

SEQ ID NO: 8161386 - DNA, 19 bp, Homo sapiens
caggcctctggtctgctgt

SEQ ID NO: 8161387 - DNA, 19 bp, Homo sapiens
caggcctcttaccctctct

SEQ ID NO: 8161388 - DNA, 20 bp, Homo sapiens
caggcctctgggggccctgg

SEQ ID NO: 8161389 - DNA, 22 bp, Homo sapiens
caggcctctatggtcagctgag

SEQ ID NO: 8161390 - DNA, 22 bp, Homo sapiens
caggcctctccttagtctggca

SEQ ID NO: 8161391 - DNA, 22 bp, Homo sapiens
caggcctctatggtcagctgag

SEQ ID NO: 8161392 - DNA, 22 bp, Homo sapiens
caggcctctatggtcagctgag

SEQ ID NO: 8161393 - DNA, 22 bp, Homo sapiens
caggcctctatggtcagctgag

SEQ ID NO: 8161394 - DNA, 22 bp, Homo sapiens
caggcctctatggtcagctgag

SEQ ID NO: 8161395 - DNA, 22 bp, Homo sapiens
caggcccagcccagcccttcga

SEQ ID NO: 8161396 - DNA, 22 bp, Homo sapiens
caggcccagcccttagccaggt

SEQ ID NO: 8161397 - DNA, 22 bp, Homo sapiens
caggcccagcccagcccttcga

SEQ ID NO: 8161398 - DNA, 22 bp, Homo sapiens
caggcccagcccagcccttcga

SEQ ID NO: 8161399 - DNA, 22 bp, Homo sapiens
caggcccagaggcctcttccca

SEQ ID NO: 8161400 - DNA, 22 bp, Homo sapiens
caggcccagaggcctcttccca

SEQ ID NO: 8161401 - DNA, 22 bp, Homo sapiens
caggcccagcccttagccaggt

SEQ ID NO: 8161402 - DNA, 22 bp, Homo sapiens
caggcccagcccttagccaggt

SEQ ID NO: 8161403 - DNA, 22 bp, Homo sapiens
caggcccagcccttagccaggt

SEQ ID NO: 8161404 - DNA, 22 bp, Homo sapiens
caggcccagggagggagaccaa

SEQ ID NO: 8161405 - DNA, 22 bp, Homo sapiens
caggcccaggccagtggttccc

SEQ ID NO: 8161406 - DNA, 22 bp, Homo sapiens
caggcctcctatgagcactagc

SEQ ID NO: 8161407 - DNA, 22 bp, Homo sapiens
caggcctcgaggagacagctac

SEQ ID NO: 8161408 - DNA, 22 bp, Homo sapiens
caggcctcctatgagcactagc

SEQ ID NO: 8161409 - DNA, 22 bp, Homo sapiens
caggccgggcactgcgctaggt

SEQ ID NO: 8161410 - DNA, 22 bp, Homo sapiens
caggccggggcggcgccatctt

SEQ ID NO: 8161411 - DNA, 22 bp, Homo sapiens
caggccgggcactgcgctaggt

SEQ ID NO: 8161412 - DNA, 22 bp, Homo sapiens
caggcccagggagggagaccaa

SEQ ID NO: 8161413 - DNA, 22 bp, Homo sapiens
caggcccagggagggagaccaa

SEQ ID NO: 8161414 - DNA, 18 bp, Homo sapiens
caggcctttgagacagaa

SEQ ID NO: 8161415 - DNA, 18 bp, Homo sapiens
caggcctttgagacagaa

SEQ ID NO: 8161416 - DNA, 22 bp, Homo sapiens
caggcctttgcacgtgcagttg

SEQ ID NO: 8161417 - DNA, 22 bp, Homo sapiens
caggcctttctggggaagtgag

SEQ ID NO: 8161418 - DNA, 22 bp, Homo sapiens
caggcgtcactgccacgggtat

SEQ ID NO: 8161419 - DNA, 22 bp, Homo sapiens
caggctaaagctttgagcatgt

SEQ ID NO: 8161420 - DNA, 22 bp, Homo sapiens
caggccttttttcctgcagtgt

SEQ ID NO: 8161421 - DNA, 22 bp, Homo sapiens
caggcgagggccctgaggagcc

SEQ ID NO: 8161422 - DNA, 22 bp, Homo sapiens
caggcgagggccctgaggagcc

SEQ ID NO: 8161423 - DNA, 22 bp, Homo sapiens
caggcgagtgaacagactctca

SEQ ID NO: 8161424 - DNA, 22 bp, Homo sapiens
caggcgagggccctgaggagcc

SEQ ID NO: 8161425 - DNA, 22 bp, Homo sapiens
tacattgtgtctctatctagtc

SEQ ID NO: 8161426 - DNA, 22 bp, Homo sapiens
tacattgtgataggaagtcacc

SEQ ID NO: 8161427 - DNA, 20 bp, Homo sapiens
tacattgtgagactaatgga

SEQ ID NO: 8161428 - DNA, 22 bp, Homo sapiens
tacattgtgatgtttcaataca

SEQ ID NO: 8161429 - DNA, 22 bp, Homo sapiens
tacattgtattatccgtgattg

SEQ ID NO: 8161430 - DNA, 20 bp, Homo sapiens
tacattgtagaaatattcaa

SEQ ID NO: 8161431 - DNA, 22 bp, Homo sapiens
tacattgtctgcaattttctct

SEQ ID NO: 8161432 - DNA, 22 bp, Homo sapiens
tacattgtttgagatagtttgt

SEQ ID NO: 8161433 - DNA, 22 bp, Homo sapiens
tacattgtttgagatagtttgt

SEQ ID NO: 8161434 - DNA, 22 bp, Homo sapiens
tacattgttttttcttgccatc

SEQ ID NO: 8161435 - DNA, 22 bp, Homo sapiens
tacatttacagagccttctctg

SEQ ID NO: 8161436 - DNA, 22 bp, Homo sapiens
tacatttacagagccttctctg

SEQ ID NO: 8161437 - DNA, 22 bp, Homo sapiens
tacatttacagagccttctctg

SEQ ID NO: 8161438 - DNA, 22 bp, Homo sapiens
tacatttcctgtcagagatata

SEQ ID NO: 8161439 - DNA, 22 bp, Homo sapiens
tacatttataaggcttctctgt

SEQ ID NO: 8161440 - DNA, 22 bp, Homo sapiens
tacatttataaggcttctctgt

SEQ ID NO: 8161441 - DNA, 22 bp, Homo sapiens
tacatttataaggcttctctgt

SEQ ID NO: 8161442 - DNA, 22 bp, Homo sapiens
tacatttataaggcttctctgt

SEQ ID NO: 8161443 - DNA, 22 bp, Homo sapiens
tacatttataaggcttctctgt

SEQ ID NO: 8161444 - DNA, 22 bp, Homo sapiens
tactttattgtaaatgctgatg

SEQ ID NO: 8161445 - DNA, 22 bp, Homo sapiens
tactttattgtaaatgctgatg

SEQ ID NO: 8161446 - DNA, 22 bp, Homo sapiens
tactttattgtaaatgctgatg

SEQ ID NO: 8161447 - DNA, 22 bp, Homo sapiens
tactttattgtaaatgctgatg

SEQ ID NO: 8161448 - DNA, 22 bp, Homo sapiens
tactttatcagcgtcaaaggta

SEQ ID NO: 8161449 - DNA, 22 bp, Homo sapiens
tactttattcaggaaggctggt

SEQ ID NO: 8161450 - DNA, 22 bp, Homo sapiens
tactttattcaggaaggctggt

SEQ ID NO: 8161451 - DNA, 22 bp, Homo sapiens
tactttattcaggaaggctggt

SEQ ID NO: 8161452 - DNA, 18 bp, Homo sapiens
tactttattccccctcca

SEQ ID NO: 8161453 - DNA, 18 bp, Homo sapiens
tactttattccccctcca

SEQ ID NO: 8161454 - DNA, 18 bp, Homo sapiens
tactttattccccctcca

SEQ ID NO: 8161455 - DNA, 22 bp, Homo sapiens
tactttattcaggaaggctggt

SEQ ID NO: 8161456 - DNA, 22 bp, Homo sapiens
tactttatattgtggctggcca

SEQ ID NO: 8161457 - DNA, 22 bp, Homo sapiens
tactttatattgtggctggcca

SEQ ID NO: 8161458 - DNA, 22 bp, Homo sapiens
tactttatcagcgtcaaaggta

SEQ ID NO: 8161459 - DNA, 22 bp, Homo sapiens
tactttatcagcgtcaaaggta

SEQ ID NO: 8161460 - DNA, 22 bp, Homo sapiens
tactttatattgtggctggcca

SEQ ID NO: 8161461 - DNA, 22 bp, Homo sapiens
tactttacagtattagataatt

SEQ ID NO: 8161462 - DNA, 22 bp, Homo sapiens
tacttgttatcatcttttcctt

SEQ ID NO: 8161463 - DNA, 22 bp, Homo sapiens
tactttaaaaactgataattca

SEQ ID NO: 8161464 - DNA, 22 bp, Homo sapiens
tactttaaaaactgataattca

SEQ ID NO: 8161465 - DNA, 22 bp, Homo sapiens
tactttaaaaactgataattca

SEQ ID NO: 8161466 - DNA, 22 bp, Homo sapiens
tacttgttgatcagttgttaaa

SEQ ID NO: 8161467 - DNA, 22 bp, Homo sapiens
caggctcaaggctgacttccat

SEQ ID NO: 8161468 - DNA, 22 bp, Homo sapiens
caggctcaagccctgcttatat

SEQ ID NO: 8161469 - DNA, 22 bp, Homo sapiens
caggctcaagccctgcttatat

SEQ ID NO: 8161470 - DNA, 22 bp, Homo sapiens
caggctagattggggccagtag

SEQ ID NO: 8161471 - DNA, 22 bp, Homo sapiens
caggctagcagggcccagggca

SEQ ID NO: 8161472 - DNA, 22 bp, Homo sapiens
caggctagattggggccagtag

SEQ ID NO: 8161473 - DNA, 22 bp, Homo sapiens
caggctacatttgctctgagaa

SEQ ID NO: 8161474 - DNA, 22 bp, Homo sapiens
taatcacatcagggtaaatggg

SEQ ID NO: 8161475 - DNA, 22 bp, Homo sapiens
taatcacatcagggtaaatggg

SEQ ID NO: 8161476 - DNA, 22 bp, Homo sapiens
taatatttctaccctgctgcct

SEQ ID NO: 8161477 - DNA, 22 bp, Homo sapiens
taatcacagaaacagactgttt

SEQ ID NO: 8161478 - DNA, 22 bp, Homo sapiens
taatacagatacaaaggaggac

SEQ ID NO: 8161479 - DNA, 22 bp, Homo sapiens
taatatctggcattcaaacatg

SEQ ID NO: 8161480 - DNA, 22 bp, Homo sapiens
taatatctggcattcaaacatg

SEQ ID NO: 8161481 - DNA, 22 bp, Homo sapiens
taatatttctaccctgctgcct

SEQ ID NO: 8161482 - DNA, 22 bp, Homo sapiens
taatatttctaccctgctgcct

SEQ ID NO: 8161483 - DNA, 22 bp, Homo sapiens
taatcactgggcgtttggtact

SEQ ID NO: 8161484 - DNA, 22 bp, Homo sapiens
taatcatatgggtaatccaatg

SEQ ID NO: 8161485 - DNA, 22 bp, Homo sapiens
taatcatatgggtaatccaatg

SEQ ID NO: 8161486 - DNA, 22 bp, Homo sapiens
taatcatggcctcaaattttat

SEQ ID NO: 8161487 - DNA, 22 bp, Homo sapiens
taatgttacactgcatggttca

SEQ ID NO: 8161488 - DNA, 22 bp, Homo sapiens
caggcagggagctggaaaggat

SEQ ID NO: 8161489 - DNA, 22 bp, Homo sapiens
caggcagggagctggaaaggat

SEQ ID NO: 8161490 - DNA, 22 bp, Homo sapiens
taatgtcttgtgagagctggag

SEQ ID NO: 8161491 - DNA, 22 bp, Homo sapiens
caggcatggagaggcagagact

SEQ ID NO: 8161492 - DNA, 22 bp, Homo sapiens
caggcatggatctggaatcatt

SEQ ID NO: 8161493 - DNA, 22 bp, Homo sapiens
caggcatgggccatgggaagtg

SEQ ID NO: 8161494 - DNA, 22 bp, Homo sapiens
caggcatggagaggcagagact

SEQ ID NO: 8161495 - DNA, 22 bp, Homo sapiens
caggcatggaaaagcccagagg

SEQ ID NO: 8161496 - DNA, 22 bp, Homo sapiens
caggcatggaaaagcccagagg

SEQ ID NO: 8161497 - DNA, 22 bp, Homo sapiens
caggcagggagctggaaaggat

SEQ ID NO: 8161498 - DNA, 22 bp, Homo sapiens
caggcagggagctggaaaggat

SEQ ID NO: 8161499 - DNA, 22 bp, Homo sapiens
caggcagggagctggaaaggat

SEQ ID NO: 8161500 - DNA, 22 bp, Homo sapiens
caggcatgagccaggcccctcc

SEQ ID NO: 8161501 - DNA, 22 bp, Homo sapiens
caggcagggagctggaaaggat

SEQ ID NO: 8161502 - DNA, 22 bp, Homo sapiens
caggcatgatgggaagtgcctg

SEQ ID NO: 8161503 - DNA, 22 bp, Homo sapiens
caggcatgatgggaagtgcctg

SEQ ID NO: 8161504 - DNA, 22 bp, Homo sapiens
caggcatgcttctgtctgggca

SEQ ID NO: 8161505 - DNA, 22 bp, Homo sapiens
caggcatgcttctgtctgggca

SEQ ID NO: 8161506 - DNA, 22 bp, Homo sapiens
caggcatgcttctgtctgggca

SEQ ID NO: 8161507 - DNA, 22 bp, Homo sapiens
caggcatgcttctgtctgggca

SEQ ID NO: 8161508 - DNA, 20 bp, Homo sapiens
tacaaacctccacactggtg

SEQ ID NO: 8161509 - DNA, 22 bp, Homo sapiens
caggccagggttgagaagagaa

SEQ ID NO: 8161510 - DNA, 22 bp, Homo sapiens
caggccagagcgcgtggttggg

SEQ ID NO: 8161511 - DNA, 22 bp, Homo sapiens
caggccagagcgcgtggttggg

SEQ ID NO: 8161512 - DNA, 22 bp, Homo sapiens
caggccagagcgcgtggttggg

SEQ ID NO: 8161513 - DNA, 22 bp, Homo sapiens
tacaaaacagtgctctggtcct

SEQ ID NO: 8161514 - DNA, 22 bp, Homo sapiens
tacaaaacagtgctctggtcct

SEQ ID NO: 8161515 - DNA, 22 bp, Homo sapiens
tacaaaacagtgctctggtcct

SEQ ID NO: 8161516 - DNA, 21 bp, Homo sapiens
caggccaaaaggttcaacatt

SEQ ID NO: 8161517 - DNA, 22 bp, Homo sapiens
tacaaaaaattgatactgacga

SEQ ID NO: 8161518 - DNA, 22 bp, Homo sapiens
tacaaaaaattgatactgacga

SEQ ID NO: 8161519 - DNA, 22 bp, Homo sapiens
tacaaaaaattgatactgacga

SEQ ID NO: 8161520 - DNA, 22 bp, Homo sapiens
tacaaaaaattgatactgacga

SEQ ID NO: 8161521 - DNA, 22 bp, Homo sapiens
caggcatgtggcccaggggtga

SEQ ID NO: 8161522 - DNA, 22 bp, Homo sapiens
caggcattgccattcctccaga

SEQ ID NO: 8161523 - DNA, 22 bp, Homo sapiens
caggcattcctctatgaatatt

SEQ ID NO: 8161524 - DNA, 22 bp, Homo sapiens
caggcattgttctaggttctca

SEQ ID NO: 8161525 - DNA, 22 bp, Homo sapiens
caggcattgtgacgagtgttct

SEQ ID NO: 8161526 - DNA, 22 bp, Homo sapiens
caggcattgtgacgagtgttct

SEQ ID NO: 8161527 - DNA, 22 bp, Homo sapiens
caggcattgccattcctccaga

SEQ ID NO: 8161528 - DNA, 22 bp, Homo sapiens
caggcatgggccatgggaagtg

SEQ ID NO: 8161529 - DNA, 22 bp, Homo sapiens
caggcatgtggcccaggggtga

SEQ ID NO: 8161530 - DNA, 22 bp, Homo sapiens
caggcatggtgagaactcagcc

SEQ ID NO: 8161531 - DNA, 22 bp, Homo sapiens
caggcatgtggcccaggggtga

SEQ ID NO: 8161532 - DNA, 22 bp, Homo sapiens
caggccagtgggaaatagggat

SEQ ID NO: 8161533 - DNA, 22 bp, Homo sapiens
caggccagtgggaaatagggat

SEQ ID NO: 8161534 - DNA, 22 bp, Homo sapiens
caggccagtgggaaatagggat

SEQ ID NO: 8161535 - DNA, 22 bp, Homo sapiens
caggccagtgggaaatagggat

SEQ ID NO: 8161536 - DNA, 22 bp, Homo sapiens
caggccaggtggcaggcaaaac

SEQ ID NO: 8161537 - DNA, 22 bp, Homo sapiens
caggccaggtggcaggcaaaac

SEQ ID NO: 8161538 - DNA, 19 bp, Homo sapiens
caggccagtgtcagggggc

SEQ ID NO: 8161539 - DNA, 19 bp, Homo sapiens
caggccagtgtcagggggc

SEQ ID NO: 8161540 - DNA, 19 bp, Homo sapiens
caggccagtgtcagggggc

SEQ ID NO: 8161541 - DNA, 19 bp, Homo sapiens
caggccagtgtcagggggc

SEQ ID NO: 8161542 - DNA, 22 bp, Homo sapiens
caggccaggtggcaggcaaaac

SEQ ID NO: 8161543 - DNA, 22 bp, Homo sapiens
caggccaggtggcaggcaaaac

SEQ ID NO: 8161544 - DNA, 22 bp, Homo sapiens
caggccaggtggcaggcaaaac

SEQ ID NO: 8161545 - DNA, 22 bp, Homo sapiens
caggccaggtgctctagaatca

SEQ ID NO: 8161546 - DNA, 22 bp, Homo sapiens
caggccaggtgctctagaatca

SEQ ID NO: 8161547 - DNA, 22 bp, Homo sapiens
caggccaggtgctctagaatca

SEQ ID NO: 8161548 - DNA, 22 bp, Homo sapiens
caggccagggttgagaagagaa

SEQ ID NO: 8161549 - DNA, 22 bp, Homo sapiens
caggccagggttgagaagagaa

SEQ ID NO: 8161550 - DNA, 22 bp, Homo sapiens
caggccagggttgagaagagaa

SEQ ID NO: 8161551 - DNA, 22 bp, Homo sapiens
caggccagggttgagaagagaa

SEQ ID NO: 8161552 - DNA, 22 bp, Homo sapiens
caggccagggttgagaagagaa

SEQ ID NO: 8161553 - DNA, 22 bp, Homo sapiens
caggccagtgtgcttcccaggc

SEQ ID NO: 8161554 - DNA, 19 bp, Homo sapiens
caggccagtgtcagggggc

SEQ ID NO: 8161555 - DNA, 22 bp, Homo sapiens
caggccagtgtgcttcccaggc

SEQ ID NO: 8161556 - DNA, 22 bp, Homo sapiens
caggccagtgtgcttcccaggc

SEQ ID NO: 8161557 - DNA, 22 bp, Homo sapiens
caggccagtgtgcttcccaggc

SEQ ID NO: 8161558 - DNA, 22 bp, Homo sapiens
caggccagtgtgcttcccaggc

SEQ ID NO: 8161559 - DNA, 22 bp, Homo sapiens
caggccagttttgatttaagcc

SEQ ID NO: 8161560 - DNA, 22 bp, Homo sapiens
caggccagttttgatttaagcc

SEQ ID NO: 8161561 - DNA, 22 bp, Homo sapiens
caggcccaaatgcaaccttctt

SEQ ID NO: 8161562 - DNA, 22 bp, Homo sapiens
caggcccacgaggcacacagag

SEQ ID NO: 8161563 - DNA, 22 bp, Homo sapiens
caggcccacgaggcacacagag

SEQ ID NO: 8161564 - DNA, 22 bp, Homo sapiens
caggcccactgcttgtctagtc

SEQ ID NO: 8161565 - DNA, 22 bp, Homo sapiens
caggcccagaggcctcttccca

SEQ ID NO: 8161566 - DNA, 22 bp, Homo sapiens
caggcccaaatgcaaccttctt

SEQ ID NO: 8161567 - DNA, 22 bp, Homo sapiens
caggcccaagactgatgagtct

SEQ ID NO: 8161568 - DNA, 22 bp, Homo sapiens
caggcccaagactgatgagtct

SEQ ID NO: 8161569 - DNA, 22 bp, Homo sapiens
caggcccacgaggcacacagag

SEQ ID NO: 8161570 - DNA, 22 bp, Homo sapiens
caggcccacgaggcacacagag

SEQ ID NO: 8161571 - DNA, 22 bp, Homo sapiens
taatacaaggcaggaagcagta

SEQ ID NO: 8161572 - DNA, 22 bp, Homo sapiens
taataattttaaagaaggctag

SEQ ID NO: 8161573 - DNA, 22 bp, Homo sapiens
taatacagaagtgtattaaaat

SEQ ID NO: 8161574 - DNA, 22 bp, Homo sapiens
taatacagaagtgtattaaaat

SEQ ID NO: 8161575 - DNA, 22 bp, Homo sapiens
taatacactgctttttgtaact

SEQ ID NO: 8161576 - DNA, 21 bp, Homo sapiens
taataattccactacagagta

SEQ ID NO: 8161577 - DNA, 22 bp, Homo sapiens
taataattggcaatgttgagca

SEQ ID NO: 8161578 - DNA, 21 bp, Homo sapiens
taataattccactacagagta

SEQ ID NO: 8161579 - DNA, 22 bp, Homo sapiens
caggcagcagccactctggtat

SEQ ID NO: 8161580 - DNA, 22 bp, Homo sapiens
taataattaacagtgatgggtc

SEQ ID NO: 8161581 - DNA, 22 bp, Homo sapiens
taataattaacagtgatgggtc

SEQ ID NO: 8161582 - DNA, 22 bp, Homo sapiens
taataattagttattgatcgtg

SEQ ID NO: 8161583 - DNA, 21 bp, Homo sapiens
taataattccactacagagta

SEQ ID NO: 8161584 - DNA, 22 bp, Homo sapiens
caggcagcagaggagtgtggga

SEQ ID NO: 8161585 - DNA, 22 bp, Homo sapiens
caggcagcagaggagtgtggga

SEQ ID NO: 8161586 - DNA, 22 bp, Homo sapiens
caggcagatttgctgccctcca

SEQ ID NO: 8161587 - DNA, 22 bp, Homo sapiens
caggcagatttgctgccctcca

SEQ ID NO: 8161588 - DNA, 22 bp, Homo sapiens
caggcagatgctgacaagagtt

SEQ ID NO: 8161589 - DNA, 22 bp, Homo sapiens
caggcagatgctgacaagagtt

SEQ ID NO: 8161590 - DNA, 22 bp, Homo sapiens
caggcagatttgctgccctcca

SEQ ID NO: 8161591 - DNA, 22 bp, Homo sapiens
caggcaccctctgaggggaagc

SEQ ID NO: 8161592 - DNA, 22 bp, Homo sapiens
caggcacctcacgtgggtccca

SEQ ID NO: 8161593 - DNA, 22 bp, Homo sapiens
caggcacctcacgtgggtccca

SEQ ID NO: 8161594 - DNA, 22 bp, Homo sapiens
caggcacctgtgtgtctcaggg

SEQ ID NO: 8161595 - DNA, 22 bp, Homo sapiens
caggcacctgtgtgtctcaggg

SEQ ID NO: 8161596 - DNA, 22 bp, Homo sapiens
caggcacctttgtgcatgggca

SEQ ID NO: 8161597 - DNA, 22 bp, Homo sapiens
caggcacctgtgtgtctcaggg

SEQ ID NO: 8161598 - DNA, 22 bp, Homo sapiens
caggcaccagtgagaagggcct

SEQ ID NO: 8161599 - DNA, 22 bp, Homo sapiens
caggcaccacactaggggctga

SEQ ID NO: 8161600 - DNA, 22 bp, Homo sapiens
caggcaccaatagggatcgtgg

SEQ ID NO: 8161601 - DNA, 22 bp, Homo sapiens
caggcaccacactaggggctga

SEQ ID NO: 8161602 - DNA, 22 bp, Homo sapiens
caggcaccacactaggggctga

SEQ ID NO: 8161603 - DNA, 22 bp, Homo sapiens
caggcaccccaggtgagcactg

SEQ ID NO: 8161604 - DNA, 22 bp, Homo sapiens
caggcacccagcccagtcgcac

SEQ ID NO: 8161605 - DNA, 22 bp, Homo sapiens
caggcaccccaggtgagcactg

SEQ ID NO: 8161606 - DNA, 22 bp, Homo sapiens
caggcagagttagtgatttagg

SEQ ID NO: 8161607 - DNA, 22 bp, Homo sapiens
caggcagagttagagcaactgg

SEQ ID NO: 8161608 - DNA, 22 bp, Homo sapiens
caggcagagttagtgatttagg

SEQ ID NO: 8161609 - DNA, 22 bp, Homo sapiens
caggcagatgctgacaagagtt

SEQ ID NO: 8161610 - DNA, 22 bp, Homo sapiens
caggcagatgctgacaagagtt

SEQ ID NO: 8161611 - DNA, 22 bp, Homo sapiens
caggcagagttagagcaactgg

SEQ ID NO: 8161612 - DNA, 22 bp, Homo sapiens
caggcagagttagagcaactgg

SEQ ID NO: 8161613 - DNA, 22 bp, Homo sapiens
caggcagagccaatcgtggggt

SEQ ID NO: 8161614 - DNA, 22 bp, Homo sapiens
caggcacgggggcatggcctct

SEQ ID NO: 8161615 - DNA, 22 bp, Homo sapiens
caggcacgggggcatggcctct

SEQ ID NO: 8161616 - DNA, 22 bp, Homo sapiens
taagtcacttaagtttgcatgt

SEQ ID NO: 8161617 - DNA, 22 bp, Homo sapiens
taagtcaggaggtctcctgaca

SEQ ID NO: 8161618 - DNA, 22 bp, Homo sapiens
taagtcatcccataacagtgct

SEQ ID NO: 8161619 - DNA, 23 bp, Homo sapiens
cagctcagcacataggaggtact

SEQ ID NO: 8161620 - DNA, 23 bp, Homo sapiens
cagctcagcacataggaggtact

SEQ ID NO: 8161621 - DNA, 23 bp, Homo sapiens
cagctcagagtgtgtcctgtttc

SEQ ID NO: 8161622 - DNA, 23 bp, Homo sapiens
cagctcagagtgtgtcctgtttc

SEQ ID NO: 8161623 - DNA, 22 bp, Homo sapiens
taaggcagcctcagggtagggt

SEQ ID NO: 8161624 - DNA, 22 bp, Homo sapiens
taagtgaaataagtcagataca

SEQ ID NO: 8161625 - DNA, 22 bp, Homo sapiens
taagtcttgaaatatttcctat

SEQ ID NO: 8161626 - DNA, 22 bp, Homo sapiens
caggcaccaatagggatcgtgg

SEQ ID NO: 8161627 - DNA, 22 bp, Homo sapiens
taagtgaaatggtgcatcaaat

SEQ ID NO: 8161628 - DNA, 22 bp, Homo sapiens
taagtcgtggatgattcttcgg

SEQ ID NO: 8161629 - DNA, 22 bp, Homo sapiens
taagtcttcatagtctaatgtc

SEQ ID NO: 8161630 - DNA, 22 bp, Homo sapiens
cagctattggtccacaggtatg

SEQ ID NO: 8161631 - DNA, 22 bp, Homo sapiens
cagctattggcaagaagtggtg

SEQ ID NO: 8161632 - DNA, 22 bp, Homo sapiens
cagctattggcaagaagtggtg

SEQ ID NO: 8161633 - DNA, 22 bp, Homo sapiens
cagctattgataaatgttgggg

SEQ ID NO: 8161634 - DNA, 22 bp, Homo sapiens
cagctattttctcattaaggat

SEQ ID NO: 8161635 - DNA, 22 bp, Homo sapiens
cagctattttgcctatcatggt

SEQ ID NO: 8161636 - DNA, 22 bp, Homo sapiens
cagctcaagtttcccaggtcag

SEQ ID NO: 8161637 - DNA, 22 bp, Homo sapiens
cagctcaagtttcccaggtcag

SEQ ID NO: 8161638 - DNA, 22 bp, Homo sapiens
cagctcagacgcaggtcgagca

SEQ ID NO: 8161639 - DNA, 22 bp, Homo sapiens
cagctcagacgcaggtcgagca

SEQ ID NO: 8161640 - DNA, 22 bp, Homo sapiens
cagctcagacgcaggtcgagca

SEQ ID NO: 8161641 - DNA, 22 bp, Homo sapiens
gtgcttcactgacctgttttca

SEQ ID NO: 8161642 - DNA, 20 bp, Homo sapiens
gtgcttcagaagccattgct

SEQ ID NO: 8161643 - DNA, 22 bp, Homo sapiens
gtgcttccatctagagggtcac

SEQ ID NO: 8161644 - DNA, 22 bp, Homo sapiens
cagctattctctgaaatgaata

SEQ ID NO: 8161645 - DNA, 22 bp, Homo sapiens
gtgcttcctcagaggttcccat

SEQ ID NO: 8161646 - DNA, 22 bp, Homo sapiens
gtgcttccccaagccacagcct

SEQ ID NO: 8161647 - DNA, 22 bp, Homo sapiens
gtgcttcctgcctggtgccttt

SEQ ID NO: 8161648 - DNA, 22 bp, Homo sapiens
gtgcttcctctgccaacactct

SEQ ID NO: 8161649 - DNA, 22 bp, Homo sapiens
tgaatgctcacatgcctaggtc

SEQ ID NO: 8161650 - DNA, 21 bp, Homo sapiens
tgaatgcttcgtcatcctggc

SEQ ID NO: 8161651 - DNA, 22 bp, Homo sapiens
tgaatgcaagaaggaacatgaa

SEQ ID NO: 8161652 - DNA, 22 bp, Homo sapiens
tgaatgcactgctctcctagga

SEQ ID NO: 8161653 - DNA, 22 bp, Homo sapiens
tgacaacagccatcacttttag

SEQ ID NO: 8161654 - DNA, 23 bp, Homo sapiens
tgacaacagctctcagccatgtc

SEQ ID NO: 8161655 - DNA, 22 bp, Homo sapiens
tgaatgatggtgtgttcttgcc

SEQ ID NO: 8161656 - DNA, 22 bp, Homo sapiens
tgaatgatggtgtgttcttgcc

SEQ ID NO: 8161657 - DNA, 22 bp, Homo sapiens
tgaatgatctccgattagtcct

SEQ ID NO: 8161658 - DNA, 22 bp, Homo sapiens
tgaatgagtggattctgagtag

SEQ ID NO: 8161659 - DNA, 22 bp, Homo sapiens
tgaatgagtggattctgagtag

SEQ ID NO: 8161660 - DNA, 22 bp, Homo sapiens
tgaatgagtttggctgctgttc

SEQ ID NO: 8161661 - DNA, 22 bp, Homo sapiens
tgaatgagtttggctgctgttc

SEQ ID NO: 8161662 - DNA, 22 bp, Homo sapiens
tgaagttcactgagagttcacc

SEQ ID NO: 8161663 - DNA, 22 bp, Homo sapiens
tgaagttgttaaggttgccatt

SEQ ID NO: 8161664 - DNA, 22 bp, Homo sapiens
tgaagttgttaaggttgccatt

SEQ ID NO: 8161665 - DNA, 22 bp, Homo sapiens
tgaatgatacagaattatgtag

SEQ ID NO: 8161666 - DNA, 22 bp, Homo sapiens
tgaatgatctagttttgtagac

SEQ ID NO: 8161667 - DNA, 22 bp, Homo sapiens
ccaggctggagtgcagtggcac

SEQ ID NO: 8161668 - DNA, 22 bp, Homo sapiens
ccaggctggagtgcagtggcac

SEQ ID NO: 8161669 - DNA, 22 bp, Homo sapiens
ccaggctggagtgcagtggcac

SEQ ID NO: 8161670 - DNA, 22 bp, Homo sapiens
ccaggctggagtgcagtggcac

SEQ ID NO: 8161671 - DNA, 22 bp, Homo sapiens
ccaggctggagtgcagtggcac

SEQ ID NO: 8161672 - DNA, 22 bp, Homo sapiens
ccaggctggagtgcagtggcac

SEQ ID NO: 8161673 - DNA, 22 bp, Homo sapiens
ccaggctggagtgcagtggcac

SEQ ID NO: 8161674 - DNA, 22 bp, Homo sapiens
ccaggctggagtgcagtggcac

SEQ ID NO: 8161675 - DNA, 22 bp, Homo sapiens
ccaggctggagtgcagtggcac

SEQ ID NO: 8161676 - DNA, 22 bp, Homo sapiens
ccaggctggagtgcagtagtgt

SEQ ID NO: 8161677 - DNA, 22 bp, Homo sapiens
ccaggctggagtgcagtagtgt

SEQ ID NO: 8161678 - DNA, 22 bp, Homo sapiens
ccaggctggagtgcaatggtgc

SEQ ID NO: 8161679 - DNA, 22 bp, Homo sapiens
ccaggctggagtgcagtagtgt

SEQ ID NO: 8161680 - DNA, 22 bp, Homo sapiens
ccaggctggagtgcaatggtgc

SEQ ID NO: 8161681 - DNA, 22 bp, Homo sapiens
ccaggctggagtgcaatggtgc

SEQ ID NO: 8161682 - DNA, 22 bp, Homo sapiens
ccaggctggagtgcaatggtgc

SEQ ID NO: 8161683 - DNA, 22 bp, Homo sapiens
ccaggctggattttgcagttca

SEQ ID NO: 8161684 - DNA, 22 bp, Homo sapiens
ccaggctggattttgcagttca

SEQ ID NO: 8161685 - DNA, 22 bp, Homo sapiens
ccaggctggattttgcagttca

SEQ ID NO: 8161686 - DNA, 22 bp, Homo sapiens
ccaggctggagtgtagtcgcat

SEQ ID NO: 8161687 - DNA, 22 bp, Homo sapiens
ccaggctggagtgtagtcgcat

SEQ ID NO: 8161688 - DNA, 22 bp, Homo sapiens
ccaggctggagtgtagtcgcat

SEQ ID NO: 8161689 - DNA, 20 bp, Homo sapiens
ccaggctggcaaatgggggc

SEQ ID NO: 8161690 - DNA, 22 bp, Homo sapiens
ccaggctggattttgcagttca

SEQ ID NO: 8161691 - DNA, 21 bp, Homo sapiens
ccaggctggccatggtattga

SEQ ID NO: 8161692 - DNA, 20 bp, Homo sapiens
ccaggctggcaaatgggggc

SEQ ID NO: 8161693 - DNA, 21 bp, Homo sapiens
ccaggctggccatggtattga

SEQ ID NO: 8161694 - DNA, 22 bp, Homo sapiens
tgacaagcatttttgagtatct

SEQ ID NO: 8161695 - DNA, 22 bp, Homo sapiens
tgacaagaggcagaatcagctg

SEQ ID NO: 8161696 - DNA, 22 bp, Homo sapiens
tgacaagcatttttgagtatct

SEQ ID NO: 8161697 - DNA, 22 bp, Homo sapiens
tgacaagagacccctccgcagg

SEQ ID NO: 8161698 - DNA, 22 bp, Homo sapiens
tgacaagagcattcccacacct

SEQ ID NO: 8161699 - DNA, 22 bp, Homo sapiens
tgacaagttctaataagaaatg

SEQ ID NO: 8161700 - DNA, 22 bp, Homo sapiens
tgacaagttggaaagcagtgca

SEQ ID NO: 8161701 - DNA, 22 bp, Homo sapiens
tgacaagttggaaagcagtgca

SEQ ID NO: 8161702 - DNA, 22 bp, Homo sapiens
tgacaagtcactgttcttcaat

SEQ ID NO: 8161703 - DNA, 22 bp, Homo sapiens
tgacaagtacataatttcatgt

SEQ ID NO: 8161704 - DNA, 22 bp, Homo sapiens
tgacaagtagggtgggatttgt

SEQ ID NO: 8161705 - DNA, 22 bp, Homo sapiens
ccagggctggaccagtgcttgg

SEQ ID NO: 8161706 - DNA, 22 bp, Homo sapiens
ccagggcttcagttagtggtga

SEQ ID NO: 8161707 - DNA, 22 bp, Homo sapiens
ccagggctgctgtgggactcca

SEQ ID NO: 8161708 - DNA, 22 bp, Homo sapiens
ccaggggaaacagggagcactc

SEQ ID NO: 8161709 - DNA, 22 bp, Homo sapiens
ccagggctttgccaaagtccag

SEQ ID NO: 8161710 - DNA, 22 bp, Homo sapiens
ccagggctttgccaaagtccag

SEQ ID NO: 8161711 - DNA, 22 bp, Homo sapiens
ccagggctttatctgcctttga

SEQ ID NO: 8161712 - DNA, 22 bp, Homo sapiens
ccagggctttatctgcctttga

SEQ ID NO: 8161713 - DNA, 22 bp, Homo sapiens
ccagggctttatctgcctttga

SEQ ID NO: 8161714 - DNA, 22 bp, Homo sapiens
ccagggcttcccacgtgccctg

SEQ ID NO: 8161715 - DNA, 22 bp, Homo sapiens
ccagggcttcccacgtgccctg

SEQ ID NO: 8161716 - DNA, 22 bp, Homo sapiens
ccagggcttcccacgtgccctg

SEQ ID NO: 8161717 - DNA, 22 bp, Homo sapiens
ccagggcttcccacgtgccctg

SEQ ID NO: 8161718 - DNA, 22 bp, Homo sapiens
ccagggcttcagttagtggtga

SEQ ID NO: 8161719 - DNA, 19 bp, Homo sapiens
ccagggctttaagttgagg

SEQ ID NO: 8161720 - DNA, 19 bp, Homo sapiens
ccagggctttaagttgagg

SEQ ID NO: 8161721 - DNA, 19 bp, Homo sapiens
ccagggctttaagttgagg

SEQ ID NO: 8161722 - DNA, 22 bp, Homo sapiens
ccagggcttggtggcttgtatc

SEQ ID NO: 8161723 - DNA, 22 bp, Homo sapiens
ccagggcttggtggcttgtatc

SEQ ID NO: 8161724 - DNA, 22 bp, Homo sapiens
tgacagttgagcatgtaagaga

SEQ ID NO: 8161725 - DNA, 22 bp, Homo sapiens
tgacataaaccagtgagcaaaa

SEQ ID NO: 8161726 - DNA, 22 bp, Homo sapiens
tgacataaaccagtgagcaaaa

SEQ ID NO: 8161727 - DNA, 22 bp, Homo sapiens
tgacagtggtgacaggatgggg

SEQ ID NO: 8161728 - DNA, 22 bp, Homo sapiens
ccaggggcctgtgaaggtgccc

SEQ ID NO: 8161729 - DNA, 22 bp, Homo sapiens
tgacagtgtttgcacttcaggt

SEQ ID NO: 8161730 - DNA, 23 bp, Homo sapiens
tgacagtgtatttgactatatgg

SEQ ID NO: 8161731 - DNA, 22 bp, Homo sapiens
tgacataataatccaaacatac

SEQ ID NO: 8161732 - DNA, 22 bp, Homo sapiens
tgacataataatccaaacatac

SEQ ID NO: 8161733 - DNA, 22 bp, Homo sapiens
tgacataatgctttgaagttgc

SEQ ID NO: 8161734 - DNA, 21 bp, Homo sapiens
tgacataatccatagtacaaa

SEQ ID NO: 8161735 - DNA, 20 bp, Homo sapiens
tgacatagctttgcagagtt

SEQ ID NO: 8161736 - DNA, 22 bp, Homo sapiens
tgacatagctattaagtgatgc

SEQ ID NO: 8161737 - DNA, 20 bp, Homo sapiens
tgacatagctcttggggtgc

SEQ ID NO: 8161738 - DNA, 22 bp, Homo sapiens
ccagggggcttggtgaggccat

SEQ ID NO: 8161739 - DNA, 22 bp, Homo sapiens
ccagggggcttggtgaggccat

SEQ ID NO: 8161740 - DNA, 22 bp, Homo sapiens
ccaggggggcgtagatgctggg

SEQ ID NO: 8161741 - DNA, 22 bp, Homo sapiens
ccaggggggcgtagatgctggg

SEQ ID NO: 8161742 - DNA, 22 bp, Homo sapiens
ccaggggggcgtagatgctggg

SEQ ID NO: 8161743 - DNA, 21 bp, Homo sapiens
ccagggtccagctgccatggt

SEQ ID NO: 8161744 - DNA, 22 bp, Homo sapiens
ccagggtaccccaagggcaggt

SEQ ID NO: 8161745 - DNA, 22 bp, Homo sapiens
ccagggtagctgagctaagcct

SEQ ID NO: 8161746 - DNA, 22 bp, Homo sapiens
ccagggtcacaaataactgcag

SEQ ID NO: 8161747 - DNA, 22 bp, Homo sapiens
ccagggtcacaaataactgcag

SEQ ID NO: 8161748 - DNA, 22 bp, Homo sapiens
ccaggtgctagcaatcactgtc

SEQ ID NO: 8161749 - DNA, 22 bp, Homo sapiens
ccaggtctcgggtctgctcgtg

SEQ ID NO: 8161750 - DNA, 22 bp, Homo sapiens
ccaggtgctagcaatcactgtc

SEQ ID NO: 8161751 - DNA, 17 bp, Homo sapiens
ccaggtctccttgcttt

SEQ ID NO: 8161752 - DNA, 21 bp, Homo sapiens
ccagggtccagctgccatggt

SEQ ID NO: 8161753 - DNA, 22 bp, Homo sapiens
ccaggtggaaggtctgtgctct

SEQ ID NO: 8161754 - DNA, 17 bp, Homo sapiens
ccaggtggaatcgtgga

SEQ ID NO: 8161755 - DNA, 22 bp, Homo sapiens
ccaggtggaaggtctgtgctct

SEQ ID NO: 8161756 - DNA, 22 bp, Homo sapiens
ccaggtggaaggtctgtgctct

SEQ ID NO: 8161757 - DNA, 22 bp, Homo sapiens
ccaggtggaaggtctgtgctct

SEQ ID NO: 8161758 - DNA, 22 bp, Homo sapiens
ccaggtggaaggtctgtgctct

SEQ ID NO: 8161759 - DNA, 17 bp, Homo sapiens
ccaggtggaatcgtgga

SEQ ID NO: 8161760 - DNA, 17 bp, Homo sapiens
ccaggtggaatcgtgga

SEQ ID NO: 8161761 - DNA, 22 bp, Homo sapiens
ccaggtggacaaggctttcaca

SEQ ID NO: 8161762 - DNA, 22 bp, Homo sapiens
ccaggtggacaaggctttcaca

SEQ ID NO: 8161763 - DNA, 22 bp, Homo sapiens
ccaggtggacggcgagtacagg

SEQ ID NO: 8161764 - DNA, 22 bp, Homo sapiens
ccaggtggacggcgagtacagg

SEQ ID NO: 8161765 - DNA, 22 bp, Homo sapiens
ccaggtggacaaggctttcaca

SEQ ID NO: 8161766 - DNA, 22 bp, Homo sapiens
ccaggtggaaggtctgtgctct

SEQ ID NO: 8161767 - DNA, 22 bp, Homo sapiens
ccaggtggaaggtctgtgctct

SEQ ID NO: 8161768 - DNA, 19 bp, Homo sapiens
ccaggtggaactgaggtag

SEQ ID NO: 8161769 - DNA, 19 bp, Homo sapiens
ccaggtggaactgaggtag

SEQ ID NO: 8161770 - DNA, 19 bp, Homo sapiens
ccaggtggaactgaggtag

SEQ ID NO: 8161771 - DNA, 19 bp, Homo sapiens
ccaggtggaactgaggtag

SEQ ID NO: 8161772 - DNA, 22 bp, Homo sapiens
ccaggtgctcttgccagggctg

SEQ ID NO: 8161773 - DNA, 22 bp, Homo sapiens
ccaggtgctcttgccagggctg

SEQ ID NO: 8161774 - DNA, 22 bp, Homo sapiens
ccaggtgctcttgccagggctg

SEQ ID NO: 8161775 - DNA, 22 bp, Homo sapiens
ccaggtgctcttgccagggctg

SEQ ID NO: 8161776 - DNA, 22 bp, Homo sapiens
ccaggggctgcagatccatggt

SEQ ID NO: 8161777 - DNA, 22 bp, Homo sapiens
ccaggggctggtgctgagctgg

SEQ ID NO: 8161778 - DNA, 22 bp, Homo sapiens
ccaggggctggtgctgagctgg

SEQ ID NO: 8161779 - DNA, 22 bp, Homo sapiens
ccaggggctggtgctgagctgg

SEQ ID NO: 8161780 - DNA, 22 bp, Homo sapiens
ccaggggctgcagatccatggt

SEQ ID NO: 8161781 - DNA, 22 bp, Homo sapiens
ccaggggctggtgctgagctgg

SEQ ID NO: 8161782 - DNA, 22 bp, Homo sapiens
tgagaatagtaataatttctgg

SEQ ID NO: 8161783 - DNA, 18 bp, Homo sapiens
tgagaatatttatcccac

SEQ ID NO: 8161784 - DNA, 22 bp, Homo sapiens
tgagaatatttgaagatgttag

SEQ ID NO: 8161785 - DNA, 22 bp, Homo sapiens
tgagaatatttgaagatgttag

SEQ ID NO: 8161786 - DNA, 19 bp, Homo sapiens
tgagaaggcagtggggagc

SEQ ID NO: 8161787 - DNA, 19 bp, Homo sapiens
tgagaaggcagtggggagc

SEQ ID NO: 8161788 - DNA, 20 bp, Homo sapiens
tgagaaggggtcagctgtac

SEQ ID NO: 8161789 - DNA, 19 bp, Homo sapiens
tgagaaggtttccgtgggt

SEQ ID NO: 8161790 - DNA, 22 bp, Homo sapiens
tgagaaggtgaaagtgtggaga

SEQ ID NO: 8161791 - DNA, 22 bp, Homo sapiens
tgagaataagagatagtttatt

SEQ ID NO: 8161792 - DNA, 22 bp, Homo sapiens
ccaggtgtgatttggcagtgtc

SEQ ID NO: 8161793 - DNA, 22 bp, Homo sapiens
ccaggtgtgatttcatctgagg

SEQ ID NO: 8161794 - DNA, 22 bp, Homo sapiens
ccaggtgtgagcattctgtctt

SEQ ID NO: 8161795 - DNA, 22 bp, Homo sapiens
ccaggtgtgatttcatctgagg

SEQ ID NO: 8161796 - DNA, 22 bp, Homo sapiens
ccaggtgtgatttcatctgagg

SEQ ID NO: 8161797 - DNA, 22 bp, Homo sapiens
ccaggtgtgagcattctgtctt

SEQ ID NO: 8161798 - DNA, 22 bp, Homo sapiens
ccaggtgtgatttggcagtgtc

SEQ ID NO: 8161799 - DNA, 22 bp, Homo sapiens
ccaggtgtgatttggcagtgtc

SEQ ID NO: 8161800 - DNA, 22 bp, Homo sapiens
ccaggtgtgatttggcagtgtc

SEQ ID NO: 8161801 - DNA, 22 bp, Homo sapiens
ccaggtgtgccagcagggactg

SEQ ID NO: 8161802 - DNA, 22 bp, Homo sapiens
ccaggtgtgccagcagggactg

SEQ ID NO: 8161803 - DNA, 22 bp, Homo sapiens
ccaggtgtgccagcagggactg

SEQ ID NO: 8161804 - DNA, 22 bp, Homo sapiens
ccaggtgtgccagcagggactg

SEQ ID NO: 8161805 - DNA, 22 bp, Homo sapiens
ccaggtgtgctctgcagtggat

SEQ ID NO: 8161806 - DNA, 22 bp, Homo sapiens
ccaggtgtgctctgcagtggat

SEQ ID NO: 8161807 - DNA, 22 bp, Homo sapiens
ccaggtgtgctctgcagtggat

SEQ ID NO: 8161808 - DNA, 22 bp, Homo sapiens
ccaggtgtgctctgcagtggat

SEQ ID NO: 8161809 - DNA, 22 bp, Homo sapiens
ccaggtgtggggaggactcaca

SEQ ID NO: 8161810 - DNA, 22 bp, Homo sapiens
ccaggtgtggccacatggctgg

SEQ ID NO: 8161811 - DNA, 22 bp, Homo sapiens
ccaggtgtggggaggactcaca

SEQ ID NO: 8161812 - DNA, 22 bp, Homo sapiens
ccaggtgtggggaggactcaca

SEQ ID NO: 8161813 - DNA, 22 bp, Homo sapiens
ccaggtgtggggaggactcaca

SEQ ID NO: 8161814 - DNA, 22 bp, Homo sapiens
ccaggtgtggccacatggctgg

SEQ ID NO: 8161815 - DNA, 22 bp, Homo sapiens
ccaggtgtggccacatggctgg

SEQ ID NO: 8161816 - DNA, 22 bp, Homo sapiens
ccaggtgtgctctgcagtggat

SEQ ID NO: 8161817 - DNA, 22 bp, Homo sapiens
ccaggtgtgtacagaacagcac

SEQ ID NO: 8161818 - DNA, 22 bp, Homo sapiens
ccaggtgtggtggcatacacct

SEQ ID NO: 8161819 - DNA, 22 bp, Homo sapiens
ccaggtgtggtggcatacacct

SEQ ID NO: 8161820 - DNA, 22 bp, Homo sapiens
ccaggtgtggtggcatacacct

SEQ ID NO: 8161821 - DNA, 22 bp, Homo sapiens
tgaggactacctggggtgggag

SEQ ID NO: 8161822 - DNA, 22 bp, Homo sapiens
ccaggtgtgtacagaacagcac

SEQ ID NO: 8161823 - DNA, 22 bp, Homo sapiens
tgaggactacctggggtgggag

SEQ ID NO: 8161824 - DNA, 22 bp, Homo sapiens
tgaggactacctggggtgggag

SEQ ID NO: 8161825 - DNA, 22 bp, Homo sapiens
tgaggactttccatgttaatgt

SEQ ID NO: 8161826 - DNA, 22 bp, Homo sapiens
tgaggcagaaattcctgttttc

SEQ ID NO: 8161827 - DNA, 22 bp, Homo sapiens
tgaggcagagtaagatacatga

SEQ ID NO: 8161828 - DNA, 22 bp, Homo sapiens
tgaggcagcaattgattattca

SEQ ID NO: 8161829 - DNA, 22 bp, Homo sapiens
tgaggcagcaattgtattgtat

SEQ ID NO: 8161830 - DNA, 22 bp, Homo sapiens
tgaggcagcaattgtattgtat

SEQ ID NO: 8161831 - DNA, 22 bp, Homo sapiens
ccaggtgtctgtggccagccct

SEQ ID NO: 8161832 - DNA, 22 bp, Homo sapiens
ccaggtgtctgtggccagccct

SEQ ID NO: 8161833 - DNA, 22 bp, Homo sapiens
ccaggtgtgagcattctgtctt

SEQ ID NO: 8161834 - DNA, 22 bp, Homo sapiens
ccaggtgtctgtggccagccct

SEQ ID NO: 8161835 - DNA, 22 bp, Homo sapiens
ccaggtgtctgtctctttttca

SEQ ID NO: 8161836 - DNA, 22 bp, Homo sapiens
ccaggtgtccccgtcactgcag

SEQ ID NO: 8161837 - DNA, 22 bp, Homo sapiens
ccaggtgtccccgtcactgcag

SEQ ID NO: 8161838 - DNA, 22 bp, Homo sapiens
ccaggtgtctgtctctttttca

SEQ ID NO: 8161839 - DNA, 22 bp, Homo sapiens
ccaggtgtctgtctctttttca

SEQ ID NO: 8161840 - DNA, 22 bp, Homo sapiens
ccaggtgtccccgtcactgcag

SEQ ID NO: 8161841 - DNA, 22 bp, Homo sapiens
ccaggtgtcatgcgtgtgaccc

SEQ ID NO: 8161842 - DNA, 22 bp, Homo sapiens
ccaggtgtaggacaccaaggga

SEQ ID NO: 8161843 - DNA, 22 bp, Homo sapiens
ccaggtgtaggacaccaaggga

SEQ ID NO: 8161844 - DNA, 22 bp, Homo sapiens
ccaggtgtaggacaccaaggga

SEQ ID NO: 8161845 - DNA, 22 bp, Homo sapiens
ccaggtgtcatgcgtgtgaccc

SEQ ID NO: 8161846 - DNA, 22 bp, Homo sapiens
ccaggtgtcatgcgtgtgaccc

SEQ ID NO: 8161847 - DNA, 22 bp, Homo sapiens
ccaggtgtcatggataatgggt

SEQ ID NO: 8161848 - DNA, 22 bp, Homo sapiens
ccaggtgtcatggataatgggt

SEQ ID NO: 8161849 - DNA, 22 bp, Homo sapiens
ccaggtgtcatggataatgggt

SEQ ID NO: 8161850 - DNA, 22 bp, Homo sapiens
ccaggtgtagcactgctcacag

SEQ ID NO: 8161851 - DNA, 22 bp, Homo sapiens
ccaggtgtagcactgctcacag

SEQ ID NO: 8161852 - DNA, 22 bp, Homo sapiens
ccaggtgtagcactgctcacag

SEQ ID NO: 8161853 - DNA, 22 bp, Homo sapiens
ccaggtgtagcactgctcacag

SEQ ID NO: 8161854 - DNA, 22 bp, Homo sapiens
ccaggtgggcgtgtcttcacct

SEQ ID NO: 8161855 - DNA, 22 bp, Homo sapiens
ccaggtgggcgtgtcttcacct

SEQ ID NO: 8161856 - DNA, 22 bp, Homo sapiens
ccaggtgtaagacatggtccta

SEQ ID NO: 8161857 - DNA, 22 bp, Homo sapiens
ccaggtgtaagacatggtccta

SEQ ID NO: 8161858 - DNA, 22 bp, Homo sapiens
ccaggtgtaagacatggtccta

SEQ ID NO: 8161859 - DNA, 22 bp, Homo sapiens
tgagacgaagtcttgctctgtt

SEQ ID NO: 8161860 - DNA, 22 bp, Homo sapiens
tgagacgaagtcttgctctgtt

SEQ ID NO: 8161861 - DNA, 22 bp, Homo sapiens
tgagacgaagtcttgctctgtt

SEQ ID NO: 8161862 - DNA, 17 bp, Homo sapiens
ccaggtgggaggtgggg

SEQ ID NO: 8161863 - DNA, 22 bp, Homo sapiens
tgagacgaagtcttgctctgtt

SEQ ID NO: 8161864 - DNA, 17 bp, Homo sapiens
ccaggtgggaggtgggg

SEQ ID NO: 8161865 - DNA, 22 bp, Homo sapiens
tgagacgaagtcttgctctgtt

SEQ ID NO: 8161866 - DNA, 22 bp, Homo sapiens
tgagacagtttttctatttcca

SEQ ID NO: 8161867 - DNA, 22 bp, Homo sapiens
tgagacagttggtgaaatctaa

SEQ ID NO: 8161868 - DNA, 22 bp, Homo sapiens
tgagacagttctgcagctgggt

SEQ ID NO: 8161869 - DNA, 22 bp, Homo sapiens
tgagacagttctgcagctgggt

SEQ ID NO: 8161870 - DNA, 22 bp, Homo sapiens
ccaggtggacggcgagtacagg

SEQ ID NO: 8161871 - DNA, 22 bp, Homo sapiens
ccaggtggacggcgagtacagg

SEQ ID NO: 8161872 - DNA, 22 bp, Homo sapiens
ccaggtggacggcgagtacagg

SEQ ID NO: 8161873 - DNA, 22 bp, Homo sapiens
tgagacagttctgcagctgggt

SEQ ID NO: 8161874 - DNA, 22 bp, Homo sapiens
tgagacagttctgcagctgggt

SEQ ID NO: 8161875 - DNA, 22 bp, Homo sapiens
tgagacatgtgaatatttgtac

SEQ ID NO: 8161876 - DNA, 22 bp, Homo sapiens
tgagacatgtgaatatttgtac

SEQ ID NO: 8161877 - DNA, 20 bp, Homo sapiens
tgagacccgctgacaagttc

SEQ ID NO: 8161878 - DNA, 23 bp, Homo sapiens
tgagaccctaatttagcaagtgt

SEQ ID NO: 8161879 - DNA, 22 bp, Homo sapiens
tgagaccttggggagccctgtt

SEQ ID NO: 8161880 - DNA, 20 bp, Homo sapiens
tgatttctcttctattcctt

SEQ ID NO: 8161881 - DNA, 22 bp, Homo sapiens
tgatttctctccgttatttcag

SEQ ID NO: 8161882 - DNA, 22 bp, Homo sapiens
tgatttctcttggcaatatgtt

SEQ ID NO: 8161883 - DNA, 20 bp, Homo sapiens
tgatttctcttctattcctt

SEQ ID NO: 8161884 - DNA, 20 bp, Homo sapiens
tgatttctcttctattcctt

SEQ ID NO: 8161885 - DNA, 22 bp, Homo sapiens
tgatttcttccttgtcattaga

SEQ ID NO: 8161886 - DNA, 22 bp, Homo sapiens
tgatttcttccttgtcattaga

SEQ ID NO: 8161887 - DNA, 22 bp, Homo sapiens
tgatttcttccttgtcattaga

SEQ ID NO: 8161888 - DNA, 22 bp, Homo sapiens
tgatttcttccttgtcattaga

SEQ ID NO: 8161889 - DNA, 21 bp, Homo sapiens
tgatttctgccaagttcacta

SEQ ID NO: 8161890 - DNA, 22 bp, Homo sapiens
tgatttctcttggcaatatgtt

SEQ ID NO: 8161891 - DNA, 22 bp, Homo sapiens
tgatttctcatattgttcaaaa

SEQ ID NO: 8161892 - DNA, 21 bp, Homo sapiens
tgatttctagatattggccca

SEQ ID NO: 8161893 - DNA, 21 bp, Homo sapiens
tgatttctagatattggccca

SEQ ID NO: 8161894 - DNA, 22 bp, Homo sapiens
tgattcaagattggttagctgt

SEQ ID NO: 8161895 - DNA, 22 bp, Homo sapiens
ccattggagccaagagttttac

SEQ ID NO: 8161896 - DNA, 22 bp, Homo sapiens
ccattgtaaattctgtggaagt

SEQ ID NO: 8161897 - DNA, 23 bp, Homo sapiens
tgattttaaaaagtaagttatca

SEQ ID NO: 8161898 - DNA, 23 bp, Homo sapiens
tgattttaaaaagtaagttatca

SEQ ID NO: 8161899 - DNA, 23 bp, Homo sapiens
tgattttaaaaagtaagttatca

SEQ ID NO: 8161900 - DNA, 22 bp, Homo sapiens
tgattttacttagcatgatgtt

SEQ ID NO: 8161901 - DNA, 22 bp, Homo sapiens
tgattttacttagcatgatgtt

SEQ ID NO: 8161902 - DNA, 22 bp, Homo sapiens
tgattttattggtgaggaaatt

SEQ ID NO: 8161903 - DNA, 22 bp, Homo sapiens
tgcaaagatttatctttctcca

SEQ ID NO: 8161904 - DNA, 22 bp, Homo sapiens
tgattttattgaaacttcactt

SEQ ID NO: 8161905 - DNA, 22 bp, Homo sapiens
tgattttacttagcatgatgtt

SEQ ID NO: 8161906 - DNA, 22 bp, Homo sapiens
tgatttgcatggagaataacag

SEQ ID NO: 8161907 - DNA, 22 bp, Homo sapiens
tgatttgaggtacataaatcca

SEQ ID NO: 8161908 - DNA, 22 bp, Homo sapiens
tgatttgaattttaaaacactg

SEQ ID NO: 8161909 - DNA, 22 bp, Homo sapiens
ccatgtgttgagattccagcct

SEQ ID NO: 8161910 - DNA, 22 bp, Homo sapiens
ccatgtgttcaataagggagtt

SEQ ID NO: 8161911 - DNA, 22 bp, Homo sapiens
ccatgtgttgattctctgcaga

SEQ ID NO: 8161912 - DNA, 22 bp, Homo sapiens
ccatgtgttgagattccagcct

SEQ ID NO: 8161913 - DNA, 22 bp, Homo sapiens
ccattaaaatggaatgtagtga

SEQ ID NO: 8161914 - DNA, 22 bp, Homo sapiens
ccattaaaatggaatgtagtga

SEQ ID NO: 8161915 - DNA, 22 bp, Homo sapiens
ccattaaaatggaatgtagtga

SEQ ID NO: 8161916 - DNA, 22 bp, Homo sapiens
ccattaaacttgtggacccagt

SEQ ID NO: 8161917 - DNA, 22 bp, Homo sapiens
ccattaaagcaccactgtaata

SEQ ID NO: 8161918 - DNA, 22 bp, Homo sapiens
ccattatccacgggcttcctga

SEQ ID NO: 8161919 - DNA, 22 bp, Homo sapiens
ccattcacttttgccctgtcct

SEQ ID NO: 8161920 - DNA, 23 bp, Homo sapiens
ccattcatctcagtcattgcttt

SEQ ID NO: 8161921 - DNA, 19 bp, Homo sapiens
ccattgtaaagaaaaatgt

SEQ ID NO: 8161922 - DNA, 19 bp, Homo sapiens
ccattctgtctctgccaca

SEQ ID NO: 8161923 - DNA, 22 bp, Homo sapiens
ccattctgtgtctctccacagc

SEQ ID NO: 8161924 - DNA, 22 bp, Homo sapiens
tgcaaatagcctatatttatag

SEQ ID NO: 8161925 - DNA, 22 bp, Homo sapiens
tgcaaatagcctatatttatag

SEQ ID NO: 8161926 - DNA, 22 bp, Homo sapiens
tgcaaataggggacaactcttt

SEQ ID NO: 8161927 - DNA, 22 bp, Homo sapiens
tgcaaatattagcattcgatat

SEQ ID NO: 8161928 - DNA, 22 bp, Homo sapiens
cccacccctggacaggtgagtg

SEQ ID NO: 8161929 - DNA, 22 bp, Homo sapiens
cccacccctggacaggtgagtg

SEQ ID NO: 8161930 - DNA, 22 bp, Homo sapiens
cccacccctggacaggtgagtg

SEQ ID NO: 8161931 - DNA, 22 bp, Homo sapiens
cccacttcatgggcaggaagga

SEQ ID NO: 8161932 - DNA, 22 bp, Homo sapiens
cccactgtttccctgaggctct

SEQ ID NO: 8161933 - DNA, 22 bp, Homo sapiens
cccactgttgcctcaaatatca

SEQ ID NO: 8161934 - DNA, 20 bp, Homo sapiens
cccagaagcttaacagagca

SEQ ID NO: 8161935 - DNA, 20 bp, Homo sapiens
cccagaagcttaacagagca

SEQ ID NO: 8161936 - DNA, 22 bp, Homo sapiens
cccaccctcaagggtgtctata

SEQ ID NO: 8161937 - DNA, 22 bp, Homo sapiens
cccaccctcaagggtgtctata

SEQ ID NO: 8161938 - DNA, 22 bp, Homo sapiens
cccactgtggaagaaaggggag

SEQ ID NO: 8161939 - DNA, 22 bp, Homo sapiens
cccactgtgttgcagtctagtg

SEQ ID NO: 8161940 - DNA, 22 bp, Homo sapiens
cccactgtgttgctgttaatct

SEQ ID NO: 8161941 - DNA, 23 bp, Homo sapiens
tgcaaataacaaggagtttaagg

SEQ ID NO: 8161942 - DNA, 22 bp, Homo sapiens
tgcaaatacaaaatggtacagc

SEQ ID NO: 8161943 - DNA, 22 bp, Homo sapiens
tgcaaataaatttctgttcatt

SEQ ID NO: 8161944 - DNA, 23 bp, Homo sapiens
tgcaaataacaaggagtttaagg

SEQ ID NO: 8161945 - DNA, 22 bp, Homo sapiens
tgcaaataaatttctgttcatt

SEQ ID NO: 8161946 - DNA, 22 bp, Homo sapiens
tgcaaataaatttctgttcatt

SEQ ID NO: 8161947 - DNA, 22 bp, Homo sapiens
tgcaaagcaatgtaggtcagct

SEQ ID NO: 8161948 - DNA, 22 bp, Homo sapiens
tgcaaaggggacagagtccact

SEQ ID NO: 8161949 - DNA, 22 bp, Homo sapiens
tgcacacattaaggatacacag

SEQ ID NO: 8161950 - DNA, 22 bp, Homo sapiens
tgcacacattctatggggctga

SEQ ID NO: 8161951 - DNA, 22 bp, Homo sapiens
tgcacacattaaggatacacag

SEQ ID NO: 8161952 - DNA, 22 bp, Homo sapiens
tgcacacattaaggatacacag

SEQ ID NO: 8161953 - DNA, 22 bp, Homo sapiens
cccagactcatccctgggagct

SEQ ID NO: 8161954 - DNA, 22 bp, Homo sapiens
cccagactcctctggctggtgg

SEQ ID NO: 8161955 - DNA, 22 bp, Homo sapiens
cccagactcatccctgggagct

SEQ ID NO: 8161956 - DNA, 22 bp, Homo sapiens
tgcacacatgtatgtatatgtg

SEQ ID NO: 8161957 - DNA, 22 bp, Homo sapiens
tgcacacatgtatgtatatgtg

SEQ ID NO: 8161958 - DNA, 22 bp, Homo sapiens
tgcacacatatgagcatgtgtg

SEQ ID NO: 8161959 - DNA, 22 bp, Homo sapiens
tgcacacatgtttacaagcatc

SEQ ID NO: 8161960 - DNA, 22 bp, Homo sapiens
tgcacacatgtatgtatatgtg

SEQ ID NO: 8161961 - DNA, 22 bp, Homo sapiens
tgcacacatgtttacaagcatc

SEQ ID NO: 8161962 - DNA, 22 bp, Homo sapiens
tgcacacatgtttacaagcatc

SEQ ID NO: 8161963 - DNA, 22 bp, Homo sapiens
tgcacacatgtttacaagcatc

SEQ ID NO: 8161964 - DNA, 22 bp, Homo sapiens
tgcacacatgtttacaagcatc

SEQ ID NO: 8161965 - DNA, 22 bp, Homo sapiens
cccagacccagagggaggcagg

SEQ ID NO: 8161966 - DNA, 22 bp, Homo sapiens
cccagacataacagcagagagg

SEQ ID NO: 8161967 - DNA, 22 bp, Homo sapiens
cccagaattattctcttctcct

SEQ ID NO: 8161968 - DNA, 22 bp, Homo sapiens
cccagaaggtcgaggctgcagt

SEQ ID NO: 8161969 - DNA, 22 bp, Homo sapiens
cccagaaggtcgaggctgcagt

SEQ ID NO: 8161970 - DNA, 22 bp, Homo sapiens
cccagaaggctaagcgtggatt

SEQ ID NO: 8161971 - DNA, 22 bp, Homo sapiens
cccagaaggcttgccaggaagc

SEQ ID NO: 8161972 - DNA, 21 bp, Homo sapiens
cccagaagttccatggggggc

SEQ ID NO: 8161973 - DNA, 22 bp, Homo sapiens
cccagaaggtcgaggctgcagt

SEQ ID NO: 8161974 - DNA, 20 bp, Homo sapiens
cccagaagtcacctccactc

SEQ ID NO: 8161975 - DNA, 22 bp, Homo sapiens
ccagtgtttccccagaagagag

SEQ ID NO: 8161976 - DNA, 22 bp, Homo sapiens
ccagtgtttccgtcagtacacg

SEQ ID NO: 8161977 - DNA, 22 bp, Homo sapiens
ccagtgttttcatcctcccttg

SEQ ID NO: 8161978 - DNA, 22 bp, Homo sapiens
ccagtgtttgatgggattttca

SEQ ID NO: 8161979 - DNA, 22 bp, Homo sapiens
ccatcctggccttgctgtccac

SEQ ID NO: 8161980 - DNA, 22 bp, Homo sapiens
ccatgcagtgctggagctgatt

SEQ ID NO: 8161981 - DNA, 22 bp, Homo sapiens
ccatcctggcctcgctgtccac

SEQ ID NO: 8161982 - DNA, 22 bp, Homo sapiens
ccatgcccacgttgtggctcag

SEQ ID NO: 8161983 - DNA, 22 bp, Homo sapiens
ccatgcatgcctgaaattgctg

SEQ ID NO: 8161984 - DNA, 22 bp, Homo sapiens
ccatgcatggcactggactggg

SEQ ID NO: 8161985 - DNA, 22 bp, Homo sapiens
ccatgctgtgacacagtagtta

SEQ ID NO: 8161986 - DNA, 22 bp, Homo sapiens
ccatgctgtgacacagtagtta

SEQ ID NO: 8161987 - DNA, 22 bp, Homo sapiens
ccatgctccttaccactcactt

SEQ ID NO: 8161988 - DNA, 22 bp, Homo sapiens
ccatgcctggactccactctca

SEQ ID NO: 8161989 - DNA, 22 bp, Homo sapiens
ccatgccctaaaggactggcag

SEQ ID NO: 8161990 - DNA, 22 bp, Homo sapiens
ccatgccctaaaggactggcag

SEQ ID NO: 8161991 - DNA, 22 bp, Homo sapiens
ccatggcctgaaggagtgcatc

SEQ ID NO: 8161992 - DNA, 22 bp, Homo sapiens
tgaggtcacagctggggatgga

SEQ ID NO: 8161993 - DNA, 22 bp, Homo sapiens
tgaggtatgaggttctatgatc

SEQ ID NO: 8161994 - DNA, 22 bp, Homo sapiens
tgaggtatgctgaactctgttt

SEQ ID NO: 8161995 - DNA, 22 bp, Homo sapiens
tgaggtatggtaaggtaaaatc

SEQ ID NO: 8161996 - DNA, 22 bp, Homo sapiens
tgaggtcaagcccagagcagca

SEQ ID NO: 8161997 - DNA, 22 bp, Homo sapiens
ccatgtggtgggaaggagaatg

SEQ ID NO: 8161998 - DNA, 22 bp, Homo sapiens
ccatgtgtcgggcctgcagtgg

SEQ ID NO: 8161999 - DNA, 22 bp, Homo sapiens
ccatgtgtaaattagataactc

SEQ ID NO: 8162000 - DNA, 22 bp, Homo sapiens
ccatgtgttcaataagggagtt

SEQ ID NO: 8162001 - DNA, 22 bp, Homo sapiens
ccatgtgtctcccctggaagta

SEQ ID NO: 8162002 - DNA, 18 bp, Homo sapiens
ccatgtgttccttttggg

SEQ ID NO: 8162003 - DNA, 22 bp, Homo sapiens
ccatggctaagtatctgtagaa

SEQ ID NO: 8162004 - DNA, 22 bp, Homo sapiens
ccatggctaagtatctgtagaa

SEQ ID NO: 8162005 - DNA, 22 bp, Homo sapiens
ccatggctaagtatctgtagaa

SEQ ID NO: 8162006 - DNA, 22 bp, Homo sapiens
ccatggcctgaaggagtgcatc

SEQ ID NO: 8162007 - DNA, 22 bp, Homo sapiens
ccatgtggctgtgtggtttatt

SEQ ID NO: 8162008 - DNA, 22 bp, Homo sapiens
ccatgtgggattttggtgtctg

SEQ ID NO: 8162009 - DNA, 22 bp, Homo sapiens
ccatgtgggattttggtgtctg

SEQ ID NO: 8162010 - DNA, 22 bp, Homo sapiens
tgaggtaggtggtgaaaaatga

SEQ ID NO: 8162011 - DNA, 22 bp, Homo sapiens
tgaggtaggtggtaagagatac

SEQ ID NO: 8162012 - DNA, 22 bp, Homo sapiens
tgaggtaggtgtcgagagaggt

SEQ ID NO: 8162013 - DNA, 22 bp, Homo sapiens
tgaggtaggtgtcgagagaggt

SEQ ID NO: 8162014 - DNA, 22 bp, Homo sapiens
tgaggtagtgtttagtccagtc

SEQ ID NO: 8162015 - DNA, 22 bp, Homo sapiens
tgaggtatacgttggttcagtc

SEQ ID NO: 8162016 - DNA, 22 bp, Homo sapiens
tgaggtagtgtttagtccagtc

SEQ ID NO: 8162017 - DNA, 20 bp, Homo sapiens
ccagtctctggccagcatca

SEQ ID NO: 8162018 - DNA, 22 bp, Homo sapiens
ccagtctcttccctcctgccag

SEQ ID NO: 8162019 - DNA, 23 bp, Homo sapiens
ccagtctctttccaaaatcacat

SEQ ID NO: 8162020 - DNA, 23 bp, Homo sapiens
ccagtctcacgtatacaggattt

SEQ ID NO: 8162021 - DNA, 23 bp, Homo sapiens
ccagtctcacgtatacaggattt

SEQ ID NO: 8162022 - DNA, 19 bp, Homo sapiens
ccagtctccttgcagcatc

SEQ ID NO: 8162023 - DNA, 22 bp, Homo sapiens
ccagtcctgtgtgaccctgcac

SEQ ID NO: 8162024 - DNA, 22 bp, Homo sapiens
ccagtcctgtgtgaccctgcac

SEQ ID NO: 8162025 - DNA, 22 bp, Homo sapiens
ccagtcctgctccctgaccacc

SEQ ID NO: 8162026 - DNA, 22 bp, Homo sapiens
ccagtcctgctccctgaccacc

SEQ ID NO: 8162027 - DNA, 19 bp, Homo sapiens
ccagtcctctttgggcctg

SEQ ID NO: 8162028 - DNA, 22 bp, Homo sapiens
ccagtcctcagatggtctgtgc

SEQ ID NO: 8162029 - DNA, 22 bp, Homo sapiens
ccagtcccgcatggtccagaat

SEQ ID NO: 8162030 - DNA, 22 bp, Homo sapiens
tgaggcagcctgcattaaagag

SEQ ID NO: 8162031 - DNA, 22 bp, Homo sapiens
ccagtcctagaagaggagtcga

SEQ ID NO: 8162032 - DNA, 22 bp, Homo sapiens
ccagtcctagttctaccttaca

SEQ ID NO: 8162033 - DNA, 22 bp, Homo sapiens
tgaggcagcattcttcaagaca

SEQ ID NO: 8162034 - DNA, 22 bp, Homo sapiens
tgaggcagcaattgtattgtat

SEQ ID NO: 8162035 - DNA, 22 bp, Homo sapiens
tgaggcagcattcttcaagaca

SEQ ID NO: 8162036 - DNA, 22 bp, Homo sapiens
tgaggcagcccactttccttag

SEQ ID NO: 8162037 - DNA, 22 bp, Homo sapiens
tgaggcagcccactttccttag

SEQ ID NO: 8162038 - DNA, 22 bp, Homo sapiens
tgagggctgcttccagagctag

SEQ ID NO: 8162039 - DNA, 22 bp, Homo sapiens
tgagggctccccgctgctgtgt

SEQ ID NO: 8162040 - DNA, 22 bp, Homo sapiens
tgagggctgacaggaggacagc

SEQ ID NO: 8162041 - DNA, 22 bp, Homo sapiens
tgagggctccccgctgctgtgt

SEQ ID NO: 8162042 - DNA, 22 bp, Homo sapiens
tgagggctgcttccagagctag

SEQ ID NO: 8162043 - DNA, 22 bp, Homo sapiens
tgagggctgcttccagagctag

SEQ ID NO: 8162044 - DNA, 22 bp, Homo sapiens
ccagtgttgcataggatgggga

SEQ ID NO: 8162045 - DNA, 22 bp, Homo sapiens
ccagtgtttacagttgaacaaa

SEQ ID NO: 8162046 - DNA, 22 bp, Homo sapiens
ccagtgttggaggatggcttgc

SEQ ID NO: 8162047 - DNA, 22 bp, Homo sapiens
ccagtgtttaggaataaaatgt

SEQ ID NO: 8162048 - DNA, 22 bp, Homo sapiens
ccagtgttccctcgggttcatg

SEQ ID NO: 8162049 - DNA, 22 bp, Homo sapiens
ccagtgttccatggagtgatta

SEQ ID NO: 8162050 - DNA, 22 bp, Homo sapiens
ccagtgttctggtgttcatttc

SEQ ID NO: 8162051 - DNA, 22 bp, Homo sapiens
ccagtgttgaacagtatttgga

SEQ ID NO: 8162052 - DNA, 20 bp, Homo sapiens
tgagggctaaccagactctg

SEQ ID NO: 8162053 - DNA, 22 bp, Homo sapiens
tgagggctaaattgtggcaggt

SEQ ID NO: 8162054 - DNA, 22 bp, Homo sapiens
tgagggcagagcactggggagc

SEQ ID NO: 8162055 - DNA, 22 bp, Homo sapiens
tgagggcagagcactggggagc

SEQ ID NO: 8162056 - DNA, 22 bp, Homo sapiens
tgagggctaaattgtggcaggt

SEQ ID NO: 8162057 - DNA, 22 bp, Homo sapiens
tgagggccgaggagctgtgggt

SEQ ID NO: 8162058 - DNA, 22 bp, Homo sapiens
tgagggcacctgggattaatgg

SEQ ID NO: 8162059 - DNA, 22 bp, Homo sapiens
tgagggcaaagtggtgctgagg

SEQ ID NO: 8162060 - DNA, 22 bp, Homo sapiens
tgagggcaaagtggtgctgagg

SEQ ID NO: 8162061 - DNA, 22 bp, Homo sapiens
tgagggattgatgtttgacatg

SEQ ID NO: 8162062 - DNA, 22 bp, Homo sapiens
tgagggatggtgagagtctgat

SEQ ID NO: 8162063 - DNA, 22 bp, Homo sapiens
tgagggatggtgagagtctgat

SEQ ID NO: 8162064 - DNA, 23 bp, Homo sapiens
tgaggctgattgatttttgctca

SEQ ID NO: 8162065 - DNA, 22 bp, Homo sapiens
ccagtctgaggcctggtgaggg

SEQ ID NO: 8162066 - DNA, 23 bp, Homo sapiens
tgaggctgattgatttttgctca

SEQ ID NO: 8162067 - DNA, 22 bp, Homo sapiens
ccagctgcaggggagcagtgga

SEQ ID NO: 8162068 - DNA, 22 bp, Homo sapiens
ccagctgcagaatgttggggaa

SEQ ID NO: 8162069 - DNA, 22 bp, Homo sapiens
ccagctgcaggggagcagtgga

SEQ ID NO: 8162070 - DNA, 22 bp, Homo sapiens
ccagctctgccaagcgtcagct

SEQ ID NO: 8162071 - DNA, 22 bp, Homo sapiens
ccagctgcccaagaggcatcct

SEQ ID NO: 8162072 - DNA, 22 bp, Homo sapiens
ccagctgcatgacattaggtga

SEQ ID NO: 8162073 - DNA, 22 bp, Homo sapiens
ccagctgcatcctattcactgc

SEQ ID NO: 8162074 - DNA, 22 bp, Homo sapiens
ccagctgcatcctattcactgc

SEQ ID NO: 8162075 - DNA, 22 bp, Homo sapiens
ccagctgcatcctattcactgc

SEQ ID NO: 8162076 - DNA, 20 bp, Homo sapiens
ccagctgcagttcttaatga

SEQ ID NO: 8162077 - DNA, 22 bp, Homo sapiens
ccagctgcaggtgttccagatg

SEQ ID NO: 8162078 - DNA, 22 bp, Homo sapiens
ccagctgcaggggagcagtgga

SEQ ID NO: 8162079 - DNA, 22 bp, Homo sapiens
ccagctgcaggggagcagtgga

SEQ ID NO: 8162080 - DNA, 22 bp, Homo sapiens
ccagctgcaggtgttccagatg

SEQ ID NO: 8162081 - DNA, 22 bp, Homo sapiens
ccagctgcaggtgttccagatg

SEQ ID NO: 8162082 - DNA, 22 bp, Homo sapiens
ccagctctctgtcctccccaca

SEQ ID NO: 8162083 - DNA, 22 bp, Homo sapiens
ccagctctcttcaagcccactc

SEQ ID NO: 8162084 - DNA, 22 bp, Homo sapiens
ccagctctcttcaagcccactc

SEQ ID NO: 8162085 - DNA, 22 bp, Homo sapiens
ccagctctctttgaagcataaa

SEQ ID NO: 8162086 - DNA, 22 bp, Homo sapiens
ccagctctctttgaagcataaa

SEQ ID NO: 8162087 - DNA, 22 bp, Homo sapiens
ccagctctgcatgtttcccttg

SEQ ID NO: 8162088 - DNA, 22 bp, Homo sapiens
ccagctctgccaagcgtcagct

SEQ ID NO: 8162089 - DNA, 22 bp, Homo sapiens
ccagctctgccaagcgtcagct

SEQ ID NO: 8162090 - DNA, 22 bp, Homo sapiens
ccagctctgcagggcctggggt

SEQ ID NO: 8162091 - DNA, 22 bp, Homo sapiens
ccagctctgcagggcctggggt

SEQ ID NO: 8162092 - DNA, 22 bp, Homo sapiens
tctggcagcaagtctgtttctc

SEQ ID NO: 8162093 - DNA, 22 bp, Homo sapiens
tctggcagcaagtctgtttctc

SEQ ID NO: 8162094 - DNA, 22 bp, Homo sapiens
tctggcagcaagtctgtttctc

SEQ ID NO: 8162095 - DNA, 22 bp, Homo sapiens
tctggaggccatagggaaggat

SEQ ID NO: 8162096 - DNA, 22 bp, Homo sapiens
tctggaggccatagggaaggat

SEQ ID NO: 8162097 - DNA, 22 bp, Homo sapiens
tctggcagcagcatcagtggct

SEQ ID NO: 8162098 - DNA, 22 bp, Homo sapiens
tctggcagcagcatcagtggct

SEQ ID NO: 8162099 - DNA, 22 bp, Homo sapiens
tctggcagcagcatcagtggct

SEQ ID NO: 8162100 - DNA, 22 bp, Homo sapiens
tctggaggccatagggaaggat

SEQ ID NO: 8162101 - DNA, 22 bp, Homo sapiens
ccagctgctgtgcagggaggct

SEQ ID NO: 8162102 - DNA, 22 bp, Homo sapiens
ccagctgctgtgcagggaggct

SEQ ID NO: 8162103 - DNA, 22 bp, Homo sapiens
ccagctgctgcaccgtgcatgg

SEQ ID NO: 8162104 - DNA, 22 bp, Homo sapiens
ccagctgctgtgaggaccacag

SEQ ID NO: 8162105 - DNA, 22 bp, Homo sapiens
ccagctgctgtgaggaccacag

SEQ ID NO: 8162106 - DNA, 22 bp, Homo sapiens
ccagctgctgacatgggcaggt

SEQ ID NO: 8162107 - DNA, 22 bp, Homo sapiens
ccagctgctgacatgggcaggt

SEQ ID NO: 8162108 - DNA, 22 bp, Homo sapiens
ccagctgctctcttctccgcca

SEQ ID NO: 8162109 - DNA, 22 bp, Homo sapiens
ccagctgctatcatgccatttc

SEQ ID NO: 8162110 - DNA, 21 bp, Homo sapiens
ccagctgctccttgaggttcc

SEQ ID NO: 8162111 - DNA, 17 bp, Homo sapiens
ccagctgctccctcaga

SEQ ID NO: 8162112 - DNA, 22 bp, Homo sapiens
ccagctgcgggcatcgagagtt

SEQ ID NO: 8162113 - DNA, 22 bp, Homo sapiens
ccagctgcggtctcccaaagtt

SEQ ID NO: 8162114 - DNA, 22 bp, Homo sapiens
ccagctgctaacacaaaggagt

SEQ ID NO: 8162115 - DNA, 22 bp, Homo sapiens
ccagctgctaacacaaaggagt

SEQ ID NO: 8162116 - DNA, 22 bp, Homo sapiens
ccagctgcccaagaggcatcct

SEQ ID NO: 8162117 - DNA, 22 bp, Homo sapiens
ccagctgcccactatgtgttct

SEQ ID NO: 8162118 - DNA, 22 bp, Homo sapiens
ccagctgcccaagaggcatcct

SEQ ID NO: 8162119 - DNA, 22 bp, Homo sapiens
ccagctgcgggcatcgagagtt

SEQ ID NO: 8162120 - DNA, 22 bp, Homo sapiens
ccagctgcgggcatcgagagtt

SEQ ID NO: 8162121 - DNA, 18 bp, Homo sapiens
ccagctgcgctgaaccga

SEQ ID NO: 8162122 - DNA, 21 bp, Homo sapiens
ccagctgcctgcactttggac

SEQ ID NO: 8162123 - DNA, 22 bp, Homo sapiens
ccagctgcctaagcaatccata

SEQ ID NO: 8162124 - DNA, 22 bp, Homo sapiens
ccagagaccagaacatggggat

SEQ ID NO: 8162125 - DNA, 22 bp, Homo sapiens
ccagagacgtcggtcagggcgc

SEQ ID NO: 8162126 - DNA, 22 bp, Homo sapiens
ccagagacgtcggtcagggcgc

SEQ ID NO: 8162127 - DNA, 22 bp, Homo sapiens
ccagagagaaaatggagggcca

SEQ ID NO: 8162128 - DNA, 22 bp, Homo sapiens
ccagagagaaaatggagggcca

SEQ ID NO: 8162129 - DNA, 22 bp, Homo sapiens
ccagagactggctgagagatct

SEQ ID NO: 8162130 - DNA, 22 bp, Homo sapiens
tctcagaagggtggtgctggag

SEQ ID NO: 8162131 - DNA, 22 bp, Homo sapiens
tctcagaagggtggtgctggag

SEQ ID NO: 8162132 - DNA, 22 bp, Homo sapiens
tctcagaagggtggtgctggag

SEQ ID NO: 8162133 - DNA, 22 bp, Homo sapiens
tctcagaagtgatcaggatgtt

SEQ ID NO: 8162134 - DNA, 22 bp, Homo sapiens
tctcagaataaattcctaactt

SEQ ID NO: 8162135 - DNA, 22 bp, Homo sapiens
tctcagaataaattcctaactt

SEQ ID NO: 8162136 - DNA, 22 bp, Homo sapiens
tctcagaagtgatcaggatgtt

SEQ ID NO: 8162137 - DNA, 22 bp, Homo sapiens
tctcagagaacagttggtgctt

SEQ ID NO: 8162138 - DNA, 22 bp, Homo sapiens
tctcagagaaatgtgtcaccat

SEQ ID NO: 8162139 - DNA, 22 bp, Homo sapiens
tctgctcaatactgctcatgaa

SEQ ID NO: 8162140 - DNA, 23 bp, Homo sapiens
tctcagacccgaagccagaggaa

SEQ ID NO: 8162141 - DNA, 22 bp, Homo sapiens
tctcagactatagtagagattc

SEQ ID NO: 8162142 - DNA, 19 bp, Homo sapiens
tctcagactgtgcttctgt

SEQ ID NO: 8162143 - DNA, 22 bp, Homo sapiens
tctcagactctttagtgaaggt

SEQ ID NO: 8162144 - DNA, 22 bp, Homo sapiens
tctcagaattgtgtccactggg

SEQ ID NO: 8162145 - DNA, 22 bp, Homo sapiens
tctcagaattgtgtccactggg

SEQ ID NO: 8162146 - DNA, 22 bp, Homo sapiens
tctcagacatgtaatctctacc

SEQ ID NO: 8162147 - DNA, 19 bp, Homo sapiens
tctcagaattggcaatcat

SEQ ID NO: 8162148 - DNA, 19 bp, Homo sapiens
tctcagaattggcaatcat

SEQ ID NO: 8162149 - DNA, 19 bp, Homo sapiens
tctcagaattaagagtgct

SEQ ID NO: 8162150 - DNA, 19 bp, Homo sapiens
tctcagaattaagagtgct

SEQ ID NO: 8162151 - DNA, 22 bp, Homo sapiens
tctcagaatccttgcccaggtg

SEQ ID NO: 8162152 - DNA, 22 bp, Homo sapiens
tctcagaatccttgcccaggtg

SEQ ID NO: 8162153 - DNA, 22 bp, Homo sapiens
tctcagaatcaggacctacttc

SEQ ID NO: 8162154 - DNA, 22 bp, Homo sapiens
tctcagaataaattcctaactt

SEQ ID NO: 8162155 - DNA, 22 bp, Homo sapiens
tctcagaatcaggacctacttc

SEQ ID NO: 8162156 - DNA, 22 bp, Homo sapiens
tctgcttcacttccccaagctt

SEQ ID NO: 8162157 - DNA, 22 bp, Homo sapiens
tctgcttctcctacttcatggg

SEQ ID NO: 8162158 - DNA, 22 bp, Homo sapiens
tctgctcacatggctccatgca

SEQ ID NO: 8162159 - DNA, 22 bp, Homo sapiens
tctgctcaatactgctcatgaa

SEQ ID NO: 8162160 - DNA, 22 bp, Homo sapiens
tctgcttgcgttctgctccctc

SEQ ID NO: 8162161 - DNA, 23 bp, Homo sapiens
tctgcttctgtattttttcccat

SEQ ID NO: 8162162 - DNA, 22 bp, Homo sapiens
tctgcttctgtgaaggcagtct

SEQ ID NO: 8162163 - DNA, 22 bp, Homo sapiens
tctgctttagaatccagtagct

SEQ ID NO: 8162164 - DNA, 22 bp, Homo sapiens
tctgctttcaaattcacttagt

SEQ ID NO: 8162165 - DNA, 22 bp, Homo sapiens
tctgctttcttactaaaaatga

SEQ ID NO: 8162166 - DNA, 22 bp, Homo sapiens
tctgctttcttgcgcagatgtg

SEQ ID NO: 8162167 - DNA, 22 bp, Homo sapiens
tctgctttatggctcagagact

SEQ ID NO: 8162168 - DNA, 22 bp, Homo sapiens
tctgctttatggctcagagact

SEQ ID NO: 8162169 - DNA, 22 bp, Homo sapiens
tctgctttattacactagccaa

SEQ ID NO: 8162170 - DNA, 22 bp, Homo sapiens
tctgctttagtgcaaagtctta

SEQ ID NO: 8162171 - DNA, 22 bp, Homo sapiens
tctgctttagacataaaaggta

SEQ ID NO: 8162172 - DNA, 22 bp, Homo sapiens
tctggaaatttcagttttagag

SEQ ID NO: 8162173 - DNA, 22 bp, Homo sapiens
tctggaaatggaagtaactatg

SEQ ID NO: 8162174 - DNA, 22 bp, Homo sapiens
ccagctctcagcgggagactca

SEQ ID NO: 8162175 - DNA, 22 bp, Homo sapiens
ccagctctctgcagaaaggact

SEQ ID NO: 8162176 - DNA, 21 bp, Homo sapiens
tctggaagaaaaaagtattat

SEQ ID NO: 8162177 - DNA, 21 bp, Homo sapiens
tctggaagaaaaaagtattat

SEQ ID NO: 8162178 - DNA, 22 bp, Homo sapiens
ccagctctcagcgggagactca

SEQ ID NO: 8162179 - DNA, 22 bp, Homo sapiens
tctggaaaagcgataaaccatt

SEQ ID NO: 8162180 - DNA, 22 bp, Homo sapiens
tctgctttttcattgactgaaa

SEQ ID NO: 8162181 - DNA, 22 bp, Homo sapiens
tctggaaataaaattatagttg

SEQ ID NO: 8162182 - DNA, 22 bp, Homo sapiens
tctgctttgaccttcttgatgc

SEQ ID NO: 8162183 - DNA, 22 bp, Homo sapiens
tctgctttgaccttcttgatgc

SEQ ID NO: 8162184 - DNA, 22 bp, Homo sapiens
tctgctttgctgcctcctgatc

SEQ ID NO: 8162185 - DNA, 22 bp, Homo sapiens
ccaggaccacacgacaggagag

SEQ ID NO: 8162186 - DNA, 19 bp, Homo sapiens
ccaggacctttccagggtc

SEQ ID NO: 8162187 - DNA, 22 bp, Homo sapiens
ccaggactcaatgaccacaggg

SEQ ID NO: 8162188 - DNA, 22 bp, Homo sapiens
ccaggactcaatgaccacaggg

SEQ ID NO: 8162189 - DNA, 22 bp, Homo sapiens
ccaggacctggagctctatgaa

SEQ ID NO: 8162190 - DNA, 22 bp, Homo sapiens
ccaggacctggagctctatgaa

SEQ ID NO: 8162191 - DNA, 22 bp, Homo sapiens
ccaggacagggagacgggagcc

SEQ ID NO: 8162192 - DNA, 22 bp, Homo sapiens
ccaggacagggagacgggagcc

SEQ ID NO: 8162193 - DNA, 18 bp, Homo sapiens
ccaggacaggcaaaaggt

SEQ ID NO: 8162194 - DNA, 22 bp, Homo sapiens
ccaggacactgcttcacagcag

SEQ ID NO: 8162195 - DNA, 22 bp, Homo sapiens
ccaggacactgcttcacagcag

SEQ ID NO: 8162196 - DNA, 22 bp, Homo sapiens
ccaggacaggagttggcttcgc

SEQ ID NO: 8162197 - DNA, 22 bp, Homo sapiens
ccaggaaggatcgtttgggagt

SEQ ID NO: 8162198 - DNA, 22 bp, Homo sapiens
ccaggaaggatcgtttgggagt

SEQ ID NO: 8162199 - DNA, 22 bp, Homo sapiens
tctggctcaggtcagacaggga

SEQ ID NO: 8162200 - DNA, 22 bp, Homo sapiens
tctggctcagggctctgaggga

SEQ ID NO: 8162201 - DNA, 22 bp, Homo sapiens
tctggctcaggagctgtgttca

SEQ ID NO: 8162202 - DNA, 17 bp, Homo sapiens
tctggccttcctgaact

SEQ ID NO: 8162203 - DNA, 17 bp, Homo sapiens
tctggccttcctgaact

SEQ ID NO: 8162204 - DNA, 22 bp, Homo sapiens
tctggcagggtcagggcccagg

SEQ ID NO: 8162205 - DNA, 22 bp, Homo sapiens
tctggcaggggttctgcacttg

SEQ ID NO: 8162206 - DNA, 22 bp, Homo sapiens
tctggcaggggttctgcacttg

SEQ ID NO: 8162207 - DNA, 22 bp, Homo sapiens
tctggcaggggttctgcacttg

SEQ ID NO: 8162208 - DNA, 22 bp, Homo sapiens
tctggcctcttgggatgctccc

SEQ ID NO: 8162209 - DNA, 22 bp, Homo sapiens
tctggcctgaaagtccatgctt

SEQ ID NO: 8162210 - DNA, 22 bp, Homo sapiens
tctggcctcttgggatgctccc

SEQ ID NO: 8162211 - DNA, 22 bp, Homo sapiens
tctggcaggccttgtcaatctg

SEQ ID NO: 8162212 - DNA, 22 bp, Homo sapiens
tctggcaggccttgtcaatctg

SEQ ID NO: 8162213 - DNA, 21 bp, Homo sapiens
tctggcaggcacgggcccagc

SEQ ID NO: 8162214 - DNA, 22 bp, Homo sapiens
tctggcaggcaatcggctctgg

SEQ ID NO: 8162215 - DNA, 22 bp, Homo sapiens
tctggcaggcaatcggctctgg

SEQ ID NO: 8162216 - DNA, 21 bp, Homo sapiens
tctggcaggcacgggcccagc

SEQ ID NO: 8162217 - DNA, 22 bp, Homo sapiens
tctggcaggcaatcggctctgg

SEQ ID NO: 8162218 - DNA, 22 bp, Homo sapiens
tctggcaggaccatgaagcgta

SEQ ID NO: 8162219 - DNA, 22 bp, Homo sapiens
tctggcaggaccatgaagcgta

SEQ ID NO: 8162220 - DNA, 22 bp, Homo sapiens
tctggcaggacatgctgaccat

SEQ ID NO: 8162221 - DNA, 22 bp, Homo sapiens
tctggcaggaccatgaagcgta

SEQ ID NO: 8162222 - DNA, 22 bp, Homo sapiens
tctggcaggatatcgaagtgaa

SEQ ID NO: 8162223 - DNA, 22 bp, Homo sapiens
tctggcaggatatcgaagtgaa

SEQ ID NO: 8162224 - DNA, 22 bp, Homo sapiens
tctggcagctatcctctggcca

SEQ ID NO: 8162225 - DNA, 22 bp, Homo sapiens
tctggcagctatcctctggcca

SEQ ID NO: 8162226 - DNA, 22 bp, Homo sapiens
tctggcagctatcctctggcca

SEQ ID NO: 8162227 - DNA, 21 bp, Homo sapiens
tctggcagcagtttgttgagt

SEQ ID NO: 8162228 - DNA, 21 bp, Homo sapiens
tctggcagcagtttgttgagt

SEQ ID NO: 8162229 - DNA, 22 bp, Homo sapiens
tctggcagcgaagcgtgtactt

SEQ ID NO: 8162230 - DNA, 22 bp, Homo sapiens
tctggcagcgaagcgtgtactt

SEQ ID NO: 8162231 - DNA, 21 bp, Homo sapiens
tctggcaggaagacggatggg

SEQ ID NO: 8162232 - DNA, 21 bp, Homo sapiens
tctggcaggaagacggatggg

SEQ ID NO: 8162233 - DNA, 22 bp, Homo sapiens
tctggcaggacatgctgaccat

SEQ ID NO: 8162234 - DNA, 22 bp, Homo sapiens
tctggcagctcagttcaggtct

SEQ ID NO: 8162235 - DNA, 22 bp, Homo sapiens
tctggcagctcagttcaggtct

SEQ ID NO: 8162236 - DNA, 22 bp, Homo sapiens
tctggcagctctcctcggcgga

SEQ ID NO: 8162237 - DNA, 22 bp, Homo sapiens
tctggcagctctcctcggcgga

SEQ ID NO: 8162238 - DNA, 22 bp, Homo sapiens
tctgggagctggctttgcctca

SEQ ID NO: 8162239 - DNA, 22 bp, Homo sapiens
tctgggagcgctgtttttccca

SEQ ID NO: 8162240 - DNA, 22 bp, Homo sapiens
tctgggagcctgaaagtgaatg

SEQ ID NO: 8162241 - DNA, 22 bp, Homo sapiens
tctgggagcctgaaagtgaatg

SEQ ID NO: 8162242 - DNA, 22 bp, Homo sapiens
tctgggagccatgccttggagt

SEQ ID NO: 8162243 - DNA, 22 bp, Homo sapiens
tctgggagccatgccttggagt

SEQ ID NO: 8162244 - DNA, 22 bp, Homo sapiens
tctgggagcagctcagcagatt

SEQ ID NO: 8162245 - DNA, 22 bp, Homo sapiens
tctgggagcagctcagcagatt

SEQ ID NO: 8162246 - DNA, 22 bp, Homo sapiens
tctgggagcagctcagcagatt

SEQ ID NO: 8162247 - DNA, 22 bp, Homo sapiens
tctgggagcagctcagcagatt

SEQ ID NO: 8162248 - DNA, 22 bp, Homo sapiens
tctgggtttgaagtagagccca

SEQ ID NO: 8162249 - DNA, 22 bp, Homo sapiens
tctgggttttgtaccgtgctcg

SEQ ID NO: 8162250 - DNA, 22 bp, Homo sapiens
tctggtcaagacatcctaacat

SEQ ID NO: 8162251 - DNA, 20 bp, Homo sapiens
tctggggatgaggtctagga

SEQ ID NO: 8162252 - DNA, 17 bp, Homo sapiens
tctgggtttaaatccca

SEQ ID NO: 8162253 - DNA, 22 bp, Homo sapiens
tctggggatgaggtccagtgat

SEQ ID NO: 8162254 - DNA, 22 bp, Homo sapiens
tctggggatgaggtccagtgat

SEQ ID NO: 8162255 - DNA, 22 bp, Homo sapiens
tctgggagctggctttgcctca

SEQ ID NO: 8162256 - DNA, 22 bp, Homo sapiens
tctgggagctggctttgcctca

SEQ ID NO: 8162257 - DNA, 22 bp, Homo sapiens
tctgggagatccaagcagaact

SEQ ID NO: 8162258 - DNA, 19 bp, Homo sapiens
tctgggagagtgaatctga

SEQ ID NO: 8162259 - DNA, 19 bp, Homo sapiens
tctgggagagtgaatctga

SEQ ID NO: 8162260 - DNA, 22 bp, Homo sapiens
tctgggagagtctaacttgttt

SEQ ID NO: 8162261 - DNA, 22 bp, Homo sapiens
tctgggagagtctaacttgttt

SEQ ID NO: 8162262 - DNA, 22 bp, Homo sapiens
ccaggactgcagggggcgagga

SEQ ID NO: 8162263 - DNA, 22 bp, Homo sapiens
ccaggactgcagggggcgagga

SEQ ID NO: 8162264 - DNA, 21 bp, Homo sapiens
ccaggactccatggggtctct

SEQ ID NO: 8162265 - DNA, 21 bp, Homo sapiens
ccaggactccatggggtctct

SEQ ID NO: 8162266 - DNA, 22 bp, Homo sapiens
ccaggactcagtggggaaaggg

SEQ ID NO: 8162267 - DNA, 22 bp, Homo sapiens
ccaggactcaattaacctcact

SEQ ID NO: 8162268 - DNA, 22 bp, Homo sapiens
ccaggactcaatgaccacaggg

SEQ ID NO: 8162269 - DNA, 22 bp, Homo sapiens
tctgggagcagatgatggtata

SEQ ID NO: 8162270 - DNA, 22 bp, Homo sapiens
tctgggagcagatgatggtata

SEQ ID NO: 8162271 - DNA, 22 bp, Homo sapiens
tctgggagcacacgcagtgatc

SEQ ID NO: 8162272 - DNA, 22 bp, Homo sapiens
tctgggagcagatgatggtata

SEQ ID NO: 8162273 - DNA, 22 bp, Homo sapiens
tctgggagcacacgcagtgatc

SEQ ID NO: 8162274 - DNA, 22 bp, Homo sapiens
tctgggagcacacgcagtgatc

SEQ ID NO: 8162275 - DNA, 22 bp, Homo sapiens
tctgggagatccaagcagaact

SEQ ID NO: 8162276 - DNA, 22 bp, Homo sapiens
tctgggagatccaagcagaact

SEQ ID NO: 8162277 - DNA, 22 bp, Homo sapiens
tctgggagatccaagcagaact

SEQ ID NO: 8162278 - DNA, 22 bp, Homo sapiens
tctgggagatccaagcagaact

SEQ ID NO: 8162279 - DNA, 22 bp, Homo sapiens
tctgggagatccaagcagaact

SEQ ID NO: 8162280 - DNA, 22 bp, Homo sapiens
tctggttgtcgaccaccaatgc

SEQ ID NO: 8162281 - DNA, 20 bp, Homo sapiens
ccaggactgctggggactct

SEQ ID NO: 8162282 - DNA, 22 bp, Homo sapiens
ccaggacttcgaggctacagtg

SEQ ID NO: 8162283 - DNA, 22 bp, Homo sapiens
ccaggacttcgaggctacagtg

SEQ ID NO: 8162284 - DNA, 22 bp, Homo sapiens
ccaggacttcgaggctacagtg

SEQ ID NO: 8162285 - DNA, 22 bp, Homo sapiens
ccaggactttaagtccagcact

SEQ ID NO: 8162286 - DNA, 22 bp, Homo sapiens
ccaggactttaagtccagcact

SEQ ID NO: 8162287 - DNA, 22 bp, Homo sapiens
ccaggagaataatggcagatta

SEQ ID NO: 8162288 - DNA, 22 bp, Homo sapiens
ccaggagaataatggcagatta

SEQ ID NO: 8162289 - DNA, 22 bp, Homo sapiens
ccaggagaataatggcagatta

SEQ ID NO: 8162290 - DNA, 22 bp, Homo sapiens
ccaggagaataatggcagatta

SEQ ID NO: 8162291 - DNA, 22 bp, Homo sapiens
ccaggagaagcatctgagtgta

SEQ ID NO: 8162292 - DNA, 22 bp, Homo sapiens
ccaggagaagcatctgagtgta

SEQ ID NO: 8162293 - DNA, 22 bp, Homo sapiens
tctggtccccattccaggtggg

SEQ ID NO: 8162294 - DNA, 22 bp, Homo sapiens
tctggtcagtctccattctacc

SEQ ID NO: 8162295 - DNA, 22 bp, Homo sapiens
tctggtcagtctccattctacc

SEQ ID NO: 8162296 - DNA, 22 bp, Homo sapiens
tctggtcccttttcctgcagtc

SEQ ID NO: 8162297 - DNA, 22 bp, Homo sapiens
tctggtcccttttcctgcagtc

SEQ ID NO: 8162298 - DNA, 22 bp, Homo sapiens
tctggtcccttttcctgcagtc

SEQ ID NO: 8162299 - DNA, 19 bp, Homo sapiens
tctggttcatttctgctgt

SEQ ID NO: 8162300 - DNA, 22 bp, Homo sapiens
tctggtgtcagtattctttgaa

SEQ ID NO: 8162301 - DNA, 22 bp, Homo sapiens
tctggtgtcagtattctttgaa

SEQ ID NO: 8162302 - DNA, 22 bp, Homo sapiens
tctggtcccttttcctgcagtc

SEQ ID NO: 8162303 - DNA, 22 bp, Homo sapiens
tctggtcctctctgtgatgcta

SEQ ID NO: 8162304 - DNA, 22 bp, Homo sapiens
tctggtcctgaagtcaacttca

SEQ ID NO: 8162305 - DNA, 22 bp, Homo sapiens
tctggtcctgaagtcaacttca

SEQ ID NO: 8162306 - DNA, 22 bp, Homo sapiens
tcttcacattcacgtaacatag

SEQ ID NO: 8162307 - DNA, 22 bp, Homo sapiens
tcttcacgccaagtgcccctca

SEQ ID NO: 8162308 - DNA, 22 bp, Homo sapiens
tcttcacattttagtggtttgt

SEQ ID NO: 8162309 - DNA, 22 bp, Homo sapiens
tcttagaatgtcaactgatgtt

SEQ ID NO: 8162310 - DNA, 22 bp, Homo sapiens
tcttagaatgtcaactgatgtt

SEQ ID NO: 8162311 - DNA, 22 bp, Homo sapiens
ccaggcaaggtctcctagagag

SEQ ID NO: 8162312 - DNA, 22 bp, Homo sapiens
ccaggcaaggtctcctagagag

SEQ ID NO: 8162313 - DNA, 22 bp, Homo sapiens
tcttagaagtttatggcacgga

SEQ ID NO: 8162314 - DNA, 22 bp, Homo sapiens
ccaggcaagctctgctgtgccc

SEQ ID NO: 8162315 - DNA, 15 bp, Homo sapiens
ccaggcaagcaggaa

SEQ ID NO: 8162316 - DNA, 22 bp, Homo sapiens
ccaggcaagagaggctctggca

SEQ ID NO: 8162317 - DNA, 22 bp, Homo sapiens
ccaggcaagagaggctctggca

SEQ ID NO: 8162318 - DNA, 22 bp, Homo sapiens
ccaggcaacggagcccactgcc

SEQ ID NO: 8162319 - DNA, 22 bp, Homo sapiens
ccaggatggggagcagatagaa

SEQ ID NO: 8162320 - DNA, 22 bp, Homo sapiens
ccaggatggggagcagatagaa

SEQ ID NO: 8162321 - DNA, 22 bp, Homo sapiens
ccaggcaaagcccatgcaagag

SEQ ID NO: 8162322 - DNA, 22 bp, Homo sapiens
ccaggcaaatccctctggcaga

SEQ ID NO: 8162323 - DNA, 22 bp, Homo sapiens
ccaggcaacggagcccactgcc

SEQ ID NO: 8162324 - DNA, 22 bp, Homo sapiens
ccaggagtttgaggctgcagtg

SEQ ID NO: 8162325 - DNA, 22 bp, Homo sapiens
ccaggatctgatattgggctcc

SEQ ID NO: 8162326 - DNA, 22 bp, Homo sapiens
ccaggagttggaagctgccatg

SEQ ID NO: 8162327 - DNA, 22 bp, Homo sapiens
ccaggagttggaagctgccatg

SEQ ID NO: 8162328 - DNA, 22 bp, Homo sapiens
ccaggagttggaagctgccatg

SEQ ID NO: 8162329 - DNA, 22 bp, Homo sapiens
ccaggagttggaggctgcagtg

SEQ ID NO: 8162330 - DNA, 22 bp, Homo sapiens
ccaggagttggaggctgcagtg

SEQ ID NO: 8162331 - DNA, 22 bp, Homo sapiens
ccaggagttggaggctgcagtg

SEQ ID NO: 8162332 - DNA, 22 bp, Homo sapiens
ccaggagtttgaggctgcagtg

SEQ ID NO: 8162333 - DNA, 22 bp, Homo sapiens
ccaggagtttgaggctgcagtg

SEQ ID NO: 8162334 - DNA, 22 bp, Homo sapiens
ccaggagtttgaggctgcagtg

SEQ ID NO: 8162335 - DNA, 22 bp, Homo sapiens
ccaggagttggaggttgcagtg

SEQ ID NO: 8162336 - DNA, 22 bp, Homo sapiens
ccaggagttggaggttgcagtg

SEQ ID NO: 8162337 - DNA, 22 bp, Homo sapiens
ccaggagttggaggttgcagtg

SEQ ID NO: 8162338 - DNA, 22 bp, Homo sapiens
ccaggagttggaggctgcagtg

SEQ ID NO: 8162339 - DNA, 22 bp, Homo sapiens
ccaggaggttgaggctgcagtg

SEQ ID NO: 8162340 - DNA, 22 bp, Homo sapiens
ccaggaggttgaggctgcagtg

SEQ ID NO: 8162341 - DNA, 22 bp, Homo sapiens
ccaggaggttgaggctgcagtg

SEQ ID NO: 8162342 - DNA, 22 bp, Homo sapiens
ccaggaggttgaggctgcagtg

SEQ ID NO: 8162343 - DNA, 22 bp, Homo sapiens
ccaggaggttgaggctgcagtg

SEQ ID NO: 8162344 - DNA, 22 bp, Homo sapiens
ccaggaggttgaggctgcagtg

SEQ ID NO: 8162345 - DNA, 22 bp, Homo sapiens
ccaggaggttgaggctgcagtg

SEQ ID NO: 8162346 - DNA, 22 bp, Homo sapiens
ccaggaggttgaggctgcagtg

SEQ ID NO: 8162347 - DNA, 22 bp, Homo sapiens
ccaggagtctggatgaggtgtc

SEQ ID NO: 8162348 - DNA, 22 bp, Homo sapiens
ccaggagtctggatgaggtgtc

SEQ ID NO: 8162349 - DNA, 22 bp, Homo sapiens
ccaggagtgcagggatggtatc

SEQ ID NO: 8162350 - DNA, 22 bp, Homo sapiens
ccaggagtctggatgaggtgtc

SEQ ID NO: 8162351 - DNA, 22 bp, Homo sapiens
ccaggagtcaataaaggaagct

SEQ ID NO: 8162352 - DNA, 19 bp, Homo sapiens
ccaggagtggtggggtgag

SEQ ID NO: 8162353 - DNA, 19 bp, Homo sapiens
ccaggagtggtggggtgag

SEQ ID NO: 8162354 - DNA, 22 bp, Homo sapiens
ccaggagttggaagctgccatg

SEQ ID NO: 8162355 - DNA, 22 bp, Homo sapiens
ccaggagttggaagctgccatg

SEQ ID NO: 8162356 - DNA, 22 bp, Homo sapiens
ccaggagtggctggtgaccttc

SEQ ID NO: 8162357 - DNA, 22 bp, Homo sapiens
ccaggagtggctggtgaccttc

SEQ ID NO: 8162358 - DNA, 22 bp, Homo sapiens
ccaggaggttgaggctgcagtg

SEQ ID NO: 8162359 - DNA, 22 bp, Homo sapiens
ccaggagggaggagttcctgag

SEQ ID NO: 8162360 - DNA, 22 bp, Homo sapiens
ccaggagggaccgcggcatccc

SEQ ID NO: 8162361 - DNA, 17 bp, Homo sapiens
ccaggagagatgcttgt

SEQ ID NO: 8162362 - DNA, 22 bp, Homo sapiens
ccaggagacccagggaaggagc

SEQ ID NO: 8162363 - DNA, 22 bp, Homo sapiens
ccaggagacaaagatgactgct

SEQ ID NO: 8162364 - DNA, 22 bp, Homo sapiens
ccaggagacccagggaaggagc

SEQ ID NO: 8162365 - DNA, 22 bp, Homo sapiens
ccaggagacccagggaaggagc

SEQ ID NO: 8162366 - DNA, 22 bp, Homo sapiens
ccaggagactgtactgatattt

SEQ ID NO: 8162367 - DNA, 20 bp, Homo sapiens
tcttcagatgcttttggagt

SEQ ID NO: 8162368 - DNA, 20 bp, Homo sapiens
tcttccaggtacagtctgca

SEQ ID NO: 8162369 - DNA, 20 bp, Homo sapiens
tcttccaggtacagtctgca

SEQ ID NO: 8162370 - DNA, 22 bp, Homo sapiens
tcttcccaatgcaaagtaggac

SEQ ID NO: 8162371 - DNA, 22 bp, Homo sapiens
tcttcccagaccttacatgtga

SEQ ID NO: 8162372 - DNA, 22 bp, Homo sapiens
tcttcagacccttagctgtgat

SEQ ID NO: 8162373 - DNA, 22 bp, Homo sapiens
tcttcagaaaattatcacttgt

SEQ ID NO: 8162374 - DNA, 22 bp, Homo sapiens
tcttcagacccttagctgtgat

SEQ ID NO: 8162375 - DNA, 22 bp, Homo sapiens
tcttcagagtgaaagtctgtga

SEQ ID NO: 8162376 - DNA, 22 bp, Homo sapiens
tcttcagagcatttctgaggta

SEQ ID NO: 8162377 - DNA, 22 bp, Homo sapiens
tcttcagagactctgagcccct

SEQ ID NO: 8162378 - DNA, 22 bp, Homo sapiens
tcttcagagatgtaacatatgg

SEQ ID NO: 8162379 - DNA, 22 bp, Homo sapiens
ccaggccagagtgcagtggcac

SEQ ID NO: 8162380 - DNA, 22 bp, Homo sapiens
ccaggccagagtgcagtggcac

SEQ ID NO: 8162381 - DNA, 22 bp, Homo sapiens
ccaggccagcctggagcatggc

SEQ ID NO: 8162382 - DNA, 22 bp, Homo sapiens
ccaggccagcaggcacacctgc

SEQ ID NO: 8162383 - DNA, 22 bp, Homo sapiens
ccaggccagcaggcacacctgc

SEQ ID NO: 8162384 - DNA, 22 bp, Homo sapiens
ccaggccagcgctggctggagg

SEQ ID NO: 8162385 - DNA, 22 bp, Homo sapiens
ccaggccagcgctggctggagg

SEQ ID NO: 8162386 - DNA, 22 bp, Homo sapiens
ccaggccagcgctggctggagg

SEQ ID NO: 8162387 - DNA, 22 bp, Homo sapiens
ccaggccagcgctggctggagg

SEQ ID NO: 8162388 - DNA, 22 bp, Homo sapiens
ccaggccagcctggagcatggc

SEQ ID NO: 8162389 - DNA, 22 bp, Homo sapiens
tcttccctcttctgccaaatac

SEQ ID NO: 8162390 - DNA, 21 bp, Homo sapiens
tcttccctcaggatgtcctgc

SEQ ID NO: 8162391 - DNA, 21 bp, Homo sapiens
tcttccctcaggatgtcctgc

SEQ ID NO: 8162392 - DNA, 22 bp, Homo sapiens
tcttccctaatcaccatcttca

SEQ ID NO: 8162393 - DNA, 22 bp, Homo sapiens
tcttcccccgtgctccagtgca

SEQ ID NO: 8162394 - DNA, 22 bp, Homo sapiens
tcttcccccgtgctccagtgca

SEQ ID NO: 8162395 - DNA, 22 bp, Homo sapiens
tcttcccattagtaatgaagtg

SEQ ID NO: 8162396 - DNA, 22 bp, Homo sapiens
tcttcccattagtaatgaagtg

SEQ ID NO: 8162397 - DNA, 22 bp, Homo sapiens
ccaggcaggctagaatgtaaat

SEQ ID NO: 8162398 - DNA, 22 bp, Homo sapiens
ccaggcaggctagaatgtaaat

SEQ ID NO: 8162399 - DNA, 22 bp, Homo sapiens
ccaggcagggagctgtttggcc

SEQ ID NO: 8162400 - DNA, 22 bp, Homo sapiens
tcttcctatggggctgcaggaa

SEQ ID NO: 8162401 - DNA, 19 bp, Homo sapiens
tcttccctggctgtcagtc

SEQ ID NO: 8162402 - DNA, 19 bp, Homo sapiens
tcttccctggctgtcagtc

SEQ ID NO: 8162403 - DNA, 22 bp, Homo sapiens
tctttggcatttaggagcagga

SEQ ID NO: 8162404 - DNA, 19 bp, Homo sapiens
tctttggcttctggatcag

SEQ ID NO: 8162405 - DNA, 19 bp, Homo sapiens
tctttggcttctggatcag

SEQ ID NO: 8162406 - DNA, 22 bp, Homo sapiens
tctttggtattcacttgtgaag

SEQ ID NO: 8162407 - DNA, 23 bp, Homo sapiens
tctttggtaaataaagtggggat

SEQ ID NO: 8162408 - DNA, 22 bp, Homo sapiens
tctttggtgatatctctttggt

SEQ ID NO: 8162409 - DNA, 22 bp, Homo sapiens
ccaggctgctgttggtgtccgc

SEQ ID NO: 8162410 - DNA, 22 bp, Homo sapiens
ccaggctggagtgcaatggcat

SEQ ID NO: 8162411 - DNA, 22 bp, Homo sapiens
ccaggctggagtgcaatggcat

SEQ ID NO: 8162412 - DNA, 22 bp, Homo sapiens
ccaggctggagtgcaatggcat

SEQ ID NO: 8162413 - DNA, 22 bp, Homo sapiens
ccaggctggagtgcaatggcat

SEQ ID NO: 8162414 - DNA, 22 bp, Homo sapiens
ccaggctggagtgcaatggcat

SEQ ID NO: 8162415 - DNA, 22 bp, Homo sapiens
ccaggctggagtgcaatggcgt

SEQ ID NO: 8162416 - DNA, 22 bp, Homo sapiens
ccaggctggagtgcaatggcgt

SEQ ID NO: 8162417 - DNA, 22 bp, Homo sapiens
ccaggctggagtgcaatggcgt

SEQ ID NO: 8162418 - DNA, 22 bp, Homo sapiens
ccaggctggagtgcaatggcgt

SEQ ID NO: 8162419 - DNA, 22 bp, Homo sapiens
ccaggctggagtgcaatggcat

SEQ ID NO: 8162420 - DNA, 22 bp, Homo sapiens
ccaggctggagtgcaatggcgt

SEQ ID NO: 8162421 - DNA, 22 bp, Homo sapiens
ccaggctggagtgcaatggtgc

SEQ ID NO: 8162422 - DNA, 22 bp, Homo sapiens
ccaggctggagtgcaatggcgt

SEQ ID NO: 8162423 - DNA, 22 bp, Homo sapiens
ccaggctggagtgcaatggcgt

SEQ ID NO: 8162424 - DNA, 22 bp, Homo sapiens
ccaggctgaatatgttccaggg

SEQ ID NO: 8162425 - DNA, 22 bp, Homo sapiens
ccaggctgaatatgttccaggg

SEQ ID NO: 8162426 - DNA, 23 bp, Homo sapiens
ccaggctctttcacctgctattc

SEQ ID NO: 8162427 - DNA, 22 bp, Homo sapiens
ccaggctgaatatgttccaggg

SEQ ID NO: 8162428 - DNA, 23 bp, Homo sapiens
ccaggctctttcacctgctattc

SEQ ID NO: 8162429 - DNA, 23 bp, Homo sapiens
ccaggctctttcacctgctattc

SEQ ID NO: 8162430 - DNA, 23 bp, Homo sapiens
ccaggctctttcacctgctattc

SEQ ID NO: 8162431 - DNA, 23 bp, Homo sapiens
ccaggctctttcacctgctattc

SEQ ID NO: 8162432 - DNA, 22 bp, Homo sapiens
ccaggctctgtgtgggctagag

SEQ ID NO: 8162433 - DNA, 22 bp, Homo sapiens
ccaggctctgtgtgggctagag

SEQ ID NO: 8162434 - DNA, 22 bp, Homo sapiens
ccaggctctgtgtgggctagag

SEQ ID NO: 8162435 - DNA, 22 bp, Homo sapiens
ccaggctctgttccccgaggag

SEQ ID NO: 8162436 - DNA, 22 bp, Homo sapiens
ccaggctctgttccccgaggag

SEQ ID NO: 8162437 - DNA, 22 bp, Homo sapiens
ccaggctctgttccccgaggag

SEQ ID NO: 8162438 - DNA, 22 bp, Homo sapiens
ccaggctctgttccccgaggag

SEQ ID NO: 8162439 - DNA, 22 bp, Homo sapiens
ccaggcctggaccatgccaggg

SEQ ID NO: 8162440 - DNA, 22 bp, Homo sapiens
ccaggcctggaccatgccaggg

SEQ ID NO: 8162441 - DNA, 22 bp, Homo sapiens
ccaggcctggacgggtggcctg

SEQ ID NO: 8162442 - DNA, 22 bp, Homo sapiens
ccaggcctggacgggtggcctg

SEQ ID NO: 8162443 - DNA, 22 bp, Homo sapiens
ccaggcctggacgggtggcctg

SEQ ID NO: 8162444 - DNA, 22 bp, Homo sapiens
ccaggcctggacgggtggcctg

SEQ ID NO: 8162445 - DNA, 22 bp, Homo sapiens
ccaggcctggccaggggatgcc

SEQ ID NO: 8162446 - DNA, 22 bp, Homo sapiens
ccaggcctggacgggtggcctg

SEQ ID NO: 8162447 - DNA, 22 bp, Homo sapiens
ccaggcctggacgggtggcctg

SEQ ID NO: 8162448 - DNA, 22 bp, Homo sapiens
ccaggcctggacgggtggcctg

SEQ ID NO: 8162449 - DNA, 22 bp, Homo sapiens
ccaggctctgtctggtcagaag

SEQ ID NO: 8162450 - DNA, 22 bp, Homo sapiens
ccaggctctgtctggtcagaag

SEQ ID NO: 8162451 - DNA, 22 bp, Homo sapiens
ccaggctctgtgtgggctagag

SEQ ID NO: 8162452 - DNA, 22 bp, Homo sapiens
ccaggctctgtctggtcagaag

SEQ ID NO: 8162453 - DNA, 21 bp, Homo sapiens
ccaggctcctgaggctggtca

SEQ ID NO: 8162454 - DNA, 22 bp, Homo sapiens
ccaggcctggccaggggatgcc

SEQ ID NO: 8162455 - DNA, 22 bp, Homo sapiens
ccaggcctggccaggggatgcc

SEQ ID NO: 8162456 - DNA, 19 bp, Homo sapiens
ccaggccatcccagttccc

SEQ ID NO: 8162457 - DNA, 19 bp, Homo sapiens
ccaggccatcccagttccc

SEQ ID NO: 8162458 - DNA, 22 bp, Homo sapiens
ccaggccattcccagagttgct

SEQ ID NO: 8162459 - DNA, 18 bp, Homo sapiens
ccaggccatgaacctctg

SEQ ID NO: 8162460 - DNA, 22 bp, Homo sapiens
ccaggccattcccagagttgct

SEQ ID NO: 8162461 - DNA, 22 bp, Homo sapiens
ccaggccagggctgcagcgagc

SEQ ID NO: 8162462 - DNA, 22 bp, Homo sapiens
ccaggccagggctgcagcgagc

SEQ ID NO: 8162463 - DNA, 21 bp, Homo sapiens
ccaggccaggcctacggggat

SEQ ID NO: 8162464 - DNA, 22 bp, Homo sapiens
ccaggccaggagagcgaggttt

SEQ ID NO: 8162465 - DNA, 22 bp, Homo sapiens
ccaggcccaccttggccactta

SEQ ID NO: 8162466 - DNA, 22 bp, Homo sapiens
ccaggcccaccttggccactta

SEQ ID NO: 8162467 - DNA, 22 bp, Homo sapiens
ccaggcccaccttggccactta

SEQ ID NO: 8162468 - DNA, 22 bp, Homo sapiens
ccaggcccaccttggccactta

SEQ ID NO: 8162469 - DNA, 22 bp, Homo sapiens
ccaggcccagggtactgaccaa

SEQ ID NO: 8162470 - DNA, 22 bp, Homo sapiens
ccaggcccagggtactgaccaa

SEQ ID NO: 8162471 - DNA, 22 bp, Homo sapiens
ccaggccccagggctggctttc

SEQ ID NO: 8162472 - DNA, 22 bp, Homo sapiens
tctttcttattagccattgttc

SEQ ID NO: 8162473 - DNA, 22 bp, Homo sapiens
tctttcttattagccattgttc

SEQ ID NO: 8162474 - DNA, 22 bp, Homo sapiens
ccaggcccccgagcagaagaca

SEQ ID NO: 8162475 - DNA, 22 bp, Homo sapiens
tctttcaaatgcttgaattgga

SEQ ID NO: 8162476 - DNA, 22 bp, Homo sapiens
ccaggccccagggctggctttc

SEQ ID NO: 8162477 - DNA, 22 bp, Homo sapiens
ccaggccccagggctggctttc

SEQ ID NO: 8162478 - DNA, 22 bp, Homo sapiens
ccaggccccagggctggctttc

SEQ ID NO: 8162479 - DNA, 19 bp, Homo sapiens
ccaggcctgcgggcgttgg

SEQ ID NO: 8162480 - DNA, 22 bp, Homo sapiens
ccaggcctgcattccctctcag

SEQ ID NO: 8162481 - DNA, 22 bp, Homo sapiens
ccaggcctgcattccctctcag

SEQ ID NO: 8162482 - DNA, 22 bp, Homo sapiens
ccaggcctgcattccctctcag

SEQ ID NO: 8162483 - DNA, 22 bp, Homo sapiens
ccaggcctgcattccctctcag

SEQ ID NO: 8162484 - DNA, 22 bp, Homo sapiens
ccaggcctggaccatgccaggg

SEQ ID NO: 8162485 - DNA, 22 bp, Homo sapiens
ccaggcctggaccatgccaggg

SEQ ID NO: 8162486 - DNA, 19 bp, Homo sapiens
ccaggcctgcgggcgttgg

SEQ ID NO: 8162487 - DNA, 22 bp, Homo sapiens
tctttctttatcacctgatatg

SEQ ID NO: 8162488 - DNA, 22 bp, Homo sapiens
tctttgaaagctgttctagagt

SEQ ID NO: 8162489 - DNA, 22 bp, Homo sapiens
ccaggcctgcatctgctgcgca

SEQ ID NO: 8162490 - DNA, 22 bp, Homo sapiens
ccaggcctgcatctgctgcgca

SEQ ID NO: 8162491 - DNA, 22 bp, Homo sapiens
tctttgaaagctgttctagagt

SEQ ID NO: 8162492 - DNA, 22 bp, Homo sapiens
tctttcttgtgggtgccctttt

SEQ ID NO: 8162493 - DNA, 22 bp, Homo sapiens
tctttcttgtgggtgccctttt

SEQ ID NO: 8162494 - DNA, 22 bp, Homo sapiens
tctttcttggtattctgagcta

SEQ ID NO: 8162495 - DNA, 22 bp, Homo sapiens
tctttcttggtattctgagcta

SEQ ID NO: 8162496 - DNA, 22 bp, Homo sapiens
tctttcttggtattctgagcta

SEQ ID NO: 8162497 - DNA, 22 bp, Homo sapiens
tctttcttggtataaagcaggg

SEQ ID NO: 8162498 - DNA, 22 bp, Homo sapiens
tctttcttgcaaggatgcagga

SEQ ID NO: 8162499 - DNA, 22 bp, Homo sapiens
tctttcttcagccctgtaagat

SEQ ID NO: 8162500 - DNA, 22 bp, Homo sapiens
tctttcttcctggagcccaaca

SEQ ID NO: 8162501 - DNA, 22 bp, Homo sapiens
tctttcttcagccctgtaagat

SEQ ID NO: 8162502 - DNA, 22 bp, Homo sapiens
tctttcttattatgctcaatgt

SEQ ID NO: 8162503 - DNA, 22 bp, Homo sapiens
tctttcttcagccctgtaagat

SEQ ID NO: 8162504 - DNA, 22 bp, Homo sapiens
cccgactagctgggattacagg

SEQ ID NO: 8162505 - DNA, 22 bp, Homo sapiens
cccgacctcgcaaagcgcactc

SEQ ID NO: 8162506 - DNA, 22 bp, Homo sapiens
cccgagggccgaaagctgcttt

SEQ ID NO: 8162507 - DNA, 22 bp, Homo sapiens
cccgagggccgaaagctgcttt

SEQ ID NO: 8162508 - DNA, 21 bp, Homo sapiens
cccgcacagcggtaggccgcc

SEQ ID NO: 8162509 - DNA, 21 bp, Homo sapiens
cccgcatcttcctctccagca

SEQ ID NO: 8162510 - DNA, 22 bp, Homo sapiens
ccccttggctgctctcaagtcc

SEQ ID NO: 8162511 - DNA, 22 bp, Homo sapiens
ccccttctgtgtcctgtcagcc

SEQ ID NO: 8162512 - DNA, 22 bp, Homo sapiens
ccccttgacctgtgatagcttc

SEQ ID NO: 8162513 - DNA, 22 bp, Homo sapiens
ccccttgaggggaatggctgga

SEQ ID NO: 8162514 - DNA, 19 bp, Homo sapiens
ccccttgtgtaactagcct

SEQ ID NO: 8162515 - DNA, 22 bp, Homo sapiens
ccccttctgtgtcctgtcagcc

SEQ ID NO: 8162516 - DNA, 22 bp, Homo sapiens
ccccttccaggaagcagaatcg

SEQ ID NO: 8162517 - DNA, 22 bp, Homo sapiens
ccccttccaggaagcagaatcg

SEQ ID NO: 8162518 - DNA, 22 bp, Homo sapiens
ccccttccttcctcagacagcc

SEQ ID NO: 8162519 - DNA, 22 bp, Homo sapiens
ccccttccttcctcagacagcc

SEQ ID NO: 8162520 - DNA, 22 bp, Homo sapiens
ccccttccttcctcagacagcc

SEQ ID NO: 8162521 - DNA, 22 bp, Homo sapiens
ccccttccttcctcagacagcc

SEQ ID NO: 8162522 - DNA, 22 bp, Homo sapiens
tgctggctttttggtccttgct

SEQ ID NO: 8162523 - DNA, 22 bp, Homo sapiens
tgctggctttttgtgtcaaaga

SEQ ID NO: 8162524 - DNA, 22 bp, Homo sapiens
tgctggctttttggtccttgct

SEQ ID NO: 8162525 - DNA, 22 bp, Homo sapiens
tgctggcttttccttcaggcag

SEQ ID NO: 8162526 - DNA, 22 bp, Homo sapiens
tgctggcttttccttcaggcag

SEQ ID NO: 8162527 - DNA, 22 bp, Homo sapiens
tgctgggatatagcttctaggg

SEQ ID NO: 8162528 - DNA, 22 bp, Homo sapiens
tgctgggattacagtcatgagc

SEQ ID NO: 8162529 - DNA, 22 bp, Homo sapiens
tgctgggatatagcttctaggg

SEQ ID NO: 8162530 - DNA, 22 bp, Homo sapiens
tgctggctttaaggttaaagtg

SEQ ID NO: 8162531 - DNA, 22 bp, Homo sapiens
tgctggctttagtgattggggt

SEQ ID NO: 8162532 - DNA, 22 bp, Homo sapiens
tgctggctttagtgattggggt

SEQ ID NO: 8162533 - DNA, 22 bp, Homo sapiens
tgctggctaatggaaaccagat

SEQ ID NO: 8162534 - DNA, 22 bp, Homo sapiens
tgctggcctgtccacgggctgt

SEQ ID NO: 8162535 - DNA, 23 bp, Homo sapiens
tgctggctaagaatctgcatttt

SEQ ID NO: 8162536 - DNA, 22 bp, Homo sapiens
tgctggctttgcgagatgcatt

SEQ ID NO: 8162537 - DNA, 22 bp, Homo sapiens
tgctggctttagtgattggggt

SEQ ID NO: 8162538 - DNA, 22 bp, Homo sapiens
tgctggctttctgtccctggca

SEQ ID NO: 8162539 - DNA, 22 bp, Homo sapiens
tgctggctttgcgagatgcatt

SEQ ID NO: 8162540 - DNA, 23 bp, Homo sapiens
tgctggcttttatctggtcccta

SEQ ID NO: 8162541 - DNA, 22 bp, Homo sapiens
tgctggcctgggctgcaccttg

SEQ ID NO: 8162542 - DNA, 22 bp, Homo sapiens
tgctggcctgggctgcaccttg

SEQ ID NO: 8162543 - DNA, 22 bp, Homo sapiens
tgctggcctcggcgctgggcct

SEQ ID NO: 8162544 - DNA, 22 bp, Homo sapiens
tgctggcctggttagaaagggg

SEQ ID NO: 8162545 - DNA, 22 bp, Homo sapiens
tgctggcctggttagaaagggg

SEQ ID NO: 8162546 - DNA, 21 bp, Homo sapiens
tgctggcctcaagggtgactt

SEQ ID NO: 8162547 - DNA, 22 bp, Homo sapiens
tgctggcccagtatggactgca

SEQ ID NO: 8162548 - DNA, 22 bp, Homo sapiens
tgctggcccagtatggactgca

SEQ ID NO: 8162549 - DNA, 22 bp, Homo sapiens
tgctggcccagtactaatgtct

SEQ ID NO: 8162550 - DNA, 21 bp, Homo sapiens
tgctggccatgtgctgggcat

SEQ ID NO: 8162551 - DNA, 22 bp, Homo sapiens
tgctggcccatgaagacgcagt

SEQ ID NO: 8162552 - DNA, 22 bp, Homo sapiens
tgctggccctggctcagggaac

SEQ ID NO: 8162553 - DNA, 22 bp, Homo sapiens
tgctggccggccaggtgctgag

SEQ ID NO: 8162554 - DNA, 22 bp, Homo sapiens
ccccacaggtgtctgaggcagg

SEQ ID NO: 8162555 - DNA, 22 bp, Homo sapiens
ccccacagcttgtggagagaat

SEQ ID NO: 8162556 - DNA, 22 bp, Homo sapiens
ccccacagccgccagcagggag

SEQ ID NO: 8162557 - DNA, 22 bp, Homo sapiens
ccccacagtccgtgaggagcca

SEQ ID NO: 8162558 - DNA, 22 bp, Homo sapiens
ccccacagtccgtgaggagcca

SEQ ID NO: 8162559 - DNA, 22 bp, Homo sapiens
ccccacaggtgtctgaggcagg

SEQ ID NO: 8162560 - DNA, 20 bp, Homo sapiens
ccccacactattgagcactt

SEQ ID NO: 8162561 - DNA, 22 bp, Homo sapiens
ccccacacctgccgggcagcag

SEQ ID NO: 8162562 - DNA, 22 bp, Homo sapiens
tgctggagcccaggcggccttt

SEQ ID NO: 8162563 - DNA, 22 bp, Homo sapiens
tgctggagcccaggcggccttt

SEQ ID NO: 8162564 - DNA, 22 bp, Homo sapiens
tgctggagcccaggcggccttt

SEQ ID NO: 8162565 - DNA, 22 bp, Homo sapiens
tgctggccaatggcagaggcgg

SEQ ID NO: 8162566 - DNA, 22 bp, Homo sapiens
tgctggccaatggcagaggcgg

SEQ ID NO: 8162567 - DNA, 22 bp, Homo sapiens
tgctggccaagcagaggtcaat

SEQ ID NO: 8162568 - DNA, 22 bp, Homo sapiens
ccccaccatgtagaaactgaga

SEQ ID NO: 8162569 - DNA, 22 bp, Homo sapiens
ccccaccaccaaggctcagttt

SEQ ID NO: 8162570 - DNA, 22 bp, Homo sapiens
ccccacccacctaagagaaact

SEQ ID NO: 8162571 - DNA, 22 bp, Homo sapiens
ccccaccctcgctccatttcgg

SEQ ID NO: 8162572 - DNA, 23 bp, Homo sapiens
cccattttcatgttaactcctgg

SEQ ID NO: 8162573 - DNA, 22 bp, Homo sapiens
cccattttagcaaggggtggcg

SEQ ID NO: 8162574 - DNA, 23 bp, Homo sapiens
cccattttcatgttaactcctgg

SEQ ID NO: 8162575 - DNA, 22 bp, Homo sapiens
cccatttttgtgtgagtaatga

SEQ ID NO: 8162576 - DNA, 22 bp, Homo sapiens
cccattttggaacgagtagcca

SEQ ID NO: 8162577 - DNA, 22 bp, Homo sapiens
cccattttgcttatgctgctgt

SEQ ID NO: 8162578 - DNA, 22 bp, Homo sapiens
cccatttttgtgtgagtaatga

SEQ ID NO: 8162579 - DNA, 22 bp, Homo sapiens
ccccaaagcctcagcctgcctg

SEQ ID NO: 8162580 - DNA, 22 bp, Homo sapiens
ccccaaagctgagttcccgcct

SEQ ID NO: 8162581 - DNA, 19 bp, Homo sapiens
ccccaaagtttagatgttg

SEQ ID NO: 8162582 - DNA, 22 bp, Homo sapiens
ccccaaagtgttggataattga

SEQ ID NO: 8162583 - DNA, 22 bp, Homo sapiens
cccattcatcctcgcttccttc

SEQ ID NO: 8162584 - DNA, 22 bp, Homo sapiens
cccattcatcctcgcttccttc

SEQ ID NO: 8162585 - DNA, 22 bp, Homo sapiens
cccattccctttactgttgcat

SEQ ID NO: 8162586 - DNA, 22 bp, Homo sapiens
cccaggtctccctgcagccctg

SEQ ID NO: 8162587 - DNA, 22 bp, Homo sapiens
cccaggtctatgccagctctga

SEQ ID NO: 8162588 - DNA, 22 bp, Homo sapiens
cccaggtctatgccagctctga

SEQ ID NO: 8162589 - DNA, 22 bp, Homo sapiens
cccaggtctatgccagctctga

SEQ ID NO: 8162590 - DNA, 22 bp, Homo sapiens
cccaggtctatgccagctctga

SEQ ID NO: 8162591 - DNA, 21 bp, Homo sapiens
cccaggtcgtggtcttcccag

SEQ ID NO: 8162592 - DNA, 22 bp, Homo sapiens
cccaggtcccggggccagctgc

SEQ ID NO: 8162593 - DNA, 22 bp, Homo sapiens
cccaggtcccggggccagctgc

SEQ ID NO: 8162594 - DNA, 22 bp, Homo sapiens
cccaggtcccgccccagctcta

SEQ ID NO: 8162595 - DNA, 22 bp, Homo sapiens
cccaggtcccgccccagctcta

SEQ ID NO: 8162596 - DNA, 23 bp, Homo sapiens
cccaggtcaaaattcacaggcct

SEQ ID NO: 8162597 - DNA, 23 bp, Homo sapiens
cccaggtcaaaattcacaggcct

SEQ ID NO: 8162598 - DNA, 23 bp, Homo sapiens
cccaggtcaaaattcacaggcct

SEQ ID NO: 8162599 - DNA, 22 bp, Homo sapiens
tggagcaggactgctgccctca

SEQ ID NO: 8162600 - DNA, 22 bp, Homo sapiens
tggagcagaaatggcctcttgt

SEQ ID NO: 8162601 - DNA, 22 bp, Homo sapiens
tggagcaggacggggagtggta

SEQ ID NO: 8162602 - DNA, 22 bp, Homo sapiens
tggagcaggacggggagtggta

SEQ ID NO: 8162603 - DNA, 22 bp, Homo sapiens
tggagcaggactgctgccctca

SEQ ID NO: 8162604 - DNA, 22 bp, Homo sapiens
tggagcaggactgctgccctca

SEQ ID NO: 8162605 - DNA, 16 bp, Homo sapiens
tggagcaggcaggatg

SEQ ID NO: 8162606 - DNA, 16 bp, Homo sapiens
tggagcaggcaggatg

SEQ ID NO: 8162607 - DNA, 22 bp, Homo sapiens
tggagcaggcatctttctctct

SEQ ID NO: 8162608 - DNA, 23 bp, Homo sapiens
ccctgagctggtccaggctcaac

SEQ ID NO: 8162609 - DNA, 23 bp, Homo sapiens
ccctgagctggtccaggctcaac

SEQ ID NO: 8162610 - DNA, 23 bp, Homo sapiens
ccctgagctggtccaggctcaac

SEQ ID NO: 8162611 - DNA, 23 bp, Homo sapiens
ccctgagctggtccaggctcaac

SEQ ID NO: 8162612 - DNA, 22 bp, Homo sapiens
tggagcaagctggagagaacat

SEQ ID NO: 8162613 - DNA, 22 bp, Homo sapiens
tggagcaaacccatggctgtgc

SEQ ID NO: 8162614 - DNA, 22 bp, Homo sapiens
ccctgagcacacctggcagaca

SEQ ID NO: 8162615 - DNA, 22 bp, Homo sapiens
ccctgagcacacctggcagaca

SEQ ID NO: 8162616 - DNA, 22 bp, Homo sapiens
ccctgagcaacaaactgaatac

SEQ ID NO: 8162617 - DNA, 18 bp, Homo sapiens
ccctgagatgatgctgtg

SEQ ID NO: 8162618 - DNA, 22 bp, Homo sapiens
ccctgagaggttgagtgtctgc

SEQ ID NO: 8162619 - DNA, 22 bp, Homo sapiens
ccctgagaggttgagtgtctgc

SEQ ID NO: 8162620 - DNA, 22 bp, Homo sapiens
ccctgagccacacagagcaggt

SEQ ID NO: 8162621 - DNA, 22 bp, Homo sapiens
ccctgagccacacagagcaggt

SEQ ID NO: 8162622 - DNA, 22 bp, Homo sapiens
ccctgagccgctgctccaacct

SEQ ID NO: 8162623 - DNA, 22 bp, Homo sapiens
ccctgagccgctgctccaacct

SEQ ID NO: 8162624 - DNA, 22 bp, Homo sapiens
ccctgagaacaacttaggggtc

SEQ ID NO: 8162625 - DNA, 22 bp, Homo sapiens
ccctgagagcagggtctttctc

SEQ ID NO: 8162626 - DNA, 20 bp, Homo sapiens
ccctgagacgactgagctcc

SEQ ID NO: 8162627 - DNA, 20 bp, Homo sapiens
ccctgagacaaaggaggggc

SEQ ID NO: 8162628 - DNA, 20 bp, Homo sapiens
ccctgagacaaaggaggggc

SEQ ID NO: 8162629 - DNA, 22 bp, Homo sapiens
ccctctctcaggctgacagcct

SEQ ID NO: 8162630 - DNA, 19 bp, Homo sapiens
ccctcttgcacaaagcaaa

SEQ ID NO: 8162631 - DNA, 19 bp, Homo sapiens
ccctcttgcacaaagcaaa

SEQ ID NO: 8162632 - DNA, 19 bp, Homo sapiens
ccctcttgcacaaagcaaa

SEQ ID NO: 8162633 - DNA, 19 bp, Homo sapiens
ccctcttgcacaaagcaaa

SEQ ID NO: 8162634 - DNA, 19 bp, Homo sapiens
ccctcttgcacaaagcaaa

SEQ ID NO: 8162635 - DNA, 22 bp, Homo sapiens
ccctcttgctgactcttaaagg

SEQ ID NO: 8162636 - DNA, 22 bp, Homo sapiens
ccctgaaagtacactgggacgg

SEQ ID NO: 8162637 - DNA, 22 bp, Homo sapiens
ccctgaaatcctgtgctctgtg

SEQ ID NO: 8162638 - DNA, 18 bp, Homo sapiens
ccctctcctgctagtggg

SEQ ID NO: 8162639 - DNA, 22 bp, Homo sapiens
ccctctcctggctgcatggagc

SEQ ID NO: 8162640 - DNA, 22 bp, Homo sapiens
ccctctccctgcagaatgtggc

SEQ ID NO: 8162641 - DNA, 18 bp, Homo sapiens
ccctctcctgctagtggg

SEQ ID NO: 8162642 - DNA, 22 bp, Homo sapiens
ccctctacagggaagcgctttc

SEQ ID NO: 8162643 - DNA, 22 bp, Homo sapiens
ccctctccctgcagaatgtggc

SEQ ID NO: 8162644 - DNA, 22 bp, Homo sapiens
tggaatgtgaacatacaaggta

SEQ ID NO: 8162645 - DNA, 22 bp, Homo sapiens
tggaatgtcttgatatagaggt

SEQ ID NO: 8162646 - DNA, 22 bp, Homo sapiens
tggaatgtgctactgttgattt

SEQ ID NO: 8162647 - DNA, 22 bp, Homo sapiens
tggaatgtgagaataccgtttt

SEQ ID NO: 8162648 - DNA, 22 bp, Homo sapiens
tggaatgtggtatcagtagaaa

SEQ ID NO: 8162649 - DNA, 22 bp, Homo sapiens
tggaatgtggataagggtgtct

SEQ ID NO: 8162650 - DNA, 22 bp, Homo sapiens
tggaatgtgctagggctgtggc

SEQ ID NO: 8162651 - DNA, 22 bp, Homo sapiens
tggaatgtcagctacaagaggg

SEQ ID NO: 8162652 - DNA, 22 bp, Homo sapiens
tggaatgtcataccataaaaga

SEQ ID NO: 8162653 - DNA, 23 bp, Homo sapiens
tggaatgtctgattctgctctag

SEQ ID NO: 8162654 - DNA, 22 bp, Homo sapiens
tggaatgtcaagaagcagtaag

SEQ ID NO: 8162655 - DNA, 22 bp, Homo sapiens
tggaatgtcaaaagtctgctat

SEQ ID NO: 8162656 - DNA, 22 bp, Homo sapiens
tggaatgtattaagtattgagt

SEQ ID NO: 8162657 - DNA, 22 bp, Homo sapiens
tggaatgtatagatgttatgta

SEQ ID NO: 8162658 - DNA, 22 bp, Homo sapiens
tggaatgtaaagcgtgtgataa

SEQ ID NO: 8162659 - DNA, 22 bp, Homo sapiens
tggaatgtaatcatgtggtggt

SEQ ID NO: 8162660 - DNA, 22 bp, Homo sapiens
tggaatgtaatcagaatatgaa

SEQ ID NO: 8162661 - DNA, 22 bp, Homo sapiens
tggaatgtaaagggtatgggat

SEQ ID NO: 8162662 - DNA, 22 bp, Homo sapiens
tggaatgtagtgtccatggaat

SEQ ID NO: 8162663 - DNA, 20 bp, Homo sapiens
tggaatgtagtcggtgagag

SEQ ID NO: 8162664 - DNA, 22 bp, Homo sapiens
tggaatgtagcaagtgttgtca

SEQ ID NO: 8162665 - DNA, 21 bp, Homo sapiens
tggaatgtacctccctctctt

SEQ ID NO: 8162666 - DNA, 22 bp, Homo sapiens
tggaatggggactttgggacat

SEQ ID NO: 8162667 - DNA, 22 bp, Homo sapiens
tggaatggaaacaaactgagga

SEQ ID NO: 8162668 - DNA, 22 bp, Homo sapiens
tggaatgtaaactctgtgaggg

SEQ ID NO: 8162669 - DNA, 22 bp, Homo sapiens
tggaatgtaaactctgtgaggg

SEQ ID NO: 8162670 - DNA, 22 bp, Homo sapiens
tggaatgtaaacctcaggtggg

SEQ ID NO: 8162671 - DNA, 22 bp, Homo sapiens
tggaatgtgttctattttacag

SEQ ID NO: 8162672 - DNA, 22 bp, Homo sapiens
tggaatgttaaacctcaatgat

SEQ ID NO: 8162673 - DNA, 22 bp, Homo sapiens
tggaatgttatgatgatggtaa

SEQ ID NO: 8162674 - DNA, 22 bp, Homo sapiens
ccctcctctccctaagagtcac

SEQ ID NO: 8162675 - DNA, 22 bp, Homo sapiens
ccctcctggaggcggatgccca

SEQ ID NO: 8162676 - DNA, 22 bp, Homo sapiens
ccctcctgtgcctgaggccagc

SEQ ID NO: 8162677 - DNA, 22 bp, Homo sapiens
ccctcctggaggcggatgccca

SEQ ID NO: 8162678 - DNA, 22 bp, Homo sapiens
ccctcgctctaggcagccctgt

SEQ ID NO: 8162679 - DNA, 22 bp, Homo sapiens
ccctcgccgcagctgcttcccg

SEQ ID NO: 8162680 - DNA, 22 bp, Homo sapiens
ccctccttaccaccacagctcc

SEQ ID NO: 8162681 - DNA, 22 bp, Homo sapiens
ccctcctgtgcctgaggccagc

SEQ ID NO: 8162682 - DNA, 22 bp, Homo sapiens
ccctcctttctaggcttccagc

SEQ ID NO: 8162683 - DNA, 22 bp, Homo sapiens
ccctcctttctaggcttccagc

SEQ ID NO: 8162684 - DNA, 22 bp, Homo sapiens
tgctgtgtaaaaggtgattgaa

SEQ ID NO: 8162685 - DNA, 22 bp, Homo sapiens
tgctgtgtaaaaggtgattgaa

SEQ ID NO: 8162686 - DNA, 22 bp, Homo sapiens
tgctgtggttcccagagtggat

SEQ ID NO: 8162687 - DNA, 22 bp, Homo sapiens
tgctgtgggatatatgttcaaa

SEQ ID NO: 8162688 - DNA, 22 bp, Homo sapiens
tgctgtgggatatatgttcaaa

SEQ ID NO: 8162689 - DNA, 22 bp, Homo sapiens
tgctgtggcagtttatgtatag

SEQ ID NO: 8162690 - DNA, 22 bp, Homo sapiens
tgctgtgctggcggcagaggcc

SEQ ID NO: 8162691 - DNA, 23 bp, Homo sapiens
tgctgtggatggcaggtccttgc

SEQ ID NO: 8162692 - DNA, 23 bp, Homo sapiens
tgctgtggatggcaggtccttgc

SEQ ID NO: 8162693 - DNA, 18 bp, Homo sapiens
cccggctaatttttggta

SEQ ID NO: 8162694 - DNA, 18 bp, Homo sapiens
cccggctaatttttggta

SEQ ID NO: 8162695 - DNA, 18 bp, Homo sapiens
cccggctaatttttggta

SEQ ID NO: 8162696 - DNA, 22 bp, Homo sapiens
tgctgtgctctttaaggtgctg

SEQ ID NO: 8162697 - DNA, 22 bp, Homo sapiens
tgctgtgttaaatacaagcatg

SEQ ID NO: 8162698 - DNA, 22 bp, Homo sapiens
tgctgtgttcaccaatatgtgt

SEQ ID NO: 8162699 - DNA, 22 bp, Homo sapiens
tgctgtgtggatgtgaagaatc

SEQ ID NO: 8162700 - DNA, 22 bp, Homo sapiens
tggaagggagctggaatttgga

SEQ ID NO: 8162701 - DNA, 22 bp, Homo sapiens
tggaatggaaacaaactgagga

SEQ ID NO: 8162702 - DNA, 22 bp, Homo sapiens
tggaagggagctggaatttgga

SEQ ID NO: 8162703 - DNA, 22 bp, Homo sapiens
tgctgtgttctcctgactcacc

SEQ ID NO: 8162704 - DNA, 22 bp, Homo sapiens
tgctgtgttctcctgactcacc

SEQ ID NO: 8162705 - DNA, 22 bp, Homo sapiens
tgcacagagagatgagacacgt

SEQ ID NO: 8162706 - DNA, 22 bp, Homo sapiens
tgcacagagagatgagacacgt

SEQ ID NO: 8162707 - DNA, 22 bp, Homo sapiens
tgcacagagggaggcataaaat

SEQ ID NO: 8162708 - DNA, 22 bp, Homo sapiens
tgcacagagcaggcaccagcgg

SEQ ID NO: 8162709 - DNA, 22 bp, Homo sapiens
tgccacagaggtgaagcccact

SEQ ID NO: 8162710 - DNA, 22 bp, Homo sapiens
tgccacagaggtgaagcccact

SEQ ID NO: 8162711 - DNA, 19 bp, Homo sapiens
tgccacagataaaaactga

SEQ ID NO: 8162712 - DNA, 22 bp, Homo sapiens
tgccagctccgaggagctgcag

SEQ ID NO: 8162713 - DNA, 22 bp, Homo sapiens
tgccagcttctaaggacccagg

SEQ ID NO: 8162714 - DNA, 22 bp, Homo sapiens
tgccagctgttcccacccaaaa

SEQ ID NO: 8162715 - DNA, 22 bp, Homo sapiens
tgccagctgacagcagagacaa

SEQ ID NO: 8162716 - DNA, 22 bp, Homo sapiens
tgccagctcctgcagctcctgt

SEQ ID NO: 8162717 - DNA, 22 bp, Homo sapiens
tgccagcttttgactatcttag

SEQ ID NO: 8162718 - DNA, 22 bp, Homo sapiens
tgccagtgcttgtgtctgagca

SEQ ID NO: 8162719 - DNA, 22 bp, Homo sapiens
tgccagtgggtgtgcagagact

SEQ ID NO: 8162720 - DNA, 22 bp, Homo sapiens
tgccagtgcctgctgcccaata

SEQ ID NO: 8162721 - DNA, 22 bp, Homo sapiens
tgccagtgcttgtgtctgagca

SEQ ID NO: 8162722 - DNA, 22 bp, Homo sapiens
tgccagtgaaacgtggtctcat

SEQ ID NO: 8162723 - DNA, 22 bp, Homo sapiens
tgccagtgagccctgggatgtg

SEQ ID NO: 8162724 - DNA, 22 bp, Homo sapiens
tgccagtgaaacgtggtctcat

SEQ ID NO: 8162725 - DNA, 22 bp, Homo sapiens
tgccagtctcaccctgggtcct

SEQ ID NO: 8162726 - DNA, 22 bp, Homo sapiens
tgccaggctaagtggaggactt

SEQ ID NO: 8162727 - DNA, 22 bp, Homo sapiens
tgccaggctaagtggaggactt

SEQ ID NO: 8162728 - DNA, 22 bp, Homo sapiens
tgccagtgaaacatggaagaat

SEQ ID NO: 8162729 - DNA, 22 bp, Homo sapiens
tgccaggctaagtggaggactt

SEQ ID NO: 8162730 - DNA, 22 bp, Homo sapiens
cccaggagataacgttcccaag

SEQ ID NO: 8162731 - DNA, 22 bp, Homo sapiens
cccaggagagaggccagttggc

SEQ ID NO: 8162732 - DNA, 22 bp, Homo sapiens
cccaggagagaggccagttggc

SEQ ID NO: 8162733 - DNA, 22 bp, Homo sapiens
cccaggagagaggccagttggc

SEQ ID NO: 8162734 - DNA, 22 bp, Homo sapiens
cccaggagacctagatctgttt

SEQ ID NO: 8162735 - DNA, 22 bp, Homo sapiens
tgccaggagtcaggccaggcag

SEQ ID NO: 8162736 - DNA, 22 bp, Homo sapiens
cccaggagacctagatctgttt

SEQ ID NO: 8162737 - DNA, 22 bp, Homo sapiens
cccaggagactgagctgtaacc

SEQ ID NO: 8162738 - DNA, 22 bp, Homo sapiens
cccaggagagagacttgaatct

SEQ ID NO: 8162739 - DNA, 22 bp, Homo sapiens
tgccagtgtctgctatctgaga

SEQ ID NO: 8162740 - DNA, 22 bp, Homo sapiens
tgccagtgtggaactaggaaga

SEQ ID NO: 8162741 - DNA, 22 bp, Homo sapiens
tgccagtgtggaactaggaaga

SEQ ID NO: 8162742 - DNA, 22 bp, Homo sapiens
tgccagtgggtgtgcagagact

SEQ ID NO: 8162743 - DNA, 22 bp, Homo sapiens
tgccagtgggtgtgcagagact

SEQ ID NO: 8162744 - DNA, 22 bp, Homo sapiens
tgccagtgtagtagctggttta

SEQ ID NO: 8162745 - DNA, 20 bp, Homo sapiens
tgccagtgtgtcaatttata

SEQ ID NO: 8162746 - DNA, 22 bp, Homo sapiens
tgccagtgtggaactaggaaga

SEQ ID NO: 8162747 - DNA, 22 bp, Homo sapiens
tgccagtgtgagtggagttctt

SEQ ID NO: 8162748 - DNA, 22 bp, Homo sapiens
tgccagtgtgtgccttaagctc

SEQ ID NO: 8162749 - DNA, 22 bp, Homo sapiens
tgccatagcaatggtaagctga

SEQ ID NO: 8162750 - DNA, 22 bp, Homo sapiens
tgcccagcccctatccctggga

SEQ ID NO: 8162751 - DNA, 22 bp, Homo sapiens
tgccatattattgagcatatta

SEQ ID NO: 8162752 - DNA, 22 bp, Homo sapiens
tgccatattgatgtgctgtacc

SEQ ID NO: 8162753 - DNA, 22 bp, Homo sapiens
tgccatattgcaaagtgtctgc

SEQ ID NO: 8162754 - DNA, 22 bp, Homo sapiens
tgccatattgcaaagtgtctgc

SEQ ID NO: 8162755 - DNA, 22 bp, Homo sapiens
tgcccagcgcccacattctgtc

SEQ ID NO: 8162756 - DNA, 22 bp, Homo sapiens
tgcccagcctaaacttggcaag

SEQ ID NO: 8162757 - DNA, 19 bp, Homo sapiens
cccaggctacatggagagg

SEQ ID NO: 8162758 - DNA, 19 bp, Homo sapiens
cccaggctacatggagagg

SEQ ID NO: 8162759 - DNA, 22 bp, Homo sapiens
cccaggcatcccattaaggagc

SEQ ID NO: 8162760 - DNA, 22 bp, Homo sapiens
cccaggcatcccattaaggagc

SEQ ID NO: 8162761 - DNA, 22 bp, Homo sapiens
tgcccagctgtcaaagtagata

SEQ ID NO: 8162762 - DNA, 22 bp, Homo sapiens
cccaggcagtgtgtgcatgcgt

SEQ ID NO: 8162763 - DNA, 22 bp, Homo sapiens
cccaggctcactgtccgcttcc

SEQ ID NO: 8162764 - DNA, 22 bp, Homo sapiens
cccaggctcactgtccgcttcc

SEQ ID NO: 8162765 - DNA, 22 bp, Homo sapiens
cccaggctcactgtccgcttcc

SEQ ID NO: 8162766 - DNA, 22 bp, Homo sapiens
cccaggctcagactggcttgtt

SEQ ID NO: 8162767 - DNA, 22 bp, Homo sapiens
cccaggctcagactggcttgtt

SEQ ID NO: 8162768 - DNA, 22 bp, Homo sapiens
cccaggctcccaggtgggacaa

SEQ ID NO: 8162769 - DNA, 22 bp, Homo sapiens
cccaggctcccaggtgggacaa

SEQ ID NO: 8162770 - DNA, 22 bp, Homo sapiens
cccaggctcccaggtgggacaa

SEQ ID NO: 8162771 - DNA, 22 bp, Homo sapiens
cccaggctcccaggtgggacaa

SEQ ID NO: 8162772 - DNA, 22 bp, Homo sapiens
cccaggctagaaaggccaacaa

SEQ ID NO: 8162773 - DNA, 22 bp, Homo sapiens
cccaggctagaaaggccaacaa

SEQ ID NO: 8162774 - DNA, 22 bp, Homo sapiens
cccaggctagaaaggccaacaa

SEQ ID NO: 8162775 - DNA, 19 bp, Homo sapiens
cccaggctacatggagagg

SEQ ID NO: 8162776 - DNA, 22 bp, Homo sapiens
cccaggctagtatgatatcagt

SEQ ID NO: 8162777 - DNA, 22 bp, Homo sapiens
cccaggctagtatgatatcagt

SEQ ID NO: 8162778 - DNA, 22 bp, Homo sapiens
tgccctggggagcccagccagg

SEQ ID NO: 8162779 - DNA, 22 bp, Homo sapiens
tgccctggggagcccagccagg

SEQ ID NO: 8162780 - DNA, 22 bp, Homo sapiens
tgccctggggtctggagcagca

SEQ ID NO: 8162781 - DNA, 21 bp, Homo sapiens
tgccctggggctcttccctca

SEQ ID NO: 8162782 - DNA, 22 bp, Homo sapiens
tgccctggggtctggagcagca

SEQ ID NO: 8162783 - DNA, 22 bp, Homo sapiens
tgccctggggtctggagcagca

SEQ ID NO: 8162784 - DNA, 22 bp, Homo sapiens
cccaggctcccaggtgggacaa

SEQ ID NO: 8162785 - DNA, 22 bp, Homo sapiens
cccaggctcctactgtattctg

SEQ ID NO: 8162786 - DNA, 22 bp, Homo sapiens
cccaggctcctactgtattctg

SEQ ID NO: 8162787 - DNA, 22 bp, Homo sapiens
tgccctgggagttggagctgct

SEQ ID NO: 8162788 - DNA, 22 bp, Homo sapiens
tgccctgggagttggagctgct

SEQ ID NO: 8162789 - DNA, 22 bp, Homo sapiens
tgccctgggctttgctatgact

SEQ ID NO: 8162790 - DNA, 22 bp, Homo sapiens
tgccctgggctttgctatgact

SEQ ID NO: 8162791 - DNA, 22 bp, Homo sapiens
tgccctgggagttggagctgct

SEQ ID NO: 8162792 - DNA, 22 bp, Homo sapiens
tgccctgggctttgctatgact

SEQ ID NO: 8162793 - DNA, 22 bp, Homo sapiens
tgcctgtgtgaccacgggcaag

SEQ ID NO: 8162794 - DNA, 17 bp, Homo sapiens
cccagggaccactgctt

SEQ ID NO: 8162795 - DNA, 17 bp, Homo sapiens
cccagggaccactgctt

SEQ ID NO: 8162796 - DNA, 17 bp, Homo sapiens
cccagggaccactgctt

SEQ ID NO: 8162797 - DNA, 22 bp, Homo sapiens
tgcctgtgttgattactttgtc

SEQ ID NO: 8162798 - DNA, 22 bp, Homo sapiens
tgcctgtgttgattactttgtc

SEQ ID NO: 8162799 - DNA, 22 bp, Homo sapiens
tgcctgtgttgattactttgtc

SEQ ID NO: 8162800 - DNA, 22 bp, Homo sapiens
tgcctgtgtggggtctgccgcc

SEQ ID NO: 8162801 - DNA, 22 bp, Homo sapiens
tgcctgtgtggtctgcgcatta

SEQ ID NO: 8162802 - DNA, 22 bp, Homo sapiens
cccagggacagatgggcagcta

SEQ ID NO: 8162803 - DNA, 22 bp, Homo sapiens
cccagggacagatgggcagcta

SEQ ID NO: 8162804 - DNA, 22 bp, Homo sapiens
cccagggacagctaggtggggc

SEQ ID NO: 8162805 - DNA, 17 bp, Homo sapiens
cccagggaccactgctt

SEQ ID NO: 8162806 - DNA, 17 bp, Homo sapiens
cccagggaccactgctt

SEQ ID NO: 8162807 - DNA, 22 bp, Homo sapiens
tgcctgttgcccacctgataaa

SEQ ID NO: 8162808 - DNA, 22 bp, Homo sapiens
tgcctgttgcccacctgataaa

SEQ ID NO: 8162809 - DNA, 22 bp, Homo sapiens
tgcctgttgcccacctgataaa

SEQ ID NO: 8162810 - DNA, 22 bp, Homo sapiens
tgcctgttgcccacctgataaa

SEQ ID NO: 8162811 - DNA, 22 bp, Homo sapiens
tgcctgttgcccacctgataaa

SEQ ID NO: 8162812 - DNA, 22 bp, Homo sapiens
tgccttcaccaggccttcagcc

SEQ ID NO: 8162813 - DNA, 22 bp, Homo sapiens
tgccttcctgctttgagttctg

SEQ ID NO: 8162814 - DNA, 22 bp, Homo sapiens
tgccttcctgctttgagttctg

SEQ ID NO: 8162815 - DNA, 22 bp, Homo sapiens
tgccttcctaatggtggggttt

SEQ ID NO: 8162816 - DNA, 22 bp, Homo sapiens
tgccttcctggagctgaaggct

SEQ ID NO: 8162817 - DNA, 22 bp, Homo sapiens
cccagggattataaaggtgaaa

SEQ ID NO: 8162818 - DNA, 22 bp, Homo sapiens
cccagggccctggacagctaca

SEQ ID NO: 8162819 - DNA, 22 bp, Homo sapiens
cccagggttgcctgcctctgct

SEQ ID NO: 8162820 - DNA, 22 bp, Homo sapiens
cccagggttgcctgcctctgct

SEQ ID NO: 8162821 - DNA, 22 bp, Homo sapiens
cccagggtggatgcaagcagca

SEQ ID NO: 8162822 - DNA, 22 bp, Homo sapiens
cccagggtggatgcaagcagca

SEQ ID NO: 8162823 - DNA, 23 bp, Homo sapiens
cccaggtagccctctagagcctg

SEQ ID NO: 8162824 - DNA, 23 bp, Homo sapiens
cccaggtagccctctagagcctg

SEQ ID NO: 8162825 - DNA, 22 bp, Homo sapiens
cccagggtccctgctctctgtg

SEQ ID NO: 8162826 - DNA, 22 bp, Homo sapiens
cccagggtgcggccctggctgg

SEQ ID NO: 8162827 - DNA, 22 bp, Homo sapiens
cccagggtagctgagctggcag

SEQ ID NO: 8162828 - DNA, 22 bp, Homo sapiens
cccagggtagctgagctggcag

SEQ ID NO: 8162829 - DNA, 22 bp, Homo sapiens
cccagggtccctgctctctgtg

SEQ ID NO: 8162830 - DNA, 22 bp, Homo sapiens
cccaggggttcaaggctgcagt

SEQ ID NO: 8162831 - DNA, 22 bp, Homo sapiens
cccaggggttcaaggctgcagt

SEQ ID NO: 8162832 - DNA, 22 bp, Homo sapiens
cccaggggttcaaggctgcagt

SEQ ID NO: 8162833 - DNA, 22 bp, Homo sapiens
cccaggggttcaaggctgcagt

SEQ ID NO: 8162834 - DNA, 22 bp, Homo sapiens
cccaggggttcaaggctgcagt

SEQ ID NO: 8162835 - DNA, 22 bp, Homo sapiens
cccaggggttctagaccagctt

SEQ ID NO: 8162836 - DNA, 22 bp, Homo sapiens
cccaggggttctagaccagctt

SEQ ID NO: 8162837 - DNA, 22 bp, Homo sapiens
cccaggggttctagaccagctt

SEQ ID NO: 8162838 - DNA, 20 bp, Homo sapiens
cccaggggttgtggtgagga

SEQ ID NO: 8162839 - DNA, 20 bp, Homo sapiens
cccaggggttgtggtgagga

SEQ ID NO: 8162840 - DNA, 20 bp, Homo sapiens
cccaggggttgtggtgagga

SEQ ID NO: 8162841 - DNA, 22 bp, Homo sapiens
cccagggtaatcatgtgaagcc

SEQ ID NO: 8162842 - DNA, 22 bp, Homo sapiens
cccagggtagctgagctggcag

SEQ ID NO: 8162843 - DNA, 22 bp, Homo sapiens
cccaggggttctgagcagcagc

SEQ ID NO: 8162844 - DNA, 22 bp, Homo sapiens
cccaggggttctgagcagcagc

SEQ ID NO: 8162845 - DNA, 21 bp, Homo sapiens
cccagggaagccgcagtcacc

SEQ ID NO: 8162846 - DNA, 22 bp, Homo sapiens
cccaggctggtcctgaactcct

SEQ ID NO: 8162847 - DNA, 22 bp, Homo sapiens
cccaggctggtcctgaactcct

SEQ ID NO: 8162848 - DNA, 22 bp, Homo sapiens
cccaggctggggctcctccagc

SEQ ID NO: 8162849 - DNA, 22 bp, Homo sapiens
cccaggctggggctcctccagc

SEQ ID NO: 8162850 - DNA, 22 bp, Homo sapiens
cccaggctggtcctgaactcct

SEQ ID NO: 8162851 - DNA, 22 bp, Homo sapiens
cccaggctggtcctgaactcct

SEQ ID NO: 8162852 - DNA, 23 bp, Homo sapiens
cccagggacacgatgacacctcc

SEQ ID NO: 8162853 - DNA, 22 bp, Homo sapiens
cccagggaagggctacctgagg

SEQ ID NO: 8162854 - DNA, 22 bp, Homo sapiens
cccagggaaggcagatggagga

SEQ ID NO: 8162855 - DNA, 22 bp, Homo sapiens
cccagggaatgactctggcctt

SEQ ID NO: 8162856 - DNA, 22 bp, Homo sapiens
cccagggaagggctacctgagg

SEQ ID NO: 8162857 - DNA, 22 bp, Homo sapiens
cccagggaatgactctggcctt

SEQ ID NO: 8162858 - DNA, 22 bp, Homo sapiens
cccaggctggcctccgcagtgc

SEQ ID NO: 8162859 - DNA, 22 bp, Homo sapiens
cccaggctggcctccgcagtgc

SEQ ID NO: 8162860 - DNA, 22 bp, Homo sapiens
cccaggctggcctccgcagtgc

SEQ ID NO: 8162861 - DNA, 22 bp, Homo sapiens
cccaggctgggaacgattctag

SEQ ID NO: 8162862 - DNA, 22 bp, Homo sapiens
cccaggctggggctcctccagc

SEQ ID NO: 8162863 - DNA, 22 bp, Homo sapiens
cccaggctggggctcctccagc

SEQ ID NO: 8162864 - DNA, 22 bp, Homo sapiens
cccaggctggggctcctccagc

SEQ ID NO: 8162865 - DNA, 22 bp, Homo sapiens
cccaggctggggctcctccagc

SEQ ID NO: 8162866 - DNA, 22 bp, Homo sapiens
cccaggctgggaacgattctag

SEQ ID NO: 8162867 - DNA, 22 bp, Homo sapiens
cccaggctggagtgtaatggtg

SEQ ID NO: 8162868 - DNA, 22 bp, Homo sapiens
cccaggctggagtgtaatggtg

SEQ ID NO: 8162869 - DNA, 22 bp, Homo sapiens
cccaggctggagtgtaatggtg

SEQ ID NO: 8162870 - DNA, 22 bp, Homo sapiens
cccaggctggatttcggtggca

SEQ ID NO: 8162871 - DNA, 22 bp, Homo sapiens
cccaggctggatttcggtggca

SEQ ID NO: 8162872 - DNA, 22 bp, Homo sapiens
cccaggctggatttcggtggca

SEQ ID NO: 8162873 - DNA, 22 bp, Homo sapiens
cccaggctggatttcggtggca

SEQ ID NO: 8162874 - DNA, 22 bp, Homo sapiens
cccaggctggcactgctgaagt

SEQ ID NO: 8162875 - DNA, 22 bp, Homo sapiens
cccaggctggcactgctgaagt

SEQ ID NO: 8162876 - DNA, 22 bp, Homo sapiens
cccaggctggcactgctgaagt

SEQ ID NO: 8162877 - DNA, 22 bp, Homo sapiens
cccaggctggagtgcagtggcg

SEQ ID NO: 8162878 - DNA, 22 bp, Homo sapiens
cccaggctggagtgcagtggcg

SEQ ID NO: 8162879 - DNA, 22 bp, Homo sapiens
cccaggctggagtgcaatggtg

SEQ ID NO: 8162880 - DNA, 22 bp, Homo sapiens
cccaggctggagtgcagtggcg

SEQ ID NO: 8162881 - DNA, 22 bp, Homo sapiens
cccaggctggagtgcagtggcg

SEQ ID NO: 8162882 - DNA, 22 bp, Homo sapiens
cccaggctggagtgcagtggcg

SEQ ID NO: 8162883 - DNA, 22 bp, Homo sapiens
cccaggctggagtgcaatggtg

SEQ ID NO: 8162884 - DNA, 22 bp, Homo sapiens
cccaggctggagtgcaatggtg

SEQ ID NO: 8162885 - DNA, 22 bp, Homo sapiens
cccaggctggagtgcaatggca

SEQ ID NO: 8162886 - DNA, 22 bp, Homo sapiens
cccaggctggagtgcaatggca

SEQ ID NO: 8162887 - DNA, 22 bp, Homo sapiens
cccaggctggagtgcaatggca

SEQ ID NO: 8162888 - DNA, 22 bp, Homo sapiens
cccaggctgagttagaggtgtc

SEQ ID NO: 8162889 - DNA, 22 bp, Homo sapiens
cccaggctgagttagaggtgtc

SEQ ID NO: 8162890 - DNA, 22 bp, Homo sapiens
cccaggctgagttagaggtgtc

SEQ ID NO: 8162891 - DNA, 22 bp, Homo sapiens
tgccctggttacactggagtcc

SEQ ID NO: 8162892 - DNA, 22 bp, Homo sapiens
cccaggctggagggcagtgtca

SEQ ID NO: 8162893 - DNA, 22 bp, Homo sapiens
cccaggctggagggcagtgtca

SEQ ID NO: 8162894 - DNA, 22 bp, Homo sapiens
cccaggctggagggcagtgtca

SEQ ID NO: 8162895 - DNA, 22 bp, Homo sapiens
cccaggctggagggcagtgtca

SEQ ID NO: 8162896 - DNA, 22 bp, Homo sapiens
cccaggctggagggcagtgtca

SEQ ID NO: 8162897 - DNA, 22 bp, Homo sapiens
tgccctggtgaagtgctctcct

SEQ ID NO: 8162898 - DNA, 22 bp, Homo sapiens
tgccctggtgaagtgctctcct

SEQ ID NO: 8162899 - DNA, 22 bp, Homo sapiens
tgccctggtgaagtgctctcct

SEQ ID NO: 8162900 - DNA, 22 bp, Homo sapiens
tgccctggtagacacagactgt

SEQ ID NO: 8162901 - DNA, 22 bp, Homo sapiens
tgccctggtagacacagactgt

SEQ ID NO: 8162902 - DNA, 22 bp, Homo sapiens
tgccctggtagacacagactgt

SEQ ID NO: 8162903 - DNA, 22 bp, Homo sapiens
tggcagaggagaattaagatta

SEQ ID NO: 8162904 - DNA, 19 bp, Homo sapiens
tggcagaggacaaggactt

SEQ ID NO: 8162905 - DNA, 19 bp, Homo sapiens
tggcagaggacaaggactt

SEQ ID NO: 8162906 - DNA, 19 bp, Homo sapiens
tggcagaggacaaggactt

SEQ ID NO: 8162907 - DNA, 19 bp, Homo sapiens
tggcagaggacaaggactt

SEQ ID NO: 8162908 - DNA, 19 bp, Homo sapiens
tggcagaggacaaggactt

SEQ ID NO: 8162909 - DNA, 21 bp, Homo sapiens
cccttcttgggtcaaagtata

SEQ ID NO: 8162910 - DNA, 22 bp, Homo sapiens
cccttccttgtgactggtgggg

SEQ ID NO: 8162911 - DNA, 22 bp, Homo sapiens
cccttctctttcactcactatt

SEQ ID NO: 8162912 - DNA, 22 bp, Homo sapiens
cccttcctcccaggcttctgtg

SEQ ID NO: 8162913 - DNA, 22 bp, Homo sapiens
cccttcctcccaggcttctgtg

SEQ ID NO: 8162914 - DNA, 22 bp, Homo sapiens
cccttcctcaaggagctgtgtt

SEQ ID NO: 8162915 - DNA, 22 bp, Homo sapiens
ccctgtggggtccgcctgtccg

SEQ ID NO: 8162916 - DNA, 22 bp, Homo sapiens
ccctgtggtgacaggcctgtct

SEQ ID NO: 8162917 - DNA, 22 bp, Homo sapiens
ccctgtggggtccgcctgtccg

SEQ ID NO: 8162918 - DNA, 22 bp, Homo sapiens
ccctgtggtgacaggcctgtct

SEQ ID NO: 8162919 - DNA, 22 bp, Homo sapiens
cccttcctgggtgtcccggagt

SEQ ID NO: 8162920 - DNA, 22 bp, Homo sapiens
cccttccttgattttaactgga

SEQ ID NO: 8162921 - DNA, 22 bp, Homo sapiens
cccttcctgggtgtcccggagt

SEQ ID NO: 8162922 - DNA, 22 bp, Homo sapiens
cccttcctgggtgtcccggagt

SEQ ID NO: 8162923 - DNA, 22 bp, Homo sapiens
cccttcctggagtaccctctgt

SEQ ID NO: 8162924 - DNA, 22 bp, Homo sapiens
cccttcctggagtaccctctgt

SEQ ID NO: 8162925 - DNA, 22 bp, Homo sapiens
cccttcctggagtaccctctgt

SEQ ID NO: 8162926 - DNA, 22 bp, Homo sapiens
cccttcctggagtaccctctgt

SEQ ID NO: 8162927 - DNA, 22 bp, Homo sapiens
cccttcctcctcgcctgtcaga

SEQ ID NO: 8162928 - DNA, 22 bp, Homo sapiens
cccttcctcctcgcctgtcaga

SEQ ID NO: 8162929 - DNA, 22 bp, Homo sapiens
ccctgcagccttgcatgccttc

SEQ ID NO: 8162930 - DNA, 22 bp, Homo sapiens
ccctgcagccttgcatgccttc

SEQ ID NO: 8162931 - DNA, 18 bp, Homo sapiens
tggagcaggtaggcatga

SEQ ID NO: 8162932 - DNA, 18 bp, Homo sapiens
tggagcaggtaggcatga

SEQ ID NO: 8162933 - DNA, 22 bp, Homo sapiens
tggagcagggcatcactgtgcg

SEQ ID NO: 8162934 - DNA, 22 bp, Homo sapiens
tggagcagggcatcactgtgcg

SEQ ID NO: 8162935 - DNA, 19 bp, Homo sapiens
tggagcagggcccttgttt

SEQ ID NO: 8162936 - DNA, 19 bp, Homo sapiens
tggagcagggcccttgttt

SEQ ID NO: 8162937 - DNA, 18 bp, Homo sapiens
tggagcaggtaggcatga

SEQ ID NO: 8162938 - DNA, 18 bp, Homo sapiens
tggagcaggtaggcatga

SEQ ID NO: 8162939 - DNA, 22 bp, Homo sapiens
tggagcagggcatcactgtgcg

SEQ ID NO: 8162940 - DNA, 22 bp, Homo sapiens
tggagcaggccggaagtggctt

SEQ ID NO: 8162941 - DNA, 22 bp, Homo sapiens
tggagcaggccggaagtggctt

SEQ ID NO: 8162942 - DNA, 22 bp, Homo sapiens
tggagcagggcatcactgtgcg

SEQ ID NO: 8162943 - DNA, 22 bp, Homo sapiens
tggagcagggcatcactgtgcg

SEQ ID NO: 8162944 - DNA, 22 bp, Homo sapiens
tggagcaggccggaagtggctt

SEQ ID NO: 8162945 - DNA, 22 bp, Homo sapiens
tggagcaggccggaagtggctt

SEQ ID NO: 8162946 - DNA, 22 bp, Homo sapiens
tggagcaggccggaagtggctt

SEQ ID NO: 8162947 - DNA, 22 bp, Homo sapiens
tggagcaggcatctttctctct

SEQ ID NO: 8162948 - DNA, 22 bp, Homo sapiens
tggagcaggcatctttctctct

SEQ ID NO: 8162949 - DNA, 23 bp, Homo sapiens
ccctgcagtcagggtgagatggt

SEQ ID NO: 8162950 - DNA, 22 bp, Homo sapiens
ccctgtgggccatgtgtctaca

SEQ ID NO: 8162951 - DNA, 23 bp, Homo sapiens
ccctgcagtcagggtgagatggt

SEQ ID NO: 8162952 - DNA, 22 bp, Homo sapiens
ccctgcaggggacctgcagcct

SEQ ID NO: 8162953 - DNA, 22 bp, Homo sapiens
ccctgcaggggacctgcagcct

SEQ ID NO: 8162954 - DNA, 22 bp, Homo sapiens
ccctgcaggctcagactggagt

SEQ ID NO: 8162955 - DNA, 21 bp, Homo sapiens
ccctgcaggccagggctgagc

SEQ ID NO: 8162956 - DNA, 22 bp, Homo sapiens
ccctgcagcttttgcatagtca

SEQ ID NO: 8162957 - DNA, 22 bp, Homo sapiens
ccctgcagccttgcatgccttc

SEQ ID NO: 8162958 - DNA, 22 bp, Homo sapiens
ccctgcagccttgcatgccttc

SEQ ID NO: 8162959 - DNA, 22 bp, Homo sapiens
ccctgcagccttgcatgccttc

SEQ ID NO: 8162960 - DNA, 22 bp, Homo sapiens
ccctgcaggctcagactggagt

SEQ ID NO: 8162961 - DNA, 22 bp, Homo sapiens
ccctgcaggctcagactggagt

SEQ ID NO: 8162962 - DNA, 22 bp, Homo sapiens
cctagccttcggcctacccatc

SEQ ID NO: 8162963 - DNA, 22 bp, Homo sapiens
cctagcagggagaggatacctg

SEQ ID NO: 8162964 - DNA, 22 bp, Homo sapiens
cctagcagggaagcagtgagga

SEQ ID NO: 8162965 - DNA, 19 bp, Homo sapiens
cctagagggaaggcaggac

SEQ ID NO: 8162966 - DNA, 22 bp, Homo sapiens
cctagagctctgctttatctaa

SEQ ID NO: 8162967 - DNA, 22 bp, Homo sapiens
cctagagctctgctttatctaa

SEQ ID NO: 8162968 - DNA, 22 bp, Homo sapiens
tggcagaggctctgtgatgttg

SEQ ID NO: 8162969 - DNA, 22 bp, Homo sapiens
tggcagaggctctgtgatgttg

SEQ ID NO: 8162970 - DNA, 18 bp, Homo sapiens
cctaagctccagccccag

SEQ ID NO: 8162971 - DNA, 22 bp, Homo sapiens
tggcagaggtaattcaaatccc

SEQ ID NO: 8162972 - DNA, 22 bp, Homo sapiens
cctaaatagagtcagatgtaat

SEQ ID NO: 8162973 - DNA, 19 bp, Homo sapiens
tggcagaggcagtttgtac

SEQ ID NO: 8162974 - DNA, 19 bp, Homo sapiens
tggcagaggcagtttgtac

SEQ ID NO: 8162975 - DNA, 22 bp, Homo sapiens
tggcagaggctctgtgatgttg

SEQ ID NO: 8162976 - DNA, 22 bp, Homo sapiens
tggcagaggaggctcagattga

SEQ ID NO: 8162977 - DNA, 22 bp, Homo sapiens
tggcagaggagaattaagatta

SEQ ID NO: 8162978 - DNA, 22 bp, Homo sapiens
tggcaggtagtcagaggcgaca

SEQ ID NO: 8162979 - DNA, 22 bp, Homo sapiens
cctcagaaggacaagagacaaa

SEQ ID NO: 8162980 - DNA, 22 bp, Homo sapiens
cctcagaaggacaagagacaaa

SEQ ID NO: 8162981 - DNA, 22 bp, Homo sapiens
tggcaggtagagttctgagatg

SEQ ID NO: 8162982 - DNA, 22 bp, Homo sapiens
tggcaggtagagttctgagatg

SEQ ID NO: 8162983 - DNA, 22 bp, Homo sapiens
tggcaggtagtcagaggcgaca

SEQ ID NO: 8162984 - DNA, 22 bp, Homo sapiens
tggcaggtacccattggctgta

SEQ ID NO: 8162985 - DNA, 18 bp, Homo sapiens
tggcaggtagactcaggt

SEQ ID NO: 8162986 - DNA, 22 bp, Homo sapiens
tggcaggtacccattggctgta

SEQ ID NO: 8162987 - DNA, 22 bp, Homo sapiens
tggcaggtacccattggctgta

SEQ ID NO: 8162988 - DNA, 22 bp, Homo sapiens
tggcaggtacccattggctgta

SEQ ID NO: 8162989 - DNA, 18 bp, Homo sapiens
tggcaggtagactcaggt

SEQ ID NO: 8162990 - DNA, 18 bp, Homo sapiens
tggcaggtagactcaggt

SEQ ID NO: 8162991 - DNA, 18 bp, Homo sapiens
tggcaggtagactcaggt

SEQ ID NO: 8162992 - DNA, 22 bp, Homo sapiens
tggcaggtagagttctgagatg

SEQ ID NO: 8162993 - DNA, 22 bp, Homo sapiens
cctcagaggtgaacatcagtgc

SEQ ID NO: 8162994 - DNA, 22 bp, Homo sapiens
cctcagaggtgtggcatctctg

SEQ ID NO: 8162995 - DNA, 22 bp, Homo sapiens
cctcagaggtgtggcatctctg

SEQ ID NO: 8162996 - DNA, 22 bp, Homo sapiens
cctcagaggttctgtgtgggaa

SEQ ID NO: 8162997 - DNA, 22 bp, Homo sapiens
cctcagaatagtcctcagatca

SEQ ID NO: 8162998 - DNA, 22 bp, Homo sapiens
cctcagaatagtcctcagatca

SEQ ID NO: 8162999 - DNA, 22 bp, Homo sapiens
cctcagaggcagatggtaagaa

SEQ ID NO: 8163000 - DNA, 22 bp, Homo sapiens
cctcagaggcatggttagaata

SEQ ID NO: 8163001 - DNA, 23 bp, Homo sapiens
cctcagaggcctcatagtctggc

SEQ ID NO: 8163002 - DNA, 22 bp, Homo sapiens
tggcagggtggcaacttttggt

SEQ ID NO: 8163003 - DNA, 22 bp, Homo sapiens
cctaggcccattaattcccctt

SEQ ID NO: 8163004 - DNA, 22 bp, Homo sapiens
cctaggcacccgagttatgttc

SEQ ID NO: 8163005 - DNA, 22 bp, Homo sapiens
cctaggcaagagttggtgtgga

SEQ ID NO: 8163006 - DNA, 22 bp, Homo sapiens
cctaggagttcgaagctgcagt

SEQ ID NO: 8163007 - DNA, 22 bp, Homo sapiens
cctaggagttcgaagctgcagt

SEQ ID NO: 8163008 - DNA, 22 bp, Homo sapiens
cctaggagttgaggtggccaga

SEQ ID NO: 8163009 - DNA, 22 bp, Homo sapiens
tggcagggttggccaccttacc

SEQ ID NO: 8163010 - DNA, 22 bp, Homo sapiens
tggcagggttggccaccttacc

SEQ ID NO: 8163011 - DNA, 22 bp, Homo sapiens
tggcagggttggccaccttacc

SEQ ID NO: 8163012 - DNA, 22 bp, Homo sapiens
tggcagggttggccaccttacc

SEQ ID NO: 8163013 - DNA, 22 bp, Homo sapiens
tggcagggtgggcttcagcccc

SEQ ID NO: 8163014 - DNA, 22 bp, Homo sapiens
tggcagggtgggcttcagcccc

SEQ ID NO: 8163015 - DNA, 22 bp, Homo sapiens
tggcagggtgggcttcagcccc

SEQ ID NO: 8163016 - DNA, 22 bp, Homo sapiens
tggcagggtgggcttcagcccc

SEQ ID NO: 8163017 - DNA, 22 bp, Homo sapiens
tggcagggtgggcttcagcccc

SEQ ID NO: 8163018 - DNA, 18 bp, Homo sapiens
cctcagggagagagacgc

SEQ ID NO: 8163019 - DNA, 22 bp, Homo sapiens
cctcagtgcgtactgaacagtg

SEQ ID NO: 8163020 - DNA, 22 bp, Homo sapiens
cctcagtgcgtactgaacagtg

SEQ ID NO: 8163021 - DNA, 22 bp, Homo sapiens
cctcagggactccatgctgcag

SEQ ID NO: 8163022 - DNA, 18 bp, Homo sapiens
cctcagggagagagacgc

SEQ ID NO: 8163023 - DNA, 18 bp, Homo sapiens
cctcagggagagagacgc

SEQ ID NO: 8163024 - DNA, 22 bp, Homo sapiens
cctcagttttctcatctgtaaa

SEQ ID NO: 8163025 - DNA, 22 bp, Homo sapiens
cctcagttttctcatctgtaaa

SEQ ID NO: 8163026 - DNA, 22 bp, Homo sapiens
cctcagtttatcctctgtaaca

SEQ ID NO: 8163027 - DNA, 22 bp, Homo sapiens
cctcagtttatcctctgtaaca

SEQ ID NO: 8163028 - DNA, 22 bp, Homo sapiens
cctcatctgtcatcctagggaa

SEQ ID NO: 8163029 - DNA, 22 bp, Homo sapiens
cctcagtgtgcagcagcatctg

SEQ ID NO: 8163030 - DNA, 22 bp, Homo sapiens
cctcatggccttgagctgaggg

SEQ ID NO: 8163031 - DNA, 22 bp, Homo sapiens
cctcatgctgcatctctgaggt

SEQ ID NO: 8163032 - DNA, 23 bp, Homo sapiens
cctcatgaaggtctgcttcctgg

SEQ ID NO: 8163033 - DNA, 22 bp, Homo sapiens
cctcattagctgttatttattg

SEQ ID NO: 8163034 - DNA, 22 bp, Homo sapiens
cctcatggccttgagctgaggg

SEQ ID NO: 8163035 - DNA, 22 bp, Homo sapiens
tggcctggctgccctgtctgga

SEQ ID NO: 8163036 - DNA, 22 bp, Homo sapiens
tggcctggctgccctgtctgga

SEQ ID NO: 8163037 - DNA, 22 bp, Homo sapiens
tggcctggctgccctgtctgga

SEQ ID NO: 8163038 - DNA, 22 bp, Homo sapiens
tggcctggctcacagtgagatt

SEQ ID NO: 8163039 - DNA, 22 bp, Homo sapiens
tggcctggctgccctgtctgga

SEQ ID NO: 8163040 - DNA, 18 bp, Homo sapiens
cctccaagtccccagcct

SEQ ID NO: 8163041 - DNA, 22 bp, Homo sapiens
cctccaagtgagagatggtaca

SEQ ID NO: 8163042 - DNA, 22 bp, Homo sapiens
cctccaaggtgagagaggatgg

SEQ ID NO: 8163043 - DNA, 22 bp, Homo sapiens
cctccaaggtgagagaggatgg

SEQ ID NO: 8163044 - DNA, 22 bp, Homo sapiens
cctccaaggtgagagaggatgg

SEQ ID NO: 8163045 - DNA, 22 bp, Homo sapiens
cctccaaggctgagttaatgaa

SEQ ID NO: 8163046 - DNA, 22 bp, Homo sapiens
cctccaagcttcatctcaacca

SEQ ID NO: 8163047 - DNA, 22 bp, Homo sapiens
cctccaagctggtcctctgtgt

SEQ ID NO: 8163048 - DNA, 22 bp, Homo sapiens
cctccaagctggtcctctgtgt

SEQ ID NO: 8163049 - DNA, 22 bp, Homo sapiens
tggctctgtcaaactgcacaca

SEQ ID NO: 8163050 - DNA, 22 bp, Homo sapiens
tggctctgtcactgtgagctat

SEQ ID NO: 8163051 - DNA, 22 bp, Homo sapiens
tggctctgtcaaactgcacaca

SEQ ID NO: 8163052 - DNA, 22 bp, Homo sapiens
tggctctgtcaaactgcacaca

SEQ ID NO: 8163053 - DNA, 22 bp, Homo sapiens
tggctctgtcaaactgcacaca

SEQ ID NO: 8163054 - DNA, 22 bp, Homo sapiens
tggctctggtgcgggctcctgc

SEQ ID NO: 8163055 - DNA, 22 bp, Homo sapiens
tggctctggtgcgggctcctgc

SEQ ID NO: 8163056 - DNA, 22 bp, Homo sapiens
tggctctggtgcgggctcctgc

SEQ ID NO: 8163057 - DNA, 22 bp, Homo sapiens
tggctctggggacagtaagtcc

SEQ ID NO: 8163058 - DNA, 21 bp, Homo sapiens
tggctctgggtaggagagtgc

SEQ ID NO: 8163059 - DNA, 22 bp, Homo sapiens
tggctctgagacacaggctctc

SEQ ID NO: 8163060 - DNA, 22 bp, Homo sapiens
tggctctgagacacaggctctc

SEQ ID NO: 8163061 - DNA, 22 bp, Homo sapiens
tggctctgaccaggtagaggag

SEQ ID NO: 8163062 - DNA, 22 bp, Homo sapiens
tggcctggggacctgtgagacc

SEQ ID NO: 8163063 - DNA, 21 bp, Homo sapiens
tggctctgggtaggagagtgc

SEQ ID NO: 8163064 - DNA, 21 bp, Homo sapiens
tggctctgggtaggagagtgc

SEQ ID NO: 8163065 - DNA, 22 bp, Homo sapiens
tggctctggtaacattgggtag

SEQ ID NO: 8163066 - DNA, 21 bp, Homo sapiens
tggctctgggtaggagagtgc

SEQ ID NO: 8163067 - DNA, 21 bp, Homo sapiens
tggctctgggtaggagagtgc

SEQ ID NO: 8163068 - DNA, 22 bp, Homo sapiens
tggcctgggcctgccggtgcaa

SEQ ID NO: 8163069 - DNA, 22 bp, Homo sapiens
tggcctgggccggcagatatac

SEQ ID NO: 8163070 - DNA, 22 bp, Homo sapiens
tggcctgggccggcagatatac

SEQ ID NO: 8163071 - DNA, 22 bp, Homo sapiens
tggcctggctgccctgtctgga

SEQ ID NO: 8163072 - DNA, 22 bp, Homo sapiens
tggcctgggcatgaagcatcgt

SEQ ID NO: 8163073 - DNA, 22 bp, Homo sapiens
tggcctgggcatgaagcatcgt

SEQ ID NO: 8163074 - DNA, 22 bp, Homo sapiens
tggcctggggacctgtgagacc

SEQ ID NO: 8163075 - DNA, 22 bp, Homo sapiens
tggcctggggacctgtgagacc

SEQ ID NO: 8163076 - DNA, 22 bp, Homo sapiens
tggcctggggacctgtgagacc

SEQ ID NO: 8163077 - DNA, 22 bp, Homo sapiens
tggcctggggaagaccatgggc

SEQ ID NO: 8163078 - DNA, 22 bp, Homo sapiens
tggcctggggaagaccatgggc

SEQ ID NO: 8163079 - DNA, 22 bp, Homo sapiens
tggcctgggcctgccggtgcaa

SEQ ID NO: 8163080 - DNA, 19 bp, Homo sapiens
tggcccagatggtcctggg

SEQ ID NO: 8163081 - DNA, 19 bp, Homo sapiens
tggcccagatggtcctggg

SEQ ID NO: 8163082 - DNA, 22 bp, Homo sapiens
tggcccagatctctgaccttga

SEQ ID NO: 8163083 - DNA, 22 bp, Homo sapiens
tggcccagagcactgctgggca

SEQ ID NO: 8163084 - DNA, 22 bp, Homo sapiens
tggcccagatctctgaccttga

SEQ ID NO: 8163085 - DNA, 20 bp, Homo sapiens
tggcccagcacgacgaggac

SEQ ID NO: 8163086 - DNA, 20 bp, Homo sapiens
tggcccagcacgacgaggac

SEQ ID NO: 8163087 - DNA, 17 bp, Homo sapiens
cctcagcttctttcctc

SEQ ID NO: 8163088 - DNA, 17 bp, Homo sapiens
cctcagcttctttcctc

SEQ ID NO: 8163089 - DNA, 17 bp, Homo sapiens
cctcagcttctttcctc

SEQ ID NO: 8163090 - DNA, 22 bp, Homo sapiens
tggcccagcagttctgccccag

SEQ ID NO: 8163091 - DNA, 22 bp, Homo sapiens
cctcagagttggccacgagagc

SEQ ID NO: 8163092 - DNA, 22 bp, Homo sapiens
cctcagagttggaatcacattt

SEQ ID NO: 8163093 - DNA, 22 bp, Homo sapiens
cctcagagttggaatcacattt

SEQ ID NO: 8163094 - DNA, 22 bp, Homo sapiens
cctcagagttatttgaagtgaa

SEQ ID NO: 8163095 - DNA, 22 bp, Homo sapiens
cctcagagttatttgaagtgaa

SEQ ID NO: 8163096 - DNA, 22 bp, Homo sapiens
cctcagagtctagtaaataata

SEQ ID NO: 8163097 - DNA, 22 bp, Homo sapiens
cctcagagtaggtctcagctgt

SEQ ID NO: 8163098 - DNA, 22 bp, Homo sapiens
cctcagagtaggtctcagctgt

SEQ ID NO: 8163099 - DNA, 22 bp, Homo sapiens
cctcagaggttttcattctgta

SEQ ID NO: 8163100 - DNA, 22 bp, Homo sapiens
cctcagaggttttcattctgta

SEQ ID NO: 8163101 - DNA, 22 bp, Homo sapiens
cctcagagtttaagatgtcaga

SEQ ID NO: 8163102 - DNA, 22 bp, Homo sapiens
cctcagagtttaagatgtcaga

SEQ ID NO: 8163103 - DNA, 22 bp, Homo sapiens
cctcagcagacacgcttctcac

SEQ ID NO: 8163104 - DNA, 22 bp, Homo sapiens
cctcagcagacacgcttctcac

SEQ ID NO: 8163105 - DNA, 22 bp, Homo sapiens
cctcagcagacacgcttctcac

SEQ ID NO: 8163106 - DNA, 22 bp, Homo sapiens
cctcagcagacacgcttctcac

SEQ ID NO: 8163107 - DNA, 22 bp, Homo sapiens
tggcccagagcactgctgggca

SEQ ID NO: 8163108 - DNA, 22 bp, Homo sapiens
cctcagcatcctcctgctcagt

SEQ ID NO: 8163109 - DNA, 22 bp, Homo sapiens
cctcagcatcctcatgctcagt

SEQ ID NO: 8163110 - DNA, 22 bp, Homo sapiens
cctcagcatcctcctgctcagt

SEQ ID NO: 8163111 - DNA, 22 bp, Homo sapiens
cctcaggctagctactgtccct

SEQ ID NO: 8163112 - DNA, 22 bp, Homo sapiens
cctcaggctagctactgtccct

SEQ ID NO: 8163113 - DNA, 22 bp, Homo sapiens
cctcaggcctctgcctcattgg

SEQ ID NO: 8163114 - DNA, 22 bp, Homo sapiens
cctcaggcctctgcctcattgg

SEQ ID NO: 8163115 - DNA, 22 bp, Homo sapiens
cctcaggcctctgcctcattgg

SEQ ID NO: 8163116 - DNA, 22 bp, Homo sapiens
cctcaggcctgccagagcccca

SEQ ID NO: 8163117 - DNA, 22 bp, Homo sapiens
cctcaggcctgccagagcccca

SEQ ID NO: 8163118 - DNA, 22 bp, Homo sapiens
cctcaggcctgccagagcccca

SEQ ID NO: 8163119 - DNA, 22 bp, Homo sapiens
cctcaggctgtcttccttctgg

SEQ ID NO: 8163120 - DNA, 22 bp, Homo sapiens
cctcaggctgggctgcccctgg

SEQ ID NO: 8163121 - DNA, 22 bp, Homo sapiens
cctcaggctgggctgcccctgg

SEQ ID NO: 8163122 - DNA, 22 bp, Homo sapiens
cctcaggctctgggtgcctacc

SEQ ID NO: 8163123 - DNA, 22 bp, Homo sapiens
cctcaggctgctcacacttgtc

SEQ ID NO: 8163124 - DNA, 22 bp, Homo sapiens
cctcaggctgctcacacttgtc

SEQ ID NO: 8163125 - DNA, 22 bp, Homo sapiens
cctcaggctctgggtgcctacc

SEQ ID NO: 8163126 - DNA, 22 bp, Homo sapiens
cctcaggctctgggtgcctacc

SEQ ID NO: 8163127 - DNA, 22 bp, Homo sapiens
cctcagggaatgggaggctggg

SEQ ID NO: 8163128 - DNA, 22 bp, Homo sapiens
cctcagggaatgggaggctggg

SEQ ID NO: 8163129 - DNA, 22 bp, Homo sapiens
cctcaggcttgtgagccttcag

SEQ ID NO: 8163130 - DNA, 22 bp, Homo sapiens
cctcaggcttgtgagccttcag

SEQ ID NO: 8163131 - DNA, 22 bp, Homo sapiens
cctcaggcttctagttcagtga

SEQ ID NO: 8163132 - DNA, 22 bp, Homo sapiens
cctcaggcttctagttcagtga

SEQ ID NO: 8163133 - DNA, 22 bp, Homo sapiens
cctcaggcttctagttcagtga

SEQ ID NO: 8163134 - DNA, 22 bp, Homo sapiens
cctcaggcttcgtcttccaccc

SEQ ID NO: 8163135 - DNA, 22 bp, Homo sapiens
cctcaggcttacgggcaatgga

SEQ ID NO: 8163136 - DNA, 22 bp, Homo sapiens
cctcaggcttcgtcttccaccc

SEQ ID NO: 8163137 - DNA, 22 bp, Homo sapiens
cctcaggctgtcttccttctgg

SEQ ID NO: 8163138 - DNA, 22 bp, Homo sapiens
cctcaggcttaacttgtcttga

SEQ ID NO: 8163139 - DNA, 22 bp, Homo sapiens
cctcaggcttacgggcaatgga

SEQ ID NO: 8163140 - DNA, 22 bp, Homo sapiens
cctcaggcttaacttgtcttga

SEQ ID NO: 8163141 - DNA, 22 bp, Homo sapiens
tgggagttaacattggtctctg

SEQ ID NO: 8163142 - DNA, 22 bp, Homo sapiens
tgggagtgttcttggcttgctt

SEQ ID NO: 8163143 - DNA, 23 bp, Homo sapiens
tgggagttgagtgaggttgcttt

SEQ ID NO: 8163144 - DNA, 22 bp, Homo sapiens
tgggagttgggcagaacaagtg

SEQ ID NO: 8163145 - DNA, 22 bp, Homo sapiens
tgggagttgggtgggagacttc

SEQ ID NO: 8163146 - DNA, 22 bp, Homo sapiens
tgggagttagttatactgtgac

SEQ ID NO: 8163147 - DNA, 22 bp, Homo sapiens
tgggagttgagacattttgccc

SEQ ID NO: 8163148 - DNA, 22 bp, Homo sapiens
tgggagttcacgtgatattcac

SEQ ID NO: 8163149 - DNA, 22 bp, Homo sapiens
tgggagtttgttagaaatgcag

SEQ ID NO: 8163150 - DNA, 22 bp, Homo sapiens
cctgagaccaagttgcagccat

SEQ ID NO: 8163151 - DNA, 22 bp, Homo sapiens
cctgagatcagtgcatttggtg

SEQ ID NO: 8163152 - DNA, 21 bp, Homo sapiens
cctgagatctggagtggcttt

SEQ ID NO: 8163153 - DNA, 22 bp, Homo sapiens
cctgagagagaagcgacctggt

SEQ ID NO: 8163154 - DNA, 22 bp, Homo sapiens
cctgagagagaagcgacctggt

SEQ ID NO: 8163155 - DNA, 22 bp, Homo sapiens
cctgagatggccagtgctggga

SEQ ID NO: 8163156 - DNA, 23 bp, Homo sapiens
cctgagatctgtaagggaccttg

SEQ ID NO: 8163157 - DNA, 22 bp, Homo sapiens
cctgagatggccagtgctggga

SEQ ID NO: 8163158 - DNA, 21 bp, Homo sapiens
cctgagatctggagtggcttt

SEQ ID NO: 8163159 - DNA, 22 bp, Homo sapiens
cctgagcaaaggcccagaggga

SEQ ID NO: 8163160 - DNA, 22 bp, Homo sapiens
cctgagcaacttcaagggcctg

SEQ ID NO: 8163161 - DNA, 22 bp, Homo sapiens
cctgagatttgtaatttttgta

SEQ ID NO: 8163162 - DNA, 22 bp, Homo sapiens
cctgagatttcattgtctggcc

SEQ ID NO: 8163163 - DNA, 22 bp, Homo sapiens
cctgagcaaaggaaggatgact

SEQ ID NO: 8163164 - DNA, 22 bp, Homo sapiens
cctgagcagctctgaggggcga

SEQ ID NO: 8163165 - DNA, 22 bp, Homo sapiens
cctgagcagctctgaggggcga

SEQ ID NO: 8163166 - DNA, 22 bp, Homo sapiens
cctgagcagggctctgcagggc

SEQ ID NO: 8163167 - DNA, 22 bp, Homo sapiens
cctgagcagggctctgcagggc

SEQ ID NO: 8163168 - DNA, 18 bp, Homo sapiens
cctgagccctgcttactt

SEQ ID NO: 8163169 - DNA, 22 bp, Homo sapiens
cctgagccgagcgctctttctc

SEQ ID NO: 8163170 - DNA, 22 bp, Homo sapiens
cctgagcctcttgcacgctcag

SEQ ID NO: 8163171 - DNA, 22 bp, Homo sapiens
cctgagcctcttgcacgctcag

SEQ ID NO: 8163172 - DNA, 22 bp, Homo sapiens
cctgagcctgcagccgagcaga

SEQ ID NO: 8163173 - DNA, 22 bp, Homo sapiens
cctgagcctgagtggtgcaggg

SEQ ID NO: 8163174 - DNA, 22 bp, Homo sapiens
cctgagcctcttgcacgctcag

SEQ ID NO: 8163175 - DNA, 22 bp, Homo sapiens
cctgagcctggctcatgcactc

SEQ ID NO: 8163176 - DNA, 22 bp, Homo sapiens
tgggccagtttctcattgaaat

SEQ ID NO: 8163177 - DNA, 17 bp, Homo sapiens
cctcttcctctcagctg

SEQ ID NO: 8163178 - DNA, 17 bp, Homo sapiens
cctcttcctctcagctg

SEQ ID NO: 8163179 - DNA, 19 bp, Homo sapiens
cctcttcctctgacactat

SEQ ID NO: 8163180 - DNA, 22 bp, Homo sapiens
cctcttccttctcactgtggaa

SEQ ID NO: 8163181 - DNA, 22 bp, Homo sapiens
cctcttctaggtttcagcctgc

SEQ ID NO: 8163182 - DNA, 22 bp, Homo sapiens
cctcttctaggtttcagcctgc

SEQ ID NO: 8163183 - DNA, 22 bp, Homo sapiens
cctcttctcaactccagccaga

SEQ ID NO: 8163184 - DNA, 22 bp, Homo sapiens
cctcttctaggtttcagcctgc

SEQ ID NO: 8163185 - DNA, 22 bp, Homo sapiens
cctcttctaccatttacatttt

SEQ ID NO: 8163186 - DNA, 22 bp, Homo sapiens
cctcttctaggacgtccttgtg

SEQ ID NO: 8163187 - DNA, 22 bp, Homo sapiens
cctcttctaggacgtccttgtg

SEQ ID NO: 8163188 - DNA, 22 bp, Homo sapiens
cctcttctaggacgtccttgtg

SEQ ID NO: 8163189 - DNA, 22 bp, Homo sapiens
cctcttctaggacgtccttgtg

SEQ ID NO: 8163190 - DNA, 19 bp, Homo sapiens
tgggagtggggaaggtcct

SEQ ID NO: 8163191 - DNA, 19 bp, Homo sapiens
tgggagtggggaaggtcct

SEQ ID NO: 8163192 - DNA, 18 bp, Homo sapiens
tgggagtgggagtggata

SEQ ID NO: 8163193 - DNA, 22 bp, Homo sapiens
cctcttctcaactccagccaga

SEQ ID NO: 8163194 - DNA, 22 bp, Homo sapiens
cctcttctcaactccagccaga

SEQ ID NO: 8163195 - DNA, 18 bp, Homo sapiens
tgggagtgggagtggata

SEQ ID NO: 8163196 - DNA, 19 bp, Homo sapiens
cctcttctctggcagcaga

SEQ ID NO: 8163197 - DNA, 19 bp, Homo sapiens
tgggagtggggaaggtcct

SEQ ID NO: 8163198 - DNA, 19 bp, Homo sapiens
tgggagtggggaaggtcct

SEQ ID NO: 8163199 - DNA, 22 bp, Homo sapiens
tgggagtggggcatagaaggta

SEQ ID NO: 8163200 - DNA, 22 bp, Homo sapiens
tgggagtggggcatagaaggta

SEQ ID NO: 8163201 - DNA, 22 bp, Homo sapiens
tgggagtggggcatagaaggta

SEQ ID NO: 8163202 - DNA, 22 bp, Homo sapiens
tgggagtgttcttggcttgctt

SEQ ID NO: 8163203 - DNA, 22 bp, Homo sapiens
tgggagtgttcttggcttgctt

SEQ ID NO: 8163204 - DNA, 22 bp, Homo sapiens
tgggagtgttcttggcttgctt

SEQ ID NO: 8163205 - DNA, 22 bp, Homo sapiens
tgggagtggggcatagaaggta

SEQ ID NO: 8163206 - DNA, 22 bp, Homo sapiens
cctgagctccagtagcagccag

SEQ ID NO: 8163207 - DNA, 22 bp, Homo sapiens
cctgagctctgcactttttaga

SEQ ID NO: 8163208 - DNA, 22 bp, Homo sapiens
cctgagctcaagaaggtgacca

SEQ ID NO: 8163209 - DNA, 22 bp, Homo sapiens
cctgagctgaactaagcagttt

SEQ ID NO: 8163210 - DNA, 22 bp, Homo sapiens
cctgagctcaaagggtgcctgg

SEQ ID NO: 8163211 - DNA, 22 bp, Homo sapiens
cctgagctcaaagggtgcctgg

SEQ ID NO: 8163212 - DNA, 22 bp, Homo sapiens
cctgagctgactctcctttcag

SEQ ID NO: 8163213 - DNA, 22 bp, Homo sapiens
cctgagctgactctcctttcag

SEQ ID NO: 8163214 - DNA, 22 bp, Homo sapiens
cctgagctgcggggcagtgctc

SEQ ID NO: 8163215 - DNA, 22 bp, Homo sapiens
cctgagctgcggggcagtgctc

SEQ ID NO: 8163216 - DNA, 22 bp, Homo sapiens
cctgagctgcggggcagtgctc

SEQ ID NO: 8163217 - DNA, 22 bp, Homo sapiens
cctgagctggaagagcttgtgc

SEQ ID NO: 8163218 - DNA, 22 bp, Homo sapiens
cctgagctggaagagcttgtgc

SEQ ID NO: 8163219 - DNA, 22 bp, Homo sapiens
cctgagctggcagtgacctgga

SEQ ID NO: 8163220 - DNA, 22 bp, Homo sapiens
tggggagcccactcacctcccc

SEQ ID NO: 8163221 - DNA, 22 bp, Homo sapiens
tggggaggaagtcagatttcag

SEQ ID NO: 8163222 - DNA, 22 bp, Homo sapiens
tgggctgcttcctcagctgaga

SEQ ID NO: 8163223 - DNA, 22 bp, Homo sapiens
tgggctgcttcctcagctgaga

SEQ ID NO: 8163224 - DNA, 22 bp, Homo sapiens
tgggctggagcttgttgcttcc

SEQ ID NO: 8163225 - DNA, 22 bp, Homo sapiens
tgggctggagcttgttgcttcc

SEQ ID NO: 8163226 - DNA, 22 bp, Homo sapiens
tgggctggagcttgttgcttcc

SEQ ID NO: 8163227 - DNA, 22 bp, Homo sapiens
tgggctggagcttgttgcttcc

SEQ ID NO: 8163228 - DNA, 22 bp, Homo sapiens
tgggctggcccaccacacctcg

SEQ ID NO: 8163229 - DNA, 22 bp, Homo sapiens
tgggctggcccaccacacctcg

SEQ ID NO: 8163230 - DNA, 22 bp, Homo sapiens
tgggctggcccaccacacctcg

SEQ ID NO: 8163231 - DNA, 21 bp, Homo sapiens
cctgagcctgtttatccagaa

SEQ ID NO: 8163232 - DNA, 21 bp, Homo sapiens
cctgagcctgtttatccagaa

SEQ ID NO: 8163233 - DNA, 22 bp, Homo sapiens
cctgagcctggctcatgcactc

SEQ ID NO: 8163234 - DNA, 21 bp, Homo sapiens
cctgagcctgtttatccagaa

SEQ ID NO: 8163235 - DNA, 22 bp, Homo sapiens
cctgagctagggaaggaagacc

SEQ ID NO: 8163236 - DNA, 22 bp, Homo sapiens
tgggcccaagagagtctccaac

SEQ ID NO: 8163237 - DNA, 22 bp, Homo sapiens
tgggcccaagagagtctccaac

SEQ ID NO: 8163238 - DNA, 23 bp, Homo sapiens
tgggccctggagtcgccagtctg

SEQ ID NO: 8163239 - DNA, 22 bp, Homo sapiens
tgggccctggtggccatgcctc

SEQ ID NO: 8163240 - DNA, 23 bp, Homo sapiens
tgggccctggagtcgccagtctg

SEQ ID NO: 8163241 - DNA, 22 bp, Homo sapiens
tgggccctgcccttgtctgtcc

SEQ ID NO: 8163242 - DNA, 22 bp, Homo sapiens
tgggccctgcccttgtctgtcc

SEQ ID NO: 8163243 - DNA, 22 bp, Homo sapiens
tgggccctgacttcaagcatcc

SEQ ID NO: 8163244 - DNA, 22 bp, Homo sapiens
tgggccctgacttcaagcatcc

SEQ ID NO: 8163245 - DNA, 22 bp, Homo sapiens
tgggctgctgtctgcacatgct

SEQ ID NO: 8163246 - DNA, 22 bp, Homo sapiens
tgggctgctgagaatgagagag

SEQ ID NO: 8163247 - DNA, 22 bp, Homo sapiens
tgggctgctgagaatgagagag

SEQ ID NO: 8163248 - DNA, 22 bp, Homo sapiens
tgggctgctgttacaggggctg

SEQ ID NO: 8163249 - DNA, 22 bp, Homo sapiens
tgggctgctgtctgcacatgct

SEQ ID NO: 8163250 - DNA, 22 bp, Homo sapiens
tgggctgctgtctgcacatgct

SEQ ID NO: 8163251 - DNA, 22 bp, Homo sapiens
tgggctctagactttagtgtgg

SEQ ID NO: 8163252 - DNA, 22 bp, Homo sapiens
tgggctccttgggagcaagtga

SEQ ID NO: 8163253 - DNA, 22 bp, Homo sapiens
cctcttccagctgttgcttcca

SEQ ID NO: 8163254 - DNA, 22 bp, Homo sapiens
cctcttccagctgttgcttcca

SEQ ID NO: 8163255 - DNA, 22 bp, Homo sapiens
cctcttccagctgttgcttcca

SEQ ID NO: 8163256 - DNA, 19 bp, Homo sapiens
cctctgtgggagtcagtga

SEQ ID NO: 8163257 - DNA, 19 bp, Homo sapiens
cctctgtgggagtcagtga

SEQ ID NO: 8163258 - DNA, 19 bp, Homo sapiens
cctctgtgggagtcagtga

SEQ ID NO: 8163259 - DNA, 22 bp, Homo sapiens
tgggaaggacgtgtcagtggca

SEQ ID NO: 8163260 - DNA, 22 bp, Homo sapiens
tgggaaggacgtgtcagtggca

SEQ ID NO: 8163261 - DNA, 22 bp, Homo sapiens
tgggaaggacgtgtcagtggca

SEQ ID NO: 8163262 - DNA, 22 bp, Homo sapiens
tgggaaggacgtgtcagtggca

SEQ ID NO: 8163263 - DNA, 22 bp, Homo sapiens
tgggaaggataccttggaacat

SEQ ID NO: 8163264 - DNA, 22 bp, Homo sapiens
tgggaaggataccttggaacat

SEQ ID NO: 8163265 - DNA, 22 bp, Homo sapiens
tgggaaggataccttggaacat

SEQ ID NO: 8163266 - DNA, 22 bp, Homo sapiens
tgggaaggcagtcactgtccta

SEQ ID NO: 8163267 - DNA, 22 bp, Homo sapiens
tgggaaggatacgttacaagat

SEQ ID NO: 8163268 - DNA, 22 bp, Homo sapiens
tgggaaggatacgttacaagat

SEQ ID NO: 8163269 - DNA, 22 bp, Homo sapiens
cctctggacttgggacagtgag

SEQ ID NO: 8163270 - DNA, 22 bp, Homo sapiens
cctctggagtcagaccagcttg

SEQ ID NO: 8163271 - DNA, 22 bp, Homo sapiens
tgggaagctgcattttaacaag

SEQ ID NO: 8163272 - DNA, 22 bp, Homo sapiens
tgggaagctgcattttaacaag

SEQ ID NO: 8163273 - DNA, 22 bp, Homo sapiens
tgggaagctgcattttaacaag

SEQ ID NO: 8163274 - DNA, 22 bp, Homo sapiens
tgggaaggacgtgtcagtggca

SEQ ID NO: 8163275 - DNA, 22 bp, Homo sapiens
tgggaaggacagaacataattg

SEQ ID NO: 8163276 - DNA, 22 bp, Homo sapiens
tgggaaggacagaacataattg

SEQ ID NO: 8163277 - DNA, 22 bp, Homo sapiens
tgggaaggaatggtgattaata

SEQ ID NO: 8163278 - DNA, 22 bp, Homo sapiens
tgggaaggaatggtgattaata

SEQ ID NO: 8163279 - DNA, 22 bp, Homo sapiens
tgggaagctttaaatgggtgtc

SEQ ID NO: 8163280 - DNA, 22 bp, Homo sapiens
tgggaaggaactgcctttagct

SEQ ID NO: 8163281 - DNA, 22 bp, Homo sapiens
tgggaaggaactgcctttagct

SEQ ID NO: 8163282 - DNA, 19 bp, Homo sapiens
cctctgctccagtttcctt

SEQ ID NO: 8163283 - DNA, 21 bp, Homo sapiens
cctctgctcgggcatgcgttt

SEQ ID NO: 8163284 - DNA, 21 bp, Homo sapiens
cctctgctcgggcatgcgttt

SEQ ID NO: 8163285 - DNA, 22 bp, Homo sapiens
cctctgctctggtccatgtgct

SEQ ID NO: 8163286 - DNA, 22 bp, Homo sapiens
cctctgctctggtccatgtgct

SEQ ID NO: 8163287 - DNA, 22 bp, Homo sapiens
cctctgctctggtccatgtgct

SEQ ID NO: 8163288 - DNA, 22 bp, Homo sapiens
cctctgctctggtccatgtgct

SEQ ID NO: 8163289 - DNA, 22 bp, Homo sapiens
cctctgctctggtccatgtgct

SEQ ID NO: 8163290 - DNA, 20 bp, Homo sapiens
cctctgcctttctagtctga

SEQ ID NO: 8163291 - DNA, 20 bp, Homo sapiens
cctctgcctttctagtctga

SEQ ID NO: 8163292 - DNA, 22 bp, Homo sapiens
cctctgagtcctccctggttgc

SEQ ID NO: 8163293 - DNA, 22 bp, Homo sapiens
cctctgcccttttcctgtatca

SEQ ID NO: 8163294 - DNA, 22 bp, Homo sapiens
cctctgcctgcacatcatcctg

SEQ ID NO: 8163295 - DNA, 22 bp, Homo sapiens
cctctgcctgcacatcatcctg

SEQ ID NO: 8163296 - DNA, 22 bp, Homo sapiens
tggcttccagagctgctccacc

SEQ ID NO: 8163297 - DNA, 22 bp, Homo sapiens
tggcttccagagctgctccacc

SEQ ID NO: 8163298 - DNA, 22 bp, Homo sapiens
tggcttccagaactgagcaaca

SEQ ID NO: 8163299 - DNA, 19 bp, Homo sapiens
tggcttccatctctctcat

SEQ ID NO: 8163300 - DNA, 17 bp, Homo sapiens
tggctctgtcctcagct

SEQ ID NO: 8163301 - DNA, 17 bp, Homo sapiens
tggctctgtcctcagct

SEQ ID NO: 8163302 - DNA, 22 bp, Homo sapiens
tggctctgtcactgtgagctat

SEQ ID NO: 8163303 - DNA, 22 bp, Homo sapiens
tggctctgtcactgtgagctat

SEQ ID NO: 8163304 - DNA, 22 bp, Homo sapiens
tggctctgtcactgtgagctat

SEQ ID NO: 8163305 - DNA, 17 bp, Homo sapiens
tggctctgtcctcagct

SEQ ID NO: 8163306 - DNA, 17 bp, Homo sapiens
tggctctgtcctcagct

SEQ ID NO: 8163307 - DNA, 17 bp, Homo sapiens
tggctctgtcctcagct

SEQ ID NO: 8163308 - DNA, 19 bp, Homo sapiens
tggctctgtcgaaggcaca

SEQ ID NO: 8163309 - DNA, 17 bp, Homo sapiens
tggctctgtcctcagct

SEQ ID NO: 8163310 - DNA, 22 bp, Homo sapiens
tggctgagaccatcagggtgta

SEQ ID NO: 8163311 - DNA, 22 bp, Homo sapiens
tggctgagaccatcagggtgta

SEQ ID NO: 8163312 - DNA, 22 bp, Homo sapiens
tggctgagaatgggatgatgcc

SEQ ID NO: 8163313 - DNA, 22 bp, Homo sapiens
tggctgagaatgggatgatgcc

SEQ ID NO: 8163314 - DNA, 22 bp, Homo sapiens
tggctgagaccatcagggtgta

SEQ ID NO: 8163315 - DNA, 22 bp, Homo sapiens
tggctgagaccatcagggtgta

SEQ ID NO: 8163316 - DNA, 22 bp, Homo sapiens
tggctgagaccatcagggtgta

SEQ ID NO: 8163317 - DNA, 22 bp, Homo sapiens
tggctgagaatgggatgatgcc

SEQ ID NO: 8163318 - DNA, 22 bp, Homo sapiens
tggctgagaagttctggtggga

SEQ ID NO: 8163319 - DNA, 22 bp, Homo sapiens
tggctgagaatgggatgatgcc

SEQ ID NO: 8163320 - DNA, 19 bp, Homo sapiens
tggctctgtcgaaggcaca

SEQ ID NO: 8163321 - DNA, 19 bp, Homo sapiens
tggctctgtcgaaggcaca

SEQ ID NO: 8163322 - DNA, 19 bp, Homo sapiens
tggctctgtcgaaggcaca

SEQ ID NO: 8163323 - DNA, 22 bp, Homo sapiens
tggctgagaccttcccaaattc

SEQ ID NO: 8163324 - DNA, 22 bp, Homo sapiens
tggctgagaccttcccaaattc

SEQ ID NO: 8163325 - DNA, 22 bp, Homo sapiens
tggctgagaccatcagggtgta

SEQ ID NO: 8163326 - DNA, 22 bp, Homo sapiens
tggctgagaccatcagggtgta

SEQ ID NO: 8163327 - DNA, 22 bp, Homo sapiens
tggctgagagaagacggggaag

SEQ ID NO: 8163328 - DNA, 22 bp, Homo sapiens
tggctgagaccttcccaaattc

SEQ ID NO: 8163329 - DNA, 22 bp, Homo sapiens
tggctgagaccttcccaaattc

SEQ ID NO: 8163330 - DNA, 16 bp, Homo sapiens
tggctgagagagggtt

SEQ ID NO: 8163331 - DNA, 22 bp, Homo sapiens
tggctgagagaagacggggaag

SEQ ID NO: 8163332 - DNA, 22 bp, Homo sapiens
tggctgagagaagacggggaag

SEQ ID NO: 8163333 - DNA, 22 bp, Homo sapiens
tggctgagagaagacggggaag

SEQ ID NO: 8163334 - DNA, 22 bp, Homo sapiens
tggctgctagccagagcttcag

SEQ ID NO: 8163335 - DNA, 16 bp, Homo sapiens
tggctgagagagggtt

SEQ ID NO: 8163336 - DNA, 16 bp, Homo sapiens
tggctgagagagggtt

SEQ ID NO: 8163337 - DNA, 22 bp, Homo sapiens
tggctgctcaagggaggaggct

SEQ ID NO: 8163338 - DNA, 22 bp, Homo sapiens
tggctggctagtgggcaggatt

SEQ ID NO: 8163339 - DNA, 22 bp, Homo sapiens
tggctggctagtgggcaggatt

SEQ ID NO: 8163340 - DNA, 22 bp, Homo sapiens
tggctgctcaagggaggaggct

SEQ ID NO: 8163341 - DNA, 22 bp, Homo sapiens
tggctggctggaccacacctgc

SEQ ID NO: 8163342 - DNA, 22 bp, Homo sapiens
tggctggctggaccacacctgc

SEQ ID NO: 8163343 - DNA, 18 bp, Homo sapiens
tggctggctctgtcatct

SEQ ID NO: 8163344 - DNA, 18 bp, Homo sapiens
tggctggctctgtcatct

SEQ ID NO: 8163345 - DNA, 22 bp, Homo sapiens
tggctgggagctggaactgggc

SEQ ID NO: 8163346 - DNA, 22 bp, Homo sapiens
tggctggctttcttgtatttac

SEQ ID NO: 8163347 - DNA, 22 bp, Homo sapiens
tggctgggagctggaactgggc

SEQ ID NO: 8163348 - DNA, 22 bp, Homo sapiens
tggctggcttgttcactgactg

SEQ ID NO: 8163349 - DNA, 22 bp, Homo sapiens
tggctggcttgttcactgactg

SEQ ID NO: 8163350 - DNA, 22 bp, Homo sapiens
tggctggcttgttcactgactg

SEQ ID NO: 8163351 - DNA, 22 bp, Homo sapiens
tggctggcttgttcactgactg

SEQ ID NO: 8163352 - DNA, 22 bp, Homo sapiens
tggctggctgtccagctgggca

SEQ ID NO: 8163353 - DNA, 20 bp, Homo sapiens
tggctggcttgtatttcctt

SEQ ID NO: 8163354 - DNA, 22 bp, Homo sapiens
tggctggctgtccagctgggca

SEQ ID NO: 8163355 - DNA, 22 bp, Homo sapiens
tggctggctgtcagtaggctgt

SEQ ID NO: 8163356 - DNA, 22 bp, Homo sapiens
tggctggctgtcagtaggctgt

SEQ ID NO: 8163357 - DNA, 22 bp, Homo sapiens
tggctggctgtcagtaggctgt

SEQ ID NO: 8163358 - DNA, 22 bp, Homo sapiens
tggctggctgtccagctgggca

SEQ ID NO: 8163359 - DNA, 22 bp, Homo sapiens
tggctggctgtccagctgggca

SEQ ID NO: 8163360 - DNA, 22 bp, Homo sapiens
tggctggctgtccagctgggca

SEQ ID NO: 8163361 - DNA, 22 bp, Homo sapiens
tggctggctgtccagctgggca

SEQ ID NO: 8163362 - DNA, 22 bp, Homo sapiens
tggctggctgtccagctgggca

SEQ ID NO: 8163363 - DNA, 22 bp, Homo sapiens
tggctggctgtcaaggaaagcc

SEQ ID NO: 8163364 - DNA, 22 bp, Homo sapiens
tggctggctgtcagtaggctgt

SEQ ID NO: 8163365 - DNA, 22 bp, Homo sapiens
tggctggctgtcaaggaaagcc

SEQ ID NO: 8163366 - DNA, 22 bp, Homo sapiens
tggctggctggaccacacctgc

SEQ ID NO: 8163367 - DNA, 22 bp, Homo sapiens
tggcttcatggctgtgcaatct

SEQ ID NO: 8163368 - DNA, 22 bp, Homo sapiens
tggcttcattcagcatgacagt

SEQ ID NO: 8163369 - DNA, 22 bp, Homo sapiens
tggcttcattattgtttttcct

SEQ ID NO: 8163370 - DNA, 22 bp, Homo sapiens
tggcttcatctgcagcactgcc

SEQ ID NO: 8163371 - DNA, 22 bp, Homo sapiens
tggcttcagggttgtcttcagc

SEQ ID NO: 8163372 - DNA, 22 bp, Homo sapiens
tgtttccaactgtgatcttact

SEQ ID NO: 8163373 - DNA, 22 bp, Homo sapiens
tgtttccatggtgacagcagct

SEQ ID NO: 8163374 - DNA, 22 bp, Homo sapiens
tgtttccagaatgtagctgctt

SEQ ID NO: 8163375 - DNA, 22 bp, Homo sapiens
tgtttcatgaaacatgtttagg

SEQ ID NO: 8163376 - DNA, 22 bp, Homo sapiens
tgtttcagtccctgtgttcaat

SEQ ID NO: 8163377 - DNA, 20 bp, Homo sapiens
tgtttcataagctgtcctat

SEQ ID NO: 8163378 - DNA, 22 bp, Homo sapiens
tgtttcatgattgctgtcattt

SEQ ID NO: 8163379 - DNA, 21 bp, Homo sapiens
tgtttcatgctattttcttgt

SEQ ID NO: 8163380 - DNA, 22 bp, Homo sapiens
tgtttcatgtggacatagttgt

SEQ ID NO: 8163381 - DNA, 21 bp, Homo sapiens
tgtttcatgctattttcttgt

SEQ ID NO: 8163382 - DNA, 22 bp, Homo sapiens
tgtttacatgcataagcttaag

SEQ ID NO: 8163383 - DNA, 22 bp, Homo sapiens
tgtttacatatttggtctcaga

SEQ ID NO: 8163384 - DNA, 22 bp, Homo sapiens
tgtttactagccaacatggaga

SEQ ID NO: 8163385 - DNA, 22 bp, Homo sapiens
tgtttacatgcataagcttaag

SEQ ID NO: 8163386 - DNA, 22 bp, Homo sapiens
tgtttacatggaggttttcagc

SEQ ID NO: 8163387 - DNA, 22 bp, Homo sapiens
tgtttcactaagcagaaatata

SEQ ID NO: 8163388 - DNA, 22 bp, Homo sapiens
tgtttactatgatgtaacctat

SEQ ID NO: 8163389 - DNA, 22 bp, Homo sapiens
tgtttactccagctgatggaac

SEQ ID NO: 8163390 - DNA, 22 bp, Homo sapiens
tgtttactcactgtatccacaa

SEQ ID NO: 8163391 - DNA, 22 bp, Homo sapiens
tgtttactccagctgatggaac

SEQ ID NO: 8163392 - DNA, 20 bp, Homo sapiens
tgtttctttaaggtgagaca

SEQ ID NO: 8163393 - DNA, 22 bp, Homo sapiens
tgtttctttgtagatattcttt

SEQ ID NO: 8163394 - DNA, 22 bp, Homo sapiens
tgtttctttgtagatattcttt

SEQ ID NO: 8163395 - DNA, 20 bp, Homo sapiens
tgtttcttttaatgagcggc

SEQ ID NO: 8163396 - DNA, 18 bp, Homo sapiens
tgtttcctcctggaggct

SEQ ID NO: 8163397 - DNA, 22 bp, Homo sapiens
tgtttccttctgtctctttgga

SEQ ID NO: 8163398 - DNA, 22 bp, Homo sapiens
tgtttcctaagtgtctctgaag

SEQ ID NO: 8163399 - DNA, 22 bp, Homo sapiens
tgtttcttgataaagcagaaaa

SEQ ID NO: 8163400 - DNA, 22 bp, Homo sapiens
tgtttcttgagagtattaccct

SEQ ID NO: 8163401 - DNA, 22 bp, Homo sapiens
tgtttcttgagagtattaccct

SEQ ID NO: 8163402 - DNA, 22 bp, Homo sapiens
tgttttcagtcatatagcaggt

SEQ ID NO: 8163403 - DNA, 22 bp, Homo sapiens
tgttttctcttgaaaagcagtc

SEQ ID NO: 8163404 - DNA, 22 bp, Homo sapiens
tgtttgcacattcgtttcaata

SEQ ID NO: 8163405 - DNA, 22 bp, Homo sapiens
tgtttgatgacgacattgtaga

SEQ ID NO: 8163406 - DNA, 22 bp, Homo sapiens
tgtttgagttctagcgcattta

SEQ ID NO: 8163407 - DNA, 22 bp, Homo sapiens
tgtttgaataacttggatatat

SEQ ID NO: 8163408 - DNA, 22 bp, Homo sapiens
tgtttaataattctatgatagt

SEQ ID NO: 8163409 - DNA, 22 bp, Homo sapiens
tgttctgtgcatctagccagta

SEQ ID NO: 8163410 - DNA, 22 bp, Homo sapiens
tgttctggtgaggccatggggt

SEQ ID NO: 8163411 - DNA, 22 bp, Homo sapiens
tgttctgtacctgtcctggggc

SEQ ID NO: 8163412 - DNA, 22 bp, Homo sapiens
tgttctggggacagcgtcccat

SEQ ID NO: 8163413 - DNA, 22 bp, Homo sapiens
tgttctgagtgcagcttaataa

SEQ ID NO: 8163414 - DNA, 22 bp, Homo sapiens
tgttctctctggctgccagtac

SEQ ID NO: 8163415 - DNA, 22 bp, Homo sapiens
tgttctcttctcattgaacatg

SEQ ID NO: 8163416 - DNA, 17 bp, Homo sapiens
tgttctcttcagaaatc

SEQ ID NO: 8163417 - DNA, 22 bp, Homo sapiens
tgttctaaattgctagctggaa

SEQ ID NO: 8163418 - DNA, 22 bp, Homo sapiens
tgttccttctggcttttacatc

SEQ ID NO: 8163419 - DNA, 21 bp, Homo sapiens
tgttcctgttctctaggatcc

SEQ ID NO: 8163420 - DNA, 21 bp, Homo sapiens
tgttcctgttctctaggatcc

SEQ ID NO: 8163421 - DNA, 22 bp, Homo sapiens
tgttctcactggatgcttcaca

SEQ ID NO: 8163422 - DNA, 22 bp, Homo sapiens
tgttctaagtgttttgttcatg

SEQ ID NO: 8163423 - DNA, 22 bp, Homo sapiens
tgtttacacttcaaggttaagg

SEQ ID NO: 8163424 - DNA, 22 bp, Homo sapiens
tgtttacagggtgattttacct

SEQ ID NO: 8163425 - DNA, 22 bp, Homo sapiens
tgtttacagggtgattttacct

SEQ ID NO: 8163426 - DNA, 22 bp, Homo sapiens
tgtttacaaggagaatttgagg

SEQ ID NO: 8163427 - DNA, 22 bp, Homo sapiens
tgtttacaaggagtttatattg

SEQ ID NO: 8163428 - DNA, 22 bp, Homo sapiens
tgtttacaaggagtttatattg

SEQ ID NO: 8163429 - DNA, 22 bp, Homo sapiens
tgtttacaaggagaatttgagg

SEQ ID NO: 8163430 - DNA, 22 bp, Homo sapiens
tgtttacaagccacttgttaag

SEQ ID NO: 8163431 - DNA, 22 bp, Homo sapiens
tgtttacaaaaccgtggtactg

SEQ ID NO: 8163432 - DNA, 22 bp, Homo sapiens
tgtttaattcaccatcatgttc

SEQ ID NO: 8163433 - DNA, 22 bp, Homo sapiens
tgtttaattcaccatcatgttc

SEQ ID NO: 8163434 - DNA, 22 bp, Homo sapiens
tgtttaatgcattgaccttggg

SEQ ID NO: 8163435 - DNA, 22 bp, Homo sapiens
tgtttaatttcacaaagttgac

SEQ ID NO: 8163436 - DNA, 22 bp, Homo sapiens
tgtttaatttttcatgagccaa

SEQ ID NO: 8163437 - DNA, 22 bp, Homo sapiens
tgtttaattgggccaacagcgg

SEQ ID NO: 8163438 - DNA, 22 bp, Homo sapiens
tgtttaatcttcaggacagtct

SEQ ID NO: 8163439 - DNA, 22 bp, Homo sapiens
tgtttaatgaagatggtttttc

SEQ ID NO: 8163440 - DNA, 22 bp, Homo sapiens
tgtttaatctataaaatggaga

SEQ ID NO: 8163441 - DNA, 22 bp, Homo sapiens
tgtttaataattctatgatagt

SEQ ID NO: 8163442 - DNA, 21 bp, Homo sapiens
tgtttaatacatatttgtgga

SEQ ID NO: 8163443 - DNA, 22 bp, Homo sapiens
tgtgttttaaatggaaatttga

SEQ ID NO: 8163444 - DNA, 22 bp, Homo sapiens
tgtgttttatctattgtatctt

SEQ ID NO: 8163445 - DNA, 21 bp, Homo sapiens
tgtgtttgagactatgtttcc

SEQ ID NO: 8163446 - DNA, 21 bp, Homo sapiens
tgtgtttgagactatgtttcc

SEQ ID NO: 8163447 - DNA, 22 bp, Homo sapiens
tgtgtttatagtgtatcttcca

SEQ ID NO: 8163448 - DNA, 22 bp, Homo sapiens
tgtgttgttttaagctgctgca

SEQ ID NO: 8163449 - DNA, 22 bp, Homo sapiens
tgtgtttagagagcacattcag

SEQ ID NO: 8163450 - DNA, 22 bp, Homo sapiens
tgtgtttatagtgtatcttcca

SEQ ID NO: 8163451 - DNA, 22 bp, Homo sapiens
tgtgtttagagagcacattcag

SEQ ID NO: 8163452 - DNA, 22 bp, Homo sapiens
tgtgtttacttctatgcagttt

SEQ ID NO: 8163453 - DNA, 23 bp, Homo sapiens
tgtgtttacctgaggatcttgtt

SEQ ID NO: 8163454 - DNA, 23 bp, Homo sapiens
tgtgtttacctgaggatcttgtt

SEQ ID NO: 8163455 - DNA, 22 bp, Homo sapiens
tgtgtgcacaggagtgtttgaa

SEQ ID NO: 8163456 - DNA, 21 bp, Homo sapiens
tgtgtgcatatgcatgtacat

SEQ ID NO: 8163457 - DNA, 22 bp, Homo sapiens
tgtgttaattccacaaacattc

SEQ ID NO: 8163458 - DNA, 22 bp, Homo sapiens
tgtgttctggaaagctcactga

SEQ ID NO: 8163459 - DNA, 22 bp, Homo sapiens
tgtgttctggaaagctcactga

SEQ ID NO: 8163460 - DNA, 22 bp, Homo sapiens
tgtgttcaagattagttctagt

SEQ ID NO: 8163461 - DNA, 22 bp, Homo sapiens
tgtgttggtagatctgaggtct

SEQ ID NO: 8163462 - DNA, 21 bp, Homo sapiens
tgtgttcttctaggtcagcta

SEQ ID NO: 8163463 - DNA, 22 bp, Homo sapiens
tgtgttggtagatctgaggtct

SEQ ID NO: 8163464 - DNA, 22 bp, Homo sapiens
tgtgttgtgacattcttggatg

SEQ ID NO: 8163465 - DNA, 21 bp, Homo sapiens
tgtgttcttctaggtcagcta

SEQ ID NO: 8163466 - DNA, 21 bp, Homo sapiens
tgtgttcttctaggtcagcta

SEQ ID NO: 8163467 - DNA, 20 bp, Homo sapiens
tgttcagaaatgcagagagg

SEQ ID NO: 8163468 - DNA, 22 bp, Homo sapiens
tgttcagaaaacagataactaa

SEQ ID NO: 8163469 - DNA, 22 bp, Homo sapiens
tgttcagaacaaaggtaaatga

SEQ ID NO: 8163470 - DNA, 22 bp, Homo sapiens
tgttcagaacaaaggtaaatga

SEQ ID NO: 8163471 - DNA, 22 bp, Homo sapiens
tgttcagaacaaaggtaaatga

SEQ ID NO: 8163472 - DNA, 22 bp, Homo sapiens
tgttcctgaatgcctggctggc

SEQ ID NO: 8163473 - DNA, 22 bp, Homo sapiens
tgttcctgacggccaaagaggt

SEQ ID NO: 8163474 - DNA, 22 bp, Homo sapiens
tgttcctgaggcatgtgtcaat

SEQ ID NO: 8163475 - DNA, 22 bp, Homo sapiens
tgttcctgaggcatgtgtcaat

SEQ ID NO: 8163476 - DNA, 22 bp, Homo sapiens
tgttcctgtactgctgtggctt

SEQ ID NO: 8163477 - DNA, 22 bp, Homo sapiens
tgttcctgctatggtttgttgc

SEQ ID NO: 8163478 - DNA, 20 bp, Homo sapiens
tgttcacagtagttgctgct

SEQ ID NO: 8163479 - DNA, 22 bp, Homo sapiens
tgttcacatgtacatgaatatt

SEQ ID NO: 8163480 - DNA, 21 bp, Homo sapiens
tgttcacatggagcagaatgt

SEQ ID NO: 8163481 - DNA, 22 bp, Homo sapiens
tgttcactccatgggaattgtg

SEQ ID NO: 8163482 - DNA, 22 bp, Homo sapiens
tgttcaaatcttttgcttattt

SEQ ID NO: 8163483 - DNA, 22 bp, Homo sapiens
tgttatttgggaaagttgtaca

SEQ ID NO: 8163484 - DNA, 22 bp, Homo sapiens
tgttatttgggaaagttgtaca

SEQ ID NO: 8163485 - DNA, 22 bp, Homo sapiens
tgttatttgggaaagttgtaca

SEQ ID NO: 8163486 - DNA, 22 bp, Homo sapiens
tgttatttgggaaagttgtaca

SEQ ID NO: 8163487 - DNA, 22 bp, Homo sapiens
tgttatttgggaaagttgtaca

SEQ ID NO: 8163488 - DNA, 22 bp, Homo sapiens
tgttatgatctcactatgacta

SEQ ID NO: 8163489 - DNA, 18 bp, Homo sapiens
tgttatgagactctagga

SEQ ID NO: 8163490 - DNA, 22 bp, Homo sapiens
tgttatgagaaagacattaggt

SEQ ID NO: 8163491 - DNA, 22 bp, Homo sapiens
tgttatgagtcctcatatacta

SEQ ID NO: 8163492 - DNA, 22 bp, Homo sapiens
tgttatgagtcctcatatacta

SEQ ID NO: 8163493 - DNA, 22 bp, Homo sapiens
tgttatgaactgcctatggact

SEQ ID NO: 8163494 - DNA, 22 bp, Homo sapiens
tgttatgaactgcctatggaga

SEQ ID NO: 8163495 - DNA, 19 bp, Homo sapiens
tgttatgactttgcctttt

SEQ ID NO: 8163496 - DNA, 22 bp, Homo sapiens
tgttatgaacttctagaaaaca

SEQ ID NO: 8163497 - DNA, 22 bp, Homo sapiens
tgttatcctcagctcacctcta

SEQ ID NO: 8163498 - DNA, 22 bp, Homo sapiens
tgttatctgcacgtagagtttt

SEQ ID NO: 8163499 - DNA, 22 bp, Homo sapiens
tgttatctggttgtctgattac

SEQ ID NO: 8163500 - DNA, 22 bp, Homo sapiens
tgttatctgagcaacgtcgacg

SEQ ID NO: 8163501 - DNA, 22 bp, Homo sapiens
tgttaaaaatgcagattcctat

SEQ ID NO: 8163502 - DNA, 22 bp, Homo sapiens
tgttaaaaatgcagattcctat

SEQ ID NO: 8163503 - DNA, 22 bp, Homo sapiens
tgttagttgttcatgttaagag

SEQ ID NO: 8163504 - DNA, 22 bp, Homo sapiens
tgttatatctaaatagccacat

SEQ ID NO: 8163505 - DNA, 22 bp, Homo sapiens
tgttatcacttagacatgctag

SEQ ID NO: 8163506 - DNA, 22 bp, Homo sapiens
tgttatcctcagctcacctcta

SEQ ID NO: 8163507 - DNA, 22 bp, Homo sapiens
tgttattgggtcccaactaggt

SEQ ID NO: 8163508 - DNA, 22 bp, Homo sapiens
tgttattgatatctaatgctct

SEQ ID NO: 8163509 - DNA, 23 bp, Homo sapiens
tgttattccaggttaatgtactt

SEQ ID NO: 8163510 - DNA, 22 bp, Homo sapiens
tgttattctagtggatcacgtc

SEQ ID NO: 8163511 - DNA, 22 bp, Homo sapiens
tgttattctggccagcaccgtt

SEQ ID NO: 8163512 - DNA, 22 bp, Homo sapiens
tgttatttatttcacctccaga

SEQ ID NO: 8163513 - DNA, 22 bp, Homo sapiens
tgttatttatctgagcatttat

SEQ ID NO: 8163514 - DNA, 22 bp, Homo sapiens
tgttatttatctgagcatttat

SEQ ID NO: 8163515 - DNA, 22 bp, Homo sapiens
tgttatttctttgccatatctt

SEQ ID NO: 8163516 - DNA, 22 bp, Homo sapiens
tgtgtgattgcaggagatgtgg

SEQ ID NO: 8163517 - DNA, 22 bp, Homo sapiens
tgtgtgattgcacttatatgag

SEQ ID NO: 8163518 - DNA, 22 bp, Homo sapiens
tgtgtgattccacttatatggg

SEQ ID NO: 8163519 - DNA, 22 bp, Homo sapiens
tgtgtgagtaaggctgagagag

SEQ ID NO: 8163520 - DNA, 22 bp, Homo sapiens
tgtgtgaggtggttctgagaag

SEQ ID NO: 8163521 - DNA, 22 bp, Homo sapiens
tgtgtgagtaaggctgagagag

SEQ ID NO: 8163522 - DNA, 22 bp, Homo sapiens
tgtgtgaggtggttctgagaag

SEQ ID NO: 8163523 - DNA, 22 bp, Homo sapiens
tgtgtgaggtggttctgagaag

SEQ ID NO: 8163524 - DNA, 22 bp, Homo sapiens
tgtgtgagacaattggctgtgg

SEQ ID NO: 8163525 - DNA, 22 bp, Homo sapiens
tgtgtgaggactcagtgaaaca

SEQ ID NO: 8163526 - DNA, 22 bp, Homo sapiens
tgtgtgacccccagtgaagcct

SEQ ID NO: 8163527 - DNA, 22 bp, Homo sapiens
tgtgtgacctggggtgagatag

SEQ ID NO: 8163528 - DNA, 22 bp, Homo sapiens
tgtgtgacccccagtgaagcct

SEQ ID NO: 8163529 - DNA, 20 bp, Homo sapiens
tgtgtgaatttcagagccgc

SEQ ID NO: 8163530 - DNA, 22 bp, Homo sapiens
tgtgtgaattctgagcagttta

SEQ ID NO: 8163531 - DNA, 20 bp, Homo sapiens
tgtgtcttcctttctttatg

SEQ ID NO: 8163532 - DNA, 22 bp, Homo sapiens
tgtgtctgttttgctcaccatt

SEQ ID NO: 8163533 - DNA, 22 bp, Homo sapiens
tgtgtctttggcgatgtctgga

SEQ ID NO: 8163534 - DNA, 20 bp, Homo sapiens
tgtgtgaacacggactctgt

SEQ ID NO: 8163535 - DNA, 22 bp, Homo sapiens
tgtgtgaatggattattctatt

SEQ ID NO: 8163536 - DNA, 22 bp, Homo sapiens
tgtgtgaaggaatatatactca

SEQ ID NO: 8163537 - DNA, 22 bp, Homo sapiens
tgtgtcctcatgaggtttgcag

SEQ ID NO: 8163538 - DNA, 22 bp, Homo sapiens
tgtgtcctcatgaggtttgcag

SEQ ID NO: 8163539 - DNA, 22 bp, Homo sapiens
tgtgtcctcatgaggtttgcag

SEQ ID NO: 8163540 - DNA, 22 bp, Homo sapiens
tgtgtcctcagggaagcagaga

SEQ ID NO: 8163541 - DNA, 22 bp, Homo sapiens
tgtgtcctcagggaagcagaga

SEQ ID NO: 8163542 - DNA, 22 bp, Homo sapiens
tgtgtcctatgaaagagggtta

SEQ ID NO: 8163543 - DNA, 22 bp, Homo sapiens
tgtgtcctcactgtatgcaagg

SEQ ID NO: 8163544 - DNA, 22 bp, Homo sapiens
tgtgtcctcactgtatgcaagg

SEQ ID NO: 8163545 - DNA, 22 bp, Homo sapiens
tgtgtcctatgaaagagggtta

SEQ ID NO: 8163546 - DNA, 19 bp, Homo sapiens
tgtgtcctagcagccagtc

SEQ ID NO: 8163547 - DNA, 22 bp, Homo sapiens
tgtgtcctactgaggagctcct

SEQ ID NO: 8163548 - DNA, 19 bp, Homo sapiens
tgtgtcctagcagccagtc

SEQ ID NO: 8163549 - DNA, 22 bp, Homo sapiens
tgtgtcctactgaggagctcct

SEQ ID NO: 8163550 - DNA, 22 bp, Homo sapiens
tgtgtccattcaggcactgacc

SEQ ID NO: 8163551 - DNA, 22 bp, Homo sapiens
tgtgtccattcaggcactgacc

SEQ ID NO: 8163552 - DNA, 22 bp, Homo sapiens
tgtgtcccttggaacctcagct

SEQ ID NO: 8163553 - DNA, 22 bp, Homo sapiens
tgtgtcaggccttatcggtggc

SEQ ID NO: 8163554 - DNA, 22 bp, Homo sapiens
tgtgtcaggccttatcggtggc

SEQ ID NO: 8163555 - DNA, 21 bp, Homo sapiens
tgtgtcagtctttggaagcaa

SEQ ID NO: 8163556 - DNA, 22 bp, Homo sapiens
tgtgtcatagagagcacaaatc

SEQ ID NO: 8163557 - DNA, 23 bp, Homo sapiens
tgtgtcataaaattaaaacttca

SEQ ID NO: 8163558 - DNA, 21 bp, Homo sapiens
tgtgtcagtctttggaagcaa

SEQ ID NO: 8163559 - DNA, 22 bp, Homo sapiens
tgtgtcatattagtattgagag

SEQ ID NO: 8163560 - DNA, 22 bp, Homo sapiens
tgtgtcatctgtgttacataat

SEQ ID NO: 8163561 - DNA, 22 bp, Homo sapiens
tgtgtcatctgtgttacataat

SEQ ID NO: 8163562 - DNA, 22 bp, Homo sapiens
tgtgtccatctgacaggagagg

SEQ ID NO: 8163563 - DNA, 20 bp, Homo sapiens
tgtgtccatcatctgggcac

SEQ ID NO: 8163564 - DNA, 22 bp, Homo sapiens
tgtgtccacgcactggcatgat

SEQ ID NO: 8163565 - DNA, 22 bp, Homo sapiens
tgtgtccacgcactggcatgat

SEQ ID NO: 8163566 - DNA, 22 bp, Homo sapiens
tgtgtccaacccagggacaagt

SEQ ID NO: 8163567 - DNA, 22 bp, Homo sapiens
tgtgtcattgccatgaaaaggc

SEQ ID NO: 8163568 - DNA, 22 bp, Homo sapiens
tgtgtccaacccagggacaagt

SEQ ID NO: 8163569 - DNA, 22 bp, Homo sapiens
tgtgtcctttcttaagagtgag

SEQ ID NO: 8163570 - DNA, 22 bp, Homo sapiens
tgtgtccttctgggagtcccag

SEQ ID NO: 8163571 - DNA, 22 bp, Homo sapiens
tgtgtcctttggaggatcagcg

SEQ ID NO: 8163572 - DNA, 22 bp, Homo sapiens
tgtgtcctttcttaagagtgag

SEQ ID NO: 8163573 - DNA, 22 bp, Homo sapiens
tgtgtcctttctaatgcccaga

SEQ ID NO: 8163574 - DNA, 23 bp, Homo sapiens
tgtgtctgtttagggaggatgtg

SEQ ID NO: 8163575 - DNA, 22 bp, Homo sapiens
tgtgtcctttggaggatcagcg

SEQ ID NO: 8163576 - DNA, 22 bp, Homo sapiens
tgtgtcctttctaatgcccaga

SEQ ID NO: 8163577 - DNA, 22 bp, Homo sapiens
tgtgtccttctgggagtcccag

SEQ ID NO: 8163578 - DNA, 22 bp, Homo sapiens
tgtgtccttctgggagtcccag

SEQ ID NO: 8163579 - DNA, 22 bp, Homo sapiens
tgtgtccttatgaaaatactgt

SEQ ID NO: 8163580 - DNA, 22 bp, Homo sapiens
tgtgtccttccagtttttcctg

SEQ ID NO: 8163581 - DNA, 22 bp, Homo sapiens
tgtgtccttccagtttttcctg

SEQ ID NO: 8163582 - DNA, 22 bp, Homo sapiens
tgtgtccttatgaaaatactgt

SEQ ID NO: 8163583 - DNA, 23 bp, Homo sapiens
tgtgtccttaactgtatatacta

SEQ ID NO: 8163584 - DNA, 23 bp, Homo sapiens
tgtgtccttaactgtatatacta

SEQ ID NO: 8163585 - DNA, 22 bp, Homo sapiens
tgtgtcctcttacctctgaccc

SEQ ID NO: 8163586 - DNA, 22 bp, Homo sapiens
tgtgtcctccagggagatgtaa

SEQ ID NO: 8163587 - DNA, 22 bp, Homo sapiens
tgtgtcctcatgtggcagagag

SEQ ID NO: 8163588 - DNA, 22 bp, Homo sapiens
tgtgtcctgcagacagactcag

SEQ ID NO: 8163589 - DNA, 22 bp, Homo sapiens
tgtgtcctgcaggtgctgcctg

SEQ ID NO: 8163590 - DNA, 22 bp, Homo sapiens
tgtgtcctgcagacagactcag

SEQ ID NO: 8163591 - DNA, 22 bp, Homo sapiens
tgtgtcctcttacctctgaccc

SEQ ID NO: 8163592 - DNA, 22 bp, Homo sapiens
tgtgtcctccagggagatgtaa

SEQ ID NO: 8163593 - DNA, 22 bp, Homo sapiens
tgtgtcctcatgtggcagagag

SEQ ID NO: 8163594 - DNA, 22 bp, Homo sapiens
tgtgtcctgtccccttgctgct

SEQ ID NO: 8163595 - DNA, 22 bp, Homo sapiens
tgtgtcctggtgttaattttat

SEQ ID NO: 8163596 - DNA, 22 bp, Homo sapiens
tgtgtcctgtccccttgctgct

SEQ ID NO: 8163597 - DNA, 22 bp, Homo sapiens
tgtgtcctggtgttaattttat

SEQ ID NO: 8163598 - DNA, 22 bp, Homo sapiens
tgtgtcctgcaggtgctgcctg

SEQ ID NO: 8163599 - DNA, 22 bp, Homo sapiens
tgtgtcctgtgatctctagggt

SEQ ID NO: 8163600 - DNA, 22 bp, Homo sapiens
tgtgtcctgtgcaaggggatga

SEQ ID NO: 8163601 - DNA, 22 bp, Homo sapiens
tgtgtcctgtgcaaggggatga

SEQ ID NO: 8163602 - DNA, 22 bp, Homo sapiens
tgtgtcctgtgatctctagggt

SEQ ID NO: 8163603 - DNA, 22 bp, Homo sapiens
tgtggtcagctactggtcatct

SEQ ID NO: 8163604 - DNA, 22 bp, Homo sapiens
tgtggtagagggcagatgggca

SEQ ID NO: 8163605 - DNA, 22 bp, Homo sapiens
tgtgggtggtaaaatacaatga

SEQ ID NO: 8163606 - DNA, 22 bp, Homo sapiens
tgtgggtgttctcacttagata

SEQ ID NO: 8163607 - DNA, 18 bp, Homo sapiens
tgtgggttgggcagacca

SEQ ID NO: 8163608 - DNA, 22 bp, Homo sapiens
tgtgggtttaagaggcagcatg

SEQ ID NO: 8163609 - DNA, 22 bp, Homo sapiens
tgtgggtggcatcgtcctggcc

SEQ ID NO: 8163610 - DNA, 22 bp, Homo sapiens
tgtgggtggcatcgtcctggcc

SEQ ID NO: 8163611 - DNA, 22 bp, Homo sapiens
tgtgggtggcatcgtcctggcc

SEQ ID NO: 8163612 - DNA, 22 bp, Homo sapiens
tgtgggtggagtgatattagct

SEQ ID NO: 8163613 - DNA, 19 bp, Homo sapiens
tgtggtctctgttctcagg

SEQ ID NO: 8163614 - DNA, 22 bp, Homo sapiens
tgtggtctggccattcagggac

SEQ ID NO: 8163615 - DNA, 19 bp, Homo sapiens
tgtggtctctgttctcagg

SEQ ID NO: 8163616 - DNA, 22 bp, Homo sapiens
tgtggtcttggaagaagttgct

SEQ ID NO: 8163617 - DNA, 22 bp, Homo sapiens
tgtggtctcgttatgttgccca

SEQ ID NO: 8163618 - DNA, 22 bp, Homo sapiens
tgtggtctcctgtcttggcctt

SEQ ID NO: 8163619 - DNA, 22 bp, Homo sapiens
tgtggtctccccagtgccagct

SEQ ID NO: 8163620 - DNA, 22 bp, Homo sapiens
tgtggtctccccagtgccagct

SEQ ID NO: 8163621 - DNA, 21 bp, Homo sapiens
tgtggtcttttagttccatca

SEQ ID NO: 8163622 - DNA, 21 bp, Homo sapiens
tgtggtcttttagttccatca

SEQ ID NO: 8163623 - DNA, 22 bp, Homo sapiens
tgtggtcttggaagaagttgct

SEQ ID NO: 8163624 - DNA, 22 bp, Homo sapiens
tgtggtgccgagagtctggacg

SEQ ID NO: 8163625 - DNA, 18 bp, Homo sapiens
tgtggtggagctgccttc

SEQ ID NO: 8163626 - DNA, 22 bp, Homo sapiens
tgtggcctgggagctgaggtct

SEQ ID NO: 8163627 - DNA, 20 bp, Homo sapiens
tgtggcctctagagacagcc

SEQ ID NO: 8163628 - DNA, 22 bp, Homo sapiens
tgtggcctctaagctcacgaag

SEQ ID NO: 8163629 - DNA, 17 bp, Homo sapiens
tgtggccttctgagctt

SEQ ID NO: 8163630 - DNA, 19 bp, Homo sapiens
tgtggcctggggacaggcc

SEQ ID NO: 8163631 - DNA, 19 bp, Homo sapiens
tgtggcctggggacaggcc

SEQ ID NO: 8163632 - DNA, 17 bp, Homo sapiens
tgtggccttctgagctt

SEQ ID NO: 8163633 - DNA, 22 bp, Homo sapiens
tgtggggactttcaaagccaat

SEQ ID NO: 8163634 - DNA, 20 bp, Homo sapiens
tgtgtcaggccctgattaaa

SEQ ID NO: 8163635 - DNA, 20 bp, Homo sapiens
tgtgtcaggccctgattaaa

SEQ ID NO: 8163636 - DNA, 22 bp, Homo sapiens
tgtgtcaggagatagcaaaggg

SEQ ID NO: 8163637 - DNA, 22 bp, Homo sapiens
tgtgtcagcatcctttgggaca

SEQ ID NO: 8163638 - DNA, 22 bp, Homo sapiens
tgtgtcaggagatagcaaaggg

SEQ ID NO: 8163639 - DNA, 22 bp, Homo sapiens
tgtgtcagcaggggagggaact

SEQ ID NO: 8163640 - DNA, 19 bp, Homo sapiens
tgtgtcagcagggggcttc

SEQ ID NO: 8163641 - DNA, 19 bp, Homo sapiens
tgtgtcagcagggggcttc

SEQ ID NO: 8163642 - DNA, 22 bp, Homo sapiens
tgtgtcagcaggggagggaact

SEQ ID NO: 8163643 - DNA, 22 bp, Homo sapiens
tgtgtacaaactaacaacatat

SEQ ID NO: 8163644 - DNA, 22 bp, Homo sapiens
tgtgtcagatttaggctcaaac

SEQ ID NO: 8163645 - DNA, 19 bp, Homo sapiens
tgtgtcagatttgctcctt

SEQ ID NO: 8163646 - DNA, 22 bp, Homo sapiens
tgtgtcagatttaggctcaaac

SEQ ID NO: 8163647 - DNA, 22 bp, Homo sapiens
tgtgtcagcacagtatcaatta

SEQ ID NO: 8163648 - DNA, 22 bp, Homo sapiens
tgtgtcagcacagtatcaatta

SEQ ID NO: 8163649 - DNA, 19 bp, Homo sapiens
tgtgtcagatttgctcctt

SEQ ID NO: 8163650 - DNA, 22 bp, Homo sapiens
tgtgtaaattatttttaatgat

SEQ ID NO: 8163651 - DNA, 22 bp, Homo sapiens
tgtgtaaatggcatctctcagc

SEQ ID NO: 8163652 - DNA, 22 bp, Homo sapiens
tgtgtaaatggactgtgaatta

SEQ ID NO: 8163653 - DNA, 22 bp, Homo sapiens
tgtgtaaatggactgtgaatta

SEQ ID NO: 8163654 - DNA, 22 bp, Homo sapiens
tgtgtaaatttatttacataaa

SEQ ID NO: 8163655 - DNA, 22 bp, Homo sapiens
tgtggtggctattctggtctca

SEQ ID NO: 8163656 - DNA, 22 bp, Homo sapiens
tgtggtggggtctggtattcca

SEQ ID NO: 8163657 - DNA, 22 bp, Homo sapiens
tgtggtggggtctggtattcca

SEQ ID NO: 8163658 - DNA, 22 bp, Homo sapiens
tgtggtggctattctggtctca

SEQ ID NO: 8163659 - DNA, 22 bp, Homo sapiens
tgtggtggtaatgagccagatg

SEQ ID NO: 8163660 - DNA, 22 bp, Homo sapiens
tgtggtgtgtctcacaaatgca

SEQ ID NO: 8163661 - DNA, 22 bp, Homo sapiens
tgtggttgaaggttattactta

SEQ ID NO: 8163662 - DNA, 22 bp, Homo sapiens
tgtgtaaaagattagtttacta

SEQ ID NO: 8163663 - DNA, 22 bp, Homo sapiens
tgtgtaaaatctgattaatact

SEQ ID NO: 8163664 - DNA, 22 bp, Homo sapiens
tgtgtaaaatctgattaatact

SEQ ID NO: 8163665 - DNA, 22 bp, Homo sapiens
tgtgtaaaatctgattaatact

SEQ ID NO: 8163666 - DNA, 22 bp, Homo sapiens
tgtgtaaagcttgttccagaaa

SEQ ID NO: 8163667 - DNA, 22 bp, Homo sapiens
tgtggcagctgctgcaggagct

SEQ ID NO: 8163668 - DNA, 18 bp, Homo sapiens
tgtggcaggggtgggaga

SEQ ID NO: 8163669 - DNA, 22 bp, Homo sapiens
tgtggcagtataagagctagaa

SEQ ID NO: 8163670 - DNA, 22 bp, Homo sapiens
tgtggcagtataagagctagaa

SEQ ID NO: 8163671 - DNA, 22 bp, Homo sapiens
tgtggccagcaggtggctgtgt

SEQ ID NO: 8163672 - DNA, 22 bp, Homo sapiens
tgtggccagaggtactatttta

SEQ ID NO: 8163673 - DNA, 22 bp, Homo sapiens
tgtggccactgtttcttttcct

SEQ ID NO: 8163674 - DNA, 22 bp, Homo sapiens
tgtggccaaaataaaatgaggt

SEQ ID NO: 8163675 - DNA, 22 bp, Homo sapiens
tgtggcattccaagacgcttaa

SEQ ID NO: 8163676 - DNA, 22 bp, Homo sapiens
tgtggccaccagagctgctatt

SEQ ID NO: 8163677 - DNA, 22 bp, Homo sapiens
tgtggccaccagagctgctatt

SEQ ID NO: 8163678 - DNA, 22 bp, Homo sapiens
tgtggcagtctcactggagggc

SEQ ID NO: 8163679 - DNA, 20 bp, Homo sapiens
tgtggccagctctctactgg

SEQ ID NO: 8163680 - DNA, 20 bp, Homo sapiens
tgtggccagctctctactgg

SEQ ID NO: 8163681 - DNA, 22 bp, Homo sapiens
tgtggccagccacaggcatggt

SEQ ID NO: 8163682 - DNA, 22 bp, Homo sapiens
tgtggccagccacaggcatggt

SEQ ID NO: 8163683 - DNA, 22 bp, Homo sapiens
tgtggccagcaggtggctgtgt

SEQ ID NO: 8163684 - DNA, 22 bp, Homo sapiens
tgtggccagccacaggcatggt

SEQ ID NO: 8163685 - DNA, 20 bp, Homo sapiens
tgtggccagctctctactgg

SEQ ID NO: 8163686 - DNA, 22 bp, Homo sapiens
tgtggccaggaaaaggagatgg

SEQ ID NO: 8163687 - DNA, 22 bp, Homo sapiens
tgtggccaggaaaaggagatgg

SEQ ID NO: 8163688 - DNA, 22 bp, Homo sapiens
tgtggccaggaaaaggagatgg

SEQ ID NO: 8163689 - DNA, 22 bp, Homo sapiens
tgtggccaggcccctgatggtg

SEQ ID NO: 8163690 - DNA, 22 bp, Homo sapiens
tgtggccagggggccatgtccc

SEQ ID NO: 8163691 - DNA, 22 bp, Homo sapiens
tgtggccatggtcagaatattg

SEQ ID NO: 8163692 - DNA, 22 bp, Homo sapiens
tgtggccatatactttgttgtg

SEQ ID NO: 8163693 - DNA, 22 bp, Homo sapiens
tgtggccataaagcttaaaatg

SEQ ID NO: 8163694 - DNA, 22 bp, Homo sapiens
tgtggccataaagcttaaaatg

SEQ ID NO: 8163695 - DNA, 19 bp, Homo sapiens
tgtggccatggttcagctg

SEQ ID NO: 8163696 - DNA, 22 bp, Homo sapiens
tgtggccatggtcagaatattg

SEQ ID NO: 8163697 - DNA, 19 bp, Homo sapiens
tgtggccatggttcagctg

SEQ ID NO: 8163698 - DNA, 22 bp, Homo sapiens
tgtggcccagatgagtgtgcta

SEQ ID NO: 8163699 - DNA, 22 bp, Homo sapiens
tgtggcctagttaaggacgcct

SEQ ID NO: 8163700 - DNA, 20 bp, Homo sapiens
tgtggccatgttccaactca

SEQ ID NO: 8163701 - DNA, 20 bp, Homo sapiens
tgtggccatgttccaactca

SEQ ID NO: 8163702 - DNA, 22 bp, Homo sapiens
tgtggccattcttgaggtcgac

SEQ ID NO: 8163703 - DNA, 22 bp, Homo sapiens
tgtggccattcttgaggtcgac

SEQ ID NO: 8163704 - DNA, 22 bp, Homo sapiens
tgtggcagaggaggcagcgtcc

SEQ ID NO: 8163705 - DNA, 22 bp, Homo sapiens
tgtggcagagtaaggacccagt

SEQ ID NO: 8163706 - DNA, 22 bp, Homo sapiens
tgtggcagagtaaggacccagt

SEQ ID NO: 8163707 - DNA, 22 bp, Homo sapiens
tgtggcagaggaggcagcgtcc

SEQ ID NO: 8163708 - DNA, 22 bp, Homo sapiens
tgtggcagaggaggcagcgtcc

SEQ ID NO: 8163709 - DNA, 22 bp, Homo sapiens
tgtggcagaggaggcagcgtcc

SEQ ID NO: 8163710 - DNA, 22 bp, Homo sapiens
tgtggcagagagagcttccttg

SEQ ID NO: 8163711 - DNA, 22 bp, Homo sapiens
tgtggcagagagagcttccttg

SEQ ID NO: 8163712 - DNA, 22 bp, Homo sapiens
tgtggcagctgctgcaggagct

SEQ ID NO: 8163713 - DNA, 22 bp, Homo sapiens
tgtggcagctgctgcaggagct

SEQ ID NO: 8163714 - DNA, 22 bp, Homo sapiens
tgtggcagctgctgcaggagct

SEQ ID NO: 8163715 - DNA, 21 bp, Homo sapiens
tgtggcagatgttgggaggca

SEQ ID NO: 8163716 - DNA, 21 bp, Homo sapiens
tgtggcagatgttgggaggca

SEQ ID NO: 8163717 - DNA, 22 bp, Homo sapiens
tgtggcacttgcaaatattttg

SEQ ID NO: 8163718 - DNA, 22 bp, Homo sapiens
tgtggcacttctctccttgtaa

SEQ ID NO: 8163719 - DNA, 22 bp, Homo sapiens
tgtggcacatacacaggagggc

SEQ ID NO: 8163720 - DNA, 22 bp, Homo sapiens
tgtggcacagaagaaagagagg

SEQ ID NO: 8163721 - DNA, 22 bp, Homo sapiens
tgtggcacttacatcctagttt

SEQ ID NO: 8163722 - DNA, 22 bp, Homo sapiens
tgtggcagaaccagaattcaaa

SEQ ID NO: 8163723 - DNA, 22 bp, Homo sapiens
tgtggcagaactgggactcaaa

SEQ ID NO: 8163724 - DNA, 22 bp, Homo sapiens
tgtggaggattctgatgccagc

SEQ ID NO: 8163725 - DNA, 22 bp, Homo sapiens
tgtggaggattctgatgccagc

SEQ ID NO: 8163726 - DNA, 22 bp, Homo sapiens
tgtggaggtttaagtaatggga

SEQ ID NO: 8163727 - DNA, 22 bp, Homo sapiens
tgtggagtggtctgaaggctcc

SEQ ID NO: 8163728 - DNA, 22 bp, Homo sapiens
tgtggatgagggagtgaacaaa

SEQ ID NO: 8163729 - DNA, 22 bp, Homo sapiens
tgtggcacagaaagatgaaggg

SEQ ID NO: 8163730 - DNA, 20 bp, Homo sapiens
tgtggatgaggtaaggatag

SEQ ID NO: 8163731 - DNA, 22 bp, Homo sapiens
tgtggagaagaaggccactgca

SEQ ID NO: 8163732 - DNA, 22 bp, Homo sapiens
tgtggaggattctgatgccagc

SEQ ID NO: 8163733 - DNA, 22 bp, Homo sapiens
tgtggagcccccaggagtgggg

SEQ ID NO: 8163734 - DNA, 22 bp, Homo sapiens
tgtggagccaggaggtggggac

SEQ ID NO: 8163735 - DNA, 22 bp, Homo sapiens
tgtggacatagaagcatgtgga

SEQ ID NO: 8163736 - DNA, 22 bp, Homo sapiens
tgtggacattttttgtcagtag

SEQ ID NO: 8163737 - DNA, 22 bp, Homo sapiens
tcccctctggaggctgcagggg

SEQ ID NO: 8163738 - DNA, 22 bp, Homo sapiens
tcccctctggaggctgcagggg

SEQ ID NO: 8163739 - DNA, 22 bp, Homo sapiens
tcccctcctgcctttgcggtgg

SEQ ID NO: 8163740 - DNA, 22 bp, Homo sapiens
tcccctctctgcgctcccaggt

SEQ ID NO: 8163741 - DNA, 22 bp, Homo sapiens
tcccctctctgcgctcccaggt

SEQ ID NO: 8163742 - DNA, 22 bp, Homo sapiens
tcccctgagacccctcagcact

SEQ ID NO: 8163743 - DNA, 22 bp, Homo sapiens
tgtggacagagcagaaggtcat

SEQ ID NO: 8163744 - DNA, 22 bp, Homo sapiens
tgtggacagagccctggtttgg

SEQ ID NO: 8163745 - DNA, 22 bp, Homo sapiens
tgtggacagctcttcccatatg

SEQ ID NO: 8163746 - DNA, 22 bp, Homo sapiens
tgtggacacctattaccagtga

SEQ ID NO: 8163747 - DNA, 22 bp, Homo sapiens
tgtggacactacgataggggaa

SEQ ID NO: 8163748 - DNA, 22 bp, Homo sapiens
tgtggacaccactgggaggtct

SEQ ID NO: 8163749 - DNA, 22 bp, Homo sapiens
tcccctgcagcgcctgcttcta

SEQ ID NO: 8163750 - DNA, 22 bp, Homo sapiens
tcccctgcagcgcctgcttcta

SEQ ID NO: 8163751 - DNA, 22 bp, Homo sapiens
tccccaggtcctgtcggctcct

SEQ ID NO: 8163752 - DNA, 22 bp, Homo sapiens
tccccagggtccctgcttccat

SEQ ID NO: 8163753 - DNA, 22 bp, Homo sapiens
tccccagggtccctgcttccat

SEQ ID NO: 8163754 - DNA, 22 bp, Homo sapiens
tccccatggaaggatgatggaa

SEQ ID NO: 8163755 - DNA, 22 bp, Homo sapiens
tccccatggaaggatgatggaa

SEQ ID NO: 8163756 - DNA, 22 bp, Homo sapiens
tccccatgggtggggacacata

SEQ ID NO: 8163757 - DNA, 22 bp, Homo sapiens
tccccatgtctgcagggagggt

SEQ ID NO: 8163758 - DNA, 22 bp, Homo sapiens
tccccatgaggctgaattgggc

SEQ ID NO: 8163759 - DNA, 22 bp, Homo sapiens
tcccccaggctggagtgcagtg

SEQ ID NO: 8163760 - DNA, 17 bp, Homo sapiens
tcccccagggctctctc

SEQ ID NO: 8163761 - DNA, 22 bp, Homo sapiens
tcccccaggctggagtgcagtg

SEQ ID NO: 8163762 - DNA, 22 bp, Homo sapiens
tcccctccaactccaactatgg

SEQ ID NO: 8163763 - DNA, 23 bp, Homo sapiens
tcccctcaggcagccagtgccct

SEQ ID NO: 8163764 - DNA, 22 bp, Homo sapiens
tcccctccaactccaactatgg

SEQ ID NO: 8163765 - DNA, 22 bp, Homo sapiens
tcccctcctctcctgatatggg

SEQ ID NO: 8163766 - DNA, 22 bp, Homo sapiens
tcccctcctctcctgatatggg

SEQ ID NO: 8163767 - DNA, 22 bp, Homo sapiens
tcccctcctgcctttgcggtgg

SEQ ID NO: 8163768 - DNA, 22 bp, Homo sapiens
tcccctcccttccaacagagct

SEQ ID NO: 8163769 - DNA, 22 bp, Homo sapiens
tccccccagcctttcacatgag

SEQ ID NO: 8163770 - DNA, 22 bp, Homo sapiens
tccccccagcctttcacatgag

SEQ ID NO: 8163771 - DNA, 22 bp, Homo sapiens
tccccccagcctttcacatgag

SEQ ID NO: 8163772 - DNA, 22 bp, Homo sapiens
tcccccatcccaaggaggtcat

SEQ ID NO: 8163773 - DNA, 22 bp, Homo sapiens
tccccctcattacctcattcaa

SEQ ID NO: 8163774 - DNA, 22 bp, Homo sapiens
tccccctcctgtggttttctgc

SEQ ID NO: 8163775 - DNA, 22 bp, Homo sapiens
tccccctccaattgccatgtta

SEQ ID NO: 8163776 - DNA, 22 bp, Homo sapiens
tccccctcctgtggttttctgc

SEQ ID NO: 8163777 - DNA, 22 bp, Homo sapiens
ttacacaaagctccccaaatag

SEQ ID NO: 8163778 - DNA, 22 bp, Homo sapiens
ttacacaaagttagctcttgca

SEQ ID NO: 8163779 - DNA, 22 bp, Homo sapiens
ttacacaacagtgcatcagcag

SEQ ID NO: 8163780 - DNA, 22 bp, Homo sapiens
ttacacaacatctgtattatta

SEQ ID NO: 8163781 - DNA, 22 bp, Homo sapiens
ttacacaacatctgtattatta

SEQ ID NO: 8163782 - DNA, 22 bp, Homo sapiens
ttacacaagttctttaacctat

SEQ ID NO: 8163783 - DNA, 22 bp, Homo sapiens
ttacacaatatatggtacttgg

SEQ ID NO: 8163784 - DNA, 22 bp, Homo sapiens
ttacacaatatatggtacttgg

SEQ ID NO: 8163785 - DNA, 22 bp, Homo sapiens
ttacaaagaaaattaggcattt

SEQ ID NO: 8163786 - DNA, 22 bp, Homo sapiens
ttacaaactgtcatatagtatt

SEQ ID NO: 8163787 - DNA, 22 bp, Homo sapiens
ttacaaactgtcatatagtatt

SEQ ID NO: 8163788 - DNA, 22 bp, Homo sapiens
ttacaaactgtcatatagtatt

SEQ ID NO: 8163789 - DNA, 22 bp, Homo sapiens
ttaatttttatgtatagtgtgt

SEQ ID NO: 8163790 - DNA, 22 bp, Homo sapiens
ttaatttttatgtatagtgtgt

SEQ ID NO: 8163791 - DNA, 22 bp, Homo sapiens
ttaattttgatgaggttcagtt

SEQ ID NO: 8163792 - DNA, 22 bp, Homo sapiens
ttacaaacaacagacatttatt

SEQ ID NO: 8163793 - DNA, 22 bp, Homo sapiens
ttacaaacaacagacatttatt

SEQ ID NO: 8163794 - DNA, 21 bp, Homo sapiens
ttaatttattcatgatagcta

SEQ ID NO: 8163795 - DNA, 21 bp, Homo sapiens
ttaatttattcatgatagcta

SEQ ID NO: 8163796 - DNA, 22 bp, Homo sapiens
ttaattttaacctgtttgtgtc

SEQ ID NO: 8163797 - DNA, 22 bp, Homo sapiens
ttacactaagctacttctatat

SEQ ID NO: 8163798 - DNA, 22 bp, Homo sapiens
ttacacgtgtgtgtatctgtat

SEQ ID NO: 8163799 - DNA, 22 bp, Homo sapiens
ttacacctcagtgagaagatct

SEQ ID NO: 8163800 - DNA, 22 bp, Homo sapiens
ttacacattgcagatcaaaatg

SEQ ID NO: 8163801 - DNA, 22 bp, Homo sapiens
ttacacatgtctcagtggaaat

SEQ ID NO: 8163802 - DNA, 22 bp, Homo sapiens
ttacacatgaaggtccaatgtt

SEQ ID NO: 8163803 - DNA, 22 bp, Homo sapiens
ttacacagtggttaagtctggg

SEQ ID NO: 8163804 - DNA, 22 bp, Homo sapiens
ttacacagatggttagtagagg

SEQ ID NO: 8163805 - DNA, 22 bp, Homo sapiens
ttacacagatggttagtagagg

SEQ ID NO: 8163806 - DNA, 22 bp, Homo sapiens
ttacacagcttctatccttgaa

SEQ ID NO: 8163807 - DNA, 22 bp, Homo sapiens
ttacacagtgaatttactcaag

SEQ ID NO: 8163808 - DNA, 22 bp, Homo sapiens
ttacacaggcacttaaaatgca

SEQ ID NO: 8163809 - DNA, 21 bp, Homo sapiens
ttacacactgcttctagaatg

SEQ ID NO: 8163810 - DNA, 22 bp, Homo sapiens
ttacacactctgccctgctgtt

SEQ ID NO: 8163811 - DNA, 21 bp, Homo sapiens
ttacacactgcttctagaatg

SEQ ID NO: 8163812 - DNA, 22 bp, Homo sapiens
ttacacagaaattttattgcct

SEQ ID NO: 8163813 - DNA, 22 bp, Homo sapiens
ttacacacaattagcatagtaa

SEQ ID NO: 8163814 - DNA, 22 bp, Homo sapiens
ttacacacagagctgggcctgg

SEQ ID NO: 8163815 - DNA, 22 bp, Homo sapiens
ttacacaattttattgacctaa

SEQ ID NO: 8163816 - DNA, 22 bp, Homo sapiens
ttacacaattactcactcctgg

SEQ ID NO: 8163817 - DNA, 22 bp, Homo sapiens
ttacatccttcaaagtcactca

SEQ ID NO: 8163818 - DNA, 22 bp, Homo sapiens
ttacatcatggagggtattgaa

SEQ ID NO: 8163819 - DNA, 22 bp, Homo sapiens
ttacatcattgagacatacata

SEQ ID NO: 8163820 - DNA, 22 bp, Homo sapiens
ttacattttggggtaaggataa

SEQ ID NO: 8163821 - DNA, 22 bp, Homo sapiens
ttacattttggggtaaggataa

SEQ ID NO: 8163822 - DNA, 22 bp, Homo sapiens
ttacatgaatacataaccattc

SEQ ID NO: 8163823 - DNA, 22 bp, Homo sapiens
ttacatgaatacataaccattc

SEQ ID NO: 8163824 - DNA, 22 bp, Homo sapiens
ttacatattgtctattgttcaa

SEQ ID NO: 8163825 - DNA, 22 bp, Homo sapiens
ttacatattgtctattgttcaa

SEQ ID NO: 8163826 - DNA, 22 bp, Homo sapiens
ttacatattatccaaaactgct

SEQ ID NO: 8163827 - DNA, 22 bp, Homo sapiens
ttacatcagcaagagtgtatgt

SEQ ID NO: 8163828 - DNA, 22 bp, Homo sapiens
ttacagtgctcttcaagacttc

SEQ ID NO: 8163829 - DNA, 22 bp, Homo sapiens
ttacagtgactcacattaacaa

SEQ ID NO: 8163830 - DNA, 22 bp, Homo sapiens
ttacatattatccaaaactgct

SEQ ID NO: 8163831 - DNA, 22 bp, Homo sapiens
ttacatattatccaaaactgct

SEQ ID NO: 8163832 - DNA, 22 bp, Homo sapiens
ttacatattatccaaaactgct

SEQ ID NO: 8163833 - DNA, 22 bp, Homo sapiens
ttacatagttaaatagtacagc

SEQ ID NO: 8163834 - DNA, 22 bp, Homo sapiens
ttacatagttaaatagtacagc

SEQ ID NO: 8163835 - DNA, 22 bp, Homo sapiens
ttacagtatgatcaacttttca

SEQ ID NO: 8163836 - DNA, 23 bp, Homo sapiens
ttacagtaggagttggaaaacca

SEQ ID NO: 8163837 - DNA, 22 bp, Homo sapiens
ttacagtattggtcacgtttgt

SEQ ID NO: 8163838 - DNA, 22 bp, Homo sapiens
ttacagtcttaaactcctgggc

SEQ ID NO: 8163839 - DNA, 22 bp, Homo sapiens
ttacagtgaagattcaggttcc

SEQ ID NO: 8163840 - DNA, 22 bp, Homo sapiens
ttacagtcttaaactcctgggc

SEQ ID NO: 8163841 - DNA, 22 bp, Homo sapiens
ttacagtctggattaggaaaca

SEQ ID NO: 8163842 - DNA, 22 bp, Homo sapiens
ttacagtagattttgaatgtgg

SEQ ID NO: 8163843 - DNA, 22 bp, Homo sapiens
ttacagtcaggcatgaattcag

SEQ ID NO: 8163844 - DNA, 22 bp, Homo sapiens
ttacagtattgttaaactcttt

SEQ ID NO: 8163845 - DNA, 22 bp, Homo sapiens
ttacaggtgagaaaactgaggc

SEQ ID NO: 8163846 - DNA, 21 bp, Homo sapiens
ttacaggtcatccaagtcacc

SEQ ID NO: 8163847 - DNA, 22 bp, Homo sapiens
ttacaggtattttattgagcag

SEQ ID NO: 8163848 - DNA, 22 bp, Homo sapiens
ttacaggtgggaaaactaagct

SEQ ID NO: 8163849 - DNA, 22 bp, Homo sapiens
ttacaggtggagaagtaaggct

SEQ ID NO: 8163850 - DNA, 22 bp, Homo sapiens
ttacaggtgagaaaactgaggc

SEQ ID NO: 8163851 - DNA, 22 bp, Homo sapiens
ttacaggttgtgtattcagtga

SEQ ID NO: 8163852 - DNA, 22 bp, Homo sapiens
ttacaggttaagtgacacttaa

SEQ ID NO: 8163853 - DNA, 22 bp, Homo sapiens
ttacaggttgtgtattcagtga

SEQ ID NO: 8163854 - DNA, 22 bp, Homo sapiens
ttacagtaacattttcagtctg

SEQ ID NO: 8163855 - DNA, 22 bp, Homo sapiens
ttacaggtgtggaaattgagta

SEQ ID NO: 8163856 - DNA, 22 bp, Homo sapiens
ttacaggtgggaaaactaagct

SEQ ID NO: 8163857 - DNA, 22 bp, Homo sapiens
ttacagtacagaaaataacaga

SEQ ID NO: 8163858 - DNA, 22 bp, Homo sapiens
ttacagtaatcgagtgttgtgg

SEQ ID NO: 8163859 - DNA, 22 bp, Homo sapiens
ttacagtaatcgagtgttgtgg

SEQ ID NO: 8163860 - DNA, 22 bp, Homo sapiens
ttacagtaatgtattatttaac

SEQ ID NO: 8163861 - DNA, 22 bp, Homo sapiens
ttacagtacctgtatggccact

SEQ ID NO: 8163862 - DNA, 22 bp, Homo sapiens
ttacagtacctgtatggccact

SEQ ID NO: 8163863 - DNA, 22 bp, Homo sapiens
ttacagtagatacaatgagtaa

SEQ ID NO: 8163864 - DNA, 22 bp, Homo sapiens
ttacagtagattttgaatgtgg

SEQ ID NO: 8163865 - DNA, 22 bp, Homo sapiens
ttacacttctaaaaaaagcagg

SEQ ID NO: 8163866 - DNA, 22 bp, Homo sapiens
ttacacttctaaaaaaagcagg

SEQ ID NO: 8163867 - DNA, 22 bp, Homo sapiens
ttacacttctgaaagcctaggt

SEQ ID NO: 8163868 - DNA, 22 bp, Homo sapiens
ttacacttgaaaacaggattta

SEQ ID NO: 8163869 - DNA, 22 bp, Homo sapiens
ttacacttgaaaacaggattta

SEQ ID NO: 8163870 - DNA, 22 bp, Homo sapiens
ttacacttgggtgtggatttta

SEQ ID NO: 8163871 - DNA, 22 bp, Homo sapiens
ttacagcttcgacagaggcagt

SEQ ID NO: 8163872 - DNA, 20 bp, Homo sapiens
ttacactttgtagcattttt

SEQ ID NO: 8163873 - DNA, 20 bp, Homo sapiens
ttacactttgtagcattttt

SEQ ID NO: 8163874 - DNA, 22 bp, Homo sapiens
ttacactttggcaagctattaa

SEQ ID NO: 8163875 - DNA, 22 bp, Homo sapiens
ttacactttggcaagctattaa

SEQ ID NO: 8163876 - DNA, 22 bp, Homo sapiens
ttacactttggcaagctattaa

SEQ ID NO: 8163877 - DNA, 22 bp, Homo sapiens
ttacactttaaatccagcttgt

SEQ ID NO: 8163878 - DNA, 22 bp, Homo sapiens
ttacaggggacattggggacat

SEQ ID NO: 8163879 - DNA, 22 bp, Homo sapiens
ttacaggggacattggggacat

SEQ ID NO: 8163880 - DNA, 22 bp, Homo sapiens
ttacagggatcccataaatgtc

SEQ ID NO: 8163881 - DNA, 22 bp, Homo sapiens
ttacagggaaccaatccagtgt

SEQ ID NO: 8163882 - DNA, 22 bp, Homo sapiens
ttacagggaaccaatccagtgt

SEQ ID NO: 8163883 - DNA, 22 bp, Homo sapiens
ttacaggggaccccgatggtga

SEQ ID NO: 8163884 - DNA, 22 bp, Homo sapiens
ttacagggggatgagattgtga

SEQ ID NO: 8163885 - DNA, 22 bp, Homo sapiens
ttacagggttgcagcattgacg

SEQ ID NO: 8163886 - DNA, 22 bp, Homo sapiens
ttacaggggtgtggaggcaatc

SEQ ID NO: 8163887 - DNA, 22 bp, Homo sapiens
ttagagaattccaaatgactac

SEQ ID NO: 8163888 - DNA, 22 bp, Homo sapiens
ttagagaagctgtaattattca

SEQ ID NO: 8163889 - DNA, 23 bp, Homo sapiens
ttagagatgattaaaaaatcttg

SEQ ID NO: 8163890 - DNA, 22 bp, Homo sapiens
ttagagatacatttgtagcttg

SEQ ID NO: 8163891 - DNA, 22 bp, Homo sapiens
ttagagagaaccatcaggatct

SEQ ID NO: 8163892 - DNA, 22 bp, Homo sapiens
ttagagatgtcccaaaatgaag

SEQ ID NO: 8163893 - DNA, 22 bp, Homo sapiens
ttagagattggttgacagattt

SEQ ID NO: 8163894 - DNA, 22 bp, Homo sapiens
ttagaggaaagtgactccgatg

SEQ ID NO: 8163895 - DNA, 22 bp, Homo sapiens
ttagaggacaagaggcctggct

SEQ ID NO: 8163896 - DNA, 22 bp, Homo sapiens
ttagaagtaaggtcagatttct

SEQ ID NO: 8163897 - DNA, 22 bp, Homo sapiens
ttagaagtaaggtcagatttct

SEQ ID NO: 8163898 - DNA, 22 bp, Homo sapiens
ttagaagtaaggtcagatttct

SEQ ID NO: 8163899 - DNA, 21 bp, Homo sapiens
ttagaagctaatgcagctggt

SEQ ID NO: 8163900 - DNA, 19 bp, Homo sapiens
ttagaagccataggtacag

SEQ ID NO: 8163901 - DNA, 22 bp, Homo sapiens
ttagaaagctttccatagtcaa

SEQ ID NO: 8163902 - DNA, 22 bp, Homo sapiens
ttagaagcaggctgtgtcccca

SEQ ID NO: 8163903 - DNA, 22 bp, Homo sapiens
ttagaaagctttccatagtcaa

SEQ ID NO: 8163904 - DNA, 22 bp, Homo sapiens
ttagagaaaagcttgcttgctt

SEQ ID NO: 8163905 - DNA, 22 bp, Homo sapiens
ttagagaagatgaaccatcgtt

SEQ ID NO: 8163906 - DNA, 22 bp, Homo sapiens
ttagagaaccaatgaatagtct

SEQ ID NO: 8163907 - DNA, 22 bp, Homo sapiens
ttagagaaccaatgaatagtct

SEQ ID NO: 8163908 - DNA, 22 bp, Homo sapiens
ttactttgcttcaggaagagga

SEQ ID NO: 8163909 - DNA, 22 bp, Homo sapiens
ttactttgctttctcattacag

SEQ ID NO: 8163910 - DNA, 22 bp, Homo sapiens
ttactttgcagatgtgtatgtc

SEQ ID NO: 8163911 - DNA, 22 bp, Homo sapiens
ttactttgcatttgtggtagtc

SEQ ID NO: 8163912 - DNA, 22 bp, Homo sapiens
ttactttgcatttgtggtagtc

SEQ ID NO: 8163913 - DNA, 22 bp, Homo sapiens
ttactttgccttttagtgtagg

SEQ ID NO: 8163914 - DNA, 22 bp, Homo sapiens
ttactttggatggtcaagaaag

SEQ ID NO: 8163915 - DNA, 22 bp, Homo sapiens
ttactttgctttctcattacag

SEQ ID NO: 8163916 - DNA, 18 bp, Homo sapiens
ttactttgtatagcctag

SEQ ID NO: 8163917 - DNA, 22 bp, Homo sapiens
ttactttgttctcaagatatgt

SEQ ID NO: 8163918 - DNA, 22 bp, Homo sapiens
ttactttggcaaactcctgccc

SEQ ID NO: 8163919 - DNA, 22 bp, Homo sapiens
ttactttgggtcctgcttataa

SEQ ID NO: 8163920 - DNA, 22 bp, Homo sapiens
ttactttgggtcctgcttataa

SEQ ID NO: 8163921 - DNA, 22 bp, Homo sapiens
ttactttgaatgtcacaagcaa

SEQ ID NO: 8163922 - DNA, 22 bp, Homo sapiens
ttactttgatgatcaatgagcg

SEQ ID NO: 8163923 - DNA, 22 bp, Homo sapiens
ttactttcagttaggcaggagc

SEQ ID NO: 8163924 - DNA, 22 bp, Homo sapiens
ttactttatgtgatggattagt

SEQ ID NO: 8163925 - DNA, 22 bp, Homo sapiens
ttactttatgtgatggattagt

SEQ ID NO: 8163926 - DNA, 22 bp, Homo sapiens
ttactttcaaaaactacgtggg

SEQ ID NO: 8163927 - DNA, 22 bp, Homo sapiens
ttactttcaagtggctgggggt

SEQ ID NO: 8163928 - DNA, 22 bp, Homo sapiens
ttactttatctcctagattcca

SEQ ID NO: 8163929 - DNA, 22 bp, Homo sapiens
ttactttagggatgttttgctt

SEQ ID NO: 8163930 - DNA, 22 bp, Homo sapiens
ttactttatagaacactggggg

SEQ ID NO: 8163931 - DNA, 22 bp, Homo sapiens
ttactttatctcctagattcca

SEQ ID NO: 8163932 - DNA, 22 bp, Homo sapiens
ttactttatgtgatggattagt

SEQ ID NO: 8163933 - DNA, 22 bp, Homo sapiens
ttagaaagaactttagatatca

SEQ ID NO: 8163934 - DNA, 22 bp, Homo sapiens
ttagaaaatttgcttctttgga

SEQ ID NO: 8163935 - DNA, 22 bp, Homo sapiens
ttagaaaatttgcttctttgga

SEQ ID NO: 8163936 - DNA, 22 bp, Homo sapiens
ttagaaaatttgcttctttgga

SEQ ID NO: 8163937 - DNA, 20 bp, Homo sapiens
ttactttgtttggatgacat

SEQ ID NO: 8163938 - DNA, 22 bp, Homo sapiens
ttactttgtttgcacttcacct

SEQ ID NO: 8163939 - DNA, 22 bp, Homo sapiens
ttactttgtttgcacttcacct

SEQ ID NO: 8163940 - DNA, 22 bp, Homo sapiens
ttacttttctattcgatatgtg

SEQ ID NO: 8163941 - DNA, 22 bp, Homo sapiens
ttacttggaggcctgttaccag

SEQ ID NO: 8163942 - DNA, 22 bp, Homo sapiens
ttactttagatcatactgtgtg

SEQ ID NO: 8163943 - DNA, 22 bp, Homo sapiens
ttactttagggatgttttgctt

SEQ ID NO: 8163944 - DNA, 22 bp, Homo sapiens
ttactttagatcatactgtgtg

SEQ ID NO: 8163945 - DNA, 22 bp, Homo sapiens
ttactttagatcatactgtgtg

SEQ ID NO: 8163946 - DNA, 22 bp, Homo sapiens
ttactttagaaatagtcatcaa

SEQ ID NO: 8163947 - DNA, 21 bp, Homo sapiens
ttactttagaaattgcctttt

SEQ ID NO: 8163948 - DNA, 22 bp, Homo sapiens
ttactttaagggtgtcttatta

SEQ ID NO: 8163949 - DNA, 19 bp, Homo sapiens
ttacttggcaaagtcagtc

SEQ ID NO: 8163950 - DNA, 22 bp, Homo sapiens
ttactttagaaatagtcatcaa

SEQ ID NO: 8163951 - DNA, 22 bp, Homo sapiens
ttactttaagggtgtcttatta

SEQ ID NO: 8163952 - DNA, 22 bp, Homo sapiens
ttactttaagggtgtcttatta

SEQ ID NO: 8163953 - DNA, 22 bp, Homo sapiens
ttacttctttggccttcagcca

SEQ ID NO: 8163954 - DNA, 22 bp, Homo sapiens
ttacttcttgtctcatgcctat

SEQ ID NO: 8163955 - DNA, 22 bp, Homo sapiens
ttacttcttacaaaagaaatat

SEQ ID NO: 8163956 - DNA, 22 bp, Homo sapiens
ttacttacagacagtagactct

SEQ ID NO: 8163957 - DNA, 21 bp, Homo sapiens
ttacttctgcttgttattgtc

SEQ ID NO: 8163958 - DNA, 21 bp, Homo sapiens
ttacttctgcttgttattgtc

SEQ ID NO: 8163959 - DNA, 22 bp, Homo sapiens
ttacttcttacaaaagaaatat

SEQ ID NO: 8163960 - DNA, 22 bp, Homo sapiens
ttacttcttacaaaagaaatat

SEQ ID NO: 8163961 - DNA, 22 bp, Homo sapiens
ttactgttttggtacctcattg

SEQ ID NO: 8163962 - DNA, 22 bp, Homo sapiens
ttacttaaacagaaatgcagaa

SEQ ID NO: 8163963 - DNA, 22 bp, Homo sapiens
ttacttacaaaggcaaaggaag

SEQ ID NO: 8163964 - DNA, 22 bp, Homo sapiens
ttactgtatgagtgtggtagtc

SEQ ID NO: 8163965 - DNA, 22 bp, Homo sapiens
ttactgttcatgttgtacactt

SEQ ID NO: 8163966 - DNA, 22 bp, Homo sapiens
ttactgttcctctctcaaagag

SEQ ID NO: 8163967 - DNA, 22 bp, Homo sapiens
ttactgttggtgtatccatagc

SEQ ID NO: 8163968 - DNA, 22 bp, Homo sapiens
ttactgttggtgtatccatagc

SEQ ID NO: 8163969 - DNA, 22 bp, Homo sapiens
ttactgtttgaaaaatgaatgt

SEQ ID NO: 8163970 - DNA, 22 bp, Homo sapiens
ttactagttgcttcactttgct

SEQ ID NO: 8163971 - DNA, 19 bp, Homo sapiens
ttactatgtgacaagcact

SEQ ID NO: 8163972 - DNA, 22 bp, Homo sapiens
ttactagtggagaaactgaggc

SEQ ID NO: 8163973 - DNA, 19 bp, Homo sapiens
ttactagtctcagttatgg

SEQ ID NO: 8163974 - DNA, 19 bp, Homo sapiens
ttactagtctcagttatgg

SEQ ID NO: 8163975 - DNA, 22 bp, Homo sapiens
ttactagtatatgtcaagcaac

SEQ ID NO: 8163976 - DNA, 22 bp, Homo sapiens
ttactgaaaattcttcaggatt

SEQ ID NO: 8163977 - DNA, 19 bp, Homo sapiens
ttactcattctaaatgggc

SEQ ID NO: 8163978 - DNA, 22 bp, Homo sapiens
ttactacattgtaacacagtac

SEQ ID NO: 8163979 - DNA, 22 bp, Homo sapiens
ttactacattgtaacacagtac

SEQ ID NO: 8163980 - DNA, 23 bp, Homo sapiens
ttactacacaagtaacgattccc

SEQ ID NO: 8163981 - DNA, 22 bp, Homo sapiens
ttaccaaatgaaatagagattt

SEQ ID NO: 8163982 - DNA, 22 bp, Homo sapiens
ttactgtgtttggctttagatg

SEQ ID NO: 8163983 - DNA, 22 bp, Homo sapiens
ttactgtatacacaagtggtga

SEQ ID NO: 8163984 - DNA, 20 bp, Homo sapiens
ttactgtagtactacatttt

SEQ ID NO: 8163985 - DNA, 22 bp, Homo sapiens
ttactgtagcttgacatatgtc

SEQ ID NO: 8163986 - DNA, 22 bp, Homo sapiens
ttactgtaaaggtcacatggtg

SEQ ID NO: 8163987 - DNA, 22 bp, Homo sapiens
ttactgtactagtgagactagg

SEQ ID NO: 8163988 - DNA, 22 bp, Homo sapiens
ttactgtagcttgacatatgtc

SEQ ID NO: 8163989 - DNA, 22 bp, Homo sapiens
ttactgctgttaggatattttt

SEQ ID NO: 8163990 - DNA, 22 bp, Homo sapiens
ttactgctaattctgtaggttt

SEQ ID NO: 8163991 - DNA, 22 bp, Homo sapiens
ttactgcacgtgggacatatat

SEQ ID NO: 8163992 - DNA, 22 bp, Homo sapiens
ttaaatgtcaatagattgcttg

SEQ ID NO: 8163993 - DNA, 22 bp, Homo sapiens
ttaaatgtcaatagattgcttg

SEQ ID NO: 8163994 - DNA, 22 bp, Homo sapiens
ttaaatgctcacataaaggtag

SEQ ID NO: 8163995 - DNA, 22 bp, Homo sapiens
ttaaatgatgcatatcatttag

SEQ ID NO: 8163996 - DNA, 22 bp, Homo sapiens
ttaaatgatgcatatcatttag

SEQ ID NO: 8163997 - DNA, 22 bp, Homo sapiens
ttaaatgagatgttcagatatt

SEQ ID NO: 8163998 - DNA, 22 bp, Homo sapiens
ttaaatgagatgttcagatatt

SEQ ID NO: 8163999 - DNA, 22 bp, Homo sapiens
ttaaatgaggctgatgtagatt

SEQ ID NO: 8164000 - DNA, 22 bp, Homo sapiens
ttaaatgagatgttcagatatt

SEQ ID NO: 8164001 - DNA, 22 bp, Homo sapiens
ttaaatgaggctgatgtagatt

SEQ ID NO: 8164002 - DNA, 22 bp, Homo sapiens
ttaaatgaggctgatgtagatt

SEQ ID NO: 8164003 - DNA, 22 bp, Homo sapiens
ttaaatgaggctgatgtagatt

SEQ ID NO: 8164004 - DNA, 22 bp, Homo sapiens
ttaaatgaggctgatgtagatt

SEQ ID NO: 8164005 - DNA, 22 bp, Homo sapiens
ttaaatgaggctgatgtagatt

SEQ ID NO: 8164006 - DNA, 22 bp, Homo sapiens
ttaaatgacttttattattctc

SEQ ID NO: 8164007 - DNA, 22 bp, Homo sapiens
ttaaatgacttttattattctc

SEQ ID NO: 8164008 - DNA, 22 bp, Homo sapiens
ttaaatgacgggactgggtttt

SEQ ID NO: 8164009 - DNA, 22 bp, Homo sapiens
ttaaatgagatgttcagatatt

SEQ ID NO: 8164010 - DNA, 22 bp, Homo sapiens
ttaaatgacttttattattctc

SEQ ID NO: 8164011 - DNA, 22 bp, Homo sapiens
ttaaatgacttttattattctc

SEQ ID NO: 8164012 - DNA, 22 bp, Homo sapiens
ttaaatcagtaggctactcctt

SEQ ID NO: 8164013 - DNA, 22 bp, Homo sapiens
ttaaatcagtaggctactcctt

SEQ ID NO: 8164014 - DNA, 22 bp, Homo sapiens
ttaaatcagtaggctactcctt

SEQ ID NO: 8164015 - DNA, 22 bp, Homo sapiens
ttaaatcagtaggctactcctt

SEQ ID NO: 8164016 - DNA, 22 bp, Homo sapiens
ttaaatgaacgagatatgcaac

SEQ ID NO: 8164017 - DNA, 22 bp, Homo sapiens
ttaaatgaacgagatatgcaac

SEQ ID NO: 8164018 - DNA, 22 bp, Homo sapiens
ttaaatattttcagcagggtca

SEQ ID NO: 8164019 - DNA, 22 bp, Homo sapiens
ttaaatattttcagcagggtca

SEQ ID NO: 8164020 - DNA, 22 bp, Homo sapiens
ttaaatattttcagcagggtca

SEQ ID NO: 8164021 - DNA, 22 bp, Homo sapiens
ttaaatcaggcatcatttcagt

SEQ ID NO: 8164022 - DNA, 22 bp, Homo sapiens
ttaaatcaggcatcatttcagt

SEQ ID NO: 8164023 - DNA, 22 bp, Homo sapiens
ttaaatcaggcatcatttcagt

SEQ ID NO: 8164024 - DNA, 22 bp, Homo sapiens
ttaaatgtgatcctggtatgca

SEQ ID NO: 8164025 - DNA, 22 bp, Homo sapiens
ttaaatgtctgtagatgtgctg

SEQ ID NO: 8164026 - DNA, 22 bp, Homo sapiens
ttaaatgtctgtagatgtgctg

SEQ ID NO: 8164027 - DNA, 22 bp, Homo sapiens
ttaaatgtctgtagatgtgctg

SEQ ID NO: 8164028 - DNA, 22 bp, Homo sapiens
ttaaatgtttaatctaacttga

SEQ ID NO: 8164029 - DNA, 22 bp, Homo sapiens
ttaaatgtttaatctaacttga

SEQ ID NO: 8164030 - DNA, 22 bp, Homo sapiens
ttaaatgtgatttcatttatgt

SEQ ID NO: 8164031 - DNA, 22 bp, Homo sapiens
ttaaatgtgatttcatttatgt

SEQ ID NO: 8164032 - DNA, 22 bp, Homo sapiens
ttaaatgtgcctaaacctgtaa

SEQ ID NO: 8164033 - DNA, 22 bp, Homo sapiens
ttaaatgtgcctaaacctgtaa

SEQ ID NO: 8164034 - DNA, 22 bp, Homo sapiens
ttaaattaggactctagttctg

SEQ ID NO: 8164035 - DNA, 22 bp, Homo sapiens
ttaaattaggactctagttctg

SEQ ID NO: 8164036 - DNA, 22 bp, Homo sapiens
ttaaattaggactctagttctg

SEQ ID NO: 8164037 - DNA, 22 bp, Homo sapiens
ttaaattaggactctagttctg

SEQ ID NO: 8164038 - DNA, 22 bp, Homo sapiens
ttaacaaaaatatcaggcatca

SEQ ID NO: 8164039 - DNA, 22 bp, Homo sapiens
ttaacaatagagtttcttcagg

SEQ ID NO: 8164040 - DNA, 22 bp, Homo sapiens
ttaacaatagagtttcttcagg

SEQ ID NO: 8164041 - DNA, 22 bp, Homo sapiens
ttaacaaggtgactgcattaaa

SEQ ID NO: 8164042 - DNA, 22 bp, Homo sapiens
ttaacaaagtaacgggaaaaga

SEQ ID NO: 8164043 - DNA, 22 bp, Homo sapiens
ttaacaaagtaacgggaaaaga

SEQ ID NO: 8164044 - DNA, 22 bp, Homo sapiens
ttaacaaagctctgttcctttt

SEQ ID NO: 8164045 - DNA, 22 bp, Homo sapiens
ttaacacatatttatcaattgc

SEQ ID NO: 8164046 - DNA, 22 bp, Homo sapiens
ttaacacatatttatcaattgc

SEQ ID NO: 8164047 - DNA, 22 bp, Homo sapiens
ttaacaatagagtttcttcagg

SEQ ID NO: 8164048 - DNA, 22 bp, Homo sapiens
tgttttgtgcatttacaacatg

SEQ ID NO: 8164049 - DNA, 22 bp, Homo sapiens
tgttttgtttatgagagcacag

SEQ ID NO: 8164050 - DNA, 22 bp, Homo sapiens
tgttttgttcactgcattgtcc

SEQ ID NO: 8164051 - DNA, 22 bp, Homo sapiens
tgttttgttcactgcattgtcc

SEQ ID NO: 8164052 - DNA, 19 bp, Homo sapiens
tgttttgttaaagcagtcc

SEQ ID NO: 8164053 - DNA, 22 bp, Homo sapiens
tgttttggttttcaccgagtcc

SEQ ID NO: 8164054 - DNA, 22 bp, Homo sapiens
tgttttggtttaagtatatgaa

SEQ ID NO: 8164055 - DNA, 22 bp, Homo sapiens
tgttttgcttctctgtttccca

SEQ ID NO: 8164056 - DNA, 23 bp, Homo sapiens
tgttttcttgtcctggtataatt

SEQ ID NO: 8164057 - DNA, 22 bp, Homo sapiens
tgttttggtagattgattatgg

SEQ ID NO: 8164058 - DNA, 22 bp, Homo sapiens
tgttttggaacaaaagctattc

SEQ ID NO: 8164059 - DNA, 22 bp, Homo sapiens
tgttttctgatggttaatgagt

SEQ ID NO: 8164060 - DNA, 17 bp, Homo sapiens
tgttttctgctaccttt

SEQ ID NO: 8164061 - DNA, 22 bp, Homo sapiens
tgttttctgggtggaaggtact

SEQ ID NO: 8164062 - DNA, 23 bp, Homo sapiens
tgttttcttgtcctggtataatt

SEQ ID NO: 8164063 - DNA, 23 bp, Homo sapiens
tgttttcttgtcctggtataatt

SEQ ID NO: 8164064 - DNA, 23 bp, Homo sapiens
tgttttcttgtcctggtataatt

SEQ ID NO: 8164065 - DNA, 22 bp, Homo sapiens
ttaaagccatctagattttgag

SEQ ID NO: 8164066 - DNA, 23 bp, Homo sapiens
tgtttttcattcacatgggctgt

SEQ ID NO: 8164067 - DNA, 22 bp, Homo sapiens
tgtttttaaataatgatagaaa

SEQ ID NO: 8164068 - DNA, 22 bp, Homo sapiens
tgtttttaaataatgatagaaa

SEQ ID NO: 8164069 - DNA, 22 bp, Homo sapiens
tgtttttactgtgatccagaaa

SEQ ID NO: 8164070 - DNA, 22 bp, Homo sapiens
tgtttttactgtgatccagaaa

SEQ ID NO: 8164071 - DNA, 22 bp, Homo sapiens
tgtttttaaataatgatagaaa

SEQ ID NO: 8164072 - DNA, 22 bp, Homo sapiens
tgtttttaaataatgatagaaa

SEQ ID NO: 8164073 - DNA, 22 bp, Homo sapiens
tgtttttaaataatgatagaaa

SEQ ID NO: 8164074 - DNA, 22 bp, Homo sapiens
ttaaatattatgttgtctgcaa

SEQ ID NO: 8164075 - DNA, 22 bp, Homo sapiens
ttaaatattatgttgtctgcaa

SEQ ID NO: 8164076 - DNA, 22 bp, Homo sapiens
ttaaatattatgttgtctgcaa

SEQ ID NO: 8164077 - DNA, 22 bp, Homo sapiens
ttaaatagtcaaatcagtggca

SEQ ID NO: 8164078 - DNA, 21 bp, Homo sapiens
ttaaagcctccctcataagga

SEQ ID NO: 8164079 - DNA, 22 bp, Homo sapiens
ttaaagctaggtggaacaaatt

SEQ ID NO: 8164080 - DNA, 22 bp, Homo sapiens
ttaaatattatgttgtctgcaa

SEQ ID NO: 8164081 - DNA, 22 bp, Homo sapiens
ttaaatattatgttgtctgcaa

SEQ ID NO: 8164082 - DNA, 22 bp, Homo sapiens
ttaaatattatgttgtctgcaa

SEQ ID NO: 8164083 - DNA, 22 bp, Homo sapiens
ttaaatattatgttgtctgcaa

SEQ ID NO: 8164084 - DNA, 22 bp, Homo sapiens
ttaaatattatgttgtctgcaa

SEQ ID NO: 8164085 - DNA, 22 bp, Homo sapiens
ttaaatattttcagcagggtca

SEQ ID NO: 8164086 - DNA, 22 bp, Homo sapiens
ttaaatattttcagcagggtca

SEQ ID NO: 8164087 - DNA, 22 bp, Homo sapiens
ttaaatattttcagcagggtca

SEQ ID NO: 8164088 - DNA, 22 bp, Homo sapiens
ttaaatattatgttgtctgcaa

SEQ ID NO: 8164089 - DNA, 22 bp, Homo sapiens
ttaaatattatgttgtctgcaa

SEQ ID NO: 8164090 - DNA, 22 bp, Homo sapiens
ttaattggcctcttagaggtta

SEQ ID NO: 8164091 - DNA, 22 bp, Homo sapiens
ttaattgggtgcaacagctgaa

SEQ ID NO: 8164092 - DNA, 22 bp, Homo sapiens
ttaattcttccggactgtgaaa

SEQ ID NO: 8164093 - DNA, 22 bp, Homo sapiens
ttaattctagtttaacacttag

SEQ ID NO: 8164094 - DNA, 22 bp, Homo sapiens
ttaattctagtttaacacttag

SEQ ID NO: 8164095 - DNA, 22 bp, Homo sapiens
ttaatttatacataatcacagg

SEQ ID NO: 8164096 - DNA, 22 bp, Homo sapiens
ttaatttatacataatcacagg

SEQ ID NO: 8164097 - DNA, 22 bp, Homo sapiens
ttaatttatacataatcacagg

SEQ ID NO: 8164098 - DNA, 22 bp, Homo sapiens
ttaatttatacataatcacagg

SEQ ID NO: 8164099 - DNA, 22 bp, Homo sapiens
ttaatttatgtccaaaccagat

SEQ ID NO: 8164100 - DNA, 22 bp, Homo sapiens
ttaattatgagaaagggaaaag

SEQ ID NO: 8164101 - DNA, 22 bp, Homo sapiens
ttaattatgagaaagggaaaag

SEQ ID NO: 8164102 - DNA, 22 bp, Homo sapiens
ttaattcagtcaaagaaaccat

SEQ ID NO: 8164103 - DNA, 22 bp, Homo sapiens
ttaattatgcaaaaggccccat

SEQ ID NO: 8164104 - DNA, 22 bp, Homo sapiens
ttaattacaaaacacataggtt

SEQ ID NO: 8164105 - DNA, 22 bp, Homo sapiens
ttaataaacaggtgcagctgaa

SEQ ID NO: 8164106 - DNA, 22 bp, Homo sapiens
ttaataaacaggtgcagctgaa

SEQ ID NO: 8164107 - DNA, 22 bp, Homo sapiens
ttaataaacaggtgcagctgaa

SEQ ID NO: 8164108 - DNA, 22 bp, Homo sapiens
ttaattaattagttaagcatgt

SEQ ID NO: 8164109 - DNA, 22 bp, Homo sapiens
ttaataaagtatgaattggaaa

SEQ ID NO: 8164110 - DNA, 22 bp, Homo sapiens
ttaaggatgttgtgatttatta

SEQ ID NO: 8164111 - DNA, 22 bp, Homo sapiens
ttaaggattactttgtgtaccc

SEQ ID NO: 8164112 - DNA, 22 bp, Homo sapiens
ttaaggctggtcccctctgcgt

SEQ ID NO: 8164113 - DNA, 17 bp, Homo sapiens
ttaaggtggatcagcac

SEQ ID NO: 8164114 - DNA, 22 bp, Homo sapiens
ttaaggttgagctcacttttat

SEQ ID NO: 8164115 - DNA, 22 bp, Homo sapiens
ttaagtgagcttgaataatctt

SEQ ID NO: 8164116 - DNA, 22 bp, Homo sapiens
ttaagtgagcttgaataatctt

SEQ ID NO: 8164117 - DNA, 22 bp, Homo sapiens
ttaacttttatttctgctcgcc

SEQ ID NO: 8164118 - DNA, 20 bp, Homo sapiens
ttaagaaaagcacatcctgc

SEQ ID NO: 8164119 - DNA, 20 bp, Homo sapiens
ttaagaaaagcacatcctgc

SEQ ID NO: 8164120 - DNA, 22 bp, Homo sapiens
ttaagaaggtactcaaagatct

SEQ ID NO: 8164121 - DNA, 22 bp, Homo sapiens
ttaagaaggtactcaaagatct

SEQ ID NO: 8164122 - DNA, 22 bp, Homo sapiens
ttaagaatggaatgaggaattt

SEQ ID NO: 8164123 - DNA, 22 bp, Homo sapiens
ttaagaatgtgccttttggttg

SEQ ID NO: 8164124 - DNA, 22 bp, Homo sapiens
ttaagaatgtgccttttggttg

SEQ ID NO: 8164125 - DNA, 22 bp, Homo sapiens
ttaaggaaagccaaaatgaatt

SEQ ID NO: 8164126 - DNA, 22 bp, Homo sapiens
ttaagagaagagtatctagaac

SEQ ID NO: 8164127 - DNA, 22 bp, Homo sapiens
ttaagacatgtgagcataactt

SEQ ID NO: 8164128 - DNA, 22 bp, Homo sapiens
ttaacacttgaactctacatgt

SEQ ID NO: 8164129 - DNA, 22 bp, Homo sapiens
ttaacacttgaactctacatgt

SEQ ID NO: 8164130 - DNA, 22 bp, Homo sapiens
ttaacactatctgtcataatta

SEQ ID NO: 8164131 - DNA, 22 bp, Homo sapiens
ttaacagagtgcctggcatgta

SEQ ID NO: 8164132 - DNA, 22 bp, Homo sapiens
ttaacagagaacatagaagtag

SEQ ID NO: 8164133 - DNA, 22 bp, Homo sapiens
ttaacagacttgggattttcta

SEQ ID NO: 8164134 - DNA, 22 bp, Homo sapiens
ttaacagacatatatatttgta

SEQ ID NO: 8164135 - DNA, 22 bp, Homo sapiens
ttaacatacatcatgaacaatg

SEQ ID NO: 8164136 - DNA, 22 bp, Homo sapiens
ttaacatcctgtttaaatttgg

SEQ ID NO: 8164137 - DNA, 19 bp, Homo sapiens
ttaacagtcaccaaggaga

SEQ ID NO: 8164138 - DNA, 22 bp, Homo sapiens
ttaacaggttatattgtacagg

SEQ ID NO: 8164139 - DNA, 22 bp, Homo sapiens
ttaacatcctgtttaaatttgg

SEQ ID NO: 8164140 - DNA, 22 bp, Homo sapiens
ttaacatgtcttgacttcatct

SEQ ID NO: 8164141 - DNA, 22 bp, Homo sapiens
ttaacatgtcttgacttcatct

SEQ ID NO: 8164142 - DNA, 22 bp, Homo sapiens
ttaacatttcttttccactcat

SEQ ID NO: 8164143 - DNA, 22 bp, Homo sapiens
ttgatttcttactcttccaagg

SEQ ID NO: 8164144 - DNA, 22 bp, Homo sapiens
ttgatttcactctctgtccaat

SEQ ID NO: 8164145 - DNA, 22 bp, Homo sapiens
ttgatttctattcagatgtaga

SEQ ID NO: 8164146 - DNA, 22 bp, Homo sapiens
ttgattttaaaatagtgacact

SEQ ID NO: 8164147 - DNA, 22 bp, Homo sapiens
ttgatttatagaatgttcaagc

SEQ ID NO: 8164148 - DNA, 22 bp, Homo sapiens
ttgatttatagaatgttcaagc

SEQ ID NO: 8164149 - DNA, 22 bp, Homo sapiens
ttgatttcaaaatatatgcttg

SEQ ID NO: 8164150 - DNA, 23 bp, Homo sapiens
ttgatttagctgggattgcatgc

SEQ ID NO: 8164151 - DNA, 23 bp, Homo sapiens
ttgatttagctgggattgcatgc

SEQ ID NO: 8164152 - DNA, 23 bp, Homo sapiens
ttgatttagctgggattgcatgc

SEQ ID NO: 8164153 - DNA, 21 bp, Homo sapiens
ttgatttagcagatctagctg

SEQ ID NO: 8164154 - DNA, 21 bp, Homo sapiens
ttgatttagcagatctagctg

SEQ ID NO: 8164155 - DNA, 22 bp, Homo sapiens
ttgattcttctgaatttgcaga

SEQ ID NO: 8164156 - DNA, 23 bp, Homo sapiens
ttgattctttcagggacctagat

SEQ ID NO: 8164157 - DNA, 22 bp, Homo sapiens
ttgattttaaaatagtgacact

SEQ ID NO: 8164158 - DNA, 21 bp, Homo sapiens
ttgattttaggaagtttgtca

SEQ ID NO: 8164159 - DNA, 22 bp, Homo sapiens
ttgattttgcctgatctgagag

SEQ ID NO: 8164160 - DNA, 23 bp, Homo sapiens
ttgcaaagggcaaaggtcatgtg

SEQ ID NO: 8164161 - DNA, 22 bp, Homo sapiens
ttgcaaagcctttctaatcgtc

SEQ ID NO: 8164162 - DNA, 22 bp, Homo sapiens
ttgcaaataaacaagtatacat

SEQ ID NO: 8164163 - DNA, 22 bp, Homo sapiens
ttgcaaataaacaagtatacat

SEQ ID NO: 8164164 - DNA, 22 bp, Homo sapiens
ttgcaaatattgtttacctttc

SEQ ID NO: 8164165 - DNA, 22 bp, Homo sapiens
ttgcaaatgtttcataacagta

SEQ ID NO: 8164166 - DNA, 22 bp, Homo sapiens
ttgcaaatgtgaataattacac

SEQ ID NO: 8164167 - DNA, 22 bp, Homo sapiens
ttgattctaaaataggaggaaa

SEQ ID NO: 8164168 - DNA, 22 bp, Homo sapiens
ttgattcatggacaggccaggt

SEQ ID NO: 8164169 - DNA, 22 bp, Homo sapiens
ttgattcatcttctaataccca

SEQ ID NO: 8164170 - DNA, 22 bp, Homo sapiens
ttgattcacaattaccaagact

SEQ ID NO: 8164171 - DNA, 22 bp, Homo sapiens
ttgattctgatgaaagtccatt

SEQ ID NO: 8164172 - DNA, 22 bp, Homo sapiens
ttgattctatgaggtaagctat

SEQ ID NO: 8164173 - DNA, 22 bp, Homo sapiens
ttgattactatgtgttgaaagc

SEQ ID NO: 8164174 - DNA, 22 bp, Homo sapiens
ttgattacaaagtagatacatt

SEQ ID NO: 8164175 - DNA, 22 bp, Homo sapiens
ttgattcaaaacaggaggtagg

SEQ ID NO: 8164176 - DNA, 20 bp, Homo sapiens
ttgattcaagggctgatgga

SEQ ID NO: 8164177 - DNA, 22 bp, Homo sapiens
ttgatgtacagaattgttcaca

SEQ ID NO: 8164178 - DNA, 22 bp, Homo sapiens
ttgatgttgctcttaacagtat

SEQ ID NO: 8164179 - DNA, 22 bp, Homo sapiens
ttgatgttcataaatgatacag

SEQ ID NO: 8164180 - DNA, 22 bp, Homo sapiens
ttgatgttcataaatgatacag

SEQ ID NO: 8164181 - DNA, 22 bp, Homo sapiens
ttgatgtctaagtcattggcct

SEQ ID NO: 8164182 - DNA, 22 bp, Homo sapiens
ttgatccagttgaaagtgatga

SEQ ID NO: 8164183 - DNA, 22 bp, Homo sapiens
ttgagtggttcctcagttgact

SEQ ID NO: 8164184 - DNA, 22 bp, Homo sapiens
ttgagtgtactttagtcatctg

SEQ ID NO: 8164185 - DNA, 17 bp, Homo sapiens
ttgagtctggggtctac

SEQ ID NO: 8164186 - DNA, 20 bp, Homo sapiens
ttgaggcatgtctagaagta

SEQ ID NO: 8164187 - DNA, 22 bp, Homo sapiens
ttgaggcaggtccgggtccttc

SEQ ID NO: 8164188 - DNA, 22 bp, Homo sapiens
ttgaggcaggtccgggtccttc

SEQ ID NO: 8164189 - DNA, 22 bp, Homo sapiens
ttgaggcagcccttaattggga

SEQ ID NO: 8164190 - DNA, 22 bp, Homo sapiens
ttgaggcagggcatggtggccc

SEQ ID NO: 8164191 - DNA, 22 bp, Homo sapiens
ttgaggcagggcatggtggccc

SEQ ID NO: 8164192 - DNA, 22 bp, Homo sapiens
ttgaggcagggcatggtggccc

SEQ ID NO: 8164193 - DNA, 22 bp, Homo sapiens
ttgaggcattactgtaatgaga

SEQ ID NO: 8164194 - DNA, 22 bp, Homo sapiens
ttgaggcattactgtaatgaga

SEQ ID NO: 8164195 - DNA, 20 bp, Homo sapiens
ttgaggcatgtctagaagta

SEQ ID NO: 8164196 - DNA, 22 bp, Homo sapiens
ttgagtctctgccaaaacacaa

SEQ ID NO: 8164197 - DNA, 22 bp, Homo sapiens
ttgaggccaaaaagtcctatga

SEQ ID NO: 8164198 - DNA, 22 bp, Homo sapiens
ttgaggccaaaaagtcctatga

SEQ ID NO: 8164199 - DNA, 22 bp, Homo sapiens
ttgatgtaaagtgattcatggg

SEQ ID NO: 8164200 - DNA, 21 bp, Homo sapiens
ttgatggtgggtgatgctctg

SEQ ID NO: 8164201 - DNA, 22 bp, Homo sapiens
ttgatgagttatccatttgact

SEQ ID NO: 8164202 - DNA, 22 bp, Homo sapiens
ttgatgatcttacggcagagga

SEQ ID NO: 8164203 - DNA, 22 bp, Homo sapiens
ttgatgatgcacatttataatt

SEQ ID NO: 8164204 - DNA, 22 bp, Homo sapiens
ttgatgagaccattgccgcgtc

SEQ ID NO: 8164205 - DNA, 22 bp, Homo sapiens
ttgatctttataatagttttga

SEQ ID NO: 8164206 - DNA, 22 bp, Homo sapiens
ttgatgaaggtagatttgaaat

SEQ ID NO: 8164207 - DNA, 22 bp, Homo sapiens
ttgatgaaggtagatttgaaat

SEQ ID NO: 8164208 - DNA, 22 bp, Homo sapiens
ttgatcttcatttgttctgtat

SEQ ID NO: 8164209 - DNA, 22 bp, Homo sapiens
ttgatcttcatttgttctgtat

SEQ ID NO: 8164210 - DNA, 22 bp, Homo sapiens
ttgatcttacagtgttcttcca

SEQ ID NO: 8164211 - DNA, 22 bp, Homo sapiens
ttgatcttcatcgaaatattgt

SEQ ID NO: 8164212 - DNA, 22 bp, Homo sapiens
ttgagcaattaggaaataaaga

SEQ ID NO: 8164213 - DNA, 19 bp, Homo sapiens
ttgagcagtgcttagcacc

SEQ ID NO: 8164214 - DNA, 22 bp, Homo sapiens
ttgagcaggatggctatgcaca

SEQ ID NO: 8164215 - DNA, 22 bp, Homo sapiens
ttgagcaagagtaggaactgaa

SEQ ID NO: 8164216 - DNA, 22 bp, Homo sapiens
ttgagcaatgctgcaaagagat

SEQ ID NO: 8164217 - DNA, 20 bp, Homo sapiens
ttgagcaatcagtaaaggat

SEQ ID NO: 8164218 - DNA, 22 bp, Homo sapiens
ttgagatgtcttttggcattat

SEQ ID NO: 8164219 - DNA, 22 bp, Homo sapiens
ttgagatgtcttttggcattat

SEQ ID NO: 8164220 - DNA, 22 bp, Homo sapiens
ttgagatggagtcttgctctct

SEQ ID NO: 8164221 - DNA, 22 bp, Homo sapiens
ttgagcaaaggagtaaaatgca

SEQ ID NO: 8164222 - DNA, 22 bp, Homo sapiens
ttgagcaaatcagattgtaatt

SEQ ID NO: 8164223 - DNA, 22 bp, Homo sapiens
ttgagcaaatcagaagtttaga

SEQ ID NO: 8164224 - DNA, 22 bp, Homo sapiens
ttgaggagtgtgaggtctccca

SEQ ID NO: 8164225 - DNA, 22 bp, Homo sapiens
ttgaggcaaaatcaacgggaag

SEQ ID NO: 8164226 - DNA, 23 bp, Homo sapiens
ttgaggcaaacatgtaagtagga

SEQ ID NO: 8164227 - DNA, 22 bp, Homo sapiens
ttgaggcaaaatcaacgggaag

SEQ ID NO: 8164228 - DNA, 22 bp, Homo sapiens
ttgaggcacagattttagtggc

SEQ ID NO: 8164229 - DNA, 22 bp, Homo sapiens
ttgaggcacagattttagtggc

SEQ ID NO: 8164230 - DNA, 22 bp, Homo sapiens
ttgaggcacacacaggttgcat

SEQ ID NO: 8164231 - DNA, 22 bp, Homo sapiens
ttgaggcacacacaggttgcat

SEQ ID NO: 8164232 - DNA, 23 bp, Homo sapiens
ttgaggcaaactcttttctgaaa

SEQ ID NO: 8164233 - DNA, 23 bp, Homo sapiens
ttgaggcaaacatgtaagtagga

SEQ ID NO: 8164234 - DNA, 22 bp, Homo sapiens
ttgagatgaggtagaagccaat

SEQ ID NO: 8164235 - DNA, 22 bp, Homo sapiens
ttgagatgacttaaatttggga

SEQ ID NO: 8164236 - DNA, 22 bp, Homo sapiens
ttgagatggagcctcagtcttg

SEQ ID NO: 8164237 - DNA, 22 bp, Homo sapiens
ttgaattatatgtatgtccttt

SEQ ID NO: 8164238 - DNA, 22 bp, Homo sapiens
ttgagatattcagttccattga

SEQ ID NO: 8164239 - DNA, 22 bp, Homo sapiens
ttgagataggtggaatctcttt

SEQ ID NO: 8164240 - DNA, 22 bp, Homo sapiens
ttgaattagactttgctacagg

SEQ ID NO: 8164241 - DNA, 22 bp, Homo sapiens
ttgaatgccaatatctccttct

SEQ ID NO: 8164242 - DNA, 22 bp, Homo sapiens
ttgaatggcttctaggttctcc

SEQ ID NO: 8164243 - DNA, 22 bp, Homo sapiens
ttgaattataagtgtgtctact

SEQ ID NO: 8164244 - DNA, 22 bp, Homo sapiens
ttgaatgatcctatctagcaca

SEQ ID NO: 8164245 - DNA, 22 bp, Homo sapiens
ttgaatgattaaagtcatctga

SEQ ID NO: 8164246 - DNA, 22 bp, Homo sapiens
ttgaatgagaagttattgccat

SEQ ID NO: 8164247 - DNA, 16 bp, Homo sapiens
ttgaatgactgtgtgc

SEQ ID NO: 8164248 - DNA, 21 bp, Homo sapiens
ttgaagcaagggtggctctga

SEQ ID NO: 8164249 - DNA, 22 bp, Homo sapiens
ttgaagcaggaaaatttctatt

SEQ ID NO: 8164250 - DNA, 22 bp, Homo sapiens
ttgaagcattgtggcttgtatt

SEQ ID NO: 8164251 - DNA, 22 bp, Homo sapiens
ttgaagctccggtgtataggaa

SEQ ID NO: 8164252 - DNA, 22 bp, Homo sapiens
ttgaagctaggctgtgcatatg

SEQ ID NO: 8164253 - DNA, 22 bp, Homo sapiens
ttgaagctctaacttccaatac

SEQ ID NO: 8164254 - DNA, 22 bp, Homo sapiens
ttgaagctctaacttccaatac

SEQ ID NO: 8164255 - DNA, 22 bp, Homo sapiens
ttgaagctgccgtttttctcca

SEQ ID NO: 8164256 - DNA, 22 bp, Homo sapiens
ttgaagctgtctttcagaatca

SEQ ID NO: 8164257 - DNA, 22 bp, Homo sapiens
ttgaagctgtgctttttgtagg

SEQ ID NO: 8164258 - DNA, 22 bp, Homo sapiens
ttgaagctgtgctttttgtagg

SEQ ID NO: 8164259 - DNA, 22 bp, Homo sapiens
ttgaatgaagtccctttttact

SEQ ID NO: 8164260 - DNA, 22 bp, Homo sapiens
ttgaatgaatagttgctagaag

SEQ ID NO: 8164261 - DNA, 22 bp, Homo sapiens
ttgaatgaatggtccatataga

SEQ ID NO: 8164262 - DNA, 22 bp, Homo sapiens
ttgaatgaatggtccatataga

SEQ ID NO: 8164263 - DNA, 20 bp, Homo sapiens
ttgaatgaatgtctggctca

SEQ ID NO: 8164264 - DNA, 22 bp, Homo sapiens
ttgaagagtctagattggttat

SEQ ID NO: 8164265 - DNA, 22 bp, Homo sapiens
ttgaagatggatcgccactctc

SEQ ID NO: 8164266 - DNA, 22 bp, Homo sapiens
ttgaagattctttttgttagta

SEQ ID NO: 8164267 - DNA, 20 bp, Homo sapiens
ttgaagaggatatatcgctc

SEQ ID NO: 8164268 - DNA, 22 bp, Homo sapiens
ttgaagatctttgcattgcagg

SEQ ID NO: 8164269 - DNA, 22 bp, Homo sapiens
ttctttctcaacatgaatgttt

SEQ ID NO: 8164270 - DNA, 22 bp, Homo sapiens
ttgaagaaattattttatatag

SEQ ID NO: 8164271 - DNA, 22 bp, Homo sapiens
ttgaagactaatttagataatg

SEQ ID NO: 8164272 - DNA, 22 bp, Homo sapiens
ttctttccttgcctcagtgaag

SEQ ID NO: 8164273 - DNA, 22 bp, Homo sapiens
ttctttctcaacatgaatgttt

SEQ ID NO: 8164274 - DNA, 22 bp, Homo sapiens
ttctttccttgcctcagtgaag

SEQ ID NO: 8164275 - DNA, 22 bp, Homo sapiens
ttctttccttgcctcagtgaag

SEQ ID NO: 8164276 - DNA, 22 bp, Homo sapiens
ttctttccccatggagttcgga

SEQ ID NO: 8164277 - DNA, 22 bp, Homo sapiens
ttctttcccttccagcagctcc

SEQ ID NO: 8164278 - DNA, 22 bp, Homo sapiens
ttctttcccttccagcagctcc

SEQ ID NO: 8164279 - DNA, 22 bp, Homo sapiens
ttctttccccatggagttcgga

SEQ ID NO: 8164280 - DNA, 21 bp, Homo sapiens
ttctttccccagaggactaaa

SEQ ID NO: 8164281 - DNA, 22 bp, Homo sapiens
ttctttcccagaagatatgttt

SEQ ID NO: 8164282 - DNA, 22 bp, Homo sapiens
ttctttcccagtagatgtgaaa

SEQ ID NO: 8164283 - DNA, 19 bp, Homo sapiens
ttctttccacatcttctct

SEQ ID NO: 8164284 - DNA, 19 bp, Homo sapiens
ttctttccacatcttctct

SEQ ID NO: 8164285 - DNA, 19 bp, Homo sapiens
ttctttccacatcttctct

SEQ ID NO: 8164286 - DNA, 22 bp, Homo sapiens
ttctttccacagaggggatgat

SEQ ID NO: 8164287 - DNA, 22 bp, Homo sapiens
ttctttccaaccagatattggt

SEQ ID NO: 8164288 - DNA, 22 bp, Homo sapiens
ttctttccacagaggggatgat

SEQ ID NO: 8164289 - DNA, 20 bp, Homo sapiens
ttctttcatctacacgttgt

SEQ ID NO: 8164290 - DNA, 20 bp, Homo sapiens
ttctttcatctacacgttgt

SEQ ID NO: 8164291 - DNA, 22 bp, Homo sapiens
ttctttcagaacacaagtgatt

SEQ ID NO: 8164292 - DNA, 22 bp, Homo sapiens
ttctttcagaacacaagtgatt

SEQ ID NO: 8164293 - DNA, 22 bp, Homo sapiens
ttctttcaatagctggcatatg

SEQ ID NO: 8164294 - DNA, 23 bp, Homo sapiens
ttctttcaagaagttcacagtgc

SEQ ID NO: 8164295 - DNA, 23 bp, Homo sapiens
ttctttcaagaagttcacagtgc

SEQ ID NO: 8164296 - DNA, 23 bp, Homo sapiens
ttctttcaagaagttcacagtgc

SEQ ID NO: 8164297 - DNA, 22 bp, Homo sapiens
ttctttatgttaatgaatctat

SEQ ID NO: 8164298 - DNA, 22 bp, Homo sapiens
ttctttattgagacttcattgt

SEQ ID NO: 8164299 - DNA, 22 bp, Homo sapiens
ttctttattagtttagtgagct

SEQ ID NO: 8164300 - DNA, 22 bp, Homo sapiens
ttctttattagtttagtgagct

SEQ ID NO: 8164301 - DNA, 22 bp, Homo sapiens
ttctttatgcttctgtttaggc

SEQ ID NO: 8164302 - DNA, 22 bp, Homo sapiens
ttctttatgcttctgtttaggc

SEQ ID NO: 8164303 - DNA, 22 bp, Homo sapiens
ttctttatggaatggtgatagt

SEQ ID NO: 8164304 - DNA, 22 bp, Homo sapiens
ttctttatggaatggtgatagt

SEQ ID NO: 8164305 - DNA, 22 bp, Homo sapiens
ttctttatcctatttgtaggtg

SEQ ID NO: 8164306 - DNA, 22 bp, Homo sapiens
ttctttatgcttctgtttaggc

SEQ ID NO: 8164307 - DNA, 22 bp, Homo sapiens
ttctttatgcttctgtttaggc

SEQ ID NO: 8164308 - DNA, 22 bp, Homo sapiens
ttctggaaagatttgcgtgtaa

SEQ ID NO: 8164309 - DNA, 22 bp, Homo sapiens
ttctggaaagcatttgaggccc

SEQ ID NO: 8164310 - DNA, 22 bp, Homo sapiens
ttctggaaagcatttgaggccc

SEQ ID NO: 8164311 - DNA, 22 bp, Homo sapiens
ttctggaaatcagcagagggtg

SEQ ID NO: 8164312 - DNA, 22 bp, Homo sapiens
ttctggaaaagaaagttaagat

SEQ ID NO: 8164313 - DNA, 19 bp, Homo sapiens
ttctggaaacccaggtaat

SEQ ID NO: 8164314 - DNA, 22 bp, Homo sapiens
ttctggaaaccctcagccagtg

SEQ ID NO: 8164315 - DNA, 22 bp, Homo sapiens
ttctggaaagaaggctaaggtc

SEQ ID NO: 8164316 - DNA, 22 bp, Homo sapiens
ttctgctttggttccatggatg

SEQ ID NO: 8164317 - DNA, 22 bp, Homo sapiens
ttctgctttcagttcttctggg

SEQ ID NO: 8164318 - DNA, 22 bp, Homo sapiens
ttctgctttcagttcttctggg

SEQ ID NO: 8164319 - DNA, 22 bp, Homo sapiens
ttctgcttttctctgtctgagt

SEQ ID NO: 8164320 - DNA, 22 bp, Homo sapiens
ttctgcttttagctaaactata

SEQ ID NO: 8164321 - DNA, 20 bp, Homo sapiens
ttctgcttgcaaatatcaag

SEQ ID NO: 8164322 - DNA, 22 bp, Homo sapiens
ttctgcttggttcttggtatga

SEQ ID NO: 8164323 - DNA, 22 bp, Homo sapiens
ttctgcttagagggcatttgca

SEQ ID NO: 8164324 - DNA, 22 bp, Homo sapiens
ttctgcttattcaaatgatctt

SEQ ID NO: 8164325 - DNA, 22 bp, Homo sapiens
ttctgcttcactggcctggagg

SEQ ID NO: 8164326 - DNA, 21 bp, Homo sapiens
ttctgctaagaaaacattatt

SEQ ID NO: 8164327 - DNA, 22 bp, Homo sapiens
ttctgctatgaaaaaagtgctg

SEQ ID NO: 8164328 - DNA, 22 bp, Homo sapiens
ttctgccttcagtcctctgact

SEQ ID NO: 8164329 - DNA, 22 bp, Homo sapiens
ttctgccttcagtcctctgact

SEQ ID NO: 8164330 - DNA, 21 bp, Homo sapiens
ttctgccttcccctagctggg

SEQ ID NO: 8164331 - DNA, 22 bp, Homo sapiens
ttctgagctacatagtactggg

SEQ ID NO: 8164332 - DNA, 22 bp, Homo sapiens
ttctgctctaatgtacaccagc

SEQ ID NO: 8164333 - DNA, 22 bp, Homo sapiens
ttctgctccaccacttccagca

SEQ ID NO: 8164334 - DNA, 17 bp, Homo sapiens
ttctgctgtcgtcctct

SEQ ID NO: 8164335 - DNA, 17 bp, Homo sapiens
ttctgctgtcgtcctct

SEQ ID NO: 8164336 - DNA, 22 bp, Homo sapiens
ttctgctggtgttttgtgaggc

SEQ ID NO: 8164337 - DNA, 22 bp, Homo sapiens
ttctgctgctgctgcacccaat

SEQ ID NO: 8164338 - DNA, 19 bp, Homo sapiens
ttctgctgttcctaggctg

SEQ ID NO: 8164339 - DNA, 22 bp, Homo sapiens
ttctgctgttgtgacgttagtt

SEQ ID NO: 8164340 - DNA, 21 bp, Homo sapiens
ttctgctgtgccatgcctctg

SEQ ID NO: 8164341 - DNA, 21 bp, Homo sapiens
ttctgctgtgccatgcctctg

SEQ ID NO: 8164342 - DNA, 22 bp, Homo sapiens
ttctagttaatgtagcatcttg

SEQ ID NO: 8164343 - DNA, 22 bp, Homo sapiens
ttctagttaatgtagcatcttg

SEQ ID NO: 8164344 - DNA, 22 bp, Homo sapiens
ttctagttaatgtagcatcttg

SEQ ID NO: 8164345 - DNA, 22 bp, Homo sapiens
ttctagttaatgtagcatcttg

SEQ ID NO: 8164346 - DNA, 22 bp, Homo sapiens
ttctagttaaagtatgtattag

SEQ ID NO: 8164347 - DNA, 22 bp, Homo sapiens
ttctagttaaagtatgtattag

SEQ ID NO: 8164348 - DNA, 22 bp, Homo sapiens
ttctagtgtccttggacttgct

SEQ ID NO: 8164349 - DNA, 22 bp, Homo sapiens
ttctagtgtccttggacttgct

SEQ ID NO: 8164350 - DNA, 22 bp, Homo sapiens
ttctagtgtccttggacttgct

SEQ ID NO: 8164351 - DNA, 22 bp, Homo sapiens
ttctagtgtccttggacttgct

SEQ ID NO: 8164352 - DNA, 22 bp, Homo sapiens
ttctagtttccattttaagaca

SEQ ID NO: 8164353 - DNA, 22 bp, Homo sapiens
ttctagtttagggctcttcaac

SEQ ID NO: 8164354 - DNA, 22 bp, Homo sapiens
ttctagtttagggctcttcaac

SEQ ID NO: 8164355 - DNA, 22 bp, Homo sapiens
ttctagttttcagtccaccagg

SEQ ID NO: 8164356 - DNA, 20 bp, Homo sapiens
ttctagtttggagttattaa

SEQ ID NO: 8164357 - DNA, 22 bp, Homo sapiens
ttctagttcccacatagttgcc

SEQ ID NO: 8164358 - DNA, 22 bp, Homo sapiens
ttctagttcttaggaacagaca

SEQ ID NO: 8164359 - DNA, 22 bp, Homo sapiens
ttctagttgagggagacaaata

SEQ ID NO: 8164360 - DNA, 22 bp, Homo sapiens
ttctataaatgaatgtgtatat

SEQ ID NO: 8164361 - DNA, 22 bp, Homo sapiens
ttctagttttgccacaggatac

SEQ ID NO: 8164362 - DNA, 22 bp, Homo sapiens
ttctagttttcagtccaccagg

SEQ ID NO: 8164363 - DNA, 22 bp, Homo sapiens
ttctagttttgccacaggatac

SEQ ID NO: 8164364 - DNA, 22 bp, Homo sapiens
ttctgaatcctcgaaacatagc

SEQ ID NO: 8164365 - DNA, 22 bp, Homo sapiens
ttctgaatcctcgaaacatagc

SEQ ID NO: 8164366 - DNA, 22 bp, Homo sapiens
ttctgagaagggtgggtctggc

SEQ ID NO: 8164367 - DNA, 22 bp, Homo sapiens
ttctgagaagtaaaatggcgtt

SEQ ID NO: 8164368 - DNA, 22 bp, Homo sapiens
ttctgacagtaatcagtttgct

SEQ ID NO: 8164369 - DNA, 22 bp, Homo sapiens
ttctgacagcaaaactcagcct

SEQ ID NO: 8164370 - DNA, 22 bp, Homo sapiens
ttctgacatatccagtctcagt

SEQ ID NO: 8164371 - DNA, 22 bp, Homo sapiens
ttctgacatttgtcaaaatgat

SEQ ID NO: 8164372 - DNA, 22 bp, Homo sapiens
ttctgaattcatgagatttggg

SEQ ID NO: 8164373 - DNA, 22 bp, Homo sapiens
ttctgaatggcaagcattaggc

SEQ ID NO: 8164374 - DNA, 22 bp, Homo sapiens
ttctgaatgatagtcttgaact

SEQ ID NO: 8164375 - DNA, 22 bp, Homo sapiens
ttctgaatgatagtcttgaact

SEQ ID NO: 8164376 - DNA, 22 bp, Homo sapiens
ttctgaatgatagtcttgaact

SEQ ID NO: 8164377 - DNA, 22 bp, Homo sapiens
ttctgaatttctgtgtatctta

SEQ ID NO: 8164378 - DNA, 22 bp, Homo sapiens
ttctgaatttctgtgtatctta

SEQ ID NO: 8164379 - DNA, 22 bp, Homo sapiens
ttctgacaattcagtaacagca

SEQ ID NO: 8164380 - DNA, 22 bp, Homo sapiens
ttctgacaattcagtaacagca

SEQ ID NO: 8164381 - DNA, 22 bp, Homo sapiens
ttctgacacattactacatgga

SEQ ID NO: 8164382 - DNA, 22 bp, Homo sapiens
ttctgacacattactacatgga

SEQ ID NO: 8164383 - DNA, 22 bp, Homo sapiens
ttctgagatgcgttagaaattt

SEQ ID NO: 8164384 - DNA, 22 bp, Homo sapiens
ttctgagaggcagagcttgtga

SEQ ID NO: 8164385 - DNA, 22 bp, Homo sapiens
ttctgagaggtttgcattttca

SEQ ID NO: 8164386 - DNA, 22 bp, Homo sapiens
ttctgagacaattgagagtcta

SEQ ID NO: 8164387 - DNA, 22 bp, Homo sapiens
ttctgagagagcctctcatgtt

SEQ ID NO: 8164388 - DNA, 22 bp, Homo sapiens
ttctgagacttgagattaattt

SEQ ID NO: 8164389 - DNA, 22 bp, Homo sapiens
ttcttctttatctcagtatcct

SEQ ID NO: 8164390 - DNA, 22 bp, Homo sapiens
ttcttacatctataaagttggg

SEQ ID NO: 8164391 - DNA, 22 bp, Homo sapiens
ttcttacagatttggtgaatga

SEQ ID NO: 8164392 - DNA, 22 bp, Homo sapiens
ttcttacagagtttacagagcc

SEQ ID NO: 8164393 - DNA, 22 bp, Homo sapiens
ttcttacagagtttacagagcc

SEQ ID NO: 8164394 - DNA, 22 bp, Homo sapiens
ttcttacatattttcatatggt

SEQ ID NO: 8164395 - DNA, 22 bp, Homo sapiens
ttcttacatattttcatatggt

SEQ ID NO: 8164396 - DNA, 22 bp, Homo sapiens
ttcttacagccctattactaaa

SEQ ID NO: 8164397 - DNA, 22 bp, Homo sapiens
ttcttacagccctattactaaa

SEQ ID NO: 8164398 - DNA, 22 bp, Homo sapiens
ttcttgaatagggattgataaa

SEQ ID NO: 8164399 - DNA, 22 bp, Homo sapiens
ttcttgaaggggatataaatag

SEQ ID NO: 8164400 - DNA, 22 bp, Homo sapiens
ttcttgaatcactttagagata

SEQ ID NO: 8164401 - DNA, 22 bp, Homo sapiens
ttcttgaccatgtatgtggtcc

SEQ ID NO: 8164402 - DNA, 22 bp, Homo sapiens
ttcttgagtatctgcacagtgc

SEQ ID NO: 8164403 - DNA, 19 bp, Homo sapiens
ttcttgaacatgtttctca

SEQ ID NO: 8164404 - DNA, 22 bp, Homo sapiens
ttcttctttcctataattaatt

SEQ ID NO: 8164405 - DNA, 22 bp, Homo sapiens
ttcttctttccaattacatggt

SEQ ID NO: 8164406 - DNA, 22 bp, Homo sapiens
ttcttctttccaattacatggt

SEQ ID NO: 8164407 - DNA, 22 bp, Homo sapiens
ttcttctttccccctgtggtac

SEQ ID NO: 8164408 - DNA, 22 bp, Homo sapiens
ttctttatcagttactcatagg

SEQ ID NO: 8164409 - DNA, 22 bp, Homo sapiens
ttctttatatctgctagtgggt

SEQ ID NO: 8164410 - DNA, 22 bp, Homo sapiens
ttctttatagctattggatgag

SEQ ID NO: 8164411 - DNA, 18 bp, Homo sapiens
ttctttaattcagtttga

SEQ ID NO: 8164412 - DNA, 18 bp, Homo sapiens
ttctttaattcagtttga

SEQ ID NO: 8164413 - DNA, 18 bp, Homo sapiens
ttctttaattcagtttga

SEQ ID NO: 8164414 - DNA, 22 bp, Homo sapiens
ttctttacagtgggttttgaat

SEQ ID NO: 8164415 - DNA, 22 bp, Homo sapiens
ttctttaccagtgaaatgttat

SEQ ID NO: 8164416 - DNA, 22 bp, Homo sapiens
ttctttaaaatagtgagaaaga

SEQ ID NO: 8164417 - DNA, 22 bp, Homo sapiens
ttctttaaaatagtgagaaaga

SEQ ID NO: 8164418 - DNA, 18 bp, Homo sapiens
ttctttaattcagtttga

SEQ ID NO: 8164419 - DNA, 22 bp, Homo sapiens
ttctttaaatgaattctctgta

SEQ ID NO: 8164420 - DNA, 22 bp, Homo sapiens
ttcttgatttcatgcagttaag

SEQ ID NO: 8164421 - DNA, 22 bp, Homo sapiens
ttcttgcctgcttcaggagaaa

SEQ ID NO: 8164422 - DNA, 22 bp, Homo sapiens
ttcttgccatatttcagccctt

SEQ ID NO: 8164423 - DNA, 22 bp, Homo sapiens
ttcttgcctgccctgtgtcgta

SEQ ID NO: 8164424 - DNA, 22 bp, Homo sapiens
ttcttgattcttccttgaagga

SEQ ID NO: 8164425 - DNA, 22 bp, Homo sapiens
ttcttgatgcttgtttaaaggt

SEQ ID NO: 8164426 - DNA, 22 bp, Homo sapiens
ttcttgatgaatgctaagaact

SEQ ID NO: 8164427 - DNA, 22 bp, Homo sapiens
ttcttgatgaatgctaagaact

SEQ ID NO: 8164428 - DNA, 22 bp, Homo sapiens
ttctgggtgccacctaagacat

SEQ ID NO: 8164429 - DNA, 22 bp, Homo sapiens
ttctgggtgccacctaagacat

SEQ ID NO: 8164430 - DNA, 22 bp, Homo sapiens
ttctgggtggccagtatttaga

SEQ ID NO: 8164431 - DNA, 18 bp, Homo sapiens
ttctgggtgttatgttta

SEQ ID NO: 8164432 - DNA, 23 bp, Homo sapiens
ttctgggttgctgtgcttggaat

SEQ ID NO: 8164433 - DNA, 22 bp, Homo sapiens
ttctgggtttacatctgacttc

SEQ ID NO: 8164434 - DNA, 21 bp, Homo sapiens
ttctgggttgttaatctgaac

SEQ ID NO: 8164435 - DNA, 22 bp, Homo sapiens
ttctggtggccagaagtctgaa

SEQ ID NO: 8164436 - DNA, 19 bp, Homo sapiens
ttctggtctggaatcaagg

SEQ ID NO: 8164437 - DNA, 19 bp, Homo sapiens
ttctggtctggaatcaagg

SEQ ID NO: 8164438 - DNA, 22 bp, Homo sapiens
ttctggtaccgtgtcagaaacc

SEQ ID NO: 8164439 - DNA, 22 bp, Homo sapiens
ttctggtaatcggatttcacag

SEQ ID NO: 8164440 - DNA, 22 bp, Homo sapiens
ttctgggtggccagtatttaga

SEQ ID NO: 8164441 - DNA, 22 bp, Homo sapiens
ttctggtatgggaaatttcaag

SEQ ID NO: 8164442 - DNA, 22 bp, Homo sapiens
ttctggggctaatacagaggtc

SEQ ID NO: 8164443 - DNA, 22 bp, Homo sapiens
ttctgggggccaggacagtggt

SEQ ID NO: 8164444 - DNA, 22 bp, Homo sapiens
ttctgggtcacccttctgctca

SEQ ID NO: 8164445 - DNA, 22 bp, Homo sapiens
ttctgggtagtatggttagttt

SEQ ID NO: 8164446 - DNA, 22 bp, Homo sapiens
ttctgggtaacaaggcaagaat

SEQ ID NO: 8164447 - DNA, 22 bp, Homo sapiens
ttctgggtgcaactctgttctg

SEQ ID NO: 8164448 - DNA, 17 bp, Homo sapiens
ttctgggtcccagggcc

SEQ ID NO: 8164449 - DNA, 22 bp, Homo sapiens
ttctgggtgactcacgctcccc

SEQ ID NO: 8164450 - DNA, 22 bp, Homo sapiens
ttctgggcctcctaggacaggc

SEQ ID NO: 8164451 - DNA, 22 bp, Homo sapiens
ttctgggcctcctaggacaggc

SEQ ID NO: 8164452 - DNA, 22 bp, Homo sapiens
ttctgggcccaaccctagagtg

SEQ ID NO: 8164453 - DNA, 22 bp, Homo sapiens
ttctgggcccaaccctagagtg

SEQ ID NO: 8164454 - DNA, 22 bp, Homo sapiens
ttctggggccaattgccactgc

SEQ ID NO: 8164455 - DNA, 22 bp, Homo sapiens
ttcttacaagtattccaggtcc

SEQ ID NO: 8164456 - DNA, 22 bp, Homo sapiens
ttcttaaaacttatggacaggt

SEQ ID NO: 8164457 - DNA, 22 bp, Homo sapiens
ttcttaaaacttatggacaggt

SEQ ID NO: 8164458 - DNA, 22 bp, Homo sapiens
ttctgttttagaaataagtagt

SEQ ID NO: 8164459 - DNA, 22 bp, Homo sapiens
ttctgttttagaaataagtagt

SEQ ID NO: 8164460 - DNA, 22 bp, Homo sapiens
ttctgttttagaaataagtagt

SEQ ID NO: 8164461 - DNA, 22 bp, Homo sapiens
ttctgtttgccatatatagtag

SEQ ID NO: 8164462 - DNA, 22 bp, Homo sapiens
ttctgtttgccatatatagtag

SEQ ID NO: 8164463 - DNA, 22 bp, Homo sapiens
ttctgtttgccatatatagtag

SEQ ID NO: 8164464 - DNA, 22 bp, Homo sapiens
ttctgtttgccatatatagtag

SEQ ID NO: 8164465 - DNA, 22 bp, Homo sapiens
ttctgtttctggggtctctgac

SEQ ID NO: 8164466 - DNA, 22 bp, Homo sapiens
ttctgtttataatttgcagttg

SEQ ID NO: 8164467 - DNA, 22 bp, Homo sapiens
ttctgtttactcagaaatacaa

SEQ ID NO: 8164468 - DNA, 22 bp, Homo sapiens
ttctgtttactcagaaatacaa

SEQ ID NO: 8164469 - DNA, 22 bp, Homo sapiens
ttctgttctttatttaccatat

SEQ ID NO: 8164470 - DNA, 22 bp, Homo sapiens
ttctgttctttatttaccatat

SEQ ID NO: 8164471 - DNA, 22 bp, Homo sapiens
ttctgttctgatacttgtttct

SEQ ID NO: 8164472 - DNA, 22 bp, Homo sapiens
ttctgttctgatacttgtttct

SEQ ID NO: 8164473 - DNA, 22 bp, Homo sapiens
ttctgttatcattaagcattat

SEQ ID NO: 8164474 - DNA, 22 bp, Homo sapiens
ttctgttacttgcaaccacagg

SEQ ID NO: 8164475 - DNA, 22 bp, Homo sapiens
ttctgttacttgcaaccacagg

SEQ ID NO: 8164476 - DNA, 22 bp, Homo sapiens
ttctgttagaattttgaaaata

SEQ ID NO: 8164477 - DNA, 22 bp, Homo sapiens
ttctggttctcaggaatgctaa

SEQ ID NO: 8164478 - DNA, 22 bp, Homo sapiens
ttctggtgtgttctctctaggc

SEQ ID NO: 8164479 - DNA, 22 bp, Homo sapiens
ttctgttacaagtgaaaaaatg

SEQ ID NO: 8164480 - DNA, 22 bp, Homo sapiens
ttctggtttaagaaagtgctgg

SEQ ID NO: 8164481 - DNA, 22 bp, Homo sapiens
ttcatgtgataaatgtgtgact

SEQ ID NO: 8164482 - DNA, 22 bp, Homo sapiens
ttcatgtggaaaagggctttca

SEQ ID NO: 8164483 - DNA, 22 bp, Homo sapiens
ttcatgtgatcacagattgtaa

SEQ ID NO: 8164484 - DNA, 22 bp, Homo sapiens
ttcatgttcatgcttaggaaaa

SEQ ID NO: 8164485 - DNA, 22 bp, Homo sapiens
ttcatgttgtagtatgtatcag

SEQ ID NO: 8164486 - DNA, 22 bp, Homo sapiens
ttccaatttgtggtgagttaat

SEQ ID NO: 8164487 - DNA, 22 bp, Homo sapiens
ttccaatttgtggtgagttaat

SEQ ID NO: 8164488 - DNA, 22 bp, Homo sapiens
ttccaattgttctttggaatct

SEQ ID NO: 8164489 - DNA, 22 bp, Homo sapiens
ttccaattgttctttggaatct

SEQ ID NO: 8164490 - DNA, 22 bp, Homo sapiens
ttcatgtaccgtgtaccaggca

SEQ ID NO: 8164491 - DNA, 22 bp, Homo sapiens
ttcatgtaggctgcaatgcaca

SEQ ID NO: 8164492 - DNA, 22 bp, Homo sapiens
ttcatgtgaatatatttgtctt

SEQ ID NO: 8164493 - DNA, 22 bp, Homo sapiens
ttcatgtctgccttttcaagtg

SEQ ID NO: 8164494 - DNA, 22 bp, Homo sapiens
ttcatgtatgaggccaatcttt

SEQ ID NO: 8164495 - DNA, 20 bp, Homo sapiens
ttcatgggagcaaagaggcc

SEQ ID NO: 8164496 - DNA, 20 bp, Homo sapiens
ttcatgggagcaaagaggcc

SEQ ID NO: 8164497 - DNA, 20 bp, Homo sapiens
ttcatgggagcaaagaggcc

SEQ ID NO: 8164498 - DNA, 20 bp, Homo sapiens
ttcatggtgtatttctttct

SEQ ID NO: 8164499 - DNA, 22 bp, Homo sapiens
ttcatgggtccagagccctggg

SEQ ID NO: 8164500 - DNA, 22 bp, Homo sapiens
ttcatgtaattccataaggtaa

SEQ ID NO: 8164501 - DNA, 22 bp, Homo sapiens
ttcagtgtcacaagagcaagcc

SEQ ID NO: 8164502 - DNA, 22 bp, Homo sapiens
ttcatcatcagaactgttcact

SEQ ID NO: 8164503 - DNA, 22 bp, Homo sapiens
ttcatcatctacaaccaggacc

SEQ ID NO: 8164504 - DNA, 18 bp, Homo sapiens
ttcatcatgactctgtgg

SEQ ID NO: 8164505 - DNA, 22 bp, Homo sapiens
ttcagtgtcaatttttaaatat

SEQ ID NO: 8164506 - DNA, 22 bp, Homo sapiens
ttcagtgtatcttgtcagggag

SEQ ID NO: 8164507 - DNA, 22 bp, Homo sapiens
ttcagtgtacagtgaagggatt

SEQ ID NO: 8164508 - DNA, 22 bp, Homo sapiens
ttcagtgtacagtgaagggatt

SEQ ID NO: 8164509 - DNA, 22 bp, Homo sapiens
ttcagtgtatattttttgagta

SEQ ID NO: 8164510 - DNA, 22 bp, Homo sapiens
ttcagtgcttacaggtttcttt

SEQ ID NO: 8164511 - DNA, 22 bp, Homo sapiens
ttcagtgcttacaggtttcttt

SEQ ID NO: 8164512 - DNA, 22 bp, Homo sapiens
ttcagtgctaaaaagtctcaag

SEQ ID NO: 8164513 - DNA, 22 bp, Homo sapiens
ttcagtgctaaaaagtctcaag

SEQ ID NO: 8164514 - DNA, 22 bp, Homo sapiens
ttcagtgcctgtccacagcttc

SEQ ID NO: 8164515 - DNA, 22 bp, Homo sapiens
ttcagtgcctgtccacagcttc

SEQ ID NO: 8164516 - DNA, 22 bp, Homo sapiens
ttcagtgcctgtccacagcttc

SEQ ID NO: 8164517 - DNA, 22 bp, Homo sapiens
ttcagtgccgtgctgggtcgct

SEQ ID NO: 8164518 - DNA, 22 bp, Homo sapiens
ttcagtgccgtgctgggtcgct

SEQ ID NO: 8164519 - DNA, 22 bp, Homo sapiens
ttcagtgacatcatactggtat

SEQ ID NO: 8164520 - DNA, 22 bp, Homo sapiens
ttcagtgcacagtactgagact

SEQ ID NO: 8164521 - DNA, 22 bp, Homo sapiens
ttcagtgacttacctggagcca

SEQ ID NO: 8164522 - DNA, 22 bp, Homo sapiens
ttcagtgcagtcggaactactg

SEQ ID NO: 8164523 - DNA, 22 bp, Homo sapiens
ttcagtgcagtcggaactactg

SEQ ID NO: 8164524 - DNA, 22 bp, Homo sapiens
ttcagtgcagacgccgaagccc

SEQ ID NO: 8164525 - DNA, 22 bp, Homo sapiens
ttcagtgcacagtactgagact

SEQ ID NO: 8164526 - DNA, 22 bp, Homo sapiens
ttcagtgcagacgccgaagccc

SEQ ID NO: 8164527 - DNA, 22 bp, Homo sapiens
ttcagtgcacagtactgagact

SEQ ID NO: 8164528 - DNA, 19 bp, Homo sapiens
ttcatgcccaatttgctac

SEQ ID NO: 8164529 - DNA, 19 bp, Homo sapiens
ttcatgcccaatttgctac

SEQ ID NO: 8164530 - DNA, 22 bp, Homo sapiens
ttcatggatcatgccttttgtg

SEQ ID NO: 8164531 - DNA, 22 bp, Homo sapiens
ttcatggatcatgccttttgtg

SEQ ID NO: 8164532 - DNA, 22 bp, Homo sapiens
ttcatcattacagtcatgttat

SEQ ID NO: 8164533 - DNA, 22 bp, Homo sapiens
ttcatcattacagtcatgttat

SEQ ID NO: 8164534 - DNA, 22 bp, Homo sapiens
ttcatcatgatgttcccctcta

SEQ ID NO: 8164535 - DNA, 22 bp, Homo sapiens
ttcatcattgccagtctttaaa

SEQ ID NO: 8164536 - DNA, 22 bp, Homo sapiens
ttcatcattgccagtctttaaa

SEQ ID NO: 8164537 - DNA, 21 bp, Homo sapiens
ttcatcattggtaaaaagtgg

SEQ ID NO: 8164538 - DNA, 22 bp, Homo sapiens
ttcatgatagtattttttgtga

SEQ ID NO: 8164539 - DNA, 22 bp, Homo sapiens
ttcatgcactatttcttctagc

SEQ ID NO: 8164540 - DNA, 22 bp, Homo sapiens
ttcacagtggctgtgccatttg

SEQ ID NO: 8164541 - DNA, 22 bp, Homo sapiens
ttcacagtggctgacaggctgg

SEQ ID NO: 8164542 - DNA, 22 bp, Homo sapiens
ttcacagtggctaagttctgca

SEQ ID NO: 8164543 - DNA, 22 bp, Homo sapiens
ttcacattagtggttctatata

SEQ ID NO: 8164544 - DNA, 22 bp, Homo sapiens
ttcacagtgctgcacctggctt

SEQ ID NO: 8164545 - DNA, 22 bp, Homo sapiens
ttcacagtggctaagttctgca

SEQ ID NO: 8164546 - DNA, 19 bp, Homo sapiens
ttcacattggaagaagtag

SEQ ID NO: 8164547 - DNA, 22 bp, Homo sapiens
ttcacattataatcagttctgc

SEQ ID NO: 8164548 - DNA, 22 bp, Homo sapiens
ttcacattataatcagttctgc

SEQ ID NO: 8164549 - DNA, 22 bp, Homo sapiens
ttcacattatcaggattgtttc

SEQ ID NO: 8164550 - DNA, 22 bp, Homo sapiens
ttcacattccgcggctattttc

SEQ ID NO: 8164551 - DNA, 20 bp, Homo sapiens
ttcagggctttggggacacc

SEQ ID NO: 8164552 - DNA, 22 bp, Homo sapiens
ttcagggttacagttggctctg

SEQ ID NO: 8164553 - DNA, 22 bp, Homo sapiens
ttcaggtagtttaactgttcca

SEQ ID NO: 8164554 - DNA, 22 bp, Homo sapiens
ttcaggtagacgcagcagaaca

SEQ ID NO: 8164555 - DNA, 21 bp, Homo sapiens
ttcaggtgagatcatgttgac

SEQ ID NO: 8164556 - DNA, 22 bp, Homo sapiens
ttcaggtgggccttttgagcat

SEQ ID NO: 8164557 - DNA, 22 bp, Homo sapiens
ttcaggtgtggccagaggagaa

SEQ ID NO: 8164558 - DNA, 22 bp, Homo sapiens
ttcaggtgtggccagaggagaa

SEQ ID NO: 8164559 - DNA, 22 bp, Homo sapiens
ttcagtatgtagaacaagtgtt

SEQ ID NO: 8164560 - DNA, 22 bp, Homo sapiens
ttcagtccatcaggcgtggcat

SEQ ID NO: 8164561 - DNA, 22 bp, Homo sapiens
ttcagtcagtgactaagcagtt

SEQ ID NO: 8164562 - DNA, 22 bp, Homo sapiens
ttcagtcagtgactaagcagtt

SEQ ID NO: 8164563 - DNA, 22 bp, Homo sapiens
ttcagtctcaagtgctgctcac

SEQ ID NO: 8164564 - DNA, 22 bp, Homo sapiens
ttcaacaacttggttcaaatgg

SEQ ID NO: 8164565 - DNA, 22 bp, Homo sapiens
ttcaacaatgaaagctaaggaa

SEQ ID NO: 8164566 - DNA, 22 bp, Homo sapiens
ttcaacaagtagtacacacagt

SEQ ID NO: 8164567 - DNA, 22 bp, Homo sapiens
ttcaacaagtagtacacacagt

SEQ ID NO: 8164568 - DNA, 22 bp, Homo sapiens
ttcaacaagtagtacacacagt

SEQ ID NO: 8164569 - DNA, 21 bp, Homo sapiens
ttcaacaaagggaataagttt

SEQ ID NO: 8164570 - DNA, 22 bp, Homo sapiens
ttcaacaaactgttcacgaatg

SEQ ID NO: 8164571 - DNA, 22 bp, Homo sapiens
ttcaaaggagacagagggaagg

SEQ ID NO: 8164572 - DNA, 17 bp, Homo sapiens
ttcaaagcttatcaagg

SEQ ID NO: 8164573 - DNA, 22 bp, Homo sapiens
ttagagtgtagcaggaagaggc

SEQ ID NO: 8164574 - DNA, 21 bp, Homo sapiens
ttagagtagagaacatgatcc

SEQ ID NO: 8164575 - DNA, 22 bp, Homo sapiens
ttagagtcaagctgcatgttct

SEQ ID NO: 8164576 - DNA, 22 bp, Homo sapiens
ttagagtgtagcaggaagaggc

SEQ ID NO: 8164577 - DNA, 22 bp, Homo sapiens
ttagagtcaaaatggcatgtta

SEQ ID NO: 8164578 - DNA, 22 bp, Homo sapiens
ttagagtagagccatttctgtt

SEQ ID NO: 8164579 - DNA, 22 bp, Homo sapiens
ttcaacacaggaacatgatata

SEQ ID NO: 8164580 - DNA, 22 bp, Homo sapiens
ttcaacccaagttctccatttt

SEQ ID NO: 8164581 - DNA, 22 bp, Homo sapiens
ttcaacgagtatttactgagtc

SEQ ID NO: 8164582 - DNA, 22 bp, Homo sapiens
ttcaactttggagatttaataa

SEQ ID NO: 8164583 - DNA, 22 bp, Homo sapiens
ttcaactttatgcatatgtatt

SEQ ID NO: 8164584 - DNA, 22 bp, Homo sapiens
ttcaactttatgcatatgtatt

SEQ ID NO: 8164585 - DNA, 22 bp, Homo sapiens
ttcaactcttcaagatcacatc

SEQ ID NO: 8164586 - DNA, 22 bp, Homo sapiens
ttcacaagtgtgaaggcagagc

SEQ ID NO: 8164587 - DNA, 22 bp, Homo sapiens
ttcacaagtcattagctgcata

SEQ ID NO: 8164588 - DNA, 18 bp, Homo sapiens
ttcacaagggcttggttt

SEQ ID NO: 8164589 - DNA, 19 bp, Homo sapiens
ttcacaagtgatgtctctc

SEQ ID NO: 8164590 - DNA, 22 bp, Homo sapiens
ttcacaagtcattagctgcata

SEQ ID NO: 8164591 - DNA, 22 bp, Homo sapiens
ttcacaaagctggagcatttcc

SEQ ID NO: 8164592 - DNA, 21 bp, Homo sapiens
ttcacaacctgctttagtggg

SEQ ID NO: 8164593 - DNA, 22 bp, Homo sapiens
ttcacaaagctggagcatttcc

SEQ ID NO: 8164594 - DNA, 22 bp, Homo sapiens
ttcacaaagctggagcatttcc

SEQ ID NO: 8164595 - DNA, 22 bp, Homo sapiens
ttcacagtgctcacagttcagt

SEQ ID NO: 8164596 - DNA, 22 bp, Homo sapiens
ttcacagtgctcacagttcagt

SEQ ID NO: 8164597 - DNA, 22 bp, Homo sapiens
ttcacagtgagctatgtcttgt

SEQ ID NO: 8164598 - DNA, 22 bp, Homo sapiens
ttcacagtctatcttggttttt

SEQ ID NO: 8164599 - DNA, 22 bp, Homo sapiens
ttcacagtcacccttctccatg

SEQ ID NO: 8164600 - DNA, 22 bp, Homo sapiens
ttcacagtcacccttctccatg

SEQ ID NO: 8164601 - DNA, 22 bp, Homo sapiens
ttcacagtataggtttccagcg

SEQ ID NO: 8164602 - DNA, 22 bp, Homo sapiens
ttcacagtataggtttccagcg

SEQ ID NO: 8164603 - DNA, 22 bp, Homo sapiens
ttcacaggttgaagcctaatcc

SEQ ID NO: 8164604 - DNA, 22 bp, Homo sapiens
ttcacagtaagtaggatagttg

SEQ ID NO: 8164605 - DNA, 22 bp, Homo sapiens
ttcacagtaatgtgcccaggta

SEQ ID NO: 8164606 - DNA, 22 bp, Homo sapiens
ttcaatgcatatagatatagaa

SEQ ID NO: 8164607 - DNA, 22 bp, Homo sapiens
ttcaatgtctatgtacatttta

SEQ ID NO: 8164608 - DNA, 22 bp, Homo sapiens
ttcaagaaagagtggctattcc

SEQ ID NO: 8164609 - DNA, 22 bp, Homo sapiens
ttcaactttggagatttaataa

SEQ ID NO: 8164610 - DNA, 22 bp, Homo sapiens
ttcaagaagcccaaagactagc

SEQ ID NO: 8164611 - DNA, 22 bp, Homo sapiens
ttcaattatccctgcaactgag

SEQ ID NO: 8164612 - DNA, 22 bp, Homo sapiens
ttcaatttagtgatgttgttgg

SEQ ID NO: 8164613 - DNA, 22 bp, Homo sapiens
ttcaatttagtgatgttgttgg

SEQ ID NO: 8164614 - DNA, 22 bp, Homo sapiens
ttcaatttgtgctaaggcaccg

SEQ ID NO: 8164615 - DNA, 22 bp, Homo sapiens
ttcaattttgcagaggaatgca

SEQ ID NO: 8164616 - DNA, 22 bp, Homo sapiens
ttcaattttgcagaggaatgca

SEQ ID NO: 8164617 - DNA, 22 bp, Homo sapiens
ttcacaaaaatgctgaacagtt

SEQ ID NO: 8164618 - DNA, 22 bp, Homo sapiens
ttcaatttcataatatctagct

SEQ ID NO: 8164619 - DNA, 22 bp, Homo sapiens
ttcaatttcataatatctagct

SEQ ID NO: 8164620 - DNA, 22 bp, Homo sapiens
ttcaatttcataatatctagct

SEQ ID NO: 8164621 - DNA, 22 bp, Homo sapiens
ttcacaaaaatgctgaacagtt

SEQ ID NO: 8164622 - DNA, 22 bp, Homo sapiens
ttcacaaaatggtttgttgatg

SEQ ID NO: 8164623 - DNA, 22 bp, Homo sapiens
ttcacaaaatggtttgttgatg

SEQ ID NO: 8164624 - DNA, 22 bp, Homo sapiens
ttctagatagagtgcaaattat

SEQ ID NO: 8164625 - DNA, 22 bp, Homo sapiens
ttctagatagagtgcaaattat

SEQ ID NO: 8164626 - DNA, 22 bp, Homo sapiens
ttctagattgacagagagcaca

SEQ ID NO: 8164627 - DNA, 22 bp, Homo sapiens
ttctaggggagaggaagaagtg

SEQ ID NO: 8164628 - DNA, 22 bp, Homo sapiens
ttctagcagagggcatctgctg

SEQ ID NO: 8164629 - DNA, 22 bp, Homo sapiens
ttctagctgttgctgtttatag

SEQ ID NO: 8164630 - DNA, 22 bp, Homo sapiens
ttctaggcctggcttgggccca

SEQ ID NO: 8164631 - DNA, 22 bp, Homo sapiens
ttctaggaccctgcgtgagaac

SEQ ID NO: 8164632 - DNA, 22 bp, Homo sapiens
ttctagaagaactagccaggaa

SEQ ID NO: 8164633 - DNA, 19 bp, Homo sapiens
ttctagaactgttctctca

SEQ ID NO: 8164634 - DNA, 19 bp, Homo sapiens
ttctagaactgttctctca

SEQ ID NO: 8164635 - DNA, 22 bp, Homo sapiens
ttctagaaggcaggctgggcca

SEQ ID NO: 8164636 - DNA, 22 bp, Homo sapiens
ttctagaagtgtctatgtctgt

SEQ ID NO: 8164637 - DNA, 22 bp, Homo sapiens
ttctagaatgatatgaggtact

SEQ ID NO: 8164638 - DNA, 22 bp, Homo sapiens
ttctagaatgatatgaggtact

SEQ ID NO: 8164639 - DNA, 22 bp, Homo sapiens
ttctaatagctgcctatgtatt

SEQ ID NO: 8164640 - DNA, 22 bp, Homo sapiens
ttctaatgaaatctgtacagta

SEQ ID NO: 8164641 - DNA, 22 bp, Homo sapiens
ttctaatgaaagtggaccatgg

SEQ ID NO: 8164642 - DNA, 22 bp, Homo sapiens
ttctaatacacggtatgacttt

SEQ ID NO: 8164643 - DNA, 22 bp, Homo sapiens
ttctaagtttctcagtttcagt

SEQ ID NO: 8164644 - DNA, 20 bp, Homo sapiens
ttctaatttgatggagtagc

SEQ ID NO: 8164645 - DNA, 20 bp, Homo sapiens
ttctaatttgatggagtagc

SEQ ID NO: 8164646 - DNA, 22 bp, Homo sapiens
ttctaattgtgtttgcatatct

SEQ ID NO: 8164647 - DNA, 22 bp, Homo sapiens
ttctaattgtgtttgcatatct

SEQ ID NO: 8164648 - DNA, 22 bp, Homo sapiens
ttctaatgatttcattcaaagc

SEQ ID NO: 8164649 - DNA, 19 bp, Homo sapiens
ttctaatgttacattttgg

SEQ ID NO: 8164650 - DNA, 22 bp, Homo sapiens
ttctaattaaatctacgctagg

SEQ ID NO: 8164651 - DNA, 22 bp, Homo sapiens
ttctaattattcccttgtccca

SEQ ID NO: 8164652 - DNA, 21 bp, Homo sapiens
ttctagaaaagtatgggactg

SEQ ID NO: 8164653 - DNA, 21 bp, Homo sapiens
ttctagaaaagtatgggactg

SEQ ID NO: 8164654 - DNA, 22 bp, Homo sapiens
ttctacttctgacactgtttgt

SEQ ID NO: 8164655 - DNA, 19 bp, Homo sapiens
ttctactttgtttccccct

SEQ ID NO: 8164656 - DNA, 22 bp, Homo sapiens
ttctacaatatgaataatgaag

SEQ ID NO: 8164657 - DNA, 22 bp, Homo sapiens
ttctacaatatgaataatgaag

SEQ ID NO: 8164658 - DNA, 22 bp, Homo sapiens
ttctacaaatatttactgttcc

SEQ ID NO: 8164659 - DNA, 20 bp, Homo sapiens
ttctacaaaactgattctga

SEQ ID NO: 8164660 - DNA, 22 bp, Homo sapiens
ttctacaaatatttactgttcc

SEQ ID NO: 8164661 - DNA, 22 bp, Homo sapiens
ttcctgaagtcaaagatctaaa

SEQ ID NO: 8164662 - DNA, 22 bp, Homo sapiens
ttcctgaagtcaaagatctaaa

SEQ ID NO: 8164663 - DNA, 22 bp, Homo sapiens
ttcctgaacatttctaagttga

SEQ ID NO: 8164664 - DNA, 22 bp, Homo sapiens
ttcctgaagtcaaagatctaaa

SEQ ID NO: 8164665 - DNA, 22 bp, Homo sapiens
ttcctgaacatttctaagttga

SEQ ID NO: 8164666 - DNA, 22 bp, Homo sapiens
ttcctgtccgcaatggcctggg

SEQ ID NO: 8164667 - DNA, 20 bp, Homo sapiens
ttcctgtcctctctttcagg

SEQ ID NO: 8164668 - DNA, 20 bp, Homo sapiens
ttcctgtcctctctttcagg

SEQ ID NO: 8164669 - DNA, 22 bp, Homo sapiens
ttcctctttgcatcctcaactc

SEQ ID NO: 8164670 - DNA, 22 bp, Homo sapiens
ttcctctttctctgtgctatgt

SEQ ID NO: 8164671 - DNA, 22 bp, Homo sapiens
ttcctgaaaatacagggagacc

SEQ ID NO: 8164672 - DNA, 22 bp, Homo sapiens
ttcctgaaaatacagggagaga

SEQ ID NO: 8164673 - DNA, 22 bp, Homo sapiens
ttcctctttagggctggccagg

SEQ ID NO: 8164674 - DNA, 22 bp, Homo sapiens
ttcctcttccatcttcccaggg

SEQ ID NO: 8164675 - DNA, 22 bp, Homo sapiens
ttcctgtgaagccggtggtctc

SEQ ID NO: 8164676 - DNA, 19 bp, Homo sapiens
ttcctgtgctgctgtgtcc

SEQ ID NO: 8164677 - DNA, 22 bp, Homo sapiens
ttcctgtggccttacatctgtg

SEQ ID NO: 8164678 - DNA, 22 bp, Homo sapiens
ttcctgtgcttaattctcactg

SEQ ID NO: 8164679 - DNA, 22 bp, Homo sapiens
ttcctgtgcttattcttctctg

SEQ ID NO: 8164680 - DNA, 22 bp, Homo sapiens
ttcctgtgcttattcttctctg

SEQ ID NO: 8164681 - DNA, 22 bp, Homo sapiens
ttcctgtggctgtcactcctgg

SEQ ID NO: 8164682 - DNA, 22 bp, Homo sapiens
ttcctgtggtccagagtcatcc

SEQ ID NO: 8164683 - DNA, 22 bp, Homo sapiens
ttcctgtgtgaccgagacagtg

SEQ ID NO: 8164684 - DNA, 22 bp, Homo sapiens
ttccttctcagccctcgaggat

SEQ ID NO: 8164685 - DNA, 22 bp, Homo sapiens
ttccttctcagccctcgaggat

SEQ ID NO: 8164686 - DNA, 22 bp, Homo sapiens
ttccttctattcagctccaaga

SEQ ID NO: 8164687 - DNA, 22 bp, Homo sapiens
ttccttctattcagctccaaga

SEQ ID NO: 8164688 - DNA, 22 bp, Homo sapiens
ttccttctattcagctccaaga

SEQ ID NO: 8164689 - DNA, 22 bp, Homo sapiens
ttccttctattcagctccaaga

SEQ ID NO: 8164690 - DNA, 22 bp, Homo sapiens
ttccttctagcccaagtattgg

SEQ ID NO: 8164691 - DNA, 22 bp, Homo sapiens
ttccttctagagcttgtttagg

SEQ ID NO: 8164692 - DNA, 22 bp, Homo sapiens
ttccttctagcccaagtattgg

SEQ ID NO: 8164693 - DNA, 22 bp, Homo sapiens
ttccttctagcccaagtattgg

SEQ ID NO: 8164694 - DNA, 22 bp, Homo sapiens
ttccttctccagaacttctagg

SEQ ID NO: 8164695 - DNA, 22 bp, Homo sapiens
ttccttctctgtggggaaggca

SEQ ID NO: 8164696 - DNA, 22 bp, Homo sapiens
ttccttctctgtggggaaggca

SEQ ID NO: 8164697 - DNA, 22 bp, Homo sapiens
ttccttctccagaacttctagg

SEQ ID NO: 8164698 - DNA, 22 bp, Homo sapiens
ttccttctccagaacttctagg

SEQ ID NO: 8164699 - DNA, 22 bp, Homo sapiens
ttccttctccagaacttctagg

SEQ ID NO: 8164700 - DNA, 22 bp, Homo sapiens
ttccttctccagaacttctagg

SEQ ID NO: 8164701 - DNA, 22 bp, Homo sapiens
ttccttctccagaacttctagg

SEQ ID NO: 8164702 - DNA, 22 bp, Homo sapiens
ttccttctcagccctcgaggat

SEQ ID NO: 8164703 - DNA, 22 bp, Homo sapiens
ttccttctcagccctcgaggat

SEQ ID NO: 8164704 - DNA, 22 bp, Homo sapiens
ttccttctctgtggggaaggca

SEQ ID NO: 8164705 - DNA, 22 bp, Homo sapiens
ttccttctgaagcctttgtgtt

SEQ ID NO: 8164706 - DNA, 22 bp, Homo sapiens
ttccttctgaagcctttgtgtt

SEQ ID NO: 8164707 - DNA, 22 bp, Homo sapiens
ttccttctgaagcctttgtgtt

SEQ ID NO: 8164708 - DNA, 22 bp, Homo sapiens
ttccttctctgtggggaaggca

SEQ ID NO: 8164709 - DNA, 22 bp, Homo sapiens
ttccttctgaagcctttgtgtt

SEQ ID NO: 8164710 - DNA, 22 bp, Homo sapiens
ttccttctgaagcctttgtgtt

SEQ ID NO: 8164711 - DNA, 18 bp, Homo sapiens
ttccttctgatgtatatg

SEQ ID NO: 8164712 - DNA, 18 bp, Homo sapiens
ttccttctgatgtatatg

SEQ ID NO: 8164713 - DNA, 22 bp, Homo sapiens
ttccttaatgaatcaggccatt

SEQ ID NO: 8164714 - DNA, 22 bp, Homo sapiens
ttccttagagtttccagaaagc

SEQ ID NO: 8164715 - DNA, 22 bp, Homo sapiens
ttccttaggctgtttgcagtgc

SEQ ID NO: 8164716 - DNA, 22 bp, Homo sapiens
ttccttagatccttcaatcacg

SEQ ID NO: 8164717 - DNA, 22 bp, Homo sapiens
ttccttagtgttagattctgtg

SEQ ID NO: 8164718 - DNA, 22 bp, Homo sapiens
ttccttagttgactgtcttagt

SEQ ID NO: 8164719 - DNA, 22 bp, Homo sapiens
ttccttagtgttagattctgtg

SEQ ID NO: 8164720 - DNA, 22 bp, Homo sapiens
ttccttctagagcttgtttagg

SEQ ID NO: 8164721 - DNA, 22 bp, Homo sapiens
ttccttctagagcttgtttagg

SEQ ID NO: 8164722 - DNA, 22 bp, Homo sapiens
ttccttctagcccaagtattgg

SEQ ID NO: 8164723 - DNA, 22 bp, Homo sapiens
ttccttctagagcttgtttagg

SEQ ID NO: 8164724 - DNA, 22 bp, Homo sapiens
ttccttcaaacgcctcctgcac

SEQ ID NO: 8164725 - DNA, 22 bp, Homo sapiens
ttccacaattcagattgttgcc

SEQ ID NO: 8164726 - DNA, 23 bp, Homo sapiens
ttccacaatgaaaataaagcagg

SEQ ID NO: 8164727 - DNA, 22 bp, Homo sapiens
ttccacaatgccaggggcatca

SEQ ID NO: 8164728 - DNA, 22 bp, Homo sapiens
ttccacaaatacactccacatt

SEQ ID NO: 8164729 - DNA, 22 bp, Homo sapiens
ttccacaaacacatcctgagca

SEQ ID NO: 8164730 - DNA, 22 bp, Homo sapiens
ttccacaaatcaattctgctga

SEQ ID NO: 8164731 - DNA, 22 bp, Homo sapiens
ttccacaaatcaattctgctga

SEQ ID NO: 8164732 - DNA, 22 bp, Homo sapiens
ttccacaacaaccaagcatata

SEQ ID NO: 8164733 - DNA, 22 bp, Homo sapiens
ttccacaagatgtttcttagaa

SEQ ID NO: 8164734 - DNA, 22 bp, Homo sapiens
ttccacaagtgatatctagctg

SEQ ID NO: 8164735 - DNA, 21 bp, Homo sapiens
ttccacagtgagaactgcaag

SEQ ID NO: 8164736 - DNA, 21 bp, Homo sapiens
ttccacagtgagaactgcaag

SEQ ID NO: 8164737 - DNA, 22 bp, Homo sapiens
ttccacattccttacattcata

SEQ ID NO: 8164738 - DNA, 22 bp, Homo sapiens
ttccagaaatctttcagctcaa

SEQ ID NO: 8164739 - DNA, 22 bp, Homo sapiens
ttccagaactcaagaaatgccc

SEQ ID NO: 8164740 - DNA, 22 bp, Homo sapiens
ttccagaaccttcctgctggaa

SEQ ID NO: 8164741 - DNA, 22 bp, Homo sapiens
ttccagaacaatgtggacgtat

SEQ ID NO: 8164742 - DNA, 21 bp, Homo sapiens
ttccacagtgagaactgcaag

SEQ ID NO: 8164743 - DNA, 22 bp, Homo sapiens
ttccacagcccaagctggtggc

SEQ ID NO: 8164744 - DNA, 20 bp, Homo sapiens
ttccagagatctgcatttta

SEQ ID NO: 8164745 - DNA, 20 bp, Homo sapiens
ttccagagatctgcatttta

SEQ ID NO: 8164746 - DNA, 22 bp, Homo sapiens
ttccagagaggctcatgttccc

SEQ ID NO: 8164747 - DNA, 22 bp, Homo sapiens
ttccagagaggctcatgttccc

SEQ ID NO: 8164748 - DNA, 22 bp, Homo sapiens
ttccagagagttattcccctgg

SEQ ID NO: 8164749 - DNA, 22 bp, Homo sapiens
ttccagagcctagaatcttgat

SEQ ID NO: 8164750 - DNA, 22 bp, Homo sapiens
ttccagagcagttttcagatca

SEQ ID NO: 8164751 - DNA, 22 bp, Homo sapiens
ttccagagcagttttcagatca

SEQ ID NO: 8164752 - DNA, 21 bp, Homo sapiens
ttccagagattgtttcacctg

SEQ ID NO: 8164753 - DNA, 22 bp, Homo sapiens
ttccagaattgggagccttgag

SEQ ID NO: 8164754 - DNA, 22 bp, Homo sapiens
ttccagaattttgttctgcttg

SEQ ID NO: 8164755 - DNA, 22 bp, Homo sapiens
ttccagagagagaaaatttgat

SEQ ID NO: 8164756 - DNA, 22 bp, Homo sapiens
ttccagaacttttgttaatttc

SEQ ID NO: 8164757 - DNA, 22 bp, Homo sapiens
ttccagaagatggcagcaaagg

SEQ ID NO: 8164758 - DNA, 22 bp, Homo sapiens
ttccagaatagatggagctcta

SEQ ID NO: 8164759 - DNA, 22 bp, Homo sapiens
ttccagaaggaagccggggagc

SEQ ID NO: 8164760 - DNA, 22 bp, Homo sapiens
ttccagaagcctccatattact

SEQ ID NO: 8164761 - DNA, 22 bp, Homo sapiens
ttccctggccctggcacgctct

SEQ ID NO: 8164762 - DNA, 22 bp, Homo sapiens
ttcctaacaagtctatctttga

SEQ ID NO: 8164763 - DNA, 22 bp, Homo sapiens
ttcctaacaaggggtattcatc

SEQ ID NO: 8164764 - DNA, 20 bp, Homo sapiens
ttccctggaaggagaagcag

SEQ ID NO: 8164765 - DNA, 20 bp, Homo sapiens
ttccctggaaggagaagcag

SEQ ID NO: 8164766 - DNA, 22 bp, Homo sapiens
ttcctaacacagtgtaagcaag

SEQ ID NO: 8164767 - DNA, 22 bp, Homo sapiens
ttcctaacgccagtattttcat

SEQ ID NO: 8164768 - DNA, 22 bp, Homo sapiens
ttcctaacctctagctgcatat

SEQ ID NO: 8164769 - DNA, 22 bp, Homo sapiens
ttcctaactctggcacctagtc

SEQ ID NO: 8164770 - DNA, 22 bp, Homo sapiens
ttcctaactggcctttatggat

SEQ ID NO: 8164771 - DNA, 22 bp, Homo sapiens
ttcctcagctgtttgggctcat

SEQ ID NO: 8164772 - DNA, 22 bp, Homo sapiens
ttcctcagctgtgtcctggcga

SEQ ID NO: 8164773 - DNA, 22 bp, Homo sapiens
ttcctcagctggcctgattggg

SEQ ID NO: 8164774 - DNA, 20 bp, Homo sapiens
ttcctcaggagaggatgtta

SEQ ID NO: 8164775 - DNA, 22 bp, Homo sapiens
ttcctcagctttagactatgaa

SEQ ID NO: 8164776 - DNA, 22 bp, Homo sapiens
ttcctcagggcggatgggcagg

SEQ ID NO: 8164777 - DNA, 22 bp, Homo sapiens
ttcctcagggaggctagcagta

SEQ ID NO: 8164778 - DNA, 22 bp, Homo sapiens
ttcctcaggcttccctttgtcc

SEQ ID NO: 8164779 - DNA, 22 bp, Homo sapiens
ttcctcaggcttccctttgtcc

SEQ ID NO: 8164780 - DNA, 22 bp, Homo sapiens
ttcctcagttagtgcctgaggc

SEQ ID NO: 8164781 - DNA, 22 bp, Homo sapiens
ttcctcagttagtgcctgaggc

SEQ ID NO: 8164782 - DNA, 22 bp, Homo sapiens
ttcctcagtgatggattcaacg

SEQ ID NO: 8164783 - DNA, 22 bp, Homo sapiens
ttcctcatggggttccttcaga

SEQ ID NO: 8164784 - DNA, 22 bp, Homo sapiens
ttcctcagttagtgcctgaggc

SEQ ID NO: 8164785 - DNA, 18 bp, Homo sapiens
ttcctccacagagcgctg

SEQ ID NO: 8164786 - DNA, 22 bp, Homo sapiens
ttcctccacgtgacaggagcca

SEQ ID NO: 8164787 - DNA, 22 bp, Homo sapiens
ttcctccagaagctgtagggga

SEQ ID NO: 8164788 - DNA, 22 bp, Homo sapiens
ttcctctgtagttgctgatgaa

SEQ ID NO: 8164789 - DNA, 22 bp, Homo sapiens
ttcctccagcctggagcacttc

SEQ ID NO: 8164790 - DNA, 22 bp, Homo sapiens
ttcctctgtagttgctgatgaa

SEQ ID NO: 8164791 - DNA, 22 bp, Homo sapiens
ttcctctggaggctctaggaga

SEQ ID NO: 8164792 - DNA, 20 bp, Homo sapiens
ttcctcacaagtccctcggc

SEQ ID NO: 8164793 - DNA, 22 bp, Homo sapiens
ttcctcaacaacttccctacag

SEQ ID NO: 8164794 - DNA, 22 bp, Homo sapiens
ttcctatgtgggcagagacaca

SEQ ID NO: 8164795 - DNA, 22 bp, Homo sapiens
ttcctatggctcagttgcattt

SEQ ID NO: 8164796 - DNA, 22 bp, Homo sapiens
ttcctatggctcagttgcattt

SEQ ID NO: 8164797 - DNA, 22 bp, Homo sapiens
ttcctatggtgaacatgaatga

SEQ ID NO: 8164798 - DNA, 22 bp, Homo sapiens
ttcctagggcagagccgctggg

SEQ ID NO: 8164799 - DNA, 22 bp, Homo sapiens
ttcctataagtcacactgttgt

SEQ ID NO: 8164800 - DNA, 22 bp, Homo sapiens
ttcctatactttattgctgtat

SEQ ID NO: 8164801 - DNA, 22 bp, Homo sapiens
ttcctatggccagagtcaaaga

SEQ ID NO: 8164802 - DNA, 22 bp, Homo sapiens
ttcctacatttgtacaataaga

SEQ ID NO: 8164803 - DNA, 22 bp, Homo sapiens
ttcctacaattagagcctcttt

SEQ ID NO: 8164804 - DNA, 22 bp, Homo sapiens
ttcctagctataaagctcttcc

SEQ ID NO: 8164805 - DNA, 18 bp, Homo sapiens
ttcctaggaactaagctt

SEQ ID NO: 8164806 - DNA, 22 bp, Homo sapiens
ttcctagctataaagctcttcc

SEQ ID NO: 8164807 - DNA, 22 bp, Homo sapiens
ttcctagggcagagccgctggg

SEQ ID NO: 8164808 - DNA, 22 bp, Homo sapiens
ttcctaggatggtgaagcagga

SEQ ID NO: 8164809 - DNA, 22 bp, Homo sapiens
ttcctcagagagacagaaacta

SEQ ID NO: 8164810 - DNA, 22 bp, Homo sapiens
ttcctcagaccctcattgtgag

SEQ ID NO: 8164811 - DNA, 22 bp, Homo sapiens
ttcctcagagggcgctggggaa

SEQ ID NO: 8164812 - DNA, 22 bp, Homo sapiens
ttcctcagagggcgctggggaa

SEQ ID NO: 8164813 - DNA, 22 bp, Homo sapiens
ttcctcagagggcgctggggaa

SEQ ID NO: 8164814 - DNA, 22 bp, Homo sapiens
ttcctcagaaaatactgtccaa

SEQ ID NO: 8164815 - DNA, 22 bp, Homo sapiens
ttcctcagaaaatactgtccaa

SEQ ID NO: 8164816 - DNA, 22 bp, Homo sapiens
ttcctcagaaaatactgtccaa

SEQ ID NO: 8164817 - DNA, 22 bp, Homo sapiens
ttcctcagaccctcattgtgag

SEQ ID NO: 8164818 - DNA, 22 bp, Homo sapiens
ttcctcagccaaggctgggatc

SEQ ID NO: 8164819 - DNA, 22 bp, Homo sapiens
ttcctcagcacaaagccaagat

SEQ ID NO: 8164820 - DNA, 22 bp, Homo sapiens
ttcctcagccagcacttagggg

SEQ ID NO: 8164821 - DNA, 22 bp, Homo sapiens
ttcctcagctcagcgagagaga

SEQ ID NO: 8164822 - DNA, 22 bp, Homo sapiens
ttcctcagccagcacttagggg

SEQ ID NO: 8164823 - DNA, 22 bp, Homo sapiens
ttcctcagctggcctgattggg

SEQ ID NO: 8164824 - DNA, 22 bp, Homo sapiens
ttcctcagctggcctgattggg

SEQ ID NO: 8164825 - DNA, 22 bp, Homo sapiens
tttaaaaaactagtctgagtct

SEQ ID NO: 8164826 - DNA, 22 bp, Homo sapiens
tttaaaaaactagtctgagtct

SEQ ID NO: 8164827 - DNA, 22 bp, Homo sapiens
tttaaaagttatcatctgtcca

SEQ ID NO: 8164828 - DNA, 23 bp, Homo sapiens
tttaaaagttgtaatgtaggctt

SEQ ID NO: 8164829 - DNA, 22 bp, Homo sapiens
tttaaaatcagatgggagttgg

SEQ ID NO: 8164830 - DNA, 22 bp, Homo sapiens
tttaaaatcagatgggagttgg

SEQ ID NO: 8164831 - DNA, 23 bp, Homo sapiens
tttaaaagttgtaatgtaggctt

SEQ ID NO: 8164832 - DNA, 22 bp, Homo sapiens
ttgtttttagagaagccctgaa

SEQ ID NO: 8164833 - DNA, 22 bp, Homo sapiens
ttgtttttagagaagccctgaa

SEQ ID NO: 8164834 - DNA, 22 bp, Homo sapiens
ttgtttttaaacatgtgactga

SEQ ID NO: 8164835 - DNA, 22 bp, Homo sapiens
ttgtttttatgaacatccagga

SEQ ID NO: 8164836 - DNA, 22 bp, Homo sapiens
ttgtttttatgaacatccagga

SEQ ID NO: 8164837 - DNA, 22 bp, Homo sapiens
tttaaaatttagacctctccac

SEQ ID NO: 8164838 - DNA, 22 bp, Homo sapiens
tttaaaatcagatgggagttgg

SEQ ID NO: 8164839 - DNA, 22 bp, Homo sapiens
tttaaaatcagatgggagttgg

SEQ ID NO: 8164840 - DNA, 22 bp, Homo sapiens
tttaaaatcagatgggagttgg

SEQ ID NO: 8164841 - DNA, 22 bp, Homo sapiens
tttaaaatcagatgggagttgg

SEQ ID NO: 8164842 - DNA, 22 bp, Homo sapiens
tttaaaatcagatgggagttgg

SEQ ID NO: 8164843 - DNA, 22 bp, Homo sapiens
tttaaaatttagacctctccac

SEQ ID NO: 8164844 - DNA, 22 bp, Homo sapiens
tttaaaatttagacctctccac

SEQ ID NO: 8164845 - DNA, 22 bp, Homo sapiens
tttaaaatttagacctctccac

SEQ ID NO: 8164846 - DNA, 22 bp, Homo sapiens
tttaaaatttagacctctccac

SEQ ID NO: 8164847 - DNA, 22 bp, Homo sapiens
tttaatgttaaatttgtagatg

SEQ ID NO: 8164848 - DNA, 22 bp, Homo sapiens
tttaatgttaaatttgtagatg

SEQ ID NO: 8164849 - DNA, 19 bp, Homo sapiens
tttaatgtgtgctgcaatc

SEQ ID NO: 8164850 - DNA, 22 bp, Homo sapiens
tttaatgtttgagtcagtatat

SEQ ID NO: 8164851 - DNA, 22 bp, Homo sapiens
tttaaacatatctgttgaggga

SEQ ID NO: 8164852 - DNA, 22 bp, Homo sapiens
tttaaacatatctgttgaggga

SEQ ID NO: 8164853 - DNA, 22 bp, Homo sapiens
tttaaacaaataggattgccta

SEQ ID NO: 8164854 - DNA, 22 bp, Homo sapiens
tttaattatgttaagccactga

SEQ ID NO: 8164855 - DNA, 22 bp, Homo sapiens
tttaattatgttaagccactga

SEQ ID NO: 8164856 - DNA, 22 bp, Homo sapiens
tttaattgattcacagtctgta

SEQ ID NO: 8164857 - DNA, 22 bp, Homo sapiens
tttaattgattcacagtctgta

SEQ ID NO: 8164858 - DNA, 22 bp, Homo sapiens
tttaattatatctgggcagtta

SEQ ID NO: 8164859 - DNA, 22 bp, Homo sapiens
tttaattagcaagccagagagc

SEQ ID NO: 8164860 - DNA, 22 bp, Homo sapiens
tttaatgtttgagtcagtatat

SEQ ID NO: 8164861 - DNA, 22 bp, Homo sapiens
tttaatttgaaatgagtaaccc

SEQ ID NO: 8164862 - DNA, 22 bp, Homo sapiens
tttaatttgaaatgagtaaccc

SEQ ID NO: 8164863 - DNA, 22 bp, Homo sapiens
tttaattgttgtgggtacatag

SEQ ID NO: 8164864 - DNA, 22 bp, Homo sapiens
tttaattgcatttaaagatgga

SEQ ID NO: 8164865 - DNA, 22 bp, Homo sapiens
tttaattgcatttaaagatgga

SEQ ID NO: 8164866 - DNA, 22 bp, Homo sapiens
tttaatttgtatttctagaggg

SEQ ID NO: 8164867 - DNA, 22 bp, Homo sapiens
tttaatttgtatttctagaggg

SEQ ID NO: 8164868 - DNA, 22 bp, Homo sapiens
tttaatttgtatttctagaggg

SEQ ID NO: 8164869 - DNA, 21 bp, Homo sapiens
tttaatttgcatgtatgacgc

SEQ ID NO: 8164870 - DNA, 21 bp, Homo sapiens
tttaatttgcatgtatgacgc

SEQ ID NO: 8164871 - DNA, 22 bp, Homo sapiens
tttaattttcctcttcctggag

SEQ ID NO: 8164872 - DNA, 22 bp, Homo sapiens
tttaattttcctcttcctggag

SEQ ID NO: 8164873 - DNA, 22 bp, Homo sapiens
tttaattttcctcttcctggag

SEQ ID NO: 8164874 - DNA, 22 bp, Homo sapiens
tttaattttcctggtaggcctg

SEQ ID NO: 8164875 - DNA, 22 bp, Homo sapiens
tttaattttctgggcccagcag

SEQ ID NO: 8164876 - DNA, 22 bp, Homo sapiens
tttacaacctcatattctgatg

SEQ ID NO: 8164877 - DNA, 22 bp, Homo sapiens
tttacaaggcagaactgattaa

SEQ ID NO: 8164878 - DNA, 22 bp, Homo sapiens
tttacaaggcagttattttcct

SEQ ID NO: 8164879 - DNA, 22 bp, Homo sapiens
tttacaaggcagaactgattaa

SEQ ID NO: 8164880 - DNA, 22 bp, Homo sapiens
tttacaaggcagaactgattaa

SEQ ID NO: 8164881 - DNA, 22 bp, Homo sapiens
tttaccagtgttaaacaccagc

SEQ ID NO: 8164882 - DNA, 22 bp, Homo sapiens
tttaccaggagtcagaaggact

SEQ ID NO: 8164883 - DNA, 22 bp, Homo sapiens
tttacaaggcagttattttcct

SEQ ID NO: 8164884 - DNA, 22 bp, Homo sapiens
tttaccagaattgccaccagaa

SEQ ID NO: 8164885 - DNA, 22 bp, Homo sapiens
tttacaagtacacctaacagct

SEQ ID NO: 8164886 - DNA, 22 bp, Homo sapiens
tttacaacctcatattctgatg

SEQ ID NO: 8164887 - DNA, 22 bp, Homo sapiens
tttacaacgttcctggtgctaa

SEQ ID NO: 8164888 - DNA, 22 bp, Homo sapiens
tttacaacctcatattctgatg

SEQ ID NO: 8164889 - DNA, 22 bp, Homo sapiens
tttacaagaaatcatgatgcta

SEQ ID NO: 8164890 - DNA, 22 bp, Homo sapiens
tttacaaggatcaagggatctc

SEQ ID NO: 8164891 - DNA, 22 bp, Homo sapiens
tttacaaggatcaagggatctc

SEQ ID NO: 8164892 - DNA, 22 bp, Homo sapiens
tttacaaggcagaactgattaa

SEQ ID NO: 8164893 - DNA, 22 bp, Homo sapiens
tttactaacaccatacatgctg

SEQ ID NO: 8164894 - DNA, 22 bp, Homo sapiens
tttactaagcccagttatatgc

SEQ ID NO: 8164895 - DNA, 22 bp, Homo sapiens
tttactaagcccagttatatgc

SEQ ID NO: 8164896 - DNA, 22 bp, Homo sapiens
tttactaacaccatacatgctg

SEQ ID NO: 8164897 - DNA, 22 bp, Homo sapiens
tttactaacaccatacatgctg

SEQ ID NO: 8164898 - DNA, 22 bp, Homo sapiens
tttactaacaccatacatgctg

SEQ ID NO: 8164899 - DNA, 22 bp, Homo sapiens
tttactaagcccagttatatgc

SEQ ID NO: 8164900 - DNA, 22 bp, Homo sapiens
tttactacttcattgacttacg

SEQ ID NO: 8164901 - DNA, 22 bp, Homo sapiens
tttaccatacatcaaaatattt

SEQ ID NO: 8164902 - DNA, 22 bp, Homo sapiens
tttacgagtgctaatgatattg

SEQ ID NO: 8164903 - DNA, 22 bp, Homo sapiens
tttacgagtgtgattaaggtaa

SEQ ID NO: 8164904 - DNA, 19 bp, Homo sapiens
tttaccttcttgagagcag

SEQ ID NO: 8164905 - DNA, 22 bp, Homo sapiens
tttagaaattcatctatggcct

SEQ ID NO: 8164906 - DNA, 22 bp, Homo sapiens
tttacttttggtaaggtcattt

SEQ ID NO: 8164907 - DNA, 22 bp, Homo sapiens
tttacttttggtaaggtcattt

SEQ ID NO: 8164908 - DNA, 22 bp, Homo sapiens
tttacttttggtaaggtcattt

SEQ ID NO: 8164909 - DNA, 22 bp, Homo sapiens
tttagttattgttacagtatga

SEQ ID NO: 8164910 - DNA, 22 bp, Homo sapiens
tttagttattgcacagaattag

SEQ ID NO: 8164911 - DNA, 22 bp, Homo sapiens
tttactttctcaagtatatagg

SEQ ID NO: 8164912 - DNA, 22 bp, Homo sapiens
tttactttctcaagtatatagg

SEQ ID NO: 8164913 - DNA, 22 bp, Homo sapiens
tttactttctcaagtatatagg

SEQ ID NO: 8164914 - DNA, 22 bp, Homo sapiens
tttacttgttctgctgaattct

SEQ ID NO: 8164915 - DNA, 22 bp, Homo sapiens
tttactttctcaagtatatagg

SEQ ID NO: 8164916 - DNA, 22 bp, Homo sapiens
tttactttctcaagtatatagg

SEQ ID NO: 8164917 - DNA, 22 bp, Homo sapiens
tttactttctcaagtatatagg

SEQ ID NO: 8164918 - DNA, 22 bp, Homo sapiens
tttactttgtgtcaagtcaaga

SEQ ID NO: 8164919 - DNA, 22 bp, Homo sapiens
tttactttgtgtcaagtcaaga

SEQ ID NO: 8164920 - DNA, 22 bp, Homo sapiens
tttactttgtgtcaagtcaaga

SEQ ID NO: 8164921 - DNA, 22 bp, Homo sapiens
tttacttgatatggagctgagg

SEQ ID NO: 8164922 - DNA, 22 bp, Homo sapiens
tttacttgatatggagctgagg

SEQ ID NO: 8164923 - DNA, 22 bp, Homo sapiens
tttactgtgcattagaatcacc

SEQ ID NO: 8164924 - DNA, 22 bp, Homo sapiens
tttactgtctcagagagacaaa

SEQ ID NO: 8164925 - DNA, 22 bp, Homo sapiens
tttactgagtgacctagaataa

SEQ ID NO: 8164926 - DNA, 22 bp, Homo sapiens
tttactcttgctacacaactgt

SEQ ID NO: 8164927 - DNA, 22 bp, Homo sapiens
tttactgaactgctagtacagg

SEQ ID NO: 8164928 - DNA, 22 bp, Homo sapiens
tttactgaatttggtatattcc

SEQ ID NO: 8164929 - DNA, 22 bp, Homo sapiens
tttactgaatttggtatattcc

SEQ ID NO: 8164930 - DNA, 22 bp, Homo sapiens
tttactgagtgacctagaataa

SEQ ID NO: 8164931 - DNA, 21 bp, Homo sapiens
tttactgagcacttactatgt

SEQ ID NO: 8164932 - DNA, 21 bp, Homo sapiens
tttactgagcacttactatgt

SEQ ID NO: 8164933 - DNA, 21 bp, Homo sapiens
tttagttcaagtacagaacca

SEQ ID NO: 8164934 - DNA, 22 bp, Homo sapiens
tttagttattgttacagtatga

SEQ ID NO: 8164935 - DNA, 22 bp, Homo sapiens
tttagttattgttacagtatga

SEQ ID NO: 8164936 - DNA, 22 bp, Homo sapiens
tttagttattgttacagtatga

SEQ ID NO: 8164937 - DNA, 22 bp, Homo sapiens
tttagttcataaaaccagggtg

SEQ ID NO: 8164938 - DNA, 22 bp, Homo sapiens
tttataaaatagactgggtcta

SEQ ID NO: 8164939 - DNA, 22 bp, Homo sapiens
tttataaacagtaccacggtgc

SEQ ID NO: 8164940 - DNA, 22 bp, Homo sapiens
tttatactccactctgcaagcg

SEQ ID NO: 8164941 - DNA, 22 bp, Homo sapiens
tttatactccactctgcaagcg

SEQ ID NO: 8164942 - DNA, 22 bp, Homo sapiens
tttatagatgtctgtattataa

SEQ ID NO: 8164943 - DNA, 22 bp, Homo sapiens
tttatagatgtctgtattataa

SEQ ID NO: 8164944 - DNA, 22 bp, Homo sapiens
tttatacttcataatgtctatt

SEQ ID NO: 8164945 - DNA, 22 bp, Homo sapiens
tttatacatggagaatttttgc

SEQ ID NO: 8164946 - DNA, 22 bp, Homo sapiens
tttatacatggagaatttttgc

SEQ ID NO: 8164947 - DNA, 22 bp, Homo sapiens
tttatacatggagaatttttgc

SEQ ID NO: 8164948 - DNA, 23 bp, Homo sapiens
tttatacaagaaaccgctggcct

SEQ ID NO: 8164949 - DNA, 17 bp, Homo sapiens
tttataattggcctctt

SEQ ID NO: 8164950 - DNA, 22 bp, Homo sapiens
tttataattatctctactctta

SEQ ID NO: 8164951 - DNA, 22 bp, Homo sapiens
tttataattatctctactctta

SEQ ID NO: 8164952 - DNA, 17 bp, Homo sapiens
tttataattggcctctt

SEQ ID NO: 8164953 - DNA, 22 bp, Homo sapiens
tttataattatctctactctta

SEQ ID NO: 8164954 - DNA, 22 bp, Homo sapiens
tttataattatctctactctta

SEQ ID NO: 8164955 - DNA, 22 bp, Homo sapiens
tttataagtactttgtctgctt

SEQ ID NO: 8164956 - DNA, 22 bp, Homo sapiens
tttataagaagcaatgtctgag

SEQ ID NO: 8164957 - DNA, 22 bp, Homo sapiens
tttataagtactttgtctgctt

SEQ ID NO: 8164958 - DNA, 22 bp, Homo sapiens
tttatataacagagactgctat

SEQ ID NO: 8164959 - DNA, 22 bp, Homo sapiens
tttatataacagagactgctat

SEQ ID NO: 8164960 - DNA, 20 bp, Homo sapiens
tttatagtgatcaatttata

SEQ ID NO: 8164961 - DNA, 22 bp, Homo sapiens
tttatagtcgtctcagtaataa

SEQ ID NO: 8164962 - DNA, 22 bp, Homo sapiens
tttatagttatatacagatgtt

SEQ ID NO: 8164963 - DNA, 22 bp, Homo sapiens
tttatgtttgcattttcaaaga

SEQ ID NO: 8164964 - DNA, 22 bp, Homo sapiens
tttatgtttgcattttcaaaga

SEQ ID NO: 8164965 - DNA, 22 bp, Homo sapiens
tttattaaaactgttggctctg

SEQ ID NO: 8164966 - DNA, 22 bp, Homo sapiens
tttattaaaactgttggctctg

SEQ ID NO: 8164967 - DNA, 21 bp, Homo sapiens
tttattaacaactgtggacgt

SEQ ID NO: 8164968 - DNA, 21 bp, Homo sapiens
tttattaacaactgtggacgt

SEQ ID NO: 8164969 - DNA, 22 bp, Homo sapiens
tttattaaaactgttggctctg

SEQ ID NO: 8164970 - DNA, 22 bp, Homo sapiens
tttattaagatgcgaatgctga

SEQ ID NO: 8164971 - DNA, 22 bp, Homo sapiens
tttattaagatgcgaatgctga

SEQ ID NO: 8164972 - DNA, 22 bp, Homo sapiens
tttattaagatgcgaatgctga

SEQ ID NO: 8164973 - DNA, 22 bp, Homo sapiens
tttattaagatgcgaatgctga

SEQ ID NO: 8164974 - DNA, 22 bp, Homo sapiens
tttcaaaattttgcagtggtaa

SEQ ID NO: 8164975 - DNA, 22 bp, Homo sapiens
tttcaaaattttgcagtggtaa

SEQ ID NO: 8164976 - DNA, 22 bp, Homo sapiens
tttatttgtcttgccatttagt

SEQ ID NO: 8164977 - DNA, 22 bp, Homo sapiens
tttatttgtcttgccatttagt

SEQ ID NO: 8164978 - DNA, 22 bp, Homo sapiens
tttcaaaagcgtacgtagtgaa

SEQ ID NO: 8164979 - DNA, 22 bp, Homo sapiens
tttcaaactgcccagcacacct

SEQ ID NO: 8164980 - DNA, 22 bp, Homo sapiens
tttcaaacctacttgtatgttt

SEQ ID NO: 8164981 - DNA, 22 bp, Homo sapiens
tttcaaacatatcttcattact

SEQ ID NO: 8164982 - DNA, 22 bp, Homo sapiens
tttatttgtcttgccatttagt

SEQ ID NO: 8164983 - DNA, 22 bp, Homo sapiens
tttatttggcatctctgccaag

SEQ ID NO: 8164984 - DNA, 22 bp, Homo sapiens
tttatttggcatccagggagaa

SEQ ID NO: 8164985 - DNA, 22 bp, Homo sapiens
tttatttggcatccagggagaa

SEQ ID NO: 8164986 - DNA, 22 bp, Homo sapiens
tttatttggcatccagggagaa

SEQ ID NO: 8164987 - DNA, 22 bp, Homo sapiens
tttatttcttagtttgccacag

SEQ ID NO: 8164988 - DNA, 22 bp, Homo sapiens
tttatttgaatcaggggagaat

SEQ ID NO: 8164989 - DNA, 23 bp, Homo sapiens
tttatttatttaggctgagggat

SEQ ID NO: 8164990 - DNA, 22 bp, Homo sapiens
tttatttcactctccggatact

SEQ ID NO: 8164991 - DNA, 22 bp, Homo sapiens
tttatttcttagtttgccacag

SEQ ID NO: 8164992 - DNA, 22 bp, Homo sapiens
tttatttcttagtttgccacag

SEQ ID NO: 8164993 - DNA, 22 bp, Homo sapiens
tttatttcactctccggatact

SEQ ID NO: 8164994 - DNA, 23 bp, Homo sapiens
tttatttatttaggctgagggat

SEQ ID NO: 8164995 - DNA, 22 bp, Homo sapiens
tttattatgatggacaccttcg

SEQ ID NO: 8164996 - DNA, 22 bp, Homo sapiens
tttattatccagtgttgtcatg

SEQ ID NO: 8164997 - DNA, 22 bp, Homo sapiens
tttattatccagtgttgtcatg

SEQ ID NO: 8164998 - DNA, 22 bp, Homo sapiens
tttattatgatggacaccttcg

SEQ ID NO: 8164999 - DNA, 22 bp, Homo sapiens
tttattatgatggacaccttcg

SEQ ID NO: 8165000 - DNA, 22 bp, Homo sapiens
tttattattctgttctctctac

SEQ ID NO: 8165001 - DNA, 22 bp, Homo sapiens
tttattattctctggagaatgt

SEQ ID NO: 8165002 - DNA, 22 bp, Homo sapiens
tttattattctctggagaatgt

SEQ ID NO: 8165003 - DNA, 22 bp, Homo sapiens
tttattattctgttctctctac

SEQ ID NO: 8165004 - DNA, 22 bp, Homo sapiens
tttattagattatcaaagaggt

SEQ ID NO: 8165005 - DNA, 22 bp, Homo sapiens
tttattagattatcaaagaggt

SEQ ID NO: 8165006 - DNA, 22 bp, Homo sapiens
tttattagattatcaaagaggt

SEQ ID NO: 8165007 - DNA, 22 bp, Homo sapiens
tttattacaccaggttaactca

SEQ ID NO: 8165008 - DNA, 22 bp, Homo sapiens
tttattacaccaggttaactca

SEQ ID NO: 8165009 - DNA, 22 bp, Homo sapiens
tttattacaccaggttaactca

SEQ ID NO: 8165010 - DNA, 22 bp, Homo sapiens
tttattaattagtgacccaatg

SEQ ID NO: 8165011 - DNA, 22 bp, Homo sapiens
tttattaattagtgacccaatg

SEQ ID NO: 8165012 - DNA, 22 bp, Homo sapiens
tttattaattagtgacccaatg

SEQ ID NO: 8165013 - DNA, 22 bp, Homo sapiens
tttattaatgtagcatccatgg

SEQ ID NO: 8165014 - DNA, 22 bp, Homo sapiens
tttattaatgtagcatccatgg

SEQ ID NO: 8165015 - DNA, 22 bp, Homo sapiens
tttattagtgcttgtatcactg

SEQ ID NO: 8165016 - DNA, 22 bp, Homo sapiens
tttattagtgcttgtatcactg

SEQ ID NO: 8165017 - DNA, 22 bp, Homo sapiens
tttattatagtggtggggactg

SEQ ID NO: 8165018 - DNA, 22 bp, Homo sapiens
tttattatccagtgttgtcatg

SEQ ID NO: 8165019 - DNA, 22 bp, Homo sapiens
tttattatccagtgttgtcatg

SEQ ID NO: 8165020 - DNA, 22 bp, Homo sapiens
tttattatccagtgttgtcatg

SEQ ID NO: 8165021 - DNA, 22 bp, Homo sapiens
tttattatccagtgttgtcatg

SEQ ID NO: 8165022 - DNA, 22 bp, Homo sapiens
tttattatccagtgttgtcatg

SEQ ID NO: 8165023 - DNA, 22 bp, Homo sapiens
ttgtttgtaaggctcttagaat

SEQ ID NO: 8165024 - DNA, 22 bp, Homo sapiens
ttgtttgaggtcactgatattt

SEQ ID NO: 8165025 - DNA, 22 bp, Homo sapiens
ttgtttgaggtcactgatattt

SEQ ID NO: 8165026 - DNA, 22 bp, Homo sapiens
ttgtttgactaaattggtatca

SEQ ID NO: 8165027 - DNA, 23 bp, Homo sapiens
ttgtttctttgtattgtctctat

SEQ ID NO: 8165028 - DNA, 23 bp, Homo sapiens
ttgtttctttgtattgtctctat

SEQ ID NO: 8165029 - DNA, 22 bp, Homo sapiens
ttgtttcttcaggcttttagga

SEQ ID NO: 8165030 - DNA, 22 bp, Homo sapiens
ttgtttctttgaagtttctaga

SEQ ID NO: 8165031 - DNA, 17 bp, Homo sapiens
ttgtttcttctctgtgg

SEQ ID NO: 8165032 - DNA, 17 bp, Homo sapiens
ttgtttcttctctgtgg

SEQ ID NO: 8165033 - DNA, 22 bp, Homo sapiens
ttgtttctttgaagtttctaga

SEQ ID NO: 8165034 - DNA, 20 bp, Homo sapiens
ttgtttctgctattttctaa

SEQ ID NO: 8165035 - DNA, 22 bp, Homo sapiens
ttgtttctgagttttcatgtat

SEQ ID NO: 8165036 - DNA, 22 bp, Homo sapiens
ttgtttctgagttttcatgtat

SEQ ID NO: 8165037 - DNA, 22 bp, Homo sapiens
ttgtttctccagtctaggaaaa

SEQ ID NO: 8165038 - DNA, 22 bp, Homo sapiens
ttgtttctccagtctaggaaaa

SEQ ID NO: 8165039 - DNA, 22 bp, Homo sapiens
ttgtttctccagtctaggaaaa

SEQ ID NO: 8165040 - DNA, 20 bp, Homo sapiens
ttgtttcctggctgttctgc

SEQ ID NO: 8165041 - DNA, 22 bp, Homo sapiens
ttgtttcctttctatacaggat

SEQ ID NO: 8165042 - DNA, 21 bp, Homo sapiens
ttgtttcctcccaaaatgcca

SEQ ID NO: 8165043 - DNA, 22 bp, Homo sapiens
ttgttttagtaggtacactgag

SEQ ID NO: 8165044 - DNA, 22 bp, Homo sapiens
ttgtttgtcataatatcattac

SEQ ID NO: 8165045 - DNA, 22 bp, Homo sapiens
ttgttttaacgactcagcttgt

SEQ ID NO: 8165046 - DNA, 22 bp, Homo sapiens
ttgttttcagggtgtcattcac

SEQ ID NO: 8165047 - DNA, 22 bp, Homo sapiens
ttgttttcacagctttgcccgg

SEQ ID NO: 8165048 - DNA, 22 bp, Homo sapiens
ttgttttctccactgcatctta

SEQ ID NO: 8165049 - DNA, 22 bp, Homo sapiens
ttgttttcctgggataccaacc

SEQ ID NO: 8165050 - DNA, 22 bp, Homo sapiens
ttgttttcctgggataccaacc

SEQ ID NO: 8165051 - DNA, 22 bp, Homo sapiens
ttgtttttaaacatgtgactga

SEQ ID NO: 8165052 - DNA, 22 bp, Homo sapiens
ttgtttttaaacatgtgactga

SEQ ID NO: 8165053 - DNA, 22 bp, Homo sapiens
ttgttttggagatgagctaaaa

SEQ ID NO: 8165054 - DNA, 22 bp, Homo sapiens
ttgttttggagatgagctaaaa

SEQ ID NO: 8165055 - DNA, 22 bp, Homo sapiens
ttgttttggagatgagctaaaa

SEQ ID NO: 8165056 - DNA, 22 bp, Homo sapiens
ttgttttgctaaagggtcatca

SEQ ID NO: 8165057 - DNA, 22 bp, Homo sapiens
ttgttttggaagaacttactct

SEQ ID NO: 8165058 - DNA, 22 bp, Homo sapiens
ttgttttggaagaacttactct

SEQ ID NO: 8165059 - DNA, 22 bp, Homo sapiens
ttgttttgctaaagggtcatca

SEQ ID NO: 8165060 - DNA, 22 bp, Homo sapiens
ttgtgtgtttgtagaaaatcca

SEQ ID NO: 8165061 - DNA, 22 bp, Homo sapiens
ttgtgtgtgtaactttatgaga

SEQ ID NO: 8165062 - DNA, 22 bp, Homo sapiens
ttgtgtgtgtaactttatgaga

SEQ ID NO: 8165063 - DNA, 22 bp, Homo sapiens
ttgtgtgtgtaactttatgaga

SEQ ID NO: 8165064 - DNA, 22 bp, Homo sapiens
ttgtgttaaggtgcatctagtg

SEQ ID NO: 8165065 - DNA, 22 bp, Homo sapiens
ttgtgtttcccttgcatattcc

SEQ ID NO: 8165066 - DNA, 19 bp, Homo sapiens
ttgtgtgtcagtcagagtt

SEQ ID NO: 8165067 - DNA, 19 bp, Homo sapiens
ttgtgtgtcagtcagagtt

SEQ ID NO: 8165068 - DNA, 22 bp, Homo sapiens
ttgtgaatggtgccgcaataaa

SEQ ID NO: 8165069 - DNA, 22 bp, Homo sapiens
ttgtgaatggtgccgcaataaa

SEQ ID NO: 8165070 - DNA, 22 bp, Homo sapiens
ttgtgacacatgccgtcctgag

SEQ ID NO: 8165071 - DNA, 22 bp, Homo sapiens
ttgtgaatgcttaatatgtttc

SEQ ID NO: 8165072 - DNA, 22 bp, Homo sapiens
ttgtgtgtcttcttcactgccc

SEQ ID NO: 8165073 - DNA, 22 bp, Homo sapiens
ttgtgtgtgagccttcaccaca

SEQ ID NO: 8165074 - DNA, 22 bp, Homo sapiens
ttgtgtgtgagccttcaccaca

SEQ ID NO: 8165075 - DNA, 22 bp, Homo sapiens
ttgtgtgtcttcttcactgccc

SEQ ID NO: 8165076 - DNA, 22 bp, Homo sapiens
ttgtttaaagaacttctgactt

SEQ ID NO: 8165077 - DNA, 22 bp, Homo sapiens
ttgtttaaaatgtagcaagaaa

SEQ ID NO: 8165078 - DNA, 22 bp, Homo sapiens
ttgttatctgcgtgaagaaaat

SEQ ID NO: 8165079 - DNA, 22 bp, Homo sapiens
ttgttattattactaagtcttc

SEQ ID NO: 8165080 - DNA, 22 bp, Homo sapiens
ttgttagtgcaatgtttggtga

SEQ ID NO: 8165081 - DNA, 22 bp, Homo sapiens
ttgttataaagactaaatatgt

SEQ ID NO: 8165082 - DNA, 20 bp, Homo sapiens
ttgtttaaaggtgaagaggc

SEQ ID NO: 8165083 - DNA, 22 bp, Homo sapiens
ttgtttaagccacccaatctgt

SEQ ID NO: 8165084 - DNA, 22 bp, Homo sapiens
ttgtttccataattaagtgtga

SEQ ID NO: 8165085 - DNA, 21 bp, Homo sapiens
ttgtttcccagagctcgctcc

SEQ ID NO: 8165086 - DNA, 22 bp, Homo sapiens
ttgttaaaaatagatttccagg

SEQ ID NO: 8165087 - DNA, 22 bp, Homo sapiens
ttgttaaaaatagatttccagg

SEQ ID NO: 8165088 - DNA, 22 bp, Homo sapiens
ttgttacagcagcaatagaaaa

SEQ ID NO: 8165089 - DNA, 22 bp, Homo sapiens
ttgttacagcagtgatttcaga

SEQ ID NO: 8165090 - DNA, 20 bp, Homo sapiens
ttgttagaggaatgccatag

SEQ ID NO: 8165091 - DNA, 22 bp, Homo sapiens
ttggtcttttctattaaatata

SEQ ID NO: 8165092 - DNA, 22 bp, Homo sapiens
ttggtgaattgagaccatttgt

SEQ ID NO: 8165093 - DNA, 22 bp, Homo sapiens
ttggtgaacacatacacatttt

SEQ ID NO: 8165094 - DNA, 22 bp, Homo sapiens
ttggtgagtatggacacagaga

SEQ ID NO: 8165095 - DNA, 22 bp, Homo sapiens
ttggtgagtgctatgtaccaca

SEQ ID NO: 8165096 - DNA, 19 bp, Homo sapiens
ttggtgcacacatgggccc

SEQ ID NO: 8165097 - DNA, 22 bp, Homo sapiens
ttggtgggagaagactctggtt

SEQ ID NO: 8165098 - DNA, 23 bp, Homo sapiens
ttggtgtcagggaactttggaat

SEQ ID NO: 8165099 - DNA, 22 bp, Homo sapiens
ttggtgtgccagagctgacatg

SEQ ID NO: 8165100 - DNA, 22 bp, Homo sapiens
ttggtgggttaatgagtgactg

SEQ ID NO: 8165101 - DNA, 22 bp, Homo sapiens
ttggtgggagagatgagggttg

SEQ ID NO: 8165102 - DNA, 22 bp, Homo sapiens
ttggtgggagagatgagggttg

SEQ ID NO: 8165103 - DNA, 22 bp, Homo sapiens
ttggggtgttcagggtacttct

SEQ ID NO: 8165104 - DNA, 22 bp, Homo sapiens
ttggggtgttggatggagcaag

SEQ ID NO: 8165105 - DNA, 22 bp, Homo sapiens
ttggggtgttggatggagcaag

SEQ ID NO: 8165106 - DNA, 22 bp, Homo sapiens
ttggggtggaagtgaggatcat

SEQ ID NO: 8165107 - DNA, 22 bp, Homo sapiens
ttggggtggaagtgaggatcat

SEQ ID NO: 8165108 - DNA, 22 bp, Homo sapiens
ttggggtgttcagggtacttct

SEQ ID NO: 8165109 - DNA, 22 bp, Homo sapiens
ttggtcatagcattcaaaatgg

SEQ ID NO: 8165110 - DNA, 22 bp, Homo sapiens
ttggtcagtcagagaatggagt

SEQ ID NO: 8165111 - DNA, 22 bp, Homo sapiens
ttggtcctggtctaggcagagt

SEQ ID NO: 8165112 - DNA, 18 bp, Homo sapiens
ttggtctgggtggaaacc

SEQ ID NO: 8165113 - DNA, 22 bp, Homo sapiens
ttggtctgtagttttcttatgt

SEQ ID NO: 8165114 - DNA, 22 bp, Homo sapiens
ttggtctgtagttttcttatgt

SEQ ID NO: 8165115 - DNA, 22 bp, Homo sapiens
ttggtctgcagggagggctgga

SEQ ID NO: 8165116 - DNA, 22 bp, Homo sapiens
ttggtctggagtatgatgataa

SEQ ID NO: 8165117 - DNA, 22 bp, Homo sapiens
ttggtctgctctgatgttttct

SEQ ID NO: 8165118 - DNA, 22 bp, Homo sapiens
ttggtctgtgttacatcattta

SEQ ID NO: 8165119 - DNA, 22 bp, Homo sapiens
ttgcaagaaataatcgaataga

SEQ ID NO: 8165120 - DNA, 22 bp, Homo sapiens
ttgcaacttctcccatcactct

SEQ ID NO: 8165121 - DNA, 22 bp, Homo sapiens
ttgcaagagagtctgaaaaatg

SEQ ID NO: 8165122 - DNA, 22 bp, Homo sapiens
ttgcaagacacttggaagcaca

SEQ ID NO: 8165123 - DNA, 22 bp, Homo sapiens
ttgcaaggtcatcatgcattgg

SEQ ID NO: 8165124 - DNA, 22 bp, Homo sapiens
ttgcaagggtgttttgaggtgt

SEQ ID NO: 8165125 - DNA, 22 bp, Homo sapiens
ttgcaaggctaggttcacccac

SEQ ID NO: 8165126 - DNA, 16 bp, Homo sapiens
ttgcaaggcgtttata

SEQ ID NO: 8165127 - DNA, 22 bp, Homo sapiens
ttgcaagggcatgtgtgcgtgt

SEQ ID NO: 8165128 - DNA, 22 bp, Homo sapiens
ttgcaagggataccatactaag

SEQ ID NO: 8165129 - DNA, 22 bp, Homo sapiens
ttgcaagatgttaccattgtta

SEQ ID NO: 8165130 - DNA, 20 bp, Homo sapiens
ttgcaagctttcaagatagc

SEQ ID NO: 8165131 - DNA, 22 bp, Homo sapiens
ttgcaaggagccactctgcctg

SEQ ID NO: 8165132 - DNA, 22 bp, Homo sapiens
ttgcaagttttacttacctgga

SEQ ID NO: 8165133 - DNA, 22 bp, Homo sapiens
ttgcaatagccttatttccaaa

SEQ ID NO: 8165134 - DNA, 22 bp, Homo sapiens
ttgcaagttccttatgagaatc

SEQ ID NO: 8165135 - DNA, 22 bp, Homo sapiens
ttgcaaggtgataaaagaatga

SEQ ID NO: 8165136 - DNA, 22 bp, Homo sapiens
ttgcaaggtgataaaagaatga

SEQ ID NO: 8165137 - DNA, 22 bp, Homo sapiens
ttgcaagttaaaaattattagt

SEQ ID NO: 8165138 - DNA, 22 bp, Homo sapiens
ttgcaaggtttctctctgccta

SEQ ID NO: 8165139 - DNA, 21 bp, Homo sapiens
ttgcaacaacctatatatttt

SEQ ID NO: 8165140 - DNA, 23 bp, Homo sapiens
ttgcaaatttcagttagttcatg

SEQ ID NO: 8165141 - DNA, 22 bp, Homo sapiens
ttgcaactaaaagaacttgaca

SEQ ID NO: 8165142 - DNA, 22 bp, Homo sapiens
ttgcaacacaaagtttgattcc

SEQ ID NO: 8165143 - DNA, 22 bp, Homo sapiens
ttggttgtgatgtcattgttac

SEQ ID NO: 8165144 - DNA, 22 bp, Homo sapiens
ttggttgtgatacaagattttg

SEQ ID NO: 8165145 - DNA, 22 bp, Homo sapiens
ttggttcagtaggcatgcctgg

SEQ ID NO: 8165146 - DNA, 22 bp, Homo sapiens
ttggttttatcttaagattctt

SEQ ID NO: 8165147 - DNA, 22 bp, Homo sapiens
ttggttttatcttaagattctt

SEQ ID NO: 8165148 - DNA, 22 bp, Homo sapiens
ttggtttagtacctgccagcgt

SEQ ID NO: 8165149 - DNA, 22 bp, Homo sapiens
ttggtttccttaacagcctaaa

SEQ ID NO: 8165150 - DNA, 22 bp, Homo sapiens
ttggtttatttcttcctatgag

SEQ ID NO: 8165151 - DNA, 17 bp, Homo sapiens
ttgtctacctagcagaa

SEQ ID NO: 8165152 - DNA, 22 bp, Homo sapiens
ttgtcgggcttacgcagggcca

SEQ ID NO: 8165153 - DNA, 22 bp, Homo sapiens
ttggttttgaaatagcttattg

SEQ ID NO: 8165154 - DNA, 22 bp, Homo sapiens
ttgtccttccagactcttccac

SEQ ID NO: 8165155 - DNA, 23 bp, Homo sapiens
ttgtaaaacagtgtgacggttcc

SEQ ID NO: 8165156 - DNA, 22 bp, Homo sapiens
ttgtccttagatgtggcctcca

SEQ ID NO: 8165157 - DNA, 22 bp, Homo sapiens
ttgtgaatagtgccgcaataaa

SEQ ID NO: 8165158 - DNA, 22 bp, Homo sapiens
ttgtgaatagtgccgcaataaa

SEQ ID NO: 8165159 - DNA, 22 bp, Homo sapiens
ttgtgaatagtgccgctataaa

SEQ ID NO: 8165160 - DNA, 22 bp, Homo sapiens
ttgtgaatagtgccgctataaa

SEQ ID NO: 8165161 - DNA, 22 bp, Homo sapiens
ttgtgaatagtgctgcaataaa

SEQ ID NO: 8165162 - DNA, 22 bp, Homo sapiens
ttgtctggtcaaatcacttgta

SEQ ID NO: 8165163 - DNA, 22 bp, Homo sapiens
ttgtgaagtgttctgagacagg

SEQ ID NO: 8165164 - DNA, 22 bp, Homo sapiens
ttgtgaaatgtttcaaaatagt

SEQ ID NO: 8165165 - DNA, 22 bp, Homo sapiens
ttgtctatttgttcaggtaagg

SEQ ID NO: 8165166 - DNA, 22 bp, Homo sapiens
ttgtctatacatcaataatgat

SEQ ID NO: 8165167 - DNA, 22 bp, Homo sapiens
ttgtctctgccatgcttgaggg

SEQ ID NO: 8165168 - DNA, 22 bp, Homo sapiens
ttgtctctacagagagtagtag

SEQ ID NO: 8165169 - DNA, 22 bp, Homo sapiens
ttgtctctaagtgtgatcttca

SEQ ID NO: 8165170 - DNA, 22 bp, Homo sapiens
ttgtctctgggacatggtatta

SEQ ID NO: 8165171 - DNA, 22 bp, Homo sapiens
ttgtctgaaagatcattacatt

SEQ ID NO: 8165172 - DNA, 22 bp, Homo sapiens
ttgtctgaatatgtatgtatcc

SEQ ID NO: 8165173 - DNA, 22 bp, Homo sapiens
tttcagagttatgtaagaaaat

SEQ ID NO: 8165174 - DNA, 22 bp, Homo sapiens
tttcagagtctggctgcagcct

SEQ ID NO: 8165175 - DNA, 20 bp, Homo sapiens
tttcaaaggcacctatgaag

SEQ ID NO: 8165176 - DNA, 22 bp, Homo sapiens
tttcaaagggaagttatgaagt

SEQ ID NO: 8165177 - DNA, 22 bp, Homo sapiens
tttcaaagggaagttatgaagt

SEQ ID NO: 8165178 - DNA, 22 bp, Homo sapiens
tttcagaggaggaaggcagtta

SEQ ID NO: 8165179 - DNA, 22 bp, Homo sapiens
tttcaaagaccattaactatca

SEQ ID NO: 8165180 - DNA, 22 bp, Homo sapiens
tttcaaagacagccatatttgt

SEQ ID NO: 8165181 - DNA, 22 bp, Homo sapiens
tttcaaagacagccatatttgt

SEQ ID NO: 8165182 - DNA, 22 bp, Homo sapiens
tttcaaagagttgtaaattact

SEQ ID NO: 8165183 - DNA, 22 bp, Homo sapiens
tttcaaagagttgtaaattact

SEQ ID NO: 8165184 - DNA, 23 bp, Homo sapiens
tttcaaagactttcccttagagt

SEQ ID NO: 8165185 - DNA, 22 bp, Homo sapiens
tttcaaagagaggcagaaggaa

SEQ ID NO: 8165186 - DNA, 22 bp, Homo sapiens
tttcaaaggaggctgagaggat

SEQ ID NO: 8165187 - DNA, 17 bp, Homo sapiens
tttcaaagcagtcagga

SEQ ID NO: 8165188 - DNA, 22 bp, Homo sapiens
tttcaaagcaactgaaaaggaa

SEQ ID NO: 8165189 - DNA, 17 bp, Homo sapiens
tttcaaagcagtcagga

SEQ ID NO: 8165190 - DNA, 22 bp, Homo sapiens
tttcagtctgtaaaggtgagga

SEQ ID NO: 8165191 - DNA, 22 bp, Homo sapiens
tttcagtgaaagctactgttag

SEQ ID NO: 8165192 - DNA, 22 bp, Homo sapiens
tttcagtcatgagttgttttca

SEQ ID NO: 8165193 - DNA, 22 bp, Homo sapiens
tttcagtgcccagagctttgca

SEQ ID NO: 8165194 - DNA, 22 bp, Homo sapiens
tttcagtgcacgtagtttattt

SEQ ID NO: 8165195 - DNA, 22 bp, Homo sapiens
tttcagtgaaagctactgttag

SEQ ID NO: 8165196 - DNA, 22 bp, Homo sapiens
tttcagggagcctagaagagct

SEQ ID NO: 8165197 - DNA, 22 bp, Homo sapiens
tttcagtcagttaagtcatgaa

SEQ ID NO: 8165198 - DNA, 22 bp, Homo sapiens
tttcagtcaggaggatctctca

SEQ ID NO: 8165199 - DNA, 22 bp, Homo sapiens
tttcagggtcagcctgtatgtg

SEQ ID NO: 8165200 - DNA, 22 bp, Homo sapiens
tttcagctggtaaaggagtagc

SEQ ID NO: 8165201 - DNA, 19 bp, Homo sapiens
tttcaggagctatgcaggg

SEQ ID NO: 8165202 - DNA, 22 bp, Homo sapiens
tttcaggattagtttaagcagg

SEQ ID NO: 8165203 - DNA, 22 bp, Homo sapiens
tttcaggcaggtggaatgagta

SEQ ID NO: 8165204 - DNA, 22 bp, Homo sapiens
tttcagagttgtcttcttgacc

SEQ ID NO: 8165205 - DNA, 22 bp, Homo sapiens
tttcagatcactttcaggaaag

SEQ ID NO: 8165206 - DNA, 22 bp, Homo sapiens
tttcagatcactttcaggaaag

SEQ ID NO: 8165207 - DNA, 22 bp, Homo sapiens
tttcagataaatatgggactaa

SEQ ID NO: 8165208 - DNA, 22 bp, Homo sapiens
tttcagatcttctttgggttaa

SEQ ID NO: 8165209 - DNA, 22 bp, Homo sapiens
tttcagatcattttttaagtac

SEQ ID NO: 8165210 - DNA, 22 bp, Homo sapiens
tttcagatcactttcaggaaag

SEQ ID NO: 8165211 - DNA, 22 bp, Homo sapiens
tttcagatgatgcatgcgctca

SEQ ID NO: 8165212 - DNA, 22 bp, Homo sapiens
tttcagatgcatccattagcag

SEQ ID NO: 8165213 - DNA, 22 bp, Homo sapiens
tttcagatggaggtttaggaca

SEQ ID NO: 8165214 - DNA, 22 bp, Homo sapiens
tttcagatggtatatacagtag

SEQ ID NO: 8165215 - DNA, 22 bp, Homo sapiens
tttcagatggaggtttaggaca

SEQ ID NO: 8165216 - DNA, 20 bp, Homo sapiens
tttcagatttacagaaatgt

SEQ ID NO: 8165217 - DNA, 20 bp, Homo sapiens
tttcagatttacagaaatgt

SEQ ID NO: 8165218 - DNA, 17 bp, Homo sapiens
tttcagattcactttct

SEQ ID NO: 8165219 - DNA, 22 bp, Homo sapiens
tttcatttcatagaattgtgtt

SEQ ID NO: 8165220 - DNA, 22 bp, Homo sapiens
tttcatttcatagaattgtgtt

SEQ ID NO: 8165221 - DNA, 22 bp, Homo sapiens
tttcatttcatagaattgtgtt

SEQ ID NO: 8165222 - DNA, 22 bp, Homo sapiens
tttcattttggttatgccataa

SEQ ID NO: 8165223 - DNA, 22 bp, Homo sapiens
tttcattttggttatgccataa

SEQ ID NO: 8165224 - DNA, 22 bp, Homo sapiens
tttcattttggttatgccataa

SEQ ID NO: 8165225 - DNA, 22 bp, Homo sapiens
tttcattttggttatgccataa

SEQ ID NO: 8165226 - DNA, 22 bp, Homo sapiens
tttccaaaagtttgttctgtgc

SEQ ID NO: 8165227 - DNA, 22 bp, Homo sapiens
tttcattttggttatgccataa

SEQ ID NO: 8165228 - DNA, 22 bp, Homo sapiens
tttcattttggttatgccataa

SEQ ID NO: 8165229 - DNA, 22 bp, Homo sapiens
tttccaaaatgaatctaatgca

SEQ ID NO: 8165230 - DNA, 22 bp, Homo sapiens
tttccaaagctgagttgagcaa

SEQ ID NO: 8165231 - DNA, 22 bp, Homo sapiens
tttccaaacccagcgagctaca

SEQ ID NO: 8165232 - DNA, 20 bp, Homo sapiens
tttcattgtcagaatcttat

SEQ ID NO: 8165233 - DNA, 22 bp, Homo sapiens
tttcattgtccccaggcaagac

SEQ ID NO: 8165234 - DNA, 22 bp, Homo sapiens
tttcattgtccccaggcaagac

SEQ ID NO: 8165235 - DNA, 22 bp, Homo sapiens
tttcattggctccctgatgaat

SEQ ID NO: 8165236 - DNA, 22 bp, Homo sapiens
tttcattgtcaataaactgtat

SEQ ID NO: 8165237 - DNA, 22 bp, Homo sapiens
tttcattggcagagcctgtttt

SEQ ID NO: 8165238 - DNA, 22 bp, Homo sapiens
tttcagtgcttctgtttaccgg

SEQ ID NO: 8165239 - DNA, 22 bp, Homo sapiens
tttcagtggaccacagtttgat

SEQ ID NO: 8165240 - DNA, 22 bp, Homo sapiens
tttcagtggaccacagtttgat

SEQ ID NO: 8165241 - DNA, 22 bp, Homo sapiens
tttcagtggagtgacatgatct

SEQ ID NO: 8165242 - DNA, 22 bp, Homo sapiens
tttcattgccataaggtgggat

SEQ ID NO: 8165243 - DNA, 22 bp, Homo sapiens
tttcctctgtcatgacagctga

SEQ ID NO: 8165244 - DNA, 22 bp, Homo sapiens
tttcctctgggccctgccaccc

SEQ ID NO: 8165245 - DNA, 22 bp, Homo sapiens
tttcctctgctgccattgcccc

SEQ ID NO: 8165246 - DNA, 22 bp, Homo sapiens
tttcctcttatacagtgtttat

SEQ ID NO: 8165247 - DNA, 22 bp, Homo sapiens
tttcctcttcgattaagtttgg

SEQ ID NO: 8165248 - DNA, 22 bp, Homo sapiens
tttcctcttctggcaggcaggg

SEQ ID NO: 8165249 - DNA, 22 bp, Homo sapiens
tttcctcttcttcccatgtcat

SEQ ID NO: 8165250 - DNA, 22 bp, Homo sapiens
tttcctcttcttcccatgtcat

SEQ ID NO: 8165251 - DNA, 22 bp, Homo sapiens
tttccaaaggtggcaggaacaa

SEQ ID NO: 8165252 - DNA, 22 bp, Homo sapiens
tttccaaagttgccataagctt

SEQ ID NO: 8165253 - DNA, 22 bp, Homo sapiens
tttccaaataaggtcacactca

SEQ ID NO: 8165254 - DNA, 16 bp, Homo sapiens
tttccaaagggcagct

SEQ ID NO: 8165255 - DNA, 22 bp, Homo sapiens
tttccaaaggctaaactcagtt

SEQ ID NO: 8165256 - DNA, 22 bp, Homo sapiens
tttccaaaggagtaccacgcat

SEQ ID NO: 8165257 - DNA, 22 bp, Homo sapiens
tttccaaaggaggaaccagttt

SEQ ID NO: 8165258 - DNA, 22 bp, Homo sapiens
tttctcctaactcaaatttaag

SEQ ID NO: 8165259 - DNA, 22 bp, Homo sapiens
tttctcctaactcaaatttaag

SEQ ID NO: 8165260 - DNA, 22 bp, Homo sapiens
tttctcctcatgactggttgtg

SEQ ID NO: 8165261 - DNA, 22 bp, Homo sapiens
tttctcctcatgactggttgtg

SEQ ID NO: 8165262 - DNA, 22 bp, Homo sapiens
tttctcctaactcaaatttaag

SEQ ID NO: 8165263 - DNA, 22 bp, Homo sapiens
tttctcctctccagagtgcagt

SEQ ID NO: 8165264 - DNA, 22 bp, Homo sapiens
tttctcctctccagagtgcagt

SEQ ID NO: 8165265 - DNA, 22 bp, Homo sapiens
tttctcctccagagagacacag

SEQ ID NO: 8165266 - DNA, 22 bp, Homo sapiens
tttctcctcatgactggttgtg

SEQ ID NO: 8165267 - DNA, 22 bp, Homo sapiens
tttctcctccagagagacacag

SEQ ID NO: 8165268 - DNA, 22 bp, Homo sapiens
tttctccccagtctaatctgga

SEQ ID NO: 8165269 - DNA, 22 bp, Homo sapiens
tttctcccccatgataatttct

SEQ ID NO: 8165270 - DNA, 22 bp, Homo sapiens
tttctccccagtctaatctgga

SEQ ID NO: 8165271 - DNA, 22 bp, Homo sapiens
tttctccctccactacaggctc

SEQ ID NO: 8165272 - DNA, 22 bp, Homo sapiens
tttctccctccactacaggctc

SEQ ID NO: 8165273 - DNA, 22 bp, Homo sapiens
tttctccctttataagactgta

SEQ ID NO: 8165274 - DNA, 22 bp, Homo sapiens
tttctccctttataagactgta

SEQ ID NO: 8165275 - DNA, 22 bp, Homo sapiens
tttctcccaaagtgcaaccaca

SEQ ID NO: 8165276 - DNA, 22 bp, Homo sapiens
tttctcccaactctggaagcca

SEQ ID NO: 8165277 - DNA, 20 bp, Homo sapiens
tttctcccaagtgcaagggt

SEQ ID NO: 8165278 - DNA, 22 bp, Homo sapiens
tttctcccagtctcctgagaca

SEQ ID NO: 8165279 - DNA, 22 bp, Homo sapiens
tttctcatggacccttcatgat

SEQ ID NO: 8165280 - DNA, 22 bp, Homo sapiens
tttctcatggacccttcatgat

SEQ ID NO: 8165281 - DNA, 23 bp, Homo sapiens
tttctcatccagagagtcagtcc

SEQ ID NO: 8165282 - DNA, 22 bp, Homo sapiens
tttctccacttctcttgccaac

SEQ ID NO: 8165283 - DNA, 22 bp, Homo sapiens
tttctcagttgtgcgagcagca

SEQ ID NO: 8165284 - DNA, 21 bp, Homo sapiens
tttctcataaaatactcatta

SEQ ID NO: 8165285 - DNA, 22 bp, Homo sapiens
tttctcagttactagctgtggt

SEQ ID NO: 8165286 - DNA, 22 bp, Homo sapiens
tttctcagttactagctgtggt

SEQ ID NO: 8165287 - DNA, 22 bp, Homo sapiens
tttctcagttctctgcaaggag

SEQ ID NO: 8165288 - DNA, 22 bp, Homo sapiens
tttctcagttactagctgtggt

SEQ ID NO: 8165289 - DNA, 22 bp, Homo sapiens
tttctcagtaatgtcctggaat

SEQ ID NO: 8165290 - DNA, 22 bp, Homo sapiens
tttctcagtcacatgaaccaat

SEQ ID NO: 8165291 - DNA, 22 bp, Homo sapiens
tttctcagctcagcatctgggt

SEQ ID NO: 8165292 - DNA, 19 bp, Homo sapiens
tttctcaggaagtttgtgt

SEQ ID NO: 8165293 - DNA, 22 bp, Homo sapiens
tttctacttctcctgaatgtct

SEQ ID NO: 8165294 - DNA, 22 bp, Homo sapiens
tttctacttctcctgaatgtct

SEQ ID NO: 8165295 - DNA, 22 bp, Homo sapiens
tttctagaaacattatctctat

SEQ ID NO: 8165296 - DNA, 22 bp, Homo sapiens
tttctactttggaatgcactga

SEQ ID NO: 8165297 - DNA, 22 bp, Homo sapiens
tttctagaaagttcatgtgttt

SEQ ID NO: 8165298 - DNA, 22 bp, Homo sapiens
tttctagaaacattatctctat

SEQ ID NO: 8165299 - DNA, 22 bp, Homo sapiens
tttctagaagatggctaataag

SEQ ID NO: 8165300 - DNA, 22 bp, Homo sapiens
tttctagaatgactcatctgag

SEQ ID NO: 8165301 - DNA, 22 bp, Homo sapiens
tttctattgtaagtctcctata

SEQ ID NO: 8165302 - DNA, 22 bp, Homo sapiens
tttctattgtaagtctcctata

SEQ ID NO: 8165303 - DNA, 22 bp, Homo sapiens
tttctatttacagtgctaggta

SEQ ID NO: 8165304 - DNA, 22 bp, Homo sapiens
tttctattttaaaggcatatgg

SEQ ID NO: 8165305 - DNA, 22 bp, Homo sapiens
tttctatttacagtgctaggta

SEQ ID NO: 8165306 - DNA, 22 bp, Homo sapiens
tttctattttaaaggcatatgg

SEQ ID NO: 8165307 - DNA, 18 bp, Homo sapiens
tttctcagactctctttc

SEQ ID NO: 8165308 - DNA, 22 bp, Homo sapiens
tttctactaagaaagttgatta

SEQ ID NO: 8165309 - DNA, 22 bp, Homo sapiens
tttctacatttgtaaccagatt

SEQ ID NO: 8165310 - DNA, 22 bp, Homo sapiens
tttctactaagaaagttgatta

SEQ ID NO: 8165311 - DNA, 22 bp, Homo sapiens
tttctacattcaaaaactacca

SEQ ID NO: 8165312 - DNA, 22 bp, Homo sapiens
tttctacattcaaaaactacca

SEQ ID NO: 8165313 - DNA, 22 bp, Homo sapiens
tttctacatttgtaaccagatt

SEQ ID NO: 8165314 - DNA, 22 bp, Homo sapiens
tttctacattcaaaaactacca

SEQ ID NO: 8165315 - DNA, 22 bp, Homo sapiens
tttctacatgttttctattgaa

SEQ ID NO: 8165316 - DNA, 22 bp, Homo sapiens
tttctacatgttttctattgaa

SEQ ID NO: 8165317 - DNA, 22 bp, Homo sapiens
tttctacatgttttctattgaa

SEQ ID NO: 8165318 - DNA, 22 bp, Homo sapiens
tttctaattgtggccgaggtag

SEQ ID NO: 8165319 - DNA, 22 bp, Homo sapiens
tttctaatgttctcagggattg

SEQ ID NO: 8165320 - DNA, 19 bp, Homo sapiens
tttctaatgtgtttttctt

SEQ ID NO: 8165321 - DNA, 22 bp, Homo sapiens
tttctaattctaactggcagag

SEQ ID NO: 8165322 - DNA, 22 bp, Homo sapiens
tttctaatctgattctcctacc

SEQ ID NO: 8165323 - DNA, 22 bp, Homo sapiens
tttctaatctttagttacaaaa

SEQ ID NO: 8165324 - DNA, 22 bp, Homo sapiens
tttctaatctttagttacaaaa

SEQ ID NO: 8165325 - DNA, 22 bp, Homo sapiens
tttctaatctttagttacaaaa

SEQ ID NO: 8165326 - DNA, 22 bp, Homo sapiens
tttctaatctgattctcctacc

SEQ ID NO: 8165327 - DNA, 23 bp, Homo sapiens
tttctaaggtttttatctgctac

SEQ ID NO: 8165328 - DNA, 22 bp, Homo sapiens
tttctaagtaaacacagcatac

SEQ ID NO: 8165329 - DNA, 22 bp, Homo sapiens
tttctaagtatcttgcagtttt

SEQ ID NO: 8165330 - DNA, 22 bp, Homo sapiens
tttctaagtatcttgcagtttt

SEQ ID NO: 8165331 - DNA, 22 bp, Homo sapiens
tttctaagtatcttgcagtttt

SEQ ID NO: 8165332 - DNA, 22 bp, Homo sapiens
tttctaagtgtgattttagatt

SEQ ID NO: 8165333 - DNA, 22 bp, Homo sapiens
tttctaatatcacttccagctg

SEQ ID NO: 8165334 - DNA, 22 bp, Homo sapiens
tttctaatagttgagtcagcta

SEQ ID NO: 8165335 - DNA, 22 bp, Homo sapiens
tttctaatatgctctaagtcaa

SEQ ID NO: 8165336 - DNA, 22 bp, Homo sapiens
tttctaatatgctctaagtcaa

SEQ ID NO: 8165337 - DNA, 22 bp, Homo sapiens
tttctaatatcacttccagctg

SEQ ID NO: 8165338 - DNA, 22 bp, Homo sapiens
tttctaatatcacttccagctg

SEQ ID NO: 8165339 - DNA, 22 bp, Homo sapiens
tttcctctttgtaccttgacta

SEQ ID NO: 8165340 - DNA, 22 bp, Homo sapiens
tttcctgcctggacctctgctt

SEQ ID NO: 8165341 - DNA, 22 bp, Homo sapiens
tttcctgcctggacctctgctt

SEQ ID NO: 8165342 - DNA, 22 bp, Homo sapiens
tttcctgcacccgctgatgcca

SEQ ID NO: 8165343 - DNA, 22 bp, Homo sapiens
tttcctgagtcagagacaccag

SEQ ID NO: 8165344 - DNA, 22 bp, Homo sapiens
tttcctgttgccatcaagaatg

SEQ ID NO: 8165345 - DNA, 22 bp, Homo sapiens
tttcctgttgccatcaagaatg

SEQ ID NO: 8165346 - DNA, 22 bp, Homo sapiens
tttcctgtgactaatctggaca

SEQ ID NO: 8165347 - DNA, 22 bp, Homo sapiens
tttcctgtcttttgtgaaggat

SEQ ID NO: 8165348 - DNA, 22 bp, Homo sapiens
tttcctggaccaactgagattg

SEQ ID NO: 8165349 - DNA, 22 bp, Homo sapiens
tttcctggtttgaagcagcagc

SEQ ID NO: 8165350 - DNA, 22 bp, Homo sapiens
tttccttccttgctagcctgag

SEQ ID NO: 8165351 - DNA, 22 bp, Homo sapiens
tttccttccttgctagcctgag

SEQ ID NO: 8165352 - DNA, 22 bp, Homo sapiens
tttccttcctaaggtgaagcaa

SEQ ID NO: 8165353 - DNA, 22 bp, Homo sapiens
tttccttcctaaggtgaagcaa

SEQ ID NO: 8165354 - DNA, 22 bp, Homo sapiens
tttccttcctaaggtgaagcaa

SEQ ID NO: 8165355 - DNA, 22 bp, Homo sapiens
tttccttccctggatgagaagt

SEQ ID NO: 8165356 - DNA, 22 bp, Homo sapiens
tttccttcttagcggtgttctt

SEQ ID NO: 8165357 - DNA, 22 bp, Homo sapiens
tttctaaggtgatcctttctta

SEQ ID NO: 8165358 - DNA, 22 bp, Homo sapiens
tttccttctcagggagcttcaa

SEQ ID NO: 8165359 - DNA, 22 bp, Homo sapiens
tttccttctcagggagcttcaa

SEQ ID NO: 8165360 - DNA, 22 bp, Homo sapiens
tttccttctcagggagcttcaa

SEQ ID NO: 8165361 - DNA, 22 bp, Homo sapiens
tttccttcatcatctgagagct

SEQ ID NO: 8165362 - DNA, 22 bp, Homo sapiens
tttccttccaaatgcccgggag

SEQ ID NO: 8165363 - DNA, 22 bp, Homo sapiens
tttccttccaaatgcccgggag

SEQ ID NO: 8165364 - DNA, 22 bp, Homo sapiens
tttccttcatcatctgagagct

SEQ ID NO: 8165365 - DNA, 22 bp, Homo sapiens
tttccttccaggttcctaaggc

SEQ ID NO: 8165366 - DNA, 22 bp, Homo sapiens
tttccttccaggttcctaaggc

SEQ ID NO: 8165367 - DNA, 22 bp, Homo sapiens
tttccttccaggttcctaaggc

SEQ ID NO: 8165368 - DNA, 22 bp, Homo sapiens
tttccttccaggttcctaaggc

SEQ ID NO: 8165369 - DNA, 22 bp, Homo sapiens
tttccttccctggatgagaagt

SEQ ID NO: 8165370 - DNA, 22 bp, Homo sapiens
tttccttccctggatgagaagt

SEQ ID NO: 8165371 - DNA, 22 bp, Homo sapiens
tttccttccatgttgggcaaaa

SEQ ID NO: 8165372 - DNA, 22 bp, Homo sapiens
tttccttccatgttgggcaaaa

SEQ ID NO: 8165373 - DNA, 22 bp, Homo sapiens
tttctcctctccagagtgcagt

SEQ ID NO: 8165374 - DNA, 22 bp, Homo sapiens
tttctcctctccagagtgcagt

SEQ ID NO: 8165375 - DNA, 22 bp, Homo sapiens
tttctcctgagttccacgctac

SEQ ID NO: 8165376 - DNA, 22 bp, Homo sapiens
tttctcctgagttccacgctac

SEQ ID NO: 8165377 - DNA, 22 bp, Homo sapiens
tttctcctgagttccacgctac

SEQ ID NO: 8165378 - DNA, 22 bp, Homo sapiens
tttctcctgcccagatgcctgg

SEQ ID NO: 8165379 - DNA, 22 bp, Homo sapiens
tttctcctgcccagatgcctgg

SEQ ID NO: 8165380 - DNA, 22 bp, Homo sapiens
tttctcctgtgaggtcagaagt

SEQ ID NO: 8165381 - DNA, 22 bp, Homo sapiens
tttctcctgctagaacaaggag

SEQ ID NO: 8165382 - DNA, 22 bp, Homo sapiens
tttctcctgtgaggtcagaagt

SEQ ID NO: 8165383 - DNA, 22 bp, Homo sapiens
tttctcctgtgaggtcagaagt

SEQ ID NO: 8165384 - DNA, 17 bp, Homo sapiens
tttctccttccatctca

SEQ ID NO: 8165385 - DNA, 22 bp, Homo sapiens
tttctcctgtgtaagccgccca

SEQ ID NO: 8165386 - DNA, 22 bp, Homo sapiens
tttctccttgtgtctcctttga

SEQ ID NO: 8165387 - DNA, 22 bp, Homo sapiens
tttctccttgtgtctcctttga

SEQ ID NO: 8165388 - DNA, 22 bp, Homo sapiens
tttctccttgtgtctcctttga

SEQ ID NO: 8165389 - DNA, 17 bp, Homo sapiens
tttctccttccatctca

SEQ ID NO: 8165390 - DNA, 17 bp, Homo sapiens
tttctccttccatctca

SEQ ID NO: 8165391 - DNA, 22 bp, Homo sapiens
tttctctgtgggctttatgcat

SEQ ID NO: 8165392 - DNA, 22 bp, Homo sapiens
tttctctgtgggctttatgcat

SEQ ID NO: 8165393 - DNA, 22 bp, Homo sapiens
tttctctgttctctaactgtaa

SEQ ID NO: 8165394 - DNA, 22 bp, Homo sapiens
tttctctgttctctaactgtaa

SEQ ID NO: 8165395 - DNA, 22 bp, Homo sapiens
tttctcttcactgtgtgcctca

SEQ ID NO: 8165396 - DNA, 22 bp, Homo sapiens
tttctcttaatgtctctgtgct

SEQ ID NO: 8165397 - DNA, 22 bp, Homo sapiens
tttctcttaatgtctctgtgct

SEQ ID NO: 8165398 - DNA, 22 bp, Homo sapiens
tttctcttaatgtctctgtgct

SEQ ID NO: 8165399 - DNA, 22 bp, Homo sapiens
tttctctagctattcattaaat

SEQ ID NO: 8165400 - DNA, 22 bp, Homo sapiens
tttctctagctattcattaaat

SEQ ID NO: 8165401 - DNA, 22 bp, Homo sapiens
tttctcggcagagatgatgggc

SEQ ID NO: 8165402 - DNA, 22 bp, Homo sapiens
tttctctgggcactctccaaac

SEQ ID NO: 8165403 - DNA, 18 bp, Homo sapiens
tttctctgtcgtcttctg

SEQ ID NO: 8165404 - DNA, 22 bp, Homo sapiens
tttctctgtgccatttccataa

SEQ ID NO: 8165405 - DNA, 22 bp, Homo sapiens
tttctctgtgccatttccataa

SEQ ID NO: 8165406 - DNA, 19 bp, Homo sapiens
tttctctgtgcaccttttc

SEQ ID NO: 8165407 - DNA, 22 bp, Homo sapiens
tttctgaagatacagctttgct

SEQ ID NO: 8165408 - DNA, 22 bp, Homo sapiens
tttctgaaatctcttttgagga

SEQ ID NO: 8165409 - DNA, 22 bp, Homo sapiens
tttctgaaatgctggctttgga

SEQ ID NO: 8165410 - DNA, 22 bp, Homo sapiens
tttctgaaatctcttttgagga

SEQ ID NO: 8165411 - DNA, 22 bp, Homo sapiens
tttctgaaatctcttttgagga

SEQ ID NO: 8165412 - DNA, 22 bp, Homo sapiens
tttctctttgacaggaatcaga

SEQ ID NO: 8165413 - DNA, 22 bp, Homo sapiens
tttctctttgacaggaatcaga

SEQ ID NO: 8165414 - DNA, 22 bp, Homo sapiens
tttctctttgacaggaatcaga

SEQ ID NO: 8165415 - DNA, 22 bp, Homo sapiens
tttctctttcaatctgcagtac

SEQ ID NO: 8165416 - DNA, 22 bp, Homo sapiens
tttctctttcaatctgcagtac

SEQ ID NO: 8165417 - DNA, 22 bp, Homo sapiens
tttctctttgacaggaatcaga

SEQ ID NO: 8165418 - DNA, 22 bp, Homo sapiens
tttctctttcaatctgcagtac

SEQ ID NO: 8165419 - DNA, 22 bp, Homo sapiens
tttctcttgcgatatgctacac

SEQ ID NO: 8165420 - DNA, 22 bp, Homo sapiens
tttctctttcaatctgcagtac

SEQ ID NO: 8165421 - DNA, 22 bp, Homo sapiens
tttctgtacacccactattcat

SEQ ID NO: 8165422 - DNA, 20 bp, Homo sapiens
tttctgtaaggcattaatct

SEQ ID NO: 8165423 - DNA, 22 bp, Homo sapiens
tttctgtaagtggcaaataatg

SEQ ID NO: 8165424 - DNA, 22 bp, Homo sapiens
tttctgtaagtggcaaataatg

SEQ ID NO: 8165425 - DNA, 22 bp, Homo sapiens
tttctgtacacccactattcat

SEQ ID NO: 8165426 - DNA, 22 bp, Homo sapiens
tttctgtacacccactattcat

SEQ ID NO: 8165427 - DNA, 22 bp, Homo sapiens
tttctgtagggatttcacagtt

SEQ ID NO: 8165428 - DNA, 22 bp, Homo sapiens
tttctgtagggatttcacagtt

SEQ ID NO: 8165429 - DNA, 22 bp, Homo sapiens
tttctggcagcgggacaggggt

SEQ ID NO: 8165430 - DNA, 22 bp, Homo sapiens
tttctggcagcgggacaggggt

SEQ ID NO: 8165431 - DNA, 22 bp, Homo sapiens
tttctgggactggggagattct

SEQ ID NO: 8165432 - DNA, 22 bp, Homo sapiens
tttctgggtttatgtcacagct

SEQ ID NO: 8165433 - DNA, 20 bp, Homo sapiens
tttctgggtactctccctct

SEQ ID NO: 8165434 - DNA, 22 bp, Homo sapiens
tttctgtaaggacttaatgcaa

SEQ ID NO: 8165435 - DNA, 22 bp, Homo sapiens
tttctgggtttatgtcacagct

SEQ ID NO: 8165436 - DNA, 22 bp, Homo sapiens
tttctgctgtgtaaaatgaggg

SEQ ID NO: 8165437 - DNA, 22 bp, Homo sapiens
tttctgcttgagagaattgctg

SEQ ID NO: 8165438 - DNA, 22 bp, Homo sapiens
tttctggaaacgggttcaagct

SEQ ID NO: 8165439 - DNA, 22 bp, Homo sapiens
tttctggattcatacagatgta

SEQ ID NO: 8165440 - DNA, 22 bp, Homo sapiens
tttctggattcatacagatgta

SEQ ID NO: 8165441 - DNA, 22 bp, Homo sapiens
tttctggaggcccaagggcaga

SEQ ID NO: 8165442 - DNA, 22 bp, Homo sapiens
tttctggacccttctgtgagtg

SEQ ID NO: 8165443 - DNA, 22 bp, Homo sapiens
tttctggacagcaagatcagtt

SEQ ID NO: 8165444 - DNA, 17 bp, Homo sapiens
tttctggaatgggcaaa

SEQ ID NO: 8165445 - DNA, 17 bp, Homo sapiens
tttctggaatgggcaaa

SEQ ID NO: 8165446 - DNA, 22 bp, Homo sapiens
tttctggaaccacaaaagtatg

SEQ ID NO: 8165447 - DNA, 22 bp, Homo sapiens
tttctggaaccacaaaagtatg

SEQ ID NO: 8165448 - DNA, 22 bp, Homo sapiens
tttctggaaagcaagatacatt

SEQ ID NO: 8165449 - DNA, 22 bp, Homo sapiens
tttctggaaccacaaaagtatg

SEQ ID NO: 8165450 - DNA, 22 bp, Homo sapiens
tttctggaacagtaattgaaga

SEQ ID NO: 8165451 - DNA, 22 bp, Homo sapiens
tttctggaacagtaattgaaga

SEQ ID NO: 8165452 - DNA, 22 bp, Homo sapiens
tttctggaacagtaattgaaga

SEQ ID NO: 8165453 - DNA, 22 bp, Homo sapiens
tttctggaaacgggttcaagct

SEQ ID NO: 8165454 - DNA, 22 bp, Homo sapiens
tttctggaaactgtaaagagga

SEQ ID NO: 8165455 - DNA, 22 bp, Homo sapiens
tttctggaaactgtaaagagga

SEQ ID NO: 8165456 - DNA, 22 bp, Homo sapiens
tttctgacctgcaacagtttac

SEQ ID NO: 8165457 - DNA, 22 bp, Homo sapiens
tttctgacacatcagttgtaaa

SEQ ID NO: 8165458 - DNA, 22 bp, Homo sapiens
tttctgacctgcaacagtttac

SEQ ID NO: 8165459 - DNA, 22 bp, Homo sapiens
tttctgactccagagaggaata

SEQ ID NO: 8165460 - DNA, 22 bp, Homo sapiens
tttctgacacatcagttgtaaa

SEQ ID NO: 8165461 - DNA, 22 bp, Homo sapiens
tttctgaatttactcaaggtca

SEQ ID NO: 8165462 - DNA, 22 bp, Homo sapiens
tttctgaagtcttctaacagat

SEQ ID NO: 8165463 - DNA, 22 bp, Homo sapiens
tttctgaaggttaaggaattag

SEQ ID NO: 8165464 - DNA, 22 bp, Homo sapiens
tttctgccaaccatttaaactc

SEQ ID NO: 8165465 - DNA, 22 bp, Homo sapiens
tttctgcatttacaaaatgagg

SEQ ID NO: 8165466 - DNA, 22 bp, Homo sapiens
tttctgccaggtttctggatga

SEQ ID NO: 8165467 - DNA, 22 bp, Homo sapiens
tttctgccaggtttctggatga

SEQ ID NO: 8165468 - DNA, 22 bp, Homo sapiens
tttctgccagtcactgctctag

SEQ ID NO: 8165469 - DNA, 22 bp, Homo sapiens
tttctgccgttccctgctctgt

SEQ ID NO: 8165470 - DNA, 22 bp, Homo sapiens
tttctgccttatctttgctgag

SEQ ID NO: 8165471 - DNA, 22 bp, Homo sapiens
tttctgcatgcatttaattaaa

SEQ ID NO: 8165472 - DNA, 22 bp, Homo sapiens
tttctgcatcttgaaacagagc

SEQ ID NO: 8165473 - DNA, 22 bp, Homo sapiens
tttctgcatctctacagttgtt

SEQ ID NO: 8165474 - DNA, 22 bp, Homo sapiens
tttctgataattttgtgaaatc

SEQ ID NO: 8165475 - DNA, 22 bp, Homo sapiens
tttctgagaaattaaacacttt

SEQ ID NO: 8165476 - DNA, 22 bp, Homo sapiens
tttctgacttttatatgcatat

SEQ ID NO: 8165477 - DNA, 22 bp, Homo sapiens
tttctgactggtgtataatagg

SEQ ID NO: 8165478 - DNA, 22 bp, Homo sapiens
tttctgagaaattaaacacttt

SEQ ID NO: 8165479 - DNA, 22 bp, Homo sapiens
tttctgaggaattaatacagaa

SEQ ID NO: 8165480 - DNA, 23 bp, Homo sapiens
tttctgttgggtatatatccaag

SEQ ID NO: 8165481 - DNA, 23 bp, Homo sapiens
tttctgttgggtatatatccaag

SEQ ID NO: 8165482 - DNA, 23 bp, Homo sapiens
tttctgttgggtatatatccaag

SEQ ID NO: 8165483 - DNA, 22 bp, Homo sapiens
tttctgttgtacttaaactagg

SEQ ID NO: 8165484 - DNA, 22 bp, Homo sapiens
tttctgttgtacttaaactagg

SEQ ID NO: 8165485 - DNA, 22 bp, Homo sapiens
tttcttatattctgtcattgtt

SEQ ID NO: 8165486 - DNA, 22 bp, Homo sapiens
tttctgtggtgggtagttcaga

SEQ ID NO: 8165487 - DNA, 22 bp, Homo sapiens
tttctgtggtgggtagttcaga

SEQ ID NO: 8165488 - DNA, 19 bp, Homo sapiens
tttctgttagaaggataca

SEQ ID NO: 8165489 - DNA, 22 bp, Homo sapiens
tttctgttaggcatcattttaa

SEQ ID NO: 8165490 - DNA, 22 bp, Homo sapiens
tttctgttaggcatcattttaa

SEQ ID NO: 8165491 - DNA, 22 bp, Homo sapiens
tttctgttaggcatcattttaa

SEQ ID NO: 8165492 - DNA, 22 bp, Homo sapiens
tttctgttaggcatcattttaa

SEQ ID NO: 8165493 - DNA, 23 bp, Homo sapiens
tttctgttcctctagctttgcat

SEQ ID NO: 8165494 - DNA, 22 bp, Homo sapiens
tttctgtattttgtcataacct

SEQ ID NO: 8165495 - DNA, 22 bp, Homo sapiens
tttctgtcattactttcctccc

SEQ ID NO: 8165496 - DNA, 22 bp, Homo sapiens
tttctgtcattactttcctccc

SEQ ID NO: 8165497 - DNA, 22 bp, Homo sapiens
tttctgtaggggatatctttga

SEQ ID NO: 8165498 - DNA, 22 bp, Homo sapiens
tttctgtatttaaaagatctgg

SEQ ID NO: 8165499 - DNA, 22 bp, Homo sapiens
tttctgtatttaggacaggtgg

SEQ ID NO: 8165500 - DNA, 22 bp, Homo sapiens
tttctgtagtgtggtatgtagg

SEQ ID NO: 8165501 - DNA, 20 bp, Homo sapiens
tttctgtgagaaacactgtt

SEQ ID NO: 8165502 - DNA, 20 bp, Homo sapiens
tttctgtgatagagaggtgt

SEQ ID NO: 8165503 - DNA, 20 bp, Homo sapiens
tttctgtgcccaggtctgtt

SEQ ID NO: 8165504 - DNA, 22 bp, Homo sapiens
tttctgtggattttccattcaa

SEQ ID NO: 8165505 - DNA, 19 bp, Homo sapiens
tttctgtctgtgttttgcc

SEQ ID NO: 8165506 - DNA, 19 bp, Homo sapiens
tttctgtctgtgttttgcc

SEQ ID NO: 8165507 - DNA, 22 bp, Homo sapiens
tttctgtctgacatccctgcct

SEQ ID NO: 8165508 - DNA, 22 bp, Homo sapiens
tttctgtctgacatccctgcct

SEQ ID NO: 8165509 - DNA, 22 bp, Homo sapiens
tttcttcctaaatatgatttcc

SEQ ID NO: 8165510 - DNA, 22 bp, Homo sapiens
tttcttcattgatgtcaggtgg

SEQ ID NO: 8165511 - DNA, 22 bp, Homo sapiens
tttcttcagccttcacaacctg

SEQ ID NO: 8165512 - DNA, 22 bp, Homo sapiens
tttcttcagtaacacaaaccat

SEQ ID NO: 8165513 - DNA, 22 bp, Homo sapiens
tttcttcagtaacacaaaccat

SEQ ID NO: 8165514 - DNA, 22 bp, Homo sapiens
tttcttcagtaacacaaaccat

SEQ ID NO: 8165515 - DNA, 22 bp, Homo sapiens
tttcttcattcaccttcacccc

SEQ ID NO: 8165516 - DNA, 22 bp, Homo sapiens
tttcttcattgacaaggaaaaa

SEQ ID NO: 8165517 - DNA, 22 bp, Homo sapiens
tttcttcattgacaaggaaaaa

SEQ ID NO: 8165518 - DNA, 22 bp, Homo sapiens
tttcttcattgacaaggaaaaa

SEQ ID NO: 8165519 - DNA, 22 bp, Homo sapiens
tttcttcagccactccaaactg

SEQ ID NO: 8165520 - DNA, 22 bp, Homo sapiens
tttcttcagccactccaaactg

SEQ ID NO: 8165521 - DNA, 22 bp, Homo sapiens
tttcttcagagagagctttccc

SEQ ID NO: 8165522 - DNA, 22 bp, Homo sapiens
tttcttcaattgctaacaagga

SEQ ID NO: 8165523 - DNA, 22 bp, Homo sapiens
tttcttcaattgctaacaagga

SEQ ID NO: 8165524 - DNA, 22 bp, Homo sapiens
tttcttcaattgctaacaagga

SEQ ID NO: 8165525 - DNA, 22 bp, Homo sapiens
tttcttcaattgctaacaagga

SEQ ID NO: 8165526 - DNA, 22 bp, Homo sapiens
tttcttcaattgctaacaagga

SEQ ID NO: 8165527 - DNA, 22 bp, Homo sapiens
tttcttatgtgcagagtgagta

SEQ ID NO: 8165528 - DNA, 22 bp, Homo sapiens
tttcttatgtgcagagtgagta

SEQ ID NO: 8165529 - DNA, 22 bp, Homo sapiens
tttcttatggggtagtccttta

SEQ ID NO: 8165530 - DNA, 22 bp, Homo sapiens
tttcttatgagcaagactctat

SEQ ID NO: 8165531 - DNA, 22 bp, Homo sapiens
tttcttatggggtagtccttta

SEQ ID NO: 8165532 - DNA, 22 bp, Homo sapiens
tttcttatggggtagtccttta

SEQ ID NO: 8165533 - DNA, 22 bp, Homo sapiens
tttcttatgagcaagactctat

SEQ ID NO: 8165534 - DNA, 22 bp, Homo sapiens
tttcttatgagcaagactctat

SEQ ID NO: 8165535 - DNA, 22 bp, Homo sapiens
tttcttctcgacaccttatccc

SEQ ID NO: 8165536 - DNA, 22 bp, Homo sapiens
tttcttctcatccctgaaatca

SEQ ID NO: 8165537 - DNA, 22 bp, Homo sapiens
tttcttctcatccctgaaatca

SEQ ID NO: 8165538 - DNA, 22 bp, Homo sapiens
tttcttctcatccctgaaatca

SEQ ID NO: 8165539 - DNA, 22 bp, Homo sapiens
tttcttctccatggcaggtcct

SEQ ID NO: 8165540 - DNA, 22 bp, Homo sapiens
tttcttctcatccctgaaatca

SEQ ID NO: 8165541 - DNA, 22 bp, Homo sapiens
tttcttctatgtgtgatatttt

SEQ ID NO: 8165542 - DNA, 22 bp, Homo sapiens
tttcttctatgtgtgatatttt

SEQ ID NO: 8165543 - DNA, 22 bp, Homo sapiens
tttcttctatgtgtgatatttt

SEQ ID NO: 8165544 - DNA, 22 bp, Homo sapiens
tttcttctaggactaataagag

SEQ ID NO: 8165545 - DNA, 22 bp, Homo sapiens
tttcttctaggactaataagag

SEQ ID NO: 8165546 - DNA, 22 bp, Homo sapiens
tttcttctaggactaataagag

SEQ ID NO: 8165547 - DNA, 22 bp, Homo sapiens
tttcttctaggactaataagag

SEQ ID NO: 8165548 - DNA, 22 bp, Homo sapiens
tttcttctaggactaataagag

SEQ ID NO: 8165549 - DNA, 22 bp, Homo sapiens
tttcttctaggactaataagag

SEQ ID NO: 8165550 - DNA, 22 bp, Homo sapiens
tttcttctaagatttcaaacta

SEQ ID NO: 8165551 - DNA, 22 bp, Homo sapiens
tttcttctaagatttcaaacta

SEQ ID NO: 8165552 - DNA, 22 bp, Homo sapiens
tttcttctaagatttcaaacta

SEQ ID NO: 8165553 - DNA, 22 bp, Homo sapiens
tttcttccttaccttactagag

SEQ ID NO: 8165554 - DNA, 22 bp, Homo sapiens
tttcttcctaaatatgatttcc

SEQ ID NO: 8165555 - DNA, 20 bp, Homo sapiens
tttcttgtcggctgttgctg

SEQ ID NO: 8165556 - DNA, 20 bp, Homo sapiens
tttcttgtcggctgttgctg

SEQ ID NO: 8165557 - DNA, 20 bp, Homo sapiens
tttcttgtcggctgttgctg

SEQ ID NO: 8165558 - DNA, 20 bp, Homo sapiens
tttcttgtacttggagaagg

SEQ ID NO: 8165559 - DNA, 20 bp, Homo sapiens
tttcttgtcggctgttgctg

SEQ ID NO: 8165560 - DNA, 20 bp, Homo sapiens
tttcttgtcggctgttgctg

SEQ ID NO: 8165561 - DNA, 22 bp, Homo sapiens
tttcttctgagatcagggagaa

SEQ ID NO: 8165562 - DNA, 22 bp, Homo sapiens
tttcttgtaagatgtttattaa

SEQ ID NO: 8165563 - DNA, 20 bp, Homo sapiens
tttcttgtacttggagaagg

SEQ ID NO: 8165564 - DNA, 22 bp, Homo sapiens
tttcttgtacactggaatttat

SEQ ID NO: 8165565 - DNA, 22 bp, Homo sapiens
tttcttctctaatctcaatgat

SEQ ID NO: 8165566 - DNA, 22 bp, Homo sapiens
tttcttctctaatctcaatgat

SEQ ID NO: 8165567 - DNA, 22 bp, Homo sapiens
tttcttctctgattaaggctca

SEQ ID NO: 8165568 - DNA, 22 bp, Homo sapiens
tttcttctctaatctcaatgat

SEQ ID NO: 8165569 - DNA, 22 bp, Homo sapiens
tttcttgtttcatggtgtctca

SEQ ID NO: 8165570 - DNA, 22 bp, Homo sapiens
tttcttgtttcatggtgtctca

SEQ ID NO: 8165571 - DNA, 22 bp, Homo sapiens
tttcttgtctttagtatctggc

SEQ ID NO: 8165572 - DNA, 22 bp, Homo sapiens
tttctttaaaggaactctgttt

SEQ ID NO: 8165573 - DNA, 22 bp, Homo sapiens
tttctttaaaggaactctgttt

SEQ ID NO: 8165574 - DNA, 22 bp, Homo sapiens
tttctttaattctcacagcaat

SEQ ID NO: 8165575 - DNA, 22 bp, Homo sapiens
tttctttaattctcacagcaat

SEQ ID NO: 8165576 - DNA, 22 bp, Homo sapiens
tttctttaattctcacagcaat

SEQ ID NO: 8165577 - DNA, 22 bp, Homo sapiens
tttctttaattctcacagcaat

SEQ ID NO: 8165578 - DNA, 22 bp, Homo sapiens
tttctttatcatagcatctttg

SEQ ID NO: 8165579 - DNA, 22 bp, Homo sapiens
tttctttatcctcctttgcaca

SEQ ID NO: 8165580 - DNA, 22 bp, Homo sapiens
tttctttatcatagcatctttg

SEQ ID NO: 8165581 - DNA, 22 bp, Homo sapiens
tttctttatcatagcatctttg

SEQ ID NO: 8165582 - DNA, 22 bp, Homo sapiens
tttttccacataccctaggcca

SEQ ID NO: 8165583 - DNA, 22 bp, Homo sapiens
tttttccaccgtacttcctgag

SEQ ID NO: 8165584 - DNA, 22 bp, Homo sapiens
tttttccagggttagatgttta

SEQ ID NO: 8165585 - DNA, 22 bp, Homo sapiens
tttttccagggttagatgttta

SEQ ID NO: 8165586 - DNA, 22 bp, Homo sapiens
tttttccagggttagatgttta

SEQ ID NO: 8165587 - DNA, 22 bp, Homo sapiens
tttttccagggttagatgttta

SEQ ID NO: 8165588 - DNA, 22 bp, Homo sapiens
tttttcccatatagaaagccaa

SEQ ID NO: 8165589 - DNA, 22 bp, Homo sapiens
tttttcccaaaggcaattgcct

SEQ ID NO: 8165590 - DNA, 22 bp, Homo sapiens
tttttcctagcgatttgtcagc

SEQ ID NO: 8165591 - DNA, 22 bp, Homo sapiens
tttttcctagcgatttgtcagc

SEQ ID NO: 8165592 - DNA, 22 bp, Homo sapiens
tttttccttaggggttactcac

SEQ ID NO: 8165593 - DNA, 22 bp, Homo sapiens
tttttccttaggggttactcac

SEQ ID NO: 8165594 - DNA, 20 bp, Homo sapiens
tttttccttctctacaggca

SEQ ID NO: 8165595 - DNA, 22 bp, Homo sapiens
tttttcctagtgctttctggta

SEQ ID NO: 8165596 - DNA, 22 bp, Homo sapiens
tttttcctagtgctttctggta

SEQ ID NO: 8165597 - DNA, 22 bp, Homo sapiens
ttttggccacatccttttgagt

SEQ ID NO: 8165598 - DNA, 22 bp, Homo sapiens
ttttggcagattacttaatatg

SEQ ID NO: 8165599 - DNA, 22 bp, Homo sapiens
ttttggcactgcgtctacatgg

SEQ ID NO: 8165600 - DNA, 22 bp, Homo sapiens
ttttggcactttgtctgattct

SEQ ID NO: 8165601 - DNA, 22 bp, Homo sapiens
tttttcatgagactagaagtca

SEQ ID NO: 8165602 - DNA, 22 bp, Homo sapiens
tttttcatgagactagaagtca

SEQ ID NO: 8165603 - DNA, 22 bp, Homo sapiens
ttttggctccagtggtttgtgc

SEQ ID NO: 8165604 - DNA, 19 bp, Homo sapiens
ttttgaagtatgagacagg

SEQ ID NO: 8165605 - DNA, 19 bp, Homo sapiens
ttttgaagtatgagacagg

SEQ ID NO: 8165606 - DNA, 22 bp, Homo sapiens
ttttgaataattcagaaacagc

SEQ ID NO: 8165607 - DNA, 23 bp, Homo sapiens
ttttgacaggaggaaggtgttga

SEQ ID NO: 8165608 - DNA, 22 bp, Homo sapiens
ttttgaataattcagaaacagc

SEQ ID NO: 8165609 - DNA, 20 bp, Homo sapiens
ttttgatagcaaagacggta

SEQ ID NO: 8165610 - DNA, 22 bp, Homo sapiens
ttttgaaagccaggtttgtatg

SEQ ID NO: 8165611 - DNA, 22 bp, Homo sapiens
ttttgaaagggtgatttggctt

SEQ ID NO: 8165612 - DNA, 22 bp, Homo sapiens
ttttgaagaagatgggaattta

SEQ ID NO: 8165613 - DNA, 22 bp, Homo sapiens
ttttgcagaatgggaaggtagt

SEQ ID NO: 8165614 - DNA, 22 bp, Homo sapiens
ttttgcctaagaatctctctga

SEQ ID NO: 8165615 - DNA, 22 bp, Homo sapiens
ttttggcaaaggcattctcttt

SEQ ID NO: 8165616 - DNA, 22 bp, Homo sapiens
ttttctaacatctagtaatttg

SEQ ID NO: 8165617 - DNA, 22 bp, Homo sapiens
ttttctaaaatatccaggacag

SEQ ID NO: 8165618 - DNA, 22 bp, Homo sapiens
ttttctaacatctagtaatttg

SEQ ID NO: 8165619 - DNA, 22 bp, Homo sapiens
ttttctaacatctagtaatttg

SEQ ID NO: 8165620 - DNA, 22 bp, Homo sapiens
ttttctaacatctagtaatttg

SEQ ID NO: 8165621 - DNA, 22 bp, Homo sapiens
ttttctaacatctagtaatttg

SEQ ID NO: 8165622 - DNA, 22 bp, Homo sapiens
ttttctaaaagaagtcactgat

SEQ ID NO: 8165623 - DNA, 23 bp, Homo sapiens
ttttcctttggacaggctgtatt

SEQ ID NO: 8165624 - DNA, 23 bp, Homo sapiens
ttttcctttggacaggctgtatt

SEQ ID NO: 8165625 - DNA, 22 bp, Homo sapiens
ttttcctttggaagatgcatat

SEQ ID NO: 8165626 - DNA, 22 bp, Homo sapiens
ttttcctttggaagatgcatat

SEQ ID NO: 8165627 - DNA, 22 bp, Homo sapiens
ttttcctttggaagatgcatat

SEQ ID NO: 8165628 - DNA, 23 bp, Homo sapiens
ttttcctttggacaggctgtatt

SEQ ID NO: 8165629 - DNA, 22 bp, Homo sapiens
ttttctttaatctggtggggtg

SEQ ID NO: 8165630 - DNA, 22 bp, Homo sapiens
ttttctttaatctggtggggtg

SEQ ID NO: 8165631 - DNA, 22 bp, Homo sapiens
ttttctttaatctggtggggtg

SEQ ID NO: 8165632 - DNA, 22 bp, Homo sapiens
ttttctttaatctggtggggtg

SEQ ID NO: 8165633 - DNA, 22 bp, Homo sapiens
ttttcttcggtgctgggttgat

SEQ ID NO: 8165634 - DNA, 22 bp, Homo sapiens
ttttctatctcctagaactgcc

SEQ ID NO: 8165635 - DNA, 22 bp, Homo sapiens
ttttctatctcctagaactgcc

SEQ ID NO: 8165636 - DNA, 22 bp, Homo sapiens
ttttctattaactcattttgca

SEQ ID NO: 8165637 - DNA, 22 bp, Homo sapiens
ttttctaactttacactcgaaa

SEQ ID NO: 8165638 - DNA, 22 bp, Homo sapiens
ttttctaactttacactcgaaa

SEQ ID NO: 8165639 - DNA, 22 bp, Homo sapiens
ttttctagggtgctaaatgaac

SEQ ID NO: 8165640 - DNA, 22 bp, Homo sapiens
ttttctatctcctagaactgcc

SEQ ID NO: 8165641 - DNA, 22 bp, Homo sapiens
ttttcctttcatcaggacaaag

SEQ ID NO: 8165642 - DNA, 20 bp, Homo sapiens
ttttccttgttgccgctgct

SEQ ID NO: 8165643 - DNA, 22 bp, Homo sapiens
ttttcctttgaaaggtgagggc

SEQ ID NO: 8165644 - DNA, 22 bp, Homo sapiens
ttttcctttgattcccagatgt

SEQ ID NO: 8165645 - DNA, 22 bp, Homo sapiens
ttttcctttgattcccagatgt

SEQ ID NO: 8165646 - DNA, 22 bp, Homo sapiens
ttttcctttgaaaggtgagggc

SEQ ID NO: 8165647 - DNA, 22 bp, Homo sapiens
ttttccttctgatactccattt

SEQ ID NO: 8165648 - DNA, 22 bp, Homo sapiens
ttttccttctgatactccattt

SEQ ID NO: 8165649 - DNA, 22 bp, Homo sapiens
ttttccttctgatactccattt

SEQ ID NO: 8165650 - DNA, 20 bp, Homo sapiens
ttttccttctgagtatgttg

SEQ ID NO: 8165651 - DNA, 20 bp, Homo sapiens
ttttccttctgagtatgttg

SEQ ID NO: 8165652 - DNA, 20 bp, Homo sapiens
ttttccttctgagtatgttg

SEQ ID NO: 8165653 - DNA, 22 bp, Homo sapiens
ttttatctacctatgctcattt

SEQ ID NO: 8165654 - DNA, 22 bp, Homo sapiens
ttttatctacctatgctcattt

SEQ ID NO: 8165655 - DNA, 19 bp, Homo sapiens
ttttccttctcctcttaat

SEQ ID NO: 8165656 - DNA, 19 bp, Homo sapiens
ttttccttctcctcttaat

SEQ ID NO: 8165657 - DNA, 22 bp, Homo sapiens
ttttatcttcattcctatctac

SEQ ID NO: 8165658 - DNA, 22 bp, Homo sapiens
ttttatgaagataattttctga

SEQ ID NO: 8165659 - DNA, 22 bp, Homo sapiens
ttttatgaagataattttctga

SEQ ID NO: 8165660 - DNA, 22 bp, Homo sapiens
ttttatgaagataattttctga

SEQ ID NO: 8165661 - DNA, 22 bp, Homo sapiens
tttttgattcctagtctaggca

SEQ ID NO: 8165662 - DNA, 22 bp, Homo sapiens
tttttgatctgagcagttggag

SEQ ID NO: 8165663 - DNA, 22 bp, Homo sapiens
tttttgatctgagcagttggag

SEQ ID NO: 8165664 - DNA, 22 bp, Homo sapiens
tttttgatactcaagaggggta

SEQ ID NO: 8165665 - DNA, 22 bp, Homo sapiens
tttttgatactcaagaggggta

SEQ ID NO: 8165666 - DNA, 22 bp, Homo sapiens
tttttgaaggctgatgtgatta

SEQ ID NO: 8165667 - DNA, 22 bp, Homo sapiens
tttttcttgtgctggatctaat

SEQ ID NO: 8165668 - DNA, 22 bp, Homo sapiens
tttttctaatggcttaggatgt

SEQ ID NO: 8165669 - DNA, 20 bp, Homo sapiens
tttttccttctctacaggca

SEQ ID NO: 8165670 - DNA, 20 bp, Homo sapiens
tttttccttctctacaggca

SEQ ID NO: 8165671 - DNA, 22 bp, Homo sapiens
tttttccttggatgtgtctctc

SEQ ID NO: 8165672 - DNA, 22 bp, Homo sapiens
tttttgctccacaactttgaag

SEQ ID NO: 8165673 - DNA, 22 bp, Homo sapiens
tttttgcaccaacctaatagaa

SEQ ID NO: 8165674 - DNA, 22 bp, Homo sapiens
tttttgattcctagtctaggca

SEQ ID NO: 8165675 - DNA, 22 bp, Homo sapiens
tttttgcaccaacctaatagaa

SEQ ID NO: 8165676 - DNA, 22 bp, Homo sapiens
tttttgctccacaactttgaag

SEQ ID NO: 8165677 - DNA, 22 bp, Homo sapiens
tttttggcagctcagaaacttc

SEQ ID NO: 8165678 - DNA, 22 bp, Homo sapiens
tttttgggtccaggctgtatct

SEQ ID NO: 8165679 - DNA, 22 bp, Homo sapiens
tttttgggtccaggctgtatct

SEQ ID NO: 8165680 - DNA, 22 bp, Homo sapiens
ttttttgtcttgaagaaatggt

SEQ ID NO: 8165681 - DNA, 22 bp, Homo sapiens
ttttttgtcttgaagaaatggt

SEQ ID NO: 8165682 - DNA, 22 bp, Homo sapiens
ttttttgtcttgaagaaatggt

SEQ ID NO: 8165683 - DNA, 22 bp, Homo sapiens
ttttttgtcttgaagaaatggt

SEQ ID NO: 8165684 - DNA, 22 bp, Homo sapiens
tttttgggtccaggctgtatct

SEQ ID NO: 8165685 - DNA, 22 bp, Homo sapiens
tttttgggtccaggctgtatct

SEQ ID NO: 8165686 - DNA, 22 bp, Homo sapiens
tttgttctgcatcacagaaaaa

SEQ ID NO: 8165687 - DNA, 22 bp, Homo sapiens
tttgttcttagtatctgtgtgc

SEQ ID NO: 8165688 - DNA, 22 bp, Homo sapiens
tttgttctgcatcacagaaaaa

SEQ ID NO: 8165689 - DNA, 22 bp, Homo sapiens
tttgttcttagtatctgtgtgc

SEQ ID NO: 8165690 - DNA, 22 bp, Homo sapiens
tttgttggttgcactggtgggt

SEQ ID NO: 8165691 - DNA, 22 bp, Homo sapiens
tttgttcttgcaacagttatta

SEQ ID NO: 8165692 - DNA, 22 bp, Homo sapiens
tttgttcttgcaacagttatta

SEQ ID NO: 8165693 - DNA, 22 bp, Homo sapiens
tttgttgtcatcagtgatgagt

SEQ ID NO: 8165694 - DNA, 22 bp, Homo sapiens
tttgttgtactgggattagact

SEQ ID NO: 8165695 - DNA, 22 bp, Homo sapiens
tttgttggttgcactggtgggt

SEQ ID NO: 8165696 - DNA, 22 bp, Homo sapiens
tttgttgtgaacagaataatat

SEQ ID NO: 8165697 - DNA, 22 bp, Homo sapiens
tttgttgtctagcatgaggtgc

SEQ ID NO: 8165698 - DNA, 22 bp, Homo sapiens
tttgttgtgaacagaataatat

SEQ ID NO: 8165699 - DNA, 22 bp, Homo sapiens
tttgttgttagagtatgtgaaa

SEQ ID NO: 8165700 - DNA, 22 bp, Homo sapiens
tttgttgtgataatggtctgca

SEQ ID NO: 8165701 - DNA, 22 bp, Homo sapiens
tttgtttacaaaaataagcagt

SEQ ID NO: 8165702 - DNA, 22 bp, Homo sapiens
tttgtttacaaaaataagcagt

SEQ ID NO: 8165703 - DNA, 22 bp, Homo sapiens
tttgttcacatgtcatgtacaa

SEQ ID NO: 8165704 - DNA, 22 bp, Homo sapiens
tttgttcacatttaggactctc

SEQ ID NO: 8165705 - DNA, 22 bp, Homo sapiens
tttgttcactatatccctcagt

SEQ ID NO: 8165706 - DNA, 22 bp, Homo sapiens
tttgttcacctcaaggatggga

SEQ ID NO: 8165707 - DNA, 22 bp, Homo sapiens
tttgttcactatatccctcagt

SEQ ID NO: 8165708 - DNA, 22 bp, Homo sapiens
tttgttcacctagcaaactttt

SEQ ID NO: 8165709 - DNA, 22 bp, Homo sapiens
tttgttcacctagcaaactttt

SEQ ID NO: 8165710 - DNA, 22 bp, Homo sapiens
tttgttcacctagcaaactttt

SEQ ID NO: 8165711 - DNA, 22 bp, Homo sapiens
tttgttcacatttaggactctc

SEQ ID NO: 8165712 - DNA, 22 bp, Homo sapiens
tttgttcagagatgttcaagct

SEQ ID NO: 8165713 - DNA, 22 bp, Homo sapiens
tttgttcactgatgtatcccaa

SEQ ID NO: 8165714 - DNA, 16 bp, Homo sapiens
tttgttcactccatgg

SEQ ID NO: 8165715 - DNA, 23 bp, Homo sapiens
tttgttcactcctgggaaagaca

SEQ ID NO: 8165716 - DNA, 22 bp, Homo sapiens
tttgttcactgagcaatgatta

SEQ ID NO: 8165717 - DNA, 22 bp, Homo sapiens
tttgttcactgagcaatgatta

SEQ ID NO: 8165718 - DNA, 22 bp, Homo sapiens
tttgtcagggatcagatcggta

SEQ ID NO: 8165719 - DNA, 22 bp, Homo sapiens
tttgtcaggaattgaaaagttt

SEQ ID NO: 8165720 - DNA, 22 bp, Homo sapiens
tttgtcaatcccttgaaaacct

SEQ ID NO: 8165721 - DNA, 22 bp, Homo sapiens
tttgtattccatatcatgccat

SEQ ID NO: 8165722 - DNA, 22 bp, Homo sapiens
tttgtatttttcccagctagct

SEQ ID NO: 8165723 - DNA, 22 bp, Homo sapiens
tttgtataagaacattctagca

SEQ ID NO: 8165724 - DNA, 22 bp, Homo sapiens
tttgtatgggcagaaattagat

SEQ ID NO: 8165725 - DNA, 22 bp, Homo sapiens
tttgtatgaactggtatgtagg

SEQ ID NO: 8165726 - DNA, 22 bp, Homo sapiens
tttgtatgaactggtatgtagg

SEQ ID NO: 8165727 - DNA, 22 bp, Homo sapiens
tttgtattccatatcatgccat

SEQ ID NO: 8165728 - DNA, 22 bp, Homo sapiens
tttgtattacaaagtcacagta

SEQ ID NO: 8165729 - DNA, 22 bp, Homo sapiens
tttgtatgtgataagactattc

SEQ ID NO: 8165730 - DNA, 22 bp, Homo sapiens
tttgtatgtgataagactattc

SEQ ID NO: 8165731 - DNA, 22 bp, Homo sapiens
tttgtagatagaaaaatgatta

SEQ ID NO: 8165732 - DNA, 22 bp, Homo sapiens
tttgtagcagcatgatttataa

SEQ ID NO: 8165733 - DNA, 22 bp, Homo sapiens
tttgtagcagcatgatttataa

SEQ ID NO: 8165734 - DNA, 22 bp, Homo sapiens
tttgtataaatgaagatgctgg

SEQ ID NO: 8165735 - DNA, 22 bp, Homo sapiens
tttgtataaattttgaggtgag

SEQ ID NO: 8165736 - DNA, 22 bp, Homo sapiens
tttgtataaattttgaggtgag

SEQ ID NO: 8165737 - DNA, 22 bp, Homo sapiens
tttgtagagggtaattgacaga

SEQ ID NO: 8165738 - DNA, 22 bp, Homo sapiens
tttgtagagggtaattgacaga

SEQ ID NO: 8165739 - DNA, 22 bp, Homo sapiens
tttgtagactaccagtaattgt

SEQ ID NO: 8165740 - DNA, 22 bp, Homo sapiens
tttgtagacgtcagaagttact

SEQ ID NO: 8165741 - DNA, 22 bp, Homo sapiens
tttgtagagaataaaacaaatt

SEQ ID NO: 8165742 - DNA, 22 bp, Homo sapiens
tttgtagaactatacttacatt

SEQ ID NO: 8165743 - DNA, 22 bp, Homo sapiens
tttgtagaactgtagaacaatg

SEQ ID NO: 8165744 - DNA, 22 bp, Homo sapiens
tttgtagaataatatctttctg

SEQ ID NO: 8165745 - DNA, 22 bp, Homo sapiens
tttgtactagtcagtaaatagt

SEQ ID NO: 8165746 - DNA, 23 bp, Homo sapiens
tttgtacattgaggaggcagaat

SEQ ID NO: 8165747 - DNA, 23 bp, Homo sapiens
tttgtacattgaggaggcagaat

SEQ ID NO: 8165748 - DNA, 22 bp, Homo sapiens
tttgtactgaagattgtaaact

SEQ ID NO: 8165749 - DNA, 22 bp, Homo sapiens
tttgtttagaaagagattggtg

SEQ ID NO: 8165750 - DNA, 22 bp, Homo sapiens
tttgtttactcattcattgatg

SEQ ID NO: 8165751 - DNA, 22 bp, Homo sapiens
tttgtttactcattcattgatg

SEQ ID NO: 8165752 - DNA, 22 bp, Homo sapiens
tttgtttcgcagcctctctctg

SEQ ID NO: 8165753 - DNA, 22 bp, Homo sapiens
tttgtttagatggtaaatcagt

SEQ ID NO: 8165754 - DNA, 22 bp, Homo sapiens
tttgtttagatggtaaatcagt

SEQ ID NO: 8165755 - DNA, 22 bp, Homo sapiens
tttgttttcaatgtgtcattca

SEQ ID NO: 8165756 - DNA, 22 bp, Homo sapiens
tttgttttcaatgtgtcattca

SEQ ID NO: 8165757 - DNA, 22 bp, Homo sapiens
tttgttttcaatgtgtcattca

SEQ ID NO: 8165758 - DNA, 22 bp, Homo sapiens
tttgttttcaatgtgtcattca

SEQ ID NO: 8165759 - DNA, 22 bp, Homo sapiens
tttgttttcaatgtgtcattca

SEQ ID NO: 8165760 - DNA, 22 bp, Homo sapiens
tttgttttgaactagctcagaa

SEQ ID NO: 8165761 - DNA, 22 bp, Homo sapiens
tttgttttctgtaggcctttcc

SEQ ID NO: 8165762 - DNA, 22 bp, Homo sapiens
tttgttttgaactagctcagaa

SEQ ID NO: 8165763 - DNA, 22 bp, Homo sapiens
ttttagaagttcacttgggttt

SEQ ID NO: 8165764 - DNA, 22 bp, Homo sapiens
tttgttttcaatgtgtcattca

SEQ ID NO: 8165765 - DNA, 22 bp, Homo sapiens
tttgttttctgtaggcctttcc

SEQ ID NO: 8165766 - DNA, 22 bp, Homo sapiens
ttttatagctgaatagtattcc

SEQ ID NO: 8165767 - DNA, 22 bp, Homo sapiens
ttttatacttaagacagagttt

SEQ ID NO: 8165768 - DNA, 22 bp, Homo sapiens
ttttataagcaagaaagggaaa

SEQ ID NO: 8165769 - DNA, 22 bp, Homo sapiens
ttttataaagagagtcagttgg

SEQ ID NO: 8165770 - DNA, 22 bp, Homo sapiens
ttttataaagagagtcagttgg

SEQ ID NO: 8165771 - DNA, 22 bp, Homo sapiens
ttttagtttggatttctaaagc

SEQ ID NO: 8165772 - DNA, 22 bp, Homo sapiens
ttttagtttggatttctaaagc

SEQ ID NO: 8165773 - DNA, 22 bp, Homo sapiens
ttttagaagttcatgtgggatt

SEQ ID NO: 8165774 - DNA, 22 bp, Homo sapiens
ttttatcagcagggataacaag

SEQ ID NO: 8165775 - DNA, 22 bp, Homo sapiens
ttttatcaatcattaagacatt

SEQ ID NO: 8165776 - DNA, 22 bp, Homo sapiens
ttttatcaatcattaagacatt

SEQ ID NO: 8165777 - DNA, 22 bp, Homo sapiens
ttttatcaatcattaagacatt

SEQ ID NO: 8165778 - DNA, 22 bp, Homo sapiens
ttttatatggcacattggttgg

SEQ ID NO: 8165779 - DNA, 22 bp, Homo sapiens
ttttatatggcacattggttgg

SEQ ID NO: 8165780 - DNA, 22 bp, Homo sapiens
ttttatatggcacattggttgg

SEQ ID NO: 8165781 - DNA, 22 bp, Homo sapiens
ttttatatggcacattggttgg

SEQ ID NO: 8165782 - DNA, 20 bp, Homo sapiens
ttttatatgtagggtatatg

SEQ ID NO: 8165783 - DNA, 22 bp, Homo sapiens
ttttatattgagtgagagttcc

SEQ ID NO: 8165784 - DNA, 22 bp, Homo sapiens
ttttatattgagtgagagttcc

SEQ ID NO: 8165785 - DNA, 22 bp, Homo sapiens
ttttatattgagtgagagttcc

SEQ ID NO: 8165786 - DNA, 22 bp, Homo sapiens
tttctttccatacatattgcta

SEQ ID NO: 8165787 - DNA, 22 bp, Homo sapiens
tttctttccagagtgattggca

SEQ ID NO: 8165788 - DNA, 22 bp, Homo sapiens
tttctttccagagtgattggca

SEQ ID NO: 8165789 - DNA, 22 bp, Homo sapiens
tttctttatcctcctttgcaca

SEQ ID NO: 8165790 - DNA, 22 bp, Homo sapiens
tttctttcaattctcctaatgc

SEQ ID NO: 8165791 - DNA, 22 bp, Homo sapiens
tttctttatcctcctttgcaca

SEQ ID NO: 8165792 - DNA, 22 bp, Homo sapiens
tttctttctcgtaaacttagtt

SEQ ID NO: 8165793 - DNA, 22 bp, Homo sapiens
tttctttccatgagcctatgta

SEQ ID NO: 8165794 - DNA, 18 bp, Homo sapiens
tttctttctgcctggggc

SEQ ID NO: 8165795 - DNA, 22 bp, Homo sapiens
tttctttctcgtaaacttagtt

SEQ ID NO: 8165796 - DNA, 22 bp, Homo sapiens
tttctttccatgagcctatgta

SEQ ID NO: 8165797 - DNA, 22 bp, Homo sapiens
tttctttccatgagcctatgta

SEQ ID NO: 8165798 - DNA, 22 bp, Homo sapiens
tttgcaaatatgtgtttctatt

SEQ ID NO: 8165799 - DNA, 22 bp, Homo sapiens
tttgattttcagcaatagtggc

SEQ ID NO: 8165800 - DNA, 22 bp, Homo sapiens
tttgatttactggatattctca

SEQ ID NO: 8165801 - DNA, 22 bp, Homo sapiens
tttgattttcagcaatagtggc

SEQ ID NO: 8165802 - DNA, 22 bp, Homo sapiens
tttgattttcagcaatagtggc

SEQ ID NO: 8165803 - DNA, 22 bp, Homo sapiens
tttgcacacattcttagaaatg

SEQ ID NO: 8165804 - DNA, 22 bp, Homo sapiens
tttgcacacacaataacaaatg

SEQ ID NO: 8165805 - DNA, 22 bp, Homo sapiens
tttgcacacattcttagaaatg

SEQ ID NO: 8165806 - DNA, 22 bp, Homo sapiens
tttgcacttcctaatgtgtttt

SEQ ID NO: 8165807 - DNA, 22 bp, Homo sapiens
tttgcactagcatttgtccatg

SEQ ID NO: 8165808 - DNA, 22 bp, Homo sapiens
tttgcacttaaatttacaacac

SEQ ID NO: 8165809 - DNA, 22 bp, Homo sapiens
tttgcagcaaggagagagcatt

SEQ ID NO: 8165810 - DNA, 22 bp, Homo sapiens
tttgcagtagacatcttatttt

SEQ ID NO: 8165811 - DNA, 22 bp, Homo sapiens
tttgcagtagacatcttatttt

SEQ ID NO: 8165812 - DNA, 22 bp, Homo sapiens
tttgcagtcaaatttgctaaat

SEQ ID NO: 8165813 - DNA, 22 bp, Homo sapiens
tttgcagcctccctggcagaag

SEQ ID NO: 8165814 - DNA, 23 bp, Homo sapiens
tttgcaaattttcctgactactc

SEQ ID NO: 8165815 - DNA, 22 bp, Homo sapiens
tttgcaacagactcatcattga

SEQ ID NO: 8165816 - DNA, 22 bp, Homo sapiens
tttgcaagatgaaaaagttcta

SEQ ID NO: 8165817 - DNA, 22 bp, Homo sapiens
tttgcaatttgtgctgcaaatg

SEQ ID NO: 8165818 - DNA, 22 bp, Homo sapiens
tttgcaagtatcaaacatgtca

SEQ ID NO: 8165819 - DNA, 22 bp, Homo sapiens
tttgcaaattagccaccctgtt

SEQ ID NO: 8165820 - DNA, 23 bp, Homo sapiens
tttgcaaattggacacaaccaca

SEQ ID NO: 8165821 - DNA, 23 bp, Homo sapiens
tttgcaaattggacacaaccaca

SEQ ID NO: 8165822 - DNA, 22 bp, Homo sapiens
tttggcaccatttttattctct

SEQ ID NO: 8165823 - DNA, 22 bp, Homo sapiens
tttggcactcacttatcattgg

SEQ ID NO: 8165824 - DNA, 22 bp, Homo sapiens
tttggcaagtgggaaattagta

SEQ ID NO: 8165825 - DNA, 22 bp, Homo sapiens
tttggcactgttctaggtgcaa

SEQ ID NO: 8165826 - DNA, 22 bp, Homo sapiens
tttgtacacaacctgtggtagt

SEQ ID NO: 8165827 - DNA, 22 bp, Homo sapiens
tttgtacacaacctgtggtagt

SEQ ID NO: 8165828 - DNA, 22 bp, Homo sapiens
tttgtacaattagcagaggcta

SEQ ID NO: 8165829 - DNA, 22 bp, Homo sapiens
tttgtacatgaatgtgcaccca

SEQ ID NO: 8165830 - DNA, 22 bp, Homo sapiens
tttgtacatcctaattctgagt

SEQ ID NO: 8165831 - DNA, 22 bp, Homo sapiens
tttgtacatcctaattctgagt

SEQ ID NO: 8165832 - DNA, 23 bp, Homo sapiens
tttgtacattgaggaggcagaat

SEQ ID NO: 8165833 - DNA, 22 bp, Homo sapiens
tttgtaatgataatgttaaatt

SEQ ID NO: 8165834 - DNA, 19 bp, Homo sapiens
tttggcaggagataggatg

SEQ ID NO: 8165835 - DNA, 22 bp, Homo sapiens
tttggagagagttaaatatgtt

SEQ ID NO: 8165836 - DNA, 20 bp, Homo sapiens
tttggagagaaagaagtagt

SEQ ID NO: 8165837 - DNA, 22 bp, Homo sapiens
tttggagaagttgctaaagtgt

SEQ ID NO: 8165838 - DNA, 22 bp, Homo sapiens
tttggcaaaactgtgtctatct

SEQ ID NO: 8165839 - DNA, 22 bp, Homo sapiens
tttggaacaagacaaaacatta

SEQ ID NO: 8165840 - DNA, 22 bp, Homo sapiens
tttgcagtgattcttgcagtga

SEQ ID NO: 8165841 - DNA, 22 bp, Homo sapiens
tttgcagtctggcctgctttgg

SEQ ID NO: 8165842 - DNA, 22 bp, Homo sapiens
tttgcagtcaaatttgctaaat

SEQ ID NO: 8165843 - DNA, 22 bp, Homo sapiens
tttggaagggaaagaaagtact

SEQ ID NO: 8165844 - DNA, 22 bp, Homo sapiens
tttggactactgggaccttgtg

SEQ ID NO: 8165845 - DNA, 22 bp, Homo sapiens
tttggactatctgtgtggcttt

SEQ ID NO: 8165846 - DNA, 22 bp, Homo sapiens
tttggactgcatgatgatctgg

SEQ ID NO: 8165847 - DNA, 22 bp, Homo sapiens
tttggacttagcctgcagaatt

SEQ ID NO: 8165848 - DNA, 22 bp, Homo sapiens
tttggacaaatgtctgactttc

SEQ ID NO: 8165849 - DNA, 22 bp, Homo sapiens
tttggacaagttactggtttcc

SEQ ID NO: 8165850 - DNA, 21 bp, Homo sapiens
cactccacttagaacagggtt

SEQ ID NO: 8165851 - DNA, 21 bp, Homo sapiens
cactccacttagaacagggtt

SEQ ID NO: 8165852 - DNA, 21 bp, Homo sapiens
cactccacttagaacagggtt

SEQ ID NO: 8165853 - DNA, 22 bp, Homo sapiens
cactcagggtacaatggagggc

SEQ ID NO: 8165854 - DNA, 22 bp, Homo sapiens
cactcagggatcaggtaaattc

SEQ ID NO: 8165855 - DNA, 22 bp, Homo sapiens
cactcagctgagccctcagccc

SEQ ID NO: 8165856 - DNA, 22 bp, Homo sapiens
cactcagcccacccatgtttgt

SEQ ID NO: 8165857 - DNA, 22 bp, Homo sapiens
cactcagcccacccatgtttgt

SEQ ID NO: 8165858 - DNA, 22 bp, Homo sapiens
cactcagaacatctccctgatg

SEQ ID NO: 8165859 - DNA, 22 bp, Homo sapiens
cactcaggctgtgtcaggagga

SEQ ID NO: 8165860 - DNA, 22 bp, Homo sapiens
cactcagctgagccctcagccc

SEQ ID NO: 8165861 - DNA, 22 bp, Homo sapiens
cactatttcctggattttgacg

SEQ ID NO: 8165862 - DNA, 21 bp, Homo sapiens
cactatttatatatgccagct

SEQ ID NO: 8165863 - DNA, 22 bp, Homo sapiens
cactatatctctttcatctttt

SEQ ID NO: 8165864 - DNA, 22 bp, Homo sapiens
cactatatgcctttgaaataca

SEQ ID NO: 8165865 - DNA, 22 bp, Homo sapiens
cactatatgcctttgaaataca

SEQ ID NO: 8165866 - DNA, 22 bp, Homo sapiens
cactatctactattgtggttat

SEQ ID NO: 8165867 - DNA, 22 bp, Homo sapiens
cacgctggtcattgtagtccag

SEQ ID NO: 8165868 - DNA, 22 bp, Homo sapiens
cacgcttggcttatacagagaa

SEQ ID NO: 8165869 - DNA, 22 bp, Homo sapiens
cacgccagccggacactgggcc

SEQ ID NO: 8165870 - DNA, 22 bp, Homo sapiens
ggccagggccaaggctttccca

SEQ ID NO: 8165871 - DNA, 22 bp, Homo sapiens
ggccagggaggagaggcccctg

SEQ ID NO: 8165872 - DNA, 22 bp, Homo sapiens
ggccagggaggagaggcccctg

SEQ ID NO: 8165873 - DNA, 22 bp, Homo sapiens
cactataatcctgttttagaac

SEQ ID NO: 8165874 - DNA, 22 bp, Homo sapiens
cactagtggccccatgtggttg

SEQ ID NO: 8165875 - DNA, 22 bp, Homo sapiens
cactctgaactattaacttggg

SEQ ID NO: 8165876 - DNA, 22 bp, Homo sapiens
cactctctcaggctttccttgt

SEQ ID NO: 8165877 - DNA, 22 bp, Homo sapiens
cactctgaactattaacttggg

SEQ ID NO: 8165878 - DNA, 22 bp, Homo sapiens
cactctgacacatgaacttgat

SEQ ID NO: 8165879 - DNA, 22 bp, Homo sapiens
cactgcaacctccacctcctgg

SEQ ID NO: 8165880 - DNA, 22 bp, Homo sapiens
cactctgactggccctgcagga

SEQ ID NO: 8165881 - DNA, 22 bp, Homo sapiens
cactctgacacatgaacttgat

SEQ ID NO: 8165882 - DNA, 22 bp, Homo sapiens
cactctgactggccctgcagga

SEQ ID NO: 8165883 - DNA, 22 bp, Homo sapiens
cactgcactccagcctgggaga

SEQ ID NO: 8165884 - DNA, 22 bp, Homo sapiens
cactgcactccagcctgcgcaa

SEQ ID NO: 8165885 - DNA, 22 bp, Homo sapiens
cactgcactccagcctgcgcaa

SEQ ID NO: 8165886 - DNA, 22 bp, Homo sapiens
cactgcactccagcctgggaga

SEQ ID NO: 8165887 - DNA, 22 bp, Homo sapiens
cactgcactccagcctgggaga

SEQ ID NO: 8165888 - DNA, 22 bp, Homo sapiens
cactgcactccagcctgggaga

SEQ ID NO: 8165889 - DNA, 22 bp, Homo sapiens
cactgcactccagcctgggaga

SEQ ID NO: 8165890 - DNA, 22 bp, Homo sapiens
cactgcactccagcctgggaga

SEQ ID NO: 8165891 - DNA, 22 bp, Homo sapiens
cactcccttcaggagcctagga

SEQ ID NO: 8165892 - DNA, 22 bp, Homo sapiens
cactccctctagttgcattctg

SEQ ID NO: 8165893 - DNA, 22 bp, Homo sapiens
cactccctctagttgcattctg

SEQ ID NO: 8165894 - DNA, 22 bp, Homo sapiens
cactccctctagttgcattctg

SEQ ID NO: 8165895 - DNA, 22 bp, Homo sapiens
cactccagcctcagtgacagag

SEQ ID NO: 8165896 - DNA, 22 bp, Homo sapiens
cactccaggtcccagttcctgg

SEQ ID NO: 8165897 - DNA, 22 bp, Homo sapiens
cactctccagcacaccccattt

SEQ ID NO: 8165898 - DNA, 21 bp, Homo sapiens
cactctcccaatccttgctga

SEQ ID NO: 8165899 - DNA, 21 bp, Homo sapiens
cactctcccaatccttgctga

SEQ ID NO: 8165900 - DNA, 21 bp, Homo sapiens
cactctcccaatccttgctga

SEQ ID NO: 8165901 - DNA, 22 bp, Homo sapiens
cactctcagcataatgaatgtg

SEQ ID NO: 8165902 - DNA, 22 bp, Homo sapiens
cactctcactgagctcatgcca

SEQ ID NO: 8165903 - DNA, 23 bp, Homo sapiens
cactcctgtttctaagccagcat

SEQ ID NO: 8165904 - DNA, 23 bp, Homo sapiens
cactcctgtttctaagccagcat

SEQ ID NO: 8165905 - DNA, 22 bp, Homo sapiens
cactctcacatgccctgtcagt

SEQ ID NO: 8165906 - DNA, 22 bp, Homo sapiens
caccaggctgaaccagagggga

SEQ ID NO: 8165907 - DNA, 22 bp, Homo sapiens
caccaggctgagcctctcatct

SEQ ID NO: 8165908 - DNA, 22 bp, Homo sapiens
caccaggctgagcctctcatct

SEQ ID NO: 8165909 - DNA, 22 bp, Homo sapiens
caccaggctgaaccagagggga

SEQ ID NO: 8165910 - DNA, 22 bp, Homo sapiens
caccaggctgaaccagagggga

SEQ ID NO: 8165911 - DNA, 20 bp, Homo sapiens
caccaggcgctctgagaaca

SEQ ID NO: 8165912 - DNA, 22 bp, Homo sapiens
caccaggctgcccaggacaggg

SEQ ID NO: 8165913 - DNA, 22 bp, Homo sapiens
caccaggctgcccaggacaggg

SEQ ID NO: 8165914 - DNA, 22 bp, Homo sapiens
caccaggctgcccaggacaggg

SEQ ID NO: 8165915 - DNA, 22 bp, Homo sapiens
caccaggctgcccaggacaggg

SEQ ID NO: 8165916 - DNA, 22 bp, Homo sapiens
caccaggctgcccaggacaggg

SEQ ID NO: 8165917 - DNA, 22 bp, Homo sapiens
caccaggctgcccaggacaggg

SEQ ID NO: 8165918 - DNA, 22 bp, Homo sapiens
caccaggctgcccaggacaggg

SEQ ID NO: 8165919 - DNA, 22 bp, Homo sapiens
caccaggcacagctctcctgct

SEQ ID NO: 8165920 - DNA, 22 bp, Homo sapiens
caccaggcacatagtaggcact

SEQ ID NO: 8165921 - DNA, 22 bp, Homo sapiens
caccaggcacatagtaggcact

SEQ ID NO: 8165922 - DNA, 22 bp, Homo sapiens
caccaggctgaaccagagggga

SEQ ID NO: 8165923 - DNA, 20 bp, Homo sapiens
caccaggcgctctgagaaca

SEQ ID NO: 8165924 - DNA, 22 bp, Homo sapiens
caccaggatgggcaggtaggtc

SEQ ID NO: 8165925 - DNA, 22 bp, Homo sapiens
caccaggcacagctctcctgct

SEQ ID NO: 8165926 - DNA, 22 bp, Homo sapiens
cacctgcctgctagagcctgac

SEQ ID NO: 8165927 - DNA, 22 bp, Homo sapiens
cacctgcctgcaggggctccac

SEQ ID NO: 8165928 - DNA, 22 bp, Homo sapiens
cacctgcctgcaggggctccac

SEQ ID NO: 8165929 - DNA, 22 bp, Homo sapiens
cacctgcctcatttgtccctgc

SEQ ID NO: 8165930 - DNA, 22 bp, Homo sapiens
cacctgccctttcttgctccac

SEQ ID NO: 8165931 - DNA, 22 bp, Homo sapiens
cacctgccccagtcttggagct

SEQ ID NO: 8165932 - DNA, 22 bp, Homo sapiens
cacctgccccagtcttggagct

SEQ ID NO: 8165933 - DNA, 22 bp, Homo sapiens
caccaggctggagtgcagaggt

SEQ ID NO: 8165934 - DNA, 22 bp, Homo sapiens
caccaggctggagtgcagaggt

SEQ ID NO: 8165935 - DNA, 22 bp, Homo sapiens
caccaggctggagtgcagaggt

SEQ ID NO: 8165936 - DNA, 22 bp, Homo sapiens
caccaggctggagtgcagaggt

SEQ ID NO: 8165937 - DNA, 22 bp, Homo sapiens
caccaggctggagtgcagaggt

SEQ ID NO: 8165938 - DNA, 22 bp, Homo sapiens
caccaggctggagtgcagaggt

SEQ ID NO: 8165939 - DNA, 22 bp, Homo sapiens
caccaggctggagtgcagaggt

SEQ ID NO: 8165940 - DNA, 22 bp, Homo sapiens
cacctgcccagcacctgggatc

SEQ ID NO: 8165941 - DNA, 22 bp, Homo sapiens
cacctgccaaatggggatgctg

SEQ ID NO: 8165942 - DNA, 22 bp, Homo sapiens
caccctgggctgggcctgttaa

SEQ ID NO: 8165943 - DNA, 22 bp, Homo sapiens
caccctgggctgggcctgttaa

SEQ ID NO: 8165944 - DNA, 22 bp, Homo sapiens
caccctgggctgggcctgttaa

SEQ ID NO: 8165945 - DNA, 22 bp, Homo sapiens
caccctgggctgggcctgttaa

SEQ ID NO: 8165946 - DNA, 22 bp, Homo sapiens
cacctgcctggtccttagggct

SEQ ID NO: 8165947 - DNA, 22 bp, Homo sapiens
cacctgcctggtccttagggct

SEQ ID NO: 8165948 - DNA, 22 bp, Homo sapiens
cacctggaccctgggaggaggg

SEQ ID NO: 8165949 - DNA, 22 bp, Homo sapiens
cacctggcccagctccagtgct

SEQ ID NO: 8165950 - DNA, 23 bp, Homo sapiens
cacctggcttgagttggtgggtc

SEQ ID NO: 8165951 - DNA, 22 bp, Homo sapiens
cacctgggctaaactatgcagg

SEQ ID NO: 8165952 - DNA, 23 bp, Homo sapiens
cacctggcttgagttggtgggtc

SEQ ID NO: 8165953 - DNA, 22 bp, Homo sapiens
cacctgggctaaactatgcagg

SEQ ID NO: 8165954 - DNA, 22 bp, Homo sapiens
cacctggctgtgaagcctgggt

SEQ ID NO: 8165955 - DNA, 20 bp, Homo sapiens
cacctggctgactgtctcca

SEQ ID NO: 8165956 - DNA, 22 bp, Homo sapiens
cacctggcctacagggaccagc

SEQ ID NO: 8165957 - DNA, 22 bp, Homo sapiens
ggccaggctggtctcagacttc

SEQ ID NO: 8165958 - DNA, 22 bp, Homo sapiens
ggccaggctggtctcagacttc

SEQ ID NO: 8165959 - DNA, 22 bp, Homo sapiens
ggccaggctggtctcagacttc

SEQ ID NO: 8165960 - DNA, 22 bp, Homo sapiens
ggccaggctggttccttgacct

SEQ ID NO: 8165961 - DNA, 22 bp, Homo sapiens
ggccaggctggttccttgacct

SEQ ID NO: 8165962 - DNA, 22 bp, Homo sapiens
ggccaggctggttccttgacct

SEQ ID NO: 8165963 - DNA, 22 bp, Homo sapiens
ggccaggctgctgggaccccgc

SEQ ID NO: 8165964 - DNA, 22 bp, Homo sapiens
ggccaggctggtctcagacttc

SEQ ID NO: 8165965 - DNA, 22 bp, Homo sapiens
ggccaggctgctgggaccccgc

SEQ ID NO: 8165966 - DNA, 22 bp, Homo sapiens
ggccaggctgctgggaccccgc

SEQ ID NO: 8165967 - DNA, 22 bp, Homo sapiens
ggccaggctgctgggaccccgc

SEQ ID NO: 8165968 - DNA, 22 bp, Homo sapiens
ggccaggctgccctgggagcag

SEQ ID NO: 8165969 - DNA, 22 bp, Homo sapiens
cacctgggctttctctggaact

SEQ ID NO: 8165970 - DNA, 22 bp, Homo sapiens
ggccaggctgccctgggagcag

SEQ ID NO: 8165971 - DNA, 22 bp, Homo sapiens
cacctgggctttctctgggact

SEQ ID NO: 8165972 - DNA, 22 bp, Homo sapiens
cacctgggctttctctgggact

SEQ ID NO: 8165973 - DNA, 22 bp, Homo sapiens
ggccaggctgccctgggagcag

SEQ ID NO: 8165974 - DNA, 22 bp, Homo sapiens
ggccaggctgccctgggagcag

SEQ ID NO: 8165975 - DNA, 22 bp, Homo sapiens
ggccaggctgccctgggagcag

SEQ ID NO: 8165976 - DNA, 21 bp, Homo sapiens
cactgtatagcaggagaaaac

SEQ ID NO: 8165977 - DNA, 22 bp, Homo sapiens
cactgtactgtgaataaggagg

SEQ ID NO: 8165978 - DNA, 22 bp, Homo sapiens
cactgtactgtgaataaggagg

SEQ ID NO: 8165979 - DNA, 22 bp, Homo sapiens
cactgtactgtgaataaggagg

SEQ ID NO: 8165980 - DNA, 22 bp, Homo sapiens
ggctctgctggattgaggccag

SEQ ID NO: 8165981 - DNA, 22 bp, Homo sapiens
ggctctgctggattgaggccag

SEQ ID NO: 8165982 - DNA, 22 bp, Homo sapiens
cactgtccaatagatacataat

SEQ ID NO: 8165983 - DNA, 22 bp, Homo sapiens
cactgtccaatagatacataat

SEQ ID NO: 8165984 - DNA, 22 bp, Homo sapiens
cactgtcacgttctgaaactgt

SEQ ID NO: 8165985 - DNA, 22 bp, Homo sapiens
cactgtcacgttctgaaactgt

SEQ ID NO: 8165986 - DNA, 22 bp, Homo sapiens
cactgtattattaggaatgaca

SEQ ID NO: 8165987 - DNA, 22 bp, Homo sapiens
ggctctgcttcctggaattgtg

SEQ ID NO: 8165988 - DNA, 22 bp, Homo sapiens
ggctctgcttcagaaggctcat

SEQ ID NO: 8165989 - DNA, 22 bp, Homo sapiens
ggctctgctggattgaggccag

SEQ ID NO: 8165990 - DNA, 22 bp, Homo sapiens
ggctctgctggtaagatgcctc

SEQ ID NO: 8165991 - DNA, 22 bp, Homo sapiens
ggctctgctggtaagatgcctc

SEQ ID NO: 8165992 - DNA, 22 bp, Homo sapiens
ggctctgcttcagaaggctcat

SEQ ID NO: 8165993 - DNA, 22 bp, Homo sapiens
ggctctgctggtaagatgcctc

SEQ ID NO: 8165994 - DNA, 22 bp, Homo sapiens
ggctctgcttcagaaggctcat

SEQ ID NO: 8165995 - DNA, 22 bp, Homo sapiens
cactgggatttggggtgtctta

SEQ ID NO: 8165996 - DNA, 22 bp, Homo sapiens
cactgggcaattctgagcctaa

SEQ ID NO: 8165997 - DNA, 22 bp, Homo sapiens
cactggtgccagagaacagaat

SEQ ID NO: 8165998 - DNA, 22 bp, Homo sapiens
cactgtacccatttaaataaat

SEQ ID NO: 8165999 - DNA, 22 bp, Homo sapiens
cactgtaaagcgtcacagggac

SEQ ID NO: 8166000 - DNA, 22 bp, Homo sapiens
cactgcactccagcctgggtga

SEQ ID NO: 8166001 - DNA, 22 bp, Homo sapiens
cactgcactccagcctgggtca

SEQ ID NO: 8166002 - DNA, 22 bp, Homo sapiens
cactgcactccagcctgggtca

SEQ ID NO: 8166003 - DNA, 22 bp, Homo sapiens
cactgcactccagcctgggtca

SEQ ID NO: 8166004 - DNA, 22 bp, Homo sapiens
cactgcactccagcctgggtca

SEQ ID NO: 8166005 - DNA, 22 bp, Homo sapiens
cactgcactccagcctgggcaa

SEQ ID NO: 8166006 - DNA, 22 bp, Homo sapiens
cactgcactccagcctgggtca

SEQ ID NO: 8166007 - DNA, 22 bp, Homo sapiens
cactgcactccagcctgggtca

SEQ ID NO: 8166008 - DNA, 22 bp, Homo sapiens
cactgcactccagcctgggtga

SEQ ID NO: 8166009 - DNA, 22 bp, Homo sapiens
cactgcactccagctgggtgac

SEQ ID NO: 8166010 - DNA, 22 bp, Homo sapiens
cactgcactccagcttgggtga

SEQ ID NO: 8166011 - DNA, 22 bp, Homo sapiens
cactgcactccagcctgggtga

SEQ ID NO: 8166012 - DNA, 22 bp, Homo sapiens
cactgcactccagcctgggtga

SEQ ID NO: 8166013 - DNA, 22 bp, Homo sapiens
cactgcactccagcctgggtga

SEQ ID NO: 8166014 - DNA, 22 bp, Homo sapiens
cactgcactccagcctgggtga

SEQ ID NO: 8166015 - DNA, 22 bp, Homo sapiens
cacttcagctacaatcacatga

SEQ ID NO: 8166016 - DNA, 22 bp, Homo sapiens
cacttcattgggaccagggctg

SEQ ID NO: 8166017 - DNA, 22 bp, Homo sapiens
cacttccagagtctgggctggg

SEQ ID NO: 8166018 - DNA, 22 bp, Homo sapiens
cacttaagcagttaatttatct

SEQ ID NO: 8166019 - DNA, 22 bp, Homo sapiens
cacttagtctcaccagttcagt

SEQ ID NO: 8166020 - DNA, 22 bp, Homo sapiens
cacttatctcatttaatcacca

SEQ ID NO: 8166021 - DNA, 22 bp, Homo sapiens
cacttattatgggctaggaact

SEQ ID NO: 8166022 - DNA, 22 bp, Homo sapiens
cacttatttatgcagaaaagtt

SEQ ID NO: 8166023 - DNA, 22 bp, Homo sapiens
ggctctggaaagtgtccttgat

SEQ ID NO: 8166024 - DNA, 22 bp, Homo sapiens
ggctctggaaagtgtccttgat

SEQ ID NO: 8166025 - DNA, 20 bp, Homo sapiens
ggctctgcttgtgagcagcc

SEQ ID NO: 8166026 - DNA, 22 bp, Homo sapiens
ggctctggaaagtgtccttgat

SEQ ID NO: 8166027 - DNA, 20 bp, Homo sapiens
ggctctgcttgtgagcagcc

SEQ ID NO: 8166028 - DNA, 20 bp, Homo sapiens
ggctctgcttgtgagcagcc

SEQ ID NO: 8166029 - DNA, 22 bp, Homo sapiens
ggctctggaaagtgtccttgat

SEQ ID NO: 8166030 - DNA, 22 bp, Homo sapiens
ggctctggaaagtgtccttgat

SEQ ID NO: 8166031 - DNA, 22 bp, Homo sapiens
ggctctggaaagtgtccttgat

SEQ ID NO: 8166032 - DNA, 20 bp, Homo sapiens
ggctctggaatctggtgggc

SEQ ID NO: 8166033 - DNA, 20 bp, Homo sapiens
ggctctggaatctggtgggc

SEQ ID NO: 8166034 - DNA, 20 bp, Homo sapiens
ggctctggaatctggtgggc

SEQ ID NO: 8166035 - DNA, 20 bp, Homo sapiens
ggctctggaatctggtgggc

SEQ ID NO: 8166036 - DNA, 20 bp, Homo sapiens
ggctctggaatctggtgggc

SEQ ID NO: 8166037 - DNA, 20 bp, Homo sapiens
ggctctggaatctggtgggc

SEQ ID NO: 8166038 - DNA, 22 bp, Homo sapiens
cactgtggcaacctgtgcccaa

SEQ ID NO: 8166039 - DNA, 20 bp, Homo sapiens
ggctctggaatctggtgggc

SEQ ID NO: 8166040 - DNA, 22 bp, Homo sapiens
cactgtggcaacctgtgcccaa

SEQ ID NO: 8166041 - DNA, 22 bp, Homo sapiens
cacttaaatctgttgagaaaaa

SEQ ID NO: 8166042 - DNA, 22 bp, Homo sapiens
cacttctcacaaagtgacattc

SEQ ID NO: 8166043 - DNA, 22 bp, Homo sapiens
cacttctctgataatctcagtt

SEQ ID NO: 8166044 - DNA, 22 bp, Homo sapiens
cacttgatatcttatatttaat

SEQ ID NO: 8166045 - DNA, 22 bp, Homo sapiens
cacttgcctacccttagaacgt

SEQ ID NO: 8166046 - DNA, 22 bp, Homo sapiens
cacttggaggaaggcctattca

SEQ ID NO: 8166047 - DNA, 20 bp, Homo sapiens
ggctgctgtgggcagagagg

SEQ ID NO: 8166048 - DNA, 22 bp, Homo sapiens
ggctggcaaaaaccttctctga

SEQ ID NO: 8166049 - DNA, 22 bp, Homo sapiens
ggctggatgtactttggggctg

SEQ ID NO: 8166050 - DNA, 22 bp, Homo sapiens
ggctggcaaaaaccttctctga

SEQ ID NO: 8166051 - DNA, 22 bp, Homo sapiens
ggctggcaaaaaccttctctga

SEQ ID NO: 8166052 - DNA, 22 bp, Homo sapiens
ggctggatttttggaaggagag

SEQ ID NO: 8166053 - DNA, 22 bp, Homo sapiens
ggctggcaagtcagtgctgatg

SEQ ID NO: 8166054 - DNA, 22 bp, Homo sapiens
ggctggcaagtcagtgctgatg

SEQ ID NO: 8166055 - DNA, 22 bp, Homo sapiens
ggctggcaagtcagtgctgatg

SEQ ID NO: 8166056 - DNA, 17 bp, Homo sapiens
ggctgctgtgctggtgc

SEQ ID NO: 8166057 - DNA, 17 bp, Homo sapiens
ggctgctgtgctggtgc

SEQ ID NO: 8166058 - DNA, 17 bp, Homo sapiens
ggctgctgtgctggtgc

SEQ ID NO: 8166059 - DNA, 22 bp, Homo sapiens
cactttaactcacatttcagct

SEQ ID NO: 8166060 - DNA, 22 bp, Homo sapiens
cactttaactcacatttcagct

SEQ ID NO: 8166061 - DNA, 22 bp, Homo sapiens
cacttgttggtggtgaaatcac

SEQ ID NO: 8166062 - DNA, 22 bp, Homo sapiens
cacttgttggtggtgaaatcac

SEQ ID NO: 8166063 - DNA, 22 bp, Homo sapiens
cacttgttggtggtgaaatcac

SEQ ID NO: 8166064 - DNA, 21 bp, Homo sapiens
cactttaaaaatatctttata

SEQ ID NO: 8166065 - DNA, 22 bp, Homo sapiens
cacttgttggtggtgaaatcac

SEQ ID NO: 8166066 - DNA, 22 bp, Homo sapiens
cacttgggattaggggctaggt

SEQ ID NO: 8166067 - DNA, 22 bp, Homo sapiens
cacatgtgtgctgaggactgtg

SEQ ID NO: 8166068 - DNA, 22 bp, Homo sapiens
cacatgtgtgctgaggactgtg

SEQ ID NO: 8166069 - DNA, 22 bp, Homo sapiens
cacatgtgtgctgaggactgtg

SEQ ID NO: 8166070 - DNA, 22 bp, Homo sapiens
cacatgtttcaggccatatttg

SEQ ID NO: 8166071 - DNA, 22 bp, Homo sapiens
cacatgtgcagttacatgaatt

SEQ ID NO: 8166072 - DNA, 22 bp, Homo sapiens
cacatgtgcaaatactgaggct

SEQ ID NO: 8166073 - DNA, 22 bp, Homo sapiens
cacatgtgcaaatactgaggct

SEQ ID NO: 8166074 - DNA, 21 bp, Homo sapiens
cacatgtgaattactgaactg

SEQ ID NO: 8166075 - DNA, 21 bp, Homo sapiens
cacatgtgaattactgaactg

SEQ ID NO: 8166076 - DNA, 22 bp, Homo sapiens
cacatgcttagatttcagtgga

SEQ ID NO: 8166077 - DNA, 22 bp, Homo sapiens
cacatgtgtatatgtgaggggg

SEQ ID NO: 8166078 - DNA, 22 bp, Homo sapiens
cacatgtgtatatgtgaggggg

SEQ ID NO: 8166079 - DNA, 22 bp, Homo sapiens
cacatgtgggaaatggtgctta

SEQ ID NO: 8166080 - DNA, 22 bp, Homo sapiens
cacatgtgggaaatggtgctta

SEQ ID NO: 8166081 - DNA, 22 bp, Homo sapiens
cacatgtgcagttacatgaatt

SEQ ID NO: 8166082 - DNA, 22 bp, Homo sapiens
cacatgtgcaaatactgaggct

SEQ ID NO: 8166083 - DNA, 22 bp, Homo sapiens
cacatgtgcagttacatgaatt

SEQ ID NO: 8166084 - DNA, 22 bp, Homo sapiens
cacattattctaaagaggtact

SEQ ID NO: 8166085 - DNA, 20 bp, Homo sapiens
cacattaaggaaaacaactg

SEQ ID NO: 8166086 - DNA, 22 bp, Homo sapiens
cacattaaaatcctaacttcca

SEQ ID NO: 8166087 - DNA, 22 bp, Homo sapiens
cacattaaaatcctaacttcca

SEQ ID NO: 8166088 - DNA, 22 bp, Homo sapiens
cacattaagaataatgagacta

SEQ ID NO: 8166089 - DNA, 22 bp, Homo sapiens
cacattaaatagtagggatgct

SEQ ID NO: 8166090 - DNA, 22 bp, Homo sapiens
caccagctccaccagggcaggt

SEQ ID NO: 8166091 - DNA, 22 bp, Homo sapiens
caccagctccaccagggcaggt

SEQ ID NO: 8166092 - DNA, 22 bp, Homo sapiens
caccagctttgcccactgccca

SEQ ID NO: 8166093 - DNA, 22 bp, Homo sapiens
caccaggaccccacggtgggtt

SEQ ID NO: 8166094 - DNA, 22 bp, Homo sapiens
caccaggaccccacggtgggtt

SEQ ID NO: 8166095 - DNA, 22 bp, Homo sapiens
caccaggaagtggtggcctggg

SEQ ID NO: 8166096 - DNA, 22 bp, Homo sapiens
caccaggagcatctaggaggcg

SEQ ID NO: 8166097 - DNA, 22 bp, Homo sapiens
caccaggagccatcaggagtcc

SEQ ID NO: 8166098 - DNA, 22 bp, Homo sapiens
caccaggagccatcaggagtcc

SEQ ID NO: 8166099 - DNA, 22 bp, Homo sapiens
caccactgcttcctgccatctg

SEQ ID NO: 8166100 - DNA, 22 bp, Homo sapiens
cacattcctgagcttcgacctg

SEQ ID NO: 8166101 - DNA, 22 bp, Homo sapiens
cacattcaggtggcatgttaga

SEQ ID NO: 8166102 - DNA, 22 bp, Homo sapiens
cacatgcaagtcctcagttcta

SEQ ID NO: 8166103 - DNA, 22 bp, Homo sapiens
cacatgcaccagaaatcaacat

SEQ ID NO: 8166104 - DNA, 22 bp, Homo sapiens
cacatgatggtggaagccatag

SEQ ID NO: 8166105 - DNA, 22 bp, Homo sapiens
cacatgcaggagccaatgtaca

SEQ ID NO: 8166106 - DNA, 22 bp, Homo sapiens
cacatgcaggagccaatgtaca

SEQ ID NO: 8166107 - DNA, 22 bp, Homo sapiens
ggcagaggtgacagtgtctttt

SEQ ID NO: 8166108 - DNA, 22 bp, Homo sapiens
ggcagaggtgacagtgtctttt

SEQ ID NO: 8166109 - DNA, 22 bp, Homo sapiens
ggcagagtcagaggtggttctg

SEQ ID NO: 8166110 - DNA, 22 bp, Homo sapiens
ggcagagtgctctgggcagggg

SEQ ID NO: 8166111 - DNA, 22 bp, Homo sapiens
ggcagagtgctctgggcagggg

SEQ ID NO: 8166112 - DNA, 22 bp, Homo sapiens
ggcagagtgctctgggcagggg

SEQ ID NO: 8166113 - DNA, 22 bp, Homo sapiens
ggcagagtcagaggtggttctg

SEQ ID NO: 8166114 - DNA, 22 bp, Homo sapiens
ggcagagtggagtgcggcctcc

SEQ ID NO: 8166115 - DNA, 22 bp, Homo sapiens
ggcagagttggtggagtcagtt

SEQ ID NO: 8166116 - DNA, 22 bp, Homo sapiens
ggcagagttggtggagtcagtt

SEQ ID NO: 8166117 - DNA, 22 bp, Homo sapiens
ggcagagtggagtgcggcctcc

SEQ ID NO: 8166118 - DNA, 22 bp, Homo sapiens
ggcagagttggtggagtcagtt

SEQ ID NO: 8166119 - DNA, 22 bp, Homo sapiens
ggcagatggaagaggctgggtc

SEQ ID NO: 8166120 - DNA, 22 bp, Homo sapiens
ggcagatggaagaggctgggtc

SEQ ID NO: 8166121 - DNA, 22 bp, Homo sapiens
ggcagatggaagaggctgggtc

SEQ ID NO: 8166122 - DNA, 20 bp, Homo sapiens
cacatgctgtgtgtttctct

SEQ ID NO: 8166123 - DNA, 22 bp, Homo sapiens
cacatgctccatacagaatggg

SEQ ID NO: 8166124 - DNA, 18 bp, Homo sapiens
ggcagatgacaggagaga

SEQ ID NO: 8166125 - DNA, 18 bp, Homo sapiens
ggcagatgacaggagaga

SEQ ID NO: 8166126 - DNA, 22 bp, Homo sapiens
ggcaatcattggcattctctgg

SEQ ID NO: 8166127 - DNA, 22 bp, Homo sapiens
ggcaatatggtgaaaccccatc

SEQ ID NO: 8166128 - DNA, 22 bp, Homo sapiens
ggcaattttaggcatgaatgaa

SEQ ID NO: 8166129 - DNA, 22 bp, Homo sapiens
ggcaatttgcagtttgtcttat

SEQ ID NO: 8166130 - DNA, 22 bp, Homo sapiens
ggcaatttggtcatttgtattg

SEQ ID NO: 8166131 - DNA, 16 bp, Homo sapiens
cacatatatttatatg

SEQ ID NO: 8166132 - DNA, 22 bp, Homo sapiens
cacatatatgggcccctgaggg

SEQ ID NO: 8166133 - DNA, 16 bp, Homo sapiens
cacatatatttatatg

SEQ ID NO: 8166134 - DNA, 22 bp, Homo sapiens
cacatgaagattcaactggatg

SEQ ID NO: 8166135 - DNA, 22 bp, Homo sapiens
cacatgaaggctggggtcgtga

SEQ ID NO: 8166136 - DNA, 22 bp, Homo sapiens
cacatgaaggctggggtcgtga

SEQ ID NO: 8166137 - DNA, 22 bp, Homo sapiens
cacatgaaggctggggtcgtga

SEQ ID NO: 8166138 - DNA, 22 bp, Homo sapiens
cacatgaaggctggggtcgtga

SEQ ID NO: 8166139 - DNA, 22 bp, Homo sapiens
cacatgaattgatgccaagtgc

SEQ ID NO: 8166140 - DNA, 22 bp, Homo sapiens
cacatgaataaggctttattgt

SEQ ID NO: 8166141 - DNA, 22 bp, Homo sapiens
cacatgactctggctacccaga

SEQ ID NO: 8166142 - DNA, 22 bp, Homo sapiens
cacatgagacaattaaagactt

SEQ ID NO: 8166143 - DNA, 22 bp, Homo sapiens
cacatgagagcccccaagagca

SEQ ID NO: 8166144 - DNA, 22 bp, Homo sapiens
ggcaagggacggccgtgagaca

SEQ ID NO: 8166145 - DNA, 22 bp, Homo sapiens
cacagtgcatgatgggcagaag

SEQ ID NO: 8166146 - DNA, 22 bp, Homo sapiens
ggcaaggggtcaggctgagaca

SEQ ID NO: 8166147 - DNA, 22 bp, Homo sapiens
ggcaaggggtcaggctgagaca

SEQ ID NO: 8166148 - DNA, 22 bp, Homo sapiens
ggcaaggtgatgaatgtctaca

SEQ ID NO: 8166149 - DNA, 22 bp, Homo sapiens
ggcaaggtgctacagacagtga

SEQ ID NO: 8166150 - DNA, 17 bp, Homo sapiens
ggcaaggttccttttca

SEQ ID NO: 8166151 - DNA, 22 bp, Homo sapiens
ggcaaggtactctagagcacat

SEQ ID NO: 8166152 - DNA, 22 bp, Homo sapiens
ggcaagggttgaagataaggta

SEQ ID NO: 8166153 - DNA, 22 bp, Homo sapiens
ggcaagtgcttccccaaccaca

SEQ ID NO: 8166154 - DNA, 22 bp, Homo sapiens
ggcaagtggaggtgttcatcag

SEQ ID NO: 8166155 - DNA, 22 bp, Homo sapiens
cacagtgactggcacctagtat

SEQ ID NO: 8166156 - DNA, 22 bp, Homo sapiens
cacagtgattgatttttacttt

SEQ ID NO: 8166157 - DNA, 22 bp, Homo sapiens
cacagtgacattagtgagaaaa

SEQ ID NO: 8166158 - DNA, 22 bp, Homo sapiens
cacagtgactggcacatagtaa

SEQ ID NO: 8166159 - DNA, 22 bp, Homo sapiens
cacagtgacctctttaaaaggg

SEQ ID NO: 8166160 - DNA, 22 bp, Homo sapiens
cacagtgactggcacatagtaa

SEQ ID NO: 8166161 - DNA, 22 bp, Homo sapiens
cacagtgacagctatacagaga

SEQ ID NO: 8166162 - DNA, 22 bp, Homo sapiens
cacagtgacattagtgagaaaa

SEQ ID NO: 8166163 - DNA, 22 bp, Homo sapiens
cacagtgacattagtgagaaaa

SEQ ID NO: 8166164 - DNA, 22 bp, Homo sapiens
cacagtgacagctatacagaga

SEQ ID NO: 8166165 - DNA, 22 bp, Homo sapiens
cacagtgaatttcaagtgttgt

SEQ ID NO: 8166166 - DNA, 22 bp, Homo sapiens
cacaggtgttcttgcagtgaaa

SEQ ID NO: 8166167 - DNA, 22 bp, Homo sapiens
cacaggtgtgtgccttatcaaa

SEQ ID NO: 8166168 - DNA, 22 bp, Homo sapiens
cacaggtgtgtcctggtcttgt

SEQ ID NO: 8166169 - DNA, 22 bp, Homo sapiens
cacaggtgtgtcctggtcttgt

SEQ ID NO: 8166170 - DNA, 22 bp, Homo sapiens
cacaggtgtttgttatactcag

SEQ ID NO: 8166171 - DNA, 23 bp, Homo sapiens
cacaggtgtttcatcttctcagt

SEQ ID NO: 8166172 - DNA, 22 bp, Homo sapiens
cacaggtgttcttgcagtgaaa

SEQ ID NO: 8166173 - DNA, 22 bp, Homo sapiens
cacaggtgttcttgcagtgaaa

SEQ ID NO: 8166174 - DNA, 22 bp, Homo sapiens
cacaggtgtccaatacctgctt

SEQ ID NO: 8166175 - DNA, 22 bp, Homo sapiens
cacaggtgtctctagtagcgtt

SEQ ID NO: 8166176 - DNA, 17 bp, Homo sapiens
cacaggtgtggtttgag

SEQ ID NO: 8166177 - DNA, 21 bp, Homo sapiens
cacaggtgggtcagtgaggcc

SEQ ID NO: 8166178 - DNA, 22 bp, Homo sapiens
cacaggtggcttctttcatctt

SEQ ID NO: 8166179 - DNA, 22 bp, Homo sapiens
cacaggtgtatgaatatgtcca

SEQ ID NO: 8166180 - DNA, 22 bp, Homo sapiens
cacagtaaccccaggactggga

SEQ ID NO: 8166181 - DNA, 22 bp, Homo sapiens
cacaggttcaaattcaggtcgc

SEQ ID NO: 8166182 - DNA, 22 bp, Homo sapiens
cacaggttcacctcaggtaggt

SEQ ID NO: 8166183 - DNA, 22 bp, Homo sapiens
cacaggttaggtattatactat

SEQ ID NO: 8166184 - DNA, 22 bp, Homo sapiens
cacaggtttgacaaggataaaa

SEQ ID NO: 8166185 - DNA, 22 bp, Homo sapiens
cacaggttgggggagttgataa

SEQ ID NO: 8166186 - DNA, 22 bp, Homo sapiens
cacaggttcaaattcaggtcgc

SEQ ID NO: 8166187 - DNA, 22 bp, Homo sapiens
cacagtgaacattctgtcaggg

SEQ ID NO: 8166188 - DNA, 22 bp, Homo sapiens
cacagtcctgccagagggcctt

SEQ ID NO: 8166189 - DNA, 22 bp, Homo sapiens
cacagtcctgccagagggcctt

SEQ ID NO: 8166190 - DNA, 22 bp, Homo sapiens
cacagtctctgttgctgggacc

SEQ ID NO: 8166191 - DNA, 22 bp, Homo sapiens
cacaggagtgctgctattgttg

SEQ ID NO: 8166192 - DNA, 22 bp, Homo sapiens
cacaggagtgctgctattgttg

SEQ ID NO: 8166193 - DNA, 22 bp, Homo sapiens
cacaggagttaacataattaag

SEQ ID NO: 8166194 - DNA, 22 bp, Homo sapiens
cacaggagtgctgctattgttg

SEQ ID NO: 8166195 - DNA, 22 bp, Homo sapiens
cacaggagttaacataattaag

SEQ ID NO: 8166196 - DNA, 18 bp, Homo sapiens
cacaggagccacactcac

SEQ ID NO: 8166197 - DNA, 22 bp, Homo sapiens
cacaggaggttaggaagtggtc

SEQ ID NO: 8166198 - DNA, 22 bp, Homo sapiens
cacaggaggttaggaagtggtc

SEQ ID NO: 8166199 - DNA, 22 bp, Homo sapiens
cacaggaggttaggaagtggtc

SEQ ID NO: 8166200 - DNA, 22 bp, Homo sapiens
cacaggaggttaggaagtggtc

SEQ ID NO: 8166201 - DNA, 22 bp, Homo sapiens
cacaggaggttaggaagtggtc

SEQ ID NO: 8166202 - DNA, 22 bp, Homo sapiens
ggagagctagtgcctgccagta

SEQ ID NO: 8166203 - DNA, 22 bp, Homo sapiens
cacaggagattgatctattggt

SEQ ID NO: 8166204 - DNA, 18 bp, Homo sapiens
cacaggagccacactcac

SEQ ID NO: 8166205 - DNA, 23 bp, Homo sapiens
cacaggcagaaatcaagacggta

SEQ ID NO: 8166206 - DNA, 23 bp, Homo sapiens
cacaggcagaaatcaagacggta

SEQ ID NO: 8166207 - DNA, 22 bp, Homo sapiens
cacaggcacccctgactgctca

SEQ ID NO: 8166208 - DNA, 22 bp, Homo sapiens
cacaggcacccctgactgctca

SEQ ID NO: 8166209 - DNA, 22 bp, Homo sapiens
cacaggcacccctgactgctca

SEQ ID NO: 8166210 - DNA, 22 bp, Homo sapiens
cacaggcacgcctctggccagg

SEQ ID NO: 8166211 - DNA, 22 bp, Homo sapiens
cacaggcacgcctctggccagg

SEQ ID NO: 8166212 - DNA, 22 bp, Homo sapiens
cacaggcacccctgactgctca

SEQ ID NO: 8166213 - DNA, 22 bp, Homo sapiens
cacaggcagccttgtagaagaa

SEQ ID NO: 8166214 - DNA, 22 bp, Homo sapiens
cacaggcagccttgtagaagaa

SEQ ID NO: 8166215 - DNA, 22 bp, Homo sapiens
cacaggcagccttgtagaagaa

SEQ ID NO: 8166216 - DNA, 22 bp, Homo sapiens
cacaggcaggaggttctccagt

SEQ ID NO: 8166217 - DNA, 18 bp, Homo sapiens
cacaggcaggtgataggt

SEQ ID NO: 8166218 - DNA, 18 bp, Homo sapiens
cacaggcaggtgataggt

SEQ ID NO: 8166219 - DNA, 18 bp, Homo sapiens
cacaggcaggtgataggt

SEQ ID NO: 8166220 - DNA, 18 bp, Homo sapiens
cacaggcaggtgataggt

SEQ ID NO: 8166221 - DNA, 22 bp, Homo sapiens
cacaggcaggaggttctccagt

SEQ ID NO: 8166222 - DNA, 22 bp, Homo sapiens
cacaggccaataccctctctct

SEQ ID NO: 8166223 - DNA, 22 bp, Homo sapiens
cacaggccaataccctctctct

SEQ ID NO: 8166224 - DNA, 18 bp, Homo sapiens
cacaggcaggtgataggt

SEQ ID NO: 8166225 - DNA, 22 bp, Homo sapiens
cacaggccagtaagactgtgtt

SEQ ID NO: 8166226 - DNA, 20 bp, Homo sapiens
cacaggccccaagacctgta

SEQ ID NO: 8166227 - DNA, 20 bp, Homo sapiens
cacaggccccaagacctgta

SEQ ID NO: 8166228 - DNA, 22 bp, Homo sapiens
cacaggccagtaagactgtgtt

SEQ ID NO: 8166229 - DNA, 22 bp, Homo sapiens
cacaggccagtaagactgtgtt

SEQ ID NO: 8166230 - DNA, 20 bp, Homo sapiens
cacaggccttgtgagcagac

SEQ ID NO: 8166231 - DNA, 22 bp, Homo sapiens
cacaggcctgtctctttctaac

SEQ ID NO: 8166232 - DNA, 22 bp, Homo sapiens
cacaggcctggggttgagcggg

SEQ ID NO: 8166233 - DNA, 22 bp, Homo sapiens
cacaggcctgtctctttctaac

SEQ ID NO: 8166234 - DNA, 22 bp, Homo sapiens
cacaggcctggggttgagcggg

SEQ ID NO: 8166235 - DNA, 22 bp, Homo sapiens
cacagggcaggtactctcagag

SEQ ID NO: 8166236 - DNA, 22 bp, Homo sapiens
cacagggcaggccccaggcctc

SEQ ID NO: 8166237 - DNA, 20 bp, Homo sapiens
cacaggccttgtgagcagac

SEQ ID NO: 8166238 - DNA, 20 bp, Homo sapiens
cacaggccttgtgagcagac

SEQ ID NO: 8166239 - DNA, 22 bp, Homo sapiens
cacaggtgccatctcttcatgg

SEQ ID NO: 8166240 - DNA, 22 bp, Homo sapiens
cacaggtgcaagaagttgcagt

SEQ ID NO: 8166241 - DNA, 22 bp, Homo sapiens
cacaggtgctcctcggggagct

SEQ ID NO: 8166242 - DNA, 22 bp, Homo sapiens
cacaggtggctccaagttagag

SEQ ID NO: 8166243 - DNA, 22 bp, Homo sapiens
cacaggtatatgtgtatatact

SEQ ID NO: 8166244 - DNA, 22 bp, Homo sapiens
cacaggtccttcctgccctggg

SEQ ID NO: 8166245 - DNA, 22 bp, Homo sapiens
cacaggggcaaactgtagggga

SEQ ID NO: 8166246 - DNA, 22 bp, Homo sapiens
cacagggctttgatggctgagt

SEQ ID NO: 8166247 - DNA, 22 bp, Homo sapiens
caatgttttgttgaatgaatag

SEQ ID NO: 8166248 - DNA, 22 bp, Homo sapiens
caatgttttcaactgacaagta

SEQ ID NO: 8166249 - DNA, 22 bp, Homo sapiens
caatcccatcaccatctgctct

SEQ ID NO: 8166250 - DNA, 22 bp, Homo sapiens
caatccagtttctgtcagctac

SEQ ID NO: 8166251 - DNA, 22 bp, Homo sapiens
caatcatttatgcttgcggagg

SEQ ID NO: 8166252 - DNA, 22 bp, Homo sapiens
caatcatggtataattcctttt

SEQ ID NO: 8166253 - DNA, 22 bp, Homo sapiens
caatcacaaagagacaagtgtc

SEQ ID NO: 8166254 - DNA, 22 bp, Homo sapiens
caatcacaaagagacaagtgtc

SEQ ID NO: 8166255 - DNA, 19 bp, Homo sapiens
caattctgcaacactgtcc

SEQ ID NO: 8166256 - DNA, 22 bp, Homo sapiens
caattcccagctgccgggctgc

SEQ ID NO: 8166257 - DNA, 22 bp, Homo sapiens
caattcattacattgcaaagac

SEQ ID NO: 8166258 - DNA, 22 bp, Homo sapiens
caattctttcagctgcatttgt

SEQ ID NO: 8166259 - DNA, 22 bp, Homo sapiens
caattcttggagaagaagcata

SEQ ID NO: 8166260 - DNA, 22 bp, Homo sapiens
caattgtgaagacaacagctta

SEQ ID NO: 8166261 - DNA, 22 bp, Homo sapiens
caattctttgtagaagctctcc

SEQ ID NO: 8166262 - DNA, 20 bp, Homo sapiens
caatttcatcatttcctgtg

SEQ ID NO: 8166263 - DNA, 18 bp, Homo sapiens
caatttcatccttaagcc

SEQ ID NO: 8166264 - DNA, 22 bp, Homo sapiens
caatttcatgccatgtattgct

SEQ ID NO: 8166265 - DNA, 22 bp, Homo sapiens
caatttcatgccatgtattgct

SEQ ID NO: 8166266 - DNA, 22 bp, Homo sapiens
caatttcatgccatgtattgct

SEQ ID NO: 8166267 - DNA, 22 bp, Homo sapiens
caatttcatgccatgtattgct

SEQ ID NO: 8166268 - DNA, 22 bp, Homo sapiens
caatttcattaatagatataga

SEQ ID NO: 8166269 - DNA, 21 bp, Homo sapiens
caatttcatgggaagatggga

SEQ ID NO: 8166270 - DNA, 22 bp, Homo sapiens
caatttccttcatagatgactg

SEQ ID NO: 8166271 - DNA, 22 bp, Homo sapiens
caatttcattaatagatataga

SEQ ID NO: 8166272 - DNA, 22 bp, Homo sapiens
ggaagagcctggggtgtcaggc

SEQ ID NO: 8166273 - DNA, 22 bp, Homo sapiens
caatttctaacattccatggat

SEQ ID NO: 8166274 - DNA, 22 bp, Homo sapiens
caatttcactaatgatgtgggg

SEQ ID NO: 8166275 - DNA, 22 bp, Homo sapiens
caatttcaggtggataggtttt

SEQ ID NO: 8166276 - DNA, 22 bp, Homo sapiens
caatttcagacctttccttgga

SEQ ID NO: 8166277 - DNA, 22 bp, Homo sapiens
caatttcaggtggataggtttt

SEQ ID NO: 8166278 - DNA, 22 bp, Homo sapiens
caatttcaggtggataggtttt

SEQ ID NO: 8166279 - DNA, 17 bp, Homo sapiens
caatttcataggttttg

SEQ ID NO: 8166280 - DNA, 23 bp, Homo sapiens
caatttcatatgattctacctaa

SEQ ID NO: 8166281 - DNA, 23 bp, Homo sapiens
caatttcatatgattctacctaa

SEQ ID NO: 8166282 - DNA, 22 bp, Homo sapiens
caatttcactaataatatttac

SEQ ID NO: 8166283 - DNA, 22 bp, Homo sapiens
caatttcactaataatatttac

SEQ ID NO: 8166284 - DNA, 22 bp, Homo sapiens
caataactttgatattttgcgg

SEQ ID NO: 8166285 - DNA, 22 bp, Homo sapiens
caataagatgtattgagcagag

SEQ ID NO: 8166286 - DNA, 22 bp, Homo sapiens
caaggctgtgcagggtccatat

SEQ ID NO: 8166287 - DNA, 22 bp, Homo sapiens
caaggctgtgcagggtccatat

SEQ ID NO: 8166288 - DNA, 22 bp, Homo sapiens
caaggctgtctccagcttccaa

SEQ ID NO: 8166289 - DNA, 22 bp, Homo sapiens
caaggctgcttcagactagtga

SEQ ID NO: 8166290 - DNA, 22 bp, Homo sapiens
caaggctgctggcttctgagct

SEQ ID NO: 8166291 - DNA, 22 bp, Homo sapiens
caaggctgcttcagactagtga

SEQ ID NO: 8166292 - DNA, 22 bp, Homo sapiens
caaggctgcaaaactacatggg

SEQ ID NO: 8166293 - DNA, 22 bp, Homo sapiens
caaggctgcaaaactacatggg

SEQ ID NO: 8166294 - DNA, 22 bp, Homo sapiens
caaggctgagaaattctgccct

SEQ ID NO: 8166295 - DNA, 22 bp, Homo sapiens
caaggctgctgcgggtcgcacc

SEQ ID NO: 8166296 - DNA, 22 bp, Homo sapiens
caaggctgctgcgggtcgcacc

SEQ ID NO: 8166297 - DNA, 22 bp, Homo sapiens
caaggctgctgcgggtcgcacc

SEQ ID NO: 8166298 - DNA, 22 bp, Homo sapiens
gctggggagctagacctcagca

SEQ ID NO: 8166299 - DNA, 22 bp, Homo sapiens
gctggggaggcagcagagaaca

SEQ ID NO: 8166300 - DNA, 22 bp, Homo sapiens
gctggggaggcagcagagaaca

SEQ ID NO: 8166301 - DNA, 22 bp, Homo sapiens
gctggggaggcagcagagaaca

SEQ ID NO: 8166302 - DNA, 22 bp, Homo sapiens
caaggccttcttgggagagatt

SEQ ID NO: 8166303 - DNA, 22 bp, Homo sapiens
caatagaaggcacagataggta

SEQ ID NO: 8166304 - DNA, 20 bp, Homo sapiens
caatagaatgtggagataag

SEQ ID NO: 8166305 - DNA, 22 bp, Homo sapiens
caatagatacctttgtcccaat

SEQ ID NO: 8166306 - DNA, 22 bp, Homo sapiens
caatagcagacctagaaagcaa

SEQ ID NO: 8166307 - DNA, 22 bp, Homo sapiens
caatagaaaactcaatacttaa

SEQ ID NO: 8166308 - DNA, 22 bp, Homo sapiens
caatagaaggcacagataggta

SEQ ID NO: 8166309 - DNA, 18 bp, Homo sapiens
caatagaaacagtaggaa

SEQ ID NO: 8166310 - DNA, 22 bp, Homo sapiens
caatagaaaactcaatacttaa

SEQ ID NO: 8166311 - DNA, 22 bp, Homo sapiens
caatatataggaacaacttagg

SEQ ID NO: 8166312 - DNA, 22 bp, Homo sapiens
caatatataggaacaacttagg

SEQ ID NO: 8166313 - DNA, 22 bp, Homo sapiens
caatatataggaacaacttagg

SEQ ID NO: 8166314 - DNA, 19 bp, Homo sapiens
caatatatagtgagtggat

SEQ ID NO: 8166315 - DNA, 22 bp, Homo sapiens
caatatataatgagtactttcc

SEQ ID NO: 8166316 - DNA, 22 bp, Homo sapiens
caatatataatgagtactttcc

SEQ ID NO: 8166317 - DNA, 22 bp, Homo sapiens
caatatataatgagtactttcc

SEQ ID NO: 8166318 - DNA, 22 bp, Homo sapiens
caatagtaaattacggaggaga

SEQ ID NO: 8166319 - DNA, 22 bp, Homo sapiens
caatatataatgagtactttcc

SEQ ID NO: 8166320 - DNA, 22 bp, Homo sapiens
caatatagagagaaaattatgt

SEQ ID NO: 8166321 - DNA, 22 bp, Homo sapiens
caatatagagagaaaattatgt

SEQ ID NO: 8166322 - DNA, 22 bp, Homo sapiens
caatagtgtctgcttgtttcta

SEQ ID NO: 8166323 - DNA, 22 bp, Homo sapiens
ggaagctgaatccagagacagg

SEQ ID NO: 8166324 - DNA, 22 bp, Homo sapiens
ggaagctgaatccagagacagg

SEQ ID NO: 8166325 - DNA, 22 bp, Homo sapiens
ggaagctgaggcccagtgaagg

SEQ ID NO: 8166326 - DNA, 22 bp, Homo sapiens
ggaagctgcataactagcgtgg

SEQ ID NO: 8166327 - DNA, 22 bp, Homo sapiens
ggaagctgaggcccagtgaagg

SEQ ID NO: 8166328 - DNA, 22 bp, Homo sapiens
ggaagctgcagtcccccccaag

SEQ ID NO: 8166329 - DNA, 22 bp, Homo sapiens
ggaagctgaggcccagtgaagg

SEQ ID NO: 8166330 - DNA, 22 bp, Homo sapiens
ggaagctgcttagctaatgtag

SEQ ID NO: 8166331 - DNA, 22 bp, Homo sapiens
ggaagctgccagtccaccagct

SEQ ID NO: 8166332 - DNA, 22 bp, Homo sapiens
ggaagctgccagtccaccagct

SEQ ID NO: 8166333 - DNA, 22 bp, Homo sapiens
ggaagctgccagtccaccagct

SEQ ID NO: 8166334 - DNA, 22 bp, Homo sapiens
ggaagagctgcttagttttgat

SEQ ID NO: 8166335 - DNA, 22 bp, Homo sapiens
ggaagagcctggggtgtcaggc

SEQ ID NO: 8166336 - DNA, 22 bp, Homo sapiens
ggaagaggaggagccaggcttt

SEQ ID NO: 8166337 - DNA, 23 bp, Homo sapiens
ggaagctcacgtagtcctgcact

SEQ ID NO: 8166338 - DNA, 22 bp, Homo sapiens
ggaagctagttgtgtttcagga

SEQ ID NO: 8166339 - DNA, 22 bp, Homo sapiens
ggaagctaagataatttaagta

SEQ ID NO: 8166340 - DNA, 22 bp, Homo sapiens
ggaagctgaacttagcaaggaa

SEQ ID NO: 8166341 - DNA, 22 bp, Homo sapiens
ggaagctgaacttagcaaggaa

SEQ ID NO: 8166342 - DNA, 22 bp, Homo sapiens
ggaagctgaacttagcaaggaa

SEQ ID NO: 8166343 - DNA, 23 bp, Homo sapiens
ggaagctcacgtagtcctgcact

SEQ ID NO: 8166344 - DNA, 22 bp, Homo sapiens
ggaagctggtaattgttgggac

SEQ ID NO: 8166345 - DNA, 22 bp, Homo sapiens
ggaagctggggagctttggaga

SEQ ID NO: 8166346 - DNA, 22 bp, Homo sapiens
ggaagctgtgctctcaggcctc

SEQ ID NO: 8166347 - DNA, 22 bp, Homo sapiens
ggaagctgtgctctcaggcctc

SEQ ID NO: 8166348 - DNA, 22 bp, Homo sapiens
ggaagctgggatctctctcccg

SEQ ID NO: 8166349 - DNA, 22 bp, Homo sapiens
ggaagctggcatatgtaatcct

SEQ ID NO: 8166350 - DNA, 22 bp, Homo sapiens
ggaagctggctcttataaatat

SEQ ID NO: 8166351 - DNA, 22 bp, Homo sapiens
ggaagctggacaggctttgagt

SEQ ID NO: 8166352 - DNA, 22 bp, Homo sapiens
cacaaataccagtttcctaaca

SEQ ID NO: 8166353 - DNA, 22 bp, Homo sapiens
cacaaataccagtttcctaaca

SEQ ID NO: 8166354 - DNA, 20 bp, Homo sapiens
ggaagctgtgggtccccagg

SEQ ID NO: 8166355 - DNA, 20 bp, Homo sapiens
ggaagctgtgggtccccagg

SEQ ID NO: 8166356 - DNA, 22 bp, Homo sapiens
cacaaatgactgaaacgactgt

SEQ ID NO: 8166357 - DNA, 19 bp, Homo sapiens
cacaaatgatgaggacctg

SEQ ID NO: 8166358 - DNA, 22 bp, Homo sapiens
cacaaatgactgaaacgactgt

SEQ ID NO: 8166359 - DNA, 22 bp, Homo sapiens
cacaaatgactgaaacgactgt

SEQ ID NO: 8166360 - DNA, 22 bp, Homo sapiens
ggacatggaagtatggagtgga

SEQ ID NO: 8166361 - DNA, 18 bp, Homo sapiens
ggacaggagacatgggtg

SEQ ID NO: 8166362 - DNA, 20 bp, Homo sapiens
ggacaggaagacaacctacc

SEQ ID NO: 8166363 - DNA, 22 bp, Homo sapiens
ggacagcttgcctggtaatgca

SEQ ID NO: 8166364 - DNA, 22 bp, Homo sapiens
cacaaatggccgtgttcaaaga

SEQ ID NO: 8166365 - DNA, 22 bp, Homo sapiens
cacaaatggccgtgttcaaaga

SEQ ID NO: 8166366 - DNA, 22 bp, Homo sapiens
cacaaatggttgtagacattaa

SEQ ID NO: 8166367 - DNA, 22 bp, Homo sapiens
cacaaatggttgtagacattaa

SEQ ID NO: 8166368 - DNA, 22 bp, Homo sapiens
cacaaatgtgcagaaatgtgag

SEQ ID NO: 8166369 - DNA, 22 bp, Homo sapiens
cacaaatgtgcagaaatgtgag

SEQ ID NO: 8166370 - DNA, 22 bp, Homo sapiens
cacaaatgtgcagaaatgtgag

SEQ ID NO: 8166371 - DNA, 22 bp, Homo sapiens
cacaaatgtagtagcttaaaac

SEQ ID NO: 8166372 - DNA, 22 bp, Homo sapiens
cacaaatgtagtagcttaaaac

SEQ ID NO: 8166373 - DNA, 23 bp, Homo sapiens
ggacatgtctctgggtattttga

SEQ ID NO: 8166374 - DNA, 22 bp, Homo sapiens
ggacatggagctccatggaggc

SEQ ID NO: 8166375 - DNA, 18 bp, Homo sapiens
ggacaggagacatgggtg

SEQ ID NO: 8166376 - DNA, 22 bp, Homo sapiens
ggacatggaagtatggagtgga

SEQ ID NO: 8166377 - DNA, 22 bp, Homo sapiens
ggacatggaagtatggagtgga

SEQ ID NO: 8166378 - DNA, 22 bp, Homo sapiens
ggacatggagcatgtagagaaa

SEQ ID NO: 8166379 - DNA, 22 bp, Homo sapiens
ggacatttagaacagagtattt

SEQ ID NO: 8166380 - DNA, 22 bp, Homo sapiens
ggacatgttccttttcatcttt

SEQ ID NO: 8166381 - DNA, 22 bp, Homo sapiens
ggacatgtgcaacttctttgga

SEQ ID NO: 8166382 - DNA, 22 bp, Homo sapiens
ggaccacaatatttgtgaggtt

SEQ ID NO: 8166383 - DNA, 22 bp, Homo sapiens
ggacatttttcttcctacaatg

SEQ ID NO: 8166384 - DNA, 22 bp, Homo sapiens
ggacatttttcttcctacaatg

SEQ ID NO: 8166385 - DNA, 22 bp, Homo sapiens
ggaccagagaagtgagcacctg

SEQ ID NO: 8166386 - DNA, 22 bp, Homo sapiens
ggacatttgcacctacctcagc

SEQ ID NO: 8166387 - DNA, 22 bp, Homo sapiens
ggacatttgcacctacctcagc

SEQ ID NO: 8166388 - DNA, 19 bp, Homo sapiens
ggacatttgagttgtttat

SEQ ID NO: 8166389 - DNA, 19 bp, Homo sapiens
ggacatttgagttgtttat

SEQ ID NO: 8166390 - DNA, 22 bp, Homo sapiens
ggacatttcataagaccattct

SEQ ID NO: 8166391 - DNA, 22 bp, Homo sapiens
ggacatttagtttcattgggca

SEQ ID NO: 8166392 - DNA, 21 bp, Homo sapiens
cacacagtgatctatccacat

SEQ ID NO: 8166393 - DNA, 21 bp, Homo sapiens
cacacagtgatctatccacat

SEQ ID NO: 8166394 - DNA, 22 bp, Homo sapiens
cacacagtggagtattactcag

SEQ ID NO: 8166395 - DNA, 22 bp, Homo sapiens
cacacagtaggcactcattaat

SEQ ID NO: 8166396 - DNA, 22 bp, Homo sapiens
cacacagtagtatgaggcaaaa

SEQ ID NO: 8166397 - DNA, 22 bp, Homo sapiens
ggagaagggacagactcagctt

SEQ ID NO: 8166398 - DNA, 22 bp, Homo sapiens
ggactgggtaggagcccagggc

SEQ ID NO: 8166399 - DNA, 22 bp, Homo sapiens
ggactgggtaggagcccagggc

SEQ ID NO: 8166400 - DNA, 22 bp, Homo sapiens
ggagaaggcacacccacctctg

SEQ ID NO: 8166401 - DNA, 22 bp, Homo sapiens
ggactgggtaggagcccagggc

SEQ ID NO: 8166402 - DNA, 22 bp, Homo sapiens
cacacaggagagtgctggaggt

SEQ ID NO: 8166403 - DNA, 22 bp, Homo sapiens
cacacaggagagtgctggaggt

SEQ ID NO: 8166404 - DNA, 22 bp, Homo sapiens
cacacaggatgaagcagcagaa

SEQ ID NO: 8166405 - DNA, 22 bp, Homo sapiens
cacacaggatgaagcagcagaa

SEQ ID NO: 8166406 - DNA, 22 bp, Homo sapiens
ggaccagcaatcaagaacctac

SEQ ID NO: 8166407 - DNA, 22 bp, Homo sapiens
ggaccagagctcgggcttctca

SEQ ID NO: 8166408 - DNA, 22 bp, Homo sapiens
cacacaggatgaagcagcagaa

SEQ ID NO: 8166409 - DNA, 22 bp, Homo sapiens
cacacaggatgaagcagcagaa

SEQ ID NO: 8166410 - DNA, 22 bp, Homo sapiens
cacacaggtatatatatgtaca

SEQ ID NO: 8166411 - DNA, 22 bp, Homo sapiens
cacacagggagaaagaaagcct

SEQ ID NO: 8166412 - DNA, 22 bp, Homo sapiens
ggagagaggctggccgtgatga

SEQ ID NO: 8166413 - DNA, 22 bp, Homo sapiens
ggagagaggagcccactgctgt

SEQ ID NO: 8166414 - DNA, 22 bp, Homo sapiens
ggagagaggagcccactgctgt

SEQ ID NO: 8166415 - DNA, 20 bp, Homo sapiens
ggagagccacatagtctccc

SEQ ID NO: 8166416 - DNA, 22 bp, Homo sapiens
ggagagcattcttagtctgttt

SEQ ID NO: 8166417 - DNA, 22 bp, Homo sapiens
ggagagcattcttagtctgttt

SEQ ID NO: 8166418 - DNA, 22 bp, Homo sapiens
ggagagcattcttagtctgttt

SEQ ID NO: 8166419 - DNA, 22 bp, Homo sapiens
ggagagcagggtcctgagatac

SEQ ID NO: 8166420 - DNA, 22 bp, Homo sapiens
ggagagcagggtcctgagatac

SEQ ID NO: 8166421 - DNA, 22 bp, Homo sapiens
ggagagcagggaggctgctctg

SEQ ID NO: 8166422 - DNA, 22 bp, Homo sapiens
ggagagcagggaggctgctctg

SEQ ID NO: 8166423 - DNA, 22 bp, Homo sapiens
ggagagcagggaggctgctctg

SEQ ID NO: 8166424 - DNA, 22 bp, Homo sapiens
ggagagcagggaggctgctctg

SEQ ID NO: 8166425 - DNA, 22 bp, Homo sapiens
ggagagcagggaggctgctctg

SEQ ID NO: 8166426 - DNA, 22 bp, Homo sapiens
ggagagcagggtcctgagatac

SEQ ID NO: 8166427 - DNA, 22 bp, Homo sapiens
ggagaagggacagactcagctt

SEQ ID NO: 8166428 - DNA, 22 bp, Homo sapiens
ggagaagggacagactcagctt

SEQ ID NO: 8166429 - DNA, 22 bp, Homo sapiens
ggagaagggtatgtgtggcgga

SEQ ID NO: 8166430 - DNA, 22 bp, Homo sapiens
ggagaagggtatgtgtggcgga

SEQ ID NO: 8166431 - DNA, 22 bp, Homo sapiens
ggagaagggccaattccatgta

SEQ ID NO: 8166432 - DNA, 19 bp, Homo sapiens
caagacaaagcccatcttc

SEQ ID NO: 8166433 - DNA, 19 bp, Homo sapiens
caagacaaagcccatcttc

SEQ ID NO: 8166434 - DNA, 22 bp, Homo sapiens
caagaattaagaattttgatgt

SEQ ID NO: 8166435 - DNA, 22 bp, Homo sapiens
caagaatataaatactttcaaa

SEQ ID NO: 8166436 - DNA, 22 bp, Homo sapiens
caagaagaggtgattggtaagt

SEQ ID NO: 8166437 - DNA, 22 bp, Homo sapiens
gctggagaaacaggaggaggaa

SEQ ID NO: 8166438 - DNA, 22 bp, Homo sapiens
caagaaggcatccccagtccct

SEQ ID NO: 8166439 - DNA, 22 bp, Homo sapiens
caagaagaggtgattggtaagt

SEQ ID NO: 8166440 - DNA, 22 bp, Homo sapiens
caagaaggctatatgggccagg

SEQ ID NO: 8166441 - DNA, 22 bp, Homo sapiens
caagaaggctatatgggccagg

SEQ ID NO: 8166442 - DNA, 22 bp, Homo sapiens
gctggacttagaggtggaaaag

SEQ ID NO: 8166443 - DNA, 22 bp, Homo sapiens
gctggacatccatcctgtagaa

SEQ ID NO: 8166444 - DNA, 22 bp, Homo sapiens
gctggacccggcccctcacctc

SEQ ID NO: 8166445 - DNA, 22 bp, Homo sapiens
gctggactagaagcagggctca

SEQ ID NO: 8166446 - DNA, 22 bp, Homo sapiens
gctggacccggcccctcacctc

SEQ ID NO: 8166447 - DNA, 22 bp, Homo sapiens
gctggaccaggtgtgcacaggc

SEQ ID NO: 8166448 - DNA, 22 bp, Homo sapiens
gctggaattggacccagggctc

SEQ ID NO: 8166449 - DNA, 22 bp, Homo sapiens
gctggaagtaaaaacttactag

SEQ ID NO: 8166450 - DNA, 20 bp, Homo sapiens
gctggaagggctagagggct

SEQ ID NO: 8166451 - DNA, 20 bp, Homo sapiens
gctggaagggctagagggct

SEQ ID NO: 8166452 - DNA, 20 bp, Homo sapiens
gctggaagggctagagggct

SEQ ID NO: 8166453 - DNA, 22 bp, Homo sapiens
gctggaagggaggcccagccgg

SEQ ID NO: 8166454 - DNA, 22 bp, Homo sapiens
gctggaagaatgagtgcctcgt

SEQ ID NO: 8166455 - DNA, 22 bp, Homo sapiens
gctggaaggctaggctcagttg

SEQ ID NO: 8166456 - DNA, 22 bp, Homo sapiens
gctggaaggctaggctcagttg

SEQ ID NO: 8166457 - DNA, 22 bp, Homo sapiens
gctggaaggctaggctcagttg

SEQ ID NO: 8166458 - DNA, 22 bp, Homo sapiens
gctgcttttgagttaaagtcat

SEQ ID NO: 8166459 - DNA, 22 bp, Homo sapiens
gctgctttttggatttggcaca

SEQ ID NO: 8166460 - DNA, 22 bp, Homo sapiens
gctggaaaaggaggcaaaatat

SEQ ID NO: 8166461 - DNA, 22 bp, Homo sapiens
gctgcttttgagttaaagtcat

SEQ ID NO: 8166462 - DNA, 22 bp, Homo sapiens
gctgcttttcacagagacaaga

SEQ ID NO: 8166463 - DNA, 22 bp, Homo sapiens
gctgctttgtgaaaatcattca

SEQ ID NO: 8166464 - DNA, 22 bp, Homo sapiens
gctgctttgtctgtaaaatgga

SEQ ID NO: 8166465 - DNA, 22 bp, Homo sapiens
gctgctttgcagtagagtaata

SEQ ID NO: 8166466 - DNA, 22 bp, Homo sapiens
gctgctttggaaagcatggaaa

SEQ ID NO: 8166467 - DNA, 22 bp, Homo sapiens
gctgctttgtctgtaaaatgga

SEQ ID NO: 8166468 - DNA, 22 bp, Homo sapiens
gctgctttggggatgaatgaga

SEQ ID NO: 8166469 - DNA, 22 bp, Homo sapiens
gctgctttgtctgtaaaatgga

SEQ ID NO: 8166470 - DNA, 22 bp, Homo sapiens
gctgctttgacagtgggaacag

SEQ ID NO: 8166471 - DNA, 22 bp, Homo sapiens
gctgctttgatatgcaaggaac

SEQ ID NO: 8166472 - DNA, 22 bp, Homo sapiens
gctgctttgaaagaggagcttt

SEQ ID NO: 8166473 - DNA, 22 bp, Homo sapiens
gctgctttctgaaggtgcactg

SEQ ID NO: 8166474 - DNA, 22 bp, Homo sapiens
gctgctttctgttaggaattgg

SEQ ID NO: 8166475 - DNA, 22 bp, Homo sapiens
gctgcctgcacagagctgcttt

SEQ ID NO: 8166476 - DNA, 22 bp, Homo sapiens
gctgcctgcacagagctgcttt

SEQ ID NO: 8166477 - DNA, 22 bp, Homo sapiens
gctgcctgccctgggtcatctg

SEQ ID NO: 8166478 - DNA, 21 bp, Homo sapiens
gctgcctgcccctcgggggct

SEQ ID NO: 8166479 - DNA, 22 bp, Homo sapiens
gctgcctgccttgcctggagga

SEQ ID NO: 8166480 - DNA, 22 bp, Homo sapiens
gctgctggccccacatgctcca

SEQ ID NO: 8166481 - DNA, 22 bp, Homo sapiens
gctgctggccccacatgctcca

SEQ ID NO: 8166482 - DNA, 22 bp, Homo sapiens
gctgctggccgcccagcttctc

SEQ ID NO: 8166483 - DNA, 22 bp, Homo sapiens
gctgctggcgctgggcgtccgg

SEQ ID NO: 8166484 - DNA, 22 bp, Homo sapiens
gctggggagcaagagtagtgag

SEQ ID NO: 8166485 - DNA, 22 bp, Homo sapiens
gctggggagcaagagtagtgag

SEQ ID NO: 8166486 - DNA, 22 bp, Homo sapiens
gctggggagcaagagtagtgag

SEQ ID NO: 8166487 - DNA, 22 bp, Homo sapiens
gctggggactccccaccatagc

SEQ ID NO: 8166488 - DNA, 22 bp, Homo sapiens
gctggggagaattgggttatct

SEQ ID NO: 8166489 - DNA, 20 bp, Homo sapiens
gctgggctttgactgacaca

SEQ ID NO: 8166490 - DNA, 20 bp, Homo sapiens
gctgggctttgactgacaca

SEQ ID NO: 8166491 - DNA, 19 bp, Homo sapiens
gctggggaatggatattga

SEQ ID NO: 8166492 - DNA, 22 bp, Homo sapiens
gctggggaccagctgtctctga

SEQ ID NO: 8166493 - DNA, 22 bp, Homo sapiens
gctggggaccagctgtctctga

SEQ ID NO: 8166494 - DNA, 20 bp, Homo sapiens
gctgggctttgactgacaca

SEQ ID NO: 8166495 - DNA, 22 bp, Homo sapiens
gctgggcttgtggccagctggg

SEQ ID NO: 8166496 - DNA, 22 bp, Homo sapiens
gctgggcttgtggccagctggg

SEQ ID NO: 8166497 - DNA, 22 bp, Homo sapiens
caagctctgcgggctccaagat

SEQ ID NO: 8166498 - DNA, 22 bp, Homo sapiens
caagctccttacatccacaggg

SEQ ID NO: 8166499 - DNA, 22 bp, Homo sapiens
caagctccttacatccacaggg

SEQ ID NO: 8166500 - DNA, 22 bp, Homo sapiens
caagctccttacatccacaggg

SEQ ID NO: 8166501 - DNA, 22 bp, Homo sapiens
caagcgtggctgctctgatgga

SEQ ID NO: 8166502 - DNA, 22 bp, Homo sapiens
caagcgtggctgctctgatgga

SEQ ID NO: 8166503 - DNA, 22 bp, Homo sapiens
caagcgtggctgctctgatgga

SEQ ID NO: 8166504 - DNA, 22 bp, Homo sapiens
caagcctgtctcaccagtgcta

SEQ ID NO: 8166505 - DNA, 22 bp, Homo sapiens
caagcctgtctcaccagtgcta

SEQ ID NO: 8166506 - DNA, 22 bp, Homo sapiens
caagcgtctaattgggggttgc

SEQ ID NO: 8166507 - DNA, 22 bp, Homo sapiens
gctgggctcaccaggccactag

SEQ ID NO: 8166508 - DNA, 22 bp, Homo sapiens
gctgggctcagacctagtgaac

SEQ ID NO: 8166509 - DNA, 22 bp, Homo sapiens
gctgggcttgtggccagctggg

SEQ ID NO: 8166510 - DNA, 22 bp, Homo sapiens
gctgggcttgtggccagctggg

SEQ ID NO: 8166511 - DNA, 22 bp, Homo sapiens
caagctgcagcgcctgcgccgg

SEQ ID NO: 8166512 - DNA, 22 bp, Homo sapiens
caagctgaacactgtcttcaag

SEQ ID NO: 8166513 - DNA, 23 bp, Homo sapiens
caagctgcagtttggttggtggg

SEQ ID NO: 8166514 - DNA, 22 bp, Homo sapiens
caagcctgtctcaccagtgcta

SEQ ID NO: 8166515 - DNA, 22 bp, Homo sapiens
caagccgcggctccagatgtgg

SEQ ID NO: 8166516 - DNA, 22 bp, Homo sapiens
caagcccaggattccccagtta

SEQ ID NO: 8166517 - DNA, 20 bp, Homo sapiens
caagccctctttagcctgcc

SEQ ID NO: 8166518 - DNA, 20 bp, Homo sapiens
caagccctctttagcctgcc

SEQ ID NO: 8166519 - DNA, 22 bp, Homo sapiens
caagcccagatcctgcgtgtct

SEQ ID NO: 8166520 - DNA, 22 bp, Homo sapiens
caagcccaggattccccagtta

SEQ ID NO: 8166521 - DNA, 22 bp, Homo sapiens
caagcccactgctcagagccaa

SEQ ID NO: 8166522 - DNA, 22 bp, Homo sapiens
gctggctgagttctgtcgtctg

SEQ ID NO: 8166523 - DNA, 22 bp, Homo sapiens
gctggctgaggtctagctcttt

SEQ ID NO: 8166524 - DNA, 22 bp, Homo sapiens
gctggctgaggtctagctcttt

SEQ ID NO: 8166525 - DNA, 22 bp, Homo sapiens
gctggctgaggtctagctcttt

SEQ ID NO: 8166526 - DNA, 22 bp, Homo sapiens
gctggctgagcactggtttata

SEQ ID NO: 8166527 - DNA, 22 bp, Homo sapiens
gctggctgagatctgttttcct

SEQ ID NO: 8166528 - DNA, 22 bp, Homo sapiens
gctggctgaggtctagctcttt

SEQ ID NO: 8166529 - DNA, 22 bp, Homo sapiens
gctggctgaggtctagctcttt

SEQ ID NO: 8166530 - DNA, 22 bp, Homo sapiens
gctggctgagttctgtcgtctg

SEQ ID NO: 8166531 - DNA, 22 bp, Homo sapiens
gctggctgagttctgtcgtctg

SEQ ID NO: 8166532 - DNA, 22 bp, Homo sapiens
gctggctgagttctgtcgtctg

SEQ ID NO: 8166533 - DNA, 17 bp, Homo sapiens
gctggctgacccatgcc

SEQ ID NO: 8166534 - DNA, 22 bp, Homo sapiens
gctggctgacagatttggggtg

SEQ ID NO: 8166535 - DNA, 22 bp, Homo sapiens
gctggctgacagatttggggtg

SEQ ID NO: 8166536 - DNA, 22 bp, Homo sapiens
gctggctgacagatttggggtg

SEQ ID NO: 8166537 - DNA, 22 bp, Homo sapiens
gctggctgacagagatttaaaa

SEQ ID NO: 8166538 - DNA, 22 bp, Homo sapiens
gctggctgacagagatttaaaa

SEQ ID NO: 8166539 - DNA, 22 bp, Homo sapiens
gctggctgaatcttctgcaata

SEQ ID NO: 8166540 - DNA, 22 bp, Homo sapiens
gctggctgagatctgttttcct

SEQ ID NO: 8166541 - DNA, 17 bp, Homo sapiens
gctggctgacccatgcc

SEQ ID NO: 8166542 - DNA, 17 bp, Homo sapiens
gctggctgacccatgcc

SEQ ID NO: 8166543 - DNA, 22 bp, Homo sapiens
gctggctgagcactggtttata

SEQ ID NO: 8166544 - DNA, 22 bp, Homo sapiens
gctggctgagcactggtttata

SEQ ID NO: 8166545 - DNA, 22 bp, Homo sapiens
gctggctgagatctgttttcct

SEQ ID NO: 8166546 - DNA, 22 bp, Homo sapiens
gctggcccagcgtggggccgtg

SEQ ID NO: 8166547 - DNA, 22 bp, Homo sapiens
gctggcccagggtcacctagga

SEQ ID NO: 8166548 - DNA, 22 bp, Homo sapiens
gctggctctttttgccgggctc

SEQ ID NO: 8166549 - DNA, 20 bp, Homo sapiens
gctggctgaactgaaagcaa

SEQ ID NO: 8166550 - DNA, 22 bp, Homo sapiens
gctggctctttttgccgggctc

SEQ ID NO: 8166551 - DNA, 22 bp, Homo sapiens
gctggctgaatcttctgcaata

SEQ ID NO: 8166552 - DNA, 22 bp, Homo sapiens
gctggctgaatcttctgcaata

SEQ ID NO: 8166553 - DNA, 22 bp, Homo sapiens
gctggctgaatcttctgcaata

SEQ ID NO: 8166554 - DNA, 20 bp, Homo sapiens
gctggctgaactgaaagcaa

SEQ ID NO: 8166555 - DNA, 20 bp, Homo sapiens
gctggctgaactgaaagcaa

SEQ ID NO: 8166556 - DNA, 20 bp, Homo sapiens
gctggctgaactgaaagcaa

SEQ ID NO: 8166557 - DNA, 22 bp, Homo sapiens
caactttctccaagtacaagaa

SEQ ID NO: 8166558 - DNA, 22 bp, Homo sapiens
caacttttctgtgaatttaagt

SEQ ID NO: 8166559 - DNA, 22 bp, Homo sapiens
caagaaacaccaatgactgctg

SEQ ID NO: 8166560 - DNA, 22 bp, Homo sapiens
caagaaatgtttactgagcatc

SEQ ID NO: 8166561 - DNA, 22 bp, Homo sapiens
caagaaatctagaagtcagtgg

SEQ ID NO: 8166562 - DNA, 22 bp, Homo sapiens
caagaaatgggatttgactgcc

SEQ ID NO: 8166563 - DNA, 22 bp, Homo sapiens
gctgcctgcacagagctgcttt

SEQ ID NO: 8166564 - DNA, 22 bp, Homo sapiens
gctgcctgcacagagctgcttt

SEQ ID NO: 8166565 - DNA, 22 bp, Homo sapiens
gctgcctgcacagagctgcttt

SEQ ID NO: 8166566 - DNA, 17 bp, Homo sapiens
gctgcctgcaactgact

SEQ ID NO: 8166567 - DNA, 22 bp, Homo sapiens
gctgcctgatttacatagtgaa

SEQ ID NO: 8166568 - DNA, 22 bp, Homo sapiens
gctgcctgatgtccagcaggac

SEQ ID NO: 8166569 - DNA, 22 bp, Homo sapiens
gctgcctgatgtccagcaggac

SEQ ID NO: 8166570 - DNA, 22 bp, Homo sapiens
caagaaatttcttaagaactaa

SEQ ID NO: 8166571 - DNA, 22 bp, Homo sapiens
caagaaattctgttcagatagc

SEQ ID NO: 8166572 - DNA, 22 bp, Homo sapiens
caagaaattctgttcagatagc

SEQ ID NO: 8166573 - DNA, 22 bp, Homo sapiens
caagaaattctgttcagatagc

SEQ ID NO: 8166574 - DNA, 22 bp, Homo sapiens
caagaacattgtgatcacttca

SEQ ID NO: 8166575 - DNA, 22 bp, Homo sapiens
caagaaatttcttaagaactaa

SEQ ID NO: 8166576 - DNA, 22 bp, Homo sapiens
caactagttttaatgttcatgg

SEQ ID NO: 8166577 - DNA, 22 bp, Homo sapiens
caacactgacaatggactgatt

SEQ ID NO: 8166578 - DNA, 22 bp, Homo sapiens
caactttagcaatgttagtata

SEQ ID NO: 8166579 - DNA, 22 bp, Homo sapiens
caacacagccattcccctagaa

SEQ ID NO: 8166580 - DNA, 22 bp, Homo sapiens
caacacattgaagctatgatga

SEQ ID NO: 8166581 - DNA, 22 bp, Homo sapiens
caacacattgaagctatgatga

SEQ ID NO: 8166582 - DNA, 22 bp, Homo sapiens
caacacattgaagctatgatga

SEQ ID NO: 8166583 - DNA, 22 bp, Homo sapiens
gctgccctgtccggctctcctg

SEQ ID NO: 8166584 - DNA, 22 bp, Homo sapiens
gctgccctgtctgcagcaggac

SEQ ID NO: 8166585 - DNA, 22 bp, Homo sapiens
gctgccctgtctgcagcaggac

SEQ ID NO: 8166586 - DNA, 22 bp, Homo sapiens
gctgccctgtctgcagcaggac

SEQ ID NO: 8166587 - DNA, 22 bp, Homo sapiens
gctgccctgtccggctctcctg

SEQ ID NO: 8166588 - DNA, 22 bp, Homo sapiens
gctgccctgtccggctctcctg

SEQ ID NO: 8166589 - DNA, 21 bp, Homo sapiens
gctgccctggctcagcattca

SEQ ID NO: 8166590 - DNA, 22 bp, Homo sapiens
caacaagcgctcagagcaaagc

SEQ ID NO: 8166591 - DNA, 22 bp, Homo sapiens
caacaatatgccagactcaatt

SEQ ID NO: 8166592 - DNA, 22 bp, Homo sapiens
caacaacatgggattcatttct

SEQ ID NO: 8166593 - DNA, 22 bp, Homo sapiens
caaattttgtgtgttctctagt

SEQ ID NO: 8166594 - DNA, 22 bp, Homo sapiens
caaagtcagggaagagtggctg

SEQ ID NO: 8166595 - DNA, 22 bp, Homo sapiens
caaagtcatggggatgcaggtc

SEQ ID NO: 8166596 - DNA, 22 bp, Homo sapiens
caaagtcctagaacagtgcttg

SEQ ID NO: 8166597 - DNA, 23 bp, Homo sapiens
gctctggagctgggcctggcagg

SEQ ID NO: 8166598 - DNA, 18 bp, Homo sapiens
gctctggaggtagcatta

SEQ ID NO: 8166599 - DNA, 22 bp, Homo sapiens
gctctggatccggctgggtctg

SEQ ID NO: 8166600 - DNA, 17 bp, Homo sapiens
gctctggcacaggattg

SEQ ID NO: 8166601 - DNA, 17 bp, Homo sapiens
gctctggcacaggattg

SEQ ID NO: 8166602 - DNA, 22 bp, Homo sapiens
caaagtcagccagctagtaggt

SEQ ID NO: 8166603 - DNA, 22 bp, Homo sapiens
gctctggagcactggaaacact

SEQ ID NO: 8166604 - DNA, 22 bp, Homo sapiens
gctctggagatggagccttgag

SEQ ID NO: 8166605 - DNA, 22 bp, Homo sapiens
gctctggagatggagccttgag

SEQ ID NO: 8166606 - DNA, 22 bp, Homo sapiens
gctctggactggggcctgagaa

SEQ ID NO: 8166607 - DNA, 22 bp, Homo sapiens
gctctggactggggcctgagaa

SEQ ID NO: 8166608 - DNA, 22 bp, Homo sapiens
gctctggaccctggagtggctg

SEQ ID NO: 8166609 - DNA, 22 bp, Homo sapiens
gctctggaccctggagtggctg

SEQ ID NO: 8166610 - DNA, 22 bp, Homo sapiens
gctctggaccctgccagcctta

SEQ ID NO: 8166611 - DNA, 22 bp, Homo sapiens
gctctggaccctgccagcctta

SEQ ID NO: 8166612 - DNA, 22 bp, Homo sapiens
gctctggaccctgccagcctta

SEQ ID NO: 8166613 - DNA, 22 bp, Homo sapiens
gctctgcttgcatcatgactgc

SEQ ID NO: 8166614 - DNA, 22 bp, Homo sapiens
gctctgcttgcatcatgactgc

SEQ ID NO: 8166615 - DNA, 22 bp, Homo sapiens
gctctgctgtgtttgttcagca

SEQ ID NO: 8166616 - DNA, 22 bp, Homo sapiens
gctctggaagcatctgagagga

SEQ ID NO: 8166617 - DNA, 22 bp, Homo sapiens
gctctggaacctgccaggatgc

SEQ ID NO: 8166618 - DNA, 22 bp, Homo sapiens
gctctggaacctgccaggatgc

SEQ ID NO: 8166619 - DNA, 22 bp, Homo sapiens
gctctggaacctgccaggatgc

SEQ ID NO: 8166620 - DNA, 22 bp, Homo sapiens
gctgccctgactccagcagcct

SEQ ID NO: 8166621 - DNA, 21 bp, Homo sapiens
gctgccctggctcagcattca

SEQ ID NO: 8166622 - DNA, 22 bp, Homo sapiens
gctgccctgcatctgtgccttc

SEQ ID NO: 8166623 - DNA, 22 bp, Homo sapiens
gctgccctgactccagcagcct

SEQ ID NO: 8166624 - DNA, 22 bp, Homo sapiens
gctgccctgacaagctactccc

SEQ ID NO: 8166625 - DNA, 22 bp, Homo sapiens
gctgccctgacaagctactccc

SEQ ID NO: 8166626 - DNA, 22 bp, Homo sapiens
gctgccctgacaagctactccc

SEQ ID NO: 8166627 - DNA, 22 bp, Homo sapiens
gctgccctgacaagctactccc

SEQ ID NO: 8166628 - DNA, 22 bp, Homo sapiens
gctgccctctctggccccacac

SEQ ID NO: 8166629 - DNA, 22 bp, Homo sapiens
gctgccctctctggccccacac

SEQ ID NO: 8166630 - DNA, 22 bp, Homo sapiens
gctgccctctgtgacccggccc

SEQ ID NO: 8166631 - DNA, 22 bp, Homo sapiens
gctgccctctgtgacccggccc

SEQ ID NO: 8166632 - DNA, 22 bp, Homo sapiens
gctgccctcccagggcaagctt

SEQ ID NO: 8166633 - DNA, 22 bp, Homo sapiens
gctgccctccagttcccacagt

SEQ ID NO: 8166634 - DNA, 22 bp, Homo sapiens
gctgccctccagttcccacagt

SEQ ID NO: 8166635 - DNA, 18 bp, Homo sapiens
gctgccctagctcccctc

SEQ ID NO: 8166636 - DNA, 22 bp, Homo sapiens
gctgccacgatctctgctgtag

SEQ ID NO: 8166637 - DNA, 17 bp, Homo sapiens
gctgccacctttggagc

SEQ ID NO: 8166638 - DNA, 22 bp, Homo sapiens
gggtaaggtcagccagaagttc

SEQ ID NO: 8166639 - DNA, 22 bp, Homo sapiens
gggtaaggtcagccagaagttc

SEQ ID NO: 8166640 - DNA, 21 bp, Homo sapiens
gggtaaggaaaatgattcttc

SEQ ID NO: 8166641 - DNA, 22 bp, Homo sapiens
gggtaattggggccttgcagtg

SEQ ID NO: 8166642 - DNA, 22 bp, Homo sapiens
gggtaaggtcagccagaagttc

SEQ ID NO: 8166643 - DNA, 20 bp, Homo sapiens
gggtacagttctgcagttac

SEQ ID NO: 8166644 - DNA, 22 bp, Homo sapiens
gggtacagttcttccagtgtca

SEQ ID NO: 8166645 - DNA, 20 bp, Homo sapiens
gggtacagatatgcagtgaa

SEQ ID NO: 8166646 - DNA, 20 bp, Homo sapiens
gggtacagttctgcagttac

SEQ ID NO: 8166647 - DNA, 22 bp, Homo sapiens
gggtacagaaactgaggcttag

SEQ ID NO: 8166648 - DNA, 22 bp, Homo sapiens
gggtacaaagatttcataagat

SEQ ID NO: 8166649 - DNA, 22 bp, Homo sapiens
gggtacagagagatgaggtaac

SEQ ID NO: 8166650 - DNA, 22 bp, Homo sapiens
gggtacagagagatgaggtaac

SEQ ID NO: 8166651 - DNA, 20 bp, Homo sapiens
ggggttggctggcacaggga

SEQ ID NO: 8166652 - DNA, 20 bp, Homo sapiens
ggggttggctggcacaggga

SEQ ID NO: 8166653 - DNA, 20 bp, Homo sapiens
ggggttggctggcacaggga

SEQ ID NO: 8166654 - DNA, 20 bp, Homo sapiens
ggggttggctggcacaggga

SEQ ID NO: 8166655 - DNA, 20 bp, Homo sapiens
ggggttggctggcacaggga

SEQ ID NO: 8166656 - DNA, 22 bp, Homo sapiens
ggggttggtttaaatgcttgag

SEQ ID NO: 8166657 - DNA, 22 bp, Homo sapiens
gggtaaaggaattgggtttcct

SEQ ID NO: 8166658 - DNA, 22 bp, Homo sapiens
gggtaaatctcttttcatggct

SEQ ID NO: 8166659 - DNA, 22 bp, Homo sapiens
gggtaaatctcttttcatggct

SEQ ID NO: 8166660 - DNA, 22 bp, Homo sapiens
ggggcctgtagagcttcaggga

SEQ ID NO: 8166661 - DNA, 22 bp, Homo sapiens
ggggcctgtagagcttcaggga

SEQ ID NO: 8166662 - DNA, 22 bp, Homo sapiens
ggggcctgtagagcttcaggga

SEQ ID NO: 8166663 - DNA, 22 bp, Homo sapiens
ggggccttggatctgtgccccg

SEQ ID NO: 8166664 - DNA, 19 bp, Homo sapiens
ggggcctgtgatggtcaca

SEQ ID NO: 8166665 - DNA, 19 bp, Homo sapiens
ggggcctgtgatggtcaca

SEQ ID NO: 8166666 - DNA, 22 bp, Homo sapiens
ggggtgagctgggcctgtgcct

SEQ ID NO: 8166667 - DNA, 22 bp, Homo sapiens
ggggtgagtgctcagccccgga

SEQ ID NO: 8166668 - DNA, 22 bp, Homo sapiens
ggggtgaggtttatgttctggg

SEQ ID NO: 8166669 - DNA, 22 bp, Homo sapiens
ggggccttttctgaatgtggaa

SEQ ID NO: 8166670 - DNA, 22 bp, Homo sapiens
ggggccttggatctgtgccccg

SEQ ID NO: 8166671 - DNA, 22 bp, Homo sapiens
ggggccttggatctgtgccccg

SEQ ID NO: 8166672 - DNA, 22 bp, Homo sapiens
ggggaggaagctctcagttcca

SEQ ID NO: 8166673 - DNA, 22 bp, Homo sapiens
ggggaggaagctctcagttcca

SEQ ID NO: 8166674 - DNA, 22 bp, Homo sapiens
ggggcagaagtagtgcccctga

SEQ ID NO: 8166675 - DNA, 22 bp, Homo sapiens
ggggcagagtagctggggtgtg

SEQ ID NO: 8166676 - DNA, 21 bp, Homo sapiens
ggggcagagctaggccctgca

SEQ ID NO: 8166677 - DNA, 22 bp, Homo sapiens
ggggcagcctccaggaaagctg

SEQ ID NO: 8166678 - DNA, 22 bp, Homo sapiens
ggggcagatggaacagagcaca

SEQ ID NO: 8166679 - DNA, 22 bp, Homo sapiens
ggggcagctaccggaagtaggg

SEQ ID NO: 8166680 - DNA, 22 bp, Homo sapiens
ggggcctctgggaacccctgtg

SEQ ID NO: 8166681 - DNA, 23 bp, Homo sapiens
ggggcctgcaccggtctgcgcgg

SEQ ID NO: 8166682 - DNA, 22 bp, Homo sapiens
ggggcctctgcagtcacgctgg

SEQ ID NO: 8166683 - DNA, 22 bp, Homo sapiens
ggggcctctgcagtcacgctgg

SEQ ID NO: 8166684 - DNA, 22 bp, Homo sapiens
ggggcctctgcagtcacgctgg

SEQ ID NO: 8166685 - DNA, 21 bp, Homo sapiens
ggggcctctccacacagccgg

SEQ ID NO: 8166686 - DNA, 21 bp, Homo sapiens
ggggcctctccacacagccgg

SEQ ID NO: 8166687 - DNA, 22 bp, Homo sapiens
ggggcctcgccgccgcctctgc

SEQ ID NO: 8166688 - DNA, 22 bp, Homo sapiens
gggctggaggaccggcctcgga

SEQ ID NO: 8166689 - DNA, 22 bp, Homo sapiens
gggctgagtgggcctcttactt

SEQ ID NO: 8166690 - DNA, 22 bp, Homo sapiens
gggctgagtgggcctcttactt

SEQ ID NO: 8166691 - DNA, 22 bp, Homo sapiens
gggctgagtgggcctcttactt

SEQ ID NO: 8166692 - DNA, 22 bp, Homo sapiens
cagagccagcagtggggacagg

SEQ ID NO: 8166693 - DNA, 22 bp, Homo sapiens
cagagccactgtctgccaggca

SEQ ID NO: 8166694 - DNA, 22 bp, Homo sapiens
cagagccactgtctgccaggca

SEQ ID NO: 8166695 - DNA, 22 bp, Homo sapiens
cagagccactgtctgccaggca

SEQ ID NO: 8166696 - DNA, 22 bp, Homo sapiens
cagagccacttggagatgagaa

SEQ ID NO: 8166697 - DNA, 22 bp, Homo sapiens
cagagccacttggagatgagaa

SEQ ID NO: 8166698 - DNA, 22 bp, Homo sapiens
cagagccagagacctgctgtgc

SEQ ID NO: 8166699 - DNA, 22 bp, Homo sapiens
cagagccagagacctgctgtgc

SEQ ID NO: 8166700 - DNA, 22 bp, Homo sapiens
cagagccagagacctgctgtgc

SEQ ID NO: 8166701 - DNA, 21 bp, Homo sapiens
cagagccagactgctgaattt

SEQ ID NO: 8166702 - DNA, 22 bp, Homo sapiens
cagagccagaactagaccttgt

SEQ ID NO: 8166703 - DNA, 21 bp, Homo sapiens
cagagccagactgctgaattt

SEQ ID NO: 8166704 - DNA, 22 bp, Homo sapiens
cagagccagaactagaccttgt

SEQ ID NO: 8166705 - DNA, 22 bp, Homo sapiens
cagagccacttggagatgagaa

SEQ ID NO: 8166706 - DNA, 22 bp, Homo sapiens
gggctggaggtgagcaggacag

SEQ ID NO: 8166707 - DNA, 19 bp, Homo sapiens
gggctggagggatagagcc

SEQ ID NO: 8166708 - DNA, 19 bp, Homo sapiens
gggctggagggatagagcc

SEQ ID NO: 8166709 - DNA, 22 bp, Homo sapiens
gggctggaggtgagcaggacag

SEQ ID NO: 8166710 - DNA, 22 bp, Homo sapiens
gggctggaggtgagcaggacag

SEQ ID NO: 8166711 - DNA, 22 bp, Homo sapiens
gggctggaggtgagcaggacag

SEQ ID NO: 8166712 - DNA, 22 bp, Homo sapiens
gggctggaggtgagcaggacag

SEQ ID NO: 8166713 - DNA, 22 bp, Homo sapiens
gggctggaggtgagcaggacag

SEQ ID NO: 8166714 - DNA, 22 bp, Homo sapiens
gggctggaggtgagcaggacag

SEQ ID NO: 8166715 - DNA, 22 bp, Homo sapiens
gggctggagtcttctgaaagcc

SEQ ID NO: 8166716 - DNA, 22 bp, Homo sapiens
gggctggaggcctgcctggtta

SEQ ID NO: 8166717 - DNA, 22 bp, Homo sapiens
gggctggaggcctgcctggtta

SEQ ID NO: 8166718 - DNA, 21 bp, Homo sapiens
gggctggaggatgggaagccc

SEQ ID NO: 8166719 - DNA, 21 bp, Homo sapiens
gggctggaggatgggaagccc

SEQ ID NO: 8166720 - DNA, 21 bp, Homo sapiens
gggctggaggatgggaagccc

SEQ ID NO: 8166721 - DNA, 22 bp, Homo sapiens
gggctggaggagatccagaggc

SEQ ID NO: 8166722 - DNA, 22 bp, Homo sapiens
gggctggaggagatccagaggc

SEQ ID NO: 8166723 - DNA, 18 bp, Homo sapiens
gggctgtgagatgggaag

SEQ ID NO: 8166724 - DNA, 18 bp, Homo sapiens
gggctgtgagatgggaag

SEQ ID NO: 8166725 - DNA, 22 bp, Homo sapiens
gggctgtgagagtggggctgct

SEQ ID NO: 8166726 - DNA, 22 bp, Homo sapiens
gggctgtcacgcccctgcacct

SEQ ID NO: 8166727 - DNA, 22 bp, Homo sapiens
gggctgtcacgcccctgcacct

SEQ ID NO: 8166728 - DNA, 22 bp, Homo sapiens
gggctgtcatgtgtcagtgacc

SEQ ID NO: 8166729 - DNA, 22 bp, Homo sapiens
gggctgtaggagctggaatggg

SEQ ID NO: 8166730 - DNA, 22 bp, Homo sapiens
gggctgtaggagctggaatggg

SEQ ID NO: 8166731 - DNA, 22 bp, Homo sapiens
gggctggatctcacgtgagacc

SEQ ID NO: 8166732 - DNA, 22 bp, Homo sapiens
gggctggatctcacgtgagacc

SEQ ID NO: 8166733 - DNA, 22 bp, Homo sapiens
gggctggagttgggaagacaaa

SEQ ID NO: 8166734 - DNA, 20 bp, Homo sapiens
gggctggataattctttgct

SEQ ID NO: 8166735 - DNA, 21 bp, Homo sapiens
gggctggatattggaaagagg

SEQ ID NO: 8166736 - DNA, 21 bp, Homo sapiens
gggctggatattggaaagagg

SEQ ID NO: 8166737 - DNA, 18 bp, Homo sapiens
gggctgtgagatgggaag

SEQ ID NO: 8166738 - DNA, 22 bp, Homo sapiens
gggctgtgctgagtaggaggtg

SEQ ID NO: 8166739 - DNA, 22 bp, Homo sapiens
gggctgtgctgagtaggaggtg

SEQ ID NO: 8166740 - DNA, 22 bp, Homo sapiens
gggctgtgtactatgaggaggg

SEQ ID NO: 8166741 - DNA, 22 bp, Homo sapiens
gggctgtggagccgcgagggct

SEQ ID NO: 8166742 - DNA, 22 bp, Homo sapiens
gggtaggaaatccagaggtggc

SEQ ID NO: 8166743 - DNA, 22 bp, Homo sapiens
gggtaggaaatccagaggtggc

SEQ ID NO: 8166744 - DNA, 22 bp, Homo sapiens
gggtaggaaatccagaggtggc

SEQ ID NO: 8166745 - DNA, 22 bp, Homo sapiens
gggtaggaaatccagaggtggc

SEQ ID NO: 8166746 - DNA, 21 bp, Homo sapiens
gggtagcgtgtggaagatccg

SEQ ID NO: 8166747 - DNA, 22 bp, Homo sapiens
gggtagcatgtgtcagagtttg

SEQ ID NO: 8166748 - DNA, 22 bp, Homo sapiens
gggtacttaatatttacggggt

SEQ ID NO: 8166749 - DNA, 22 bp, Homo sapiens
gggtacagttcttccagtgtca

SEQ ID NO: 8166750 - DNA, 22 bp, Homo sapiens
gggtccagtagttggtggccgt

SEQ ID NO: 8166751 - DNA, 22 bp, Homo sapiens
gggtccaggtttagtcatttgt

SEQ ID NO: 8166752 - DNA, 22 bp, Homo sapiens
gggtcccagaggcaaaggacta

SEQ ID NO: 8166753 - DNA, 22 bp, Homo sapiens
gggtcccaggaaggagcagtgt

SEQ ID NO: 8166754 - DNA, 19 bp, Homo sapiens
gggtcccaaaagatgtgct

SEQ ID NO: 8166755 - DNA, 19 bp, Homo sapiens
gggtccatggtgtcaagga

SEQ ID NO: 8166756 - DNA, 22 bp, Homo sapiens
gggtcctgcgtgggcccaggac

SEQ ID NO: 8166757 - DNA, 20 bp, Homo sapiens
gggtcctgacttggtctcct

SEQ ID NO: 8166758 - DNA, 22 bp, Homo sapiens
gggtccctggaattacttgaca

SEQ ID NO: 8166759 - DNA, 22 bp, Homo sapiens
gggtgggatctgtggagcctca

SEQ ID NO: 8166760 - DNA, 22 bp, Homo sapiens
gggtgggatctgtggagcctca

SEQ ID NO: 8166761 - DNA, 22 bp, Homo sapiens
gggttcagtccctcttgctact

SEQ ID NO: 8166762 - DNA, 22 bp, Homo sapiens
gggttcagtccctcttgctact

SEQ ID NO: 8166763 - DNA, 22 bp, Homo sapiens
gggttcaggttggcctgagcac

SEQ ID NO: 8166764 - DNA, 22 bp, Homo sapiens
gggttcagtccctcttgctact

SEQ ID NO: 8166765 - DNA, 22 bp, Homo sapiens
gggttcagtgatgccttcagga

SEQ ID NO: 8166766 - DNA, 22 bp, Homo sapiens
gggttcctggctcctgtgtggt

SEQ ID NO: 8166767 - DNA, 22 bp, Homo sapiens
gggttccctgcctggccactct

SEQ ID NO: 8166768 - DNA, 22 bp, Homo sapiens
ggtattcaatcagtgttcattc

SEQ ID NO: 8166769 - DNA, 19 bp, Homo sapiens
ggtattcaagctatattag

SEQ ID NO: 8166770 - DNA, 22 bp, Homo sapiens
ggtatgggcctgagaatctgtc

SEQ ID NO: 8166771 - DNA, 22 bp, Homo sapiens
ggtatggatcagatgggctcaa

SEQ ID NO: 8166772 - DNA, 22 bp, Homo sapiens
ggtatggagtctgagtttctag

SEQ ID NO: 8166773 - DNA, 19 bp, Homo sapiens
ggtatatgggcctcacttg

SEQ ID NO: 8166774 - DNA, 22 bp, Homo sapiens
ggtagtgaggtgaaagagaggt

SEQ ID NO: 8166775 - DNA, 22 bp, Homo sapiens
ggtagtcggccttgccctgggc

SEQ ID NO: 8166776 - DNA, 22 bp, Homo sapiens
ggtagtgaggtgaaagagaggt

SEQ ID NO: 8166777 - DNA, 22 bp, Homo sapiens
ggtataaatgatcagatcgctg

SEQ ID NO: 8166778 - DNA, 22 bp, Homo sapiens
ggtataaatgatcagatcgctg

SEQ ID NO: 8166779 - DNA, 22 bp, Homo sapiens
gggtgtggctgcgtgccaataa

SEQ ID NO: 8166780 - DNA, 22 bp, Homo sapiens
gggtgtggctgcgtgccaataa

SEQ ID NO: 8166781 - DNA, 22 bp, Homo sapiens
gggtgtgtcttttgctcctgga

SEQ ID NO: 8166782 - DNA, 20 bp, Homo sapiens
gggtgtgggcccggccaggc

SEQ ID NO: 8166783 - DNA, 21 bp, Homo sapiens
gggtgtggaaattacatcctg

SEQ ID NO: 8166784 - DNA, 20 bp, Homo sapiens
gggtgtggcctgggaatttg

SEQ ID NO: 8166785 - DNA, 22 bp, Homo sapiens
gggtgggatgccgctgtctcca

SEQ ID NO: 8166786 - DNA, 22 bp, Homo sapiens
gggtgggatctgtggagcctca

SEQ ID NO: 8166787 - DNA, 20 bp, Homo sapiens
gggtgtgtgcagggcctggt

SEQ ID NO: 8166788 - DNA, 20 bp, Homo sapiens
gggtgtgtgcagggcctggt

SEQ ID NO: 8166789 - DNA, 22 bp, Homo sapiens
gggtgtttatgtattatgatgt

SEQ ID NO: 8166790 - DNA, 22 bp, Homo sapiens
gggtgttgattttacactaaaa

SEQ ID NO: 8166791 - DNA, 22 bp, Homo sapiens
gggtgtgttcctaaggaaacca

SEQ ID NO: 8166792 - DNA, 22 bp, Homo sapiens
gggtgtgttacaatgatgccga

SEQ ID NO: 8166793 - DNA, 22 bp, Homo sapiens
gggttaggtccctcccttctgg

SEQ ID NO: 8166794 - DNA, 22 bp, Homo sapiens
gggttaggttctagaggcacaa

SEQ ID NO: 8166795 - DNA, 22 bp, Homo sapiens
ggtcctggaaattgacggaaag

SEQ ID NO: 8166796 - DNA, 22 bp, Homo sapiens
ggtcctggaaattgacggaaag

SEQ ID NO: 8166797 - DNA, 22 bp, Homo sapiens
ggtcctggaagtgtaagtggca

SEQ ID NO: 8166798 - DNA, 22 bp, Homo sapiens
ggtcctggaaattgacggaaag

SEQ ID NO: 8166799 - DNA, 22 bp, Homo sapiens
ggtcctggaaattgacggaaag

SEQ ID NO: 8166800 - DNA, 22 bp, Homo sapiens
ggtcctggaaattgacggaaag

SEQ ID NO: 8166801 - DNA, 22 bp, Homo sapiens
ggtcctggcagctctgtgtcca

SEQ ID NO: 8166802 - DNA, 22 bp, Homo sapiens
ggtcctggcagctctgtgtcca

SEQ ID NO: 8166803 - DNA, 22 bp, Homo sapiens
ggtcctggcagctctgtgtcca

SEQ ID NO: 8166804 - DNA, 22 bp, Homo sapiens
ggtcctggatgagacaggtagt

SEQ ID NO: 8166805 - DNA, 22 bp, Homo sapiens
ggtcctggcagctctgtgtcca

SEQ ID NO: 8166806 - DNA, 22 bp, Homo sapiens
ggtcctggaagtgtaagtggca

SEQ ID NO: 8166807 - DNA, 22 bp, Homo sapiens
ggtcctggaagtgtaagtggca

SEQ ID NO: 8166808 - DNA, 22 bp, Homo sapiens
ggtcctggatgagacaggtagt

SEQ ID NO: 8166809 - DNA, 22 bp, Homo sapiens
ggtcctggatgagacaggtagt

SEQ ID NO: 8166810 - DNA, 22 bp, Homo sapiens
ggtcctggatgagacaggtagt

SEQ ID NO: 8166811 - DNA, 22 bp, Homo sapiens
ggtcctgggaagatgctcatga

SEQ ID NO: 8166812 - DNA, 22 bp, Homo sapiens
cagatggcaacagctctgtgac

SEQ ID NO: 8166813 - DNA, 22 bp, Homo sapiens
ggtcctggcagtctttggttgt

SEQ ID NO: 8166814 - DNA, 22 bp, Homo sapiens
ggtcctggcagtctttggttgt

SEQ ID NO: 8166815 - DNA, 20 bp, Homo sapiens
cagatggcacgtcagggcat

SEQ ID NO: 8166816 - DNA, 20 bp, Homo sapiens
cagatggcacgtcagggcat

SEQ ID NO: 8166817 - DNA, 20 bp, Homo sapiens
cagatggcacgtcagggcat

SEQ ID NO: 8166818 - DNA, 22 bp, Homo sapiens
cagatgtttgtctatatgcttt

SEQ ID NO: 8166819 - DNA, 22 bp, Homo sapiens
cagatgtggttaacatgtacat

SEQ ID NO: 8166820 - DNA, 22 bp, Homo sapiens
ggtccctggttccctctgagct

SEQ ID NO: 8166821 - DNA, 22 bp, Homo sapiens
cagatgctaagttatcagcagg

SEQ ID NO: 8166822 - DNA, 22 bp, Homo sapiens
cagatgcatgtacagtgttgct

SEQ ID NO: 8166823 - DNA, 22 bp, Homo sapiens
cagatgcacattctcatcagca

SEQ ID NO: 8166824 - DNA, 22 bp, Homo sapiens
ggtcctgagtacctatgtttat

SEQ ID NO: 8166825 - DNA, 22 bp, Homo sapiens
ggtcctgaggggagctgaaggt

SEQ ID NO: 8166826 - DNA, 22 bp, Homo sapiens
ggtcctgcctgctgtccttcaa

SEQ ID NO: 8166827 - DNA, 22 bp, Homo sapiens
ggtcctcaatcccaacaaggca

SEQ ID NO: 8166828 - DNA, 22 bp, Homo sapiens
ggtcctcaatcccaacaaggca

SEQ ID NO: 8166829 - DNA, 19 bp, Homo sapiens
ggtcctcagcagagcatgc

SEQ ID NO: 8166830 - DNA, 22 bp, Homo sapiens
ggtcctctccagcgccacagtg

SEQ ID NO: 8166831 - DNA, 19 bp, Homo sapiens
ggtcctcagcagagcatgc

SEQ ID NO: 8166832 - DNA, 18 bp, Homo sapiens
ggtcctgaatgcctgcta

SEQ ID NO: 8166833 - DNA, 22 bp, Homo sapiens
ggtcctctccagcgccacagtg

SEQ ID NO: 8166834 - DNA, 22 bp, Homo sapiens
ggtatttatagtggtgcttagt

SEQ ID NO: 8166835 - DNA, 22 bp, Homo sapiens
ggtatttatatgtctgaagctg

SEQ ID NO: 8166836 - DNA, 22 bp, Homo sapiens
ggtattcacaatatttaaagag

SEQ ID NO: 8166837 - DNA, 23 bp, Homo sapiens
ggtattcattcatttatgctaag

SEQ ID NO: 8166838 - DNA, 22 bp, Homo sapiens
ggtatttactgagagccactct

SEQ ID NO: 8166839 - DNA, 22 bp, Homo sapiens
ggtatttactgagagccactct

SEQ ID NO: 8166840 - DNA, 22 bp, Homo sapiens
cagatatgtggattctattagc

SEQ ID NO: 8166841 - DNA, 22 bp, Homo sapiens
cagatatattttccttattagg

SEQ ID NO: 8166842 - DNA, 22 bp, Homo sapiens
ggtcacaaggtactgtaagaaa

SEQ ID NO: 8166843 - DNA, 22 bp, Homo sapiens
ggtcacaaggcagataataagg

SEQ ID NO: 8166844 - DNA, 22 bp, Homo sapiens
ggtcaagtattttggccccagc

SEQ ID NO: 8166845 - DNA, 22 bp, Homo sapiens
ggtcaagaatttggccgtggct

SEQ ID NO: 8166846 - DNA, 22 bp, Homo sapiens
cagatgaccaggctccacccag

SEQ ID NO: 8166847 - DNA, 22 bp, Homo sapiens
cagatgaccaggctccacccag

SEQ ID NO: 8166848 - DNA, 22 bp, Homo sapiens
cagatgaataaatgatgaggta

SEQ ID NO: 8166849 - DNA, 22 bp, Homo sapiens
cagatgaagtttgcctagagct

SEQ ID NO: 8166850 - DNA, 19 bp, Homo sapiens
cagatgagaaaagtgaggt

SEQ ID NO: 8166851 - DNA, 19 bp, Homo sapiens
cagatgagaaaagtgaggt

SEQ ID NO: 8166852 - DNA, 22 bp, Homo sapiens
cagatgagagtggccagggttc

SEQ ID NO: 8166853 - DNA, 18 bp, Homo sapiens
cagatgagatgcaatctc

SEQ ID NO: 8166854 - DNA, 18 bp, Homo sapiens
cagatgagatgcaatctc

SEQ ID NO: 8166855 - DNA, 22 bp, Homo sapiens
cagatgaggggcatataacaat

SEQ ID NO: 8166856 - DNA, 23 bp, Homo sapiens
cagatgaggttggcagcatggtc

SEQ ID NO: 8166857 - DNA, 23 bp, Homo sapiens
cagatgaggttggcagcatggtc

SEQ ID NO: 8166858 - DNA, 23 bp, Homo sapiens
cagatgaggttggcagcatggtc

SEQ ID NO: 8166859 - DNA, 23 bp, Homo sapiens
cagatgaggttggcagcatggtc

SEQ ID NO: 8166860 - DNA, 22 bp, Homo sapiens
cagatgaggcaacctcattgct

SEQ ID NO: 8166861 - DNA, 22 bp, Homo sapiens
cagatgaggacagatgactggg

SEQ ID NO: 8166862 - DNA, 22 bp, Homo sapiens
cagatgaggacagatgactggg

SEQ ID NO: 8166863 - DNA, 22 bp, Homo sapiens
cagatgagcatgggcacaagca

SEQ ID NO: 8166864 - DNA, 22 bp, Homo sapiens
cagatgagcatgggcacaagca

SEQ ID NO: 8166865 - DNA, 22 bp, Homo sapiens
cagaataaaggtacaattgagt

SEQ ID NO: 8166866 - DNA, 22 bp, Homo sapiens
cagaatttaagtggattattct

SEQ ID NO: 8166867 - DNA, 22 bp, Homo sapiens
cagaatttaagtggattattct

SEQ ID NO: 8166868 - DNA, 22 bp, Homo sapiens
cagaaacagagaaatattggct

SEQ ID NO: 8166869 - DNA, 22 bp, Homo sapiens
cagaaacagagaaatattggct

SEQ ID NO: 8166870 - DNA, 22 bp, Homo sapiens
cagaaacaggcaacgtgtgcac

SEQ ID NO: 8166871 - DNA, 22 bp, Homo sapiens
cagaaacagacatgacgcagta

SEQ ID NO: 8166872 - DNA, 22 bp, Homo sapiens
cagaaacagacatgacgcagta

SEQ ID NO: 8166873 - DNA, 22 bp, Homo sapiens
cagacaaagcggaaactgttta

SEQ ID NO: 8166874 - DNA, 22 bp, Homo sapiens
cagaatttttcgaatgtactgt

SEQ ID NO: 8166875 - DNA, 22 bp, Homo sapiens
cagaatttttcgaatgtactgt

SEQ ID NO: 8166876 - DNA, 22 bp, Homo sapiens
cagacaaggccatctttcattt

SEQ ID NO: 8166877 - DNA, 22 bp, Homo sapiens
cagacaaggccatctttcattt

SEQ ID NO: 8166878 - DNA, 22 bp, Homo sapiens
cagacaactggactaagatcac

SEQ ID NO: 8166879 - DNA, 22 bp, Homo sapiens
cagacaactggactaagatcac

SEQ ID NO: 8166880 - DNA, 22 bp, Homo sapiens
cagaatttagaaaacaacataa

SEQ ID NO: 8166881 - DNA, 22 bp, Homo sapiens
cagaatttagaaaacaacataa

SEQ ID NO: 8166882 - DNA, 22 bp, Homo sapiens
cagaatttagcacaatgtatgg

SEQ ID NO: 8166883 - DNA, 22 bp, Homo sapiens
cagaatttagcacaatgtatgg

SEQ ID NO: 8166884 - DNA, 22 bp, Homo sapiens
cagaatttttcactcaatcttc

SEQ ID NO: 8166885 - DNA, 22 bp, Homo sapiens
cagaatttgaagtaatattcca

SEQ ID NO: 8166886 - DNA, 22 bp, Homo sapiens
cagaatttgaagtaatattcca

SEQ ID NO: 8166887 - DNA, 22 bp, Homo sapiens
cagaatttgaagtaatattcca

SEQ ID NO: 8166888 - DNA, 22 bp, Homo sapiens
ggctggcactgaggagagctct

SEQ ID NO: 8166889 - DNA, 22 bp, Homo sapiens
ggctggcactgaggagagctct

SEQ ID NO: 8166890 - DNA, 22 bp, Homo sapiens
ggctggcactgaggagagctct

SEQ ID NO: 8166891 - DNA, 22 bp, Homo sapiens
ggctggcactgaggagagctct

SEQ ID NO: 8166892 - DNA, 22 bp, Homo sapiens
ggctggcactgaggagagctct

SEQ ID NO: 8166893 - DNA, 22 bp, Homo sapiens
cagaaacacttgtagagaagtt

SEQ ID NO: 8166894 - DNA, 22 bp, Homo sapiens
cagaaacacttgtagagaagtt

SEQ ID NO: 8166895 - DNA, 22 bp, Homo sapiens
cagaaacactgtatttagggaa

SEQ ID NO: 8166896 - DNA, 22 bp, Homo sapiens
cagaaacactgtatttagggaa

SEQ ID NO: 8166897 - DNA, 22 bp, Homo sapiens
ggctggcactctgtccagtgtc

SEQ ID NO: 8166898 - DNA, 22 bp, Homo sapiens
ggctggcactctgtccagtgtc

SEQ ID NO: 8166899 - DNA, 22 bp, Homo sapiens
ggctggcactctgtccagtgtc

SEQ ID NO: 8166900 - DNA, 22 bp, Homo sapiens
ggctggcacgaagccctgctgg

SEQ ID NO: 8166901 - DNA, 22 bp, Homo sapiens
ggctggcacagagggctggtgt

SEQ ID NO: 8166902 - DNA, 22 bp, Homo sapiens
ggctggcacccttggggatagg

SEQ ID NO: 8166903 - DNA, 22 bp, Homo sapiens
ggctggcacctgccctccgctg

SEQ ID NO: 8166904 - DNA, 22 bp, Homo sapiens
ggctggcacccttggggatagg

SEQ ID NO: 8166905 - DNA, 22 bp, Homo sapiens
ggctggcacgaagccctgctgg

SEQ ID NO: 8166906 - DNA, 22 bp, Homo sapiens
ggctggcacctgccctccgctg

SEQ ID NO: 8166907 - DNA, 22 bp, Homo sapiens
ggctggcaagtgtctgctcatg

SEQ ID NO: 8166908 - DNA, 22 bp, Homo sapiens
ggctggcaagtgtctgctcatg

SEQ ID NO: 8166909 - DNA, 22 bp, Homo sapiens
ggctggcacaaagctccaaatc

SEQ ID NO: 8166910 - DNA, 22 bp, Homo sapiens
ggctggcacagagggctggtgt

SEQ ID NO: 8166911 - DNA, 22 bp, Homo sapiens
ggctggcacagagggctggtgt

SEQ ID NO: 8166912 - DNA, 22 bp, Homo sapiens
ggctggcacagagggctggtgt

SEQ ID NO: 8166913 - DNA, 22 bp, Homo sapiens
ggctggcacagagggctggtgt

SEQ ID NO: 8166914 - DNA, 22 bp, Homo sapiens
ggctggcacccttggggatagg

SEQ ID NO: 8166915 - DNA, 22 bp, Homo sapiens
ggctggcacagagggctggtgt

SEQ ID NO: 8166916 - DNA, 22 bp, Homo sapiens
ggctggcaagtgtctgctcatg

SEQ ID NO: 8166917 - DNA, 22 bp, Homo sapiens
ggctggcaagtgtctgctcatg

SEQ ID NO: 8166918 - DNA, 22 bp, Homo sapiens
ggctggcaagtgtctgctcatg

SEQ ID NO: 8166919 - DNA, 19 bp, Homo sapiens
ggctggcaagtgacagtgt

SEQ ID NO: 8166920 - DNA, 19 bp, Homo sapiens
ggctggcaagtgacagtgt

SEQ ID NO: 8166921 - DNA, 19 bp, Homo sapiens
ggctggcaagtgacagtgt

SEQ ID NO: 8166922 - DNA, 19 bp, Homo sapiens
ggctggcaagtgacagtgt

SEQ ID NO: 8166923 - DNA, 22 bp, Homo sapiens
cagacacagatatgcatatggc

SEQ ID NO: 8166924 - DNA, 22 bp, Homo sapiens
cagacactaggtgacagagtgc

SEQ ID NO: 8166925 - DNA, 22 bp, Homo sapiens
cagacactattgtgtataaatc

SEQ ID NO: 8166926 - DNA, 22 bp, Homo sapiens
cagacactatgctaaggtacta

SEQ ID NO: 8166927 - DNA, 18 bp, Homo sapiens
cagacactctgctctgca

SEQ ID NO: 8166928 - DNA, 18 bp, Homo sapiens
cagacactctgctctgca

SEQ ID NO: 8166929 - DNA, 22 bp, Homo sapiens
cagacacaccaggcccattctg

SEQ ID NO: 8166930 - DNA, 22 bp, Homo sapiens
cagacacaccaggcccattctg

SEQ ID NO: 8166931 - DNA, 22 bp, Homo sapiens
cagacacagatatgcatatggc

SEQ ID NO: 8166932 - DNA, 22 bp, Homo sapiens
cagacacacaagcaatctaagt

SEQ ID NO: 8166933 - DNA, 22 bp, Homo sapiens
cagacacacaagcaatctaagt

SEQ ID NO: 8166934 - DNA, 22 bp, Homo sapiens
cagacagaaggctccttgaggt

SEQ ID NO: 8166935 - DNA, 22 bp, Homo sapiens
cagacagaaggaaggccaacat

SEQ ID NO: 8166936 - DNA, 22 bp, Homo sapiens
gggagccaaggagagaggcctt

SEQ ID NO: 8166937 - DNA, 22 bp, Homo sapiens
cagacactgcagcagtctccca

SEQ ID NO: 8166938 - DNA, 22 bp, Homo sapiens
cagacacttattgagcaagtac

SEQ ID NO: 8166939 - DNA, 22 bp, Homo sapiens
gggagctgatgatgtaagtccc

SEQ ID NO: 8166940 - DNA, 22 bp, Homo sapiens
gggagctgatgatgtaagtccc

SEQ ID NO: 8166941 - DNA, 22 bp, Homo sapiens
gggagctgcacacgccccggaa

SEQ ID NO: 8166942 - DNA, 22 bp, Homo sapiens
gggagctgcacacgccccggaa

SEQ ID NO: 8166943 - DNA, 22 bp, Homo sapiens
gggagctgccaccacccctggg

SEQ ID NO: 8166944 - DNA, 22 bp, Homo sapiens
gggagctgatgatgtaagtccc

SEQ ID NO: 8166945 - DNA, 22 bp, Homo sapiens
gggagctgatcaggtggattca

SEQ ID NO: 8166946 - DNA, 22 bp, Homo sapiens
gggagctgatcaggtggattca

SEQ ID NO: 8166947 - DNA, 22 bp, Homo sapiens
gggagccaaggagagaggcctt

SEQ ID NO: 8166948 - DNA, 21 bp, Homo sapiens
gggagctggaaactgggtgac

SEQ ID NO: 8166949 - DNA, 20 bp, Homo sapiens
gggagctggaattgtcttag

SEQ ID NO: 8166950 - DNA, 22 bp, Homo sapiens
gggaggagggtgctggctaaac

SEQ ID NO: 8166951 - DNA, 21 bp, Homo sapiens
gggagctggaaactgggtgac

SEQ ID NO: 8166952 - DNA, 21 bp, Homo sapiens
gggagctggaaactgggtgac

SEQ ID NO: 8166953 - DNA, 21 bp, Homo sapiens
gggagctggaaactgggtgac

SEQ ID NO: 8166954 - DNA, 21 bp, Homo sapiens
gggagctggaaactgggtgac

SEQ ID NO: 8166955 - DNA, 21 bp, Homo sapiens
gggagctggaaactgggtgac

SEQ ID NO: 8166956 - DNA, 22 bp, Homo sapiens
gggagctgctgaacacaagggt

SEQ ID NO: 8166957 - DNA, 21 bp, Homo sapiens
gggagctggaaactgggtgac

SEQ ID NO: 8166958 - DNA, 22 bp, Homo sapiens
gggagctgccaccacccctggg

SEQ ID NO: 8166959 - DNA, 22 bp, Homo sapiens
gggagctgccttagaccggagg

SEQ ID NO: 8166960 - DNA, 22 bp, Homo sapiens
gggagctgccttagaccggagg

SEQ ID NO: 8166961 - DNA, 22 bp, Homo sapiens
gggagctgctgaacacaagggt

SEQ ID NO: 8166962 - DNA, 22 bp, Homo sapiens
gggagctgcggtcttgcgaaga

SEQ ID NO: 8166963 - DNA, 22 bp, Homo sapiens
gggagctgcggtcttgcgaaga

SEQ ID NO: 8166964 - DNA, 22 bp, Homo sapiens
gggagctgctgaacacaagggt

SEQ ID NO: 8166965 - DNA, 22 bp, Homo sapiens
gggaggcatgtgttatccactt

SEQ ID NO: 8166966 - DNA, 22 bp, Homo sapiens
gggaggcagtgctggaggctgg

SEQ ID NO: 8166967 - DNA, 22 bp, Homo sapiens
gggaggcagtgctggaggctgg

SEQ ID NO: 8166968 - DNA, 22 bp, Homo sapiens
gggaggcagtgctggaggctgg

SEQ ID NO: 8166969 - DNA, 22 bp, Homo sapiens
gggaggcagtgctggaggctgg

SEQ ID NO: 8166970 - DNA, 22 bp, Homo sapiens
gggaggcagtgctggaggctgg

SEQ ID NO: 8166971 - DNA, 22 bp, Homo sapiens
gggaggcagtgctggaggctgg

SEQ ID NO: 8166972 - DNA, 22 bp, Homo sapiens
gggaggcagtgctggaggctgg

SEQ ID NO: 8166973 - DNA, 22 bp, Homo sapiens
gggaggcacgaggcgcgcagtg

SEQ ID NO: 8166974 - DNA, 22 bp, Homo sapiens
gggaggcacgaggcgcgcagtg

SEQ ID NO: 8166975 - DNA, 22 bp, Homo sapiens
gggaggcacgaggcgcgcagtg

SEQ ID NO: 8166976 - DNA, 22 bp, Homo sapiens
gggaggagtgaagattcacctg

SEQ ID NO: 8166977 - DNA, 22 bp, Homo sapiens
gggaggagggtgctggctaaac

SEQ ID NO: 8166978 - DNA, 22 bp, Homo sapiens
gggaggcacgaggcgcgcagtg

SEQ ID NO: 8166979 - DNA, 22 bp, Homo sapiens
gggaggagtgaagattcacctg

SEQ ID NO: 8166980 - DNA, 22 bp, Homo sapiens
cagagacaccccagaaaataag

SEQ ID NO: 8166981 - DNA, 22 bp, Homo sapiens
cagagacacttaacaggaatgg

SEQ ID NO: 8166982 - DNA, 22 bp, Homo sapiens
cagagacacttaacaggaatgg

SEQ ID NO: 8166983 - DNA, 22 bp, Homo sapiens
cagagacacttaacaggaatgg

SEQ ID NO: 8166984 - DNA, 22 bp, Homo sapiens
cagagacaatgtctctgcttgt

SEQ ID NO: 8166985 - DNA, 22 bp, Homo sapiens
cagagacaatgtctctgcttgt

SEQ ID NO: 8166986 - DNA, 22 bp, Homo sapiens
cagagacaatgtctctgcttgt

SEQ ID NO: 8166987 - DNA, 22 bp, Homo sapiens
cagagacaacctggtagagaaa

SEQ ID NO: 8166988 - DNA, 22 bp, Homo sapiens
cagagacaacctggtagagaaa

SEQ ID NO: 8166989 - DNA, 22 bp, Homo sapiens
cagagacaacctggtagagaaa

SEQ ID NO: 8166990 - DNA, 22 bp, Homo sapiens
cagagaataaaagggcattcct

SEQ ID NO: 8166991 - DNA, 22 bp, Homo sapiens
cagagaagagtctggcctctct

SEQ ID NO: 8166992 - DNA, 22 bp, Homo sapiens
cagagacaacaagtttaactat

SEQ ID NO: 8166993 - DNA, 22 bp, Homo sapiens
cagagacaacaagtttaactat

SEQ ID NO: 8166994 - DNA, 22 bp, Homo sapiens
cagagaagagtctggcctctct

SEQ ID NO: 8166995 - DNA, 22 bp, Homo sapiens
cagactgtgtctgaacctggtc

SEQ ID NO: 8166996 - DNA, 22 bp, Homo sapiens
cagagaactccagtggctggcg

SEQ ID NO: 8166997 - DNA, 22 bp, Homo sapiens
cagagcagaagcggtcctcaca

SEQ ID NO: 8166998 - DNA, 22 bp, Homo sapiens
cagagcagaagcggtcctcaca

SEQ ID NO: 8166999 - DNA, 22 bp, Homo sapiens
cagagcagaagcggtcctcaca

SEQ ID NO: 8167000 - DNA, 22 bp, Homo sapiens
cagagcagaaacctgggtgatt

SEQ ID NO: 8167001 - DNA, 22 bp, Homo sapiens
cagagcagaaacctgggtgatt

SEQ ID NO: 8167002 - DNA, 22 bp, Homo sapiens
cagagcagaaacctgggtgatt

SEQ ID NO: 8167003 - DNA, 22 bp, Homo sapiens
cagagcagaaacctgggtgatt

SEQ ID NO: 8167004 - DNA, 22 bp, Homo sapiens
cagagcagaaacctgggtgatt

SEQ ID NO: 8167005 - DNA, 22 bp, Homo sapiens
cagagaggaggctatatgcaaa

SEQ ID NO: 8167006 - DNA, 22 bp, Homo sapiens
cagagaggaggctatatgcaaa

SEQ ID NO: 8167007 - DNA, 22 bp, Homo sapiens
cagagaggaggctatatgcaaa

SEQ ID NO: 8167008 - DNA, 22 bp, Homo sapiens
cagagcactgcttggaggattt

SEQ ID NO: 8167009 - DNA, 22 bp, Homo sapiens
cagagcactgcttggaggattt

SEQ ID NO: 8167010 - DNA, 22 bp, Homo sapiens
cagagcactgcttggaggattt

SEQ ID NO: 8167011 - DNA, 22 bp, Homo sapiens
cagagaggatggattccatagc

SEQ ID NO: 8167012 - DNA, 22 bp, Homo sapiens
gggatgagagtagggtgtgaaa

SEQ ID NO: 8167013 - DNA, 22 bp, Homo sapiens
gggatgagagctgggacagaag

SEQ ID NO: 8167014 - DNA, 22 bp, Homo sapiens
gggatgactttttgaaatggat

SEQ ID NO: 8167015 - DNA, 22 bp, Homo sapiens
gggatgacaaagtgtctgtccc

SEQ ID NO: 8167016 - DNA, 22 bp, Homo sapiens
gggatgactacttatgggaagt

SEQ ID NO: 8167017 - DNA, 22 bp, Homo sapiens
gggatgacacaaacttcctaag

SEQ ID NO: 8167018 - DNA, 22 bp, Homo sapiens
gggatgacagctatggaactct

SEQ ID NO: 8167019 - DNA, 19 bp, Homo sapiens
gggatgacagcccagagcc

SEQ ID NO: 8167020 - DNA, 22 bp, Homo sapiens
gggatgacaattcaagggctgg

SEQ ID NO: 8167021 - DNA, 22 bp, Homo sapiens
gggatgacaaagtgtctgtccc

SEQ ID NO: 8167022 - DNA, 22 bp, Homo sapiens
gggatctgctccagagggaaaa

SEQ ID NO: 8167023 - DNA, 23 bp, Homo sapiens
gggatctgtaaacctggagaacc

SEQ ID NO: 8167024 - DNA, 23 bp, Homo sapiens
gggatctgtaagttgaagacaaa

SEQ ID NO: 8167025 - DNA, 22 bp, Homo sapiens
gggatgaattgagtcagaaggg

SEQ ID NO: 8167026 - DNA, 22 bp, Homo sapiens
gggcaggtacaagatgcttctt

SEQ ID NO: 8167027 - DNA, 22 bp, Homo sapiens
gggcaggtacaagatgcttctt

SEQ ID NO: 8167028 - DNA, 22 bp, Homo sapiens
gggcaggtactgggtggtgagc

SEQ ID NO: 8167029 - DNA, 22 bp, Homo sapiens
gggcaggggtcagtggccccaa

SEQ ID NO: 8167030 - DNA, 22 bp, Homo sapiens
gggcaggtacaagatgcttctt

SEQ ID NO: 8167031 - DNA, 22 bp, Homo sapiens
gggcaggggtcagtggccccaa

SEQ ID NO: 8167032 - DNA, 22 bp, Homo sapiens
gggcaggtaggtgaaataatga

SEQ ID NO: 8167033 - DNA, 22 bp, Homo sapiens
gggcaggtaggtgaaataatga

SEQ ID NO: 8167034 - DNA, 22 bp, Homo sapiens
gggcaggtactgggtggtgagc

SEQ ID NO: 8167035 - DNA, 22 bp, Homo sapiens
cagagcagtgaggagttgtgta

SEQ ID NO: 8167036 - DNA, 22 bp, Homo sapiens
cagagcagtgaggagttgtgta

SEQ ID NO: 8167037 - DNA, 22 bp, Homo sapiens
cagagcaggggtttcccaggtt

SEQ ID NO: 8167038 - DNA, 22 bp, Homo sapiens
cagagcagtgaggagttgtgta

SEQ ID NO: 8167039 - DNA, 18 bp, Homo sapiens
cagagcagaggtggagcg

SEQ ID NO: 8167040 - DNA, 18 bp, Homo sapiens
cagagcagaggtggagcg

SEQ ID NO: 8167041 - DNA, 22 bp, Homo sapiens
gggcaggggtagcattccaagt

SEQ ID NO: 8167042 - DNA, 22 bp, Homo sapiens
gggcaggggtcagtggccccaa

SEQ ID NO: 8167043 - DNA, 22 bp, Homo sapiens
gggcaggggtcagtggccccaa

SEQ ID NO: 8167044 - DNA, 22 bp, Homo sapiens
gggcaggggtcagtggccccaa

SEQ ID NO: 8167045 - DNA, 22 bp, Homo sapiens
cagagcagaaggtccaagcctg

SEQ ID NO: 8167046 - DNA, 22 bp, Homo sapiens
cagagcagaaggtccaagcctg

SEQ ID NO: 8167047 - DNA, 22 bp, Homo sapiens
cagagcagaaggtccaagcctg

SEQ ID NO: 8167048 - DNA, 22 bp, Homo sapiens
cagagcagaagcggtcctcaca

SEQ ID NO: 8167049 - DNA, 22 bp, Homo sapiens
cagagcagacgttgagattaag

SEQ ID NO: 8167050 - DNA, 18 bp, Homo sapiens
cagagcagaggtggagcg

SEQ ID NO: 8167051 - DNA, 18 bp, Homo sapiens
cagagcagaggtggagcg

SEQ ID NO: 8167052 - DNA, 22 bp, Homo sapiens
cagagcagtggagagtaggtct

SEQ ID NO: 8167053 - DNA, 22 bp, Homo sapiens
cagagcagtgaggagttgtgta

SEQ ID NO: 8167054 - DNA, 22 bp, Homo sapiens
cagagcagtgaggagttgtgta

SEQ ID NO: 8167055 - DNA, 20 bp, Homo sapiens
cagagcagtgcccaggcggc

SEQ ID NO: 8167056 - DNA, 22 bp, Homo sapiens
cagagcagtggagagtaggtct

SEQ ID NO: 8167057 - DNA, 19 bp, Homo sapiens
cagagcagtggttcctgaa

SEQ ID NO: 8167058 - DNA, 19 bp, Homo sapiens
cagagcagtggttcctgaa

SEQ ID NO: 8167059 - DNA, 22 bp, Homo sapiens
cagagcataattgacatgaggt

SEQ ID NO: 8167060 - DNA, 22 bp, Homo sapiens
cagagcataattgacatgaggt

SEQ ID NO: 8167061 - DNA, 20 bp, Homo sapiens
cagagccaagagcagcatct

SEQ ID NO: 8167062 - DNA, 22 bp, Homo sapiens
cagagccaacgccacctgccca

SEQ ID NO: 8167063 - DNA, 22 bp, Homo sapiens
cagagccaaatgctgtggttat

SEQ ID NO: 8167064 - DNA, 20 bp, Homo sapiens
cagagccaagagcagcatct

SEQ ID NO: 8167065 - DNA, 22 bp, Homo sapiens
cagagccacagcctccagattt

SEQ ID NO: 8167066 - DNA, 22 bp, Homo sapiens
cagagccactgcattttacagc

SEQ ID NO: 8167067 - DNA, 22 bp, Homo sapiens
cagagcattaaaaccagctctg

SEQ ID NO: 8167068 - DNA, 22 bp, Homo sapiens
cagagcatgtcaactagcttta

SEQ ID NO: 8167069 - DNA, 22 bp, Homo sapiens
cagagcattgagggtctgccaa

SEQ ID NO: 8167070 - DNA, 22 bp, Homo sapiens
cagagccaaacctcagggcccg

SEQ ID NO: 8167071 - DNA, 22 bp, Homo sapiens
cagagccaaacctcagggcccg

SEQ ID NO: 8167072 - DNA, 22 bp, Homo sapiens
cagagccaaacctcagggcccg

SEQ ID NO: 8167073 - DNA, 22 bp, Homo sapiens
cagagccaaatgctgtggttat

SEQ ID NO: 8167074 - DNA, 22 bp, Homo sapiens
cagagccaaacctcagggcccg

SEQ ID NO: 8167075 - DNA, 22 bp, Homo sapiens
cagagccaaacctcagggcccg

SEQ ID NO: 8167076 - DNA, 22 bp, Homo sapiens
cagcaaagcaggctcctagaac

SEQ ID NO: 8167077 - DNA, 22 bp, Homo sapiens
cagcaaaggggatgcgtcctaa

SEQ ID NO: 8167078 - DNA, 22 bp, Homo sapiens
cagcaaaggtagaagcacagga

SEQ ID NO: 8167079 - DNA, 22 bp, Homo sapiens
cagcagccactagagggctcac

SEQ ID NO: 8167080 - DNA, 22 bp, Homo sapiens
cagcagccactagagggctcac

SEQ ID NO: 8167081 - DNA, 22 bp, Homo sapiens
cagcagccactagagggctcac

SEQ ID NO: 8167082 - DNA, 22 bp, Homo sapiens
cagcaaaggtagaagcacagga

SEQ ID NO: 8167083 - DNA, 22 bp, Homo sapiens
cagcagcagccccaggaaggtt

SEQ ID NO: 8167084 - DNA, 22 bp, Homo sapiens
cagcagcagattcagcgtctgg

SEQ ID NO: 8167085 - DNA, 22 bp, Homo sapiens
cagcagcagattcagcgtctgg

SEQ ID NO: 8167086 - DNA, 22 bp, Homo sapiens
cagcagcccacgcgtgctgtcc

SEQ ID NO: 8167087 - DNA, 22 bp, Homo sapiens
cagcagcccacgcgtgctgtcc

SEQ ID NO: 8167088 - DNA, 22 bp, Homo sapiens
cagcagcccacgcgtgctgtcc

SEQ ID NO: 8167089 - DNA, 20 bp, Homo sapiens
cagcagccattctagtagta

SEQ ID NO: 8167090 - DNA, 22 bp, Homo sapiens
cagcagccatgtaccacactca

SEQ ID NO: 8167091 - DNA, 20 bp, Homo sapiens
cagcagccattctagtagta

SEQ ID NO: 8167092 - DNA, 22 bp, Homo sapiens
cagcagccagacaagatacatc

SEQ ID NO: 8167093 - DNA, 19 bp, Homo sapiens
cagcagccagggggcccct

SEQ ID NO: 8167094 - DNA, 19 bp, Homo sapiens
cagcagccagggggcccct

SEQ ID NO: 8167095 - DNA, 22 bp, Homo sapiens
cagcagccatgtaccacactca

SEQ ID NO: 8167096 - DNA, 22 bp, Homo sapiens
cagcagcctagaagctctacca

SEQ ID NO: 8167097 - DNA, 22 bp, Homo sapiens
cagcagcctacaatgcacagaa

SEQ ID NO: 8167098 - DNA, 22 bp, Homo sapiens
cagcagcctacaatgcacagaa

SEQ ID NO: 8167099 - DNA, 22 bp, Homo sapiens
cagcagcctacaatgcacagaa

SEQ ID NO: 8167100 - DNA, 22 bp, Homo sapiens
cagcagcccacgcgtgctgtcc

SEQ ID NO: 8167101 - DNA, 22 bp, Homo sapiens
cagcagccgagagggggctctg

SEQ ID NO: 8167102 - DNA, 22 bp, Homo sapiens
cagatttctttagcaagctaag

SEQ ID NO: 8167103 - DNA, 22 bp, Homo sapiens
cagatttctttagcaagctaag

SEQ ID NO: 8167104 - DNA, 22 bp, Homo sapiens
cagatttaggtcactagaattt

SEQ ID NO: 8167105 - DNA, 22 bp, Homo sapiens
cagatttaggcttagtccaagc

SEQ ID NO: 8167106 - DNA, 22 bp, Homo sapiens
cagatttaagatatttgtattg

SEQ ID NO: 8167107 - DNA, 22 bp, Homo sapiens
cagatttacctaactccaagtt

SEQ ID NO: 8167108 - DNA, 22 bp, Homo sapiens
cagatttactccctgctgctgc

SEQ ID NO: 8167109 - DNA, 22 bp, Homo sapiens
cagatttattttacatccttca

SEQ ID NO: 8167110 - DNA, 22 bp, Homo sapiens
cagatttcagctcatatattat

SEQ ID NO: 8167111 - DNA, 22 bp, Homo sapiens
cagatttcagctcatatattat

SEQ ID NO: 8167112 - DNA, 22 bp, Homo sapiens
cagatttcaaggaggcactcca

SEQ ID NO: 8167113 - DNA, 22 bp, Homo sapiens
cagatttctatttcaaatacat

SEQ ID NO: 8167114 - DNA, 22 bp, Homo sapiens
cagatttctatttcaaatacat

SEQ ID NO: 8167115 - DNA, 22 bp, Homo sapiens
cagatttcatgcgaaatggggt

SEQ ID NO: 8167116 - DNA, 22 bp, Homo sapiens
cagattccagtttgtggctccc

SEQ ID NO: 8167117 - DNA, 22 bp, Homo sapiens
cagattactttgtagcagtcag

SEQ ID NO: 8167118 - DNA, 22 bp, Homo sapiens
cagattaagtgctcaacagtgt

SEQ ID NO: 8167119 - DNA, 22 bp, Homo sapiens
cagattctcactgtattcaggt

SEQ ID NO: 8167120 - DNA, 22 bp, Homo sapiens
cagattctcactgtattcaggt

SEQ ID NO: 8167121 - DNA, 22 bp, Homo sapiens
cagattctccaggggctgcaga

SEQ ID NO: 8167122 - DNA, 22 bp, Homo sapiens
cagatttaagagataaacagtg

SEQ ID NO: 8167123 - DNA, 22 bp, Homo sapiens
cagatttaagagataaacagtg

SEQ ID NO: 8167124 - DNA, 22 bp, Homo sapiens
cagattcttcattgccccattc

SEQ ID NO: 8167125 - DNA, 22 bp, Homo sapiens
cagattctgggcccagcttgtc

SEQ ID NO: 8167126 - DNA, 22 bp, Homo sapiens
cagattcttaatttatgggatt

SEQ ID NO: 8167127 - DNA, 22 bp, Homo sapiens
gtaggcagggctgtggggagaa

SEQ ID NO: 8167128 - DNA, 22 bp, Homo sapiens
gtaggcagggctgtggggagaa

SEQ ID NO: 8167129 - DNA, 22 bp, Homo sapiens
gtaggcagggctgtggggagaa

SEQ ID NO: 8167130 - DNA, 22 bp, Homo sapiens
gtaggcaggtggaggagtgaag

SEQ ID NO: 8167131 - DNA, 22 bp, Homo sapiens
gtaggcaggtggaggagtgaag

SEQ ID NO: 8167132 - DNA, 22 bp, Homo sapiens
gtaggcaggtggaggagtgaag

SEQ ID NO: 8167133 - DNA, 22 bp, Homo sapiens
gtaggcagtctctcaggtgatc

SEQ ID NO: 8167134 - DNA, 22 bp, Homo sapiens
gtaggcagtctctcaggtgatc

SEQ ID NO: 8167135 - DNA, 22 bp, Homo sapiens
gtaggccatggtggttgtctct

SEQ ID NO: 8167136 - DNA, 22 bp, Homo sapiens
gtaggctgtgtgaggctagaga

SEQ ID NO: 8167137 - DNA, 22 bp, Homo sapiens
gtaggctgtgtgaggctagaga

SEQ ID NO: 8167138 - DNA, 22 bp, Homo sapiens
gtaggccagtgtgaaacctggt

SEQ ID NO: 8167139 - DNA, 22 bp, Homo sapiens
gtaggcagtggttggaagagaa

SEQ ID NO: 8167140 - DNA, 22 bp, Homo sapiens
gtaggcagtgcttgattttcca

SEQ ID NO: 8167141 - DNA, 22 bp, Homo sapiens
gtaggcagtggttggaagagaa

SEQ ID NO: 8167142 - DNA, 22 bp, Homo sapiens
gtaggcagtggttggaagagaa

SEQ ID NO: 8167143 - DNA, 22 bp, Homo sapiens
gtactttaaatcaatgtagatt

SEQ ID NO: 8167144 - DNA, 22 bp, Homo sapiens
gtactttaaatcaatgtagatt

SEQ ID NO: 8167145 - DNA, 22 bp, Homo sapiens
gtactttaagactccagtagca

SEQ ID NO: 8167146 - DNA, 22 bp, Homo sapiens
gtactttaagactccagtagca

SEQ ID NO: 8167147 - DNA, 22 bp, Homo sapiens
gtactttagagtaaaatagacc

SEQ ID NO: 8167148 - DNA, 22 bp, Homo sapiens
gtactttagagtaaaatagacc

SEQ ID NO: 8167149 - DNA, 22 bp, Homo sapiens
gtactttagagtaaaatagacc

SEQ ID NO: 8167150 - DNA, 22 bp, Homo sapiens
gtacttccctgggaggcaagca

SEQ ID NO: 8167151 - DNA, 22 bp, Homo sapiens
gtacttctttagtcaatatgta

SEQ ID NO: 8167152 - DNA, 22 bp, Homo sapiens
gtagaaatagtggttgacagga

SEQ ID NO: 8167153 - DNA, 22 bp, Homo sapiens
gtagaaaattaggatgaggctt

SEQ ID NO: 8167154 - DNA, 22 bp, Homo sapiens
gtagaaaattaggatgaggctt

SEQ ID NO: 8167155 - DNA, 22 bp, Homo sapiens
gtagaaaaagcagtaagtctca

SEQ ID NO: 8167156 - DNA, 22 bp, Homo sapiens
gtagaaaaagcagtaagtctca

SEQ ID NO: 8167157 - DNA, 20 bp, Homo sapiens
gtactcagatcaagtcagct

SEQ ID NO: 8167158 - DNA, 22 bp, Homo sapiens
gtactataggtaatgtagacca

SEQ ID NO: 8167159 - DNA, 22 bp, Homo sapiens
gtactgctgtaaatattcttca

SEQ ID NO: 8167160 - DNA, 22 bp, Homo sapiens
gtactaaaaaatgatcagtttg

SEQ ID NO: 8167161 - DNA, 22 bp, Homo sapiens
gtacacattatgcttctctaaa

SEQ ID NO: 8167162 - DNA, 22 bp, Homo sapiens
gtacacattgtctgtttacttc

SEQ ID NO: 8167163 - DNA, 22 bp, Homo sapiens
gtacacattatgcttctctaaa

SEQ ID NO: 8167164 - DNA, 22 bp, Homo sapiens
gtacacagatgcttgagaatct

SEQ ID NO: 8167165 - DNA, 22 bp, Homo sapiens
cagcagcctagggttccatcat

SEQ ID NO: 8167166 - DNA, 22 bp, Homo sapiens
cagcagcctagggttccatcat

SEQ ID NO: 8167167 - DNA, 22 bp, Homo sapiens
cagcagcctagaagctctacca

SEQ ID NO: 8167168 - DNA, 22 bp, Homo sapiens
gtacacactgtttgatcatttc

SEQ ID NO: 8167169 - DNA, 22 bp, Homo sapiens
gtacacactatttaaagtgttt

SEQ ID NO: 8167170 - DNA, 22 bp, Homo sapiens
gtacacactatgtattgtacac

SEQ ID NO: 8167171 - DNA, 22 bp, Homo sapiens
gtacacactatgtattgtacac

SEQ ID NO: 8167172 - DNA, 22 bp, Homo sapiens
gtccagagccggaagagtgaca

SEQ ID NO: 8167173 - DNA, 22 bp, Homo sapiens
gtccagagccggaagagtgaca

SEQ ID NO: 8167174 - DNA, 22 bp, Homo sapiens
gtccagagaggcaggaggctac

SEQ ID NO: 8167175 - DNA, 22 bp, Homo sapiens
gtccagagaggcaggaggctac

SEQ ID NO: 8167176 - DNA, 22 bp, Homo sapiens
gtccagagggctgcaggatgct

SEQ ID NO: 8167177 - DNA, 22 bp, Homo sapiens
gtccagagggtcaagtttcttg

SEQ ID NO: 8167178 - DNA, 20 bp, Homo sapiens
gtccagagtaatgtgctgac

SEQ ID NO: 8167179 - DNA, 22 bp, Homo sapiens
gtccagagggctgcaggatgct

SEQ ID NO: 8167180 - DNA, 22 bp, Homo sapiens
gtccagagctggcacactgtca

SEQ ID NO: 8167181 - DNA, 22 bp, Homo sapiens
gtccagagggctgcaggatgct

SEQ ID NO: 8167182 - DNA, 22 bp, Homo sapiens
cagcatctggatttcctccact

SEQ ID NO: 8167183 - DNA, 22 bp, Homo sapiens
cagcatctggatttcctccact

SEQ ID NO: 8167184 - DNA, 22 bp, Homo sapiens
cagcatctggggaacattcaag

SEQ ID NO: 8167185 - DNA, 22 bp, Homo sapiens
cagcatctctgggagaagcatc

SEQ ID NO: 8167186 - DNA, 22 bp, Homo sapiens
cagcatctgaccaatatctaca

SEQ ID NO: 8167187 - DNA, 22 bp, Homo sapiens
cagcatctctgcctgcctgcaa

SEQ ID NO: 8167188 - DNA, 22 bp, Homo sapiens
cagccagctgtcccaagtgcct

SEQ ID NO: 8167189 - DNA, 22 bp, Homo sapiens
cagccagctggtgcggcagagc

SEQ ID NO: 8167190 - DNA, 22 bp, Homo sapiens
cagccagctgtcccaagtgcct

SEQ ID NO: 8167191 - DNA, 22 bp, Homo sapiens
cagccagcttcagatccaagcc

SEQ ID NO: 8167192 - DNA, 22 bp, Homo sapiens
cagccagaacctaggatgagct

SEQ ID NO: 8167193 - DNA, 22 bp, Homo sapiens
cagccagaacctaggatgagct

SEQ ID NO: 8167194 - DNA, 22 bp, Homo sapiens
gtccagccaccctggaggcacg

SEQ ID NO: 8167195 - DNA, 22 bp, Homo sapiens
gtccagagtattcaagtaactt

SEQ ID NO: 8167196 - DNA, 22 bp, Homo sapiens
cagccaggcccagatcatgctg

SEQ ID NO: 8167197 - DNA, 22 bp, Homo sapiens
cagccaggatggagaactgttg

SEQ ID NO: 8167198 - DNA, 22 bp, Homo sapiens
cagccaggatggagaactgttg

SEQ ID NO: 8167199 - DNA, 22 bp, Homo sapiens
cagccaggatggagaactgttg

SEQ ID NO: 8167200 - DNA, 22 bp, Homo sapiens
cagccaggcccccgagtcgttg

SEQ ID NO: 8167201 - DNA, 22 bp, Homo sapiens
cagccaggcccccgagtcgttg

SEQ ID NO: 8167202 - DNA, 22 bp, Homo sapiens
cagccaggcccagatcatgctg

SEQ ID NO: 8167203 - DNA, 22 bp, Homo sapiens
cagccaggactcccatttagga

SEQ ID NO: 8167204 - DNA, 22 bp, Homo sapiens
cagccaggagcctctgcaacta

SEQ ID NO: 8167205 - DNA, 22 bp, Homo sapiens
cagccaggactcccatttagga

SEQ ID NO: 8167206 - DNA, 22 bp, Homo sapiens
cagccaggagcctctgcaacta

SEQ ID NO: 8167207 - DNA, 22 bp, Homo sapiens
cagccaggagctccccctgctc

SEQ ID NO: 8167208 - DNA, 22 bp, Homo sapiens
cagccaggagctccccctgctc

SEQ ID NO: 8167209 - DNA, 22 bp, Homo sapiens
cagccaggagctccccctgctc

SEQ ID NO: 8167210 - DNA, 22 bp, Homo sapiens
gtcagcaaaaaatttatgtgag

SEQ ID NO: 8167211 - DNA, 22 bp, Homo sapiens
gtcagattttcaagacgagagg

SEQ ID NO: 8167212 - DNA, 22 bp, Homo sapiens
gtcagatgatacactgttgtca

SEQ ID NO: 8167213 - DNA, 19 bp, Homo sapiens
gtcagcaccatggacaggg

SEQ ID NO: 8167214 - DNA, 22 bp, Homo sapiens
gtcagcacctctttggggagct

SEQ ID NO: 8167215 - DNA, 22 bp, Homo sapiens
gtcagcacttttccgaggcaga

SEQ ID NO: 8167216 - DNA, 22 bp, Homo sapiens
gtcagcagtggcagctcccggg

SEQ ID NO: 8167217 - DNA, 22 bp, Homo sapiens
gtcagcagtgtcagctctgggg

SEQ ID NO: 8167218 - DNA, 22 bp, Homo sapiens
gtcagcagggtccccttgagtg

SEQ ID NO: 8167219 - DNA, 22 bp, Homo sapiens
gtcagcagggtccccttgagtg

SEQ ID NO: 8167220 - DNA, 22 bp, Homo sapiens
gtcagcagggtccccttgagtg

SEQ ID NO: 8167221 - DNA, 22 bp, Homo sapiens
gtcagcagggctccctggcagg

SEQ ID NO: 8167222 - DNA, 22 bp, Homo sapiens
gtcagcagggctccctggcagg

SEQ ID NO: 8167223 - DNA, 22 bp, Homo sapiens
gtcagcagcatgtttaatcaaa

SEQ ID NO: 8167224 - DNA, 21 bp, Homo sapiens
gtcagcagatccagcacttgt

SEQ ID NO: 8167225 - DNA, 22 bp, Homo sapiens
cagcatctaatcttcatgccgg

SEQ ID NO: 8167226 - DNA, 22 bp, Homo sapiens
cagcatccgttctcaggactga

SEQ ID NO: 8167227 - DNA, 22 bp, Homo sapiens
cagcatccggcagcccgggcct

SEQ ID NO: 8167228 - DNA, 22 bp, Homo sapiens
cagcagtgtctccagcatcaca

SEQ ID NO: 8167229 - DNA, 22 bp, Homo sapiens
cagcagtgtctccagcatcaca

SEQ ID NO: 8167230 - DNA, 22 bp, Homo sapiens
gtcagcagtgtcagctctgggg

SEQ ID NO: 8167231 - DNA, 22 bp, Homo sapiens
cagcatccctcaggggcctctg

SEQ ID NO: 8167232 - DNA, 22 bp, Homo sapiens
cagcatctccatggctttggag

SEQ ID NO: 8167233 - DNA, 22 bp, Homo sapiens
cagcatctcctgtgcagaggga

SEQ ID NO: 8167234 - DNA, 22 bp, Homo sapiens
gtcacagatctcttgagtcaag

SEQ ID NO: 8167235 - DNA, 22 bp, Homo sapiens
gtcacagagttattaattgtgt

SEQ ID NO: 8167236 - DNA, 22 bp, Homo sapiens
gtcacactcttccctccacatg

SEQ ID NO: 8167237 - DNA, 22 bp, Homo sapiens
gtcacactagggccaagtggag

SEQ ID NO: 8167238 - DNA, 22 bp, Homo sapiens
gtcacaggaaagggtgtaaggg

SEQ ID NO: 8167239 - DNA, 22 bp, Homo sapiens
gtcacagatctcttgagtcaag

SEQ ID NO: 8167240 - DNA, 22 bp, Homo sapiens
gtcagatctttggggatgctgt

SEQ ID NO: 8167241 - DNA, 22 bp, Homo sapiens
gtcacaggcagtaactaggacc

SEQ ID NO: 8167242 - DNA, 22 bp, Homo sapiens
gtcacaggaagcagcaggcact

SEQ ID NO: 8167243 - DNA, 21 bp, Homo sapiens
gtcacacaggcctggagctga

SEQ ID NO: 8167244 - DNA, 22 bp, Homo sapiens
gtcacactagggccaagtggag

SEQ ID NO: 8167245 - DNA, 22 bp, Homo sapiens
gtcacacagagccctgtgctca

SEQ ID NO: 8167246 - DNA, 22 bp, Homo sapiens
gtcacaattataggaactcaga

SEQ ID NO: 8167247 - DNA, 22 bp, Homo sapiens
gtcacacacatttctttggtgc

SEQ ID NO: 8167248 - DNA, 22 bp, Homo sapiens
gtcacacacatttctttggtgc

SEQ ID NO: 8167249 - DNA, 22 bp, Homo sapiens
gtattttatggcatgcagtggc

SEQ ID NO: 8167250 - DNA, 22 bp, Homo sapiens
gtattttacttacgcatgactt

SEQ ID NO: 8167251 - DNA, 22 bp, Homo sapiens
gtattttacttacgcatgactt

SEQ ID NO: 8167252 - DNA, 20 bp, Homo sapiens
gtagggaaggaatctgcagg

SEQ ID NO: 8167253 - DNA, 22 bp, Homo sapiens
gtagggaagggagcactggaca

SEQ ID NO: 8167254 - DNA, 21 bp, Homo sapiens
gtagggacagagagttggtga

SEQ ID NO: 8167255 - DNA, 19 bp, Homo sapiens
gtagggacagtggttctga

SEQ ID NO: 8167256 - DNA, 22 bp, Homo sapiens
gtagggacccacagtctatatt

SEQ ID NO: 8167257 - DNA, 22 bp, Homo sapiens
gtagggacttgttttactagta

SEQ ID NO: 8167258 - DNA, 22 bp, Homo sapiens
cagccctggccccaggtggtct

SEQ ID NO: 8167259 - DNA, 22 bp, Homo sapiens
cagccctgaaacaacctcctct

SEQ ID NO: 8167260 - DNA, 22 bp, Homo sapiens
cagccctgaaacaacctcctct

SEQ ID NO: 8167261 - DNA, 22 bp, Homo sapiens
cagccctgaaacaacctcctct

SEQ ID NO: 8167262 - DNA, 22 bp, Homo sapiens
cagccctgtccaatgtctgctc

SEQ ID NO: 8167263 - DNA, 22 bp, Homo sapiens
cagccctgtccaatgtctgctc

SEQ ID NO: 8167264 - DNA, 22 bp, Homo sapiens
cagccctgtccaatgtctgctc

SEQ ID NO: 8167265 - DNA, 22 bp, Homo sapiens
cagccctggtgccaaggttccc

SEQ ID NO: 8167266 - DNA, 22 bp, Homo sapiens
cagccctggtgccaaggttccc

SEQ ID NO: 8167267 - DNA, 22 bp, Homo sapiens
cagccctgtccagcagagggtg

SEQ ID NO: 8167268 - DNA, 22 bp, Homo sapiens
cagccctgtccctgagggacct

SEQ ID NO: 8167269 - DNA, 22 bp, Homo sapiens
cagccctgtccctgagggacct

SEQ ID NO: 8167270 - DNA, 22 bp, Homo sapiens
cagccctgtccagcagagggtg

SEQ ID NO: 8167271 - DNA, 22 bp, Homo sapiens
cagccctgtccagcagagggtg

SEQ ID NO: 8167272 - DNA, 22 bp, Homo sapiens
cagccctgtccagcagagggtg

SEQ ID NO: 8167273 - DNA, 22 bp, Homo sapiens
cagccctgtccagcagagggtg

SEQ ID NO: 8167274 - DNA, 22 bp, Homo sapiens
cagccctgtctatgactgatga

SEQ ID NO: 8167275 - DNA, 22 bp, Homo sapiens
cagccctgtctatgactgatga

SEQ ID NO: 8167276 - DNA, 22 bp, Homo sapiens
cagccctgtctatgactgatga

SEQ ID NO: 8167277 - DNA, 22 bp, Homo sapiens
cagccctgtctatgactgatga

SEQ ID NO: 8167278 - DNA, 22 bp, Homo sapiens
cagccctgtctatgactgatga

SEQ ID NO: 8167279 - DNA, 22 bp, Homo sapiens
cagccctcctaccctgccaggc

SEQ ID NO: 8167280 - DNA, 22 bp, Homo sapiens
cagccctcctaccctgccaggc

SEQ ID NO: 8167281 - DNA, 22 bp, Homo sapiens
cagccctcctaccctgccaggc

SEQ ID NO: 8167282 - DNA, 20 bp, Homo sapiens
cagccctccagtggaggcag

SEQ ID NO: 8167283 - DNA, 22 bp, Homo sapiens
cagccctcctaccctgccaggc

SEQ ID NO: 8167284 - DNA, 22 bp, Homo sapiens
cagccctcctttcactcccagg

SEQ ID NO: 8167285 - DNA, 22 bp, Homo sapiens
cagccctctgaagaggcgcttg

SEQ ID NO: 8167286 - DNA, 19 bp, Homo sapiens
cagccctcttaccactgtg

SEQ ID NO: 8167287 - DNA, 19 bp, Homo sapiens
cagccctcttaccactgtg

SEQ ID NO: 8167288 - DNA, 22 bp, Homo sapiens
cagccctgaaacaacctcctct

SEQ ID NO: 8167289 - DNA, 18 bp, Homo sapiens
gtgagcagagagcatcac

SEQ ID NO: 8167290 - DNA, 18 bp, Homo sapiens
gtgagcagagagcatcac

SEQ ID NO: 8167291 - DNA, 18 bp, Homo sapiens
gtgagcagagagcatcac

SEQ ID NO: 8167292 - DNA, 22 bp, Homo sapiens
gtgagcagaacaggtggcttct

SEQ ID NO: 8167293 - DNA, 22 bp, Homo sapiens
gtgagcagaataagggttgaga

SEQ ID NO: 8167294 - DNA, 22 bp, Homo sapiens
gtgagagtgtttggaaatagaa

SEQ ID NO: 8167295 - DNA, 22 bp, Homo sapiens
gtgagatggagttggtgtcttt

SEQ ID NO: 8167296 - DNA, 22 bp, Homo sapiens
gtgagcaatgttatcaggttga

SEQ ID NO: 8167297 - DNA, 22 bp, Homo sapiens
cagccctcatcccgcctgcgtt

SEQ ID NO: 8167298 - DNA, 23 bp, Homo sapiens
gtgagcagcccactaggaatgcc

SEQ ID NO: 8167299 - DNA, 18 bp, Homo sapiens
gtgagcagagagcatcac

SEQ ID NO: 8167300 - DNA, 22 bp, Homo sapiens
gtgagcagagatcgcgtgattg

SEQ ID NO: 8167301 - DNA, 23 bp, Homo sapiens
gtgagcagcaccatgaggctaga

SEQ ID NO: 8167302 - DNA, 22 bp, Homo sapiens
gtgagagggctgggctcatgat

SEQ ID NO: 8167303 - DNA, 22 bp, Homo sapiens
gtgagagattgattgtagcggc

SEQ ID NO: 8167304 - DNA, 22 bp, Homo sapiens
gtgagagattgattgtagcggc

SEQ ID NO: 8167305 - DNA, 22 bp, Homo sapiens
gtgaatttagtttgtaagaagg

SEQ ID NO: 8167306 - DNA, 22 bp, Homo sapiens
gtcctgtgctcagacatggggg

SEQ ID NO: 8167307 - DNA, 22 bp, Homo sapiens
gtcctgtgctcagacatggggg

SEQ ID NO: 8167308 - DNA, 22 bp, Homo sapiens
gtcctgtgccctgggtggcgct

SEQ ID NO: 8167309 - DNA, 22 bp, Homo sapiens
gtcctgtgccctgggtggcgct

SEQ ID NO: 8167310 - DNA, 22 bp, Homo sapiens
gtcctgtgcaccgtgggatgtt

SEQ ID NO: 8167311 - DNA, 22 bp, Homo sapiens
gtcctgtgccgaggtgggaagc

SEQ ID NO: 8167312 - DNA, 22 bp, Homo sapiens
gtcctgtgccgaggtgggaagc

SEQ ID NO: 8167313 - DNA, 22 bp, Homo sapiens
gtcctgtgccctgggtggcgct

SEQ ID NO: 8167314 - DNA, 22 bp, Homo sapiens
gtcctgtgccctgggtggcgct

SEQ ID NO: 8167315 - DNA, 22 bp, Homo sapiens
cagccaggcccccgagtcgttg

SEQ ID NO: 8167316 - DNA, 22 bp, Homo sapiens
gtcctggtataattgtttaaaa

SEQ ID NO: 8167317 - DNA, 22 bp, Homo sapiens
gtcctggtgaggtagtgggagg

SEQ ID NO: 8167318 - DNA, 17 bp, Homo sapiens
gtcctggtgtgtgagga

SEQ ID NO: 8167319 - DNA, 22 bp, Homo sapiens
gtcctggtgccacctgcgggat

SEQ ID NO: 8167320 - DNA, 22 bp, Homo sapiens
gtcctgtcccccaaggctgtgg

SEQ ID NO: 8167321 - DNA, 22 bp, Homo sapiens
gtcctgtcccccaaggctgtgg

SEQ ID NO: 8167322 - DNA, 22 bp, Homo sapiens
gtcctggttttcacagaccttt

SEQ ID NO: 8167323 - DNA, 22 bp, Homo sapiens
gtcctgtgacctgcatcctgag

SEQ ID NO: 8167324 - DNA, 22 bp, Homo sapiens
gtcctgtgagattcatgctcaa

SEQ ID NO: 8167325 - DNA, 22 bp, Homo sapiens
gtcctgtgatgagtaccaggtg

SEQ ID NO: 8167326 - DNA, 22 bp, Homo sapiens
gtcctgtgcaccgtgggatgtt

SEQ ID NO: 8167327 - DNA, 22 bp, Homo sapiens
gtcctgtgcaccgtgggatgtt

SEQ ID NO: 8167328 - DNA, 22 bp, Homo sapiens
gtcctgtgcaccgtgggatgtt

SEQ ID NO: 8167329 - DNA, 22 bp, Homo sapiens
cttctcctctgagtcctgggag

SEQ ID NO: 8167330 - DNA, 22 bp, Homo sapiens
cttctcctctgagtcctgggag

SEQ ID NO: 8167331 - DNA, 22 bp, Homo sapiens
cttctccctgggggctctttat

SEQ ID NO: 8167332 - DNA, 22 bp, Homo sapiens
cttctcctaaggtcagaattgc

SEQ ID NO: 8167333 - DNA, 22 bp, Homo sapiens
cttctcctaaggtcagaattgc

SEQ ID NO: 8167334 - DNA, 22 bp, Homo sapiens
cttctccctggcttctgcacac

SEQ ID NO: 8167335 - DNA, 22 bp, Homo sapiens
cttctccctggcttctgcacac

SEQ ID NO: 8167336 - DNA, 22 bp, Homo sapiens
cttctccctgggggctctttat

SEQ ID NO: 8167337 - DNA, 22 bp, Homo sapiens
cttctccccagaaaagatttct

SEQ ID NO: 8167338 - DNA, 18 bp, Homo sapiens
cttctcccatcttggcca

SEQ ID NO: 8167339 - DNA, 18 bp, Homo sapiens
cttctcccatcttggcca

SEQ ID NO: 8167340 - DNA, 18 bp, Homo sapiens
cttctcccatcttggcca

SEQ ID NO: 8167341 - DNA, 22 bp, Homo sapiens
cttctcccaagtatgcagtttg

SEQ ID NO: 8167342 - DNA, 22 bp, Homo sapiens
cttctcccaagtatgcagtttg

SEQ ID NO: 8167343 - DNA, 19 bp, Homo sapiens
cttctccagcttctagaag

SEQ ID NO: 8167344 - DNA, 22 bp, Homo sapiens
cttctccctggcttctgcacac

SEQ ID NO: 8167345 - DNA, 22 bp, Homo sapiens
cttctccctggcttctgcacac

SEQ ID NO: 8167346 - DNA, 22 bp, Homo sapiens
cttctcccgaagccggttctgc

SEQ ID NO: 8167347 - DNA, 22 bp, Homo sapiens
cttctcccgaagccggttctgc

SEQ ID NO: 8167348 - DNA, 22 bp, Homo sapiens
cttctccctggcttctgcacac

SEQ ID NO: 8167349 - DNA, 22 bp, Homo sapiens
cttctccctggcttctgcacac

SEQ ID NO: 8167350 - DNA, 22 bp, Homo sapiens
atctggaattgaagaggtttga

SEQ ID NO: 8167351 - DNA, 22 bp, Homo sapiens
atctggaattaagagaaagtga

SEQ ID NO: 8167352 - DNA, 22 bp, Homo sapiens
atctggaattaagagaaagtga

SEQ ID NO: 8167353 - DNA, 22 bp, Homo sapiens
atctggaattgaagaggtttga

SEQ ID NO: 8167354 - DNA, 22 bp, Homo sapiens
atctggactggacatagtcttt

SEQ ID NO: 8167355 - DNA, 22 bp, Homo sapiens
atctggagaaaccgccaaggga

SEQ ID NO: 8167356 - DNA, 22 bp, Homo sapiens
cttctccagccacgcccactcc

SEQ ID NO: 8167357 - DNA, 19 bp, Homo sapiens
cttctccagcttctagaag

SEQ ID NO: 8167358 - DNA, 22 bp, Homo sapiens
cttctccagccacgcccactcc

SEQ ID NO: 8167359 - DNA, 22 bp, Homo sapiens
atctggaagtcagaggtttgca

SEQ ID NO: 8167360 - DNA, 22 bp, Homo sapiens
atctggaagtcagaggtttgca

SEQ ID NO: 8167361 - DNA, 22 bp, Homo sapiens
atctggaagtaggagagtgggc

SEQ ID NO: 8167362 - DNA, 17 bp, Homo sapiens
atctggaagctagctga

SEQ ID NO: 8167363 - DNA, 17 bp, Homo sapiens
atctggaagctagctga

SEQ ID NO: 8167364 - DNA, 22 bp, Homo sapiens
atctggaagtctccgaaggcag

SEQ ID NO: 8167365 - DNA, 22 bp, Homo sapiens
atctggaagttaagcttggtgc

SEQ ID NO: 8167366 - DNA, 22 bp, Homo sapiens
atctggaatgtctcattgggaa

SEQ ID NO: 8167367 - DNA, 22 bp, Homo sapiens
atctggaatccttgtggacaat

SEQ ID NO: 8167368 - DNA, 22 bp, Homo sapiens
atctggaatcttgctgaccctg

SEQ ID NO: 8167369 - DNA, 22 bp, Homo sapiens
atctggaatccttgtggacaat

SEQ ID NO: 8167370 - DNA, 22 bp, Homo sapiens
atctggaatagcatggggttga

SEQ ID NO: 8167371 - DNA, 22 bp, Homo sapiens
cttctcctgtaagaagatcaaa

SEQ ID NO: 8167372 - DNA, 22 bp, Homo sapiens
atcttgggaattttccaggagt

SEQ ID NO: 8167373 - DNA, 21 bp, Homo sapiens
atctttattacgcagagaaga

SEQ ID NO: 8167374 - DNA, 20 bp, Homo sapiens
atcttgggacagggcacatg

SEQ ID NO: 8167375 - DNA, 21 bp, Homo sapiens
atctttattacgcagagaaga

SEQ ID NO: 8167376 - DNA, 22 bp, Homo sapiens
atctttcaatcaggaaaaatct

SEQ ID NO: 8167377 - DNA, 22 bp, Homo sapiens
atctttcaatcaggaaaaatct

SEQ ID NO: 8167378 - DNA, 22 bp, Homo sapiens
atctttcagtttcataccaatt

SEQ ID NO: 8167379 - DNA, 22 bp, Homo sapiens
atctttcagggccatttgtatt

SEQ ID NO: 8167380 - DNA, 22 bp, Homo sapiens
atctttcagggccatttgtatt

SEQ ID NO: 8167381 - DNA, 22 bp, Homo sapiens
atctttctctgcactatacaat

SEQ ID NO: 8167382 - DNA, 22 bp, Homo sapiens
atctttctctgcactatacaat

SEQ ID NO: 8167383 - DNA, 22 bp, Homo sapiens
atctttcttatttgaagaaaga

SEQ ID NO: 8167384 - DNA, 22 bp, Homo sapiens
atctttctccatatacatcttt

SEQ ID NO: 8167385 - DNA, 22 bp, Homo sapiens
atctttctccatatacatcttt

SEQ ID NO: 8167386 - DNA, 22 bp, Homo sapiens
atctttctccatatacatcttt

SEQ ID NO: 8167387 - DNA, 22 bp, Homo sapiens
atctttctctgcactatacaat

SEQ ID NO: 8167388 - DNA, 22 bp, Homo sapiens
atctttctatttctaaaaacta

SEQ ID NO: 8167389 - DNA, 22 bp, Homo sapiens
atctttctatggtactttctcc

SEQ ID NO: 8167390 - DNA, 22 bp, Homo sapiens
atctttctatggtactttctcc

SEQ ID NO: 8167391 - DNA, 22 bp, Homo sapiens
atctttcctgttttcagacagc

SEQ ID NO: 8167392 - DNA, 22 bp, Homo sapiens
atctttctatggtactttctcc

SEQ ID NO: 8167393 - DNA, 18 bp, Homo sapiens
atctttccatagcatgtt

SEQ ID NO: 8167394 - DNA, 22 bp, Homo sapiens
atctttcatctctattatttga

SEQ ID NO: 8167395 - DNA, 18 bp, Homo sapiens
atctttccatagcatgtt

SEQ ID NO: 8167396 - DNA, 22 bp, Homo sapiens
ctttagaaatctggatgtattt

SEQ ID NO: 8167397 - DNA, 22 bp, Homo sapiens
ctttatgtgtactttccatttt

SEQ ID NO: 8167398 - DNA, 22 bp, Homo sapiens
ctttacttgctttgttacaaaa

SEQ ID NO: 8167399 - DNA, 22 bp, Homo sapiens
ctttattagatgtagactttct

SEQ ID NO: 8167400 - DNA, 22 bp, Homo sapiens
ctttacattaatttctactgat

SEQ ID NO: 8167401 - DNA, 22 bp, Homo sapiens
ctttacattaatttctactgat

SEQ ID NO: 8167402 - DNA, 22 bp, Homo sapiens
ctttactatcaggaataaacaa

SEQ ID NO: 8167403 - DNA, 22 bp, Homo sapiens
ctttacttcagcaagctttcct

SEQ ID NO: 8167404 - DNA, 22 bp, Homo sapiens
ctttacttctcaaaataaagca

SEQ ID NO: 8167405 - DNA, 22 bp, Homo sapiens
ctttactgtttggtgctctatt

SEQ ID NO: 8167406 - DNA, 22 bp, Homo sapiens
ctttattgtccttcttaggtgg

SEQ ID NO: 8167407 - DNA, 22 bp, Homo sapiens
ctttattgtccttcttaggtgg

SEQ ID NO: 8167408 - DNA, 22 bp, Homo sapiens
ctttattgtccttcttaggtgg

SEQ ID NO: 8167409 - DNA, 22 bp, Homo sapiens
ctttattgtccttcttaggtgg

SEQ ID NO: 8167410 - DNA, 22 bp, Homo sapiens
ctttattgtccttcttaggtgg

SEQ ID NO: 8167411 - DNA, 22 bp, Homo sapiens
ctttattgtccttcttaggtgg

SEQ ID NO: 8167412 - DNA, 22 bp, Homo sapiens
ctttattctgcaaattgccttg

SEQ ID NO: 8167413 - DNA, 22 bp, Homo sapiens
ctttattctgcaaattgccttg

SEQ ID NO: 8167414 - DNA, 22 bp, Homo sapiens
ctttattagatgtagactttct

SEQ ID NO: 8167415 - DNA, 22 bp, Homo sapiens
ctttattcctacaagattttct

SEQ ID NO: 8167416 - DNA, 22 bp, Homo sapiens
ctttattagatgtagactttct

SEQ ID NO: 8167417 - DNA, 22 bp, Homo sapiens
ctttattagatgtagactttct

SEQ ID NO: 8167418 - DNA, 22 bp, Homo sapiens
ctttattcctacaagattttct

SEQ ID NO: 8167419 - DNA, 22 bp, Homo sapiens
ctttattctgcaaattgccttg

SEQ ID NO: 8167420 - DNA, 22 bp, Homo sapiens
ctttattcctacaagattttct

SEQ ID NO: 8167421 - DNA, 22 bp, Homo sapiens
ctttattcctacaagattttct

SEQ ID NO: 8167422 - DNA, 20 bp, Homo sapiens
atctttggctcagaagcctt

SEQ ID NO: 8167423 - DNA, 22 bp, Homo sapiens
atctttgggatcctgatttact

SEQ ID NO: 8167424 - DNA, 22 bp, Homo sapiens
cttgttttaaactgttgtggct

SEQ ID NO: 8167425 - DNA, 22 bp, Homo sapiens
atctttgattgaagggaccctg

SEQ ID NO: 8167426 - DNA, 22 bp, Homo sapiens
ctttacagcttagtggtatgga

SEQ ID NO: 8167427 - DNA, 22 bp, Homo sapiens
ctttacagcttagtggtatgga

SEQ ID NO: 8167428 - DNA, 22 bp, Homo sapiens
ctttacagcctccagaaggaac

SEQ ID NO: 8167429 - DNA, 22 bp, Homo sapiens
ctttacagcctccagaaggaac

SEQ ID NO: 8167430 - DNA, 22 bp, Homo sapiens
ctttacagcctccagaaggaac

SEQ ID NO: 8167431 - DNA, 22 bp, Homo sapiens
ctttacagccccacttccgggc

SEQ ID NO: 8167432 - DNA, 22 bp, Homo sapiens
ctttacagatggataattgttt

SEQ ID NO: 8167433 - DNA, 22 bp, Homo sapiens
ctttacagatggataattgttt

SEQ ID NO: 8167434 - DNA, 22 bp, Homo sapiens
ctttacagataggaactactca

SEQ ID NO: 8167435 - DNA, 22 bp, Homo sapiens
ctttacagtgctgctaatggct

SEQ ID NO: 8167436 - DNA, 22 bp, Homo sapiens
ctttacataaggataaacctgg

SEQ ID NO: 8167437 - DNA, 22 bp, Homo sapiens
ctttacagtgaacttgcttgtc

SEQ ID NO: 8167438 - DNA, 22 bp, Homo sapiens
ctttacagtgaacttgcttgtc

SEQ ID NO: 8167439 - DNA, 22 bp, Homo sapiens
ctttacataaggataaacctgg

SEQ ID NO: 8167440 - DNA, 22 bp, Homo sapiens
ctttacagcttagtggtatgga

SEQ ID NO: 8167441 - DNA, 22 bp, Homo sapiens
ctttacaggaaaaggtggctgt

SEQ ID NO: 8167442 - DNA, 22 bp, Homo sapiens
ctttacaccaagcagatctttc

SEQ ID NO: 8167443 - DNA, 22 bp, Homo sapiens
ctttacaccaagcagatctttc

SEQ ID NO: 8167444 - DNA, 22 bp, Homo sapiens
ctttacagaaagagaactctgg

SEQ ID NO: 8167445 - DNA, 22 bp, Homo sapiens
ctttacacttggacccacactt

SEQ ID NO: 8167446 - DNA, 22 bp, Homo sapiens
ctttacagaataagaatactgg

SEQ ID NO: 8167447 - DNA, 22 bp, Homo sapiens
ctttacagaataagaatactgg

SEQ ID NO: 8167448 - DNA, 22 bp, Homo sapiens
ctttacagaaagagaactctgg

SEQ ID NO: 8167449 - DNA, 22 bp, Homo sapiens
ctttacagaataagaatactgg

SEQ ID NO: 8167450 - DNA, 22 bp, Homo sapiens
ctttacacaatgattttcttta

SEQ ID NO: 8167451 - DNA, 22 bp, Homo sapiens
ctttacacatcctaaccagtgt

SEQ ID NO: 8167452 - DNA, 22 bp, Homo sapiens
ctttacacatgagacctgcaat

SEQ ID NO: 8167453 - DNA, 17 bp, Homo sapiens
cttgttttccactggga

SEQ ID NO: 8167454 - DNA, 22 bp, Homo sapiens
atgacaaaagaagacatgaggt

SEQ ID NO: 8167455 - DNA, 22 bp, Homo sapiens
atgacaatggacatagttaaaa

SEQ ID NO: 8167456 - DNA, 22 bp, Homo sapiens
atgacacataaaacaaggactg

SEQ ID NO: 8167457 - DNA, 22 bp, Homo sapiens
atgacacataaaacaaggactg

SEQ ID NO: 8167458 - DNA, 23 bp, Homo sapiens
atgacactcctgtgcgcaccctg

SEQ ID NO: 8167459 - DNA, 23 bp, Homo sapiens
atgacactcctgtgcgcaccctg

SEQ ID NO: 8167460 - DNA, 22 bp, Homo sapiens
atgacactgtcctagtaaggaa

SEQ ID NO: 8167461 - DNA, 22 bp, Homo sapiens
atgacagaaggcctccctgaca

SEQ ID NO: 8167462 - DNA, 22 bp, Homo sapiens
atgacacttggtgatactttgt

SEQ ID NO: 8167463 - DNA, 22 bp, Homo sapiens
atgaattgtccgatgttgtgca

SEQ ID NO: 8167464 - DNA, 22 bp, Homo sapiens
atgaattgtaaattccttgaaa

SEQ ID NO: 8167465 - DNA, 22 bp, Homo sapiens
ctttgggcaaagggccaattcg

SEQ ID NO: 8167466 - DNA, 22 bp, Homo sapiens
ctttggctgggcaaagggaggt

SEQ ID NO: 8167467 - DNA, 22 bp, Homo sapiens
ctttggctgacgaggaggaggc

SEQ ID NO: 8167468 - DNA, 22 bp, Homo sapiens
ctttggcttgccctggcagtac

SEQ ID NO: 8167469 - DNA, 22 bp, Homo sapiens
ctttggcttgccctggcagtac

SEQ ID NO: 8167470 - DNA, 23 bp, Homo sapiens
ctttgccacccagagcctgacag

SEQ ID NO: 8167471 - DNA, 22 bp, Homo sapiens
ctttgcattttgcccaactgtg

SEQ ID NO: 8167472 - DNA, 22 bp, Homo sapiens
ctttctttgcagtgagccagag

SEQ ID NO: 8167473 - DNA, 22 bp, Homo sapiens
ctttctttcgaagacgtgatta

SEQ ID NO: 8167474 - DNA, 20 bp, Homo sapiens
ctttgcctattctctgcctg

SEQ ID NO: 8167475 - DNA, 22 bp, Homo sapiens
ctttgctgatctctggtttaaa

SEQ ID NO: 8167476 - DNA, 22 bp, Homo sapiens
ctttgctgttataatgatagct

SEQ ID NO: 8167477 - DNA, 22 bp, Homo sapiens
ctttgcttgacactgtgattgt

SEQ ID NO: 8167478 - DNA, 22 bp, Homo sapiens
ctttggaaagtggttcaggtga

SEQ ID NO: 8167479 - DNA, 22 bp, Homo sapiens
ctttggctaacaaatcagcttg

SEQ ID NO: 8167480 - DNA, 22 bp, Homo sapiens
atgagattttatagtgtcttga

SEQ ID NO: 8167481 - DNA, 22 bp, Homo sapiens
atgagatgttcaggagtctgag

SEQ ID NO: 8167482 - DNA, 22 bp, Homo sapiens
atgagattttaaaacttcactt

SEQ ID NO: 8167483 - DNA, 22 bp, Homo sapiens
atgagagctctatgatctgttt

SEQ ID NO: 8167484 - DNA, 22 bp, Homo sapiens
atgagaggtttcgtcagaggaa

SEQ ID NO: 8167485 - DNA, 22 bp, Homo sapiens
atgagaggtttcgtcagaggaa

SEQ ID NO: 8167486 - DNA, 22 bp, Homo sapiens
atgagataggaacaaacttaca

SEQ ID NO: 8167487 - DNA, 22 bp, Homo sapiens
atgagatgtgtctaatggaacc

SEQ ID NO: 8167488 - DNA, 22 bp, Homo sapiens
atgagatgtgtctaatggaacc

SEQ ID NO: 8167489 - DNA, 22 bp, Homo sapiens
atgagatagactatgtcataca

SEQ ID NO: 8167490 - DNA, 22 bp, Homo sapiens
atgagagtactagaaacttcct

SEQ ID NO: 8167491 - DNA, 22 bp, Homo sapiens
atgagagtctcagagtctcttc

SEQ ID NO: 8167492 - DNA, 22 bp, Homo sapiens
atgagactacctgtaatgtggc

SEQ ID NO: 8167493 - DNA, 22 bp, Homo sapiens
atgagacattgcaagtccagaa

SEQ ID NO: 8167494 - DNA, 22 bp, Homo sapiens
atgagaatatgatttactattg

SEQ ID NO: 8167495 - DNA, 22 bp, Homo sapiens
atgagaatatgatttactattg

SEQ ID NO: 8167496 - DNA, 22 bp, Homo sapiens
atgagaaagttaatcatcatga

SEQ ID NO: 8167497 - DNA, 22 bp, Homo sapiens
atgagaaatttattacaagcta

SEQ ID NO: 8167498 - DNA, 22 bp, Homo sapiens
atgacattgaatatgttaacta

SEQ ID NO: 8167499 - DNA, 22 bp, Homo sapiens
atgacagaggagtgcaggtgat

SEQ ID NO: 8167500 - DNA, 22 bp, Homo sapiens
atgacagaggagtgcaggtgat

SEQ ID NO: 8167501 - DNA, 22 bp, Homo sapiens
atgacagaggagtgcaggtgat

SEQ ID NO: 8167502 - DNA, 22 bp, Homo sapiens
atgacagaggagtgcaggtgat

SEQ ID NO: 8167503 - DNA, 22 bp, Homo sapiens
atgacagatagtcttcatttgc

SEQ ID NO: 8167504 - DNA, 22 bp, Homo sapiens
ctttttatagctatgtcctatg

SEQ ID NO: 8167505 - DNA, 22 bp, Homo sapiens
ctttttatagctatgtcctatg

SEQ ID NO: 8167506 - DNA, 22 bp, Homo sapiens
ctttttataccgtgccagttga

SEQ ID NO: 8167507 - DNA, 22 bp, Homo sapiens
ctttttataccgtgccagttga

SEQ ID NO: 8167508 - DNA, 22 bp, Homo sapiens
ctttttatctcttaatgatgtt

SEQ ID NO: 8167509 - DNA, 22 bp, Homo sapiens
ctttttcaagtcaaagagggta

SEQ ID NO: 8167510 - DNA, 22 bp, Homo sapiens
ctttttatctcttaatgatgtt

SEQ ID NO: 8167511 - DNA, 22 bp, Homo sapiens
ctttttatctcttaatgatgtt

SEQ ID NO: 8167512 - DNA, 22 bp, Homo sapiens
ctttttatctcttaatgatgtt

SEQ ID NO: 8167513 - DNA, 22 bp, Homo sapiens
ctttttcactgtgtcctcacac

SEQ ID NO: 8167514 - DNA, 22 bp, Homo sapiens
atgacatgattgccatttgata

SEQ ID NO: 8167515 - DNA, 22 bp, Homo sapiens
ctttttcattggctttaggaca

SEQ ID NO: 8167516 - DNA, 22 bp, Homo sapiens
atgccactgcactccagcctgg

SEQ ID NO: 8167517 - DNA, 22 bp, Homo sapiens
atgccactgcactccagcctgg

SEQ ID NO: 8167518 - DNA, 22 bp, Homo sapiens
atgccactgcactccagcctgg

SEQ ID NO: 8167519 - DNA, 22 bp, Homo sapiens
atgccactgcactccagcctgg

SEQ ID NO: 8167520 - DNA, 22 bp, Homo sapiens
atgccactgcactccagcctgg

SEQ ID NO: 8167521 - DNA, 22 bp, Homo sapiens
atgccactgcactccagcctgg

SEQ ID NO: 8167522 - DNA, 22 bp, Homo sapiens
atgccactgcactccagcctgg

SEQ ID NO: 8167523 - DNA, 22 bp, Homo sapiens
atgccactgcactccagcctgg

SEQ ID NO: 8167524 - DNA, 22 bp, Homo sapiens
atgccactgcactccagcctgg

SEQ ID NO: 8167525 - DNA, 22 bp, Homo sapiens
atgccactgcactccagcctag

SEQ ID NO: 8167526 - DNA, 22 bp, Homo sapiens
atgccactgcactccagcctag

SEQ ID NO: 8167527 - DNA, 22 bp, Homo sapiens
atgccactgcactccagcctag

SEQ ID NO: 8167528 - DNA, 22 bp, Homo sapiens
atgccactgcactccagcctag

SEQ ID NO: 8167529 - DNA, 22 bp, Homo sapiens
atgccactgcactccagcctag

SEQ ID NO: 8167530 - DNA, 22 bp, Homo sapiens
atgccactgcactccagcctag

SEQ ID NO: 8167531 - DNA, 22 bp, Homo sapiens
atgccactgcactccagcctag

SEQ ID NO: 8167532 - DNA, 22 bp, Homo sapiens
atgccactgcactccagcctag

SEQ ID NO: 8167533 - DNA, 22 bp, Homo sapiens
atgccactgcacttcagcctgg

SEQ ID NO: 8167534 - DNA, 22 bp, Homo sapiens
atgccactgcacttcagcctgg

SEQ ID NO: 8167535 - DNA, 22 bp, Homo sapiens
atgccactgcacttcagcctgg

SEQ ID NO: 8167536 - DNA, 22 bp, Homo sapiens
atgccactgcacttcagcttgg

SEQ ID NO: 8167537 - DNA, 22 bp, Homo sapiens
gaatttatctacgttaagtatg

SEQ ID NO: 8167538 - DNA, 22 bp, Homo sapiens
atgccactgcacttcagcctgg

SEQ ID NO: 8167539 - DNA, 22 bp, Homo sapiens
atgccactgcacttcagcctgg

SEQ ID NO: 8167540 - DNA, 22 bp, Homo sapiens
atgccactgcacttcagcctgg

SEQ ID NO: 8167541 - DNA, 22 bp, Homo sapiens
atgccactgcacttcagcttgg

SEQ ID NO: 8167542 - DNA, 22 bp, Homo sapiens
atgccactgcacttcagcttgg

SEQ ID NO: 8167543 - DNA, 22 bp, Homo sapiens
gaatttcaaagaggttaagagg

SEQ ID NO: 8167544 - DNA, 22 bp, Homo sapiens
gaatttcagaggtaacatcatc

SEQ ID NO: 8167545 - DNA, 22 bp, Homo sapiens
gaatttcagaggtaacatcatc

SEQ ID NO: 8167546 - DNA, 22 bp, Homo sapiens
atgcatttgacgggatatattt

SEQ ID NO: 8167547 - DNA, 22 bp, Homo sapiens
gaagtctgagtgggggccaggc

SEQ ID NO: 8167548 - DNA, 22 bp, Homo sapiens
atgcataaagaaagctatctgg

SEQ ID NO: 8167549 - DNA, 22 bp, Homo sapiens
atgcagttttaaatcatttcag

SEQ ID NO: 8167550 - DNA, 18 bp, Homo sapiens
atgcagttggtactctca

SEQ ID NO: 8167551 - DNA, 22 bp, Homo sapiens
atgcagtttaaggcacaattag

SEQ ID NO: 8167552 - DNA, 22 bp, Homo sapiens
atgcagttgcaatggaggactc

SEQ ID NO: 8167553 - DNA, 22 bp, Homo sapiens
atgcagttttcaaagactattc

SEQ ID NO: 8167554 - DNA, 22 bp, Homo sapiens
atgcagtttgcttcgcagcagt

SEQ ID NO: 8167555 - DNA, 22 bp, Homo sapiens
atgctataaactctaggtcatt

SEQ ID NO: 8167556 - DNA, 22 bp, Homo sapiens
atgctacaggaagacgtcaggc

SEQ ID NO: 8167557 - DNA, 22 bp, Homo sapiens
atgctatagaaatatttaaatt

SEQ ID NO: 8167558 - DNA, 22 bp, Homo sapiens
atgctatagaaatatttaaatt

SEQ ID NO: 8167559 - DNA, 22 bp, Homo sapiens
atgctatactcaaagaaattca

SEQ ID NO: 8167560 - DNA, 22 bp, Homo sapiens
atgctatagaaatatttaaatt

SEQ ID NO: 8167561 - DNA, 22 bp, Homo sapiens
gacagcttcgaggaggtgagct

SEQ ID NO: 8167562 - DNA, 22 bp, Homo sapiens
gacagcttagtgaaaatgtaaa

SEQ ID NO: 8167563 - DNA, 22 bp, Homo sapiens
gacagcttaggaagtttctatt

SEQ ID NO: 8167564 - DNA, 22 bp, Homo sapiens
gacaggaaaggggtctgttttc

SEQ ID NO: 8167565 - DNA, 22 bp, Homo sapiens
atgctgaaaattggatttgaat

SEQ ID NO: 8167566 - DNA, 16 bp, Homo sapiens
atgctgctattagagg

SEQ ID NO: 8167567 - DNA, 16 bp, Homo sapiens
atgctgctattagagg

SEQ ID NO: 8167568 - DNA, 20 bp, Homo sapiens
gacagcttggggtgtcacct

SEQ ID NO: 8167569 - DNA, 22 bp, Homo sapiens
gacaggaaacaagaaggcagga

SEQ ID NO: 8167570 - DNA, 22 bp, Homo sapiens
gacagcttgcctggtactgcaa

SEQ ID NO: 8167571 - DNA, 22 bp, Homo sapiens
gacagcttcttgggccgggcct

SEQ ID NO: 8167572 - DNA, 22 bp, Homo sapiens
gacagcttctatgtgacgagca

SEQ ID NO: 8167573 - DNA, 22 bp, Homo sapiens
gacagcttctagaggaattggt

SEQ ID NO: 8167574 - DNA, 22 bp, Homo sapiens
gacagcttctagaaatggtcac

SEQ ID NO: 8167575 - DNA, 22 bp, Homo sapiens
atgcctggtatgaagcaaggaa

SEQ ID NO: 8167576 - DNA, 22 bp, Homo sapiens
atgcctggatttgggactcaaa

SEQ ID NO: 8167577 - DNA, 22 bp, Homo sapiens
atgctaaggcccaggagaaaat

SEQ ID NO: 8167578 - DNA, 22 bp, Homo sapiens
gaatttcctctaaacccctgag

SEQ ID NO: 8167579 - DNA, 22 bp, Homo sapiens
atgcctggactgtatcccagat

SEQ ID NO: 8167580 - DNA, 22 bp, Homo sapiens
gaattttaagtgttcgcctctt

SEQ ID NO: 8167581 - DNA, 22 bp, Homo sapiens
gaagccttgaactgcaaacccc

SEQ ID NO: 8167582 - DNA, 22 bp, Homo sapiens
gaagccttgaactgcaaacccc

SEQ ID NO: 8167583 - DNA, 22 bp, Homo sapiens
gaagccttgaactgcaaacccc

SEQ ID NO: 8167584 - DNA, 22 bp, Homo sapiens
gaagcgtctaggtagaaattta

SEQ ID NO: 8167585 - DNA, 22 bp, Homo sapiens
gaagcgtcatgaaagaaaggct

SEQ ID NO: 8167586 - DNA, 22 bp, Homo sapiens
gaagcctggtccagagctccca

SEQ ID NO: 8167587 - DNA, 22 bp, Homo sapiens
gaagcctgctgtgcagccaaat

SEQ ID NO: 8167588 - DNA, 22 bp, Homo sapiens
gaagcctgtggataggggcatc

SEQ ID NO: 8167589 - DNA, 22 bp, Homo sapiens
gaagctaggctggggttcagga

SEQ ID NO: 8167590 - DNA, 22 bp, Homo sapiens
gaagctgcaataattgttttga

SEQ ID NO: 8167591 - DNA, 22 bp, Homo sapiens
gaagctgcgtgtagccatactt

SEQ ID NO: 8167592 - DNA, 22 bp, Homo sapiens
gaagctgcaataattgttttga

SEQ ID NO: 8167593 - DNA, 22 bp, Homo sapiens
gaagctgagtggactctggcca

SEQ ID NO: 8167594 - DNA, 22 bp, Homo sapiens
gaagctgagctgaggcatgttg

SEQ ID NO: 8167595 - DNA, 22 bp, Homo sapiens
gaaggaggcgttagccctagga

SEQ ID NO: 8167596 - DNA, 22 bp, Homo sapiens
gaaggaggcgttagccctagga

SEQ ID NO: 8167597 - DNA, 22 bp, Homo sapiens
gaaggaggcgttagccctagga

SEQ ID NO: 8167598 - DNA, 22 bp, Homo sapiens
gaagctgggtcgctgggatcct

SEQ ID NO: 8167599 - DNA, 22 bp, Homo sapiens
gaagctggctgaagttcagcta

SEQ ID NO: 8167600 - DNA, 22 bp, Homo sapiens
gaagctgggtcgctgggatcct

SEQ ID NO: 8167601 - DNA, 22 bp, Homo sapiens
gaaggagggtgcggatctgagc

SEQ ID NO: 8167602 - DNA, 22 bp, Homo sapiens
gaaggagggtgcggatctgagc

SEQ ID NO: 8167603 - DNA, 22 bp, Homo sapiens
gaaggagggtgcggatctgagc

SEQ ID NO: 8167604 - DNA, 22 bp, Homo sapiens
gaaggagggtgcggatctgagc

SEQ ID NO: 8167605 - DNA, 22 bp, Homo sapiens
gaaggagggtgcggatctgagc

SEQ ID NO: 8167606 - DNA, 22 bp, Homo sapiens
gaaggagggtgcggatctgagc

SEQ ID NO: 8167607 - DNA, 22 bp, Homo sapiens
gaaggagggtgcggatctgagc

SEQ ID NO: 8167608 - DNA, 22 bp, Homo sapiens
gaaggagggagcggcgcggatt

SEQ ID NO: 8167609 - DNA, 22 bp, Homo sapiens
gaaggagggagcggcgcggatt

SEQ ID NO: 8167610 - DNA, 22 bp, Homo sapiens
gaaggagggagcggcgcggatt

SEQ ID NO: 8167611 - DNA, 22 bp, Homo sapiens
gaaggaggctccccaaagtctg

SEQ ID NO: 8167612 - DNA, 22 bp, Homo sapiens
atgcaggagccctcttgagggc

SEQ ID NO: 8167613 - DNA, 22 bp, Homo sapiens
gaaggcaacaccaggatgcact

SEQ ID NO: 8167614 - DNA, 22 bp, Homo sapiens
gaaggatttgagattatcctag

SEQ ID NO: 8167615 - DNA, 22 bp, Homo sapiens
gaaggaggtgtcagttggactg

SEQ ID NO: 8167616 - DNA, 22 bp, Homo sapiens
gaaggaggtgtcagttggactg

SEQ ID NO: 8167617 - DNA, 22 bp, Homo sapiens
atgcagtgtttggaagcttaag

SEQ ID NO: 8167618 - DNA, 22 bp, Homo sapiens
atgcagttagtatacttccagt

SEQ ID NO: 8167619 - DNA, 22 bp, Homo sapiens
atgcagtggcagctcctggtgt

SEQ ID NO: 8167620 - DNA, 22 bp, Homo sapiens
atgcagtagataggcactttta

SEQ ID NO: 8167621 - DNA, 22 bp, Homo sapiens
atgcagtataaatcatttctgg

SEQ ID NO: 8167622 - DNA, 22 bp, Homo sapiens
atgcagtacagataattctaca

SEQ ID NO: 8167623 - DNA, 22 bp, Homo sapiens
atgcagtaaatgttctagtttg

SEQ ID NO: 8167624 - DNA, 22 bp, Homo sapiens
atgcaggttgtatctgaagcca

SEQ ID NO: 8167625 - DNA, 22 bp, Homo sapiens
gaagagagcagcaaactggagt

SEQ ID NO: 8167626 - DNA, 22 bp, Homo sapiens
gaagagagagtggggttctgcg

SEQ ID NO: 8167627 - DNA, 22 bp, Homo sapiens
gaagagagagtggggttctgcg

SEQ ID NO: 8167628 - DNA, 22 bp, Homo sapiens
gaagagagagtggggttctgcg

SEQ ID NO: 8167629 - DNA, 21 bp, Homo sapiens
gaagagagtcctcatcctgag

SEQ ID NO: 8167630 - DNA, 22 bp, Homo sapiens
gaagagagcagcaaactggagt

SEQ ID NO: 8167631 - DNA, 22 bp, Homo sapiens
gaagagagcagcaaactggagt

SEQ ID NO: 8167632 - DNA, 22 bp, Homo sapiens
gaagaaagggaattaacttgag

SEQ ID NO: 8167633 - DNA, 22 bp, Homo sapiens
gaagaaagggaattaacttgag

SEQ ID NO: 8167634 - DNA, 22 bp, Homo sapiens
gaagaaagggaattaacttgag

SEQ ID NO: 8167635 - DNA, 22 bp, Homo sapiens
gaagagagaacattacataaac

SEQ ID NO: 8167636 - DNA, 22 bp, Homo sapiens
gaagagagagccctggggtccg

SEQ ID NO: 8167637 - DNA, 22 bp, Homo sapiens
atgagctgagtttgtaagtctt

SEQ ID NO: 8167638 - DNA, 22 bp, Homo sapiens
atgagcccagggaattcctttc

SEQ ID NO: 8167639 - DNA, 22 bp, Homo sapiens
atgagctgggccatccagtgat

SEQ ID NO: 8167640 - DNA, 22 bp, Homo sapiens
atgagctgtgggattccagagg

SEQ ID NO: 8167641 - DNA, 22 bp, Homo sapiens
atgagctgtgggattccagagg

SEQ ID NO: 8167642 - DNA, 22 bp, Homo sapiens
atgagctgtgggattccagagg

SEQ ID NO: 8167643 - DNA, 22 bp, Homo sapiens
atgagcagtttttaagtagcaa

SEQ ID NO: 8167644 - DNA, 22 bp, Homo sapiens
atgagcaggtttaagagaggcc

SEQ ID NO: 8167645 - DNA, 22 bp, Homo sapiens
atgagcagtaggttcatggctg

SEQ ID NO: 8167646 - DNA, 22 bp, Homo sapiens
gaagagctaaaggcacaggctt

SEQ ID NO: 8167647 - DNA, 22 bp, Homo sapiens
atgatggatatgtaaagtgttg

SEQ ID NO: 8167648 - DNA, 22 bp, Homo sapiens
atgatggatgtcacagtctgta

SEQ ID NO: 8167649 - DNA, 22 bp, Homo sapiens
atgatggctaggctggttttga

SEQ ID NO: 8167650 - DNA, 22 bp, Homo sapiens
atgatggctaggctggttttga

SEQ ID NO: 8167651 - DNA, 21 bp, Homo sapiens
gaagagagtcctcatcctgag

SEQ ID NO: 8167652 - DNA, 21 bp, Homo sapiens
gaagagagtcctcatcctgag

SEQ ID NO: 8167653 - DNA, 22 bp, Homo sapiens
gaagagatgacaaaggagcatg

SEQ ID NO: 8167654 - DNA, 22 bp, Homo sapiens
gaagagatgacaaaggagcatg

SEQ ID NO: 8167655 - DNA, 22 bp, Homo sapiens
gaagagatgacaaaggagcatg

SEQ ID NO: 8167656 - DNA, 22 bp, Homo sapiens
gaagagcatttgcccaggctgt

SEQ ID NO: 8167657 - DNA, 22 bp, Homo sapiens
gaagagcatatgaagagcatat

SEQ ID NO: 8167658 - DNA, 22 bp, Homo sapiens
gaagagcatatgaagagcatat

SEQ ID NO: 8167659 - DNA, 22 bp, Homo sapiens
atgatgttggtttaatttgagt

SEQ ID NO: 8167660 - DNA, 23 bp, Homo sapiens
gaagcagatgtctgagtaggcag

SEQ ID NO: 8167661 - DNA, 22 bp, Homo sapiens
atgatgtcatgaatatattagt

SEQ ID NO: 8167662 - DNA, 22 bp, Homo sapiens
atgatgtcattcttgtttgctc

SEQ ID NO: 8167663 - DNA, 22 bp, Homo sapiens
atgatgtccacaggggtgttca

SEQ ID NO: 8167664 - DNA, 22 bp, Homo sapiens
atgatgtgtgctgatcaagctt

SEQ ID NO: 8167665 - DNA, 22 bp, Homo sapiens
atgatgtatgactgtgttcaaa

SEQ ID NO: 8167666 - DNA, 22 bp, Homo sapiens
atgatgtaacataaagatgtct

SEQ ID NO: 8167667 - DNA, 22 bp, Homo sapiens
atgttactgtgatcatgatact

SEQ ID NO: 8167668 - DNA, 22 bp, Homo sapiens
atgttacctctattagaatatt

SEQ ID NO: 8167669 - DNA, 22 bp, Homo sapiens
atgttacagttgagtaaattaa

SEQ ID NO: 8167670 - DNA, 22 bp, Homo sapiens
atgttacattgagaggtggttg

SEQ ID NO: 8167671 - DNA, 22 bp, Homo sapiens
atgttacatagtccttatttgt

SEQ ID NO: 8167672 - DNA, 22 bp, Homo sapiens
atgttacatagtccttatttgt

SEQ ID NO: 8167673 - DNA, 22 bp, Homo sapiens
atgttacagagaaagtggaagc

SEQ ID NO: 8167674 - DNA, 22 bp, Homo sapiens
atgttacagggagagaaggcca

SEQ ID NO: 8167675 - DNA, 22 bp, Homo sapiens
atgtggctagggaataaaatat

SEQ ID NO: 8167676 - DNA, 18 bp, Homo sapiens
atgtggctagtgcaactg

SEQ ID NO: 8167677 - DNA, 18 bp, Homo sapiens
atgtggctagtgctactg

SEQ ID NO: 8167678 - DNA, 22 bp, Homo sapiens
atgtggctagtggctatgatct

SEQ ID NO: 8167679 - DNA, 22 bp, Homo sapiens
atgtggctagtggctatgatct

SEQ ID NO: 8167680 - DNA, 22 bp, Homo sapiens
atgtggctcacatagctggaaa

SEQ ID NO: 8167681 - DNA, 22 bp, Homo sapiens
atgtggctcattgtttgcttac

SEQ ID NO: 8167682 - DNA, 21 bp, Homo sapiens
atgtggctcccttcctcagga

SEQ ID NO: 8167683 - DNA, 22 bp, Homo sapiens
atgtggctggtgactgccgtac

SEQ ID NO: 8167684 - DNA, 23 bp, Homo sapiens
atgttaaacataactgaagagcc

SEQ ID NO: 8167685 - DNA, 22 bp, Homo sapiens
atgtggctgatcgcagagctct

SEQ ID NO: 8167686 - DNA, 22 bp, Homo sapiens
atgtggctgccacctgcctgaa

SEQ ID NO: 8167687 - DNA, 22 bp, Homo sapiens
atgtggctgccacctgcctgaa

SEQ ID NO: 8167688 - DNA, 22 bp, Homo sapiens
gaggttggcgccctgcctggcc

SEQ ID NO: 8167689 - DNA, 22 bp, Homo sapiens
gaggttggcgccctgcctggcc

SEQ ID NO: 8167690 - DNA, 22 bp, Homo sapiens
gaggttggagggctggcctgca

SEQ ID NO: 8167691 - DNA, 21 bp, Homo sapiens
gagtgcaggtctgatgccatc

SEQ ID NO: 8167692 - DNA, 22 bp, Homo sapiens
gagtgcagtatgagaggctgct

SEQ ID NO: 8167693 - DNA, 22 bp, Homo sapiens
gagtgcagtatcttctgtgtcc

SEQ ID NO: 8167694 - DNA, 22 bp, Homo sapiens
gagtgcagtatcttctgtgtcc

SEQ ID NO: 8167695 - DNA, 22 bp, Homo sapiens
gagtgcagtatcttctgtgtcc

SEQ ID NO: 8167696 - DNA, 22 bp, Homo sapiens
gaggttccccattgtactggct

SEQ ID NO: 8167697 - DNA, 22 bp, Homo sapiens
gaggttgccatgcatcctggtt

SEQ ID NO: 8167698 - DNA, 19 bp, Homo sapiens
gaggttcacgcgctggatg

SEQ ID NO: 8167699 - DNA, 22 bp, Homo sapiens
gaggttcacttcctgaaatagc

SEQ ID NO: 8167700 - DNA, 22 bp, Homo sapiens
gaggttcagctgctgcctggta

SEQ ID NO: 8167701 - DNA, 22 bp, Homo sapiens
gaggttcaggaaatgggcaaag

SEQ ID NO: 8167702 - DNA, 22 bp, Homo sapiens
gaggttcacttcctggatcctt

SEQ ID NO: 8167703 - DNA, 22 bp, Homo sapiens
gaggttcagtaaggaatactga

SEQ ID NO: 8167704 - DNA, 22 bp, Homo sapiens
gaggtgtgaggaatgaatgggg

SEQ ID NO: 8167705 - DNA, 22 bp, Homo sapiens
atgttatgtaacacttgtttct

SEQ ID NO: 8167706 - DNA, 22 bp, Homo sapiens
atgttatgtccctcttactcag

SEQ ID NO: 8167707 - DNA, 22 bp, Homo sapiens
atgttatgacaagcatgacaga

SEQ ID NO: 8167708 - DNA, 22 bp, Homo sapiens
atgttatggctcaaacatttgg

SEQ ID NO: 8167709 - DNA, 22 bp, Homo sapiens
atgttatgacaagcatgacaga

SEQ ID NO: 8167710 - DNA, 22 bp, Homo sapiens
atgttataaatagagacactgg

SEQ ID NO: 8167711 - DNA, 22 bp, Homo sapiens
atgttataaatagagacactgg

SEQ ID NO: 8167712 - DNA, 22 bp, Homo sapiens
atgttagtgtcactttgtacaa

SEQ ID NO: 8167713 - DNA, 22 bp, Homo sapiens
atgttataaatagagacactgg

SEQ ID NO: 8167714 - DNA, 22 bp, Homo sapiens
gaggtgtgctgcggcccggtgc

SEQ ID NO: 8167715 - DNA, 22 bp, Homo sapiens
gaggtgtggtcctcagccccca

SEQ ID NO: 8167716 - DNA, 22 bp, Homo sapiens
gaggtgtgcacagcgtgctgac

SEQ ID NO: 8167717 - DNA, 22 bp, Homo sapiens
gaggtgtgcacagcgtgctgac

SEQ ID NO: 8167718 - DNA, 22 bp, Homo sapiens
gaggttcacaggctatcacagt

SEQ ID NO: 8167719 - DNA, 22 bp, Homo sapiens
gaggtgtgttacagattgtcat

SEQ ID NO: 8167720 - DNA, 22 bp, Homo sapiens
gaggtgtgttacagattgtcat

SEQ ID NO: 8167721 - DNA, 22 bp, Homo sapiens
gaggtgtgttacagattgtcat

SEQ ID NO: 8167722 - DNA, 22 bp, Homo sapiens
atgtgccaatttatagaggctc

SEQ ID NO: 8167723 - DNA, 22 bp, Homo sapiens
atgtgaggttaacctactgtta

SEQ ID NO: 8167724 - DNA, 22 bp, Homo sapiens
atgtgaggttaacctactgtta

SEQ ID NO: 8167725 - DNA, 22 bp, Homo sapiens
atgtcatattactaatgctggc

SEQ ID NO: 8167726 - DNA, 22 bp, Homo sapiens
atgtgaggtagataggatgcag

SEQ ID NO: 8167727 - DNA, 22 bp, Homo sapiens
atgtgaggtagataggatgcag

SEQ ID NO: 8167728 - DNA, 20 bp, Homo sapiens
atgtcaggaagggagtcagg

SEQ ID NO: 8167729 - DNA, 21 bp, Homo sapiens
atgtcaggcacttatgaggaa

SEQ ID NO: 8167730 - DNA, 22 bp, Homo sapiens
atgtcaggaccctactgcattg

SEQ ID NO: 8167731 - DNA, 22 bp, Homo sapiens
atgtcagtagtttctttgagtt

SEQ ID NO: 8167732 - DNA, 22 bp, Homo sapiens
atgtcagttataaaagacagat

SEQ ID NO: 8167733 - DNA, 22 bp, Homo sapiens
atgtcagaatctacattctact

SEQ ID NO: 8167734 - DNA, 22 bp, Homo sapiens
atgtcactccagggacacaggt

SEQ ID NO: 8167735 - DNA, 19 bp, Homo sapiens
atgtcactcatgttccctg

SEQ ID NO: 8167736 - DNA, 22 bp, Homo sapiens
gaggctgaacaggttctcatga

SEQ ID NO: 8167737 - DNA, 22 bp, Homo sapiens
gaggctcttttctgctgtgtct

SEQ ID NO: 8167738 - DNA, 22 bp, Homo sapiens
gaggctcttttctgctgtgtct

SEQ ID NO: 8167739 - DNA, 22 bp, Homo sapiens
gaggctgaacaggttctcatga

SEQ ID NO: 8167740 - DNA, 22 bp, Homo sapiens
atgtcacttttgagactaggtt

SEQ ID NO: 8167741 - DNA, 22 bp, Homo sapiens
atgtcactgtgaggcagctgtc

SEQ ID NO: 8167742 - DNA, 22 bp, Homo sapiens
atgtcactgtgaggcagctgtc

SEQ ID NO: 8167743 - DNA, 22 bp, Homo sapiens
atgtcactgtttaccagctcca

SEQ ID NO: 8167744 - DNA, 22 bp, Homo sapiens
atgtcactgttgttattgttat

SEQ ID NO: 8167745 - DNA, 22 bp, Homo sapiens
atgtgctttaggtttgtttaca

SEQ ID NO: 8167746 - DNA, 22 bp, Homo sapiens
atgtgcttcattctacatgaca

SEQ ID NO: 8167747 - DNA, 22 bp, Homo sapiens
atgtgcttcattctacatgaca

SEQ ID NO: 8167748 - DNA, 22 bp, Homo sapiens
atgtgctggctaactggatggg

SEQ ID NO: 8167749 - DNA, 22 bp, Homo sapiens
atgtgctaagcactacttgtca

SEQ ID NO: 8167750 - DNA, 22 bp, Homo sapiens
atgtggaatgaacaaaggaggc

SEQ ID NO: 8167751 - DNA, 20 bp, Homo sapiens
atgtggataagggcagaatc

SEQ ID NO: 8167752 - DNA, 22 bp, Homo sapiens
atgtggatagcacaggaatggt

SEQ ID NO: 8167753 - DNA, 22 bp, Homo sapiens
atgtggatgtttatatgaagaa

SEQ ID NO: 8167754 - DNA, 22 bp, Homo sapiens
atgtggatctgttattctagat

SEQ ID NO: 8167755 - DNA, 22 bp, Homo sapiens
atgtggatggaagtcagatagc

SEQ ID NO: 8167756 - DNA, 22 bp, Homo sapiens
atgtggatggaagtcagatagc

SEQ ID NO: 8167757 - DNA, 22 bp, Homo sapiens
atgtggatgtttatatgaagaa

SEQ ID NO: 8167758 - DNA, 22 bp, Homo sapiens
atgtggaatgaacaaaggaggc

SEQ ID NO: 8167759 - DNA, 22 bp, Homo sapiens
atgtgctttgctggaaatgtca

SEQ ID NO: 8167760 - DNA, 22 bp, Homo sapiens
atgtgctttctttgtttcataa

SEQ ID NO: 8167761 - DNA, 22 bp, Homo sapiens
atgtggcctagtatagaaatga

SEQ ID NO: 8167762 - DNA, 22 bp, Homo sapiens
atgtggattgtaggaaactgat

SEQ ID NO: 8167763 - DNA, 23 bp, Homo sapiens
atgtatttaaatttcagtgatga

SEQ ID NO: 8167764 - DNA, 23 bp, Homo sapiens
atgtatttaaatttcagtgatga

SEQ ID NO: 8167765 - DNA, 23 bp, Homo sapiens
atgtatttaaatttcagtgatga

SEQ ID NO: 8167766 - DNA, 22 bp, Homo sapiens
atgtattgaccatactactaaa

SEQ ID NO: 8167767 - DNA, 23 bp, Homo sapiens
atgtatttaaatttcagtgatga

SEQ ID NO: 8167768 - DNA, 22 bp, Homo sapiens
atgtatttactgagaaggaaac

SEQ ID NO: 8167769 - DNA, 22 bp, Homo sapiens
atgtatttactgagaaggaaac

SEQ ID NO: 8167770 - DNA, 22 bp, Homo sapiens
atgtatttctatgtagtgaaga

SEQ ID NO: 8167771 - DNA, 22 bp, Homo sapiens
gaggctccatggaggagtatgg

SEQ ID NO: 8167772 - DNA, 22 bp, Homo sapiens
gaggctccagcgacacctaggc

SEQ ID NO: 8167773 - DNA, 22 bp, Homo sapiens
gaggctccagcgacacctaggc

SEQ ID NO: 8167774 - DNA, 22 bp, Homo sapiens
atgtatttctatgtagtgaaga

SEQ ID NO: 8167775 - DNA, 22 bp, Homo sapiens
gaggcctgggttggaggtgcat

SEQ ID NO: 8167776 - DNA, 22 bp, Homo sapiens
atgtatttctatgtagtgaaga

SEQ ID NO: 8167777 - DNA, 22 bp, Homo sapiens
atgtatttctatgtagtgaaga

SEQ ID NO: 8167778 - DNA, 22 bp, Homo sapiens
atgtatttctatgtagtgaaga

SEQ ID NO: 8167779 - DNA, 22 bp, Homo sapiens
gaggctccctttaggtccagat

SEQ ID NO: 8167780 - DNA, 22 bp, Homo sapiens
gaggctccggtagtagccttga

SEQ ID NO: 8167781 - DNA, 22 bp, Homo sapiens
gaggctccgtgctgctgccctg

SEQ ID NO: 8167782 - DNA, 22 bp, Homo sapiens
gaggctccgtgctgctgccctg

SEQ ID NO: 8167783 - DNA, 22 bp, Homo sapiens
gaggctccctcaactctgggtg

SEQ ID NO: 8167784 - DNA, 22 bp, Homo sapiens
gaggctccctcaactctgggtg

SEQ ID NO: 8167785 - DNA, 22 bp, Homo sapiens
gaggctccccatgaggccccag

SEQ ID NO: 8167786 - DNA, 22 bp, Homo sapiens
gaggctcccaaggggctaggcc

SEQ ID NO: 8167787 - DNA, 22 bp, Homo sapiens
gaggctccccatgaggccccag

SEQ ID NO: 8167788 - DNA, 22 bp, Homo sapiens
gaggctcttcaataggtcaatg

SEQ ID NO: 8167789 - DNA, 22 bp, Homo sapiens
gaggctcttcaataggtcaatg

SEQ ID NO: 8167790 - DNA, 20 bp, Homo sapiens
gaggctctgggcatggcgcc

SEQ ID NO: 8167791 - DNA, 22 bp, Homo sapiens
gaggctctgtgatgtgccaggc

SEQ ID NO: 8167792 - DNA, 20 bp, Homo sapiens
gaggctctgggcatggcgcc

SEQ ID NO: 8167793 - DNA, 22 bp, Homo sapiens
gaggctctggagtaggtacaca

SEQ ID NO: 8167794 - DNA, 22 bp, Homo sapiens
gaggctcctcattcagtatgct

SEQ ID NO: 8167795 - DNA, 22 bp, Homo sapiens
gaggctcctcattcagtatgct

SEQ ID NO: 8167796 - DNA, 22 bp, Homo sapiens
gaggctccttgaaagggggact

SEQ ID NO: 8167797 - DNA, 22 bp, Homo sapiens
gaggctcctccttacatttacc

SEQ ID NO: 8167798 - DNA, 22 bp, Homo sapiens
atgtatcacagcaatgtagtca

SEQ ID NO: 8167799 - DNA, 22 bp, Homo sapiens
atgtatcacagcaatgtagtca

SEQ ID NO: 8167800 - DNA, 22 bp, Homo sapiens
atgtatcagaaatagcattggc

SEQ ID NO: 8167801 - DNA, 22 bp, Homo sapiens
atgtatcagataaagcatgtgg

SEQ ID NO: 8167802 - DNA, 22 bp, Homo sapiens
atgtatgtaggatgggccagtg

SEQ ID NO: 8167803 - DNA, 18 bp, Homo sapiens
atgtatgtacatatttat

SEQ ID NO: 8167804 - DNA, 18 bp, Homo sapiens
atgtatgtacatatttat

SEQ ID NO: 8167805 - DNA, 22 bp, Homo sapiens
atgtatgcatagtgagtaaatg

SEQ ID NO: 8167806 - DNA, 22 bp, Homo sapiens
atgtatgtaaatttcagtcctt

SEQ ID NO: 8167807 - DNA, 22 bp, Homo sapiens
atgtatgtagtgtacatataca

SEQ ID NO: 8167808 - DNA, 22 bp, Homo sapiens
atgtatgtagtgtacatataca

SEQ ID NO: 8167809 - DNA, 22 bp, Homo sapiens
atgtatgtataacacccagcta

SEQ ID NO: 8167810 - DNA, 22 bp, Homo sapiens
atgtatgtatacaccccacata

SEQ ID NO: 8167811 - DNA, 22 bp, Homo sapiens
atgtatgtataacacccagcta

SEQ ID NO: 8167812 - DNA, 22 bp, Homo sapiens
atgtatgtatgtacttttgtat

SEQ ID NO: 8167813 - DNA, 22 bp, Homo sapiens
atgtatgtatgtacttttgtat

SEQ ID NO: 8167814 - DNA, 22 bp, Homo sapiens
atgtatgtctaaaacggggagg

SEQ ID NO: 8167815 - DNA, 22 bp, Homo sapiens
atgtatgtatgctgtgcttgca

SEQ ID NO: 8167816 - DNA, 22 bp, Homo sapiens
atgtatgtatgctgtgcttgca

SEQ ID NO: 8167817 - DNA, 22 bp, Homo sapiens
atgtatgtatgctgtgcttgca

SEQ ID NO: 8167818 - DNA, 22 bp, Homo sapiens
atgtatgtttttgcagatacat

SEQ ID NO: 8167819 - DNA, 22 bp, Homo sapiens
atgtatgttttcagttgtatta

SEQ ID NO: 8167820 - DNA, 23 bp, Homo sapiens
atgtatgtttctgcatcttcaac

SEQ ID NO: 8167821 - DNA, 22 bp, Homo sapiens
atgtatgttttcagttgtatta

SEQ ID NO: 8167822 - DNA, 22 bp, Homo sapiens
atgtatgtttcatatcttcatt

SEQ ID NO: 8167823 - DNA, 22 bp, Homo sapiens
atgtatgttcaagcaatgatta

SEQ ID NO: 8167824 - DNA, 22 bp, Homo sapiens
atgtatgttcaagcaatgatta

SEQ ID NO: 8167825 - DNA, 22 bp, Homo sapiens
atgtatgttcaagcaatgatta

SEQ ID NO: 8167826 - DNA, 22 bp, Homo sapiens
atgtatgtttctatatatgaca

SEQ ID NO: 8167827 - DNA, 22 bp, Homo sapiens
atgtatgtttctatatatgaca

SEQ ID NO: 8167828 - DNA, 22 bp, Homo sapiens
atgtatgttagacaagcctaca

SEQ ID NO: 8167829 - DNA, 22 bp, Homo sapiens
atgtatgttagacaagcctaca

SEQ ID NO: 8167830 - DNA, 22 bp, Homo sapiens
atgtatgttagacaagcctaca

SEQ ID NO: 8167831 - DNA, 22 bp, Homo sapiens
atgtatgtgcacgcatgtacat

SEQ ID NO: 8167832 - DNA, 22 bp, Homo sapiens
atgtatgtgcacgcatgtacat

SEQ ID NO: 8167833 - DNA, 22 bp, Homo sapiens
atgtatgtgttgcaattatgtt

SEQ ID NO: 8167834 - DNA, 22 bp, Homo sapiens
atgtatgttagtgtattatcta

SEQ ID NO: 8167835 - DNA, 22 bp, Homo sapiens
atgtatgttagtgtattatcta

SEQ ID NO: 8167836 - DNA, 22 bp, Homo sapiens
atgtatgttagtgtattatcta

SEQ ID NO: 8167837 - DNA, 22 bp, Homo sapiens
atgtatgtctgcatacacatac

SEQ ID NO: 8167838 - DNA, 22 bp, Homo sapiens
atgtatgtctgatgcacatgca

SEQ ID NO: 8167839 - DNA, 22 bp, Homo sapiens
atgtatgtctgatgcacatgca

SEQ ID NO: 8167840 - DNA, 22 bp, Homo sapiens
atgtatgtctgatgcacatgca

SEQ ID NO: 8167841 - DNA, 22 bp, Homo sapiens
atgtatgtgagctttgagatca

SEQ ID NO: 8167842 - DNA, 22 bp, Homo sapiens
atgtatgtctgcatacacatac

SEQ ID NO: 8167843 - DNA, 22 bp, Homo sapiens
gaggcacagtcccgaggcaagg

SEQ ID NO: 8167844 - DNA, 22 bp, Homo sapiens
gaggcacagtcccgaggcaagg

SEQ ID NO: 8167845 - DNA, 22 bp, Homo sapiens
gaggcacagtgtttggtcagtg

SEQ ID NO: 8167846 - DNA, 22 bp, Homo sapiens
atgtagcttcctaggagtgatt

SEQ ID NO: 8167847 - DNA, 22 bp, Homo sapiens
atgtagcttgtcccacatcata

SEQ ID NO: 8167848 - DNA, 22 bp, Homo sapiens
atgtatcaacaaattgtacagt

SEQ ID NO: 8167849 - DNA, 22 bp, Homo sapiens
atgtaggattgagtgatagagg

SEQ ID NO: 8167850 - DNA, 22 bp, Homo sapiens
atgtagctggggaggttgagtc

SEQ ID NO: 8167851 - DNA, 22 bp, Homo sapiens
atgtagctgcagatgataatgc

SEQ ID NO: 8167852 - DNA, 22 bp, Homo sapiens
gaggcacatatatacagagccc

SEQ ID NO: 8167853 - DNA, 22 bp, Homo sapiens
gaggcacatatatacagagccc

SEQ ID NO: 8167854 - DNA, 22 bp, Homo sapiens
gaggaggggcacttgtctccta

SEQ ID NO: 8167855 - DNA, 22 bp, Homo sapiens
gaggaggggcacttgtctccta

SEQ ID NO: 8167856 - DNA, 22 bp, Homo sapiens
gaggcacaatacatgtctcaag

SEQ ID NO: 8167857 - DNA, 23 bp, Homo sapiens
gaggagggtcgtgctgtgttcct

SEQ ID NO: 8167858 - DNA, 22 bp, Homo sapiens
gaggcacaccagggagtcttgt

SEQ ID NO: 8167859 - DNA, 22 bp, Homo sapiens
gaggcacagagccctaggagct

SEQ ID NO: 8167860 - DNA, 22 bp, Homo sapiens
gaggcacagagccctaggagct

SEQ ID NO: 8167861 - DNA, 22 bp, Homo sapiens
gaggcacagagccctaggagct

SEQ ID NO: 8167862 - DNA, 22 bp, Homo sapiens
gaggcacagagtaggtgcacac

SEQ ID NO: 8167863 - DNA, 22 bp, Homo sapiens
gaggcacagagtaggtgcacac

SEQ ID NO: 8167864 - DNA, 22 bp, Homo sapiens
gaggcacagagtaggtgcacac

SEQ ID NO: 8167865 - DNA, 22 bp, Homo sapiens
gaggcacagagccctaggagct

SEQ ID NO: 8167866 - DNA, 22 bp, Homo sapiens
gaggagggcagttcctctttta

SEQ ID NO: 8167867 - DNA, 22 bp, Homo sapiens
gaggagggcctggtgtcccttc

SEQ ID NO: 8167868 - DNA, 22 bp, Homo sapiens
gaggaggggacagtacttgtgc

SEQ ID NO: 8167869 - DNA, 22 bp, Homo sapiens
gaggagggctttgttgatgtta

SEQ ID NO: 8167870 - DNA, 22 bp, Homo sapiens
gaggagggctttgttgatgtta

SEQ ID NO: 8167871 - DNA, 22 bp, Homo sapiens
gaggagctgggtcagggagaca

SEQ ID NO: 8167872 - DNA, 22 bp, Homo sapiens
gaggagctgggtcagggagaca

SEQ ID NO: 8167873 - DNA, 22 bp, Homo sapiens
atgggcagcagctgccattcat

SEQ ID NO: 8167874 - DNA, 22 bp, Homo sapiens
atgggcagctgcagcagtggtg

SEQ ID NO: 8167875 - DNA, 22 bp, Homo sapiens
atgggcagctgcagcagtggtg

SEQ ID NO: 8167876 - DNA, 22 bp, Homo sapiens
atgggcagcagctgtcattttc

SEQ ID NO: 8167877 - DNA, 22 bp, Homo sapiens
atgggcagcagctgtcattttc

SEQ ID NO: 8167878 - DNA, 22 bp, Homo sapiens
gagaatatattgaagtagttcc

SEQ ID NO: 8167879 - DNA, 22 bp, Homo sapiens
gagaatatcttggcagtctctg

SEQ ID NO: 8167880 - DNA, 21 bp, Homo sapiens
gagaatagaggggaagctgaa

SEQ ID NO: 8167881 - DNA, 22 bp, Homo sapiens
gagaatattagagttagtttat

SEQ ID NO: 8167882 - DNA, 22 bp, Homo sapiens
gagaatattagagttagtttat

SEQ ID NO: 8167883 - DNA, 21 bp, Homo sapiens
gagaatcaggaaggattgatg

SEQ ID NO: 8167884 - DNA, 22 bp, Homo sapiens
gagacaggatttaaccaaagct

SEQ ID NO: 8167885 - DNA, 22 bp, Homo sapiens
gagacaggccaggtggtactta

SEQ ID NO: 8167886 - DNA, 22 bp, Homo sapiens
gagacaggccaggtggtactta

SEQ ID NO: 8167887 - DNA, 22 bp, Homo sapiens
gagacaggcagctagtgggtca

SEQ ID NO: 8167888 - DNA, 22 bp, Homo sapiens
gagacaggcagctagtgggtca

SEQ ID NO: 8167889 - DNA, 22 bp, Homo sapiens
gagacaggcagctagtgggtca

SEQ ID NO: 8167890 - DNA, 22 bp, Homo sapiens
atggatattggccaaactcatt

SEQ ID NO: 8167891 - DNA, 22 bp, Homo sapiens
atggatctcagccaaccagtgt

SEQ ID NO: 8167892 - DNA, 22 bp, Homo sapiens
atggagggtgtcagagagcgaa

SEQ ID NO: 8167893 - DNA, 22 bp, Homo sapiens
gagacagtgaggaaggctaggt

SEQ ID NO: 8167894 - DNA, 22 bp, Homo sapiens
gagacaggccaggtggtactta

SEQ ID NO: 8167895 - DNA, 22 bp, Homo sapiens
atggagggtgtcagagagcgaa

SEQ ID NO: 8167896 - DNA, 22 bp, Homo sapiens
atggagggtgtcagagagcgaa

SEQ ID NO: 8167897 - DNA, 22 bp, Homo sapiens
atggagggtgtcagagagcgaa

SEQ ID NO: 8167898 - DNA, 22 bp, Homo sapiens
atggatcttccctcatttctga

SEQ ID NO: 8167899 - DNA, 20 bp, Homo sapiens
atggatgaccttggccaggg

SEQ ID NO: 8167900 - DNA, 22 bp, Homo sapiens
atggattggatttttatggacc

SEQ ID NO: 8167901 - DNA, 22 bp, Homo sapiens
atggatgtgaagagggagaagc

SEQ ID NO: 8167902 - DNA, 21 bp, Homo sapiens
atggatttaaacaggccacaa

SEQ ID NO: 8167903 - DNA, 22 bp, Homo sapiens
atggatttgcttatacacatgt

SEQ ID NO: 8167904 - DNA, 22 bp, Homo sapiens
atggatttggatgagattactt

SEQ ID NO: 8167905 - DNA, 22 bp, Homo sapiens
atggcaaaaactgcagttacct

SEQ ID NO: 8167906 - DNA, 22 bp, Homo sapiens
atggcaaaaattaacagatcaa

SEQ ID NO: 8167907 - DNA, 22 bp, Homo sapiens
atggcaagcaagctgaagagat

SEQ ID NO: 8167908 - DNA, 22 bp, Homo sapiens
atggcacaggagaggagggctg

SEQ ID NO: 8167909 - DNA, 22 bp, Homo sapiens
atggcacacaggtctgcaaggg

SEQ ID NO: 8167910 - DNA, 22 bp, Homo sapiens
atggcagaatatctgcatcgca

SEQ ID NO: 8167911 - DNA, 22 bp, Homo sapiens
atggcagacctcctggccacaa

SEQ ID NO: 8167912 - DNA, 22 bp, Homo sapiens
atggcagacctgggctggagaa

SEQ ID NO: 8167913 - DNA, 22 bp, Homo sapiens
atggcagacctcctggccacaa

SEQ ID NO: 8167914 - DNA, 22 bp, Homo sapiens
atggcagaaagaatagaggcta

SEQ ID NO: 8167915 - DNA, 22 bp, Homo sapiens
atggcactgacctcccttgtaa

SEQ ID NO: 8167916 - DNA, 22 bp, Homo sapiens
atggcagaaaggcatgtgggcc

SEQ ID NO: 8167917 - DNA, 22 bp, Homo sapiens
atggcagaaaggcatgtgggcc

SEQ ID NO: 8167918 - DNA, 22 bp, Homo sapiens
atggcaccaaatatgtctcatt

SEQ ID NO: 8167919 - DNA, 22 bp, Homo sapiens
atggcaccttccccagagctca

SEQ ID NO: 8167920 - DNA, 22 bp, Homo sapiens
atggcactaagagggagctgga

SEQ ID NO: 8167921 - DNA, 22 bp, Homo sapiens
atgctggtggttgatggcagga

SEQ ID NO: 8167922 - DNA, 22 bp, Homo sapiens
atgctggggcctcagaccagaa

SEQ ID NO: 8167923 - DNA, 22 bp, Homo sapiens
atgctggttgctaagcagcgat

SEQ ID NO: 8167924 - DNA, 22 bp, Homo sapiens
atgctggtttcatgataacata

SEQ ID NO: 8167925 - DNA, 22 bp, Homo sapiens
atgctggtttcatgataacata

SEQ ID NO: 8167926 - DNA, 22 bp, Homo sapiens
atgctggtctcattgggttagg

SEQ ID NO: 8167927 - DNA, 22 bp, Homo sapiens
atgctggtgctagaaactggaa

SEQ ID NO: 8167928 - DNA, 22 bp, Homo sapiens
atgctgggaaactgaaaggaat

SEQ ID NO: 8167929 - DNA, 22 bp, Homo sapiens
atgctggcagccgagtgctcca

SEQ ID NO: 8167930 - DNA, 22 bp, Homo sapiens
atgctggcagccgagtgctcca

SEQ ID NO: 8167931 - DNA, 22 bp, Homo sapiens
atgctggcagccgagtgctcca

SEQ ID NO: 8167932 - DNA, 22 bp, Homo sapiens
atgctggattgagagcaagggg

SEQ ID NO: 8167933 - DNA, 22 bp, Homo sapiens
atgctgggaagacaaggtggag

SEQ ID NO: 8167934 - DNA, 22 bp, Homo sapiens
atgctgggaagacaaggtggag

SEQ ID NO: 8167935 - DNA, 22 bp, Homo sapiens
atgctgggaagtcctaaccaca

SEQ ID NO: 8167936 - DNA, 22 bp, Homo sapiens
atgctgtggatgccttgcccca

SEQ ID NO: 8167937 - DNA, 22 bp, Homo sapiens
atgctgtggccagagttcaact

SEQ ID NO: 8167938 - DNA, 22 bp, Homo sapiens
atgctgtggccagagttcaact

SEQ ID NO: 8167939 - DNA, 22 bp, Homo sapiens
atgctgtggggagtgagggtag

SEQ ID NO: 8167940 - DNA, 22 bp, Homo sapiens
atgctgtggggagtgagggtag

SEQ ID NO: 8167941 - DNA, 22 bp, Homo sapiens
atgctgtgtattttactctttc

SEQ ID NO: 8167942 - DNA, 22 bp, Homo sapiens
atgctgtggtagacagcattcc

SEQ ID NO: 8167943 - DNA, 22 bp, Homo sapiens
atgctgtgtcaggaatttgata

SEQ ID NO: 8167944 - DNA, 22 bp, Homo sapiens
atgctgtgtcaccttaggattt

SEQ ID NO: 8167945 - DNA, 22 bp, Homo sapiens
atgctgtgaaaaagaaggctga

SEQ ID NO: 8167946 - DNA, 22 bp, Homo sapiens
atgctgtgattgtagaaatatt

SEQ ID NO: 8167947 - DNA, 22 bp, Homo sapiens
atgctgtgagtgtgccgcagag

SEQ ID NO: 8167948 - DNA, 22 bp, Homo sapiens
atgctgtgccttctctgtgcca

SEQ ID NO: 8167949 - DNA, 22 bp, Homo sapiens
atgctgtgcctggaaagcggct

SEQ ID NO: 8167950 - DNA, 22 bp, Homo sapiens
atgctgtgctggctaaccatgg

SEQ ID NO: 8167951 - DNA, 22 bp, Homo sapiens
atgctgtggaagttcctgaagc

SEQ ID NO: 8167952 - DNA, 22 bp, Homo sapiens
atgctgtggaagttcctgaagc

SEQ ID NO: 8167953 - DNA, 22 bp, Homo sapiens
atgctgttattctaatgtgtga

SEQ ID NO: 8167954 - DNA, 22 bp, Homo sapiens
atgctgtgtggccacctccatg

SEQ ID NO: 8167955 - DNA, 22 bp, Homo sapiens
atgctgtgtctagcaggaacac

SEQ ID NO: 8167956 - DNA, 22 bp, Homo sapiens
atgctgtgtcctagtgaaagaa

SEQ ID NO: 8167957 - DNA, 22 bp, Homo sapiens
atgctgtgtcctagtgaaagaa

SEQ ID NO: 8167958 - DNA, 22 bp, Homo sapiens
atgctgtgtttgagaacctagg

SEQ ID NO: 8167959 - DNA, 22 bp, Homo sapiens
atgctgtgtggtcaagttaatt

SEQ ID NO: 8167960 - DNA, 22 bp, Homo sapiens
atgctgttaagaatctcttcct

SEQ ID NO: 8167961 - DNA, 22 bp, Homo sapiens
atgctgtgttttaaatggaaat

SEQ ID NO: 8167962 - DNA, 22 bp, Homo sapiens
gagaaggtggacctgaaggagc

SEQ ID NO: 8167963 - DNA, 22 bp, Homo sapiens
gagaaggggtgatgtgggtaat

SEQ ID NO: 8167964 - DNA, 22 bp, Homo sapiens
gagaacaggctctggagtcaga

SEQ ID NO: 8167965 - DNA, 18 bp, Homo sapiens
gagaagtgcatacattat

SEQ ID NO: 8167966 - DNA, 22 bp, Homo sapiens
gagaagtcatttgaccacctag

SEQ ID NO: 8167967 - DNA, 22 bp, Homo sapiens
gagaagtgcagagtggttaagc

SEQ ID NO: 8167968 - DNA, 22 bp, Homo sapiens
gagaagttgtaggagaattttg

SEQ ID NO: 8167969 - DNA, 22 bp, Homo sapiens
gagaagttgtaggagaattttg

SEQ ID NO: 8167970 - DNA, 22 bp, Homo sapiens
gagaagttgtgtggatttaaag

SEQ ID NO: 8167971 - DNA, 22 bp, Homo sapiens
gagaagtttaatcattagacca

SEQ ID NO: 8167972 - DNA, 22 bp, Homo sapiens
gagaagtttggagtgaaggttt

SEQ ID NO: 8167973 - DNA, 22 bp, Homo sapiens
gagaagtttggagtgaaggttt

SEQ ID NO: 8167974 - DNA, 22 bp, Homo sapiens
gagaataaatctaaagtttctt

SEQ ID NO: 8167975 - DNA, 22 bp, Homo sapiens
gagaagtttttcttattacatg

SEQ ID NO: 8167976 - DNA, 21 bp, Homo sapiens
atgggcagaggcagagaggct

SEQ ID NO: 8167977 - DNA, 22 bp, Homo sapiens
atgggcaaggggtaaggacact

SEQ ID NO: 8167978 - DNA, 22 bp, Homo sapiens
atgggatgcatggctgtggcca

SEQ ID NO: 8167979 - DNA, 22 bp, Homo sapiens
atgggatcttgccctgagggct

SEQ ID NO: 8167980 - DNA, 22 bp, Homo sapiens
atgggatcttgccctgagggct

SEQ ID NO: 8167981 - DNA, 22 bp, Homo sapiens
atgggagttttctctgatgctc

SEQ ID NO: 8167982 - DNA, 22 bp, Homo sapiens
atgggagttttctctgatgctc

SEQ ID NO: 8167983 - DNA, 22 bp, Homo sapiens
atgggatgcatggctgtggcca

SEQ ID NO: 8167984 - DNA, 22 bp, Homo sapiens
atgggatgcatggctgtggcca

SEQ ID NO: 8167985 - DNA, 22 bp, Homo sapiens
atgggatgaacttgatctgctt

SEQ ID NO: 8167986 - DNA, 22 bp, Homo sapiens
gagccccttctgcagtcaggtt

SEQ ID NO: 8167987 - DNA, 22 bp, Homo sapiens
gagccccagccctgcttctata

SEQ ID NO: 8167988 - DNA, 22 bp, Homo sapiens
gagccctccatggagccaggca

SEQ ID NO: 8167989 - DNA, 22 bp, Homo sapiens
gagccctcaccgcctgaccagg

SEQ ID NO: 8167990 - DNA, 22 bp, Homo sapiens
atgggcagagtggggacaggaa

SEQ ID NO: 8167991 - DNA, 22 bp, Homo sapiens
gagctgccggcccacagtacta

SEQ ID NO: 8167992 - DNA, 22 bp, Homo sapiens
gagctgccctgagctttgcatg

SEQ ID NO: 8167993 - DNA, 22 bp, Homo sapiens
gagctgccagtgtatgaattct

SEQ ID NO: 8167994 - DNA, 18 bp, Homo sapiens
gagctgccatatttagtt

SEQ ID NO: 8167995 - DNA, 22 bp, Homo sapiens
gagctgccagacatgggaatga

SEQ ID NO: 8167996 - DNA, 22 bp, Homo sapiens
gagctgccaagattacaatcag

SEQ ID NO: 8167997 - DNA, 22 bp, Homo sapiens
gagctgccagacatgggaatga

SEQ ID NO: 8167998 - DNA, 22 bp, Homo sapiens
gagctgccagtgtatgaattct

SEQ ID NO: 8167999 - DNA, 22 bp, Homo sapiens
gagctgcagcggctgacgcaac

SEQ ID NO: 8168000 - DNA, 22 bp, Homo sapiens
gagctgcatagctgggatcctc

SEQ ID NO: 8168001 - DNA, 20 bp, Homo sapiens
gagctgagtgtggtcatggg

SEQ ID NO: 8168002 - DNA, 20 bp, Homo sapiens
gagctgagtgtggtcatggg

SEQ ID NO: 8168003 - DNA, 20 bp, Homo sapiens
gagctgagtgtggtcatggg

SEQ ID NO: 8168004 - DNA, 22 bp, Homo sapiens
gagctgagttacctccagatca

SEQ ID NO: 8168005 - DNA, 22 bp, Homo sapiens
gagctgagtgtcctaggcatgg

SEQ ID NO: 8168006 - DNA, 22 bp, Homo sapiens
gagctgagtgtcctaggcatgg

SEQ ID NO: 8168007 - DNA, 22 bp, Homo sapiens
gagctctgtgtagcctgagggt

SEQ ID NO: 8168008 - DNA, 17 bp, Homo sapiens
gagctctgtggcacaag

SEQ ID NO: 8168009 - DNA, 17 bp, Homo sapiens
gagctctgtggcacaag

SEQ ID NO: 8168010 - DNA, 22 bp, Homo sapiens
gagctctgtgaatgtggggagg

SEQ ID NO: 8168011 - DNA, 22 bp, Homo sapiens
gagctctgtgaatgtggggagg

SEQ ID NO: 8168012 - DNA, 19 bp, Homo sapiens
gagccctctccatggccac

SEQ ID NO: 8168013 - DNA, 20 bp, Homo sapiens
gagccctctgcactagcgcc

SEQ ID NO: 8168014 - DNA, 22 bp, Homo sapiens
atggctctagaatacccctcag

SEQ ID NO: 8168015 - DNA, 22 bp, Homo sapiens
atggcagacctgggctggagaa

SEQ ID NO: 8168016 - DNA, 22 bp, Homo sapiens
atggcagagaaagcgagccaca

SEQ ID NO: 8168017 - DNA, 22 bp, Homo sapiens
atggccctttattccttcttcc

SEQ ID NO: 8168018 - DNA, 22 bp, Homo sapiens
atggccctgtttatggtaaggc

SEQ ID NO: 8168019 - DNA, 22 bp, Homo sapiens
atggctgaggctggaggtggca

SEQ ID NO: 8168020 - DNA, 22 bp, Homo sapiens
atggctgaggctggaggtggca

SEQ ID NO: 8168021 - DNA, 22 bp, Homo sapiens
atggctgagatgggctccaggc

SEQ ID NO: 8168022 - DNA, 22 bp, Homo sapiens
atggctgagatgggctccaggc

SEQ ID NO: 8168023 - DNA, 22 bp, Homo sapiens
atggctgcagtccgtgccctgg

SEQ ID NO: 8168024 - DNA, 22 bp, Homo sapiens
atggctgcagtccgtgccctgg

SEQ ID NO: 8168025 - DNA, 22 bp, Homo sapiens
atggctgcatcatcctggttga

SEQ ID NO: 8168026 - DNA, 22 bp, Homo sapiens
atggctgcatcatcctggttga

SEQ ID NO: 8168027 - DNA, 22 bp, Homo sapiens
atggctgcagccggccctgcgc

SEQ ID NO: 8168028 - DNA, 22 bp, Homo sapiens
atggctgcagccggccctgcgc

SEQ ID NO: 8168029 - DNA, 22 bp, Homo sapiens
atggctgcagagacctgaagaa

SEQ ID NO: 8168030 - DNA, 20 bp, Homo sapiens
atggctctgattctgagccc

SEQ ID NO: 8168031 - DNA, 20 bp, Homo sapiens
atggctctgtttggcagtga

SEQ ID NO: 8168032 - DNA, 22 bp, Homo sapiens
atggctctgagaacctgagcta

SEQ ID NO: 8168033 - DNA, 22 bp, Homo sapiens
atggctctcttgacctaggcac

SEQ ID NO: 8168034 - DNA, 22 bp, Homo sapiens
atggctctctagggcccaggtt

SEQ ID NO: 8168035 - DNA, 22 bp, Homo sapiens
gagcacagctggaggtagcatt

SEQ ID NO: 8168036 - DNA, 22 bp, Homo sapiens
gagcacagcagggctctgggtg

SEQ ID NO: 8168037 - DNA, 22 bp, Homo sapiens
gagcacagcagggctctgggtg

SEQ ID NO: 8168038 - DNA, 22 bp, Homo sapiens
gagcacagcagggctctgggtg

SEQ ID NO: 8168039 - DNA, 22 bp, Homo sapiens
gagcacagcagggctctgggtg

SEQ ID NO: 8168040 - DNA, 22 bp, Homo sapiens
atgggagggtggaaaggctctg

SEQ ID NO: 8168041 - DNA, 22 bp, Homo sapiens
atgggagggtggaaaggctctg

SEQ ID NO: 8168042 - DNA, 22 bp, Homo sapiens
atgggagggtggaaaggctctg

SEQ ID NO: 8168043 - DNA, 22 bp, Homo sapiens
atgggagttttctctgatgctc

SEQ ID NO: 8168044 - DNA, 22 bp, Homo sapiens
atgggagttgggtaaggatcat

SEQ ID NO: 8168045 - DNA, 22 bp, Homo sapiens
atgggagtgtggttagagacct

SEQ ID NO: 8168046 - DNA, 22 bp, Homo sapiens
atgggagttgggtaaggatcat

SEQ ID NO: 8168047 - DNA, 22 bp, Homo sapiens
atgggagtgtgcttgaggagtt

SEQ ID NO: 8168048 - DNA, 22 bp, Homo sapiens
atgggagtgtggttagagacct

SEQ ID NO: 8168049 - DNA, 22 bp, Homo sapiens
atgggagtgacagggccactgg

SEQ ID NO: 8168050 - DNA, 22 bp, Homo sapiens
atgggagtccaacatcaaggac

SEQ ID NO: 8168051 - DNA, 22 bp, Homo sapiens
atgggagtccaacatcaaggac

SEQ ID NO: 8168052 - DNA, 22 bp, Homo sapiens
atgggagtgacagggccactgg

SEQ ID NO: 8168053 - DNA, 22 bp, Homo sapiens
atgggagtggaggaaaaaagtt

SEQ ID NO: 8168054 - DNA, 22 bp, Homo sapiens
atgggaggaagagaagatgtct

SEQ ID NO: 8168055 - DNA, 22 bp, Homo sapiens
gagcacagggaatagacagata

SEQ ID NO: 8168056 - DNA, 22 bp, Homo sapiens
gagcacagggaatagacagata

SEQ ID NO: 8168057 - DNA, 22 bp, Homo sapiens
gagcacagggaatagacagata

SEQ ID NO: 8168058 - DNA, 22 bp, Homo sapiens
gagcacaggctttggtggacac

SEQ ID NO: 8168059 - DNA, 22 bp, Homo sapiens
atttatgactggtgaatagaac

SEQ ID NO: 8168060 - DNA, 22 bp, Homo sapiens
atttatgactggtgaatagaac

SEQ ID NO: 8168061 - DNA, 22 bp, Homo sapiens
atttatgagctgaaccatgaaa

SEQ ID NO: 8168062 - DNA, 18 bp, Homo sapiens
atttatgctaatgggata

SEQ ID NO: 8168063 - DNA, 22 bp, Homo sapiens
atttatgattagcctattgttg

SEQ ID NO: 8168064 - DNA, 22 bp, Homo sapiens
atttatgattagcctattgttg

SEQ ID NO: 8168065 - DNA, 22 bp, Homo sapiens
atttatgatagctgcattaaag

SEQ ID NO: 8168066 - DNA, 22 bp, Homo sapiens
atttattaagcatctgctatgt

SEQ ID NO: 8168067 - DNA, 22 bp, Homo sapiens
atttattaagcatctgctatgt

SEQ ID NO: 8168068 - DNA, 22 bp, Homo sapiens
atttattaagcatctgctatgt

SEQ ID NO: 8168069 - DNA, 22 bp, Homo sapiens
atttatgtatctgtgtagatca

SEQ ID NO: 8168070 - DNA, 22 bp, Homo sapiens
atttatgtatctgtgtagatca

SEQ ID NO: 8168071 - DNA, 22 bp, Homo sapiens
atttatgtatctgtgtagatca

SEQ ID NO: 8168072 - DNA, 22 bp, Homo sapiens
gccaggtggctgagcagctgca

SEQ ID NO: 8168073 - DNA, 22 bp, Homo sapiens
gccaggtggctgagcagctgca

SEQ ID NO: 8168074 - DNA, 22 bp, Homo sapiens
gccaggtggctgagcagctgca

SEQ ID NO: 8168075 - DNA, 22 bp, Homo sapiens
gccaggtggctgagcagctgca

SEQ ID NO: 8168076 - DNA, 22 bp, Homo sapiens
gccaggtggctgagcagctgca

SEQ ID NO: 8168077 - DNA, 22 bp, Homo sapiens
atttattatgggatttggcaca

SEQ ID NO: 8168078 - DNA, 22 bp, Homo sapiens
gccatcatatcccctgtgacct

SEQ ID NO: 8168079 - DNA, 22 bp, Homo sapiens
gccatcatatcccctgtgacct

SEQ ID NO: 8168080 - DNA, 22 bp, Homo sapiens
gccatcatatcccctgtgacct

SEQ ID NO: 8168081 - DNA, 22 bp, Homo sapiens
gccatcatatcccctgtgacct

SEQ ID NO: 8168082 - DNA, 22 bp, Homo sapiens
atttattacctcggagtttctg

SEQ ID NO: 8168083 - DNA, 22 bp, Homo sapiens
atttattacctcggagtttctg

SEQ ID NO: 8168084 - DNA, 22 bp, Homo sapiens
atttattatgggatttggcaca

SEQ ID NO: 8168085 - DNA, 22 bp, Homo sapiens
atttattatgggatttggcaca

SEQ ID NO: 8168086 - DNA, 22 bp, Homo sapiens
atttattacctcggagtttctg

SEQ ID NO: 8168087 - DNA, 22 bp, Homo sapiens
atttatattttgggagctcctg

SEQ ID NO: 8168088 - DNA, 22 bp, Homo sapiens
atttatcaacatgtaccattgg

SEQ ID NO: 8168089 - DNA, 22 bp, Homo sapiens
atttatagggcattgaaaactg

SEQ ID NO: 8168090 - DNA, 22 bp, Homo sapiens
atttatcaccagttagctgact

SEQ ID NO: 8168091 - DNA, 22 bp, Homo sapiens
atttatgacaaccaaagagtga

SEQ ID NO: 8168092 - DNA, 22 bp, Homo sapiens
atttatctctggaaactaagca

SEQ ID NO: 8168093 - DNA, 22 bp, Homo sapiens
atttatgacagaagatatgctg

SEQ ID NO: 8168094 - DNA, 22 bp, Homo sapiens
atttatgacgtgttcggtcaat

SEQ ID NO: 8168095 - DNA, 21 bp, Homo sapiens
atttagaaggaaattttgcaa

SEQ ID NO: 8168096 - DNA, 21 bp, Homo sapiens
atttagaaggaaattttgcaa

SEQ ID NO: 8168097 - DNA, 22 bp, Homo sapiens
gccagctggagtgagagtgggc

SEQ ID NO: 8168098 - DNA, 22 bp, Homo sapiens
atttagtttaggaaaagtaggt

SEQ ID NO: 8168099 - DNA, 22 bp, Homo sapiens
atttataacgtgcagccagggt

SEQ ID NO: 8168100 - DNA, 22 bp, Homo sapiens
atttagtttaggaaaagtaggt

SEQ ID NO: 8168101 - DNA, 22 bp, Homo sapiens
atttagtttaggaaaagtaggt

SEQ ID NO: 8168102 - DNA, 22 bp, Homo sapiens
gccagctggagactggcagggg

SEQ ID NO: 8168103 - DNA, 22 bp, Homo sapiens
gccagctggagactggcagggg

SEQ ID NO: 8168104 - DNA, 22 bp, Homo sapiens
gccagctggagactggcagggg

SEQ ID NO: 8168105 - DNA, 22 bp, Homo sapiens
gccagctggagactggcagggg

SEQ ID NO: 8168106 - DNA, 22 bp, Homo sapiens
gccagctggagactggcagggg

SEQ ID NO: 8168107 - DNA, 22 bp, Homo sapiens
gccagctggagactggcagggg

SEQ ID NO: 8168108 - DNA, 22 bp, Homo sapiens
gccagctgcttctccagaattt

SEQ ID NO: 8168109 - DNA, 22 bp, Homo sapiens
gccagctggaaatctgcttgaa

SEQ ID NO: 8168110 - DNA, 22 bp, Homo sapiens
gccagctggaaatctgcttgaa

SEQ ID NO: 8168111 - DNA, 22 bp, Homo sapiens
gccagctggaaatctgcttgaa

SEQ ID NO: 8168112 - DNA, 22 bp, Homo sapiens
gccagctggaaatctgcttgaa

SEQ ID NO: 8168113 - DNA, 22 bp, Homo sapiens
gccagctgcttctccagaattt

SEQ ID NO: 8168114 - DNA, 22 bp, Homo sapiens
attgtactcacaaaacatgagt

SEQ ID NO: 8168115 - DNA, 22 bp, Homo sapiens
attgtactcacaaaacatgagt

SEQ ID NO: 8168116 - DNA, 20 bp, Homo sapiens
attgtacttctgttgatggt

SEQ ID NO: 8168117 - DNA, 22 bp, Homo sapiens
attgtactggtaaagaagtggg

SEQ ID NO: 8168118 - DNA, 22 bp, Homo sapiens
attgtactagaaattgtattca

SEQ ID NO: 8168119 - DNA, 19 bp, Homo sapiens
attgtacattgagtttggc

SEQ ID NO: 8168120 - DNA, 22 bp, Homo sapiens
attgtacatgcagtgagtcatc

SEQ ID NO: 8168121 - DNA, 19 bp, Homo sapiens
attgtacattgagtttggc

SEQ ID NO: 8168122 - DNA, 22 bp, Homo sapiens
gccagagtgccatcagtgccat

SEQ ID NO: 8168123 - DNA, 22 bp, Homo sapiens
gccagagtgccatcagtgccat

SEQ ID NO: 8168124 - DNA, 22 bp, Homo sapiens
gccagccacgttagactggccc

SEQ ID NO: 8168125 - DNA, 22 bp, Homo sapiens
gcatggcattaacaagatggaa

SEQ ID NO: 8168126 - DNA, 22 bp, Homo sapiens
gcatggcatttgaaggtagaag

SEQ ID NO: 8168127 - DNA, 22 bp, Homo sapiens
gcatggcattaacaagatggaa

SEQ ID NO: 8168128 - DNA, 22 bp, Homo sapiens
attgtacagacatgggaaacaa

SEQ ID NO: 8168129 - DNA, 22 bp, Homo sapiens
gcatggcatttgaaggtagaag

SEQ ID NO: 8168130 - DNA, 22 bp, Homo sapiens
attgtacataaaatgtatgtct

SEQ ID NO: 8168131 - DNA, 22 bp, Homo sapiens
attgtacataaaatgtatgtct

SEQ ID NO: 8168132 - DNA, 22 bp, Homo sapiens
attgtacataaaatgtatgtct

SEQ ID NO: 8168133 - DNA, 22 bp, Homo sapiens
attgtacatatgatgtatgtaa

SEQ ID NO: 8168134 - DNA, 22 bp, Homo sapiens
attgtacataaaatgtatgtct

SEQ ID NO: 8168135 - DNA, 22 bp, Homo sapiens
attgtacatatgatgtatgtaa

SEQ ID NO: 8168136 - DNA, 22 bp, Homo sapiens
attgtacatatgatgtatgtaa

SEQ ID NO: 8168137 - DNA, 22 bp, Homo sapiens
attgtacatgcagtgagtcatc

SEQ ID NO: 8168138 - DNA, 22 bp, Homo sapiens
attgtacatgcagtgagtcatc

SEQ ID NO: 8168139 - DNA, 22 bp, Homo sapiens
attgtacatatgatgtatgtaa

SEQ ID NO: 8168140 - DNA, 22 bp, Homo sapiens
attgtacatgcagtgagtcatc

SEQ ID NO: 8168141 - DNA, 22 bp, Homo sapiens
gccagctgcatctcctgggctg

SEQ ID NO: 8168142 - DNA, 22 bp, Homo sapiens
gccagctgcatctcctgggctg

SEQ ID NO: 8168143 - DNA, 21 bp, Homo sapiens
gccagctgcagggcttccttg

SEQ ID NO: 8168144 - DNA, 21 bp, Homo sapiens
gccagctgcagggcttccttg

SEQ ID NO: 8168145 - DNA, 21 bp, Homo sapiens
gccagctgcagggcttccttg

SEQ ID NO: 8168146 - DNA, 18 bp, Homo sapiens
gccagctgcacggccctc

SEQ ID NO: 8168147 - DNA, 22 bp, Homo sapiens
gccagccataggccagcactgg

SEQ ID NO: 8168148 - DNA, 22 bp, Homo sapiens
gccagctgcatctcctgggctg

SEQ ID NO: 8168149 - DNA, 22 bp, Homo sapiens
gccagctgccaagttgtgagat

SEQ ID NO: 8168150 - DNA, 22 bp, Homo sapiens
gccagctgccctctgctggtcc

SEQ ID NO: 8168151 - DNA, 22 bp, Homo sapiens
gccagctgccaagttgtgagat

SEQ ID NO: 8168152 - DNA, 22 bp, Homo sapiens
gccagctgccctctgctggtcc

SEQ ID NO: 8168153 - DNA, 22 bp, Homo sapiens
gccagctgccctctgctggtcc

SEQ ID NO: 8168154 - DNA, 22 bp, Homo sapiens
gccagctgctggaacagcgcga

SEQ ID NO: 8168155 - DNA, 22 bp, Homo sapiens
gccagctgctggaacagcgcga

SEQ ID NO: 8168156 - DNA, 22 bp, Homo sapiens
gccagctgctcgcgtagggtag

SEQ ID NO: 8168157 - DNA, 22 bp, Homo sapiens
gccagctgctcgcgtagggtag

SEQ ID NO: 8168158 - DNA, 22 bp, Homo sapiens
gccagctgctcgcgtagggtag

SEQ ID NO: 8168159 - DNA, 22 bp, Homo sapiens
gccagccagagtggctgtgtgt

SEQ ID NO: 8168160 - DNA, 22 bp, Homo sapiens
gccagccagagtccatctgaga

SEQ ID NO: 8168161 - DNA, 22 bp, Homo sapiens
gccagccagagaggcatggtta

SEQ ID NO: 8168162 - DNA, 22 bp, Homo sapiens
gccagccagagaggcatggtta

SEQ ID NO: 8168163 - DNA, 22 bp, Homo sapiens
gccagccagagaggcatggtta

SEQ ID NO: 8168164 - DNA, 22 bp, Homo sapiens
gccagccagagaggcatggtta

SEQ ID NO: 8168165 - DNA, 22 bp, Homo sapiens
gccagccagagtggctgtgtgt

SEQ ID NO: 8168166 - DNA, 22 bp, Homo sapiens
gccagccagtttgctgatggct

SEQ ID NO: 8168167 - DNA, 22 bp, Homo sapiens
gccagccagggaagggagagac

SEQ ID NO: 8168168 - DNA, 22 bp, Homo sapiens
gccagccagggaagggagagac

SEQ ID NO: 8168169 - DNA, 22 bp, Homo sapiens
gccagccacttcccagactggc

SEQ ID NO: 8168170 - DNA, 22 bp, Homo sapiens
gccagccagaaacgtcacactg

SEQ ID NO: 8168171 - DNA, 22 bp, Homo sapiens
gccagccacttcccagactggc

SEQ ID NO: 8168172 - DNA, 22 bp, Homo sapiens
atttcaagaaggcagcagtggt

SEQ ID NO: 8168173 - DNA, 22 bp, Homo sapiens
atttcaaggactacttttcaat

SEQ ID NO: 8168174 - DNA, 22 bp, Homo sapiens
atttcaacgttagatgtaatag

SEQ ID NO: 8168175 - DNA, 19 bp, Homo sapiens
atttcaagaggtttattgg

SEQ ID NO: 8168176 - DNA, 22 bp, Homo sapiens
atttcaaggctattaatataaa

SEQ ID NO: 8168177 - DNA, 22 bp, Homo sapiens
atttcaagtccaagtcttgggt

SEQ ID NO: 8168178 - DNA, 22 bp, Homo sapiens
atttcaagtgttgagctcataa

SEQ ID NO: 8168179 - DNA, 22 bp, Homo sapiens
gcccaggagttgaatgcagcag

SEQ ID NO: 8168180 - DNA, 19 bp, Homo sapiens
gcccaggggcccgatgctg

SEQ ID NO: 8168181 - DNA, 22 bp, Homo sapiens
gcccagtctcttctggccctgt

SEQ ID NO: 8168182 - DNA, 22 bp, Homo sapiens
gcccagtctcttctggccctgt

SEQ ID NO: 8168183 - DNA, 22 bp, Homo sapiens
gcccagtgccctagaatgcact

SEQ ID NO: 8168184 - DNA, 21 bp, Homo sapiens
gcccagtgatttcttcacagt

SEQ ID NO: 8168185 - DNA, 22 bp, Homo sapiens
gcccagtagttcaaggttgcag

SEQ ID NO: 8168186 - DNA, 22 bp, Homo sapiens
gcccagtagttcaaggttgcag

SEQ ID NO: 8168187 - DNA, 22 bp, Homo sapiens
gcccagtagttcaaggttgcag

SEQ ID NO: 8168188 - DNA, 22 bp, Homo sapiens
gcccagtagttcaaggttgcag

SEQ ID NO: 8168189 - DNA, 22 bp, Homo sapiens
gcccagtagttcaaggttgcag

SEQ ID NO: 8168190 - DNA, 22 bp, Homo sapiens
gcccaggtgccctctgccttac

SEQ ID NO: 8168191 - DNA, 22 bp, Homo sapiens
gcccaggtttcatctgctccgt

SEQ ID NO: 8168192 - DNA, 22 bp, Homo sapiens
gcccaggtttcatctgctccgt

SEQ ID NO: 8168193 - DNA, 22 bp, Homo sapiens
gcccagggtgaagtgcagttgt

SEQ ID NO: 8168194 - DNA, 20 bp, Homo sapiens
gccatgaggggaggtgactg

SEQ ID NO: 8168195 - DNA, 22 bp, Homo sapiens
gccatctggcattgcagcacct

SEQ ID NO: 8168196 - DNA, 22 bp, Homo sapiens
gccatgcctgtgtctccaggcc

SEQ ID NO: 8168197 - DNA, 22 bp, Homo sapiens
atttattggtttgcatggtgaa

SEQ ID NO: 8168198 - DNA, 22 bp, Homo sapiens
atttattggtttgcatggtgaa

SEQ ID NO: 8168199 - DNA, 22 bp, Homo sapiens
atttattggtttgcatggtgaa

SEQ ID NO: 8168200 - DNA, 22 bp, Homo sapiens
atttattggtttgcatggtgaa

SEQ ID NO: 8168201 - DNA, 19 bp, Homo sapiens
atttattgtatgattccat

SEQ ID NO: 8168202 - DNA, 19 bp, Homo sapiens
atttattgtatgattccat

SEQ ID NO: 8168203 - DNA, 19 bp, Homo sapiens
atttattgtatgattccat

SEQ ID NO: 8168204 - DNA, 19 bp, Homo sapiens
atttattgtatgattccat

SEQ ID NO: 8168205 - DNA, 19 bp, Homo sapiens
atttattgtatgattccat

SEQ ID NO: 8168206 - DNA, 19 bp, Homo sapiens
atttattgtatgattccat

SEQ ID NO: 8168207 - DNA, 22 bp, Homo sapiens
gccctggggaaggtgtctccaa

SEQ ID NO: 8168208 - DNA, 22 bp, Homo sapiens
gccctggggaaggtgtctccaa

SEQ ID NO: 8168209 - DNA, 22 bp, Homo sapiens
gccctggggaaggtgtctccaa

SEQ ID NO: 8168210 - DNA, 22 bp, Homo sapiens
gccctggggaaggtgtctccaa

SEQ ID NO: 8168211 - DNA, 22 bp, Homo sapiens
gccctggggaaggtgtctccaa

SEQ ID NO: 8168212 - DNA, 17 bp, Homo sapiens
gccctgcctgctgccct

SEQ ID NO: 8168213 - DNA, 17 bp, Homo sapiens
gccctgcctgctgccct

SEQ ID NO: 8168214 - DNA, 22 bp, Homo sapiens
gccctgggctccctgctccaca

SEQ ID NO: 8168215 - DNA, 22 bp, Homo sapiens
gccctgggctccctgctccaca

SEQ ID NO: 8168216 - DNA, 22 bp, Homo sapiens
gccctgggctccctgctccaca

SEQ ID NO: 8168217 - DNA, 22 bp, Homo sapiens
gccctgggctccctgctccaca

SEQ ID NO: 8168218 - DNA, 22 bp, Homo sapiens
gccctgggctccctgctccaca

SEQ ID NO: 8168219 - DNA, 23 bp, Homo sapiens
atttcccattgtgtcagcagagc

SEQ ID NO: 8168220 - DNA, 23 bp, Homo sapiens
atttcctaaaagataatcattac

SEQ ID NO: 8168221 - DNA, 23 bp, Homo sapiens
atttcctactataaaagaggtaa

SEQ ID NO: 8168222 - DNA, 22 bp, Homo sapiens
atttcctaatttagggatagac

SEQ ID NO: 8168223 - DNA, 22 bp, Homo sapiens
atttcctaacagaggcaacagt

SEQ ID NO: 8168224 - DNA, 22 bp, Homo sapiens
atttcctaatttatgcaggagt

SEQ ID NO: 8168225 - DNA, 22 bp, Homo sapiens
gcccagtggtaaaagcaggcct

SEQ ID NO: 8168226 - DNA, 22 bp, Homo sapiens
gcccagtgggaagctaaggtgg

SEQ ID NO: 8168227 - DNA, 22 bp, Homo sapiens
gcccagtgctgagggtgctgct

SEQ ID NO: 8168228 - DNA, 22 bp, Homo sapiens
gcccagtgctgagggtgctgct

SEQ ID NO: 8168229 - DNA, 22 bp, Homo sapiens
atttcccaatacgctaagtgga

SEQ ID NO: 8168230 - DNA, 22 bp, Homo sapiens
atttcccactctactacatgct

SEQ ID NO: 8168231 - DNA, 22 bp, Homo sapiens
atttcccatgtgaatcaattgg

SEQ ID NO: 8168232 - DNA, 18 bp, Homo sapiens
gccctggtggagctggtg

SEQ ID NO: 8168233 - DNA, 18 bp, Homo sapiens
gccctggtggagctggtg

SEQ ID NO: 8168234 - DNA, 18 bp, Homo sapiens
gccctggtggagctggtg

SEQ ID NO: 8168235 - DNA, 18 bp, Homo sapiens
gccctggtggagctggtg

SEQ ID NO: 8168236 - DNA, 22 bp, Homo sapiens
gccctggtgtgcccagcatggg

SEQ ID NO: 8168237 - DNA, 22 bp, Homo sapiens
gccctggtgtgcccagcatggg

SEQ ID NO: 8168238 - DNA, 22 bp, Homo sapiens
gccctggttttagaggagcagg

SEQ ID NO: 8168239 - DNA, 22 bp, Homo sapiens
gccctgtcggaactgcgacctc

SEQ ID NO: 8168240 - DNA, 22 bp, Homo sapiens
gccctggttttagaggagcagg

SEQ ID NO: 8168241 - DNA, 22 bp, Homo sapiens
gccctgtcccttggcttctagg

SEQ ID NO: 8168242 - DNA, 22 bp, Homo sapiens
gccctgtgccagtcacgctgtg

SEQ ID NO: 8168243 - DNA, 22 bp, Homo sapiens
gccctgtgcaggtgtgcagcag

SEQ ID NO: 8168244 - DNA, 20 bp, Homo sapiens
gccctgtgatgtcttgacct

SEQ ID NO: 8168245 - DNA, 20 bp, Homo sapiens
gccctgtgatgtcttgacct

SEQ ID NO: 8168246 - DNA, 20 bp, Homo sapiens
gccctgtgatgtcttgacct

SEQ ID NO: 8168247 - DNA, 22 bp, Homo sapiens
atttcttacataacaaattgtt

SEQ ID NO: 8168248 - DNA, 22 bp, Homo sapiens
atttctgtttgctactataagt

SEQ ID NO: 8168249 - DNA, 22 bp, Homo sapiens
atttctgtttgctactataagt

SEQ ID NO: 8168250 - DNA, 22 bp, Homo sapiens
atttctgtttgctactataagt

SEQ ID NO: 8168251 - DNA, 22 bp, Homo sapiens
atttcttatgaatattgactgt

SEQ ID NO: 8168252 - DNA, 22 bp, Homo sapiens
atttcttcaggttcttctagga

SEQ ID NO: 8168253 - DNA, 22 bp, Homo sapiens
atttcttcaggttcttctagga

SEQ ID NO: 8168254 - DNA, 22 bp, Homo sapiens
atttcttccattgcctcttcaa

SEQ ID NO: 8168255 - DNA, 22 bp, Homo sapiens
atttcttcaggttcttctagga

SEQ ID NO: 8168256 - DNA, 22 bp, Homo sapiens
atttcttatgaatattgactgt

SEQ ID NO: 8168257 - DNA, 22 bp, Homo sapiens
atttcttatgaatattgactgt

SEQ ID NO: 8168258 - DNA, 22 bp, Homo sapiens
atttcttcaggtcagaaataga

SEQ ID NO: 8168259 - DNA, 22 bp, Homo sapiens
attttcatggcttctgctcagt

SEQ ID NO: 8168260 - DNA, 22 bp, Homo sapiens
attttcatggcttctgctcagt

SEQ ID NO: 8168261 - DNA, 22 bp, Homo sapiens
attttcatcatgggtttaacat

SEQ ID NO: 8168262 - DNA, 22 bp, Homo sapiens
attttcatcatgggtttaacat

SEQ ID NO: 8168263 - DNA, 22 bp, Homo sapiens
attttcatcatgggtttaacat

SEQ ID NO: 8168264 - DNA, 22 bp, Homo sapiens
attttcagtgtaaatgttttat

SEQ ID NO: 8168265 - DNA, 22 bp, Homo sapiens
attttcagttgaaaaagttggt

SEQ ID NO: 8168266 - DNA, 22 bp, Homo sapiens
attttcagttgaaaaagttggt

SEQ ID NO: 8168267 - DNA, 21 bp, Homo sapiens
attttcattaattcagtgtgg

SEQ ID NO: 8168268 - DNA, 22 bp, Homo sapiens
attttccatctccacaccaggg

SEQ ID NO: 8168269 - DNA, 22 bp, Homo sapiens
attttccagcctttctagaact

SEQ ID NO: 8168270 - DNA, 22 bp, Homo sapiens
attttccaaaataattgttact

SEQ ID NO: 8168271 - DNA, 22 bp, Homo sapiens
attttccaaaataattgttact

SEQ ID NO: 8168272 - DNA, 22 bp, Homo sapiens
attttccaaaataattgttact

SEQ ID NO: 8168273 - DNA, 22 bp, Homo sapiens
gccttccttacacctgctcagc

SEQ ID NO: 8168274 - DNA, 22 bp, Homo sapiens
gccttccttacacctgctcagc

SEQ ID NO: 8168275 - DNA, 22 bp, Homo sapiens
gccttcctgcagctctgagcgt

SEQ ID NO: 8168276 - DNA, 22 bp, Homo sapiens
gccttcccaagacgcctgagtt

SEQ ID NO: 8168277 - DNA, 20 bp, Homo sapiens
gccttccagttcagtggcac

SEQ ID NO: 8168278 - DNA, 20 bp, Homo sapiens
gccttccagttcagtggcac

SEQ ID NO: 8168279 - DNA, 19 bp, Homo sapiens
gccttcccaccacccgtcc

SEQ ID NO: 8168280 - DNA, 19 bp, Homo sapiens
gccttcccaccacccgtcc

SEQ ID NO: 8168281 - DNA, 22 bp, Homo sapiens
gccttccctctcatcctgctgg

SEQ ID NO: 8168282 - DNA, 22 bp, Homo sapiens
gcctgtgctgttccctctgcca

SEQ ID NO: 8168283 - DNA, 17 bp, Homo sapiens
gccttccagcatgtggg

SEQ ID NO: 8168284 - DNA, 17 bp, Homo sapiens
gccttccagcatgtggg

SEQ ID NO: 8168285 - DNA, 22 bp, Homo sapiens
gcctgtgcttaactgacgtgag

SEQ ID NO: 8168286 - DNA, 22 bp, Homo sapiens
gccttccagaatacacatagca

SEQ ID NO: 8168287 - DNA, 22 bp, Homo sapiens
gcctgtgcttaactgacgtgag

SEQ ID NO: 8168288 - DNA, 22 bp, Homo sapiens
attttcctagtcatgtgcttct

SEQ ID NO: 8168289 - DNA, 22 bp, Homo sapiens
attttcctccatgtgagcagtt

SEQ ID NO: 8168290 - DNA, 22 bp, Homo sapiens
attttccttctaagaggaaggt

SEQ ID NO: 8168291 - DNA, 22 bp, Homo sapiens
attttcctccatgtgagcagtt

SEQ ID NO: 8168292 - DNA, 22 bp, Homo sapiens
attttcctctggtttccccaga

SEQ ID NO: 8168293 - DNA, 22 bp, Homo sapiens
atttgtatcttctaatattatc

SEQ ID NO: 8168294 - DNA, 22 bp, Homo sapiens
atttgtatcttctaatattatc

SEQ ID NO: 8168295 - DNA, 22 bp, Homo sapiens
atttgtatcttctaatattatc

SEQ ID NO: 8168296 - DNA, 22 bp, Homo sapiens
atttgtatcaatctcaatatat

SEQ ID NO: 8168297 - DNA, 22 bp, Homo sapiens
atttgtatcaatctcaatatat

SEQ ID NO: 8168298 - DNA, 22 bp, Homo sapiens
atttgtagtgaagtgaaaataa

SEQ ID NO: 8168299 - DNA, 22 bp, Homo sapiens
atttgtctaatgagtgtgtact

SEQ ID NO: 8168300 - DNA, 22 bp, Homo sapiens
attttagatttaagaataaggt

SEQ ID NO: 8168301 - DNA, 22 bp, Homo sapiens
attttcaggttttgccattgta

SEQ ID NO: 8168302 - DNA, 22 bp, Homo sapiens
attttcagtctggctggaccca

SEQ ID NO: 8168303 - DNA, 22 bp, Homo sapiens
atttgtaaagtgcttaaaagta

SEQ ID NO: 8168304 - DNA, 22 bp, Homo sapiens
atttggttactcagttgtctga

SEQ ID NO: 8168305 - DNA, 22 bp, Homo sapiens
atttgtacaaatttatgttagt

SEQ ID NO: 8168306 - DNA, 22 bp, Homo sapiens
atttgtaagctagagccatgat

SEQ ID NO: 8168307 - DNA, 22 bp, Homo sapiens
atttgggcagtccatgaaataa

SEQ ID NO: 8168308 - DNA, 22 bp, Homo sapiens
atttggggctcaccagggctga

SEQ ID NO: 8168309 - DNA, 22 bp, Homo sapiens
atttcttcctctgtcagtaact

SEQ ID NO: 8168310 - DNA, 22 bp, Homo sapiens
atttcttcctctgtcagtaact

SEQ ID NO: 8168311 - DNA, 22 bp, Homo sapiens
atttcttcctctgtcagtaact

SEQ ID NO: 8168312 - DNA, 22 bp, Homo sapiens
atttcttcctctgtcagtaact

SEQ ID NO: 8168313 - DNA, 22 bp, Homo sapiens
atttggaatgtgtttgatcacc

SEQ ID NO: 8168314 - DNA, 19 bp, Homo sapiens
gctcagagacacctgttgc

SEQ ID NO: 8168315 - DNA, 19 bp, Homo sapiens
gctcagagacacctgttgc

SEQ ID NO: 8168316 - DNA, 22 bp, Homo sapiens
gctcagagagaggatatgttat

SEQ ID NO: 8168317 - DNA, 22 bp, Homo sapiens
gctcagagagaggctcaccatt

SEQ ID NO: 8168318 - DNA, 22 bp, Homo sapiens
caaaagaagctcttggggctag

SEQ ID NO: 8168319 - DNA, 22 bp, Homo sapiens
gctcagagagtttcacaagttt

SEQ ID NO: 8168320 - DNA, 22 bp, Homo sapiens
gctcagagagattaaataattt

SEQ ID NO: 8168321 - DNA, 21 bp, Homo sapiens
gctcagagagggtaattaacc

SEQ ID NO: 8168322 - DNA, 22 bp, Homo sapiens
gctcagagaagcggtttcgcct

SEQ ID NO: 8168323 - DNA, 22 bp, Homo sapiens
gctcagagaagttaaggaattt

SEQ ID NO: 8168324 - DNA, 22 bp, Homo sapiens
gctcagagaatcagcagacacc

SEQ ID NO: 8168325 - DNA, 22 bp, Homo sapiens
gctcagagaagttgtgcctggc

SEQ ID NO: 8168326 - DNA, 22 bp, Homo sapiens
gctcagagaatttactgctgcc

SEQ ID NO: 8168327 - DNA, 22 bp, Homo sapiens
gctcagagaatttactgctgcc

SEQ ID NO: 8168328 - DNA, 22 bp, Homo sapiens
gctcagagaatcagcagacacc

SEQ ID NO: 8168329 - DNA, 22 bp, Homo sapiens
caaaagaagctcttggggctag

SEQ ID NO: 8168330 - DNA, 22 bp, Homo sapiens
caaaagaagctcttggggctag

SEQ ID NO: 8168331 - DNA, 22 bp, Homo sapiens
caaaagcagcaagtttatatgt

SEQ ID NO: 8168332 - DNA, 20 bp, Homo sapiens
caaaagcaatgaagttatga

SEQ ID NO: 8168333 - DNA, 22 bp, Homo sapiens
attttgcacactatgcagcttt

SEQ ID NO: 8168334 - DNA, 22 bp, Homo sapiens
attttgatgctatctaatgaat

SEQ ID NO: 8168335 - DNA, 22 bp, Homo sapiens
attttgatgtatctttgtagct

SEQ ID NO: 8168336 - DNA, 22 bp, Homo sapiens
attttgcacactatgcagcttt

SEQ ID NO: 8168337 - DNA, 22 bp, Homo sapiens
attttgcacactatgcagcttt

SEQ ID NO: 8168338 - DNA, 22 bp, Homo sapiens
attttgctacagttggtggaaa

SEQ ID NO: 8168339 - DNA, 22 bp, Homo sapiens
attttgctggtctgaattactt

SEQ ID NO: 8168340 - DNA, 22 bp, Homo sapiens
attttgctgtggtacattagga

SEQ ID NO: 8168341 - DNA, 22 bp, Homo sapiens
gctcagagaaaactggggcttg

SEQ ID NO: 8168342 - DNA, 22 bp, Homo sapiens
gctcagagaaattataggaatt

SEQ ID NO: 8168343 - DNA, 22 bp, Homo sapiens
gctcagagaaaactggggcttg

SEQ ID NO: 8168344 - DNA, 22 bp, Homo sapiens
gctcagagaaagattagtccct

SEQ ID NO: 8168345 - DNA, 22 bp, Homo sapiens
gctcaaatcccagcgggctcct

SEQ ID NO: 8168346 - DNA, 22 bp, Homo sapiens
gctcaaatcccagcgggctcct

SEQ ID NO: 8168347 - DNA, 22 bp, Homo sapiens
gctcaaatgtcatggggagcct

SEQ ID NO: 8168348 - DNA, 22 bp, Homo sapiens
gctcaaatgtcatggggagcct

SEQ ID NO: 8168349 - DNA, 22 bp, Homo sapiens
gctcagacttgttttacaggct

SEQ ID NO: 8168350 - DNA, 22 bp, Homo sapiens
gctcagacttgttttacaggct

SEQ ID NO: 8168351 - DNA, 22 bp, Homo sapiens
gctcagactgcacaccctggtc

SEQ ID NO: 8168352 - DNA, 22 bp, Homo sapiens
gctcagactgcacaccctggtc

SEQ ID NO: 8168353 - DNA, 22 bp, Homo sapiens
attttgataatcatgttagaga

SEQ ID NO: 8168354 - DNA, 22 bp, Homo sapiens
attttgactgcattacagaaca

SEQ ID NO: 8168355 - DNA, 22 bp, Homo sapiens
attttgactgcattacagaaca

SEQ ID NO: 8168356 - DNA, 22 bp, Homo sapiens
attttgataatcatgttagaga

SEQ ID NO: 8168357 - DNA, 22 bp, Homo sapiens
attttgataatcatgttagaga

SEQ ID NO: 8168358 - DNA, 22 bp, Homo sapiens
attttgataatcatgttagaga

SEQ ID NO: 8168359 - DNA, 17 bp, Homo sapiens
gccttccttcctccaca

SEQ ID NO: 8168360 - DNA, 17 bp, Homo sapiens
gccttccttcctccaca

SEQ ID NO: 8168361 - DNA, 22 bp, Homo sapiens
gccttccttttaccaccagcca

SEQ ID NO: 8168362 - DNA, 22 bp, Homo sapiens
caaagactgcataacacatgaa

SEQ ID NO: 8168363 - DNA, 22 bp, Homo sapiens
caaagaccatgtggcctgaaaa

SEQ ID NO: 8168364 - DNA, 20 bp, Homo sapiens
caaagacatgctaggggtgg

SEQ ID NO: 8168365 - DNA, 22 bp, Homo sapiens
caaagactgcataacacatgaa

SEQ ID NO: 8168366 - DNA, 22 bp, Homo sapiens
caaagactgcataacacatgaa

SEQ ID NO: 8168367 - DNA, 22 bp, Homo sapiens
caaagaggtgagaggagccttt

SEQ ID NO: 8168368 - DNA, 22 bp, Homo sapiens
gctctgctgtgtttgttcagca

SEQ ID NO: 8168369 - DNA, 22 bp, Homo sapiens
gctctgctgtgtttgttcagca

SEQ ID NO: 8168370 - DNA, 22 bp, Homo sapiens
gctctgctgtggaatcctctcc

SEQ ID NO: 8168371 - DNA, 22 bp, Homo sapiens
gctctgagataaacgttgccct

SEQ ID NO: 8168372 - DNA, 22 bp, Homo sapiens
gctctgagagtgggtgattctg

SEQ ID NO: 8168373 - DNA, 22 bp, Homo sapiens
gctctgagattgagcctttggt

SEQ ID NO: 8168374 - DNA, 22 bp, Homo sapiens
caaagacacgggaaacaacgtt

SEQ ID NO: 8168375 - DNA, 22 bp, Homo sapiens
caaagaatcactcatctttagc

SEQ ID NO: 8168376 - DNA, 22 bp, Homo sapiens
caaagaatagcatggcatttgt

SEQ ID NO: 8168377 - DNA, 22 bp, Homo sapiens
caaagaaggaactataatccca

SEQ ID NO: 8168378 - DNA, 22 bp, Homo sapiens
caaagaatcactcatctttagc

SEQ ID NO: 8168379 - DNA, 22 bp, Homo sapiens
caaagaagagatttacagagct

SEQ ID NO: 8168380 - DNA, 22 bp, Homo sapiens
gctccccaggctggtcccctcg

SEQ ID NO: 8168381 - DNA, 22 bp, Homo sapiens
gctccccaggctggtcccctcg

SEQ ID NO: 8168382 - DNA, 22 bp, Homo sapiens
gctccccaggctggtcccctcg

SEQ ID NO: 8168383 - DNA, 22 bp, Homo sapiens
caaagaagagatttacagagct

SEQ ID NO: 8168384 - DNA, 22 bp, Homo sapiens
caaagaagagatttacagagct

SEQ ID NO: 8168385 - DNA, 22 bp, Homo sapiens
caaagaagagatttacagagct

SEQ ID NO: 8168386 - DNA, 22 bp, Homo sapiens
gctcccagtctgatggaggaga

SEQ ID NO: 8168387 - DNA, 22 bp, Homo sapiens
gctcccagggcagcgcagaaga

SEQ ID NO: 8168388 - DNA, 22 bp, Homo sapiens
gctcccagggcagcgcagaaga

SEQ ID NO: 8168389 - DNA, 22 bp, Homo sapiens
gctcccagtctgatggaggaga

SEQ ID NO: 8168390 - DNA, 22 bp, Homo sapiens
gctccccaaaagctccaggaaa

SEQ ID NO: 8168391 - DNA, 22 bp, Homo sapiens
gctccccaaaagctccaggaaa

SEQ ID NO: 8168392 - DNA, 22 bp, Homo sapiens
gctccccagcttagccctggct

SEQ ID NO: 8168393 - DNA, 22 bp, Homo sapiens
gctccccagcttagccctggct

SEQ ID NO: 8168394 - DNA, 22 bp, Homo sapiens
gctccccagcttagccctggct

SEQ ID NO: 8168395 - DNA, 22 bp, Homo sapiens
gctccagggaacagaatgtact

SEQ ID NO: 8168396 - DNA, 22 bp, Homo sapiens
gctccagggacccaagagaaaa

SEQ ID NO: 8168397 - DNA, 22 bp, Homo sapiens
gctccagggaacagaatgtact

SEQ ID NO: 8168398 - DNA, 22 bp, Homo sapiens
gctcccaggcatggaggtaatt

SEQ ID NO: 8168399 - DNA, 22 bp, Homo sapiens
gctcccagggacactggccact

SEQ ID NO: 8168400 - DNA, 22 bp, Homo sapiens
gctcccagggaccgcagggcag

SEQ ID NO: 8168401 - DNA, 22 bp, Homo sapiens
gctcccagggaccgcagggcag

SEQ ID NO: 8168402 - DNA, 22 bp, Homo sapiens
attgcacagctgaatattttgg

SEQ ID NO: 8168403 - DNA, 22 bp, Homo sapiens
attgcacagctgaatattttgg

SEQ ID NO: 8168404 - DNA, 22 bp, Homo sapiens
attgcactccagcctgggggac

SEQ ID NO: 8168405 - DNA, 22 bp, Homo sapiens
gcatcatcacggtcaccgagcc

SEQ ID NO: 8168406 - DNA, 19 bp, Homo sapiens
gcatcatttgtctcttctt

SEQ ID NO: 8168407 - DNA, 22 bp, Homo sapiens
gcatcagtagctatagttacaa

SEQ ID NO: 8168408 - DNA, 22 bp, Homo sapiens
attgcactccagcctgggtgac

SEQ ID NO: 8168409 - DNA, 22 bp, Homo sapiens
attgcactccggcctgggtgac

SEQ ID NO: 8168410 - DNA, 22 bp, Homo sapiens
gcatggaattcccttatgggcc

SEQ ID NO: 8168411 - DNA, 22 bp, Homo sapiens
gcatggaattcccttatgggcc

SEQ ID NO: 8168412 - DNA, 22 bp, Homo sapiens
gcatggagaagtgggaacaggt

SEQ ID NO: 8168413 - DNA, 22 bp, Homo sapiens
gcatggcaagatcaggagacca

SEQ ID NO: 8168414 - DNA, 22 bp, Homo sapiens
gcatggcaaatatcgagggcag

SEQ ID NO: 8168415 - DNA, 22 bp, Homo sapiens
gcatggcaaatatcgagggcag

SEQ ID NO: 8168416 - DNA, 22 bp, Homo sapiens
gcatggcagtgaggatggtgct

SEQ ID NO: 8168417 - DNA, 22 bp, Homo sapiens
gcatggcagtgaggatggtgct

SEQ ID NO: 8168418 - DNA, 22 bp, Homo sapiens
gcatggcagtgaggatggtgct

SEQ ID NO: 8168419 - DNA, 22 bp, Homo sapiens
gcatggcaagatcaggagacca

SEQ ID NO: 8168420 - DNA, 22 bp, Homo sapiens
attgcaaaggtcccattcaaga

SEQ ID NO: 8168421 - DNA, 22 bp, Homo sapiens
gcagtaaataattttgtgtata

SEQ ID NO: 8168422 - DNA, 22 bp, Homo sapiens
gcagtaaaggtgacaatatagg

SEQ ID NO: 8168423 - DNA, 22 bp, Homo sapiens
gcagtaaagcctgagatatatg

SEQ ID NO: 8168424 - DNA, 22 bp, Homo sapiens
attgcaaaggtcccattcaaga

SEQ ID NO: 8168425 - DNA, 22 bp, Homo sapiens
attgcaaagcgtagactctaaa

SEQ ID NO: 8168426 - DNA, 22 bp, Homo sapiens
attgcaaataactgtactgaat

SEQ ID NO: 8168427 - DNA, 22 bp, Homo sapiens
attgcaaataactgtactgaat

SEQ ID NO: 8168428 - DNA, 22 bp, Homo sapiens
attgcaaataactgtactgaat

SEQ ID NO: 8168429 - DNA, 22 bp, Homo sapiens
attgcaaataatgcgagccagt

SEQ ID NO: 8168430 - DNA, 22 bp, Homo sapiens
attcttttttaaggaatagaac

SEQ ID NO: 8168431 - DNA, 22 bp, Homo sapiens
attcttttttaaggaatagaac

SEQ ID NO: 8168432 - DNA, 22 bp, Homo sapiens
attcttttttaaggaatagaac

SEQ ID NO: 8168433 - DNA, 19 bp, Homo sapiens
gcaggtggatgtggtcagc

SEQ ID NO: 8168434 - DNA, 19 bp, Homo sapiens
gcaggtggatgtggtcagc

SEQ ID NO: 8168435 - DNA, 19 bp, Homo sapiens
gcaggtggatgtggtcagc

SEQ ID NO: 8168436 - DNA, 22 bp, Homo sapiens
gcaggtgtggagagtggtcggg

SEQ ID NO: 8168437 - DNA, 22 bp, Homo sapiens
gcaggtgtggagtggggtgagc

SEQ ID NO: 8168438 - DNA, 22 bp, Homo sapiens
gcaggtgtggagagtggtcggg

SEQ ID NO: 8168439 - DNA, 22 bp, Homo sapiens
gcaggtgtggagagtggtcggg

SEQ ID NO: 8168440 - DNA, 18 bp, Homo sapiens
gcaggtgtggagaagggg

SEQ ID NO: 8168441 - DNA, 18 bp, Homo sapiens
gcaggtgtggagaagggg

SEQ ID NO: 8168442 - DNA, 22 bp, Homo sapiens
gcaggtgtgctgaattacgtga

SEQ ID NO: 8168443 - DNA, 22 bp, Homo sapiens
gcaggtgtgctgaattacgtga

SEQ ID NO: 8168444 - DNA, 22 bp, Homo sapiens
gcaggtgttttaagacattgaa

SEQ ID NO: 8168445 - DNA, 22 bp, Homo sapiens
gcaggtgttctcagaggaggct

SEQ ID NO: 8168446 - DNA, 21 bp, Homo sapiens
gcaggtgtggtatcagcttcc

SEQ ID NO: 8168447 - DNA, 22 bp, Homo sapiens
gcaggtgttctcagaggaggct

SEQ ID NO: 8168448 - DNA, 22 bp, Homo sapiens
gcaggtgttttaagacattgaa

SEQ ID NO: 8168449 - DNA, 22 bp, Homo sapiens
gcaggtgttttaagacattgaa

SEQ ID NO: 8168450 - DNA, 22 bp, Homo sapiens
gcaggtgttttaagacattgaa

SEQ ID NO: 8168451 - DNA, 22 bp, Homo sapiens
gcaggtgttttaagacattgaa

SEQ ID NO: 8168452 - DNA, 22 bp, Homo sapiens
gcaggtgtgggtggctgccagg

SEQ ID NO: 8168453 - DNA, 22 bp, Homo sapiens
gcaggtgtggatttgcatccag

SEQ ID NO: 8168454 - DNA, 22 bp, Homo sapiens
gcaggtgtggatttgcatccag

SEQ ID NO: 8168455 - DNA, 22 bp, Homo sapiens
gcaggtgtggatttgcatccag

SEQ ID NO: 8168456 - DNA, 22 bp, Homo sapiens
gcaggtgtggagtggggtgagc

SEQ ID NO: 8168457 - DNA, 22 bp, Homo sapiens
gcaggtgtggagtggggtgagc

SEQ ID NO: 8168458 - DNA, 22 bp, Homo sapiens
gcaggtgttctcagaggaggct

SEQ ID NO: 8168459 - DNA, 21 bp, Homo sapiens
gcaggtgtggtatcagcttcc

SEQ ID NO: 8168460 - DNA, 21 bp, Homo sapiens
gcaggtgtggtatcagcttcc

SEQ ID NO: 8168461 - DNA, 22 bp, Homo sapiens
gcaggtgtgggtggctgccagg

SEQ ID NO: 8168462 - DNA, 22 bp, Homo sapiens
attcttttcccaactgctttaa

SEQ ID NO: 8168463 - DNA, 22 bp, Homo sapiens
attcttttaagccccagggatt

SEQ ID NO: 8168464 - DNA, 22 bp, Homo sapiens
attcttttcccaactgctttaa

SEQ ID NO: 8168465 - DNA, 22 bp, Homo sapiens
attcttttaagccccagggatt

SEQ ID NO: 8168466 - DNA, 22 bp, Homo sapiens
attcttttcccaactgctttaa

SEQ ID NO: 8168467 - DNA, 22 bp, Homo sapiens
attcttttcccaactgctttaa

SEQ ID NO: 8168468 - DNA, 22 bp, Homo sapiens
attcttttcccaactgctttaa

SEQ ID NO: 8168469 - DNA, 22 bp, Homo sapiens
attcttttgtcctagcttgata

SEQ ID NO: 8168470 - DNA, 22 bp, Homo sapiens
attcttttgtcctagcttgata

SEQ ID NO: 8168471 - DNA, 22 bp, Homo sapiens
attcttttaagccccagggatt

SEQ ID NO: 8168472 - DNA, 22 bp, Homo sapiens
attcttttaaatggcagtagta

SEQ ID NO: 8168473 - DNA, 22 bp, Homo sapiens
attctttggacaataagtggtg

SEQ ID NO: 8168474 - DNA, 22 bp, Homo sapiens
attctttggacaataagtggtg

SEQ ID NO: 8168475 - DNA, 22 bp, Homo sapiens
gcagggcagtgtgtctgtgggg

SEQ ID NO: 8168476 - DNA, 22 bp, Homo sapiens
gcagggcagtgtgtctgtgggg

SEQ ID NO: 8168477 - DNA, 22 bp, Homo sapiens
gcagggcatagaggcacggagg

SEQ ID NO: 8168478 - DNA, 22 bp, Homo sapiens
gcagggcatagaggcacggagg

SEQ ID NO: 8168479 - DNA, 22 bp, Homo sapiens
gcagggcatagaggcacggagg

SEQ ID NO: 8168480 - DNA, 22 bp, Homo sapiens
gcagggcatagaggcacggagg

SEQ ID NO: 8168481 - DNA, 22 bp, Homo sapiens
gcagggcatccctgagcgggtg

SEQ ID NO: 8168482 - DNA, 22 bp, Homo sapiens
gcagggcatccctgagcgggtg

SEQ ID NO: 8168483 - DNA, 22 bp, Homo sapiens
gcagggcatccctgagcgggtg

SEQ ID NO: 8168484 - DNA, 22 bp, Homo sapiens
gcagggcatccctgagcgggtg

SEQ ID NO: 8168485 - DNA, 20 bp, Homo sapiens
gcagggcatcttggccccca

SEQ ID NO: 8168486 - DNA, 20 bp, Homo sapiens
gcagggcatcttggccccca

SEQ ID NO: 8168487 - DNA, 22 bp, Homo sapiens
gcagggcatgggccctgtctgc

SEQ ID NO: 8168488 - DNA, 20 bp, Homo sapiens
gcagggcatcttggccccca

SEQ ID NO: 8168489 - DNA, 20 bp, Homo sapiens
gcagggcatcttggccccca

SEQ ID NO: 8168490 - DNA, 22 bp, Homo sapiens
attctttccagacactgattgc

SEQ ID NO: 8168491 - DNA, 22 bp, Homo sapiens
attctttccagacactgattgc

SEQ ID NO: 8168492 - DNA, 22 bp, Homo sapiens
attctttccagacactgattgc

SEQ ID NO: 8168493 - DNA, 15 bp, Homo sapiens
gcaggcaggtcacct

SEQ ID NO: 8168494 - DNA, 22 bp, Homo sapiens
gcaggcaggtggcatcttgtga

SEQ ID NO: 8168495 - DNA, 20 bp, Homo sapiens
gcaggcagggaatgggggtg

SEQ ID NO: 8168496 - DNA, 20 bp, Homo sapiens
gcaggcagggaatgggggtg

SEQ ID NO: 8168497 - DNA, 22 bp, Homo sapiens
attctgcaactgttgttggtgg

SEQ ID NO: 8168498 - DNA, 22 bp, Homo sapiens
attctgcacatccaagaacagg

SEQ ID NO: 8168499 - DNA, 22 bp, Homo sapiens
attctgatgcttcacaaaggta

SEQ ID NO: 8168500 - DNA, 22 bp, Homo sapiens
attctgctagtaacagatgaag

SEQ ID NO: 8168501 - DNA, 22 bp, Homo sapiens
attctgcatgtaggtttgctca

SEQ ID NO: 8168502 - DNA, 22 bp, Homo sapiens
attctgcatggtggtgtctctg

SEQ ID NO: 8168503 - DNA, 22 bp, Homo sapiens
attctgcataatttcctggcag

SEQ ID NO: 8168504 - DNA, 22 bp, Homo sapiens
attctgcaggtggaggatggca

SEQ ID NO: 8168505 - DNA, 22 bp, Homo sapiens
attctgcacatccaagaacagg

SEQ ID NO: 8168506 - DNA, 22 bp, Homo sapiens
attctgcacttcctttgcttcc

SEQ ID NO: 8168507 - DNA, 22 bp, Homo sapiens
attctgcacttcctttgcttcc

SEQ ID NO: 8168508 - DNA, 22 bp, Homo sapiens
attctgctgcctagtttatgaa

SEQ ID NO: 8168509 - DNA, 22 bp, Homo sapiens
attctgctgcctagtttatgaa

SEQ ID NO: 8168510 - DNA, 22 bp, Homo sapiens
attctgctccacactgattcat

SEQ ID NO: 8168511 - DNA, 22 bp, Homo sapiens
attctgctcccaggtgatgctg

SEQ ID NO: 8168512 - DNA, 22 bp, Homo sapiens
attctgctagttaatatctctc

SEQ ID NO: 8168513 - DNA, 22 bp, Homo sapiens
attctgcttcttatttcacgtg

SEQ ID NO: 8168514 - DNA, 22 bp, Homo sapiens
attctgcttcttatttcacgtg

SEQ ID NO: 8168515 - DNA, 22 bp, Homo sapiens
attctgctggtaactctataaa

SEQ ID NO: 8168516 - DNA, 22 bp, Homo sapiens
attctgcttaagggaggctgtc

SEQ ID NO: 8168517 - DNA, 22 bp, Homo sapiens
attctggaaagctattctctct

SEQ ID NO: 8168518 - DNA, 20 bp, Homo sapiens
attctgctttctgatagagc

SEQ ID NO: 8168519 - DNA, 20 bp, Homo sapiens
attctgctttgaaaataagg

SEQ ID NO: 8168520 - DNA, 22 bp, Homo sapiens
attctgcttttgctgacctacc

SEQ ID NO: 8168521 - DNA, 22 bp, Homo sapiens
gcagggcagtaagagctagagt

SEQ ID NO: 8168522 - DNA, 22 bp, Homo sapiens
gcagggcaaacccaggtgttca

SEQ ID NO: 8168523 - DNA, 22 bp, Homo sapiens
gcagggcaaacccaggtgttca

SEQ ID NO: 8168524 - DNA, 22 bp, Homo sapiens
attctggaagcaagcttttaaa

SEQ ID NO: 8168525 - DNA, 22 bp, Homo sapiens
attctggaaagctattctctct

SEQ ID NO: 8168526 - DNA, 22 bp, Homo sapiens
attctggaaagctattctctct

SEQ ID NO: 8168527 - DNA, 22 bp, Homo sapiens
gcagggcagtgtgtctgtgggg

SEQ ID NO: 8168528 - DNA, 22 bp, Homo sapiens
gcagggcagtgtgtctgtgggg

SEQ ID NO: 8168529 - DNA, 22 bp, Homo sapiens
gcagggcagtaagagctagagt

SEQ ID NO: 8168530 - DNA, 22 bp, Homo sapiens
gcagggcagtgtgtctgtgggg

SEQ ID NO: 8168531 - DNA, 22 bp, Homo sapiens
attcacaaaatgatatagatac

SEQ ID NO: 8168532 - DNA, 22 bp, Homo sapiens
attcacaaaatgatatagatac

SEQ ID NO: 8168533 - DNA, 22 bp, Homo sapiens
attcacaaagaagggaagtaca

SEQ ID NO: 8168534 - DNA, 22 bp, Homo sapiens
attcacaaagaagggaagtaca

SEQ ID NO: 8168535 - DNA, 22 bp, Homo sapiens
attcacaaaatgatatagatac

SEQ ID NO: 8168536 - DNA, 22 bp, Homo sapiens
attcacaaaatgatatagatac

SEQ ID NO: 8168537 - DNA, 22 bp, Homo sapiens
attcacaaagaagggaagtaca

SEQ ID NO: 8168538 - DNA, 22 bp, Homo sapiens
attcacaacaaaaggatatgag

SEQ ID NO: 8168539 - DNA, 22 bp, Homo sapiens
attcacaacaaaaggatatgag

SEQ ID NO: 8168540 - DNA, 22 bp, Homo sapiens
attcacaagttctagggattag

SEQ ID NO: 8168541 - DNA, 22 bp, Homo sapiens
attcatgaccccatggttgatt

SEQ ID NO: 8168542 - DNA, 19 bp, Homo sapiens
attcatttttgccttctaa

SEQ ID NO: 8168543 - DNA, 22 bp, Homo sapiens
attcatgaatctacattgtggt

SEQ ID NO: 8168544 - DNA, 22 bp, Homo sapiens
attcacaagttgatggatattt

SEQ ID NO: 8168545 - DNA, 22 bp, Homo sapiens
attcacaagttgatggatattt

SEQ ID NO: 8168546 - DNA, 22 bp, Homo sapiens
attccaaacttaccccagagga

SEQ ID NO: 8168547 - DNA, 22 bp, Homo sapiens
attccaaacttaccccagagga

SEQ ID NO: 8168548 - DNA, 22 bp, Homo sapiens
attccaaacagtgctgcagact

SEQ ID NO: 8168549 - DNA, 22 bp, Homo sapiens
attccacaagaccataaattag

SEQ ID NO: 8168550 - DNA, 22 bp, Homo sapiens
attccaattgtacttgctttta

SEQ ID NO: 8168551 - DNA, 22 bp, Homo sapiens
attccaattgtacttgctttta

SEQ ID NO: 8168552 - DNA, 22 bp, Homo sapiens
attccaaaggttaatgcccatt

SEQ ID NO: 8168553 - DNA, 20 bp, Homo sapiens
attccacttatatgaggtcc

SEQ ID NO: 8168554 - DNA, 22 bp, Homo sapiens
attccacttatatgaagtaacg

SEQ ID NO: 8168555 - DNA, 22 bp, Homo sapiens
attccacttagtgactcatttg

SEQ ID NO: 8168556 - DNA, 22 bp, Homo sapiens
attccactccaataagtgtcaa

SEQ ID NO: 8168557 - DNA, 22 bp, Homo sapiens
attccactccaataagtgtcaa

SEQ ID NO: 8168558 - DNA, 22 bp, Homo sapiens
attccactgttataaaatgtcc

SEQ ID NO: 8168559 - DNA, 22 bp, Homo sapiens
attccactgccgaatgatacat

SEQ ID NO: 8168560 - DNA, 22 bp, Homo sapiens
attccacaggactaccaatgtg

SEQ ID NO: 8168561 - DNA, 17 bp, Homo sapiens
attccacagggaatctg

SEQ ID NO: 8168562 - DNA, 22 bp, Homo sapiens
attctgatatgaacacacatat

SEQ ID NO: 8168563 - DNA, 19 bp, Homo sapiens
gcagctgtgggaagagcca

SEQ ID NO: 8168564 - DNA, 22 bp, Homo sapiens
gcagctgtgggcctcggagagc

SEQ ID NO: 8168565 - DNA, 22 bp, Homo sapiens
gcagctgtgggcctcggagagc

SEQ ID NO: 8168566 - DNA, 22 bp, Homo sapiens
gcagctgtgggttccaagtcta

SEQ ID NO: 8168567 - DNA, 22 bp, Homo sapiens
gcagctgtggtgctgagatagg

SEQ ID NO: 8168568 - DNA, 22 bp, Homo sapiens
gcagctgtgtaatgagcccaca

SEQ ID NO: 8168569 - DNA, 22 bp, Homo sapiens
gcagctgtgtaatgagcccaca

SEQ ID NO: 8168570 - DNA, 22 bp, Homo sapiens
attctgataaataagcagcaag

SEQ ID NO: 8168571 - DNA, 21 bp, Homo sapiens
attctgagttgtcagtcttca

SEQ ID NO: 8168572 - DNA, 23 bp, Homo sapiens
attctgagtcagaaagtttgggg

SEQ ID NO: 8168573 - DNA, 22 bp, Homo sapiens
attctgagtccatgggggcagg

SEQ ID NO: 8168574 - DNA, 22 bp, Homo sapiens
attctgaattctgagcctttca

SEQ ID NO: 8168575 - DNA, 22 bp, Homo sapiens
attctgaattctgagcctttca

SEQ ID NO: 8168576 - DNA, 22 bp, Homo sapiens
attctgaggacagagtctagca

SEQ ID NO: 8168577 - DNA, 22 bp, Homo sapiens
attctgaggacagagtctagca

SEQ ID NO: 8168578 - DNA, 22 bp, Homo sapiens
attctccacacatccagacctt

SEQ ID NO: 8168579 - DNA, 22 bp, Homo sapiens
attctctttgtataacatcttg

SEQ ID NO: 8168580 - DNA, 22 bp, Homo sapiens
attctctttgtataacatcttg

SEQ ID NO: 8168581 - DNA, 20 bp, Homo sapiens
attccacttgtttgaggtac

SEQ ID NO: 8168582 - DNA, 22 bp, Homo sapiens
attccacttccactagtttctc

SEQ ID NO: 8168583 - DNA, 22 bp, Homo sapiens
attccacttgattttaggggaa

SEQ ID NO: 8168584 - DNA, 22 bp, Homo sapiens
gcaggcaggaaggactaagtaa

SEQ ID NO: 8168585 - DNA, 22 bp, Homo sapiens
gcaggcaggaaggactaagtaa

SEQ ID NO: 8168586 - DNA, 19 bp, Homo sapiens
gcaggcagctggggtatcc

SEQ ID NO: 8168587 - DNA, 22 bp, Homo sapiens
gcaggcaggagcccaactgcct

SEQ ID NO: 8168588 - DNA, 22 bp, Homo sapiens
gcaggcaggagcccaactgcct

SEQ ID NO: 8168589 - DNA, 22 bp, Homo sapiens
gcaggcaggagcccaactgcct

SEQ ID NO: 8168590 - DNA, 22 bp, Homo sapiens
gcaggcaggagcccaactgcct

SEQ ID NO: 8168591 - DNA, 22 bp, Homo sapiens
gcaggcaggagcccaactgcct

SEQ ID NO: 8168592 - DNA, 20 bp, Homo sapiens
gcaggcagggaatgggggtg

SEQ ID NO: 8168593 - DNA, 20 bp, Homo sapiens
gcaggcagggaatgggggtg

SEQ ID NO: 8168594 - DNA, 22 bp, Homo sapiens
gcaggcaggcttccttgaactg

SEQ ID NO: 8168595 - DNA, 22 bp, Homo sapiens
gcaggcaggcttccttgaactg

SEQ ID NO: 8168596 - DNA, 20 bp, Homo sapiens
gcaggcagggaatgggggtg

SEQ ID NO: 8168597 - DNA, 22 bp, Homo sapiens
gcaggcaggcttccttgaactg

SEQ ID NO: 8168598 - DNA, 22 bp, Homo sapiens
gcaggcaggcttccttgaactg

SEQ ID NO: 8168599 - DNA, 22 bp, Homo sapiens
gcaggcaggcttccttgaactg

SEQ ID NO: 8168600 - DNA, 22 bp, Homo sapiens
gcaggcaggcttccttgaactg

SEQ ID NO: 8168601 - DNA, 23 bp, Homo sapiens
gcagcttgtggtttagtagaggg

SEQ ID NO: 8168602 - DNA, 22 bp, Homo sapiens
gcagcttggatttctgtagttt

SEQ ID NO: 8168603 - DNA, 22 bp, Homo sapiens
gcaggcaaggaacagagactgt

SEQ ID NO: 8168604 - DNA, 22 bp, Homo sapiens
gcaggcaaggaacagagactgt

SEQ ID NO: 8168605 - DNA, 22 bp, Homo sapiens
gcaggcaaggtagacagaggaa

SEQ ID NO: 8168606 - DNA, 22 bp, Homo sapiens
gcaggcaaggaacagagactgt

SEQ ID NO: 8168607 - DNA, 19 bp, Homo sapiens
gcaggcagctggggtatcc

SEQ ID NO: 8168608 - DNA, 22 bp, Homo sapiens
gcaggcaaggtagacagaggaa

SEQ ID NO: 8168609 - DNA, 22 bp, Homo sapiens
gcaggcaattttggaaggtcag

SEQ ID NO: 8168610 - DNA, 22 bp, Homo sapiens
gcagcttcaagatactttttct

SEQ ID NO: 8168611 - DNA, 22 bp, Homo sapiens
gcagctgttcagctggccagat

SEQ ID NO: 8168612 - DNA, 22 bp, Homo sapiens
gcagcttcagccagagggccag

SEQ ID NO: 8168613 - DNA, 22 bp, Homo sapiens
gcagcttcagtaggtgaagaca

SEQ ID NO: 8168614 - DNA, 22 bp, Homo sapiens
gcagcttcctgagtgtggacag

SEQ ID NO: 8168615 - DNA, 22 bp, Homo sapiens
gattcccatgtctgaggaggtg

SEQ ID NO: 8168616 - DNA, 22 bp, Homo sapiens
gattcctgctattcacagggct

SEQ ID NO: 8168617 - DNA, 22 bp, Homo sapiens
gattcctgctattcacagggct

SEQ ID NO: 8168618 - DNA, 22 bp, Homo sapiens
gattcctgattccagcacaacc

SEQ ID NO: 8168619 - DNA, 22 bp, Homo sapiens
gattctgaaattaacagactgg

SEQ ID NO: 8168620 - DNA, 22 bp, Homo sapiens
gattctctctggatcccatgga

SEQ ID NO: 8168621 - DNA, 22 bp, Homo sapiens
gattctgagacagaaacgtatt

SEQ ID NO: 8168622 - DNA, 22 bp, Homo sapiens
gattctgagctggtgttttacg

SEQ ID NO: 8168623 - DNA, 22 bp, Homo sapiens
gattctgatctatagtgttata

SEQ ID NO: 8168624 - DNA, 22 bp, Homo sapiens
gattctgaggccttgctcaaga

SEQ ID NO: 8168625 - DNA, 22 bp, Homo sapiens
gattctgcttaccatttgatct

SEQ ID NO: 8168626 - DNA, 22 bp, Homo sapiens
gattctggagttaaggatgcct

SEQ ID NO: 8168627 - DNA, 22 bp, Homo sapiens
attaaattttcactaggctccc

SEQ ID NO: 8168628 - DNA, 22 bp, Homo sapiens
attaacagaattttacatgctt

SEQ ID NO: 8168629 - DNA, 22 bp, Homo sapiens
attaaattttcactaggctccc

SEQ ID NO: 8168630 - DNA, 22 bp, Homo sapiens
attaacatgagttggagatagg

SEQ ID NO: 8168631 - DNA, 22 bp, Homo sapiens
attaacagcagcatccccagcc

SEQ ID NO: 8168632 - DNA, 22 bp, Homo sapiens
attaacatgagttggagatagg

SEQ ID NO: 8168633 - DNA, 22 bp, Homo sapiens
gattcttgggccttctgaagtt

SEQ ID NO: 8168634 - DNA, 22 bp, Homo sapiens
gattcttatgagtgaactttac

SEQ ID NO: 8168635 - DNA, 22 bp, Homo sapiens
gattcttaagacattatgtatt

SEQ ID NO: 8168636 - DNA, 22 bp, Homo sapiens
gattcttacttctaagcaagct

SEQ ID NO: 8168637 - DNA, 22 bp, Homo sapiens
attaaattggatctgcatagtt

SEQ ID NO: 8168638 - DNA, 18 bp, Homo sapiens
gatggccatttcaatgtt

SEQ ID NO: 8168639 - DNA, 22 bp, Homo sapiens
gatggccacatacatggctggg

SEQ ID NO: 8168640 - DNA, 22 bp, Homo sapiens
gatgtgagtggtagctgggatt

SEQ ID NO: 8168641 - DNA, 22 bp, Homo sapiens
gatgtgaggactcatgtggagg

SEQ ID NO: 8168642 - DNA, 22 bp, Homo sapiens
gatgtgaggactcatgtggagg

SEQ ID NO: 8168643 - DNA, 22 bp, Homo sapiens
gattcactcatattttacgttt

SEQ ID NO: 8168644 - DNA, 22 bp, Homo sapiens
gatgtgtcatttggtcatctgc

SEQ ID NO: 8168645 - DNA, 22 bp, Homo sapiens
gatgtgtcatttggtcatctgc

SEQ ID NO: 8168646 - DNA, 22 bp, Homo sapiens
gattcactcatattttacgttt

SEQ ID NO: 8168647 - DNA, 22 bp, Homo sapiens
gattcactcatattttacgttt

SEQ ID NO: 8168648 - DNA, 18 bp, Homo sapiens
gatgtgggccctggatat

SEQ ID NO: 8168649 - DNA, 22 bp, Homo sapiens
gatgtgtagagggaatttcaaa

SEQ ID NO: 8168650 - DNA, 22 bp, Homo sapiens
gatggcacacagacatccccgc

SEQ ID NO: 8168651 - DNA, 22 bp, Homo sapiens
gatggagtctgaagctgggaac

SEQ ID NO: 8168652 - DNA, 22 bp, Homo sapiens
gatggcaccttgaacgctgcgt

SEQ ID NO: 8168653 - DNA, 22 bp, Homo sapiens
gatggcacacagacatccccgc

SEQ ID NO: 8168654 - DNA, 22 bp, Homo sapiens
gatggagtctgaagctgggaac

SEQ ID NO: 8168655 - DNA, 22 bp, Homo sapiens
gatggaggagatggcagggtgc

SEQ ID NO: 8168656 - DNA, 22 bp, Homo sapiens
gatggaggagatggcagggtgc

SEQ ID NO: 8168657 - DNA, 21 bp, Homo sapiens
gatgatggcaggcagcactgg

SEQ ID NO: 8168658 - DNA, 22 bp, Homo sapiens
atgttatttctgaaagatcatt

SEQ ID NO: 8168659 - DNA, 22 bp, Homo sapiens
atgttatttctgaaagatcatt

SEQ ID NO: 8168660 - DNA, 22 bp, Homo sapiens
atgttatttattgaaacacttt

SEQ ID NO: 8168661 - DNA, 22 bp, Homo sapiens
atgttatttattgaaacacttt

SEQ ID NO: 8168662 - DNA, 22 bp, Homo sapiens
gatggcagtcaaccaggtgagg

SEQ ID NO: 8168663 - DNA, 22 bp, Homo sapiens
gatggcaggtgatagccgagtc

SEQ ID NO: 8168664 - DNA, 22 bp, Homo sapiens
gatggcagtgggcctcgagtcc

SEQ ID NO: 8168665 - DNA, 22 bp, Homo sapiens
gatggccaaggaccacgcatcg

SEQ ID NO: 8168666 - DNA, 22 bp, Homo sapiens
gatggccacatacatggctggg

SEQ ID NO: 8168667 - DNA, 22 bp, Homo sapiens
gatggccacatacatggctggg

SEQ ID NO: 8168668 - DNA, 22 bp, Homo sapiens
gatggccaaggaccacgcatcg

SEQ ID NO: 8168669 - DNA, 22 bp, Homo sapiens
gatggcaggcaggtgagtagag

SEQ ID NO: 8168670 - DNA, 22 bp, Homo sapiens
gatggcaggtagtggtctcatc

SEQ ID NO: 8168671 - DNA, 22 bp, Homo sapiens
gatggcaggcaggtgagtagag

SEQ ID NO: 8168672 - DNA, 22 bp, Homo sapiens
gatggcaggcaggtgagtagag

SEQ ID NO: 8168673 - DNA, 22 bp, Homo sapiens
gatggcagcatattgacagcat

SEQ ID NO: 8168674 - DNA, 22 bp, Homo sapiens
gatggcagcatattgacagcat

SEQ ID NO: 8168675 - DNA, 22 bp, Homo sapiens
gatggcagcatattgacagcat

SEQ ID NO: 8168676 - DNA, 22 bp, Homo sapiens
gatggcagcagcagccagggat

SEQ ID NO: 8168677 - DNA, 22 bp, Homo sapiens
gatggcagcagcagccagggat

SEQ ID NO: 8168678 - DNA, 22 bp, Homo sapiens
gatggcagcagcagccagggat

SEQ ID NO: 8168679 - DNA, 22 bp, Homo sapiens
atgttattaaagtacagattct

SEQ ID NO: 8168680 - DNA, 22 bp, Homo sapiens
atgttatgtgcaagatacataa

SEQ ID NO: 8168681 - DNA, 23 bp, Homo sapiens
atgttattattagcagtcttgcc

SEQ ID NO: 8168682 - DNA, 22 bp, Homo sapiens
atgttatgtctgggaaggggta

SEQ ID NO: 8168683 - DNA, 22 bp, Homo sapiens
atgttatgtgcaagatacataa

SEQ ID NO: 8168684 - DNA, 22 bp, Homo sapiens
atgttatgtgcaagatacataa

SEQ ID NO: 8168685 - DNA, 22 bp, Homo sapiens
gagtggggcgtggatccagcgt

SEQ ID NO: 8168686 - DNA, 22 bp, Homo sapiens
gagtggggcgaagtcggcgagt

SEQ ID NO: 8168687 - DNA, 22 bp, Homo sapiens
gagtggggcgaagtcggcgagt

SEQ ID NO: 8168688 - DNA, 22 bp, Homo sapiens
gagtggggaaagccaggacaga

SEQ ID NO: 8168689 - DNA, 22 bp, Homo sapiens
gagtggggaaagccaggacaga

SEQ ID NO: 8168690 - DNA, 22 bp, Homo sapiens
gagtggggaaagccaggacaga

SEQ ID NO: 8168691 - DNA, 22 bp, Homo sapiens
gagtgggcaccgtgggcacact

SEQ ID NO: 8168692 - DNA, 22 bp, Homo sapiens
gagtggggaaagccaggacaga

SEQ ID NO: 8168693 - DNA, 23 bp, Homo sapiens
gagtggggagaaattggttaaac

SEQ ID NO: 8168694 - DNA, 22 bp, Homo sapiens
gagtggggcccactgctgggtg

SEQ ID NO: 8168695 - DNA, 22 bp, Homo sapiens
gagtggggcccactgctgggtg

SEQ ID NO: 8168696 - DNA, 22 bp, Homo sapiens
gagtggggcccactgctgggtg

SEQ ID NO: 8168697 - DNA, 22 bp, Homo sapiens
gagtggggcccactgctgggtg

SEQ ID NO: 8168698 - DNA, 22 bp, Homo sapiens
gagtggggcccactgctgggtg

SEQ ID NO: 8168699 - DNA, 23 bp, Homo sapiens
gcagagacagccccagcgcgatg

SEQ ID NO: 8168700 - DNA, 21 bp, Homo sapiens
gcagagaatgaactttggctt

SEQ ID NO: 8168701 - DNA, 22 bp, Homo sapiens
gcagagaccccgcagtgaggcc

SEQ ID NO: 8168702 - DNA, 23 bp, Homo sapiens
gcagagacagccccagcgcgatg

SEQ ID NO: 8168703 - DNA, 22 bp, Homo sapiens
gcagagactagtagtgcagact

SEQ ID NO: 8168704 - DNA, 22 bp, Homo sapiens
gcagagagttgggctgcgccag

SEQ ID NO: 8168705 - DNA, 22 bp, Homo sapiens
gcagagataagtagacaggatg

SEQ ID NO: 8168706 - DNA, 22 bp, Homo sapiens
gcagagagttgggctgcgccag

SEQ ID NO: 8168707 - DNA, 22 bp, Homo sapiens
gcagagaggaatgaagccatcc

SEQ ID NO: 8168708 - DNA, 22 bp, Homo sapiens
gcagagaggaatgaagccatcc

SEQ ID NO: 8168709 - DNA, 22 bp, Homo sapiens
gcagagattggtgcactgatga

SEQ ID NO: 8168710 - DNA, 22 bp, Homo sapiens
attcaagtacagttttcttctt

SEQ ID NO: 8168711 - DNA, 22 bp, Homo sapiens
attcaagtacagttttcttctt

SEQ ID NO: 8168712 - DNA, 22 bp, Homo sapiens
attcaagtccagcttctctaca

SEQ ID NO: 8168713 - DNA, 22 bp, Homo sapiens
attcaagtccagcttctctaca

SEQ ID NO: 8168714 - DNA, 22 bp, Homo sapiens
attcaagtggctgctatgttaa

SEQ ID NO: 8168715 - DNA, 22 bp, Homo sapiens
attcaataaatatgctacatgg

SEQ ID NO: 8168716 - DNA, 22 bp, Homo sapiens
gcagagatggctgatctattcc

SEQ ID NO: 8168717 - DNA, 22 bp, Homo sapiens
gcagagattatgccatggaaag

SEQ ID NO: 8168718 - DNA, 22 bp, Homo sapiens
gcagagattatgccatggaaag

SEQ ID NO: 8168719 - DNA, 22 bp, Homo sapiens
gcagagatattgatatagattt

SEQ ID NO: 8168720 - DNA, 22 bp, Homo sapiens
gcagagatccagggtataggtt

SEQ ID NO: 8168721 - DNA, 22 bp, Homo sapiens
gcagagaaggattgaaaccaga

SEQ ID NO: 8168722 - DNA, 22 bp, Homo sapiens
gcagacaatttattagcagatt

SEQ ID NO: 8168723 - DNA, 22 bp, Homo sapiens
attatgtatttggtatagtttg

SEQ ID NO: 8168724 - DNA, 22 bp, Homo sapiens
attatggatggaggcattagtc

SEQ ID NO: 8168725 - DNA, 22 bp, Homo sapiens
attatggagaaatatgtacagg

SEQ ID NO: 8168726 - DNA, 22 bp, Homo sapiens
attatggacatcaaataactct

SEQ ID NO: 8168727 - DNA, 22 bp, Homo sapiens
attatggacgttaattttggaa

SEQ ID NO: 8168728 - DNA, 22 bp, Homo sapiens
attatgtagctaaaaattgtgt

SEQ ID NO: 8168729 - DNA, 22 bp, Homo sapiens
attatgggtataacacagttat

SEQ ID NO: 8168730 - DNA, 22 bp, Homo sapiens
attatcttgataaaatggcagt

SEQ ID NO: 8168731 - DNA, 22 bp, Homo sapiens
attatctatgtagaatgatttt

SEQ ID NO: 8168732 - DNA, 22 bp, Homo sapiens
attatgcatttgttagtattaa

SEQ ID NO: 8168733 - DNA, 18 bp, Homo sapiens
attatgctcattacagtg

SEQ ID NO: 8168734 - DNA, 22 bp, Homo sapiens
attatgcatatacatttgacta

SEQ ID NO: 8168735 - DNA, 22 bp, Homo sapiens
attatctaggaattgacagaag

SEQ ID NO: 8168736 - DNA, 22 bp, Homo sapiens
attatctaggaattgacagaag

SEQ ID NO: 8168737 - DNA, 22 bp, Homo sapiens
gcacccagaataaggacaggac

SEQ ID NO: 8168738 - DNA, 22 bp, Homo sapiens
gcacccacttaggccagtcaat

SEQ ID NO: 8168739 - DNA, 22 bp, Homo sapiens
gcacccagaataaggacaggac

SEQ ID NO: 8168740 - DNA, 22 bp, Homo sapiens
gcaccatgatggagcctcatta

SEQ ID NO: 8168741 - DNA, 22 bp, Homo sapiens
gcaccatgatggagcctcatta

SEQ ID NO: 8168742 - DNA, 22 bp, Homo sapiens
gcacacagaattgattcactgt

SEQ ID NO: 8168743 - DNA, 22 bp, Homo sapiens
gcacacagactaaccatatttc

SEQ ID NO: 8168744 - DNA, 22 bp, Homo sapiens
gcacacagagaggtggtatgtc

SEQ ID NO: 8168745 - DNA, 22 bp, Homo sapiens
gcacacagactaaccatatttc

SEQ ID NO: 8168746 - DNA, 22 bp, Homo sapiens
gcacacagattaggaaacagaa

SEQ ID NO: 8168747 - DNA, 22 bp, Homo sapiens
gcacacaggcagtttccagcca

SEQ ID NO: 8168748 - DNA, 22 bp, Homo sapiens
gcacacaggcagtttccagcca

SEQ ID NO: 8168749 - DNA, 22 bp, Homo sapiens
gcacacaggcagtttccagcca

SEQ ID NO: 8168750 - DNA, 22 bp, Homo sapiens
gcacacagctagattaccattc

SEQ ID NO: 8168751 - DNA, 22 bp, Homo sapiens
gcacacagccagctgagggcta

SEQ ID NO: 8168752 - DNA, 22 bp, Homo sapiens
gcacacagctagattaccattc

SEQ ID NO: 8168753 - DNA, 22 bp, Homo sapiens
gcaccagggagggtgtgcttca

SEQ ID NO: 8168754 - DNA, 22 bp, Homo sapiens
gcaccagggagggtgtgcttca

SEQ ID NO: 8168755 - DNA, 22 bp, Homo sapiens
gcaccaggcttagagccccagg

SEQ ID NO: 8168756 - DNA, 22 bp, Homo sapiens
gcaccaggcagctgagcaggcc

SEQ ID NO: 8168757 - DNA, 22 bp, Homo sapiens
gcaccaggcttagagccccagg

SEQ ID NO: 8168758 - DNA, 22 bp, Homo sapiens
gcaccaggcttagagccccagg

SEQ ID NO: 8168759 - DNA, 22 bp, Homo sapiens
gcacagggctgccaggcggctt

SEQ ID NO: 8168760 - DNA, 22 bp, Homo sapiens
gcaccaggcagctgagcaggcc

SEQ ID NO: 8168761 - DNA, 22 bp, Homo sapiens
gcaccaggcagctgagcaggcc

SEQ ID NO: 8168762 - DNA, 22 bp, Homo sapiens
gcaccaggcagctgagcaggcc

SEQ ID NO: 8168763 - DNA, 22 bp, Homo sapiens
gcaccaggcagctgagcaggcc

SEQ ID NO: 8168764 - DNA, 22 bp, Homo sapiens
gcaccaggcagctgagcaggcc

SEQ ID NO: 8168765 - DNA, 22 bp, Homo sapiens
gcaccaggcagctgagcaggcc

SEQ ID NO: 8168766 - DNA, 22 bp, Homo sapiens
attatcacaggtgagtctcact

SEQ ID NO: 8168767 - DNA, 22 bp, Homo sapiens
attatccaacacccagttacat

SEQ ID NO: 8168768 - DNA, 22 bp, Homo sapiens
attatccaacacccagttacat

SEQ ID NO: 8168769 - DNA, 22 bp, Homo sapiens
attatccagcaccaatgtcaga

SEQ ID NO: 8168770 - DNA, 22 bp, Homo sapiens
gcacacagaattgattcactgt

SEQ ID NO: 8168771 - DNA, 22 bp, Homo sapiens
attatattgagtataaccagag

SEQ ID NO: 8168772 - DNA, 22 bp, Homo sapiens
attatatttgaaaggttggaag

SEQ ID NO: 8168773 - DNA, 22 bp, Homo sapiens
attatattgagtataaccagag

SEQ ID NO: 8168774 - DNA, 22 bp, Homo sapiens
attatatgtgggatagaattta

SEQ ID NO: 8168775 - DNA, 22 bp, Homo sapiens
attaagactgcccatgttttta

SEQ ID NO: 8168776 - DNA, 22 bp, Homo sapiens
attaagactattgatatttaca

SEQ ID NO: 8168777 - DNA, 22 bp, Homo sapiens
attaagatcattgtagaagatt

SEQ ID NO: 8168778 - DNA, 22 bp, Homo sapiens
attagtttggtgcaaaagtaat

SEQ ID NO: 8168779 - DNA, 22 bp, Homo sapiens
attagttggggtggagaaggat

SEQ ID NO: 8168780 - DNA, 22 bp, Homo sapiens
attatataaaattctggaagct

SEQ ID NO: 8168781 - DNA, 22 bp, Homo sapiens
attataggcttgagccaccgtg

SEQ ID NO: 8168782 - DNA, 22 bp, Homo sapiens
attataggcttgagccaccgtg

SEQ ID NO: 8168783 - DNA, 22 bp, Homo sapiens
attataggcttgagccaccgtg

SEQ ID NO: 8168784 - DNA, 22 bp, Homo sapiens
attataggcttgagccaccgtg

SEQ ID NO: 8168785 - DNA, 22 bp, Homo sapiens
attataggcttgagccaccgtg

SEQ ID NO: 8168786 - DNA, 22 bp, Homo sapiens
attataggcttgagccaccgtg

SEQ ID NO: 8168787 - DNA, 22 bp, Homo sapiens
attataggcttgagccaccgtg

SEQ ID NO: 8168788 - DNA, 22 bp, Homo sapiens
attataggcttgagccaccgtg

SEQ ID NO: 8168789 - DNA, 22 bp, Homo sapiens
attataggcttgagccaccgtg

SEQ ID NO: 8168790 - DNA, 22 bp, Homo sapiens
attataggcttgagccaccgtg

SEQ ID NO: 8168791 - DNA, 22 bp, Homo sapiens
aggtctggtgttgggcctgaaa

SEQ ID NO: 8168792 - DNA, 22 bp, Homo sapiens
aggtctggtgttgatgaattcc

SEQ ID NO: 8168793 - DNA, 22 bp, Homo sapiens
aggtctgtcaaactgtcagtga

SEQ ID NO: 8168794 - DNA, 22 bp, Homo sapiens
aggtctgttagcatgttgacta

SEQ ID NO: 8168795 - DNA, 19 bp, Homo sapiens
aggtgaggggcaccatgtc

SEQ ID NO: 8168796 - DNA, 18 bp, Homo sapiens
aggtctgtggtcaccagg

SEQ ID NO: 8168797 - DNA, 22 bp, Homo sapiens
aggtctgtctggccccatgaat

SEQ ID NO: 8168798 - DNA, 19 bp, Homo sapiens
aggtgaggggcaccatgtc

SEQ ID NO: 8168799 - DNA, 19 bp, Homo sapiens
aggtgaggggcaccatgtc

SEQ ID NO: 8168800 - DNA, 22 bp, Homo sapiens
aggtgagggtgccagtgcatgg

SEQ ID NO: 8168801 - DNA, 22 bp, Homo sapiens
aggtctggaggcggagtcagga

SEQ ID NO: 8168802 - DNA, 22 bp, Homo sapiens
aggtctggaggcggagtcagga

SEQ ID NO: 8168803 - DNA, 22 bp, Homo sapiens
aggtctggaggcggagtcagga

SEQ ID NO: 8168804 - DNA, 23 bp, Homo sapiens
aggtctggacccttggcccctgc

SEQ ID NO: 8168805 - DNA, 23 bp, Homo sapiens
aggtctggacccttggcccctgc

SEQ ID NO: 8168806 - DNA, 22 bp, Homo sapiens
aggtctggagtgggatctgaga

SEQ ID NO: 8168807 - DNA, 22 bp, Homo sapiens
aggtctggctcttctccacaga

SEQ ID NO: 8168808 - DNA, 22 bp, Homo sapiens
aggtctggagtgggatctgaga

SEQ ID NO: 8168809 - DNA, 22 bp, Homo sapiens
aggtctgggagttcattccctg

SEQ ID NO: 8168810 - DNA, 22 bp, Homo sapiens
aggtctgggagttcattccctg

SEQ ID NO: 8168811 - DNA, 22 bp, Homo sapiens
aggtctggctcttctccacaga

SEQ ID NO: 8168812 - DNA, 22 bp, Homo sapiens
aggtctggtgagagcaggtgct

SEQ ID NO: 8168813 - DNA, 22 bp, Homo sapiens
aggtctggtgagagcaggtgct

SEQ ID NO: 8168814 - DNA, 22 bp, Homo sapiens
aggtctggtgagagcaggtgct

SEQ ID NO: 8168815 - DNA, 22 bp, Homo sapiens
aggtctggtgagagcaggtgct

SEQ ID NO: 8168816 - DNA, 22 bp, Homo sapiens
aggtctggtgggctttagattg

SEQ ID NO: 8168817 - DNA, 22 bp, Homo sapiens
aggtctgggattgaagacatca

SEQ ID NO: 8168818 - DNA, 22 bp, Homo sapiens
aggtctgggcaccactggctgc

SEQ ID NO: 8168819 - DNA, 22 bp, Homo sapiens
aggtctggtatttttctatact

SEQ ID NO: 8168820 - DNA, 22 bp, Homo sapiens
aggtctggaaacagcagggaga

SEQ ID NO: 8168821 - DNA, 22 bp, Homo sapiens
aggtctggaaacagcagggaga

SEQ ID NO: 8168822 - DNA, 22 bp, Homo sapiens
aggtctgcctcactcacttctg

SEQ ID NO: 8168823 - DNA, 20 bp, Homo sapiens
aggtctgattccagaatcag

SEQ ID NO: 8168824 - DNA, 22 bp, Homo sapiens
aggtctgagtatggcctgagaa

SEQ ID NO: 8168825 - DNA, 22 bp, Homo sapiens
aggtctgagtcccaggggtacc

SEQ ID NO: 8168826 - DNA, 22 bp, Homo sapiens
aggtctgagtttgttgttggct

SEQ ID NO: 8168827 - DNA, 22 bp, Homo sapiens
aggtctgagtatggcctgagaa

SEQ ID NO: 8168828 - DNA, 22 bp, Homo sapiens
aggtctgagtatggcctgagaa

SEQ ID NO: 8168829 - DNA, 22 bp, Homo sapiens
aggtctgagtagagaaaaggca

SEQ ID NO: 8168830 - DNA, 18 bp, Homo sapiens
aggtctgaggaagagcct

SEQ ID NO: 8168831 - DNA, 22 bp, Homo sapiens
aggtctgagcaggggagaacag

SEQ ID NO: 8168832 - DNA, 22 bp, Homo sapiens
aggtctgagcaggggagaacag

SEQ ID NO: 8168833 - DNA, 18 bp, Homo sapiens
aggtctgaggaagagcct

SEQ ID NO: 8168834 - DNA, 22 bp, Homo sapiens
aggtcctgtccttggtctctga

SEQ ID NO: 8168835 - DNA, 22 bp, Homo sapiens
aggtcctgtccttggtctctga

SEQ ID NO: 8168836 - DNA, 17 bp, Homo sapiens
aggtctgagagtatctg

SEQ ID NO: 8168837 - DNA, 17 bp, Homo sapiens
aggtctgagagtatctg

SEQ ID NO: 8168838 - DNA, 22 bp, Homo sapiens
aggtctgacttcaagcctgtgg

SEQ ID NO: 8168839 - DNA, 20 bp, Homo sapiens
aggtctgaatgtcagggctg

SEQ ID NO: 8168840 - DNA, 22 bp, Homo sapiens
aggtatgtggttccatgatgag

SEQ ID NO: 8168841 - DNA, 22 bp, Homo sapiens
aggtatgtggttccatgatgag

SEQ ID NO: 8168842 - DNA, 21 bp, Homo sapiens
aggtatgttgagaactgagga

SEQ ID NO: 8168843 - DNA, 22 bp, Homo sapiens
aggtattagaagagtcatggga

SEQ ID NO: 8168844 - DNA, 22 bp, Homo sapiens
aggtattattagcatctctatt

SEQ ID NO: 8168845 - DNA, 22 bp, Homo sapiens
aggtatgtgctattgttatatt

SEQ ID NO: 8168846 - DNA, 22 bp, Homo sapiens
aggtatgtgctattgttatatt

SEQ ID NO: 8168847 - DNA, 22 bp, Homo sapiens
aggtatgtgggtgagaggagga

SEQ ID NO: 8168848 - DNA, 22 bp, Homo sapiens
aggtatgtatgtgtgtatattt

SEQ ID NO: 8168849 - DNA, 22 bp, Homo sapiens
aggtatgtatgtgtgtatattt

SEQ ID NO: 8168850 - DNA, 22 bp, Homo sapiens
aggtatggcataaatcacaggg

SEQ ID NO: 8168851 - DNA, 22 bp, Homo sapiens
cctgggcaggccggacgctggg

SEQ ID NO: 8168852 - DNA, 22 bp, Homo sapiens
cctgggcaggccggacgctggg

SEQ ID NO: 8168853 - DNA, 22 bp, Homo sapiens
cctgggcagggagaccaggctc

SEQ ID NO: 8168854 - DNA, 22 bp, Homo sapiens
cctgggcagggagaccaggctc

SEQ ID NO: 8168855 - DNA, 22 bp, Homo sapiens
cctgggcagggctggactctca

SEQ ID NO: 8168856 - DNA, 22 bp, Homo sapiens
cctgggcagggctggactctca

SEQ ID NO: 8168857 - DNA, 22 bp, Homo sapiens
aggtgctgtttgtcagcagttt

SEQ ID NO: 8168858 - DNA, 22 bp, Homo sapiens
cctgggcagtgctggagttgaa

SEQ ID NO: 8168859 - DNA, 22 bp, Homo sapiens
cctgggcaggtgtggcttcccc

SEQ ID NO: 8168860 - DNA, 22 bp, Homo sapiens
cctgggcagtgctggagttgaa

SEQ ID NO: 8168861 - DNA, 22 bp, Homo sapiens
cctgggcagggctggactctca

SEQ ID NO: 8168862 - DNA, 22 bp, Homo sapiens
cctgggcaggtgtggcttcccc

SEQ ID NO: 8168863 - DNA, 22 bp, Homo sapiens
cctgggcagggctggactctca

SEQ ID NO: 8168864 - DNA, 22 bp, Homo sapiens
cctgggcaggtgtggcttcccc

SEQ ID NO: 8168865 - DNA, 20 bp, Homo sapiens
aggtgcaaggcatggcatgt

SEQ ID NO: 8168866 - DNA, 22 bp, Homo sapiens
aggtgcagaaaaaagtccttta

SEQ ID NO: 8168867 - DNA, 23 bp, Homo sapiens
aggtgcactgtggtggcagtggc

SEQ ID NO: 8168868 - DNA, 22 bp, Homo sapiens
aggtgcactgtctaattaggtc

SEQ ID NO: 8168869 - DNA, 21 bp, Homo sapiens
aggtgcagagccagggaccag

SEQ ID NO: 8168870 - DNA, 21 bp, Homo sapiens
aggtgcagagccagggaccag

SEQ ID NO: 8168871 - DNA, 22 bp, Homo sapiens
aggtgcagaaaaaagtccttta

SEQ ID NO: 8168872 - DNA, 22 bp, Homo sapiens
cctgggcaggatgggcccggtg

SEQ ID NO: 8168873 - DNA, 22 bp, Homo sapiens
cctgggcaggatgggcccggtg

SEQ ID NO: 8168874 - DNA, 22 bp, Homo sapiens
aggtgattagcttgaaatcctt

SEQ ID NO: 8168875 - DNA, 22 bp, Homo sapiens
aggtgattttctccttacgatt

SEQ ID NO: 8168876 - DNA, 22 bp, Homo sapiens
aggtgattcaactgtgcagtga

SEQ ID NO: 8168877 - DNA, 22 bp, Homo sapiens
aggtgattctaatgtgcagtca

SEQ ID NO: 8168878 - DNA, 20 bp, Homo sapiens
aggtgcaagcagtaaattgc

SEQ ID NO: 8168879 - DNA, 22 bp, Homo sapiens
aggtgataagtgttaaataaag

SEQ ID NO: 8168880 - DNA, 22 bp, Homo sapiens
aggtgagttggtaggaagtttg

SEQ ID NO: 8168881 - DNA, 22 bp, Homo sapiens
aggtgagtgtgactgcaagaga

SEQ ID NO: 8168882 - DNA, 22 bp, Homo sapiens
aggtgagttacaggaggaggtc

SEQ ID NO: 8168883 - DNA, 19 bp, Homo sapiens
aggtgagtgtgggaaaggg

SEQ ID NO: 8168884 - DNA, 22 bp, Homo sapiens
aggtgagtcctgggcacaggta

SEQ ID NO: 8168885 - DNA, 22 bp, Homo sapiens
aggtgagtcctgggcacaggta

SEQ ID NO: 8168886 - DNA, 22 bp, Homo sapiens
aggtggagttggctgtagttca

SEQ ID NO: 8168887 - DNA, 22 bp, Homo sapiens
aggtggagttaagtgtgaactg

SEQ ID NO: 8168888 - DNA, 22 bp, Homo sapiens
cctgggttattttggtctagtg

SEQ ID NO: 8168889 - DNA, 22 bp, Homo sapiens
aggtggatcatatactagacca

SEQ ID NO: 8168890 - DNA, 22 bp, Homo sapiens
aggtggatctcagctcatctaa

SEQ ID NO: 8168891 - DNA, 22 bp, Homo sapiens
cctggtcacccctctctctgca

SEQ ID NO: 8168892 - DNA, 22 bp, Homo sapiens
cctgggtttggagcctgcagaa

SEQ ID NO: 8168893 - DNA, 22 bp, Homo sapiens
cctggtcacccctctctctgca

SEQ ID NO: 8168894 - DNA, 22 bp, Homo sapiens
cctggtcagagcagtcaggatc

SEQ ID NO: 8168895 - DNA, 22 bp, Homo sapiens
cctggtcacccctctctctgca

SEQ ID NO: 8168896 - DNA, 22 bp, Homo sapiens
cctgggttggagagcaatggtg

SEQ ID NO: 8168897 - DNA, 22 bp, Homo sapiens
cctgggttccagcaccctctag

SEQ ID NO: 8168898 - DNA, 22 bp, Homo sapiens
cctggtcccattgcggctgcct

SEQ ID NO: 8168899 - DNA, 22 bp, Homo sapiens
cctggtcccattgcggctgcct

SEQ ID NO: 8168900 - DNA, 22 bp, Homo sapiens
cctggtcaggtaactgggctga

SEQ ID NO: 8168901 - DNA, 22 bp, Homo sapiens
cctggtcaggtaactgggctga

SEQ ID NO: 8168902 - DNA, 23 bp, Homo sapiens
aggtggagctgtgcagccggggc

SEQ ID NO: 8168903 - DNA, 23 bp, Homo sapiens
aggtggagctgtgcagccggggc

SEQ ID NO: 8168904 - DNA, 22 bp, Homo sapiens
aggtgcttggctcgtgcacaca

SEQ ID NO: 8168905 - DNA, 22 bp, Homo sapiens
aggtgcttggctcgtgcacaca

SEQ ID NO: 8168906 - DNA, 23 bp, Homo sapiens
aggtggagctgtgcagccggggc

SEQ ID NO: 8168907 - DNA, 22 bp, Homo sapiens
aggtggagtgaaggaaaggcag

SEQ ID NO: 8168908 - DNA, 22 bp, Homo sapiens
aggtggagtgaaggaaaggcag

SEQ ID NO: 8168909 - DNA, 22 bp, Homo sapiens
aggtggagtgaaggaaaggcag

SEQ ID NO: 8168910 - DNA, 22 bp, Homo sapiens
aggtggagtgaaggaaaggcag

SEQ ID NO: 8168911 - DNA, 22 bp, Homo sapiens
aggtggagtgaaggaaaggcag

SEQ ID NO: 8168912 - DNA, 22 bp, Homo sapiens
aggtggagtgaaggaaaggcag

SEQ ID NO: 8168913 - DNA, 22 bp, Homo sapiens
aggtggagtgtgcagggagagc

SEQ ID NO: 8168914 - DNA, 22 bp, Homo sapiens
aggtggagtgtgcagggagagc

SEQ ID NO: 8168915 - DNA, 22 bp, Homo sapiens
aggtggagtgtgcagggagagc

SEQ ID NO: 8168916 - DNA, 22 bp, Homo sapiens
aggtggagtgtgcagggagagc

SEQ ID NO: 8168917 - DNA, 22 bp, Homo sapiens
aggtggagtgtgcagggagagc

SEQ ID NO: 8168918 - DNA, 22 bp, Homo sapiens
aggtggagtgtgcagggagagc

SEQ ID NO: 8168919 - DNA, 22 bp, Homo sapiens
cctggagcaggagctgcagagg

SEQ ID NO: 8168920 - DNA, 22 bp, Homo sapiens
cctggagcaggagctgcagagg

SEQ ID NO: 8168921 - DNA, 22 bp, Homo sapiens
cctggagcaggagctgcagagg

SEQ ID NO: 8168922 - DNA, 22 bp, Homo sapiens
cctgcctggctgtcagcagagc

SEQ ID NO: 8168923 - DNA, 18 bp, Homo sapiens
cctggacctgtctccttt

SEQ ID NO: 8168924 - DNA, 22 bp, Homo sapiens
cctggagcaggagctgcagagg

SEQ ID NO: 8168925 - DNA, 22 bp, Homo sapiens
cctggagcatcaggaggaaggg

SEQ ID NO: 8168926 - DNA, 22 bp, Homo sapiens
cctggagcatcaggaggaaggg

SEQ ID NO: 8168927 - DNA, 22 bp, Homo sapiens
cctggagcccaaggcagtgaga

SEQ ID NO: 8168928 - DNA, 22 bp, Homo sapiens
cctggagcccaaggcagtgaga

SEQ ID NO: 8168929 - DNA, 22 bp, Homo sapiens
cctggagcccaaggcagtgaga

SEQ ID NO: 8168930 - DNA, 22 bp, Homo sapiens
cctggagcccaaggcagtgaga

SEQ ID NO: 8168931 - DNA, 22 bp, Homo sapiens
cctggagcccaaggcagtgaga

SEQ ID NO: 8168932 - DNA, 22 bp, Homo sapiens
cctggagcccaaggcagtgaga

SEQ ID NO: 8168933 - DNA, 22 bp, Homo sapiens
cctgcctggatcagccatcctg

SEQ ID NO: 8168934 - DNA, 22 bp, Homo sapiens
cctgcctggatcagccatcctg

SEQ ID NO: 8168935 - DNA, 22 bp, Homo sapiens
cctgcctggagctgagtgtgga

SEQ ID NO: 8168936 - DNA, 22 bp, Homo sapiens
cctgcctgctttctgctttgca

SEQ ID NO: 8168937 - DNA, 22 bp, Homo sapiens
cctgcctgctttctgctttgca

SEQ ID NO: 8168938 - DNA, 22 bp, Homo sapiens
cctgcctggctgtcagcagagc

SEQ ID NO: 8168939 - DNA, 22 bp, Homo sapiens
cctgcctggctgtcagcagagc

SEQ ID NO: 8168940 - DNA, 22 bp, Homo sapiens
cctgcctggctgtcagcagagc

SEQ ID NO: 8168941 - DNA, 22 bp, Homo sapiens
cctgcctggctgtcagcagagc

SEQ ID NO: 8168942 - DNA, 22 bp, Homo sapiens
cctgcctggcacatagtactct

SEQ ID NO: 8168943 - DNA, 22 bp, Homo sapiens
cctgcctggcccaccttgccac

SEQ ID NO: 8168944 - DNA, 19 bp, Homo sapiens
agggtggcaaaggagggtg

SEQ ID NO: 8168945 - DNA, 20 bp, Homo sapiens
agggtggcaagttagtgaca

SEQ ID NO: 8168946 - DNA, 19 bp, Homo sapiens
agggtggcaaaggagggtg

SEQ ID NO: 8168947 - DNA, 19 bp, Homo sapiens
agggtggcaaaggagggtg

SEQ ID NO: 8168948 - DNA, 19 bp, Homo sapiens
agggtggcaaaggagggtg

SEQ ID NO: 8168949 - DNA, 22 bp, Homo sapiens
agggtggcacctggaagggatg

SEQ ID NO: 8168950 - DNA, 22 bp, Homo sapiens
agggtggcaccacatatcatag

SEQ ID NO: 8168951 - DNA, 22 bp, Homo sapiens
agggtggcaccacatatcatag

SEQ ID NO: 8168952 - DNA, 22 bp, Homo sapiens
agggtggcagttactggagcaa

SEQ ID NO: 8168953 - DNA, 22 bp, Homo sapiens
agggtggcactggtggctctat

SEQ ID NO: 8168954 - DNA, 22 bp, Homo sapiens
agggtggcactggtggctctat

SEQ ID NO: 8168955 - DNA, 22 bp, Homo sapiens
agggtggcactggtggctctat

SEQ ID NO: 8168956 - DNA, 22 bp, Homo sapiens
agggtggcagttactggagcaa

SEQ ID NO: 8168957 - DNA, 22 bp, Homo sapiens
agggtggcagttactggagcaa

SEQ ID NO: 8168958 - DNA, 22 bp, Homo sapiens
agggtggcagttactggagcaa

SEQ ID NO: 8168959 - DNA, 22 bp, Homo sapiens
cctgcctgcgtcctctgagggc

SEQ ID NO: 8168960 - DNA, 22 bp, Homo sapiens
aggggcttatgtttctccaggc

SEQ ID NO: 8168961 - DNA, 22 bp, Homo sapiens
aggggcttgtggagttgctggt

SEQ ID NO: 8168962 - DNA, 22 bp, Homo sapiens
aggggctgtggaaaccaactct

SEQ ID NO: 8168963 - DNA, 23 bp, Homo sapiens
agggtgagcaagctatggagacc

SEQ ID NO: 8168964 - DNA, 23 bp, Homo sapiens
agggtgagcaagctatggagacc

SEQ ID NO: 8168965 - DNA, 23 bp, Homo sapiens
agggtgagcaagctatggagacc

SEQ ID NO: 8168966 - DNA, 23 bp, Homo sapiens
agggtgagcaagctatggagacc

SEQ ID NO: 8168967 - DNA, 22 bp, Homo sapiens
aggggctttggtgctggtcctg

SEQ ID NO: 8168968 - DNA, 17 bp, Homo sapiens
agggggaacctgggagg

SEQ ID NO: 8168969 - DNA, 22 bp, Homo sapiens
agggtggagggagtccctgagc

SEQ ID NO: 8168970 - DNA, 22 bp, Homo sapiens
agggtggaagatggcactatct

SEQ ID NO: 8168971 - DNA, 19 bp, Homo sapiens
agggtggcaaaggagggtg

SEQ ID NO: 8168972 - DNA, 22 bp, Homo sapiens
agggtgctaatctcattcacat

SEQ ID NO: 8168973 - DNA, 22 bp, Homo sapiens
agggtggaagatggcactatct

SEQ ID NO: 8168974 - DNA, 22 bp, Homo sapiens
agggtgctgccggacaggtggg

SEQ ID NO: 8168975 - DNA, 22 bp, Homo sapiens
agggtgctctggaaaatgtagt

SEQ ID NO: 8168976 - DNA, 22 bp, Homo sapiens
agggtggctgagtagatggaag

SEQ ID NO: 8168977 - DNA, 22 bp, Homo sapiens
agggtggctgagtagatggaag

SEQ ID NO: 8168978 - DNA, 22 bp, Homo sapiens
agggtggctgagtagatggaag

SEQ ID NO: 8168979 - DNA, 21 bp, Homo sapiens
agggtggctctgggtcagaac

SEQ ID NO: 8168980 - DNA, 21 bp, Homo sapiens
agggtggctctgggtcagaac

SEQ ID NO: 8168981 - DNA, 21 bp, Homo sapiens
agggtggctctgggtcagaac

SEQ ID NO: 8168982 - DNA, 21 bp, Homo sapiens
agggtggctctgggtcagaac

SEQ ID NO: 8168983 - DNA, 22 bp, Homo sapiens
agggtggctgtgaagtgcttgg

SEQ ID NO: 8168984 - DNA, 22 bp, Homo sapiens
agggtggctggaggaatcagaa

SEQ ID NO: 8168985 - DNA, 22 bp, Homo sapiens
agggtggctgagtagatggaag

SEQ ID NO: 8168986 - DNA, 23 bp, Homo sapiens
agggtggcttgctttgcttcctt

SEQ ID NO: 8168987 - DNA, 22 bp, Homo sapiens
cctggccagcagccccttcctc

SEQ ID NO: 8168988 - DNA, 22 bp, Homo sapiens
agggtggcttaattccaaaggg

SEQ ID NO: 8168989 - DNA, 23 bp, Homo sapiens
agggtggcttgctttgcttcctt

SEQ ID NO: 8168990 - DNA, 23 bp, Homo sapiens
agggtggcttgctttgcttcctt

SEQ ID NO: 8168991 - DNA, 22 bp, Homo sapiens
agggtggcttaattccaaaggg

SEQ ID NO: 8168992 - DNA, 22 bp, Homo sapiens
agggtggcttaattccaaaggg

SEQ ID NO: 8168993 - DNA, 22 bp, Homo sapiens
agggtggcttaattccaaaggg

SEQ ID NO: 8168994 - DNA, 22 bp, Homo sapiens
agggtggctgtgaagtgcttgg

SEQ ID NO: 8168995 - DNA, 22 bp, Homo sapiens
agggtggctgtgaagtgcttgg

SEQ ID NO: 8168996 - DNA, 22 bp, Homo sapiens
cctggccttaagggcagggagc

SEQ ID NO: 8168997 - DNA, 22 bp, Homo sapiens
agggtggccccactttggttgg

SEQ ID NO: 8168998 - DNA, 22 bp, Homo sapiens
agggtggccccactttggttgg

SEQ ID NO: 8168999 - DNA, 22 bp, Homo sapiens
agggtggccatgagggagagat

SEQ ID NO: 8169000 - DNA, 22 bp, Homo sapiens
agggtggccatgagggagagat

SEQ ID NO: 8169001 - DNA, 22 bp, Homo sapiens
agggtggccaccaagtatgtca

SEQ ID NO: 8169002 - DNA, 22 bp, Homo sapiens
cctggagctcactgggagccgg

SEQ ID NO: 8169003 - DNA, 22 bp, Homo sapiens
cctggagctcactgggagccgg

SEQ ID NO: 8169004 - DNA, 22 bp, Homo sapiens
cctggagctcactgggagccgg

SEQ ID NO: 8169005 - DNA, 22 bp, Homo sapiens
cctggagctcactgggagccgg

SEQ ID NO: 8169006 - DNA, 22 bp, Homo sapiens
cctggagctcactgggagccgg

SEQ ID NO: 8169007 - DNA, 22 bp, Homo sapiens
cctggagcgcgggtcaagctgg

SEQ ID NO: 8169008 - DNA, 20 bp, Homo sapiens
cctggagcctggaaggagtc

SEQ ID NO: 8169009 - DNA, 20 bp, Homo sapiens
cctggagcctggaaggagtc

SEQ ID NO: 8169010 - DNA, 22 bp, Homo sapiens
cctggagcccctctggccagcc

SEQ ID NO: 8169011 - DNA, 22 bp, Homo sapiens
cctggagcccctctggccagcc

SEQ ID NO: 8169012 - DNA, 22 bp, Homo sapiens
cctggagcccctctggccagcc

SEQ ID NO: 8169013 - DNA, 22 bp, Homo sapiens
cctggctcaaggcgaggactcc

SEQ ID NO: 8169014 - DNA, 22 bp, Homo sapiens
cctggctcaaggcgaggactcc

SEQ ID NO: 8169015 - DNA, 23 bp, Homo sapiens
cctggctcaccccttatgtccag

SEQ ID NO: 8169016 - DNA, 22 bp, Homo sapiens
cctggcctttgaacgctagact

SEQ ID NO: 8169017 - DNA, 22 bp, Homo sapiens
cctggccttaagggcagggagc

SEQ ID NO: 8169018 - DNA, 22 bp, Homo sapiens
cctggctaggagagctgggctc

SEQ ID NO: 8169019 - DNA, 22 bp, Homo sapiens
cctggctcagaccccagttctg

SEQ ID NO: 8169020 - DNA, 22 bp, Homo sapiens
cctggctcagcagctctttctc

SEQ ID NO: 8169021 - DNA, 18 bp, Homo sapiens
aggtataagtgatctgct

SEQ ID NO: 8169022 - DNA, 22 bp, Homo sapiens
aggtataagtctcatttctgtt

SEQ ID NO: 8169023 - DNA, 22 bp, Homo sapiens
aggtataagaagattatttata

SEQ ID NO: 8169024 - DNA, 22 bp, Homo sapiens
aggtataagaagattatttata

SEQ ID NO: 8169025 - DNA, 18 bp, Homo sapiens
aggtatatgaatctcttt

SEQ ID NO: 8169026 - DNA, 22 bp, Homo sapiens
aggtatatgaagatgaaataac

SEQ ID NO: 8169027 - DNA, 20 bp, Homo sapiens
aggtataagaaatgtgattt

SEQ ID NO: 8169028 - DNA, 22 bp, Homo sapiens
aggtatatgctattacttctgc

SEQ ID NO: 8169029 - DNA, 22 bp, Homo sapiens
aggtatatgctattacttctgc

SEQ ID NO: 8169030 - DNA, 22 bp, Homo sapiens
aggtatatgttcatgtatgtgt

SEQ ID NO: 8169031 - DNA, 22 bp, Homo sapiens
aggtatctggtaagaggcagac

SEQ ID NO: 8169032 - DNA, 22 bp, Homo sapiens
aggtatattttgtatatactct

SEQ ID NO: 8169033 - DNA, 22 bp, Homo sapiens
aggtatcaacagcagagtctga

SEQ ID NO: 8169034 - DNA, 22 bp, Homo sapiens
cctggctcagtgttgaaggggt

SEQ ID NO: 8169035 - DNA, 20 bp, Homo sapiens
aggtataagaaatgtgattt

SEQ ID NO: 8169036 - DNA, 22 bp, Homo sapiens
aggtataagaagattatttata

SEQ ID NO: 8169037 - DNA, 17 bp, Homo sapiens
aggtataaaatggtagc

SEQ ID NO: 8169038 - DNA, 17 bp, Homo sapiens
aggtataaaatggtagc

SEQ ID NO: 8169039 - DNA, 22 bp, Homo sapiens
aggttggctgctcttttcctaa

SEQ ID NO: 8169040 - DNA, 22 bp, Homo sapiens
aggttggcctcagggaggctct

SEQ ID NO: 8169041 - DNA, 22 bp, Homo sapiens
aggttggcctcagggaggctct

SEQ ID NO: 8169042 - DNA, 22 bp, Homo sapiens
aggttccaagaaatcatcagtg

SEQ ID NO: 8169043 - DNA, 22 bp, Homo sapiens
aggtttactgagggtgctggtt

SEQ ID NO: 8169044 - DNA, 22 bp, Homo sapiens
aggttggcctcagggaggctct

SEQ ID NO: 8169045 - DNA, 22 bp, Homo sapiens
aggtttataggaaatttgttcc

SEQ ID NO: 8169046 - DNA, 22 bp, Homo sapiens
aggtttatctcatagaaagaat

SEQ ID NO: 8169047 - DNA, 22 bp, Homo sapiens
aggtttatctcatagaaagaat

SEQ ID NO: 8169048 - DNA, 22 bp, Homo sapiens
aggttcagatgacttttatgct

SEQ ID NO: 8169049 - DNA, 22 bp, Homo sapiens
aggttcaaatgcaagagatgct

SEQ ID NO: 8169050 - DNA, 22 bp, Homo sapiens
aggttcaaattgttgcagtttc

SEQ ID NO: 8169051 - DNA, 22 bp, Homo sapiens
aggttaaaaaggattcagttaa

SEQ ID NO: 8169052 - DNA, 17 bp, Homo sapiens
aggtgtggtcaagggag

SEQ ID NO: 8169053 - DNA, 22 bp, Homo sapiens
aggttacagtgattataggttt

SEQ ID NO: 8169054 - DNA, 22 bp, Homo sapiens
aggttatttaggaaggtagagc

SEQ ID NO: 8169055 - DNA, 22 bp, Homo sapiens
aggttattaaagtgtatttttg

SEQ ID NO: 8169056 - DNA, 21 bp, Homo sapiens
aggttattacaatttttctac

SEQ ID NO: 8169057 - DNA, 22 bp, Homo sapiens
aggttatcatcagttgagcact

SEQ ID NO: 8169058 - DNA, 23 bp, Homo sapiens
aggttatgattatagagcgagga

SEQ ID NO: 8169059 - DNA, 23 bp, Homo sapiens
aggttatgattatagagcgagga

SEQ ID NO: 8169060 - DNA, 22 bp, Homo sapiens
cctggtgcaccaagtaagggtg

SEQ ID NO: 8169061 - DNA, 22 bp, Homo sapiens
cctggtccccatcggcccagcg

SEQ ID NO: 8169062 - DNA, 22 bp, Homo sapiens
cctggtccccatcggcccagcg

SEQ ID NO: 8169063 - DNA, 22 bp, Homo sapiens
cctggtgcccccaagccagctg

SEQ ID NO: 8169064 - DNA, 22 bp, Homo sapiens
aggtggggttcagtctcagccg

SEQ ID NO: 8169065 - DNA, 22 bp, Homo sapiens
cctggtgccactagagaatgtc

SEQ ID NO: 8169066 - DNA, 22 bp, Homo sapiens
cctggtgccactagagaatgtc

SEQ ID NO: 8169067 - DNA, 22 bp, Homo sapiens
aggtgtctgtgatgggagcgat

SEQ ID NO: 8169068 - DNA, 22 bp, Homo sapiens
aggtgtcttcagggtgagacag

SEQ ID NO: 8169069 - DNA, 22 bp, Homo sapiens
aggtgtctgtgatgggagcgat

SEQ ID NO: 8169070 - DNA, 22 bp, Homo sapiens
aggtgtctttgcggcccgccgc

SEQ ID NO: 8169071 - DNA, 22 bp, Homo sapiens
aggtgtgaagagttgacacatt

SEQ ID NO: 8169072 - DNA, 22 bp, Homo sapiens
aggtgtcttcagggtgagacag

SEQ ID NO: 8169073 - DNA, 22 bp, Homo sapiens
aggtgtctggatgggtgtcctt

SEQ ID NO: 8169074 - DNA, 22 bp, Homo sapiens
aggtgtctgggctttggagtca

SEQ ID NO: 8169075 - DNA, 22 bp, Homo sapiens
aggtggggttcagtctcagccg

SEQ ID NO: 8169076 - DNA, 22 bp, Homo sapiens
cctggtgcccccaagccagctg

SEQ ID NO: 8169077 - DNA, 22 bp, Homo sapiens
aggtgtggcttgaagtctctat

SEQ ID NO: 8169078 - DNA, 22 bp, Homo sapiens
aggtgtggctggggcagaggcc

SEQ ID NO: 8169079 - DNA, 22 bp, Homo sapiens
aggtgtggctggggcagaggcc

SEQ ID NO: 8169080 - DNA, 22 bp, Homo sapiens
aggtgtggctggggcagaggcc

SEQ ID NO: 8169081 - DNA, 19 bp, Homo sapiens
aggtgtgggggctgcagac

SEQ ID NO: 8169082 - DNA, 19 bp, Homo sapiens
aggtgtgggggctgcagac

SEQ ID NO: 8169083 - DNA, 19 bp, Homo sapiens
aggtgtgggggctgcagac

SEQ ID NO: 8169084 - DNA, 21 bp, Homo sapiens
aggtttatttcaacttcagga

SEQ ID NO: 8169085 - DNA, 22 bp, Homo sapiens
aggtttccagcaggccatagat

SEQ ID NO: 8169086 - DNA, 22 bp, Homo sapiens
aggtttcatgggagacaactca

SEQ ID NO: 8169087 - DNA, 22 bp, Homo sapiens
aggtttcatgggagacaactca

SEQ ID NO: 8169088 - DNA, 22 bp, Homo sapiens
aggtttattatgtagcattatt

SEQ ID NO: 8169089 - DNA, 22 bp, Homo sapiens
aggtttattaagtaaatagagc

SEQ ID NO: 8169090 - DNA, 17 bp, Homo sapiens
aggtttatggtatttga

SEQ ID NO: 8169091 - DNA, 22 bp, Homo sapiens
aggtttctactgtgttaagaaa

SEQ ID NO: 8169092 - DNA, 22 bp, Homo sapiens
aggtttctatgctgtttatctt

SEQ ID NO: 8169093 - DNA, 19 bp, Homo sapiens
aggtttctaactattcaag

SEQ ID NO: 8169094 - DNA, 22 bp, Homo sapiens
cctttagaaagtcagtagttgc

SEQ ID NO: 8169095 - DNA, 22 bp, Homo sapiens
cctttagaatacagactttcta

SEQ ID NO: 8169096 - DNA, 22 bp, Homo sapiens
aggtttctcctttaaagcatgg

SEQ ID NO: 8169097 - DNA, 21 bp, Homo sapiens
aggtttctcttttatggaggg

SEQ ID NO: 8169098 - DNA, 21 bp, Homo sapiens
aggtttctcttttatggaggg

SEQ ID NO: 8169099 - DNA, 21 bp, Homo sapiens
cctttagatttctatgcagtt

SEQ ID NO: 8169100 - DNA, 22 bp, Homo sapiens
cctttagatgatctcttggaca

SEQ ID NO: 8169101 - DNA, 22 bp, Homo sapiens
cctttagagcaaacgccaccta

SEQ ID NO: 8169102 - DNA, 22 bp, Homo sapiens
cctttagaattctgcccctcct

SEQ ID NO: 8169103 - DNA, 22 bp, Homo sapiens
cctttatgagatcctggggtga

SEQ ID NO: 8169104 - DNA, 22 bp, Homo sapiens
cctttatactaaggcatacaat

SEQ ID NO: 8169105 - DNA, 21 bp, Homo sapiens
cctttatgcaaggactggcat

SEQ ID NO: 8169106 - DNA, 22 bp, Homo sapiens
cctttatgtcactctggagagc

SEQ ID NO: 8169107 - DNA, 22 bp, Homo sapiens
cctttatgatagatgctttcag

SEQ ID NO: 8169108 - DNA, 20 bp, Homo sapiens
cctttattatttgtatgatg

SEQ ID NO: 8169109 - DNA, 22 bp, Homo sapiens
cctttattcaattagtcctaat

SEQ ID NO: 8169110 - DNA, 22 bp, Homo sapiens
cctttatgtttctgcagccccc

SEQ ID NO: 8169111 - DNA, 20 bp, Homo sapiens
cctttattatttgtatgatg

SEQ ID NO: 8169112 - DNA, 20 bp, Homo sapiens
cctttattatttgtatgatg

SEQ ID NO: 8169113 - DNA, 20 bp, Homo sapiens
cctttattatttgtatgatg

SEQ ID NO: 8169114 - DNA, 22 bp, Homo sapiens
agtaatttgttataaagcaata

SEQ ID NO: 8169115 - DNA, 22 bp, Homo sapiens
agtaatttgttataaagcaata

SEQ ID NO: 8169116 - DNA, 22 bp, Homo sapiens
agtaattggctacagtgtaatt

SEQ ID NO: 8169117 - DNA, 21 bp, Homo sapiens
agtaattgcggtgattagtga

SEQ ID NO: 8169118 - DNA, 21 bp, Homo sapiens
agtacaaaaattcctttctca

SEQ ID NO: 8169119 - DNA, 22 bp, Homo sapiens
agtaatagagattttaatgtcc

SEQ ID NO: 8169120 - DNA, 22 bp, Homo sapiens
agtaatcaatttttcggtggat

SEQ ID NO: 8169121 - DNA, 22 bp, Homo sapiens
agtacaaactgtttcaaagtag

SEQ ID NO: 8169122 - DNA, 22 bp, Homo sapiens
agtacaaactgtttcaaagtag

SEQ ID NO: 8169123 - DNA, 22 bp, Homo sapiens
agtacaaaggcccttgattact

SEQ ID NO: 8169124 - DNA, 22 bp, Homo sapiens
agtacaaactgtttcaaagtag

SEQ ID NO: 8169125 - DNA, 22 bp, Homo sapiens
agtacaaactgtttcaaagtag

SEQ ID NO: 8169126 - DNA, 22 bp, Homo sapiens
agtacaaaggcccttgattact

SEQ ID NO: 8169127 - DNA, 22 bp, Homo sapiens
agtacaaagtgctcctggttct

SEQ ID NO: 8169128 - DNA, 22 bp, Homo sapiens
agtacaaaggcccttgattact

SEQ ID NO: 8169129 - DNA, 22 bp, Homo sapiens
agtacaaagtgctcctggttct

SEQ ID NO: 8169130 - DNA, 22 bp, Homo sapiens
agtacaaagtgctcctggttct

SEQ ID NO: 8169131 - DNA, 22 bp, Homo sapiens
cgcctgctctgtttccatgtgg

SEQ ID NO: 8169132 - DNA, 22 bp, Homo sapiens
cgcctgctctcactggacagct

SEQ ID NO: 8169133 - DNA, 22 bp, Homo sapiens
cgcctgcttaacgaattgtgtt

SEQ ID NO: 8169134 - DNA, 22 bp, Homo sapiens
cgcctggaacctctaggaccag

SEQ ID NO: 8169135 - DNA, 22 bp, Homo sapiens
cgcctggaacctctaggaccag

SEQ ID NO: 8169136 - DNA, 22 bp, Homo sapiens
cgcctggagaggaggcgacgcg

SEQ ID NO: 8169137 - DNA, 22 bp, Homo sapiens
agtcaccaacatggttcccagg

SEQ ID NO: 8169138 - DNA, 22 bp, Homo sapiens
agtcactttctacttggtttct

SEQ ID NO: 8169139 - DNA, 22 bp, Homo sapiens
agtcactttatgagagaaccat

SEQ ID NO: 8169140 - DNA, 22 bp, Homo sapiens
agtcagaagggcccttccttcc

SEQ ID NO: 8169141 - DNA, 22 bp, Homo sapiens
agtcagaagccggcctaaggga

SEQ ID NO: 8169142 - DNA, 22 bp, Homo sapiens
agtcactttgctactctgcctt

SEQ ID NO: 8169143 - DNA, 22 bp, Homo sapiens
agtcagaattcgatcccaggtc

SEQ ID NO: 8169144 - DNA, 22 bp, Homo sapiens
agtcagaattcgatcccaggtc

SEQ ID NO: 8169145 - DNA, 22 bp, Homo sapiens
agtcagagaatgttttcatgga

SEQ ID NO: 8169146 - DNA, 23 bp, Homo sapiens
agtcagagagtgtgagacaactg

SEQ ID NO: 8169147 - DNA, 22 bp, Homo sapiens
ctacaagaggaatggaggtctg

SEQ ID NO: 8169148 - DNA, 22 bp, Homo sapiens
agtcagatttagatgtagcaag

SEQ ID NO: 8169149 - DNA, 22 bp, Homo sapiens
ctacaagtggagttctgacgca

SEQ ID NO: 8169150 - DNA, 22 bp, Homo sapiens
ctacaagtggagttctgacgca

SEQ ID NO: 8169151 - DNA, 22 bp, Homo sapiens
ctacaagtcattccaggtactt

SEQ ID NO: 8169152 - DNA, 22 bp, Homo sapiens
ctacaagtgcaacctgtgcgac

SEQ ID NO: 8169153 - DNA, 21 bp, Homo sapiens
ctacaagtaaagtattgggac

SEQ ID NO: 8169154 - DNA, 22 bp, Homo sapiens
ctacaagtatgggggctccaaa

SEQ ID NO: 8169155 - DNA, 22 bp, Homo sapiens
ctacaagcatctatgtttcaag

SEQ ID NO: 8169156 - DNA, 22 bp, Homo sapiens
agtcagaggaatgggccaggct

SEQ ID NO: 8169157 - DNA, 22 bp, Homo sapiens
agtcagagtgtgcaggccggct

SEQ ID NO: 8169158 - DNA, 22 bp, Homo sapiens
ctacacagttctgcctaatggc

SEQ ID NO: 8169159 - DNA, 20 bp, Homo sapiens
ctacacagggttcgctgggc

SEQ ID NO: 8169160 - DNA, 22 bp, Homo sapiens
ctacacagagcctacttctgca

SEQ ID NO: 8169161 - DNA, 22 bp, Homo sapiens
ctacacagagcctacttctgca

SEQ ID NO: 8169162 - DNA, 21 bp, Homo sapiens
ctacacagctttctataggaa

SEQ ID NO: 8169163 - DNA, 22 bp, Homo sapiens
ctacaccggagcctggaaggta

SEQ ID NO: 8169164 - DNA, 22 bp, Homo sapiens
agtcataattataaacatcagt

SEQ ID NO: 8169165 - DNA, 22 bp, Homo sapiens
agtcataattataaacatcagt

SEQ ID NO: 8169166 - DNA, 22 bp, Homo sapiens
agtcagttgtggagatttaact

SEQ ID NO: 8169167 - DNA, 18 bp, Homo sapiens
agtcagttgatggggacc

SEQ ID NO: 8169168 - DNA, 22 bp, Homo sapiens
agtcagtgttctccggagaggc

SEQ ID NO: 8169169 - DNA, 22 bp, Homo sapiens
agtcagtgtagaaagcccaggc

SEQ ID NO: 8169170 - DNA, 22 bp, Homo sapiens
ctaaacatgcaagagcttctgg

SEQ ID NO: 8169171 - DNA, 22 bp, Homo sapiens
ctaaacatggcttagaacactc

SEQ ID NO: 8169172 - DNA, 22 bp, Homo sapiens
ctaaacatcttgcaatgcacag

SEQ ID NO: 8169173 - DNA, 22 bp, Homo sapiens
ctaaacatgaactacatttagg

SEQ ID NO: 8169174 - DNA, 22 bp, Homo sapiens
ctaaacatgaactacatttagg

SEQ ID NO: 8169175 - DNA, 22 bp, Homo sapiens
ctaaacatgtagcttttgtggt

SEQ ID NO: 8169176 - DNA, 22 bp, Homo sapiens
ctaaacatgtagcttttgtggt

SEQ ID NO: 8169177 - DNA, 22 bp, Homo sapiens
ctaaacatgttggtgctttaaa

SEQ ID NO: 8169178 - DNA, 22 bp, Homo sapiens
ctaaacatgttggtgctttaaa

SEQ ID NO: 8169179 - DNA, 22 bp, Homo sapiens
agtcacatttgggggtgtcaaa

SEQ ID NO: 8169180 - DNA, 22 bp, Homo sapiens
ctaaacaagggattataattga

SEQ ID NO: 8169181 - DNA, 22 bp, Homo sapiens
ctaaacagtgcatatgggtgtt

SEQ ID NO: 8169182 - DNA, 22 bp, Homo sapiens
ctaaacatcttgcaatgcacag

SEQ ID NO: 8169183 - DNA, 19 bp, Homo sapiens
cgtggagctggcaggcagg

SEQ ID NO: 8169184 - DNA, 23 bp, Homo sapiens
cgtgcttccaggcccagctgagc

SEQ ID NO: 8169185 - DNA, 23 bp, Homo sapiens
cgtgcttccaggcccagctgagc

SEQ ID NO: 8169186 - DNA, 20 bp, Homo sapiens
cgtgctgtgaccttgagcat

SEQ ID NO: 8169187 - DNA, 22 bp, Homo sapiens
cgtggccagcacaaggcagtga

SEQ ID NO: 8169188 - DNA, 22 bp, Homo sapiens
cgtggccacccagtggtgcgtg

SEQ ID NO: 8169189 - DNA, 22 bp, Homo sapiens
cgtggccacccagtggtgcgtg

SEQ ID NO: 8169190 - DNA, 22 bp, Homo sapiens
cgtggcagtggaaggctgggtg

SEQ ID NO: 8169191 - DNA, 22 bp, Homo sapiens
cgtggccagtttcaagctacca

SEQ ID NO: 8169192 - DNA, 22 bp, Homo sapiens
cgtggccagccatttcctggaa

SEQ ID NO: 8169193 - DNA, 22 bp, Homo sapiens
cgtggccagcacaaggcagtga

SEQ ID NO: 8169194 - DNA, 22 bp, Homo sapiens
cgtggccagccatttcctggaa

SEQ ID NO: 8169195 - DNA, 22 bp, Homo sapiens
cgtggccagtttcaagctacca

SEQ ID NO: 8169196 - DNA, 22 bp, Homo sapiens
ctaaaattatcaagataattcc

SEQ ID NO: 8169197 - DNA, 22 bp, Homo sapiens
ctaaaattatcaagataattcc

SEQ ID NO: 8169198 - DNA, 22 bp, Homo sapiens
ctaaaattatcaagataattcc

SEQ ID NO: 8169199 - DNA, 22 bp, Homo sapiens
cggtcagctgcgcccggcctga

SEQ ID NO: 8169200 - DNA, 22 bp, Homo sapiens
cggtcaggtgcagcgttggcac

SEQ ID NO: 8169201 - DNA, 22 bp, Homo sapiens
cgtgaggggggtaaggcgtccg

SEQ ID NO: 8169202 - DNA, 17 bp, Homo sapiens
cgtgagcagcaggtgcc

SEQ ID NO: 8169203 - DNA, 22 bp, Homo sapiens
cgtgagggcatggcagtgagga

SEQ ID NO: 8169204 - DNA, 22 bp, Homo sapiens
cgtgccactgcactctagcctg

SEQ ID NO: 8169205 - DNA, 22 bp, Homo sapiens
cgtgccactgcactccagtctg

SEQ ID NO: 8169206 - DNA, 22 bp, Homo sapiens
cgtgatttctggctttctatat

SEQ ID NO: 8169207 - DNA, 22 bp, Homo sapiens
cgtgatttatggtctggtggcg

SEQ ID NO: 8169208 - DNA, 22 bp, Homo sapiens
cgtgattttgttgactggggcc

SEQ ID NO: 8169209 - DNA, 22 bp, Homo sapiens
cgtgatttgcaaattgaggcag

SEQ ID NO: 8169210 - DNA, 22 bp, Homo sapiens
cgtgccctgcgcaagtgctgct

SEQ ID NO: 8169211 - DNA, 22 bp, Homo sapiens
cgtgccactgcactctagcctg

SEQ ID NO: 8169212 - DNA, 22 bp, Homo sapiens
cgtgccactgcactctagcctg

SEQ ID NO: 8169213 - DNA, 22 bp, Homo sapiens
cgtgccactgcactctagcctg

SEQ ID NO: 8169214 - DNA, 22 bp, Homo sapiens
cgcggtggcggcctccagcgcc

SEQ ID NO: 8169215 - DNA, 22 bp, Homo sapiens
cgcggtggcggcctccagcgcc

SEQ ID NO: 8169216 - DNA, 22 bp, Homo sapiens
cgcgctgcagacagcggaggcc

SEQ ID NO: 8169217 - DNA, 22 bp, Homo sapiens
cgcgaggtggaggttgcagtga

SEQ ID NO: 8169218 - DNA, 22 bp, Homo sapiens
cgcctgggagtccacacctgct

SEQ ID NO: 8169219 - DNA, 22 bp, Homo sapiens
cgcctgggagtccacacctgct

SEQ ID NO: 8169220 - DNA, 22 bp, Homo sapiens
cgcctgggagtccacacctgct

SEQ ID NO: 8169221 - DNA, 22 bp, Homo sapiens
cgcctggatgttcacgggcagc

SEQ ID NO: 8169222 - DNA, 22 bp, Homo sapiens
agtgatttgactcttttattgt

SEQ ID NO: 8169223 - DNA, 22 bp, Homo sapiens
agtgactggttttgacaggaat

SEQ ID NO: 8169224 - DNA, 22 bp, Homo sapiens
agtgactggtgtgaagttaaat

SEQ ID NO: 8169225 - DNA, 22 bp, Homo sapiens
agtgactggtgtgaagttaaat

SEQ ID NO: 8169226 - DNA, 22 bp, Homo sapiens
agtgactgggcagggcagggcc

SEQ ID NO: 8169227 - DNA, 22 bp, Homo sapiens
agtgactgggcagggcagggcc

SEQ ID NO: 8169228 - DNA, 22 bp, Homo sapiens
agtgacgtttattgggtgtgaa

SEQ ID NO: 8169229 - DNA, 22 bp, Homo sapiens
agtgacccctgtctcctcgctg

SEQ ID NO: 8169230 - DNA, 22 bp, Homo sapiens
agtgaccatgttatttatttga

SEQ ID NO: 8169231 - DNA, 21 bp, Homo sapiens
agtgacccatagggtagagta

SEQ ID NO: 8169232 - DNA, 22 bp, Homo sapiens
agtgaccatatatcatttttgt

SEQ ID NO: 8169233 - DNA, 22 bp, Homo sapiens
agtgaccaagcctgaccaatca

SEQ ID NO: 8169234 - DNA, 22 bp, Homo sapiens
agtgatttgaggattattgctc

SEQ ID NO: 8169235 - DNA, 22 bp, Homo sapiens
agtgcacaccttagtacaaagt

SEQ ID NO: 8169236 - DNA, 22 bp, Homo sapiens
agtgatttgcagtatttactaa

SEQ ID NO: 8169237 - DNA, 22 bp, Homo sapiens
agtgcactggcaccatctcagc

SEQ ID NO: 8169238 - DNA, 22 bp, Homo sapiens
agtgcagactgaaatgaccttc

SEQ ID NO: 8169239 - DNA, 22 bp, Homo sapiens
agtgcagagtacatttgtggca

SEQ ID NO: 8169240 - DNA, 22 bp, Homo sapiens
agtgcagagacctggtcaggca

SEQ ID NO: 8169241 - DNA, 22 bp, Homo sapiens
agtgcagagacctggtcaggca

SEQ ID NO: 8169242 - DNA, 22 bp, Homo sapiens
agtgcagagacctggtcaggca

SEQ ID NO: 8169243 - DNA, 22 bp, Homo sapiens
agtgcagagagcaatactctac

SEQ ID NO: 8169244 - DNA, 22 bp, Homo sapiens
ctccatggaaaaggctgttgtt

SEQ ID NO: 8169245 - DNA, 22 bp, Homo sapiens
ctccatggaaaaggctgttgtt

SEQ ID NO: 8169246 - DNA, 22 bp, Homo sapiens
ctccatggaaaaggctgttgtt

SEQ ID NO: 8169247 - DNA, 22 bp, Homo sapiens
ctccatcatgtttgatcctgag

SEQ ID NO: 8169248 - DNA, 22 bp, Homo sapiens
ctccatcagctgttggttgagg

SEQ ID NO: 8169249 - DNA, 22 bp, Homo sapiens
ctccagttggccccagttggtt

SEQ ID NO: 8169250 - DNA, 22 bp, Homo sapiens
ctccagttggccccagttggtt

SEQ ID NO: 8169251 - DNA, 22 bp, Homo sapiens
agtgacatgctctcaggcataa

SEQ ID NO: 8169252 - DNA, 22 bp, Homo sapiens
agtgacatcatgtcagcaaagt

SEQ ID NO: 8169253 - DNA, 22 bp, Homo sapiens
agtgacatttgcaccagctgct

SEQ ID NO: 8169254 - DNA, 22 bp, Homo sapiens
agtgacatttaaaaccacagct

SEQ ID NO: 8169255 - DNA, 22 bp, Homo sapiens
ctccagggagctgcgggagcca

SEQ ID NO: 8169256 - DNA, 22 bp, Homo sapiens
ctccagggagctgcgggagcca

SEQ ID NO: 8169257 - DNA, 22 bp, Homo sapiens
ctccagtgggggtgagcctaga

SEQ ID NO: 8169258 - DNA, 22 bp, Homo sapiens
ctccagtgggggtgagcctaga

SEQ ID NO: 8169259 - DNA, 22 bp, Homo sapiens
ctccagtggtgatggggaagaa

SEQ ID NO: 8169260 - DNA, 22 bp, Homo sapiens
ctccagttggccccagttggtt

SEQ ID NO: 8169261 - DNA, 22 bp, Homo sapiens
ctccagttggccccagttggtt

SEQ ID NO: 8169262 - DNA, 20 bp, Homo sapiens
ctccagtgttcaggggagtg

SEQ ID NO: 8169263 - DNA, 20 bp, Homo sapiens
ctccagtgttcaggggagtg

SEQ ID NO: 8169264 - DNA, 22 bp, Homo sapiens
ctccagtgtctcagagcagatg

SEQ ID NO: 8169265 - DNA, 22 bp, Homo sapiens
ctccagtgtctcagagcagatg

SEQ ID NO: 8169266 - DNA, 22 bp, Homo sapiens
ctcctccttcctgtgttgtgca

SEQ ID NO: 8169267 - DNA, 22 bp, Homo sapiens
ctcctcctggacacaggctgtg

SEQ ID NO: 8169268 - DNA, 22 bp, Homo sapiens
agtgcagctaagtggctctgtg

SEQ ID NO: 8169269 - DNA, 22 bp, Homo sapiens
agtgcagctgggactgtagggt

SEQ ID NO: 8169270 - DNA, 22 bp, Homo sapiens
agtgcaggagcctggccagagc

SEQ ID NO: 8169271 - DNA, 22 bp, Homo sapiens
agtgcaggagcctggccagagc

SEQ ID NO: 8169272 - DNA, 22 bp, Homo sapiens
agtgcaggagcctggccagagc

SEQ ID NO: 8169273 - DNA, 22 bp, Homo sapiens
agtgcaggagcctggccagagc

SEQ ID NO: 8169274 - DNA, 22 bp, Homo sapiens
ctcctccctgggaggctggcat

SEQ ID NO: 8169275 - DNA, 22 bp, Homo sapiens
ctcctcctaaatgattcttcct

SEQ ID NO: 8169276 - DNA, 22 bp, Homo sapiens
ctcctcctaaatgattcttcct

SEQ ID NO: 8169277 - DNA, 22 bp, Homo sapiens
ctcctcctggacacaggctgtg

SEQ ID NO: 8169278 - DNA, 22 bp, Homo sapiens
ctcctcctggacacaggctgtg

SEQ ID NO: 8169279 - DNA, 22 bp, Homo sapiens
ctcctccctgcgattgctctgc

SEQ ID NO: 8169280 - DNA, 22 bp, Homo sapiens
ctcctccctgcgattgctctgc

SEQ ID NO: 8169281 - DNA, 22 bp, Homo sapiens
ctcctccctctttgccacacat

SEQ ID NO: 8169282 - DNA, 22 bp, Homo sapiens
ctcctccctctttgccacacat

SEQ ID NO: 8169283 - DNA, 18 bp, Homo sapiens
ctcctccctaagggctca

SEQ ID NO: 8169284 - DNA, 22 bp, Homo sapiens
ctcctccctctttgccacacat

SEQ ID NO: 8169285 - DNA, 22 bp, Homo sapiens
ctcctccccttgagtctgggat

SEQ ID NO: 8169286 - DNA, 22 bp, Homo sapiens
ctcctcccacggtctcaggaag

SEQ ID NO: 8169287 - DNA, 22 bp, Homo sapiens
ctcctcccacggtctcaggaag

SEQ ID NO: 8169288 - DNA, 22 bp, Homo sapiens
ctcctcccacggtctcaggaag

SEQ ID NO: 8169289 - DNA, 22 bp, Homo sapiens
ctcccaggttccgacgcctctt

SEQ ID NO: 8169290 - DNA, 22 bp, Homo sapiens
ctcccaggttccgacgcctctt

SEQ ID NO: 8169291 - DNA, 22 bp, Homo sapiens
ctcccaggttccgacgcctctt

SEQ ID NO: 8169292 - DNA, 22 bp, Homo sapiens
ctcctcagctgggaggagtccc

SEQ ID NO: 8169293 - DNA, 22 bp, Homo sapiens
ctcctcccacggtctcaggaag

SEQ ID NO: 8169294 - DNA, 22 bp, Homo sapiens
ctcccaggttacatctgagcct

SEQ ID NO: 8169295 - DNA, 22 bp, Homo sapiens
ctcccaggttacatctgagcct

SEQ ID NO: 8169296 - DNA, 22 bp, Homo sapiens
ctcccaggtgtcccttctgcca

SEQ ID NO: 8169297 - DNA, 21 bp, Homo sapiens
ctcccagggtgactgttcaac

SEQ ID NO: 8169298 - DNA, 21 bp, Homo sapiens
ctcccagggtgactgttcaac

SEQ ID NO: 8169299 - DNA, 22 bp, Homo sapiens
agtgcagccgagatcaggtgct

SEQ ID NO: 8169300 - DNA, 22 bp, Homo sapiens
agtgcagccttctgggccgctt

SEQ ID NO: 8169301 - DNA, 22 bp, Homo sapiens
agtgcagcaccatgttacagag

SEQ ID NO: 8169302 - DNA, 22 bp, Homo sapiens
ctcccaggggagtcatctgctt

SEQ ID NO: 8169303 - DNA, 22 bp, Homo sapiens
ctcccagggtagggagagacta

SEQ ID NO: 8169304 - DNA, 22 bp, Homo sapiens
ctcccagggtagggagagacta

SEQ ID NO: 8169305 - DNA, 22 bp, Homo sapiens
ctcccagggtctaggctgctgg

SEQ ID NO: 8169306 - DNA, 22 bp, Homo sapiens
ctcccagggtctaggctgctgg

SEQ ID NO: 8169307 - DNA, 21 bp, Homo sapiens
agtctgttaggatgactctga

SEQ ID NO: 8169308 - DNA, 22 bp, Homo sapiens
ctcaggagttggaggctacagt

SEQ ID NO: 8169309 - DNA, 23 bp, Homo sapiens
agtcttactgtcccagaacaggg

SEQ ID NO: 8169310 - DNA, 22 bp, Homo sapiens
agtcttaatagagaaaaactgt

SEQ ID NO: 8169311 - DNA, 22 bp, Homo sapiens
agtcttacatgagaaagaacct

SEQ ID NO: 8169312 - DNA, 23 bp, Homo sapiens
agtcttaatacagctcttttcta

SEQ ID NO: 8169313 - DNA, 18 bp, Homo sapiens
ctcaggcagagaagcttt

SEQ ID NO: 8169314 - DNA, 22 bp, Homo sapiens
ctcaggcacgggtcagtgagcg

SEQ ID NO: 8169315 - DNA, 22 bp, Homo sapiens
ctcaggcagttctgtagcctcc

SEQ ID NO: 8169316 - DNA, 22 bp, Homo sapiens
ctcaggcagttctgtagcctcc

SEQ ID NO: 8169317 - DNA, 18 bp, Homo sapiens
ctcaggcagagaagcttt

SEQ ID NO: 8169318 - DNA, 22 bp, Homo sapiens
ctcaggcagtgccctctggccg

SEQ ID NO: 8169319 - DNA, 22 bp, Homo sapiens
ctcaggcagtgccctctggccg

SEQ ID NO: 8169320 - DNA, 22 bp, Homo sapiens
ctcaggcaaggcccgcattctc

SEQ ID NO: 8169321 - DNA, 22 bp, Homo sapiens
ctcaggcacgggtcagtgagcg

SEQ ID NO: 8169322 - DNA, 22 bp, Homo sapiens
ctcaggcacgggtcagtgagcg

SEQ ID NO: 8169323 - DNA, 20 bp, Homo sapiens
agtctgcctgctccttctcc

SEQ ID NO: 8169324 - DNA, 21 bp, Homo sapiens
agtctggaaaacacattcatg

SEQ ID NO: 8169325 - DNA, 22 bp, Homo sapiens
agtctggaaaatgcatgtttca

SEQ ID NO: 8169326 - DNA, 22 bp, Homo sapiens
agtctggaataaaactacttac

SEQ ID NO: 8169327 - DNA, 23 bp, Homo sapiens
agtctggaagtgcagtggctgga

SEQ ID NO: 8169328 - DNA, 22 bp, Homo sapiens
agtctggacatgctgaacttgg

SEQ ID NO: 8169329 - DNA, 22 bp, Homo sapiens
agtctggacctgctgggtctcc

SEQ ID NO: 8169330 - DNA, 22 bp, Homo sapiens
agtctggaatttggcctgagca

SEQ ID NO: 8169331 - DNA, 22 bp, Homo sapiens
agtctggagctcagacttggga

SEQ ID NO: 8169332 - DNA, 22 bp, Homo sapiens
agtctggagcagcagtattggt

SEQ ID NO: 8169333 - DNA, 22 bp, Homo sapiens
agtctggacctgctgggtctcc

SEQ ID NO: 8169334 - DNA, 22 bp, Homo sapiens
agtctggaggtggcaggtgtgt

SEQ ID NO: 8169335 - DNA, 22 bp, Homo sapiens
agtctggaggtggcaggtgtgt

SEQ ID NO: 8169336 - DNA, 22 bp, Homo sapiens
agtctggagtagagcctagaaa

SEQ ID NO: 8169337 - DNA, 19 bp, Homo sapiens
agtctggagtaaaaggaat

SEQ ID NO: 8169338 - DNA, 22 bp, Homo sapiens
agtctggagtgcggcggcagga

SEQ ID NO: 8169339 - DNA, 22 bp, Homo sapiens
agtctggagtgattatgtggga

SEQ ID NO: 8169340 - DNA, 22 bp, Homo sapiens
agtctggattagttgggggcaa

SEQ ID NO: 8169341 - DNA, 22 bp, Homo sapiens
agtctggatttagaggtgggcc

SEQ ID NO: 8169342 - DNA, 22 bp, Homo sapiens
agtctggatttagaggtgggcc

SEQ ID NO: 8169343 - DNA, 22 bp, Homo sapiens
agtctgtctacttaaagtctgt

SEQ ID NO: 8169344 - DNA, 22 bp, Homo sapiens
agtctggatttagaggtgggcc

SEQ ID NO: 8169345 - DNA, 22 bp, Homo sapiens
agtctggagtgttttgtagcaa

SEQ ID NO: 8169346 - DNA, 22 bp, Homo sapiens
agtctggagtttgctactggac

SEQ ID NO: 8169347 - DNA, 22 bp, Homo sapiens
agtctggattagttgggggcaa

SEQ ID NO: 8169348 - DNA, 22 bp, Homo sapiens
agtctgtctgtcacttctgcag

SEQ ID NO: 8169349 - DNA, 22 bp, Homo sapiens
agtctgtggatggactggcaga

SEQ ID NO: 8169350 - DNA, 22 bp, Homo sapiens
agtcattttgccagtcttcagg

SEQ ID NO: 8169351 - DNA, 22 bp, Homo sapiens
agtccaaagcagatgagggcca

SEQ ID NO: 8169352 - DNA, 22 bp, Homo sapiens
agtccaagatcaaggtgtcagg

SEQ ID NO: 8169353 - DNA, 22 bp, Homo sapiens
agtccaagaccaaggtgtcacc

SEQ ID NO: 8169354 - DNA, 22 bp, Homo sapiens
agtccaagatcaaggtgtcaac

SEQ ID NO: 8169355 - DNA, 22 bp, Homo sapiens
agtcatttatcttagccattat

SEQ ID NO: 8169356 - DNA, 22 bp, Homo sapiens
agtcatttcccattcttcatat

SEQ ID NO: 8169357 - DNA, 22 bp, Homo sapiens
agtcattttgccagtcttcagg

SEQ ID NO: 8169358 - DNA, 22 bp, Homo sapiens
agtcattttctgcctgtaatct

SEQ ID NO: 8169359 - DNA, 22 bp, Homo sapiens
agtcattattatttgtcaaagg

SEQ ID NO: 8169360 - DNA, 22 bp, Homo sapiens
agtcattaagacaactggagta

SEQ ID NO: 8169361 - DNA, 22 bp, Homo sapiens
agtcatctggttttgcatggca

SEQ ID NO: 8169362 - DNA, 22 bp, Homo sapiens
agtcatgctacttcatcttctg

SEQ ID NO: 8169363 - DNA, 22 bp, Homo sapiens
agtcatcatctgccctcactgg

SEQ ID NO: 8169364 - DNA, 22 bp, Homo sapiens
agtcatcatggaaaatgttgtt

SEQ ID NO: 8169365 - DNA, 22 bp, Homo sapiens
agtcatatctgaggaggaatcc

SEQ ID NO: 8169366 - DNA, 22 bp, Homo sapiens
agtctgcaggctgtgatttttt

SEQ ID NO: 8169367 - DNA, 22 bp, Homo sapiens
agtctgcactcaggtggaggtc

SEQ ID NO: 8169368 - DNA, 22 bp, Homo sapiens
agtctgagttagtggaaatgta

SEQ ID NO: 8169369 - DNA, 22 bp, Homo sapiens
agtctgagtatctctgagccag

SEQ ID NO: 8169370 - DNA, 21 bp, Homo sapiens
agtctgaggtggggcctagga

SEQ ID NO: 8169371 - DNA, 22 bp, Homo sapiens
agtctgaaggcaatctgctgac

SEQ ID NO: 8169372 - DNA, 22 bp, Homo sapiens
agtctgaagatattcttgcagg

SEQ ID NO: 8169373 - DNA, 22 bp, Homo sapiens
agtctgaagactcatgtctgaa

SEQ ID NO: 8169374 - DNA, 22 bp, Homo sapiens
agtctcttttgcgaagagtgtt

SEQ ID NO: 8169375 - DNA, 22 bp, Homo sapiens
agtctctttgtggactctgcct

SEQ ID NO: 8169376 - DNA, 22 bp, Homo sapiens
agtctcttttggttccaaaaat

SEQ ID NO: 8169377 - DNA, 22 bp, Homo sapiens
agtctctttaatcacagtgtct

SEQ ID NO: 8169378 - DNA, 22 bp, Homo sapiens
agtctctttctaaataaggtca

SEQ ID NO: 8169379 - DNA, 22 bp, Homo sapiens
agtctgaaagtatgttgtaatg

SEQ ID NO: 8169380 - DNA, 22 bp, Homo sapiens
agtctgaagactcatgtctgaa

SEQ ID NO: 8169381 - DNA, 22 bp, Homo sapiens
agtctgaagactcatgtctgaa

SEQ ID NO: 8169382 - DNA, 21 bp, Homo sapiens
agtctctctaataaatgcttg

SEQ ID NO: 8169383 - DNA, 20 bp, Homo sapiens
agtctctcccagaatgagca

SEQ ID NO: 8169384 - DNA, 22 bp, Homo sapiens
agtccaaggagagacagcattt

SEQ ID NO: 8169385 - DNA, 22 bp, Homo sapiens
agtccaagattagggtgacagc

SEQ ID NO: 8169386 - DNA, 22 bp, Homo sapiens
agtccaaggccatacagttgtg

SEQ ID NO: 8169387 - DNA, 22 bp, Homo sapiens
agtccaaggccatacagttgtg

SEQ ID NO: 8169388 - DNA, 22 bp, Homo sapiens
agtctctcacagaggattctcc

SEQ ID NO: 8169389 - DNA, 22 bp, Homo sapiens
agtctctccacattgttataaa

SEQ ID NO: 8169390 - DNA, 22 bp, Homo sapiens
agtgtgtgtttgggcggtttat

SEQ ID NO: 8169391 - DNA, 22 bp, Homo sapiens
agtgtgtgtttgggcggtttat

SEQ ID NO: 8169392 - DNA, 22 bp, Homo sapiens
ctgaagcaattgagagatgttt

SEQ ID NO: 8169393 - DNA, 23 bp, Homo sapiens
ctgaagcaatatcccctcacttc

SEQ ID NO: 8169394 - DNA, 23 bp, Homo sapiens
ctgaagcaatatcccctcacttc

SEQ ID NO: 8169395 - DNA, 19 bp, Homo sapiens
agtgttaacccagtgttgg

SEQ ID NO: 8169396 - DNA, 19 bp, Homo sapiens
agtgttaacccagtgttgg

SEQ ID NO: 8169397 - DNA, 22 bp, Homo sapiens
agtgtgtgcatgcattcgtgca

SEQ ID NO: 8169398 - DNA, 22 bp, Homo sapiens
agtgtgtgcatgcattcgtgca

SEQ ID NO: 8169399 - DNA, 22 bp, Homo sapiens
agtgtgggggctttggtgtcac

SEQ ID NO: 8169400 - DNA, 22 bp, Homo sapiens
agtgtgggggctttggtgtcac

SEQ ID NO: 8169401 - DNA, 18 bp, Homo sapiens
agtgtgtgccctttcagg

SEQ ID NO: 8169402 - DNA, 18 bp, Homo sapiens
agtgtgtgccctttcagg

SEQ ID NO: 8169403 - DNA, 22 bp, Homo sapiens
agtgtgtgcctttggatacctg

SEQ ID NO: 8169404 - DNA, 21 bp, Homo sapiens
agtgtgtgtggaatgagaata

SEQ ID NO: 8169405 - DNA, 22 bp, Homo sapiens
agtgtgtgctgttccccggagg

SEQ ID NO: 8169406 - DNA, 22 bp, Homo sapiens
ctgagaaaggacctcaaacagg

SEQ ID NO: 8169407 - DNA, 22 bp, Homo sapiens
ctgaagctgggcacttcctttt

SEQ ID NO: 8169408 - DNA, 22 bp, Homo sapiens
ctgaagctctccagtttgtttc

SEQ ID NO: 8169409 - DNA, 22 bp, Homo sapiens
ctgaagctgaaaacttccagca

SEQ ID NO: 8169410 - DNA, 22 bp, Homo sapiens
ctgaagcaggcctacttcattg

SEQ ID NO: 8169411 - DNA, 22 bp, Homo sapiens
ctgaagccagtttgctgccctt

SEQ ID NO: 8169412 - DNA, 22 bp, Homo sapiens
ctgagaggcggagcttgcagtg

SEQ ID NO: 8169413 - DNA, 22 bp, Homo sapiens
ctgagaggcagccagagaaaat

SEQ ID NO: 8169414 - DNA, 22 bp, Homo sapiens
ctgagaggcggaggttgcagtg

SEQ ID NO: 8169415 - DNA, 22 bp, Homo sapiens
ctgagaggcggagcttgcagtg

SEQ ID NO: 8169416 - DNA, 22 bp, Homo sapiens
ctgagagatggtgtgtttataa

SEQ ID NO: 8169417 - DNA, 22 bp, Homo sapiens
ctgagagcctcctgttggctag

SEQ ID NO: 8169418 - DNA, 22 bp, Homo sapiens
ctgagagcatcgctggagatag

SEQ ID NO: 8169419 - DNA, 22 bp, Homo sapiens
ctgagagatggtgtgtttataa

SEQ ID NO: 8169420 - DNA, 22 bp, Homo sapiens
ctctgtttggcgctgctccttc

SEQ ID NO: 8169421 - DNA, 22 bp, Homo sapiens
ctctgtttggcgctgctccttc

SEQ ID NO: 8169422 - DNA, 22 bp, Homo sapiens
agtgtctgcctatttttcaagc

SEQ ID NO: 8169423 - DNA, 22 bp, Homo sapiens
ctctgtttttcaatagttcttg

SEQ ID NO: 8169424 - DNA, 22 bp, Homo sapiens
agtgtctgccagctgccaggtg

SEQ ID NO: 8169425 - DNA, 22 bp, Homo sapiens
agtgtctgccaactgcatggtc

SEQ ID NO: 8169426 - DNA, 22 bp, Homo sapiens
agtgtctgccaactgcatggtc

SEQ ID NO: 8169427 - DNA, 22 bp, Homo sapiens
agtgtctgccagctgccaggtg

SEQ ID NO: 8169428 - DNA, 22 bp, Homo sapiens
agtgtctgcaaaatgaaagagc

SEQ ID NO: 8169429 - DNA, 22 bp, Homo sapiens
agtgtctgcagtgatgtctctt

SEQ ID NO: 8169430 - DNA, 22 bp, Homo sapiens
agtgtctgcaaaatgaaagagc

SEQ ID NO: 8169431 - DNA, 20 bp, Homo sapiens
ctcttaaatgtaaagtaggc

SEQ ID NO: 8169432 - DNA, 19 bp, Homo sapiens
ctcttaaattgtctcttgc

SEQ ID NO: 8169433 - DNA, 19 bp, Homo sapiens
ctcttacagaatagacaca

SEQ ID NO: 8169434 - DNA, 22 bp, Homo sapiens
ctcttaatgttttatagattga

SEQ ID NO: 8169435 - DNA, 22 bp, Homo sapiens
ctcttaatgttttatagattga

SEQ ID NO: 8169436 - DNA, 22 bp, Homo sapiens
ctcttagagagttgttgatcag

SEQ ID NO: 8169437 - DNA, 22 bp, Homo sapiens
ctcttagaaagaaacacactgg

SEQ ID NO: 8169438 - DNA, 22 bp, Homo sapiens
ctcttagatatggagaattacc

SEQ ID NO: 8169439 - DNA, 22 bp, Homo sapiens
ctcttagaaactatagagatta

SEQ ID NO: 8169440 - DNA, 22 bp, Homo sapiens
agtggggacttatgccagcatt

SEQ ID NO: 8169441 - DNA, 20 bp, Homo sapiens
agtggggagtcaggagtgcc

SEQ ID NO: 8169442 - DNA, 20 bp, Homo sapiens
agtggggagtcaggagtgcc

SEQ ID NO: 8169443 - DNA, 22 bp, Homo sapiens
agtggggacttatgccagcatt

SEQ ID NO: 8169444 - DNA, 22 bp, Homo sapiens
agtggggacaatgagagcaggt

SEQ ID NO: 8169445 - DNA, 23 bp, Homo sapiens
agtggggaatcaacagattcttt

SEQ ID NO: 8169446 - DNA, 22 bp, Homo sapiens
agtgtctgatcagttgactaga

SEQ ID NO: 8169447 - DNA, 22 bp, Homo sapiens
agtgtctgatcagttgactaga

SEQ ID NO: 8169448 - DNA, 22 bp, Homo sapiens
agtgtctgatgcacagttgtcc

SEQ ID NO: 8169449 - DNA, 22 bp, Homo sapiens
agtgtctgatcagttgactaga

SEQ ID NO: 8169450 - DNA, 21 bp, Homo sapiens
agtgtctgagcgctgcttctg

SEQ ID NO: 8169451 - DNA, 21 bp, Homo sapiens
agtgtctgagcgctgcttctg

SEQ ID NO: 8169452 - DNA, 23 bp, Homo sapiens
agtgtctgagtgcaggctgtgca

SEQ ID NO: 8169453 - DNA, 22 bp, Homo sapiens
agtgtctgagtaaatttctcat

SEQ ID NO: 8169454 - DNA, 22 bp, Homo sapiens
agtgtctgaactgggtgctgac

SEQ ID NO: 8169455 - DNA, 22 bp, Homo sapiens
agtgtcctggcaagggtttcag

SEQ ID NO: 8169456 - DNA, 22 bp, Homo sapiens
agtgtcctctattatgacttta

SEQ ID NO: 8169457 - DNA, 22 bp, Homo sapiens
agtgtcctctattatgacttta

SEQ ID NO: 8169458 - DNA, 22 bp, Homo sapiens
agtgtcctctattatgacttta

SEQ ID NO: 8169459 - DNA, 22 bp, Homo sapiens
agtgtctgaaggatttggcttc

SEQ ID NO: 8169460 - DNA, 22 bp, Homo sapiens
ctctgagaggtgagaagcagca

SEQ ID NO: 8169461 - DNA, 22 bp, Homo sapiens
ctctgagagtgctcagagggta

SEQ ID NO: 8169462 - DNA, 22 bp, Homo sapiens
ctctgagagtgctcagagggta

SEQ ID NO: 8169463 - DNA, 22 bp, Homo sapiens
ctctgagagcggtctgtggctt

SEQ ID NO: 8169464 - DNA, 22 bp, Homo sapiens
ctctgagagcggtctgtggctt

SEQ ID NO: 8169465 - DNA, 22 bp, Homo sapiens
ctctgagagcggtctgtggctt

SEQ ID NO: 8169466 - DNA, 22 bp, Homo sapiens
ctctgagagcggtctgtggctt

SEQ ID NO: 8169467 - DNA, 22 bp, Homo sapiens
ctctgagacttttcacctccca

SEQ ID NO: 8169468 - DNA, 22 bp, Homo sapiens
ctctgagagagctggtgagcac

SEQ ID NO: 8169469 - DNA, 22 bp, Homo sapiens
ctctgagaagccttgatgggga

SEQ ID NO: 8169470 - DNA, 22 bp, Homo sapiens
ctctgagaagccttgatgggga

SEQ ID NO: 8169471 - DNA, 22 bp, Homo sapiens
ctctgagaaagctgtgagctaa

SEQ ID NO: 8169472 - DNA, 22 bp, Homo sapiens
ctctgagaactcaggattctga

SEQ ID NO: 8169473 - DNA, 22 bp, Homo sapiens
ctctgagactcaagtgagtggg

SEQ ID NO: 8169474 - DNA, 22 bp, Homo sapiens
ctctgacttatcggagaagtcc

SEQ ID NO: 8169475 - DNA, 22 bp, Homo sapiens
ctctgactgacctggaatgaat

SEQ ID NO: 8169476 - DNA, 22 bp, Homo sapiens
agtggctggtctaaggtcacag

SEQ ID NO: 8169477 - DNA, 22 bp, Homo sapiens
agtggctggtctaaggtcacag

SEQ ID NO: 8169478 - DNA, 22 bp, Homo sapiens
agtggctggtctaaggtcacag

SEQ ID NO: 8169479 - DNA, 22 bp, Homo sapiens
agtggctggtagttactgagca

SEQ ID NO: 8169480 - DNA, 22 bp, Homo sapiens
agtggctggtagttactgagca

SEQ ID NO: 8169481 - DNA, 19 bp, Homo sapiens
agtggctgggcagaagcaa

SEQ ID NO: 8169482 - DNA, 22 bp, Homo sapiens
agtggctgtactattttttcat

SEQ ID NO: 8169483 - DNA, 21 bp, Homo sapiens
agtggctgtcaagggggcctt

SEQ ID NO: 8169484 - DNA, 22 bp, Homo sapiens
agtggctgtatcagtcaaccct

SEQ ID NO: 8169485 - DNA, 22 bp, Homo sapiens
agtgggcatgatctggtgtctg

SEQ ID NO: 8169486 - DNA, 22 bp, Homo sapiens
agtgggccttagaaggttccct

SEQ ID NO: 8169487 - DNA, 22 bp, Homo sapiens
agtgggcttttttccgttccat

SEQ ID NO: 8169488 - DNA, 22 bp, Homo sapiens
agtgggcttactgagggagtgt

SEQ ID NO: 8169489 - DNA, 22 bp, Homo sapiens
agtgggctgagcttgctgggtg

SEQ ID NO: 8169490 - DNA, 22 bp, Homo sapiens
agtgggctggtggcagggagaa

SEQ ID NO: 8169491 - DNA, 22 bp, Homo sapiens
agtgggctggtggcagggagaa

SEQ ID NO: 8169492 - DNA, 22 bp, Homo sapiens
agtgggcaggcagggtgcgcag

SEQ ID NO: 8169493 - DNA, 22 bp, Homo sapiens
agtgggcagtgcgctcggatgc

SEQ ID NO: 8169494 - DNA, 22 bp, Homo sapiens
agtgggcagcccaggaggtctt

SEQ ID NO: 8169495 - DNA, 22 bp, Homo sapiens
agtgggcaggcagggtgcgcag

SEQ ID NO: 8169496 - DNA, 22 bp, Homo sapiens
agtgggcagcccaggaggtctt

SEQ ID NO: 8169497 - DNA, 20 bp, Homo sapiens
agtgggagagggcagactgc

SEQ ID NO: 8169498 - DNA, 22 bp, Homo sapiens
agtgggagggccatatggtgaa

SEQ ID NO: 8169499 - DNA, 21 bp, Homo sapiens
agtgggatactggaaggtaga

SEQ ID NO: 8169500 - DNA, 22 bp, Homo sapiens
ctctgagcagaggccgtggcta

SEQ ID NO: 8169501 - DNA, 22 bp, Homo sapiens
agtgcaggccccaggccaggcc

SEQ ID NO: 8169502 - DNA, 22 bp, Homo sapiens
agtgcaggccccaggccaggcc

SEQ ID NO: 8169503 - DNA, 22 bp, Homo sapiens
agtgcaggccccaggccaggcc

SEQ ID NO: 8169504 - DNA, 22 bp, Homo sapiens
agtgcaggccccaggccaggcc

SEQ ID NO: 8169505 - DNA, 22 bp, Homo sapiens
agtgcaggagcctggccagagc

SEQ ID NO: 8169506 - DNA, 22 bp, Homo sapiens
agtgcaggccccaggccaggcc

SEQ ID NO: 8169507 - DNA, 22 bp, Homo sapiens
agtgcaggctcgcttgtgaggc

SEQ ID NO: 8169508 - DNA, 19 bp, Homo sapiens
agtgcagggagcaccctca

SEQ ID NO: 8169509 - DNA, 22 bp, Homo sapiens
agtgcagggcctgcccagcagg

SEQ ID NO: 8169510 - DNA, 19 bp, Homo sapiens
agtgcagggagcaccctca

SEQ ID NO: 8169511 - DNA, 23 bp, Homo sapiens
ctctctctaccatgtgaggacac

SEQ ID NO: 8169512 - DNA, 23 bp, Homo sapiens
ctctctctaccatgtgaggacac

SEQ ID NO: 8169513 - DNA, 22 bp, Homo sapiens
ctctctggcttggcacggagat

SEQ ID NO: 8169514 - DNA, 22 bp, Homo sapiens
ctctctggcttggcacggagat

SEQ ID NO: 8169515 - DNA, 22 bp, Homo sapiens
ctctctggggttccagacgtgg

SEQ ID NO: 8169516 - DNA, 22 bp, Homo sapiens
ctctctgggggccatgccaaga

SEQ ID NO: 8169517 - DNA, 22 bp, Homo sapiens
ctctctgggcccagttggcacc

SEQ ID NO: 8169518 - DNA, 22 bp, Homo sapiens
ctctctgggcccagttggcacc

SEQ ID NO: 8169519 - DNA, 18 bp, Homo sapiens
ctctctgggtgaggacaa

SEQ ID NO: 8169520 - DNA, 18 bp, Homo sapiens
ctctctgggtgaggacaa

SEQ ID NO: 8169521 - DNA, 22 bp, Homo sapiens
ctctctggtacatagagtttgg

SEQ ID NO: 8169522 - DNA, 18 bp, Homo sapiens
ctctctgggtgaggacaa

SEQ ID NO: 8169523 - DNA, 18 bp, Homo sapiens
ctctctgggtgaggacaa

SEQ ID NO: 8169524 - DNA, 18 bp, Homo sapiens
ctctctgggtgaggacaa

SEQ ID NO: 8169525 - DNA, 22 bp, Homo sapiens
ctctctgggtcctcttttatag

SEQ ID NO: 8169526 - DNA, 22 bp, Homo sapiens
ctctctggggttccagacgtgg

SEQ ID NO: 8169527 - DNA, 17 bp, Homo sapiens
agtggcaggcagatggg

SEQ ID NO: 8169528 - DNA, 17 bp, Homo sapiens
agtggcaggcagatggg

SEQ ID NO: 8169529 - DNA, 17 bp, Homo sapiens
agtggcaggcagatggg

SEQ ID NO: 8169530 - DNA, 17 bp, Homo sapiens
agtggcaggcagatggg

SEQ ID NO: 8169531 - DNA, 22 bp, Homo sapiens
agtggcaggcagaagcttctca

SEQ ID NO: 8169532 - DNA, 22 bp, Homo sapiens
agtggcaggaaagtggaagaga

SEQ ID NO: 8169533 - DNA, 22 bp, Homo sapiens
ctctctggtcccagattccaga

SEQ ID NO: 8169534 - DNA, 22 bp, Homo sapiens
agtggcagccgagcaggagatg

SEQ ID NO: 8169535 - DNA, 22 bp, Homo sapiens
agtggcagctgtcatgccctag

SEQ ID NO: 8169536 - DNA, 22 bp, Homo sapiens
agtggcagctgtcatgccctag

SEQ ID NO: 8169537 - DNA, 22 bp, Homo sapiens
agtggcagccgagcaggagatg

SEQ ID NO: 8169538 - DNA, 22 bp, Homo sapiens
agtggcaggcggagatgtagga

SEQ ID NO: 8169539 - DNA, 17 bp, Homo sapiens
agtggcaggcagatggg

SEQ ID NO: 8169540 - DNA, 22 bp, Homo sapiens
agtggcaggcggagatgtagga

SEQ ID NO: 8169541 - DNA, 22 bp, Homo sapiens
agtggcaggcggagatgtagga

SEQ ID NO: 8169542 - DNA, 22 bp, Homo sapiens
agtggctgacaactgggttaac

SEQ ID NO: 8169543 - DNA, 22 bp, Homo sapiens
agtggctgaagcatcaaaggca

SEQ ID NO: 8169544 - DNA, 22 bp, Homo sapiens
agtggctggacgacaagggtga

SEQ ID NO: 8169545 - DNA, 19 bp, Homo sapiens
agtggctgggcagaagcaa

SEQ ID NO: 8169546 - DNA, 19 bp, Homo sapiens
agtggctgggcagaagcaa

SEQ ID NO: 8169547 - DNA, 19 bp, Homo sapiens
agtggctgggcagaagcaa

SEQ ID NO: 8169548 - DNA, 19 bp, Homo sapiens
agtggctgggcagaagcaa

SEQ ID NO: 8169549 - DNA, 22 bp, Homo sapiens
agtggctggcataggaacagac

SEQ ID NO: 8169550 - DNA, 22 bp, Homo sapiens
agtggctggcataggaacagac

SEQ ID NO: 8169551 - DNA, 22 bp, Homo sapiens
agtggctggcataggaacagac

SEQ ID NO: 8169552 - DNA, 22 bp, Homo sapiens
agtggctggcataggaacagac

SEQ ID NO: 8169553 - DNA, 22 bp, Homo sapiens
agtggctggagccccaggctgg

SEQ ID NO: 8169554 - DNA, 22 bp, Homo sapiens
agtggctggagccccaggctgg

SEQ ID NO: 8169555 - DNA, 22 bp, Homo sapiens
agtggctggagccccaggctgg

SEQ ID NO: 8169556 - DNA, 22 bp, Homo sapiens
agtggctggacgacaagggtga

SEQ ID NO: 8169557 - DNA, 22 bp, Homo sapiens
ctgtttccaccttcatggctaa

SEQ ID NO: 8169558 - DNA, 22 bp, Homo sapiens
ctgtttcaagtgaagtcagaca

SEQ ID NO: 8169559 - DNA, 22 bp, Homo sapiens
ctgtttctaaagggagcagatt

SEQ ID NO: 8169560 - DNA, 22 bp, Homo sapiens
cttcacacccactaggatggct

SEQ ID NO: 8169561 - DNA, 22 bp, Homo sapiens
cttcacacccactaaaatgatg

SEQ ID NO: 8169562 - DNA, 22 bp, Homo sapiens
ctgtttcctgtcttctcactat

SEQ ID NO: 8169563 - DNA, 22 bp, Homo sapiens
ctgtttctaaagggagcagatt

SEQ ID NO: 8169564 - DNA, 22 bp, Homo sapiens
cttcagaatgggactgtgtttg

SEQ ID NO: 8169565 - DNA, 22 bp, Homo sapiens
cttcagaatgggactgtgtttg

SEQ ID NO: 8169566 - DNA, 22 bp, Homo sapiens
cttcagaatgggactgtgtttg

SEQ ID NO: 8169567 - DNA, 22 bp, Homo sapiens
cttcagaagcctgcagcctttg

SEQ ID NO: 8169568 - DNA, 22 bp, Homo sapiens
cttcagagagtccagggactgc

SEQ ID NO: 8169569 - DNA, 22 bp, Homo sapiens
cttcagaattcctcagcctcag

SEQ ID NO: 8169570 - DNA, 22 bp, Homo sapiens
cttcagaatgggactgtgtttg

SEQ ID NO: 8169571 - DNA, 22 bp, Homo sapiens
cttcagaggggactcaaagtca

SEQ ID NO: 8169572 - DNA, 21 bp, Homo sapiens
cttcagcaaatacttggcagg

SEQ ID NO: 8169573 - DNA, 22 bp, Homo sapiens
cttcagcagcctcttgcataaa

SEQ ID NO: 8169574 - DNA, 23 bp, Homo sapiens
cttcagcagaaacataaattctc

SEQ ID NO: 8169575 - DNA, 22 bp, Homo sapiens
cttcagcagatgcaaaacccct

SEQ ID NO: 8169576 - DNA, 22 bp, Homo sapiens
cttcagcacctcagctggagag

SEQ ID NO: 8169577 - DNA, 22 bp, Homo sapiens
cttcagcacctcagctggagag

SEQ ID NO: 8169578 - DNA, 22 bp, Homo sapiens
cttcagcatctttttcttgggg

SEQ ID NO: 8169579 - DNA, 19 bp, Homo sapiens
cttcagcatctccggagct

SEQ ID NO: 8169580 - DNA, 19 bp, Homo sapiens
cttcagcatctccggagct

SEQ ID NO: 8169581 - DNA, 19 bp, Homo sapiens
cttcagcatctccggagct

SEQ ID NO: 8169582 - DNA, 22 bp, Homo sapiens
atccttcagctgccctgttacc

SEQ ID NO: 8169583 - DNA, 22 bp, Homo sapiens
atccttcagtggaagacagtag

SEQ ID NO: 8169584 - DNA, 22 bp, Homo sapiens
atccttcaggaaaccatcctca

SEQ ID NO: 8169585 - DNA, 22 bp, Homo sapiens
atccttcaggaaaccatcctca

SEQ ID NO: 8169586 - DNA, 22 bp, Homo sapiens
atccttctaagagggacgtatg

SEQ ID NO: 8169587 - DNA, 22 bp, Homo sapiens
atccttctacctaggactattt

SEQ ID NO: 8169588 - DNA, 22 bp, Homo sapiens
atccttctccaaaactggctcc

SEQ ID NO: 8169589 - DNA, 22 bp, Homo sapiens
atccttctaagagggacgtatg

SEQ ID NO: 8169590 - DNA, 22 bp, Homo sapiens
atccttctccaaaactggctcc

SEQ ID NO: 8169591 - DNA, 22 bp, Homo sapiens
atccttctccaaaactggctcc

SEQ ID NO: 8169592 - DNA, 22 bp, Homo sapiens
atccttctccagtcgtattttt

SEQ ID NO: 8169593 - DNA, 22 bp, Homo sapiens
atccttctacctaggactattt

SEQ ID NO: 8169594 - DNA, 22 bp, Homo sapiens
atccttctccagtcgtattttt

SEQ ID NO: 8169595 - DNA, 22 bp, Homo sapiens
atccttcttcaaagagggaaaa

SEQ ID NO: 8169596 - DNA, 17 bp, Homo sapiens
atccttctgttctttct

SEQ ID NO: 8169597 - DNA, 22 bp, Homo sapiens
atccttcttcaaagagggaaaa

SEQ ID NO: 8169598 - DNA, 17 bp, Homo sapiens
atccttctgttctttct

SEQ ID NO: 8169599 - DNA, 22 bp, Homo sapiens
atccttcttctgctagtgtcta

SEQ ID NO: 8169600 - DNA, 22 bp, Homo sapiens
atccttcttctgctagtgtcta

SEQ ID NO: 8169601 - DNA, 22 bp, Homo sapiens
atccttggtaagagagttggat

SEQ ID NO: 8169602 - DNA, 22 bp, Homo sapiens
atccttggccctgaatgaagtt

SEQ ID NO: 8169603 - DNA, 18 bp, Homo sapiens
atccttggggctgctgct

SEQ ID NO: 8169604 - DNA, 22 bp, Homo sapiens
atccttcttctgctagtgtcta

SEQ ID NO: 8169605 - DNA, 22 bp, Homo sapiens
atccttggatcctgtgttcctg

SEQ ID NO: 8169606 - DNA, 22 bp, Homo sapiens
atccttggcacagtggaattca

SEQ ID NO: 8169607 - DNA, 22 bp, Homo sapiens
atctccaggattttcacactca

SEQ ID NO: 8169608 - DNA, 22 bp, Homo sapiens
atctcataaacacacatatatg

SEQ ID NO: 8169609 - DNA, 22 bp, Homo sapiens
atctcataactcatttgaagac

SEQ ID NO: 8169610 - DNA, 22 bp, Homo sapiens
atctcattttggtttctactta

SEQ ID NO: 8169611 - DNA, 22 bp, Homo sapiens
atctatttctgctaataacaat

SEQ ID NO: 8169612 - DNA, 22 bp, Homo sapiens
atctatttctgctaataacaat

SEQ ID NO: 8169613 - DNA, 22 bp, Homo sapiens
atctcccaaactcatttcttca

SEQ ID NO: 8169614 - DNA, 22 bp, Homo sapiens
atctccagttagcagtactgat

SEQ ID NO: 8169615 - DNA, 22 bp, Homo sapiens
atctccagtcctggtttcctgg

SEQ ID NO: 8169616 - DNA, 22 bp, Homo sapiens
atctcccagccacagcattctt

SEQ ID NO: 8169617 - DNA, 22 bp, Homo sapiens
atctcccacaggctgctacttc

SEQ ID NO: 8169618 - DNA, 22 bp, Homo sapiens
atctcccacaggctgctacttc

SEQ ID NO: 8169619 - DNA, 22 bp, Homo sapiens
atctcccaaattagcctcttga

SEQ ID NO: 8169620 - DNA, 22 bp, Homo sapiens
cttcagttatgtgccaaggaca

SEQ ID NO: 8169621 - DNA, 22 bp, Homo sapiens
cttcagttatgtgccaaggaca

SEQ ID NO: 8169622 - DNA, 22 bp, Homo sapiens
cttcagttctaaagtagaatgt

SEQ ID NO: 8169623 - DNA, 22 bp, Homo sapiens
atctggaaaacacagtgtagac

SEQ ID NO: 8169624 - DNA, 22 bp, Homo sapiens
atctggaaataaatacgagttc

SEQ ID NO: 8169625 - DNA, 17 bp, Homo sapiens
atctgcatttctaatga

SEQ ID NO: 8169626 - DNA, 22 bp, Homo sapiens
atctggaaataaatacgagttc

SEQ ID NO: 8169627 - DNA, 21 bp, Homo sapiens
atctggaaattctgccagaga

SEQ ID NO: 8169628 - DNA, 21 bp, Homo sapiens
atctggaaattctgccagaga

SEQ ID NO: 8169629 - DNA, 22 bp, Homo sapiens
atctgcatttacattgcttgta

SEQ ID NO: 8169630 - DNA, 22 bp, Homo sapiens
cttcatggtaaatctgccttta

SEQ ID NO: 8169631 - DNA, 22 bp, Homo sapiens
cttcattaaccaaaatgcaata

SEQ ID NO: 8169632 - DNA, 22 bp, Homo sapiens
atctggaagattgaaggggagt

SEQ ID NO: 8169633 - DNA, 21 bp, Homo sapiens
atctggaagaactggtaagtg

SEQ ID NO: 8169634 - DNA, 22 bp, Homo sapiens
atctggaagccagatactcagt

SEQ ID NO: 8169635 - DNA, 22 bp, Homo sapiens
atctggaagccagatactcagt

SEQ ID NO: 8169636 - DNA, 19 bp, Homo sapiens
atctggaactcgtttgttt

SEQ ID NO: 8169637 - DNA, 19 bp, Homo sapiens
atctggaactcgtttgttt

SEQ ID NO: 8169638 - DNA, 22 bp, Homo sapiens
atctggaacaaagcttaggaat

SEQ ID NO: 8169639 - DNA, 22 bp, Homo sapiens
cttcataagattgttgtgagga

SEQ ID NO: 8169640 - DNA, 22 bp, Homo sapiens
cttcataaactcagaaggcagc

SEQ ID NO: 8169641 - DNA, 23 bp, Homo sapiens
cttcatgagagccctgaggaaaa

SEQ ID NO: 8169642 - DNA, 22 bp, Homo sapiens
cttcatgagactccactgccat

SEQ ID NO: 8169643 - DNA, 22 bp, Homo sapiens
cttcatgagactccactgccat

SEQ ID NO: 8169644 - DNA, 22 bp, Homo sapiens
cttcatctttctgagcctcagt

SEQ ID NO: 8169645 - DNA, 22 bp, Homo sapiens
cttcatgagggtaatctacaaa

SEQ ID NO: 8169646 - DNA, 22 bp, Homo sapiens
cttcatgagtgtacaacctgtg

SEQ ID NO: 8169647 - DNA, 22 bp, Homo sapiens
ctgttactggacgcacgcagct

SEQ ID NO: 8169648 - DNA, 22 bp, Homo sapiens
ctgttatttctgaatgccatcc

SEQ ID NO: 8169649 - DNA, 22 bp, Homo sapiens
ctgttatttagaacatggaatc

SEQ ID NO: 8169650 - DNA, 22 bp, Homo sapiens
ctgttattcaagacaaaggcag

SEQ ID NO: 8169651 - DNA, 22 bp, Homo sapiens
ctgttattttataattcaagaa

SEQ ID NO: 8169652 - DNA, 22 bp, Homo sapiens
ctgttattttataattcaagaa

SEQ ID NO: 8169653 - DNA, 22 bp, Homo sapiens
ctgtttatctctaacctgttta

SEQ ID NO: 8169654 - DNA, 22 bp, Homo sapiens
atcattcagtctctgggacagt

SEQ ID NO: 8169655 - DNA, 22 bp, Homo sapiens
atcattcagcctaagcaagtac

SEQ ID NO: 8169656 - DNA, 22 bp, Homo sapiens
atcattagaccaaactagagct

SEQ ID NO: 8169657 - DNA, 22 bp, Homo sapiens
atcattagcaattttcaataag

SEQ ID NO: 8169658 - DNA, 22 bp, Homo sapiens
atcattagcaattttcaataag

SEQ ID NO: 8169659 - DNA, 22 bp, Homo sapiens
atcattcagtgaccacttccca

SEQ ID NO: 8169660 - DNA, 22 bp, Homo sapiens
atcattcagtgaccacttccca

SEQ ID NO: 8169661 - DNA, 22 bp, Homo sapiens
atcattctagctgttgtgttga

SEQ ID NO: 8169662 - DNA, 22 bp, Homo sapiens
atcattccacatgtaccactag

SEQ ID NO: 8169663 - DNA, 22 bp, Homo sapiens
atcattcatcttattgccagtc

SEQ ID NO: 8169664 - DNA, 22 bp, Homo sapiens
atcattccacatgtaccactag

SEQ ID NO: 8169665 - DNA, 22 bp, Homo sapiens
ctgtgtcctccccatcacttct

SEQ ID NO: 8169666 - DNA, 22 bp, Homo sapiens
ctgtgtcccttgtcccagagcc

SEQ ID NO: 8169667 - DNA, 22 bp, Homo sapiens
ctgtgtcccttgtcccagagcc

SEQ ID NO: 8169668 - DNA, 23 bp, Homo sapiens
atcattaacagtgcaggggtagg

SEQ ID NO: 8169669 - DNA, 21 bp, Homo sapiens
atcattaattgctgagtgaca

SEQ ID NO: 8169670 - DNA, 22 bp, Homo sapiens
atcattaacccttgatgctggg

SEQ ID NO: 8169671 - DNA, 21 bp, Homo sapiens
atcattaattgctgagtgaca

SEQ ID NO: 8169672 - DNA, 22 bp, Homo sapiens
ctgtgtccccctcagccaggtg

SEQ ID NO: 8169673 - DNA, 22 bp, Homo sapiens
ctgtgtccccctcagccaggtg

SEQ ID NO: 8169674 - DNA, 22 bp, Homo sapiens
ctgtgtccccctcagccaggtg

SEQ ID NO: 8169675 - DNA, 22 bp, Homo sapiens
ctgtgtccccctcagccaggtg

SEQ ID NO: 8169676 - DNA, 22 bp, Homo sapiens
ctgtgtccccctcagccaggtg

SEQ ID NO: 8169677 - DNA, 22 bp, Homo sapiens
ctgtgtcccttgtcccagagcc

SEQ ID NO: 8169678 - DNA, 22 bp, Homo sapiens
ctgtgtcccttgtcccagagcc

SEQ ID NO: 8169679 - DNA, 22 bp, Homo sapiens
ctgtgtcccttgtcccagagcc

SEQ ID NO: 8169680 - DNA, 22 bp, Homo sapiens
ctgtgtcccagtaccttgggta

SEQ ID NO: 8169681 - DNA, 22 bp, Homo sapiens
ctgtgtcccagtaccttgggta

SEQ ID NO: 8169682 - DNA, 22 bp, Homo sapiens
ctgtgtcccagtaccttgggta

SEQ ID NO: 8169683 - DNA, 22 bp, Homo sapiens
ctgtgtcccagccaggataatg

SEQ ID NO: 8169684 - DNA, 22 bp, Homo sapiens
atcaggaagccagtctaatgga

SEQ ID NO: 8169685 - DNA, 22 bp, Homo sapiens
atcaggaagccagtctaatgga

SEQ ID NO: 8169686 - DNA, 22 bp, Homo sapiens
atcaggaatgaatacttttgga

SEQ ID NO: 8169687 - DNA, 22 bp, Homo sapiens
atcaggaatgaatacttttgga

SEQ ID NO: 8169688 - DNA, 22 bp, Homo sapiens
atcaggaattaggtgagatgga

SEQ ID NO: 8169689 - DNA, 20 bp, Homo sapiens
ctgtgctccgggttcctgga

SEQ ID NO: 8169690 - DNA, 22 bp, Homo sapiens
atcaggaaatacttatttataa

SEQ ID NO: 8169691 - DNA, 19 bp, Homo sapiens
atcaggaacaaggctgatc

SEQ ID NO: 8169692 - DNA, 20 bp, Homo sapiens
atcaggaagagagactgacc

SEQ ID NO: 8169693 - DNA, 22 bp, Homo sapiens
atcaggaagaattggatgctac

SEQ ID NO: 8169694 - DNA, 22 bp, Homo sapiens
atcaggaagaagaatgtgttgg

SEQ ID NO: 8169695 - DNA, 22 bp, Homo sapiens
atcaggaagaagaatgtgttgg

SEQ ID NO: 8169696 - DNA, 22 bp, Homo sapiens
atcaggaacgttcatggactgt

SEQ ID NO: 8169697 - DNA, 22 bp, Homo sapiens
ctgtgggagcacatgacagata

SEQ ID NO: 8169698 - DNA, 22 bp, Homo sapiens
atcaggctagtgtgtgtgttca

SEQ ID NO: 8169699 - DNA, 22 bp, Homo sapiens
atcaggccagcaatccctgggc

SEQ ID NO: 8169700 - DNA, 22 bp, Homo sapiens
ctgtgtcactcactgcgttatg

SEQ ID NO: 8169701 - DNA, 22 bp, Homo sapiens
ctgtgtccaatggccttagcag

SEQ ID NO: 8169702 - DNA, 22 bp, Homo sapiens
ctgtgtccaatggccttagcag

SEQ ID NO: 8169703 - DNA, 22 bp, Homo sapiens
ctgtgtccaatggccttagcag

SEQ ID NO: 8169704 - DNA, 22 bp, Homo sapiens
ctgtgtcccacacgaggtgtat

SEQ ID NO: 8169705 - DNA, 22 bp, Homo sapiens
ctgtgtccatttatcattgtca

SEQ ID NO: 8169706 - DNA, 22 bp, Homo sapiens
ctgtgtccatgttctaatttgg

SEQ ID NO: 8169707 - DNA, 22 bp, Homo sapiens
ctgtgggagcacatgacagata

SEQ ID NO: 8169708 - DNA, 22 bp, Homo sapiens
ctgtgtattgaaaaagggttaa

SEQ ID NO: 8169709 - DNA, 19 bp, Homo sapiens
ctgtgtcacatttatgaaa

SEQ ID NO: 8169710 - DNA, 22 bp, Homo sapiens
ctgtgcagtaggtcagggctgg

SEQ ID NO: 8169711 - DNA, 22 bp, Homo sapiens
ctgtccagtcagaacgtcatta

SEQ ID NO: 8169712 - DNA, 22 bp, Homo sapiens
ctgtccagggtgtgcaggggct

SEQ ID NO: 8169713 - DNA, 22 bp, Homo sapiens
ctgtgcctccaagtggtctctg

SEQ ID NO: 8169714 - DNA, 22 bp, Homo sapiens
ctgtgcctcagtgtcctcgagt

SEQ ID NO: 8169715 - DNA, 22 bp, Homo sapiens
ctgtgcctaagatgcatgtctc

SEQ ID NO: 8169716 - DNA, 22 bp, Homo sapiens
ctgtgcctaagatgcatgtctc

SEQ ID NO: 8169717 - DNA, 22 bp, Homo sapiens
ctgtgccctttcgctgcactgt

SEQ ID NO: 8169718 - DNA, 22 bp, Homo sapiens
ctgtgccctttcgctgcactgt

SEQ ID NO: 8169719 - DNA, 22 bp, Homo sapiens
ctgtgcagtaggtcagggctgg

SEQ ID NO: 8169720 - DNA, 22 bp, Homo sapiens
ctgtgcagtaggtcagggctgg

SEQ ID NO: 8169721 - DNA, 22 bp, Homo sapiens
ctgtgccctttgtcctcgtctc

SEQ ID NO: 8169722 - DNA, 20 bp, Homo sapiens
ctgtgcctaaacctccgggt

SEQ ID NO: 8169723 - DNA, 22 bp, Homo sapiens
ctgtgccttctacttcactcta

SEQ ID NO: 8169724 - DNA, 22 bp, Homo sapiens
ctgtgccttctacttcactcta

SEQ ID NO: 8169725 - DNA, 22 bp, Homo sapiens
ctgtgccttggcgctgtgccac

SEQ ID NO: 8169726 - DNA, 22 bp, Homo sapiens
ctgtgcctttgtagctgtgcct

SEQ ID NO: 8169727 - DNA, 22 bp, Homo sapiens
ctgtgcctttgtagctgtgcct

SEQ ID NO: 8169728 - DNA, 22 bp, Homo sapiens
ctgtgcctttgtagctgtgcct

SEQ ID NO: 8169729 - DNA, 22 bp, Homo sapiens
ctgtgctccctctggcgccccg

SEQ ID NO: 8169730 - DNA, 22 bp, Homo sapiens
ctgtgcctgcaggccacatcaa

SEQ ID NO: 8169731 - DNA, 20 bp, Homo sapiens
ctgtgcctcctgctagtcct

SEQ ID NO: 8169732 - DNA, 22 bp, Homo sapiens
ctgtgcctccaagtggtctctg

SEQ ID NO: 8169733 - DNA, 22 bp, Homo sapiens
ctgtgcctccctttactttgag

SEQ ID NO: 8169734 - DNA, 22 bp, Homo sapiens
ctgtgcctgccttgttcactga

SEQ ID NO: 8169735 - DNA, 22 bp, Homo sapiens
ctgtgcctggggggcagagctg

SEQ ID NO: 8169736 - DNA, 22 bp, Homo sapiens
ctgtgccttagtattctcattt

SEQ ID NO: 8169737 - DNA, 22 bp, Homo sapiens
ctgtgccttagtattctcattt

SEQ ID NO: 8169738 - DNA, 22 bp, Homo sapiens
ctgtgccttagtattctcattt

SEQ ID NO: 8169739 - DNA, 22 bp, Homo sapiens
atatcacagatgcagaaagaga

SEQ ID NO: 8169740 - DNA, 22 bp, Homo sapiens
atatcacagctctttcattgct

SEQ ID NO: 8169741 - DNA, 22 bp, Homo sapiens
atatcacagctctttcattgct

SEQ ID NO: 8169742 - DNA, 22 bp, Homo sapiens
atatcacaggaaaggaagatac

SEQ ID NO: 8169743 - DNA, 22 bp, Homo sapiens
atatcacagtagttgtttagtt

SEQ ID NO: 8169744 - DNA, 22 bp, Homo sapiens
atatcataaatcggtgcatgaa

SEQ ID NO: 8169745 - DNA, 22 bp, Homo sapiens
atatcatgttctctgtgtgtca

SEQ ID NO: 8169746 - DNA, 22 bp, Homo sapiens
atatcattatgttatgagcaca

SEQ ID NO: 8169747 - DNA, 22 bp, Homo sapiens
atatcactagagaagttgttaa

SEQ ID NO: 8169748 - DNA, 22 bp, Homo sapiens
atatcattatgttatgagcaca

SEQ ID NO: 8169749 - DNA, 22 bp, Homo sapiens
atatcattatgttatgagcaca

SEQ ID NO: 8169750 - DNA, 22 bp, Homo sapiens
atatcattatgttatgagcaca

SEQ ID NO: 8169751 - DNA, 22 bp, Homo sapiens
atatcataaatcggtgcatgaa

SEQ ID NO: 8169752 - DNA, 22 bp, Homo sapiens
atatattttttgagacagagtc

SEQ ID NO: 8169753 - DNA, 22 bp, Homo sapiens
atatcaaacgaagttattttaa

SEQ ID NO: 8169754 - DNA, 22 bp, Homo sapiens
atatcaaagctagtggaaattt

SEQ ID NO: 8169755 - DNA, 23 bp, Homo sapiens
atatcacacccagtacagtctcc

SEQ ID NO: 8169756 - DNA, 22 bp, Homo sapiens
atatattttgcggtcacgtggc

SEQ ID NO: 8169757 - DNA, 22 bp, Homo sapiens
atatattttgaatagcctctgt

SEQ ID NO: 8169758 - DNA, 22 bp, Homo sapiens
atatattttgcggtcacgtggc

SEQ ID NO: 8169759 - DNA, 22 bp, Homo sapiens
atatattttgcggtcacgtggc

SEQ ID NO: 8169760 - DNA, 22 bp, Homo sapiens
atatattttgcggtcacgtggc

SEQ ID NO: 8169761 - DNA, 22 bp, Homo sapiens
atatattttttgagacagagtc

SEQ ID NO: 8169762 - DNA, 22 bp, Homo sapiens
atatattttttgagacagagtc

SEQ ID NO: 8169763 - DNA, 22 bp, Homo sapiens
atatattttttgagacagagtc

SEQ ID NO: 8169764 - DNA, 22 bp, Homo sapiens
atatattttttgagacagagtc

SEQ ID NO: 8169765 - DNA, 22 bp, Homo sapiens
atatattttgaatagcctctgt

SEQ ID NO: 8169766 - DNA, 22 bp, Homo sapiens
atatattttgaatagcctctgt

SEQ ID NO: 8169767 - DNA, 19 bp, Homo sapiens
atatatgtatacaatgtgg

SEQ ID NO: 8169768 - DNA, 22 bp, Homo sapiens
atatatgtgcaggctcacacat

SEQ ID NO: 8169769 - DNA, 20 bp, Homo sapiens
atatatgtatgcgtgtggtt

SEQ ID NO: 8169770 - DNA, 22 bp, Homo sapiens
atagtgaaaatgctgtcagcat

SEQ ID NO: 8169771 - DNA, 21 bp, Homo sapiens
atagtgatagataactgagtt

SEQ ID NO: 8169772 - DNA, 19 bp, Homo sapiens
atatatgtatacaatgtgg

SEQ ID NO: 8169773 - DNA, 22 bp, Homo sapiens
atagtatttccagaaatagtct

SEQ ID NO: 8169774 - DNA, 22 bp, Homo sapiens
atagtatgaattaaatcatgag

SEQ ID NO: 8169775 - DNA, 20 bp, Homo sapiens
atagtattcaggccacttgt

SEQ ID NO: 8169776 - DNA, 20 bp, Homo sapiens
atagtattcaggccacttgt

SEQ ID NO: 8169777 - DNA, 22 bp, Homo sapiens
atagtatgtgtgtttatgtaca

SEQ ID NO: 8169778 - DNA, 22 bp, Homo sapiens
atagtacagatccattaattat

SEQ ID NO: 8169779 - DNA, 22 bp, Homo sapiens
atagtcttacttttctctgcta

SEQ ID NO: 8169780 - DNA, 22 bp, Homo sapiens
atagtcttcagcactttgatca

SEQ ID NO: 8169781 - DNA, 22 bp, Homo sapiens
atagtcttagatcagataaagt

SEQ ID NO: 8169782 - DNA, 22 bp, Homo sapiens
ctgggccagttatgtctcatct

SEQ ID NO: 8169783 - DNA, 22 bp, Homo sapiens
ctgggccatcagaggggctgga

SEQ ID NO: 8169784 - DNA, 20 bp, Homo sapiens
ctgggccatccttttacaat

SEQ ID NO: 8169785 - DNA, 22 bp, Homo sapiens
ctgggccagtctcggccgctct

SEQ ID NO: 8169786 - DNA, 22 bp, Homo sapiens
ctgggccagtctcggccgctct

SEQ ID NO: 8169787 - DNA, 22 bp, Homo sapiens
ctgggccagggaggtgtctgta

SEQ ID NO: 8169788 - DNA, 22 bp, Homo sapiens
ctgggccatctctctgcaagtg

SEQ ID NO: 8169789 - DNA, 22 bp, Homo sapiens
ctgggccatctctctgcaagtg

SEQ ID NO: 8169790 - DNA, 22 bp, Homo sapiens
ctgggccatctctctgcaagtg

SEQ ID NO: 8169791 - DNA, 22 bp, Homo sapiens
ctgggccatggaagtctctgcc

SEQ ID NO: 8169792 - DNA, 22 bp, Homo sapiens
ctgggccatggaagtctctgcc

SEQ ID NO: 8169793 - DNA, 22 bp, Homo sapiens
ctgggccatgggccagcgaggc

SEQ ID NO: 8169794 - DNA, 22 bp, Homo sapiens
ctgggccatgggccagcgaggc

SEQ ID NO: 8169795 - DNA, 17 bp, Homo sapiens
ctgggcctctgcccttt

SEQ ID NO: 8169796 - DNA, 22 bp, Homo sapiens
ctgggccatgggccagcgaggc

SEQ ID NO: 8169797 - DNA, 22 bp, Homo sapiens
ctgggccatgggccagcgaggc

SEQ ID NO: 8169798 - DNA, 22 bp, Homo sapiens
ctgggctgtaatgtggcactga

SEQ ID NO: 8169799 - DNA, 22 bp, Homo sapiens
ctgggctgtaatgtggcactga

SEQ ID NO: 8169800 - DNA, 22 bp, Homo sapiens
ctgggctgggtttaccctcttc

SEQ ID NO: 8169801 - DNA, 22 bp, Homo sapiens
ctgggctgggtttaccctcttc

SEQ ID NO: 8169802 - DNA, 20 bp, Homo sapiens
ctgggctgggctacagggtc

SEQ ID NO: 8169803 - DNA, 20 bp, Homo sapiens
ctgggctgggctacagggtc

SEQ ID NO: 8169804 - DNA, 20 bp, Homo sapiens
ctgggctgggctacagggtc

SEQ ID NO: 8169805 - DNA, 22 bp, Homo sapiens
ctgggctgtcaatggccctctg

SEQ ID NO: 8169806 - DNA, 22 bp, Homo sapiens
ctgggctgtaatgtggcactga

SEQ ID NO: 8169807 - DNA, 22 bp, Homo sapiens
ctgggctgtaatgtggcactga

SEQ ID NO: 8169808 - DNA, 22 bp, Homo sapiens
ctgggctgtaatgtggcactga

SEQ ID NO: 8169809 - DNA, 22 bp, Homo sapiens
ctgggctgtaatgtggcactga

SEQ ID NO: 8169810 - DNA, 22 bp, Homo sapiens
ctgggctgtaatgtggcactga

SEQ ID NO: 8169811 - DNA, 22 bp, Homo sapiens
ctgggctgcagcgggagcgacg

SEQ ID NO: 8169812 - DNA, 22 bp, Homo sapiens
ctgggctgatttagtcacgttt

SEQ ID NO: 8169813 - DNA, 22 bp, Homo sapiens
ctgggctgatttagtcacgttt

SEQ ID NO: 8169814 - DNA, 22 bp, Homo sapiens
ctgggctggcgcatccgacacg

SEQ ID NO: 8169815 - DNA, 20 bp, Homo sapiens
ctgggctgggctacagggtc

SEQ ID NO: 8169816 - DNA, 22 bp, Homo sapiens
ctgggcctgccaccatcttagg

SEQ ID NO: 8169817 - DNA, 22 bp, Homo sapiens
ctgggcctggacgggcagatct

SEQ ID NO: 8169818 - DNA, 22 bp, Homo sapiens
ctgggcctgagctctgaagagt

SEQ ID NO: 8169819 - DNA, 22 bp, Homo sapiens
ctgggcctgggaggccaggtct

SEQ ID NO: 8169820 - DNA, 22 bp, Homo sapiens
ctgggcctgggaggccaggtct

SEQ ID NO: 8169821 - DNA, 22 bp, Homo sapiens
ctgggcctgggaggccaggtct

SEQ ID NO: 8169822 - DNA, 22 bp, Homo sapiens
ctgggcctggagcccacgagcc

SEQ ID NO: 8169823 - DNA, 22 bp, Homo sapiens
ctgtatgttccgttttgtcact

SEQ ID NO: 8169824 - DNA, 22 bp, Homo sapiens
ctgtatgttgggtaagcattgc

SEQ ID NO: 8169825 - DNA, 22 bp, Homo sapiens
ctgtatgtagaatagctgacaa

SEQ ID NO: 8169826 - DNA, 22 bp, Homo sapiens
ctgtatgtgaaaatgtcaagtg

SEQ ID NO: 8169827 - DNA, 22 bp, Homo sapiens
ctgtatgtcttgtgaattgtag

SEQ ID NO: 8169828 - DNA, 22 bp, Homo sapiens
ctgtattagccaggtgcacaag

SEQ ID NO: 8169829 - DNA, 22 bp, Homo sapiens
ctgtattaaaggcagtgatctt

SEQ ID NO: 8169830 - DNA, 22 bp, Homo sapiens
ctgtatgttttctcctttggtt

SEQ ID NO: 8169831 - DNA, 22 bp, Homo sapiens
ctgtatgtttctatgaatgtga

SEQ ID NO: 8169832 - DNA, 22 bp, Homo sapiens
ctgtattcaagcttctgcccaa

SEQ ID NO: 8169833 - DNA, 22 bp, Homo sapiens
ctgtatttagttaaaatgctaa

SEQ ID NO: 8169834 - DNA, 22 bp, Homo sapiens
ctgtatttcttggacagttgct

SEQ ID NO: 8169835 - DNA, 22 bp, Homo sapiens
ctgtcattgtacatgttataca

SEQ ID NO: 8169836 - DNA, 22 bp, Homo sapiens
ctgtatttcccacattctctat

SEQ ID NO: 8169837 - DNA, 22 bp, Homo sapiens
ctgtatttcccacattctctat

SEQ ID NO: 8169838 - DNA, 22 bp, Homo sapiens
ctgtccacatggagaacctggt

SEQ ID NO: 8169839 - DNA, 22 bp, Homo sapiens
ctgtcatttgtctgctccctct

SEQ ID NO: 8169840 - DNA, 22 bp, Homo sapiens
ctgtcatttttttagaacacct

SEQ ID NO: 8169841 - DNA, 21 bp, Homo sapiens
ctgtccaaatttcataacttt

SEQ ID NO: 8169842 - DNA, 22 bp, Homo sapiens
ctgtccagctgaccagagcagc

SEQ ID NO: 8169843 - DNA, 22 bp, Homo sapiens
ctgtccagaaagggggcaacaa

SEQ ID NO: 8169844 - DNA, 22 bp, Homo sapiens
ctgtccagctgaccagagcagc

SEQ ID NO: 8169845 - DNA, 22 bp, Homo sapiens
ctgtccagcttggctcctgggg

SEQ ID NO: 8169846 - DNA, 22 bp, Homo sapiens
ctgtccagctgaccagagcagc

SEQ ID NO: 8169847 - DNA, 22 bp, Homo sapiens
atattttccgaacttgaggtag

SEQ ID NO: 8169848 - DNA, 22 bp, Homo sapiens
atattttccgaacttgaggtag

SEQ ID NO: 8169849 - DNA, 22 bp, Homo sapiens
atattttcacagaacttgcaaa

SEQ ID NO: 8169850 - DNA, 22 bp, Homo sapiens
atattttcacagaacttgcaaa

SEQ ID NO: 8169851 - DNA, 22 bp, Homo sapiens
atatttgttgagttcttatgat

SEQ ID NO: 8169852 - DNA, 22 bp, Homo sapiens
ctgtaatcccagctactcggga

SEQ ID NO: 8169853 - DNA, 22 bp, Homo sapiens
atattttggcaaatgtctagat

SEQ ID NO: 8169854 - DNA, 22 bp, Homo sapiens
atattttgaagttaataatgtg

SEQ ID NO: 8169855 - DNA, 22 bp, Homo sapiens
atattttgaagttaataatgtg

SEQ ID NO: 8169856 - DNA, 22 bp, Homo sapiens
atattttgaagttaataatgtg

SEQ ID NO: 8169857 - DNA, 22 bp, Homo sapiens
ctgtatctgtcagctggtctcg

SEQ ID NO: 8169858 - DNA, 22 bp, Homo sapiens
ctgtatctgtgttggatgagtt

SEQ ID NO: 8169859 - DNA, 22 bp, Homo sapiens
ctgtatatgtgcatacacacac

SEQ ID NO: 8169860 - DNA, 22 bp, Homo sapiens
ctgggctgttctgcccctgggt

SEQ ID NO: 8169861 - DNA, 22 bp, Homo sapiens
ctgggctgttctgcccctgggt

SEQ ID NO: 8169862 - DNA, 22 bp, Homo sapiens
ctgggctgttctgcccctgggt

SEQ ID NO: 8169863 - DNA, 22 bp, Homo sapiens
ctggggaggatgctacgacctg

SEQ ID NO: 8169864 - DNA, 22 bp, Homo sapiens
ctggggaggcagggctgcccct

SEQ ID NO: 8169865 - DNA, 22 bp, Homo sapiens
ctggggaggcagggctgcccct

SEQ ID NO: 8169866 - DNA, 22 bp, Homo sapiens
ctggggaggcagggctgcccct

SEQ ID NO: 8169867 - DNA, 22 bp, Homo sapiens
ctggggagtgaaattcttaaat

SEQ ID NO: 8169868 - DNA, 22 bp, Homo sapiens
ctggggagtgaaggtaattaca

SEQ ID NO: 8169869 - DNA, 22 bp, Homo sapiens
ctggggatgggacctggcataa

SEQ ID NO: 8169870 - DNA, 22 bp, Homo sapiens
ctggggatgggacctggcataa

SEQ ID NO: 8169871 - DNA, 22 bp, Homo sapiens
ctggggatgggacctggcataa

SEQ ID NO: 8169872 - DNA, 22 bp, Homo sapiens
ctgggctgtcccagggcggcag

SEQ ID NO: 8169873 - DNA, 22 bp, Homo sapiens
ctgggctgtcccagggcggcag

SEQ ID NO: 8169874 - DNA, 22 bp, Homo sapiens
ctgggctgtcccagggcggcag

SEQ ID NO: 8169875 - DNA, 22 bp, Homo sapiens
ctgggctgtcccaaccccatcc

SEQ ID NO: 8169876 - DNA, 22 bp, Homo sapiens
ctgggctgtcccaaccccatcc

SEQ ID NO: 8169877 - DNA, 22 bp, Homo sapiens
ctgggctgtcaatggccctctg

SEQ ID NO: 8169878 - DNA, 22 bp, Homo sapiens
ctgggctgtcaatggccctctg

SEQ ID NO: 8169879 - DNA, 22 bp, Homo sapiens
ctgggctgtcaatggccctctg

SEQ ID NO: 8169880 - DNA, 22 bp, Homo sapiens
ctgggctgtcaatggccctctg

SEQ ID NO: 8169881 - DNA, 22 bp, Homo sapiens
ctgggctgtcagttttgtttta

SEQ ID NO: 8169882 - DNA, 22 bp, Homo sapiens
ctgggctgtcagttttgtttta

SEQ ID NO: 8169883 - DNA, 22 bp, Homo sapiens
ctgggctgtcagttttgtttta

SEQ ID NO: 8169884 - DNA, 22 bp, Homo sapiens
ctgggctgtggtgtggcccaaa

SEQ ID NO: 8169885 - DNA, 22 bp, Homo sapiens
ctgggctgtggtgtggcccaaa

SEQ ID NO: 8169886 - DNA, 22 bp, Homo sapiens
ctgggctgtggtgtggcccaaa

SEQ ID NO: 8169887 - DNA, 22 bp, Homo sapiens
ctgggctgtggtgtggcccaaa

SEQ ID NO: 8169888 - DNA, 22 bp, Homo sapiens
ctgggctgtggtgtggcccaaa

SEQ ID NO: 8169889 - DNA, 23 bp, Homo sapiens
ctgggctgtcctgaggtcacctc

SEQ ID NO: 8169890 - DNA, 23 bp, Homo sapiens
ctgggctgtcctgaggtcacctc

SEQ ID NO: 8169891 - DNA, 22 bp, Homo sapiens
ctgggctgtcccagggcggcag

SEQ ID NO: 8169892 - DNA, 23 bp, Homo sapiens
ctgggctgtcctgaggtcacctc

SEQ ID NO: 8169893 - DNA, 22 bp, Homo sapiens
ctggtgggagcagcaggcagct

SEQ ID NO: 8169894 - DNA, 22 bp, Homo sapiens
ctggtgggagcagcaggcagct

SEQ ID NO: 8169895 - DNA, 22 bp, Homo sapiens
atatttgttagagtctatgtgt

SEQ ID NO: 8169896 - DNA, 22 bp, Homo sapiens
ctggtgggaggcaaggtggaag

SEQ ID NO: 8169897 - DNA, 22 bp, Homo sapiens
ctggtgggaagatggaaaacat

SEQ ID NO: 8169898 - DNA, 22 bp, Homo sapiens
ctggtggcatcttgagatggtt

SEQ ID NO: 8169899 - DNA, 22 bp, Homo sapiens
ctggtggcatcttgagatggtt

SEQ ID NO: 8169900 - DNA, 22 bp, Homo sapiens
ctggtggagagtgggctctgga

SEQ ID NO: 8169901 - DNA, 22 bp, Homo sapiens
ctggtggagatgcctggcccct

SEQ ID NO: 8169902 - DNA, 22 bp, Homo sapiens
ctggtggaggtgccaggatttg

SEQ ID NO: 8169903 - DNA, 22 bp, Homo sapiens
ctggtggcatcttgagacggtt

SEQ ID NO: 8169904 - DNA, 19 bp, Homo sapiens
ctggtgcttgagtgagtca

SEQ ID NO: 8169905 - DNA, 22 bp, Homo sapiens
ctggtgctgggcagggctcagg

SEQ ID NO: 8169906 - DNA, 22 bp, Homo sapiens
ctggtgctggcaacagagtagg

SEQ ID NO: 8169907 - DNA, 22 bp, Homo sapiens
ctggtgctggcaacagagtagg

SEQ ID NO: 8169908 - DNA, 19 bp, Homo sapiens
ctggtcctgactgaggggt

SEQ ID NO: 8169909 - DNA, 22 bp, Homo sapiens
ctggtccttgacgcgtgggagg

SEQ ID NO: 8169910 - DNA, 22 bp, Homo sapiens
ctggtggaatggcagagggaac

SEQ ID NO: 8169911 - DNA, 19 bp, Homo sapiens
ctggtgcttgagtgagtca

SEQ ID NO: 8169912 - DNA, 22 bp, Homo sapiens
ctggtggagagtgggctctgga

SEQ ID NO: 8169913 - DNA, 22 bp, Homo sapiens
ctggtggagagtgggctctgga

SEQ ID NO: 8169914 - DNA, 22 bp, Homo sapiens
ctggggcagagcccagcaattt

SEQ ID NO: 8169915 - DNA, 22 bp, Homo sapiens
ctggggcagagcctttagcaaa

SEQ ID NO: 8169916 - DNA, 22 bp, Homo sapiens
ctggggcatcatccattctttc

SEQ ID NO: 8169917 - DNA, 22 bp, Homo sapiens
agttttattgtcccagaggtga

SEQ ID NO: 8169918 - DNA, 22 bp, Homo sapiens
agttttattccaatgtgcagca

SEQ ID NO: 8169919 - DNA, 22 bp, Homo sapiens
agttttattccaatgtgcagca

SEQ ID NO: 8169920 - DNA, 22 bp, Homo sapiens
agttttattccaatgtgcagca

SEQ ID NO: 8169921 - DNA, 22 bp, Homo sapiens
agttttatgttcacagaaggat

SEQ ID NO: 8169922 - DNA, 22 bp, Homo sapiens
agttttattaaatccacagaag

SEQ ID NO: 8169923 - DNA, 22 bp, Homo sapiens
agtttgtatgccaacagcaaag

SEQ ID NO: 8169924 - DNA, 22 bp, Homo sapiens
agtttgtgcaatggtgtcacct

SEQ ID NO: 8169925 - DNA, 22 bp, Homo sapiens
ctgatagacaatcaccatggga

SEQ ID NO: 8169926 - DNA, 18 bp, Homo sapiens
ctgataggggtggcagct

SEQ ID NO: 8169927 - DNA, 22 bp, Homo sapiens
ctgataggatttagtttctgtt

SEQ ID NO: 8169928 - DNA, 22 bp, Homo sapiens
ctgatagacaatcaccatggga

SEQ ID NO: 8169929 - DNA, 22 bp, Homo sapiens
ctgataggttattttcagtgag

SEQ ID NO: 8169930 - DNA, 22 bp, Homo sapiens
ctgatacaatgctaataaattt

SEQ ID NO: 8169931 - DNA, 22 bp, Homo sapiens
ctgatacactccctaaaatata

SEQ ID NO: 8169932 - DNA, 22 bp, Homo sapiens
ctgatacactccctaaaatata

SEQ ID NO: 8169933 - DNA, 21 bp, Homo sapiens
ctgataattgttaaattattt

SEQ ID NO: 8169934 - DNA, 21 bp, Homo sapiens
ctgataattgttaaattattt

SEQ ID NO: 8169935 - DNA, 22 bp, Homo sapiens
ctgataatgtcctgcagtaaat

SEQ ID NO: 8169936 - DNA, 22 bp, Homo sapiens
ctgagtgttttcagccacggcc

SEQ ID NO: 8169937 - DNA, 22 bp, Homo sapiens
ctgagttctaggctgccacctt

SEQ ID NO: 8169938 - DNA, 22 bp, Homo sapiens
ctgagtgaggggagcttgatgg

SEQ ID NO: 8169939 - DNA, 22 bp, Homo sapiens
ctgagtgaggggagcttgatgg

SEQ ID NO: 8169940 - DNA, 22 bp, Homo sapiens
ctgagtgaggggagcttgatgg

SEQ ID NO: 8169941 - DNA, 22 bp, Homo sapiens
ctgagtgatagcgatggggaac

SEQ ID NO: 8169942 - DNA, 22 bp, Homo sapiens
ctgagtggaacataggatgata

SEQ ID NO: 8169943 - DNA, 22 bp, Homo sapiens
agtttcacatgcatggatgtgt

SEQ ID NO: 8169944 - DNA, 22 bp, Homo sapiens
agtttcatgagacagattttca

SEQ ID NO: 8169945 - DNA, 22 bp, Homo sapiens
agtttctctagagtctttgaaa

SEQ ID NO: 8169946 - DNA, 22 bp, Homo sapiens
agtttctctcagtatagaatag

SEQ ID NO: 8169947 - DNA, 22 bp, Homo sapiens
agtttctcttaatctagtatct

SEQ ID NO: 8169948 - DNA, 22 bp, Homo sapiens
agtttcttgaagactgatgttt

SEQ ID NO: 8169949 - DNA, 22 bp, Homo sapiens
agtttcttgaagactgatgttt

SEQ ID NO: 8169950 - DNA, 22 bp, Homo sapiens
agtttctttagatagaaagttc

SEQ ID NO: 8169951 - DNA, 22 bp, Homo sapiens
agtttcttggtcacagttttca

SEQ ID NO: 8169952 - DNA, 22 bp, Homo sapiens
agtttcttggtcacagttttca

SEQ ID NO: 8169953 - DNA, 22 bp, Homo sapiens
agtttctttagatagaaagttc

SEQ ID NO: 8169954 - DNA, 22 bp, Homo sapiens
ctgagtctcccggcagtggagg

SEQ ID NO: 8169955 - DNA, 22 bp, Homo sapiens
ctgagtctcccggcagtggagg

SEQ ID NO: 8169956 - DNA, 22 bp, Homo sapiens
agtttcttcatccaaaaaatgg

SEQ ID NO: 8169957 - DNA, 22 bp, Homo sapiens
agtttcttcatccaaaaaatgg

SEQ ID NO: 8169958 - DNA, 22 bp, Homo sapiens
agtttcttattcttagttatgt

SEQ ID NO: 8169959 - DNA, 22 bp, Homo sapiens
agtttcttattcttagttatgt

SEQ ID NO: 8169960 - DNA, 22 bp, Homo sapiens
agtttctgttaccatatttgac

SEQ ID NO: 8169961 - DNA, 22 bp, Homo sapiens
agtttcttattcttagttatgt

SEQ ID NO: 8169962 - DNA, 22 bp, Homo sapiens
agtttctgcaaatcatttttat

SEQ ID NO: 8169963 - DNA, 22 bp, Homo sapiens
agtttctcttaatctagtatct

SEQ ID NO: 8169964 - DNA, 22 bp, Homo sapiens
agtttctctttgacaccaaaat

SEQ ID NO: 8169965 - DNA, 22 bp, Homo sapiens
agtgttactcagttttgtccag

SEQ ID NO: 8169966 - DNA, 22 bp, Homo sapiens
ctgagaggcggaggttgcagtg

SEQ ID NO: 8169967 - DNA, 22 bp, Homo sapiens
agtgttatttattgtttcataa

SEQ ID NO: 8169968 - DNA, 22 bp, Homo sapiens
agtgttattgaggcaaaactgt

SEQ ID NO: 8169969 - DNA, 21 bp, Homo sapiens
agtttacaactgtccagcccc

SEQ ID NO: 8169970 - DNA, 22 bp, Homo sapiens
agtgttcatttattcattcact

SEQ ID NO: 8169971 - DNA, 19 bp, Homo sapiens
agtttattataggtgattc

SEQ ID NO: 8169972 - DNA, 19 bp, Homo sapiens
agtttattataggtgattc

SEQ ID NO: 8169973 - DNA, 19 bp, Homo sapiens
agtttattataggtgattc

SEQ ID NO: 8169974 - DNA, 19 bp, Homo sapiens
agtttattataggtgattc

SEQ ID NO: 8169975 - DNA, 19 bp, Homo sapiens
agtttattataggtgattc

SEQ ID NO: 8169976 - DNA, 22 bp, Homo sapiens
agtttatgttgtttataagcca

SEQ ID NO: 8169977 - DNA, 22 bp, Homo sapiens
agtttatgttgtttataagcca

SEQ ID NO: 8169978 - DNA, 19 bp, Homo sapiens
agtttattataggtgattc

SEQ ID NO: 8169979 - DNA, 22 bp, Homo sapiens
agtttcaaattactgcccatgg

SEQ ID NO: 8169980 - DNA, 22 bp, Homo sapiens
agtttcacagaatatgaaggtt

SEQ ID NO: 8169981 - DNA, 22 bp, Homo sapiens
agtttatttttgataagtcttg

SEQ ID NO: 8169982 - DNA, 22 bp, Homo sapiens
agtttatttttgataagtcttg

SEQ ID NO: 8169983 - DNA, 22 bp, Homo sapiens
agtttatttttgataagtcttg

SEQ ID NO: 8169984 - DNA, 22 bp, Homo sapiens
agtttatttttgataagtcttg

SEQ ID NO: 8169985 - DNA, 22 bp, Homo sapiens
agtttatttttgataagtcttg

SEQ ID NO: 8169986 - DNA, 22 bp, Homo sapiens
agtttatttttgataagtcttg

SEQ ID NO: 8169987 - DNA, 17 bp, Homo sapiens
agtttatttagccttct

SEQ ID NO: 8169988 - DNA, 17 bp, Homo sapiens
agtttatttagccttct

SEQ ID NO: 8169989 - DNA, 22 bp, Homo sapiens
agtttatttctccatttaccta

SEQ ID NO: 8169990 - DNA, 22 bp, Homo sapiens
agtttatttctccatttaccta

SEQ ID NO: 8169991 - DNA, 22 bp, Homo sapiens
agtttatttctccatttaccta

SEQ ID NO: 8169992 - DNA, 22 bp, Homo sapiens
agtttatttctccatttaccta

SEQ ID NO: 8169993 - DNA, 22 bp, Homo sapiens
agtttatttctccatttaccta

SEQ ID NO: 8169994 - DNA, 22 bp, Homo sapiens
agtttatttctccatttaccta

SEQ ID NO: 8169995 - DNA, 22 bp, Homo sapiens
agtttatttctccatttaccta

SEQ ID NO: 8169996 - DNA, 22 bp, Homo sapiens
agtttattctgcttggccctcc

SEQ ID NO: 8169997 - DNA, 22 bp, Homo sapiens
agtttattgtatatggtagttt

SEQ ID NO: 8169998 - DNA, 22 bp, Homo sapiens
agtttattgtatatggtagttt

SEQ ID NO: 8169999 - DNA, 22 bp, Homo sapiens
agtttattctgcttggccctcc

SEQ ID NO: 8170000 - DNA, 22 bp, Homo sapiens
agtttattctgcttggccctcc

SEQ ID NO: 8170001 - DNA, 22 bp, Homo sapiens
agtttattctgcttggccctcc

SEQ ID NO: 8170002 - DNA, 22 bp, Homo sapiens
agtttattgtatatggtagttt

SEQ ID NO: 8170003 - DNA, 22 bp, Homo sapiens
agtttattgtatatggtagttt

SEQ ID NO: 8170004 - DNA, 22 bp, Homo sapiens
agtttattgtatatggtagttt

SEQ ID NO: 8170005 - DNA, 17 bp, Homo sapiens
agtttatttagccttct

SEQ ID NO: 8170006 - DNA, 17 bp, Homo sapiens
agtttatttagccttct

SEQ ID NO: 8170007 - DNA, 20 bp, Homo sapiens
agtttattccaggagaactg

SEQ ID NO: 8170008 - DNA, 20 bp, Homo sapiens
agtttattccaggagaactg

SEQ ID NO: 8170009 - DNA, 20 bp, Homo sapiens
agtttattccaggagaactg

SEQ ID NO: 8170010 - DNA, 20 bp, Homo sapiens
agtttattccaggagaactg

SEQ ID NO: 8170011 - DNA, 22 bp, Homo sapiens
agtttattctctggtcttagta

SEQ ID NO: 8170012 - DNA, 22 bp, Homo sapiens
agtttattctctggtcttagta

SEQ ID NO: 8170013 - DNA, 22 bp, Homo sapiens
agtttattctctggtcttagta

SEQ ID NO: 8170014 - DNA, 22 bp, Homo sapiens
agtttattctctggtcttagta

SEQ ID NO: 8170015 - DNA, 22 bp, Homo sapiens
agtttattctgcttggccctcc

SEQ ID NO: 8170016 - DNA, 22 bp, Homo sapiens
agtttattctgcttggccctcc

SEQ ID NO: 8170017 - DNA, 22 bp, Homo sapiens
agttttctcacatcaaaaatga

SEQ ID NO: 8170018 - DNA, 22 bp, Homo sapiens
agttttctcacatcaaaaatga

SEQ ID NO: 8170019 - DNA, 19 bp, Homo sapiens
agttttctgtgatccattt

SEQ ID NO: 8170020 - DNA, 22 bp, Homo sapiens
agttttctgggatcactggaat

SEQ ID NO: 8170021 - DNA, 21 bp, Homo sapiens
agttttctgagttataaaata

SEQ ID NO: 8170022 - DNA, 21 bp, Homo sapiens
agttttctgagttataaaata

SEQ ID NO: 8170023 - DNA, 22 bp, Homo sapiens
agttttgaaatgaaatgtagtt

SEQ ID NO: 8170024 - DNA, 22 bp, Homo sapiens
agttttgaaatgaaatgtagtt

SEQ ID NO: 8170025 - DNA, 22 bp, Homo sapiens
agttttctttcgcaaaggtaca

SEQ ID NO: 8170026 - DNA, 22 bp, Homo sapiens
agttttctttcatctatcagca

SEQ ID NO: 8170027 - DNA, 22 bp, Homo sapiens
agttttctgttctacaatttga

SEQ ID NO: 8170028 - DNA, 19 bp, Homo sapiens
agttttctgtgatccattt

SEQ ID NO: 8170029 - DNA, 22 bp, Homo sapiens
agttttctgttctacaatttga

SEQ ID NO: 8170030 - DNA, 21 bp, Homo sapiens
ctgccctagatggctctggaa

SEQ ID NO: 8170031 - DNA, 21 bp, Homo sapiens
ctgccctagatggctctggaa

SEQ ID NO: 8170032 - DNA, 22 bp, Homo sapiens
ctgcccgctgctagagaggccg

SEQ ID NO: 8170033 - DNA, 22 bp, Homo sapiens
ctgccctctagaggaggactga

SEQ ID NO: 8170034 - DNA, 22 bp, Homo sapiens
ctgccctcgggccctcccatag

SEQ ID NO: 8170035 - DNA, 22 bp, Homo sapiens
ctgccctcgggccctcccatag

SEQ ID NO: 8170036 - DNA, 22 bp, Homo sapiens
ctgccctcgggccctcccatag

SEQ ID NO: 8170037 - DNA, 22 bp, Homo sapiens
ctgccctcgggccctcccatag

SEQ ID NO: 8170038 - DNA, 17 bp, Homo sapiens
agttttgatataatggc

SEQ ID NO: 8170039 - DNA, 21 bp, Homo sapiens
agttttgagagtgggtagtgt

SEQ ID NO: 8170040 - DNA, 21 bp, Homo sapiens
agttttgagagtgggtagtgt

SEQ ID NO: 8170041 - DNA, 22 bp, Homo sapiens
agttttgatactttctcttcat

SEQ ID NO: 8170042 - DNA, 18 bp, Homo sapiens
ctgccccttctctgagat

SEQ ID NO: 8170043 - DNA, 22 bp, Homo sapiens
ctgcccagattttaccacctgc

SEQ ID NO: 8170044 - DNA, 18 bp, Homo sapiens
ctgcccagagcatttcat

SEQ ID NO: 8170045 - DNA, 22 bp, Homo sapiens
ctgccctctagggatgcactgg

SEQ ID NO: 8170046 - DNA, 22 bp, Homo sapiens
ctgccctctagaggaggactga

SEQ ID NO: 8170047 - DNA, 22 bp, Homo sapiens
ctgccctgacctgcctcagagt

SEQ ID NO: 8170048 - DNA, 22 bp, Homo sapiens
ctgccctgacctgcctcagagt

SEQ ID NO: 8170049 - DNA, 22 bp, Homo sapiens
ctgccctctagggatgcactgg

SEQ ID NO: 8170050 - DNA, 22 bp, Homo sapiens
ctgccctctagggatgcactgg

SEQ ID NO: 8170051 - DNA, 22 bp, Homo sapiens
ctgccctctagggatgcactgg

SEQ ID NO: 8170052 - DNA, 22 bp, Homo sapiens
ctgccctgactgaccttttgaa

SEQ ID NO: 8170053 - DNA, 22 bp, Homo sapiens
ctgccctgacctgcctcagagt

SEQ ID NO: 8170054 - DNA, 22 bp, Homo sapiens
ctgccctggtcccatggctgat

SEQ ID NO: 8170055 - DNA, 22 bp, Homo sapiens
ctgccctggtcccatggctgat

SEQ ID NO: 8170056 - DNA, 22 bp, Homo sapiens
ctgccctgtagctgttctagca

SEQ ID NO: 8170057 - DNA, 22 bp, Homo sapiens
ctgccctggtcccatggctgat

SEQ ID NO: 8170058 - DNA, 22 bp, Homo sapiens
ataagcatttcacaggtgtgtt

SEQ ID NO: 8170059 - DNA, 22 bp, Homo sapiens
ctgccctgtttggacagcccgg

SEQ ID NO: 8170060 - DNA, 22 bp, Homo sapiens
ataagccataatttctgccttt

SEQ ID NO: 8170061 - DNA, 22 bp, Homo sapiens
ataagccaaagaggcctcaatc

SEQ ID NO: 8170062 - DNA, 22 bp, Homo sapiens
ataagtgatatttagctataga

SEQ ID NO: 8170063 - DNA, 22 bp, Homo sapiens
ataagtgatatttagctataga

SEQ ID NO: 8170064 - DNA, 21 bp, Homo sapiens
ataagttgtgcaactgtttga

SEQ ID NO: 8170065 - DNA, 22 bp, Homo sapiens
ataagttggtggtctttaatta

SEQ ID NO: 8170066 - DNA, 22 bp, Homo sapiens
ataagtttgtctttgtaaagat

SEQ ID NO: 8170067 - DNA, 22 bp, Homo sapiens
ataagtttgtctttgtaaagat

SEQ ID NO: 8170068 - DNA, 22 bp, Homo sapiens
ataagtttgtctttgtaaagat

SEQ ID NO: 8170069 - DNA, 22 bp, Homo sapiens
ataataaaccaggatgggtctg

SEQ ID NO: 8170070 - DNA, 22 bp, Homo sapiens
ataataaaccaggatgggtctg

SEQ ID NO: 8170071 - DNA, 22 bp, Homo sapiens
ctgccctgtatcttctcccaat

SEQ ID NO: 8170072 - DNA, 22 bp, Homo sapiens
ctgccctgtctgcagcctggct

SEQ ID NO: 8170073 - DNA, 22 bp, Homo sapiens
ctgccctgtctgcagcctggct

SEQ ID NO: 8170074 - DNA, 22 bp, Homo sapiens
ctgccctgtctgcagcctggct

SEQ ID NO: 8170075 - DNA, 22 bp, Homo sapiens
ctgccctgtgagggtccttggg

SEQ ID NO: 8170076 - DNA, 22 bp, Homo sapiens
ctgccctgtgagggtccttggg

SEQ ID NO: 8170077 - DNA, 22 bp, Homo sapiens
ctgccctgtgagggtccttggg

SEQ ID NO: 8170078 - DNA, 22 bp, Homo sapiens
ctgccctgtggctctgagtcat

SEQ ID NO: 8170079 - DNA, 22 bp, Homo sapiens
ctgccctgtggctctgagtcat

SEQ ID NO: 8170080 - DNA, 22 bp, Homo sapiens
ctgccctgtggctctgagtcat

SEQ ID NO: 8170081 - DNA, 22 bp, Homo sapiens
ctgccctgtggctctgagtcat

SEQ ID NO: 8170082 - DNA, 22 bp, Homo sapiens
ctgccctgtgcacaggaaactg

SEQ ID NO: 8170083 - DNA, 23 bp, Homo sapiens
ctgcctgctggggagacagatct

SEQ ID NO: 8170084 - DNA, 22 bp, Homo sapiens
ctgcctgcttaccatgcatcag

SEQ ID NO: 8170085 - DNA, 22 bp, Homo sapiens
ctgcctgcttctgagccagagg

SEQ ID NO: 8170086 - DNA, 22 bp, Homo sapiens
ctgcctgcttttctgggagccg

SEQ ID NO: 8170087 - DNA, 22 bp, Homo sapiens
ctgcctgctgccctccagagcc

SEQ ID NO: 8170088 - DNA, 22 bp, Homo sapiens
ctgcctgctgccctccagagcc

SEQ ID NO: 8170089 - DNA, 18 bp, Homo sapiens
ctgcctgctctccagctt

SEQ ID NO: 8170090 - DNA, 22 bp, Homo sapiens
ctgcctgctgattagtattgtc

SEQ ID NO: 8170091 - DNA, 22 bp, Homo sapiens
ataataaaccaggatgggtctg

SEQ ID NO: 8170092 - DNA, 23 bp, Homo sapiens
ataataacgtctgtcttgtctct

SEQ ID NO: 8170093 - DNA, 22 bp, Homo sapiens
ataataactcctgttgaagaac

SEQ ID NO: 8170094 - DNA, 22 bp, Homo sapiens
ataataatactgtgcaatggat

SEQ ID NO: 8170095 - DNA, 18 bp, Homo sapiens
ctgcctgctctccagctt

SEQ ID NO: 8170096 - DNA, 18 bp, Homo sapiens
ctgcctgctctccagctt

SEQ ID NO: 8170097 - DNA, 23 bp, Homo sapiens
ataataattatggcagcaaagtg

SEQ ID NO: 8170098 - DNA, 23 bp, Homo sapiens
ataataattatggcagcaaagtg

SEQ ID NO: 8170099 - DNA, 22 bp, Homo sapiens
ataataatactgtgcaatggat

SEQ ID NO: 8170100 - DNA, 22 bp, Homo sapiens
atactttgctagtatcagtgtg

SEQ ID NO: 8170101 - DNA, 21 bp, Homo sapiens
atactttgaattacagccttg

SEQ ID NO: 8170102 - DNA, 21 bp, Homo sapiens
atactttgaattacagccttg

SEQ ID NO: 8170103 - DNA, 22 bp, Homo sapiens
atactttggtcactattattgg

SEQ ID NO: 8170104 - DNA, 22 bp, Homo sapiens
atacttttaattccttctgagt

SEQ ID NO: 8170105 - DNA, 22 bp, Homo sapiens
atacttttaattccttctgagt

SEQ ID NO: 8170106 - DNA, 22 bp, Homo sapiens
atagaaaacagatgtccttaaa

SEQ ID NO: 8170107 - DNA, 22 bp, Homo sapiens
atagaaaacagatgtccttaaa

SEQ ID NO: 8170108 - DNA, 22 bp, Homo sapiens
atagaaaacagatgtccttaaa

SEQ ID NO: 8170109 - DNA, 22 bp, Homo sapiens
atagaaacagggaagcaaagca

SEQ ID NO: 8170110 - DNA, 22 bp, Homo sapiens
atagaatagcatagaaaattga

SEQ ID NO: 8170111 - DNA, 22 bp, Homo sapiens
atagaatagcatagaaaattga

SEQ ID NO: 8170112 - DNA, 22 bp, Homo sapiens
atagaatagcatagaaaattga

SEQ ID NO: 8170113 - DNA, 22 bp, Homo sapiens
atagaatagcatagaaaattga

SEQ ID NO: 8170114 - DNA, 22 bp, Homo sapiens
atagaatatgacttttagatcc

SEQ ID NO: 8170115 - DNA, 22 bp, Homo sapiens
atagaatatgacttttagatcc

SEQ ID NO: 8170116 - DNA, 22 bp, Homo sapiens
atagaatatgacttttagatcc

SEQ ID NO: 8170117 - DNA, 22 bp, Homo sapiens
atagaatatgacttttagatcc

SEQ ID NO: 8170118 - DNA, 22 bp, Homo sapiens
atagaaaggtctttggcagaca

SEQ ID NO: 8170119 - DNA, 22 bp, Homo sapiens
ctggccaggcttgggacagaca

SEQ ID NO: 8170120 - DNA, 22 bp, Homo sapiens
ctggccaggcttgggacagaca

SEQ ID NO: 8170121 - DNA, 22 bp, Homo sapiens
ctggccaggcttgggacagaca

SEQ ID NO: 8170122 - DNA, 22 bp, Homo sapiens
ctggccaggttttgaacagttg

SEQ ID NO: 8170123 - DNA, 22 bp, Homo sapiens
ctggccaggttttgaacagttg

SEQ ID NO: 8170124 - DNA, 22 bp, Homo sapiens
ctggccagggtgcgatcgtggt

SEQ ID NO: 8170125 - DNA, 22 bp, Homo sapiens
ctggccagggtgcgatcgtggt

SEQ ID NO: 8170126 - DNA, 22 bp, Homo sapiens
ctggccagggtgcgatcgtggt

SEQ ID NO: 8170127 - DNA, 22 bp, Homo sapiens
ctggccagtgactgctcacccg

SEQ ID NO: 8170128 - DNA, 22 bp, Homo sapiens
ctggccagtgcctgtgggcccc

SEQ ID NO: 8170129 - DNA, 22 bp, Homo sapiens
ctggccagtgcctgtgggcccc

SEQ ID NO: 8170130 - DNA, 22 bp, Homo sapiens
ctggccagtgcctgtgggcccc

SEQ ID NO: 8170131 - DNA, 22 bp, Homo sapiens
ctggccagtgactgctcacccg

SEQ ID NO: 8170132 - DNA, 22 bp, Homo sapiens
ctggccagtgactgctcacccg

SEQ ID NO: 8170133 - DNA, 22 bp, Homo sapiens
ctggccagtgactgctcacccg

SEQ ID NO: 8170134 - DNA, 22 bp, Homo sapiens
ctggccagtgactgctcacccg

SEQ ID NO: 8170135 - DNA, 22 bp, Homo sapiens
ctggccaggttttgaacagttg

SEQ ID NO: 8170136 - DNA, 22 bp, Homo sapiens
ctggccagaggttcctctgccc

SEQ ID NO: 8170137 - DNA, 22 bp, Homo sapiens
ctggccaggctctcacgtggtc

SEQ ID NO: 8170138 - DNA, 22 bp, Homo sapiens
ctggccagaggttcctctgccc

SEQ ID NO: 8170139 - DNA, 22 bp, Homo sapiens
ctggccagaggttcctctgccc

SEQ ID NO: 8170140 - DNA, 22 bp, Homo sapiens
ctggccaggcttgggacagaca

SEQ ID NO: 8170141 - DNA, 22 bp, Homo sapiens
ctggccaggcttgggacagaca

SEQ ID NO: 8170142 - DNA, 22 bp, Homo sapiens
ctggccaggcttgggacagaca

SEQ ID NO: 8170143 - DNA, 22 bp, Homo sapiens
ctggccaggcttgggacagaca

SEQ ID NO: 8170144 - DNA, 22 bp, Homo sapiens
ctggccaggctctcacgtggtc

SEQ ID NO: 8170145 - DNA, 22 bp, Homo sapiens
ctggaggaaaacaactgcagac

SEQ ID NO: 8170146 - DNA, 22 bp, Homo sapiens
ctggaggaaaacaactgcagac

SEQ ID NO: 8170147 - DNA, 21 bp, Homo sapiens
ctggagcttggtgagaagtgt

SEQ ID NO: 8170148 - DNA, 21 bp, Homo sapiens
ctggagcttggtgagaagtgt

SEQ ID NO: 8170149 - DNA, 22 bp, Homo sapiens
ctggagcttattgggagcagaa

SEQ ID NO: 8170150 - DNA, 22 bp, Homo sapiens
ctggagcttattgggagcagaa

SEQ ID NO: 8170151 - DNA, 22 bp, Homo sapiens
ctggagctgttttttcaggaaa

SEQ ID NO: 8170152 - DNA, 17 bp, Homo sapiens
ctggagctgtgtaacct

SEQ ID NO: 8170153 - DNA, 22 bp, Homo sapiens
ctggagctgttttttcaggaaa

SEQ ID NO: 8170154 - DNA, 22 bp, Homo sapiens
ctggagcttattgggagcagaa

SEQ ID NO: 8170155 - DNA, 22 bp, Homo sapiens
ctggagctgtcttcacaggcct

SEQ ID NO: 8170156 - DNA, 22 bp, Homo sapiens
ctggagctgtcttcacaggcct

SEQ ID NO: 8170157 - DNA, 22 bp, Homo sapiens
atagtacacatcctacaatgtt

SEQ ID NO: 8170158 - DNA, 22 bp, Homo sapiens
atagtacacatcctacaatgtt

SEQ ID NO: 8170159 - DNA, 22 bp, Homo sapiens
atagtacagatccattaattat

SEQ ID NO: 8170160 - DNA, 22 bp, Homo sapiens
ataggggcagatgaggaatggg

SEQ ID NO: 8170161 - DNA, 22 bp, Homo sapiens
atagggcctaaaaagtattgct

SEQ ID NO: 8170162 - DNA, 22 bp, Homo sapiens
atagtaactggcatgtttatga

SEQ ID NO: 8170163 - DNA, 20 bp, Homo sapiens
atagtaatgaagtcttgttc

SEQ ID NO: 8170164 - DNA, 22 bp, Homo sapiens
ataggcaagggatacaatatac

SEQ ID NO: 8170165 - DNA, 22 bp, Homo sapiens
ataggcagaaatgctccctatt

SEQ ID NO: 8170166 - DNA, 22 bp, Homo sapiens
ataggcacattaggaacttttg

SEQ ID NO: 8170167 - DNA, 22 bp, Homo sapiens
atagcatataagttataaaact

SEQ ID NO: 8170168 - DNA, 22 bp, Homo sapiens
atagcatagtcagcttcgctga

SEQ ID NO: 8170169 - DNA, 22 bp, Homo sapiens
atagcatagtcagcttcgctga

SEQ ID NO: 8170170 - DNA, 22 bp, Homo sapiens
atagcatataagttataaaact

SEQ ID NO: 8170171 - DNA, 21 bp, Homo sapiens
atagaccagtatggataacag

SEQ ID NO: 8170172 - DNA, 22 bp, Homo sapiens
atagggaggaactgagtcagga

SEQ ID NO: 8170173 - DNA, 22 bp, Homo sapiens
atagggcagtcaggccgccact

SEQ ID NO: 8170174 - DNA, 22 bp, Homo sapiens
atagggcccccgtgggtgctca

SEQ ID NO: 8170175 - DNA, 22 bp, Homo sapiens
ataggctttgtgttttgttatc

SEQ ID NO: 8170176 - DNA, 22 bp, Homo sapiens
atagggaggaactgagtcagga

SEQ ID NO: 8170177 - DNA, 22 bp, Homo sapiens
ataggctggagtgcagtggcat

SEQ ID NO: 8170178 - DNA, 22 bp, Homo sapiens
ataggccatttgagggccaggt

SEQ ID NO: 8170179 - DNA, 22 bp, Homo sapiens
ataggcatcacctaggagcttg

SEQ ID NO: 8170180 - DNA, 22 bp, Homo sapiens
atagacacagatctatatatgt

SEQ ID NO: 8170181 - DNA, 22 bp, Homo sapiens
atagacacagatctatatatgt

SEQ ID NO: 8170182 - DNA, 22 bp, Homo sapiens
atagacacatgttattatactt

SEQ ID NO: 8170183 - DNA, 22 bp, Homo sapiens
atagacacatgttattatactt

SEQ ID NO: 8170184 - DNA, 22 bp, Homo sapiens
atagacattataacacagagct

SEQ ID NO: 8170185 - DNA, 22 bp, Homo sapiens
atagacatggtcttttgtcatt

SEQ ID NO: 8170186 - DNA, 22 bp, Homo sapiens
atagacatagccgtaatttatt

SEQ ID NO: 8170187 - DNA, 22 bp, Homo sapiens
atagacatagccgtaatttatt

SEQ ID NO: 8170188 - DNA, 22 bp, Homo sapiens
atagacagctacatagaatata

SEQ ID NO: 8170189 - DNA, 22 bp, Homo sapiens
atagaatttgtacttgtagaac

SEQ ID NO: 8170190 - DNA, 22 bp, Homo sapiens
atagaattctttgaaatttatg

SEQ ID NO: 8170191 - DNA, 22 bp, Homo sapiens
atagaatttgcactaaatctgc

SEQ ID NO: 8170192 - DNA, 22 bp, Homo sapiens
atagaattctttgaaatttatg

SEQ ID NO: 8170193 - DNA, 22 bp, Homo sapiens
atacatgaggaggctggaaaca

SEQ ID NO: 8170194 - DNA, 22 bp, Homo sapiens
atacatgactcacacattctgc

SEQ ID NO: 8170195 - DNA, 22 bp, Homo sapiens
atacatgactcacacattctgc

SEQ ID NO: 8170196 - DNA, 22 bp, Homo sapiens
atacatctcatgtaagagataa

SEQ ID NO: 8170197 - DNA, 22 bp, Homo sapiens
atacatctcatgtaagagataa

SEQ ID NO: 8170198 - DNA, 22 bp, Homo sapiens
atacatcttgtcagattcatgt

SEQ ID NO: 8170199 - DNA, 22 bp, Homo sapiens
atacatcttccttttaaaatgc

SEQ ID NO: 8170200 - DNA, 22 bp, Homo sapiens
atacatgatacttagtacgtag

SEQ ID NO: 8170201 - DNA, 22 bp, Homo sapiens
atacatgatcactgtattataa

SEQ ID NO: 8170202 - DNA, 22 bp, Homo sapiens
ctggagctgccagacgggcaca

SEQ ID NO: 8170203 - DNA, 22 bp, Homo sapiens
ctggagctgccagggctgccgc

SEQ ID NO: 8170204 - DNA, 22 bp, Homo sapiens
ctggagctgccagacgggcaca

SEQ ID NO: 8170205 - DNA, 22 bp, Homo sapiens
ctggagctgctgtccttgggtg

SEQ ID NO: 8170206 - DNA, 22 bp, Homo sapiens
ctggagctgccagggctgccgc

SEQ ID NO: 8170207 - DNA, 22 bp, Homo sapiens
ctggagctggcccaggctggcc

SEQ ID NO: 8170208 - DNA, 22 bp, Homo sapiens
ctggagctggcccaggctggcc

SEQ ID NO: 8170209 - DNA, 22 bp, Homo sapiens
ctggagctggcccaggctggcc

SEQ ID NO: 8170210 - DNA, 22 bp, Homo sapiens
ctggagctggcccaggctggcc

SEQ ID NO: 8170211 - DNA, 22 bp, Homo sapiens
ctggagctggcttccttccact

SEQ ID NO: 8170212 - DNA, 22 bp, Homo sapiens
ctggagctggtatagggacaaa

SEQ ID NO: 8170213 - DNA, 22 bp, Homo sapiens
ctggagctgggctagggtagga

SEQ ID NO: 8170214 - DNA, 22 bp, Homo sapiens
ctggagctggcttccttccact

SEQ ID NO: 8170215 - DNA, 22 bp, Homo sapiens
ctggagctgggctagggtagga

SEQ ID NO: 8170216 - DNA, 22 bp, Homo sapiens
ctggagctgtcttcacaggcct

SEQ ID NO: 8170217 - DNA, 22 bp, Homo sapiens
ctggagctggtatagggacaaa

SEQ ID NO: 8170218 - DNA, 22 bp, Homo sapiens
ctggagctgtcttcacaggcct

SEQ ID NO: 8170219 - DNA, 22 bp, Homo sapiens
ctggagctgtcttcacaggcct

SEQ ID NO: 8170220 - DNA, 22 bp, Homo sapiens
ctggagctggtatagggacaaa

SEQ ID NO: 8170221 - DNA, 22 bp, Homo sapiens
ctggagctggtatagggacaaa

SEQ ID NO: 8170222 - DNA, 19 bp, Homo sapiens
ctggaaagttggcagtgag

SEQ ID NO: 8170223 - DNA, 19 bp, Homo sapiens
ctggaaagttggcagtgag

SEQ ID NO: 8170224 - DNA, 22 bp, Homo sapiens
ctggaaagttcaagataaagct

SEQ ID NO: 8170225 - DNA, 21 bp, Homo sapiens
atacagaaggtggcaaagtac

SEQ ID NO: 8170226 - DNA, 22 bp, Homo sapiens
ctggaaatcactactagtcaat

SEQ ID NO: 8170227 - DNA, 22 bp, Homo sapiens
atacagaagcctgtatttctgg

SEQ ID NO: 8170228 - DNA, 22 bp, Homo sapiens
atacagaagcctgtatttctgg

SEQ ID NO: 8170229 - DNA, 22 bp, Homo sapiens
atacagaagcctgtatttctgg

SEQ ID NO: 8170230 - DNA, 22 bp, Homo sapiens
atacatatatggtacttcctgg

SEQ ID NO: 8170231 - DNA, 22 bp, Homo sapiens
ctggaagactcaatggcctgcc

SEQ ID NO: 8170232 - DNA, 22 bp, Homo sapiens
atacatctcatgtaagagataa

SEQ ID NO: 8170233 - DNA, 22 bp, Homo sapiens
ctggaagacgtttgaagccatg

SEQ ID NO: 8170234 - DNA, 22 bp, Homo sapiens
ctggaagacgtttgaagccatg

SEQ ID NO: 8170235 - DNA, 21 bp, Homo sapiens
ctggaagaagcagcaggattc

SEQ ID NO: 8170236 - DNA, 22 bp, Homo sapiens
ctggaacaagtggccttgcaag

SEQ ID NO: 8170237 - DNA, 22 bp, Homo sapiens
ctggaacccaggcctggaagcc

SEQ ID NO: 8170238 - DNA, 22 bp, Homo sapiens
ctggaacccaggcctggaagcc

SEQ ID NO: 8170239 - DNA, 22 bp, Homo sapiens
ctggaactcctggggagctggt

SEQ ID NO: 8170240 - DNA, 22 bp, Homo sapiens
ctggaagaactccagttctgtg

SEQ ID NO: 8170241 - DNA, 21 bp, Homo sapiens
ctggaagaagcagcaggattc

SEQ ID NO: 8170242 - DNA, 22 bp, Homo sapiens
ctggaagaactccagttctgtg

SEQ ID NO: 8170243 - DNA, 22 bp, Homo sapiens
ctggaagaactccagttctgtg

SEQ ID NO: 8170244 - DNA, 22 bp, Homo sapiens
ataatgtttcagtactgtctgt

SEQ ID NO: 8170245 - DNA, 22 bp, Homo sapiens
ataatgtttcagtactgtctgt

SEQ ID NO: 8170246 - DNA, 22 bp, Homo sapiens
ataatgtttcagtactgtctgt

SEQ ID NO: 8170247 - DNA, 22 bp, Homo sapiens
ataatgtgatatttcatttaca

SEQ ID NO: 8170248 - DNA, 22 bp, Homo sapiens
ataatgttgatgattgtctttg

SEQ ID NO: 8170249 - DNA, 22 bp, Homo sapiens
ataatgtgttcatcttacaatt

SEQ ID NO: 8170250 - DNA, 22 bp, Homo sapiens
ataatggtagatgtccacgcag

SEQ ID NO: 8170251 - DNA, 22 bp, Homo sapiens
ataatggcttctgagtattagg

SEQ ID NO: 8170252 - DNA, 22 bp, Homo sapiens
ctgcctggaaggagcaagggga

SEQ ID NO: 8170253 - DNA, 22 bp, Homo sapiens
ataatcattcacataaggtgct

SEQ ID NO: 8170254 - DNA, 22 bp, Homo sapiens
ataattatctcagacacttgtt

SEQ ID NO: 8170255 - DNA, 22 bp, Homo sapiens
ataattatctcagacacttgtt

SEQ ID NO: 8170256 - DNA, 22 bp, Homo sapiens
ataattatctcagacacttgtt

SEQ ID NO: 8170257 - DNA, 22 bp, Homo sapiens
ataattatctcagacacttgtt

SEQ ID NO: 8170258 - DNA, 22 bp, Homo sapiens
ataattaatttcagtaatctcc

SEQ ID NO: 8170259 - DNA, 20 bp, Homo sapiens
ataattatttacttttgtgc

SEQ ID NO: 8170260 - DNA, 22 bp, Homo sapiens
ataattatctcagacacttgtt

SEQ ID NO: 8170261 - DNA, 22 bp, Homo sapiens
ataattatctcagacacttgtt

SEQ ID NO: 8170262 - DNA, 22 bp, Homo sapiens
ataattcaggttttctggcaca

SEQ ID NO: 8170263 - DNA, 20 bp, Homo sapiens
ataattatttacttttgtgc

SEQ ID NO: 8170264 - DNA, 20 bp, Homo sapiens
ataattatttacttttgtgc

SEQ ID NO: 8170265 - DNA, 22 bp, Homo sapiens
ataattctccaatttttgttgt

SEQ ID NO: 8170266 - DNA, 22 bp, Homo sapiens
ataatttaattttcacagtggt

SEQ ID NO: 8170267 - DNA, 22 bp, Homo sapiens
ataatttaaattagtatgtgat

SEQ ID NO: 8170268 - DNA, 22 bp, Homo sapiens
ataatttaaattagtatgtgat

SEQ ID NO: 8170269 - DNA, 20 bp, Homo sapiens
atacacattcatagaaaaat

SEQ ID NO: 8170270 - DNA, 20 bp, Homo sapiens
atacacattcatagaaaaat

SEQ ID NO: 8170271 - DNA, 20 bp, Homo sapiens
ataatttaccctgcaccact

SEQ ID NO: 8170272 - DNA, 20 bp, Homo sapiens
ataatttaccctgcaccact

SEQ ID NO: 8170273 - DNA, 22 bp, Homo sapiens
ataatttacaactgcttttaat

SEQ ID NO: 8170274 - DNA, 20 bp, Homo sapiens
ataatttaccctgcaccact

SEQ ID NO: 8170275 - DNA, 22 bp, Homo sapiens
atacagaaaatgatgcagagtt

SEQ ID NO: 8170276 - DNA, 22 bp, Homo sapiens
atacagaaaatgatgcagagtt

SEQ ID NO: 8170277 - DNA, 22 bp, Homo sapiens
atacagaaaatgatgcagagtt

SEQ ID NO: 8170278 - DNA, 22 bp, Homo sapiens
atacagaactctcagttgtata

SEQ ID NO: 8170279 - DNA, 22 bp, Homo sapiens
atacagaagaactatagccact

SEQ ID NO: 8170280 - DNA, 22 bp, Homo sapiens
atacagaactctcagttgtata

SEQ ID NO: 8170281 - DNA, 21 bp, Homo sapiens
atacagaacattgatccaaga

SEQ ID NO: 8170282 - DNA, 22 bp, Homo sapiens
aggctcagtctgttcatgcact

SEQ ID NO: 8170283 - DNA, 22 bp, Homo sapiens
aggctcagtctgttcatgcact

SEQ ID NO: 8170284 - DNA, 22 bp, Homo sapiens
aggctcagtctgttcatgcact

SEQ ID NO: 8170285 - DNA, 22 bp, Homo sapiens
aggctcagtgatgtaaaatata

SEQ ID NO: 8170286 - DNA, 22 bp, Homo sapiens
aggctcagtgcaaatcattctg

SEQ ID NO: 8170287 - DNA, 22 bp, Homo sapiens
aggctcagtgatgtaaaatata

SEQ ID NO: 8170288 - DNA, 22 bp, Homo sapiens
aggctcagtcccggcccgcgcc

SEQ ID NO: 8170289 - DNA, 22 bp, Homo sapiens
aggctcagtctgttcatgcact

SEQ ID NO: 8170290 - DNA, 22 bp, Homo sapiens
aggctcagtcccggcccgcgcc

SEQ ID NO: 8170291 - DNA, 22 bp, Homo sapiens
aggctcagtcccggcccgcgcc

SEQ ID NO: 8170292 - DNA, 22 bp, Homo sapiens
aggctcagtatagctggcaagt

SEQ ID NO: 8170293 - DNA, 22 bp, Homo sapiens
aggctcagtatagctggcaagt

SEQ ID NO: 8170294 - DNA, 22 bp, Homo sapiens
aggctcagtatagctggcaagt

SEQ ID NO: 8170295 - DNA, 22 bp, Homo sapiens
aggctcaggtgcctcattcaca

SEQ ID NO: 8170296 - DNA, 22 bp, Homo sapiens
aggctcagtatagctggcaagt

SEQ ID NO: 8170297 - DNA, 22 bp, Homo sapiens
aggctcagcctgggcctagagc

SEQ ID NO: 8170298 - DNA, 17 bp, Homo sapiens
ccaggagcgtgggtctc

SEQ ID NO: 8170299 - DNA, 22 bp, Homo sapiens
ccaggagctggagggtgcagtg

SEQ ID NO: 8170300 - DNA, 22 bp, Homo sapiens
ccaggagctatgtacacactat

SEQ ID NO: 8170301 - DNA, 22 bp, Homo sapiens
ccaggagctggagggtgcagtg

SEQ ID NO: 8170302 - DNA, 22 bp, Homo sapiens
ccaggagctggagggtgcagtg

SEQ ID NO: 8170303 - DNA, 22 bp, Homo sapiens
ccaggagctggcatgtggagag

SEQ ID NO: 8170304 - DNA, 22 bp, Homo sapiens
ccaggaggaaagaccagcccat

SEQ ID NO: 8170305 - DNA, 22 bp, Homo sapiens
ccaggaggaaattctaaaggta

SEQ ID NO: 8170306 - DNA, 22 bp, Homo sapiens
aggctcagttctgtggtgagcc

SEQ ID NO: 8170307 - DNA, 22 bp, Homo sapiens
aggctcagttctgtggtgagcc

SEQ ID NO: 8170308 - DNA, 22 bp, Homo sapiens
aggctcagttctgtggtgagcc

SEQ ID NO: 8170309 - DNA, 22 bp, Homo sapiens
aggctcagttctgtggtgagcc

SEQ ID NO: 8170310 - DNA, 22 bp, Homo sapiens
aggctcagttctgtggtgagcc

SEQ ID NO: 8170311 - DNA, 22 bp, Homo sapiens
aggctcagttcacgtcaacttt

SEQ ID NO: 8170312 - DNA, 22 bp, Homo sapiens
aggctcagttcacgtcaacttt

SEQ ID NO: 8170313 - DNA, 22 bp, Homo sapiens
aggctcagtttggtttccattg

SEQ ID NO: 8170314 - DNA, 22 bp, Homo sapiens
aggctccaaattaccaagctct

SEQ ID NO: 8170315 - DNA, 22 bp, Homo sapiens
aggctccaaattaccaagctct

SEQ ID NO: 8170316 - DNA, 22 bp, Homo sapiens
aggctccaccagtcaggtgcat

SEQ ID NO: 8170317 - DNA, 23 bp, Homo sapiens
aggctccacatgggcactttgca

SEQ ID NO: 8170318 - DNA, 22 bp, Homo sapiens
aggctccaccagtcaggtgcat

SEQ ID NO: 8170319 - DNA, 22 bp, Homo sapiens
aggctccaccagtcaggtgcat

SEQ ID NO: 8170320 - DNA, 22 bp, Homo sapiens
aggctccaccccgccagacctt

SEQ ID NO: 8170321 - DNA, 22 bp, Homo sapiens
aggctccaccagtcaggtgcat

SEQ ID NO: 8170322 - DNA, 22 bp, Homo sapiens
aggctccaccctacagagctcc

SEQ ID NO: 8170323 - DNA, 22 bp, Homo sapiens
aggctccaccctacagagctcc

SEQ ID NO: 8170324 - DNA, 22 bp, Homo sapiens
aggctccaccctacagagctcc

SEQ ID NO: 8170325 - DNA, 22 bp, Homo sapiens
aggctccaccctacagagctcc

SEQ ID NO: 8170326 - DNA, 22 bp, Homo sapiens
ccaggctgtaaacaccttcaaa

SEQ ID NO: 8170327 - DNA, 22 bp, Homo sapiens
ccaggctgtaaacaccttcaaa

SEQ ID NO: 8170328 - DNA, 22 bp, Homo sapiens
ccagggaaggctctgcctgctt

SEQ ID NO: 8170329 - DNA, 22 bp, Homo sapiens
ccagggagcccacaggacaatg

SEQ ID NO: 8170330 - DNA, 22 bp, Homo sapiens
ccagggagcccacaggacaatg

SEQ ID NO: 8170331 - DNA, 22 bp, Homo sapiens
ccagggagcccacaggacaatg

SEQ ID NO: 8170332 - DNA, 22 bp, Homo sapiens
ccagggagcctggtgtgtcagc

SEQ ID NO: 8170333 - DNA, 22 bp, Homo sapiens
ccagggagcggggctgggtctc

SEQ ID NO: 8170334 - DNA, 22 bp, Homo sapiens
ccagggaaggctgctggctgtg

SEQ ID NO: 8170335 - DNA, 22 bp, Homo sapiens
ccagggaatcaggcagaagtca

SEQ ID NO: 8170336 - DNA, 22 bp, Homo sapiens
ccagggaagtcacattgtctag

SEQ ID NO: 8170337 - DNA, 22 bp, Homo sapiens
ccagggaatgtgggatgactct

SEQ ID NO: 8170338 - DNA, 22 bp, Homo sapiens
ccagggaatcaggcagaagtca

SEQ ID NO: 8170339 - DNA, 22 bp, Homo sapiens
ccagggaatctctgagtgtgtt

SEQ ID NO: 8170340 - DNA, 17 bp, Homo sapiens
aggctcctcctaaggtc

SEQ ID NO: 8170341 - DNA, 22 bp, Homo sapiens
aggctcctcggggctgacggcg

SEQ ID NO: 8170342 - DNA, 22 bp, Homo sapiens
aggctcctgagaggcagaggct

SEQ ID NO: 8170343 - DNA, 22 bp, Homo sapiens
aggctcctgagaggcagaggct

SEQ ID NO: 8170344 - DNA, 22 bp, Homo sapiens
aggctcctatcgctttcagcaa

SEQ ID NO: 8170345 - DNA, 20 bp, Homo sapiens
aggctcctccaggatgtgtg

SEQ ID NO: 8170346 - DNA, 20 bp, Homo sapiens
aggctcctccaggatgtgtg

SEQ ID NO: 8170347 - DNA, 22 bp, Homo sapiens
aggctcctagcctgtggctggt

SEQ ID NO: 8170348 - DNA, 22 bp, Homo sapiens
aggctcctagcctgtggctggt

SEQ ID NO: 8170349 - DNA, 22 bp, Homo sapiens
aggctcctagcctgtggctggt

SEQ ID NO: 8170350 - DNA, 17 bp, Homo sapiens
ccagggaggggccgcgc

SEQ ID NO: 8170351 - DNA, 17 bp, Homo sapiens
ccagggaggggccgcgc

SEQ ID NO: 8170352 - DNA, 22 bp, Homo sapiens
ccagggagcggggctgggtctc

SEQ ID NO: 8170353 - DNA, 22 bp, Homo sapiens
ccagggtgctctgtggcgtcgc

SEQ ID NO: 8170354 - DNA, 22 bp, Homo sapiens
ccagggtgctctgtggcgtcgc

SEQ ID NO: 8170355 - DNA, 22 bp, Homo sapiens
ccagggtgagtgtcatgggtta

SEQ ID NO: 8170356 - DNA, 22 bp, Homo sapiens
ccagggtgagtgtcatgggtta

SEQ ID NO: 8170357 - DNA, 22 bp, Homo sapiens
ccagggtgagtgtcatgggtta

SEQ ID NO: 8170358 - DNA, 22 bp, Homo sapiens
ccagggtgaggaggctcccacg

SEQ ID NO: 8170359 - DNA, 22 bp, Homo sapiens
ccagggtgaggaggctcccacg

SEQ ID NO: 8170360 - DNA, 22 bp, Homo sapiens
ccagggtgagtgtcatgggtta

SEQ ID NO: 8170361 - DNA, 22 bp, Homo sapiens
ccagggtgaggaggctcccacg

SEQ ID NO: 8170362 - DNA, 22 bp, Homo sapiens
ccagggtgaggaggctcccacg

SEQ ID NO: 8170363 - DNA, 22 bp, Homo sapiens
ccagggtgaccagctggcctag

SEQ ID NO: 8170364 - DNA, 22 bp, Homo sapiens
ccagggtcttcgaggcagcaat

SEQ ID NO: 8170365 - DNA, 22 bp, Homo sapiens
ccagggtcttggagaggagtgc

SEQ ID NO: 8170366 - DNA, 22 bp, Homo sapiens
ccagggtgaccctcccggtggc

SEQ ID NO: 8170367 - DNA, 22 bp, Homo sapiens
ccagggtgaccagctggcctag

SEQ ID NO: 8170368 - DNA, 22 bp, Homo sapiens
ccagggtgagaaaaggctggat

SEQ ID NO: 8170369 - DNA, 22 bp, Homo sapiens
ccagggtgagaaaaggctggat

SEQ ID NO: 8170370 - DNA, 22 bp, Homo sapiens
ccagggtgaccctcccggtggc

SEQ ID NO: 8170371 - DNA, 22 bp, Homo sapiens
aggctccttcacagcactcgcc

SEQ ID NO: 8170372 - DNA, 22 bp, Homo sapiens
aggctccttgctcacaggctca

SEQ ID NO: 8170373 - DNA, 22 bp, Homo sapiens
aggctccttgctcacaggctca

SEQ ID NO: 8170374 - DNA, 22 bp, Homo sapiens
aggctccttgctcacaggctca

SEQ ID NO: 8170375 - DNA, 22 bp, Homo sapiens
ccagggcttaacttttcaggag

SEQ ID NO: 8170376 - DNA, 22 bp, Homo sapiens
ccagggcttcagaggttttggc

SEQ ID NO: 8170377 - DNA, 22 bp, Homo sapiens
aggctcctgggtgtggccgcca

SEQ ID NO: 8170378 - DNA, 20 bp, Homo sapiens
aggctcctgtacctgaggaa

SEQ ID NO: 8170379 - DNA, 20 bp, Homo sapiens
aggctcctgtacctgaggaa

SEQ ID NO: 8170380 - DNA, 22 bp, Homo sapiens
aggctcctgcaggtgaggtgct

SEQ ID NO: 8170381 - DNA, 22 bp, Homo sapiens
aggctcctgcaggtgaggtgct

SEQ ID NO: 8170382 - DNA, 22 bp, Homo sapiens
aggctcctgggtgtggccgcca

SEQ ID NO: 8170383 - DNA, 22 bp, Homo sapiens
aggctcctgcaggccttgtagg

SEQ ID NO: 8170384 - DNA, 22 bp, Homo sapiens
aggctcctgagaggcagaggct

SEQ ID NO: 8170385 - DNA, 22 bp, Homo sapiens
aggctcctgagaggcagaggct

SEQ ID NO: 8170386 - DNA, 22 bp, Homo sapiens
aggctgaggtgtgctgtgatcg

SEQ ID NO: 8170387 - DNA, 22 bp, Homo sapiens
aggctgaggtgtgctgtgatcg

SEQ ID NO: 8170388 - DNA, 22 bp, Homo sapiens
aggctgaggtgtgctgtgatcg

SEQ ID NO: 8170389 - DNA, 22 bp, Homo sapiens
aggctgaggtaggaggatcgct

SEQ ID NO: 8170390 - DNA, 22 bp, Homo sapiens
aggctgaggtaggaggatcgct

SEQ ID NO: 8170391 - DNA, 22 bp, Homo sapiens
aggctgaggtaggaggatcgct

SEQ ID NO: 8170392 - DNA, 22 bp, Homo sapiens
aggctgaggtaggaggatcgct

SEQ ID NO: 8170393 - DNA, 22 bp, Homo sapiens
aggctgaggtaggaggatcgct

SEQ ID NO: 8170394 - DNA, 22 bp, Homo sapiens
aggctgagtcaagttagggtga

SEQ ID NO: 8170395 - DNA, 22 bp, Homo sapiens
aggctgagtcaagttagggtga

SEQ ID NO: 8170396 - DNA, 22 bp, Homo sapiens
aggctgaggtgtgctgtgatcg

SEQ ID NO: 8170397 - DNA, 22 bp, Homo sapiens
aggctgaggtgtgctgtgatcg

SEQ ID NO: 8170398 - DNA, 22 bp, Homo sapiens
aggctgaggtgtgctgtgatcg

SEQ ID NO: 8170399 - DNA, 22 bp, Homo sapiens
aggctgaggtgtgctgtgatcg

SEQ ID NO: 8170400 - DNA, 22 bp, Homo sapiens
aggctgagtcgggaggatcact

SEQ ID NO: 8170401 - DNA, 22 bp, Homo sapiens
aggctgagtcaagttagggtga

SEQ ID NO: 8170402 - DNA, 22 bp, Homo sapiens
aggctgagtcgggaggatcact

SEQ ID NO: 8170403 - DNA, 22 bp, Homo sapiens
aggctgagtcaagttagggtga

SEQ ID NO: 8170404 - DNA, 22 bp, Homo sapiens
aggctgagtcgggaggatcact

SEQ ID NO: 8170405 - DNA, 22 bp, Homo sapiens
aggctgagtcgggaggatcact

SEQ ID NO: 8170406 - DNA, 22 bp, Homo sapiens
aggctgagtcgggaggatcact

SEQ ID NO: 8170407 - DNA, 18 bp, Homo sapiens
ccatggctccctcctgcc

SEQ ID NO: 8170408 - DNA, 22 bp, Homo sapiens
ccatggctccttgccctgtagc

SEQ ID NO: 8170409 - DNA, 19 bp, Homo sapiens
ccatgcagcctgggggcag

SEQ ID NO: 8170410 - DNA, 22 bp, Homo sapiens
ccatgcacaccagcaggcagac

SEQ ID NO: 8170411 - DNA, 22 bp, Homo sapiens
ccatgcacaccagcaggcagac

SEQ ID NO: 8170412 - DNA, 22 bp, Homo sapiens
ccatggcttggaaagggaggtg

SEQ ID NO: 8170413 - DNA, 22 bp, Homo sapiens
ccatggcttttgagtctcaaga

SEQ ID NO: 8170414 - DNA, 22 bp, Homo sapiens
ccatggcttttgagtctcaaga

SEQ ID NO: 8170415 - DNA, 22 bp, Homo sapiens
ccatggcttttgagtctcaaga

SEQ ID NO: 8170416 - DNA, 22 bp, Homo sapiens
ccatggcttctttctctgccag

SEQ ID NO: 8170417 - DNA, 22 bp, Homo sapiens
ccatggcttacagatggagcat

SEQ ID NO: 8170418 - DNA, 22 bp, Homo sapiens
ccatggctgcaattcttctgga

SEQ ID NO: 8170419 - DNA, 22 bp, Homo sapiens
ccatggctgcaattcttctgga

SEQ ID NO: 8170420 - DNA, 22 bp, Homo sapiens
ccatggcttacagatggagcat

SEQ ID NO: 8170421 - DNA, 22 bp, Homo sapiens
ccatggcttacagatggagcat

SEQ ID NO: 8170422 - DNA, 22 bp, Homo sapiens
aggctctgtgcagcctgcatct

SEQ ID NO: 8170423 - DNA, 22 bp, Homo sapiens
aggctctgttattctagagggc

SEQ ID NO: 8170424 - DNA, 22 bp, Homo sapiens
aggctctgtgcatcctccccaa

SEQ ID NO: 8170425 - DNA, 22 bp, Homo sapiens
aggctctgtgcatcctccccaa

SEQ ID NO: 8170426 - DNA, 22 bp, Homo sapiens
aggctgaggcgggtagatcacc

SEQ ID NO: 8170427 - DNA, 22 bp, Homo sapiens
aggctgaggcgggtagatcacc

SEQ ID NO: 8170428 - DNA, 22 bp, Homo sapiens
aggctgaggggcgagggaccct

SEQ ID NO: 8170429 - DNA, 22 bp, Homo sapiens
aggctgaggcgggtagatcacc

SEQ ID NO: 8170430 - DNA, 22 bp, Homo sapiens
aggctgaggggcgagggaccct

SEQ ID NO: 8170431 - DNA, 20 bp, Homo sapiens
aggctgagggtgattgtgtc

SEQ ID NO: 8170432 - DNA, 22 bp, Homo sapiens
aggctgaggggcgagggaccct

SEQ ID NO: 8170433 - DNA, 22 bp, Homo sapiens
aggctgaggggcgagggaccct

SEQ ID NO: 8170434 - DNA, 22 bp, Homo sapiens
aggctgaggggcgagggaccct

SEQ ID NO: 8170435 - DNA, 22 bp, Homo sapiens
aggctgaggggcgagggaccct

SEQ ID NO: 8170436 - DNA, 22 bp, Homo sapiens
aggctgaggggcgagggaccct

SEQ ID NO: 8170437 - DNA, 22 bp, Homo sapiens
aggctgaggtaggaggatcgct

SEQ ID NO: 8170438 - DNA, 22 bp, Homo sapiens
aggctgaggtaggaggatcgct

SEQ ID NO: 8170439 - DNA, 20 bp, Homo sapiens
aggctgagggtgattgtgtc

SEQ ID NO: 8170440 - DNA, 20 bp, Homo sapiens
aggctgagggtgattgtgtc

SEQ ID NO: 8170441 - DNA, 20 bp, Homo sapiens
aggctgagggtgattgtgtc

SEQ ID NO: 8170442 - DNA, 20 bp, Homo sapiens
aggctgagggtgattgtgtc

SEQ ID NO: 8170443 - DNA, 20 bp, Homo sapiens
aggctgagggtgattgtgtc

SEQ ID NO: 8170444 - DNA, 20 bp, Homo sapiens
aggctgagggtgattgtgtc

SEQ ID NO: 8170445 - DNA, 22 bp, Homo sapiens
aggctctgtgatccacaatgag

SEQ ID NO: 8170446 - DNA, 22 bp, Homo sapiens
aggctctgtgatccacaatgag

SEQ ID NO: 8170447 - DNA, 22 bp, Homo sapiens
aggctctgtgatgtgccaggca

SEQ ID NO: 8170448 - DNA, 22 bp, Homo sapiens
aggctctgtgatgtgccaggca

SEQ ID NO: 8170449 - DNA, 22 bp, Homo sapiens
aggctctgtgatgtgccaggca

SEQ ID NO: 8170450 - DNA, 22 bp, Homo sapiens
aggctctgtgatgtgccaggca

SEQ ID NO: 8170451 - DNA, 22 bp, Homo sapiens
aggctctgtgatccacaatgag

SEQ ID NO: 8170452 - DNA, 22 bp, Homo sapiens
aggctctgtgatgtgccaggca

SEQ ID NO: 8170453 - DNA, 22 bp, Homo sapiens
aggctctgtgatgtgccaggca

SEQ ID NO: 8170454 - DNA, 22 bp, Homo sapiens
aggctctgtgatgtgccaggca

SEQ ID NO: 8170455 - DNA, 22 bp, Homo sapiens
aggctctgtgcagcctgcatct

SEQ ID NO: 8170456 - DNA, 22 bp, Homo sapiens
aggctctgtgcagcctgcatct

SEQ ID NO: 8170457 - DNA, 22 bp, Homo sapiens
aggctctgtgcagcctgcatct

SEQ ID NO: 8170458 - DNA, 22 bp, Homo sapiens
ccagggtggaggctggatggag

SEQ ID NO: 8170459 - DNA, 22 bp, Homo sapiens
ccagggtgctctgtggcgtcgc

SEQ ID NO: 8170460 - DNA, 22 bp, Homo sapiens
ccagggtggaggctggatggag

SEQ ID NO: 8170461 - DNA, 21 bp, Homo sapiens
aggctctgtgaatatgtttcc

SEQ ID NO: 8170462 - DNA, 21 bp, Homo sapiens
aggctctgtgaatatgtttcc

SEQ ID NO: 8170463 - DNA, 22 bp, Homo sapiens
aggctctgtgacaatcaagctg

SEQ ID NO: 8170464 - DNA, 22 bp, Homo sapiens
aggctctgtgacaatcaagctg

SEQ ID NO: 8170465 - DNA, 22 bp, Homo sapiens
aggctctgtgacaatcaagctg

SEQ ID NO: 8170466 - DNA, 22 bp, Homo sapiens
aggctctgtgactaaagaggat

SEQ ID NO: 8170467 - DNA, 22 bp, Homo sapiens
aggctctgtgactaaagaggat

SEQ ID NO: 8170468 - DNA, 22 bp, Homo sapiens
aggctctgtgactaaagaggat

SEQ ID NO: 8170469 - DNA, 22 bp, Homo sapiens
aggctctgtgactaaagaggat

SEQ ID NO: 8170470 - DNA, 22 bp, Homo sapiens
aggctctgtgacaatcaagctg

SEQ ID NO: 8170471 - DNA, 22 bp, Homo sapiens
aggctctgtgacaatcaagctg

SEQ ID NO: 8170472 - DNA, 22 bp, Homo sapiens
cccagagatgtcctgagtgata

SEQ ID NO: 8170473 - DNA, 23 bp, Homo sapiens
cccagagcacagcctccagatgc

SEQ ID NO: 8170474 - DNA, 23 bp, Homo sapiens
cccagagcacagcctccagatgc

SEQ ID NO: 8170475 - DNA, 23 bp, Homo sapiens
cccagagcacagcctccagatgc

SEQ ID NO: 8170476 - DNA, 19 bp, Homo sapiens
cccagagcatcctgaactt

SEQ ID NO: 8170477 - DNA, 22 bp, Homo sapiens
cccagagcatgtgctgcctttg

SEQ ID NO: 8170478 - DNA, 22 bp, Homo sapiens
cccagagatgtcctgagtgata

SEQ ID NO: 8170479 - DNA, 20 bp, Homo sapiens
cccagagcactttttcatgt

SEQ ID NO: 8170480 - DNA, 19 bp, Homo sapiens
cccagagcatcctgaactt

SEQ ID NO: 8170481 - DNA, 22 bp, Homo sapiens
cccagagcataacgtatcttga

SEQ ID NO: 8170482 - DNA, 22 bp, Homo sapiens
cccagagccgctcccctacttc

SEQ ID NO: 8170483 - DNA, 22 bp, Homo sapiens
cccagagccgctcccctacttc

SEQ ID NO: 8170484 - DNA, 22 bp, Homo sapiens
cccagagccgctcccctacttc

SEQ ID NO: 8170485 - DNA, 20 bp, Homo sapiens
cccagagccatagccagaca

SEQ ID NO: 8170486 - DNA, 22 bp, Homo sapiens
cccagagcatgtgctgcctttg

SEQ ID NO: 8170487 - DNA, 22 bp, Homo sapiens
cccagagcatgtgctgcctttg

SEQ ID NO: 8170488 - DNA, 20 bp, Homo sapiens
cccagagccatagccagaca

SEQ ID NO: 8170489 - DNA, 20 bp, Homo sapiens
cccagagccatagccagaca

SEQ ID NO: 8170490 - DNA, 20 bp, Homo sapiens
cccagagccatagccagaca

SEQ ID NO: 8170491 - DNA, 20 bp, Homo sapiens
cccagagccatagccagaca

SEQ ID NO: 8170492 - DNA, 20 bp, Homo sapiens
cccagagccatagccagaca

SEQ ID NO: 8170493 - DNA, 22 bp, Homo sapiens
cccagagccggtggtgctcaca

SEQ ID NO: 8170494 - DNA, 22 bp, Homo sapiens
cccagagccggtggtgctcaca

SEQ ID NO: 8170495 - DNA, 22 bp, Homo sapiens
cccagagccggtggtgctcaca

SEQ ID NO: 8170496 - DNA, 22 bp, Homo sapiens
cccagagccggtggtgctcaca

SEQ ID NO: 8170497 - DNA, 21 bp, Homo sapiens
cccagagcctagggagggcac

SEQ ID NO: 8170498 - DNA, 21 bp, Homo sapiens
cccagagcctagggagggcac

SEQ ID NO: 8170499 - DNA, 21 bp, Homo sapiens
cccagagcctagggagggcac

SEQ ID NO: 8170500 - DNA, 22 bp, Homo sapiens
aggctggcgtcaggggctgtac

SEQ ID NO: 8170501 - DNA, 22 bp, Homo sapiens
aggctggcgtcaggggctgtac

SEQ ID NO: 8170502 - DNA, 17 bp, Homo sapiens
aggctggctcacaggga

SEQ ID NO: 8170503 - DNA, 17 bp, Homo sapiens
aggctggctcacaggga

SEQ ID NO: 8170504 - DNA, 17 bp, Homo sapiens
aggctggctcacaggga

SEQ ID NO: 8170505 - DNA, 17 bp, Homo sapiens
aggctggctcacaggga

SEQ ID NO: 8170506 - DNA, 17 bp, Homo sapiens
aggctggctcacaggga

SEQ ID NO: 8170507 - DNA, 17 bp, Homo sapiens
aggctggctcacaggga

SEQ ID NO: 8170508 - DNA, 22 bp, Homo sapiens
aggctggctgacttctgaagca

SEQ ID NO: 8170509 - DNA, 22 bp, Homo sapiens
aggctggctgaaaaacaccctt

SEQ ID NO: 8170510 - DNA, 22 bp, Homo sapiens
aggctggctgaaaaacaccctt

SEQ ID NO: 8170511 - DNA, 22 bp, Homo sapiens
aggctggctcggcttttctgtc

SEQ ID NO: 8170512 - DNA, 22 bp, Homo sapiens
aggctggctcggcttttctgtc

SEQ ID NO: 8170513 - DNA, 22 bp, Homo sapiens
aggctggctcggcttttctgtc

SEQ ID NO: 8170514 - DNA, 22 bp, Homo sapiens
aggctgcctcgtgagctcgctg

SEQ ID NO: 8170515 - DNA, 19 bp, Homo sapiens
aggctgcctcaccctccct

SEQ ID NO: 8170516 - DNA, 22 bp, Homo sapiens
aggctgcctaggttcaacacct

SEQ ID NO: 8170517 - DNA, 22 bp, Homo sapiens
aggctgcctaggttcaacacct

SEQ ID NO: 8170518 - DNA, 20 bp, Homo sapiens
aggctgcctaaggctctgca

SEQ ID NO: 8170519 - DNA, 20 bp, Homo sapiens
aggctgcctaaggctctgca

SEQ ID NO: 8170520 - DNA, 20 bp, Homo sapiens
aggctgcctaaggctctgca

SEQ ID NO: 8170521 - DNA, 20 bp, Homo sapiens
aggctgcctaaggctctgca

SEQ ID NO: 8170522 - DNA, 22 bp, Homo sapiens
ccatgtacatgaacacggcggc

SEQ ID NO: 8170523 - DNA, 22 bp, Homo sapiens
ccatgtgcttgctctggcacct

SEQ ID NO: 8170524 - DNA, 22 bp, Homo sapiens
ccatgggcactgggtggaggta

SEQ ID NO: 8170525 - DNA, 22 bp, Homo sapiens
ccatgggaattgggaggtccca

SEQ ID NO: 8170526 - DNA, 22 bp, Homo sapiens
aggctgcctggctgtgagtgaa

SEQ ID NO: 8170527 - DNA, 22 bp, Homo sapiens
aggctgcctcttttgagagggt

SEQ ID NO: 8170528 - DNA, 22 bp, Homo sapiens
aggctgcctcttttgagagggt

SEQ ID NO: 8170529 - DNA, 22 bp, Homo sapiens
aggctgcctctgcaggatccct

SEQ ID NO: 8170530 - DNA, 22 bp, Homo sapiens
aggctgcctctgcaggatccct

SEQ ID NO: 8170531 - DNA, 22 bp, Homo sapiens
aggctgcctctgcaggatccct

SEQ ID NO: 8170532 - DNA, 22 bp, Homo sapiens
aggctgcctcgtgagctcgctg

SEQ ID NO: 8170533 - DNA, 22 bp, Homo sapiens
aggctgcctcgtgagctcgctg

SEQ ID NO: 8170534 - DNA, 22 bp, Homo sapiens
aggctgcctcgtgagctcgctg

SEQ ID NO: 8170535 - DNA, 22 bp, Homo sapiens
aggctgcctgttccaatctcct

SEQ ID NO: 8170536 - DNA, 22 bp, Homo sapiens
aggctgcctgttccaatctcct

SEQ ID NO: 8170537 - DNA, 22 bp, Homo sapiens
aggctgcctgttccaatctcct

SEQ ID NO: 8170538 - DNA, 22 bp, Homo sapiens
aggctgcgttagcctcactccc

SEQ ID NO: 8170539 - DNA, 22 bp, Homo sapiens
aggctgctataaacattcccgt

SEQ ID NO: 8170540 - DNA, 22 bp, Homo sapiens
aggctgctcacctccctgtctg

SEQ ID NO: 8170541 - DNA, 22 bp, Homo sapiens
aggctgctataaacattcccgt

SEQ ID NO: 8170542 - DNA, 18 bp, Homo sapiens
cccactgtccccacaggc

SEQ ID NO: 8170543 - DNA, 16 bp, Homo sapiens
cccactgtctggtctt

SEQ ID NO: 8170544 - DNA, 22 bp, Homo sapiens
cccactgtctgttcccagggcc

SEQ ID NO: 8170545 - DNA, 22 bp, Homo sapiens
ccagctttaggttgcctgccag

SEQ ID NO: 8170546 - DNA, 22 bp, Homo sapiens
ccagctttatagcttcaaagga

SEQ ID NO: 8170547 - DNA, 22 bp, Homo sapiens
ccagctttatcaagtctgagct

SEQ ID NO: 8170548 - DNA, 22 bp, Homo sapiens
ccagctttcatatcatgaggta

SEQ ID NO: 8170549 - DNA, 22 bp, Homo sapiens
ccagctttccagggttgactgg

SEQ ID NO: 8170550 - DNA, 21 bp, Homo sapiens
ccagctttcccaagtcccttt

SEQ ID NO: 8170551 - DNA, 22 bp, Homo sapiens
ccagcttctctctgatgcagct

SEQ ID NO: 8170552 - DNA, 19 bp, Homo sapiens
ccagctggcctgggacctc

SEQ ID NO: 8170553 - DNA, 22 bp, Homo sapiens
ccagcttctctctgatgcagct

SEQ ID NO: 8170554 - DNA, 22 bp, Homo sapiens
ccagcttctctctgatgcagct

SEQ ID NO: 8170555 - DNA, 22 bp, Homo sapiens
ccagcttctctgttccagcccc

SEQ ID NO: 8170556 - DNA, 22 bp, Homo sapiens
ccagcttctctgttccagcccc

SEQ ID NO: 8170557 - DNA, 19 bp, Homo sapiens
ccagctggcctgggacctc

SEQ ID NO: 8170558 - DNA, 22 bp, Homo sapiens
aggcccagctggacaaactgct

SEQ ID NO: 8170559 - DNA, 22 bp, Homo sapiens
aggcccagcccgtcctcgtgct

SEQ ID NO: 8170560 - DNA, 22 bp, Homo sapiens
aggcccagcccgtcctcgtgct

SEQ ID NO: 8170561 - DNA, 22 bp, Homo sapiens
aggcccagcccgtcctcgtgct

SEQ ID NO: 8170562 - DNA, 19 bp, Homo sapiens
aggcccagcgctgggggct

SEQ ID NO: 8170563 - DNA, 19 bp, Homo sapiens
aggcccagcgctgggggct

SEQ ID NO: 8170564 - DNA, 22 bp, Homo sapiens
aggcccagctggacaaactgct

SEQ ID NO: 8170565 - DNA, 19 bp, Homo sapiens
aggcccagcgctgggggct

SEQ ID NO: 8170566 - DNA, 22 bp, Homo sapiens
aggcccagagcaggaaagggtt

SEQ ID NO: 8170567 - DNA, 22 bp, Homo sapiens
aggcccagagcaggaaagggtt

SEQ ID NO: 8170568 - DNA, 21 bp, Homo sapiens
aggcccagagtcttgggggga

SEQ ID NO: 8170569 - DNA, 22 bp, Homo sapiens
aggcccagagagccagttagtg

SEQ ID NO: 8170570 - DNA, 22 bp, Homo sapiens
ccagcctggactgggtcttgtg

SEQ ID NO: 8170571 - DNA, 22 bp, Homo sapiens
ccagcctggactgggtcttgtg

SEQ ID NO: 8170572 - DNA, 22 bp, Homo sapiens
ccagcctggactgggtcttgtg

SEQ ID NO: 8170573 - DNA, 22 bp, Homo sapiens
ccagcctccatgtagatagctg

SEQ ID NO: 8170574 - DNA, 22 bp, Homo sapiens
ccagcctccatgtagatagctg

SEQ ID NO: 8170575 - DNA, 22 bp, Homo sapiens
ccagcctccatgtagatagctg

SEQ ID NO: 8170576 - DNA, 19 bp, Homo sapiens
ccagcctctcttccacccc

SEQ ID NO: 8170577 - DNA, 19 bp, Homo sapiens
ccagcctctcttccacccc

SEQ ID NO: 8170578 - DNA, 22 bp, Homo sapiens
ccagcctcatcgcctgcctgtc

SEQ ID NO: 8170579 - DNA, 22 bp, Homo sapiens
ccagcctcatcgcctgcctgtc

SEQ ID NO: 8170580 - DNA, 22 bp, Homo sapiens
ccagcctcatcgcctgcctgtc

SEQ ID NO: 8170581 - DNA, 22 bp, Homo sapiens
ccagcctccatgtagatagctg

SEQ ID NO: 8170582 - DNA, 22 bp, Homo sapiens
ccagcctccatgtagatagctg

SEQ ID NO: 8170583 - DNA, 23 bp, Homo sapiens
ccagcctctgggtcttcatccag

SEQ ID NO: 8170584 - DNA, 23 bp, Homo sapiens
ccagcctctgggtcttcatccag

SEQ ID NO: 8170585 - DNA, 22 bp, Homo sapiens
ccagcctgaaatgcctcatcct

SEQ ID NO: 8170586 - DNA, 22 bp, Homo sapiens
ccagcctgaaatgcctcatcct

SEQ ID NO: 8170587 - DNA, 22 bp, Homo sapiens
ccagcctgaaatgcctcatcct

SEQ ID NO: 8170588 - DNA, 22 bp, Homo sapiens
ccagcctgaaatgcctcatcct

SEQ ID NO: 8170589 - DNA, 22 bp, Homo sapiens
ccagcctcatcatattcctgct

SEQ ID NO: 8170590 - DNA, 22 bp, Homo sapiens
ccagcctcatcgcctgcctgtc

SEQ ID NO: 8170591 - DNA, 22 bp, Homo sapiens
ccagccctgccagagagagctg

SEQ ID NO: 8170592 - DNA, 22 bp, Homo sapiens
aggccagatgtcgggctagaag

SEQ ID NO: 8170593 - DNA, 22 bp, Homo sapiens
ccagccctgccagagagagctg

SEQ ID NO: 8170594 - DNA, 22 bp, Homo sapiens
aggccagatgtcgggctagaag

SEQ ID NO: 8170595 - DNA, 22 bp, Homo sapiens
ccagccctgccagagagagctg

SEQ ID NO: 8170596 - DNA, 22 bp, Homo sapiens
aggccagatgtcgggctagaag

SEQ ID NO: 8170597 - DNA, 22 bp, Homo sapiens
aggccagatgtcgggctagaag

SEQ ID NO: 8170598 - DNA, 22 bp, Homo sapiens
aggccagatattgtgctaccca

SEQ ID NO: 8170599 - DNA, 22 bp, Homo sapiens
aggccagatattgtgctaccca

SEQ ID NO: 8170600 - DNA, 17 bp, Homo sapiens
aggccagatgaggcaag

SEQ ID NO: 8170601 - DNA, 17 bp, Homo sapiens
aggccagatgaggcaag

SEQ ID NO: 8170602 - DNA, 17 bp, Homo sapiens
aggccagatgaggcaag

SEQ ID NO: 8170603 - DNA, 17 bp, Homo sapiens
aggccagatgaggcaag

SEQ ID NO: 8170604 - DNA, 22 bp, Homo sapiens
aggccagagttaaggagaacag

SEQ ID NO: 8170605 - DNA, 22 bp, Homo sapiens
aggccagagttaaggagaacag

SEQ ID NO: 8170606 - DNA, 22 bp, Homo sapiens
aggccagagttaaggagaacag

SEQ ID NO: 8170607 - DNA, 22 bp, Homo sapiens
aggccctggcccccagagattc

SEQ ID NO: 8170608 - DNA, 22 bp, Homo sapiens
aggccctggcccccagagattc

SEQ ID NO: 8170609 - DNA, 22 bp, Homo sapiens
aggccctggcccccagagattc

SEQ ID NO: 8170610 - DNA, 22 bp, Homo sapiens
aggccctggcccccagagattc

SEQ ID NO: 8170611 - DNA, 22 bp, Homo sapiens
aggccctggcactgcctgggag

SEQ ID NO: 8170612 - DNA, 22 bp, Homo sapiens
aggccctggcactgcctgggag

SEQ ID NO: 8170613 - DNA, 22 bp, Homo sapiens
aggccctggcactgcctgggag

SEQ ID NO: 8170614 - DNA, 22 bp, Homo sapiens
aggccctggcactgcctgggag

SEQ ID NO: 8170615 - DNA, 22 bp, Homo sapiens
ccagctttctcagaggcttcta

SEQ ID NO: 8170616 - DNA, 22 bp, Homo sapiens
ccagctttcctgcgagttgatt

SEQ ID NO: 8170617 - DNA, 20 bp, Homo sapiens
ccagctttccctgcagcatc

SEQ ID NO: 8170618 - DNA, 22 bp, Homo sapiens
ccagcttttagtgggcttatta

SEQ ID NO: 8170619 - DNA, 22 bp, Homo sapiens
ccagctttggagtgttgttgct

SEQ ID NO: 8170620 - DNA, 22 bp, Homo sapiens
ccagctttctgggtggtttctg

SEQ ID NO: 8170621 - DNA, 22 bp, Homo sapiens
ccagctttctcagaggcttcta

SEQ ID NO: 8170622 - DNA, 22 bp, Homo sapiens
ccagcttttcagaatctgcctg

SEQ ID NO: 8170623 - DNA, 22 bp, Homo sapiens
ccagcttttcctctcattgctt

SEQ ID NO: 8170624 - DNA, 22 bp, Homo sapiens
ccagcttttcttatcattataa

SEQ ID NO: 8170625 - DNA, 22 bp, Homo sapiens
ccagcttttgcactggactggg

SEQ ID NO: 8170626 - DNA, 22 bp, Homo sapiens
ccagcttttggggtgacaattt

SEQ ID NO: 8170627 - DNA, 22 bp, Homo sapiens
ccagcttttcttatcattataa

SEQ ID NO: 8170628 - DNA, 22 bp, Homo sapiens
aggccctgggcagttctgtagc

SEQ ID NO: 8170629 - DNA, 22 bp, Homo sapiens
aggccctgggagcagagatgca

SEQ ID NO: 8170630 - DNA, 22 bp, Homo sapiens
aggccctgggagcagagatgca

SEQ ID NO: 8170631 - DNA, 22 bp, Homo sapiens
aggccctgggagcagagatgca

SEQ ID NO: 8170632 - DNA, 22 bp, Homo sapiens
aggccctggcctgactcaatgt

SEQ ID NO: 8170633 - DNA, 18 bp, Homo sapiens
aggccctggcctcgaaca

SEQ ID NO: 8170634 - DNA, 18 bp, Homo sapiens
aggccctggcctcgaaca

SEQ ID NO: 8170635 - DNA, 22 bp, Homo sapiens
aggccctgggcagttctgtagc

SEQ ID NO: 8170636 - DNA, 22 bp, Homo sapiens
aggccctgggttagggcccact

SEQ ID NO: 8170637 - DNA, 22 bp, Homo sapiens
aggccctgggcagttctgtagc

SEQ ID NO: 8170638 - DNA, 22 bp, Homo sapiens
ccaggacaagtgtggccatggc

SEQ ID NO: 8170639 - DNA, 22 bp, Homo sapiens
ccaggagagcattgcacagagg

SEQ ID NO: 8170640 - DNA, 22 bp, Homo sapiens
ccaggagagctctcgttcagtg

SEQ ID NO: 8170641 - DNA, 22 bp, Homo sapiens
ccaggagagctctaaatggctg

SEQ ID NO: 8170642 - DNA, 22 bp, Homo sapiens
ccaggagagctctaaatggctg

SEQ ID NO: 8170643 - DNA, 22 bp, Homo sapiens
ccaggagagcgccctcccggcc

SEQ ID NO: 8170644 - DNA, 22 bp, Homo sapiens
ccaggagagcagaagcccaggc

SEQ ID NO: 8170645 - DNA, 22 bp, Homo sapiens
ccaggagagcagaagcccaggc

SEQ ID NO: 8170646 - DNA, 22 bp, Homo sapiens
ccaggagagcaggcgtgcagct

SEQ ID NO: 8170647 - DNA, 22 bp, Homo sapiens
ccaggagagcaggcgtgcagct

SEQ ID NO: 8170648 - DNA, 22 bp, Homo sapiens
ccaggagcaaagatcactggga

SEQ ID NO: 8170649 - DNA, 22 bp, Homo sapiens
ccaggagcaaagatcactggga

SEQ ID NO: 8170650 - DNA, 22 bp, Homo sapiens
ccaggagcaaagatcactggga

SEQ ID NO: 8170651 - DNA, 22 bp, Homo sapiens
ccaggagatttttccatagcac

SEQ ID NO: 8170652 - DNA, 22 bp, Homo sapiens
ccaggagatgggagcatctaaa

SEQ ID NO: 8170653 - DNA, 22 bp, Homo sapiens
ccaggagcgggaaaaggaagaa

SEQ ID NO: 8170654 - DNA, 22 bp, Homo sapiens
ccaggagcgcgtgaacaggctg

SEQ ID NO: 8170655 - DNA, 22 bp, Homo sapiens
ccaggagcaaagatcactggga

SEQ ID NO: 8170656 - DNA, 22 bp, Homo sapiens
ccaggagcgggaaaaggaagaa

SEQ ID NO: 8170657 - DNA, 17 bp, Homo sapiens
ccaggagcgtgggtctc

SEQ ID NO: 8170658 - DNA, 22 bp, Homo sapiens
ccaggagatgatgttggggatt

SEQ ID NO: 8170659 - DNA, 19 bp, Homo sapiens
ccaggagagcttggagaag

SEQ ID NO: 8170660 - DNA, 22 bp, Homo sapiens
ccaggagatgggaaagtagcag

SEQ ID NO: 8170661 - DNA, 22 bp, Homo sapiens
ccaggagatgggaaagtagcag

SEQ ID NO: 8170662 - DNA, 22 bp, Homo sapiens
aggccagaagccagaaatgctt

SEQ ID NO: 8170663 - DNA, 22 bp, Homo sapiens
aggccagaagtcaaaaactcta

SEQ ID NO: 8170664 - DNA, 22 bp, Homo sapiens
aggccagaacagctctgcacca

SEQ ID NO: 8170665 - DNA, 22 bp, Homo sapiens
aggccagaacagctctgcacca

SEQ ID NO: 8170666 - DNA, 22 bp, Homo sapiens
aggccagactttggccaaatcc

SEQ ID NO: 8170667 - DNA, 22 bp, Homo sapiens
aggccagacagctagaaacagg

SEQ ID NO: 8170668 - DNA, 22 bp, Homo sapiens
aggccagagaggggaccagcct

SEQ ID NO: 8170669 - DNA, 22 bp, Homo sapiens
aggccagagaggggaccagcct

SEQ ID NO: 8170670 - DNA, 22 bp, Homo sapiens
aggccagactttggccaaatcc

SEQ ID NO: 8170671 - DNA, 22 bp, Homo sapiens
ccagcagaggggcggagtgcag

SEQ ID NO: 8170672 - DNA, 22 bp, Homo sapiens
ccagcagagctggaagtgtgct

SEQ ID NO: 8170673 - DNA, 22 bp, Homo sapiens
aggccagaaatttggagtatgt

SEQ ID NO: 8170674 - DNA, 22 bp, Homo sapiens
aggccagaaatttggagtatgt

SEQ ID NO: 8170675 - DNA, 22 bp, Homo sapiens
aggccagaaatgtcagggagtg

SEQ ID NO: 8170676 - DNA, 22 bp, Homo sapiens
ccagcagaggggcggagtgcag

SEQ ID NO: 8170677 - DNA, 19 bp, Homo sapiens
ccagcagacacagctgccc

SEQ ID NO: 8170678 - DNA, 22 bp, Homo sapiens
ccagcagagcatggggaggaag

SEQ ID NO: 8170679 - DNA, 22 bp, Homo sapiens
ccagcagagcatggggaggaag

SEQ ID NO: 8170680 - DNA, 22 bp, Homo sapiens
ccagcactgttctaaggaaaca

SEQ ID NO: 8170681 - DNA, 22 bp, Homo sapiens
ccagcactgctctcagactgag

SEQ ID NO: 8170682 - DNA, 22 bp, Homo sapiens
ccagcactgctctcagactgag

SEQ ID NO: 8170683 - DNA, 22 bp, Homo sapiens
ccagcagaagctcccgctgggt

SEQ ID NO: 8170684 - DNA, 22 bp, Homo sapiens
ccagcagaagctcccgctgggt

SEQ ID NO: 8170685 - DNA, 22 bp, Homo sapiens
ccagcagaagctcccgctgggt

SEQ ID NO: 8170686 - DNA, 22 bp, Homo sapiens
ccagcagacacacaggcgtggg

SEQ ID NO: 8170687 - DNA, 22 bp, Homo sapiens
aggcatggacatttcggcagct

SEQ ID NO: 8170688 - DNA, 22 bp, Homo sapiens
aggcatggacatttcggcagct

SEQ ID NO: 8170689 - DNA, 22 bp, Homo sapiens
aggcatggatggatccagggct

SEQ ID NO: 8170690 - DNA, 22 bp, Homo sapiens
aggcatggatggatccagggct

SEQ ID NO: 8170691 - DNA, 22 bp, Homo sapiens
aggcatggacatttcggcagct

SEQ ID NO: 8170692 - DNA, 22 bp, Homo sapiens
aggcatggacatttcggcagct

SEQ ID NO: 8170693 - DNA, 21 bp, Homo sapiens
aggcatggaaatggcacactg

SEQ ID NO: 8170694 - DNA, 21 bp, Homo sapiens
aggcatggaaatggcacactg

SEQ ID NO: 8170695 - DNA, 21 bp, Homo sapiens
aggcatggaaatggcacactg

SEQ ID NO: 8170696 - DNA, 20 bp, Homo sapiens
ccagagcagccactgaagtt

SEQ ID NO: 8170697 - DNA, 22 bp, Homo sapiens
ccagagcaattctcacagaact

SEQ ID NO: 8170698 - DNA, 17 bp, Homo sapiens
ccagagatgcctcaggc

SEQ ID NO: 8170699 - DNA, 22 bp, Homo sapiens
ccagagcagatgtggccttggt

SEQ ID NO: 8170700 - DNA, 22 bp, Homo sapiens
ccagagcagatgtggccttggt

SEQ ID NO: 8170701 - DNA, 22 bp, Homo sapiens
ccagagcagatgtggccttggt

SEQ ID NO: 8170702 - DNA, 22 bp, Homo sapiens
ccagagcagaaccggaacacca

SEQ ID NO: 8170703 - DNA, 22 bp, Homo sapiens
ccagagcagaaccggaacacca

SEQ ID NO: 8170704 - DNA, 22 bp, Homo sapiens
ccagagcagaaccggaacacca

SEQ ID NO: 8170705 - DNA, 22 bp, Homo sapiens
aggcatggatgtagcagtgacc

SEQ ID NO: 8170706 - DNA, 22 bp, Homo sapiens
aggcatggatgtagcagtgacc

SEQ ID NO: 8170707 - DNA, 22 bp, Homo sapiens
aggcatggatgtagcagtgacc

SEQ ID NO: 8170708 - DNA, 22 bp, Homo sapiens
aggcatggatggatccagggct

SEQ ID NO: 8170709 - DNA, 22 bp, Homo sapiens
aggcatggatggatccagggct

SEQ ID NO: 8170710 - DNA, 22 bp, Homo sapiens
aggcatggatgtagcagtgacc

SEQ ID NO: 8170711 - DNA, 22 bp, Homo sapiens
aggcatggatgtagcagtgacc

SEQ ID NO: 8170712 - DNA, 22 bp, Homo sapiens
aggcatggcactgagcagcttc

SEQ ID NO: 8170713 - DNA, 22 bp, Homo sapiens
aggcatggcactgagcagcttc

SEQ ID NO: 8170714 - DNA, 22 bp, Homo sapiens
aggcatggcactgagcagcttc

SEQ ID NO: 8170715 - DNA, 23 bp, Homo sapiens
aggcatggcatggatggtggctc

SEQ ID NO: 8170716 - DNA, 23 bp, Homo sapiens
aggcatggcatggatggtggctc

SEQ ID NO: 8170717 - DNA, 22 bp, Homo sapiens
aggcatggcatggggcagatgt

SEQ ID NO: 8170718 - DNA, 23 bp, Homo sapiens
aggcatggcatggatggtggctc

SEQ ID NO: 8170719 - DNA, 22 bp, Homo sapiens
ccagagtgacgtgaagtgtgaa

SEQ ID NO: 8170720 - DNA, 17 bp, Homo sapiens
ccagagagtagttagga

SEQ ID NO: 8170721 - DNA, 22 bp, Homo sapiens
ccagagagtaggaggcattatt

SEQ ID NO: 8170722 - DNA, 22 bp, Homo sapiens
ccagagagtatcatggagagta

SEQ ID NO: 8170723 - DNA, 22 bp, Homo sapiens
ccagagaaagtgaagcaaatgt

SEQ ID NO: 8170724 - DNA, 22 bp, Homo sapiens
ccacaggatccaagggaaggca

SEQ ID NO: 8170725 - DNA, 20 bp, Homo sapiens
ccacaggagtccagtcgacc

SEQ ID NO: 8170726 - DNA, 23 bp, Homo sapiens
ccacaggcacagaggcttgcatc

SEQ ID NO: 8170727 - DNA, 22 bp, Homo sapiens
ccacaggaccagaggagatcac

SEQ ID NO: 8170728 - DNA, 22 bp, Homo sapiens
ccacaggacggaggtctggccg

SEQ ID NO: 8170729 - DNA, 22 bp, Homo sapiens
ccacaggacggaggtctggccg

SEQ ID NO: 8170730 - DNA, 22 bp, Homo sapiens
aggcagggtcttgctatgttgc

SEQ ID NO: 8170731 - DNA, 22 bp, Homo sapiens
aggcagggtgatgataatgatt

SEQ ID NO: 8170732 - DNA, 22 bp, Homo sapiens
aggcagggtgatgataatgatt

SEQ ID NO: 8170733 - DNA, 22 bp, Homo sapiens
aggcagggtgatgataatgatt

SEQ ID NO: 8170734 - DNA, 22 bp, Homo sapiens
aggcagggtcttgctatgttgc

SEQ ID NO: 8170735 - DNA, 22 bp, Homo sapiens
aggcagggtcttgctatgttgc

SEQ ID NO: 8170736 - DNA, 22 bp, Homo sapiens
aggcaggggagctggaagggta

SEQ ID NO: 8170737 - DNA, 22 bp, Homo sapiens
aggcaggggagctggaagggta

SEQ ID NO: 8170738 - DNA, 22 bp, Homo sapiens
aggcaggggagctggaagggta

SEQ ID NO: 8170739 - DNA, 22 bp, Homo sapiens
aggcaggggagctggaagggta

SEQ ID NO: 8170740 - DNA, 22 bp, Homo sapiens
ccacaggaagttatgagtacta

SEQ ID NO: 8170741 - DNA, 22 bp, Homo sapiens
ccacaggacacaactgctgacc

SEQ ID NO: 8170742 - DNA, 22 bp, Homo sapiens
ccacaggacacaactgctgacc

SEQ ID NO: 8170743 - DNA, 21 bp, Homo sapiens
ccacagctggtctctgagccc

SEQ ID NO: 8170744 - DNA, 22 bp, Homo sapiens
ccacagcttcttatatcactgg

SEQ ID NO: 8170745 - DNA, 22 bp, Homo sapiens
aggcagggtgatgataatgatt

SEQ ID NO: 8170746 - DNA, 22 bp, Homo sapiens
aggcagggtgatgataatgatt

SEQ ID NO: 8170747 - DNA, 17 bp, Homo sapiens
aggcaggtaagagttat

SEQ ID NO: 8170748 - DNA, 22 bp, Homo sapiens
aggcagggtgatgataatgatt

SEQ ID NO: 8170749 - DNA, 17 bp, Homo sapiens
ccacagctgggtgcctt

SEQ ID NO: 8170750 - DNA, 17 bp, Homo sapiens
aggcaggtaagagttat

SEQ ID NO: 8170751 - DNA, 22 bp, Homo sapiens
agggctatgattaatgatggtg

SEQ ID NO: 8170752 - DNA, 22 bp, Homo sapiens
agggctcataattcctgacttc

SEQ ID NO: 8170753 - DNA, 22 bp, Homo sapiens
agggctcagttgcctggagccc

SEQ ID NO: 8170754 - DNA, 22 bp, Homo sapiens
agggctcataattcctgacttc

SEQ ID NO: 8170755 - DNA, 22 bp, Homo sapiens
agggctcataattcctgacttc

SEQ ID NO: 8170756 - DNA, 22 bp, Homo sapiens
agggctcatctgagactgacat

SEQ ID NO: 8170757 - DNA, 22 bp, Homo sapiens
agggctcattgacatggaaaag

SEQ ID NO: 8170758 - DNA, 22 bp, Homo sapiens
agggctcatctgagactgacat

SEQ ID NO: 8170759 - DNA, 22 bp, Homo sapiens
agggctccaaggaagtgtagct

SEQ ID NO: 8170760 - DNA, 22 bp, Homo sapiens
agggctccaaggaagtgtagct

SEQ ID NO: 8170761 - DNA, 22 bp, Homo sapiens
agggctccaggggctgggtgac

SEQ ID NO: 8170762 - DNA, 22 bp, Homo sapiens
agggctcccgtgaggtgactgc

SEQ ID NO: 8170763 - DNA, 22 bp, Homo sapiens
agggctcccgcggtgtccggga

SEQ ID NO: 8170764 - DNA, 22 bp, Homo sapiens
agggctccaggggctgggtgac

SEQ ID NO: 8170765 - DNA, 23 bp, Homo sapiens
agggcctcaggagggctgcatgg

SEQ ID NO: 8170766 - DNA, 23 bp, Homo sapiens
agggcctcaggagggctgcatgg

SEQ ID NO: 8170767 - DNA, 23 bp, Homo sapiens
agggcctcaggagggctgcatgg

SEQ ID NO: 8170768 - DNA, 22 bp, Homo sapiens
agggctaggaatggaactggag

SEQ ID NO: 8170769 - DNA, 22 bp, Homo sapiens
agggctaggaatggaactggag

SEQ ID NO: 8170770 - DNA, 19 bp, Homo sapiens
agggctaggcacatagggc

SEQ ID NO: 8170771 - DNA, 19 bp, Homo sapiens
agggctaggcacatagggc

SEQ ID NO: 8170772 - DNA, 22 bp, Homo sapiens
agggcccttacgcaggcccttc

SEQ ID NO: 8170773 - DNA, 22 bp, Homo sapiens
agggcccttacgcaggcccttc

SEQ ID NO: 8170774 - DNA, 22 bp, Homo sapiens
agggcccttacgcaggcccttc

SEQ ID NO: 8170775 - DNA, 18 bp, Homo sapiens
agggccctggtggccatt

SEQ ID NO: 8170776 - DNA, 22 bp, Homo sapiens
agggccctggggtgcactgaca

SEQ ID NO: 8170777 - DNA, 22 bp, Homo sapiens
agggccctgagttgcagccctg

SEQ ID NO: 8170778 - DNA, 22 bp, Homo sapiens
agggccctgagttgcagccctg

SEQ ID NO: 8170779 - DNA, 22 bp, Homo sapiens
agggccctctgggcactgtggc

SEQ ID NO: 8170780 - DNA, 22 bp, Homo sapiens
agggccctctgggcactgtggc

SEQ ID NO: 8170781 - DNA, 22 bp, Homo sapiens
agggccctctggcaggccaggc

SEQ ID NO: 8170782 - DNA, 22 bp, Homo sapiens
agggccctctggcaggccaggc

SEQ ID NO: 8170783 - DNA, 22 bp, Homo sapiens
agggccctccccgctcagggca

SEQ ID NO: 8170784 - DNA, 22 bp, Homo sapiens
agggccctccccgctcagggca

SEQ ID NO: 8170785 - DNA, 22 bp, Homo sapiens
agggccctagggaatgagacat

SEQ ID NO: 8170786 - DNA, 18 bp, Homo sapiens
agggctctctgctgggtt

SEQ ID NO: 8170787 - DNA, 22 bp, Homo sapiens
agggctctcttcttggtttgca

SEQ ID NO: 8170788 - DNA, 22 bp, Homo sapiens
agggctctcttcttggtttgca

SEQ ID NO: 8170789 - DNA, 22 bp, Homo sapiens
agggctctcttggacaactgct

SEQ ID NO: 8170790 - DNA, 22 bp, Homo sapiens
agggctctcttggacaactgct

SEQ ID NO: 8170791 - DNA, 22 bp, Homo sapiens
agggctctgagctggaccacct

SEQ ID NO: 8170792 - DNA, 22 bp, Homo sapiens
agggctctgagctggaccacct

SEQ ID NO: 8170793 - DNA, 22 bp, Homo sapiens
agggctcctccccggcctccac

SEQ ID NO: 8170794 - DNA, 22 bp, Homo sapiens
agggctcctccccggcctccac

SEQ ID NO: 8170795 - DNA, 18 bp, Homo sapiens
agggctctctgctgggtt

SEQ ID NO: 8170796 - DNA, 22 bp, Homo sapiens
agggctccgggcaggcgatgga

SEQ ID NO: 8170797 - DNA, 22 bp, Homo sapiens
agggctcctatgatgctctgcc

SEQ ID NO: 8170798 - DNA, 22 bp, Homo sapiens
agggctcttcctttgcctctca

SEQ ID NO: 8170799 - DNA, 22 bp, Homo sapiens
agggctcttcctttgcctctca

SEQ ID NO: 8170800 - DNA, 22 bp, Homo sapiens
agggctcttcctttgcctctca

SEQ ID NO: 8170801 - DNA, 22 bp, Homo sapiens
agggctctgttggggtcagcac

SEQ ID NO: 8170802 - DNA, 22 bp, Homo sapiens
agggctctgttggggtcagcac

SEQ ID NO: 8170803 - DNA, 22 bp, Homo sapiens
agggctctgttggggtcagcac

SEQ ID NO: 8170804 - DNA, 22 bp, Homo sapiens
agggctctgttggggtcagcac

SEQ ID NO: 8170805 - DNA, 22 bp, Homo sapiens
cctccccatgacccggtgctgg

SEQ ID NO: 8170806 - DNA, 22 bp, Homo sapiens
cctccccatgacccggtgctgg

SEQ ID NO: 8170807 - DNA, 22 bp, Homo sapiens
agggctcttcctttgcctctca

SEQ ID NO: 8170808 - DNA, 22 bp, Homo sapiens
cctccccacgggcagccggcgc

SEQ ID NO: 8170809 - DNA, 22 bp, Homo sapiens
cctccccacgggcagccggcgc

SEQ ID NO: 8170810 - DNA, 22 bp, Homo sapiens
cctccccacgggcagccggcgc

SEQ ID NO: 8170811 - DNA, 22 bp, Homo sapiens
agggctctgtgactatcactgc

SEQ ID NO: 8170812 - DNA, 22 bp, Homo sapiens
agggctctgtccccagaggccc

SEQ ID NO: 8170813 - DNA, 22 bp, Homo sapiens
agggctctgtccccagaggccc

SEQ ID NO: 8170814 - DNA, 22 bp, Homo sapiens
agggctctgtccccagaggccc

SEQ ID NO: 8170815 - DNA, 22 bp, Homo sapiens
agggctctgtccccagaggccc

SEQ ID NO: 8170816 - DNA, 22 bp, Homo sapiens
agggctctggggtggcagagat

SEQ ID NO: 8170817 - DNA, 22 bp, Homo sapiens
agggctctggggtggcagagat

SEQ ID NO: 8170818 - DNA, 22 bp, Homo sapiens
agggctctgagtgggaaagagg

SEQ ID NO: 8170819 - DNA, 20 bp, Homo sapiens
agggctctgccttgctgatg

SEQ ID NO: 8170820 - DNA, 22 bp, Homo sapiens
agggctctgagtgggaaagagg

SEQ ID NO: 8170821 - DNA, 22 bp, Homo sapiens
agggctctggggtggcagagat

SEQ ID NO: 8170822 - DNA, 20 bp, Homo sapiens
agggctctgccttgctgatg

SEQ ID NO: 8170823 - DNA, 22 bp, Homo sapiens
ccgaggctggcctcagggctgt

SEQ ID NO: 8170824 - DNA, 22 bp, Homo sapiens
ccgaggctggagtgcagtggcg

SEQ ID NO: 8170825 - DNA, 22 bp, Homo sapiens
ccgaggtcctggacttggccct

SEQ ID NO: 8170826 - DNA, 22 bp, Homo sapiens
ccgagatgggctcgcctgggaa

SEQ ID NO: 8170827 - DNA, 22 bp, Homo sapiens
ccgagaacttttcctgaaaagt

SEQ ID NO: 8170828 - DNA, 22 bp, Homo sapiens
ccgagctgtggtctcttttacg

SEQ ID NO: 8170829 - DNA, 22 bp, Homo sapiens
ccgaggctcctccccgagtctg

SEQ ID NO: 8170830 - DNA, 21 bp, Homo sapiens
ccgccgctgatagctctgggc

SEQ ID NO: 8170831 - DNA, 22 bp, Homo sapiens
agggccctaaggaaggcacaca

SEQ ID NO: 8170832 - DNA, 22 bp, Homo sapiens
agggccctaaggaaggcacaca

SEQ ID NO: 8170833 - DNA, 22 bp, Homo sapiens
ccgcccacactaaatatgagcg

SEQ ID NO: 8170834 - DNA, 22 bp, Homo sapiens
ccgccaggatattgtggctttt

SEQ ID NO: 8170835 - DNA, 22 bp, Homo sapiens
ccgcatttccaatgaggcaaag

SEQ ID NO: 8170836 - DNA, 20 bp, Homo sapiens
cccttttcacgaaaaggaga

SEQ ID NO: 8170837 - DNA, 22 bp, Homo sapiens
ccctttctgggacccctgtctc

SEQ ID NO: 8170838 - DNA, 22 bp, Homo sapiens
ccctttcttccgtgacttctgc

SEQ ID NO: 8170839 - DNA, 21 bp, Homo sapiens
ccctttctccatacttcatcc

SEQ ID NO: 8170840 - DNA, 22 bp, Homo sapiens
ccctttctccagaactgtctga

SEQ ID NO: 8170841 - DNA, 22 bp, Homo sapiens
agggccagagtctgtgtagata

SEQ ID NO: 8170842 - DNA, 22 bp, Homo sapiens
agggccagagtctgtgtagata

SEQ ID NO: 8170843 - DNA, 22 bp, Homo sapiens
cccttcccttctgggagatcca

SEQ ID NO: 8170844 - DNA, 22 bp, Homo sapiens
cccttcccttctgggagatcca

SEQ ID NO: 8170845 - DNA, 22 bp, Homo sapiens
cccttcccttctgggagatcca

SEQ ID NO: 8170846 - DNA, 22 bp, Homo sapiens
ccctggaggctggaggcagtag

SEQ ID NO: 8170847 - DNA, 22 bp, Homo sapiens
ccctggaggctggaggcagtag

SEQ ID NO: 8170848 - DNA, 22 bp, Homo sapiens
ccctggaggctggaggcagtag

SEQ ID NO: 8170849 - DNA, 22 bp, Homo sapiens
ccctggaggcggatgttgcagt

SEQ ID NO: 8170850 - DNA, 16 bp, Homo sapiens
agggccagaagcatca

SEQ ID NO: 8170851 - DNA, 22 bp, Homo sapiens
ccctggagggacagctgctcta

SEQ ID NO: 8170852 - DNA, 22 bp, Homo sapiens
ccctggagggacagctgctcta

SEQ ID NO: 8170853 - DNA, 22 bp, Homo sapiens
ccctggagggacagctgctcta

SEQ ID NO: 8170854 - DNA, 22 bp, Homo sapiens
ccctggagggacagctgctcta

SEQ ID NO: 8170855 - DNA, 22 bp, Homo sapiens
ccctggagggacagctgctcta

SEQ ID NO: 8170856 - DNA, 22 bp, Homo sapiens
ccctggaggcggatgttgcagt

SEQ ID NO: 8170857 - DNA, 22 bp, Homo sapiens
ccctggaggcggatgttgcagt

SEQ ID NO: 8170858 - DNA, 22 bp, Homo sapiens
ccctggaggcggagcttgcagt

SEQ ID NO: 8170859 - DNA, 22 bp, Homo sapiens
ccctggaggcggagcttgcagt

SEQ ID NO: 8170860 - DNA, 22 bp, Homo sapiens
ccctggaggcggagcttgcagt

SEQ ID NO: 8170861 - DNA, 22 bp, Homo sapiens
ccctggaggcggagcttgcagt

SEQ ID NO: 8170862 - DNA, 22 bp, Homo sapiens
ccctggaggcggagcttgcagt

SEQ ID NO: 8170863 - DNA, 22 bp, Homo sapiens
ccctggaggcggagcttgcagt

SEQ ID NO: 8170864 - DNA, 22 bp, Homo sapiens
ccctggaggcaaaggttgcagt

SEQ ID NO: 8170865 - DNA, 22 bp, Homo sapiens
ccctggaggcaaaggttgcagt

SEQ ID NO: 8170866 - DNA, 22 bp, Homo sapiens
ccctggaggcaaaggttgcagt

SEQ ID NO: 8170867 - DNA, 22 bp, Homo sapiens
ccctggaggcaaaggttgcagt

SEQ ID NO: 8170868 - DNA, 22 bp, Homo sapiens
agggccagaatccctcagtcta

SEQ ID NO: 8170869 - DNA, 22 bp, Homo sapiens
agggccagaatccctcagtcta

SEQ ID NO: 8170870 - DNA, 22 bp, Homo sapiens
agggccagaggcaccttgcagc

SEQ ID NO: 8170871 - DNA, 22 bp, Homo sapiens
agggccagaatccctcagtcta

SEQ ID NO: 8170872 - DNA, 22 bp, Homo sapiens
agggccagaatccctcagtcta

SEQ ID NO: 8170873 - DNA, 22 bp, Homo sapiens
agggccagaatccctcagtcta

SEQ ID NO: 8170874 - DNA, 22 bp, Homo sapiens
agggccagagtacatcagggct

SEQ ID NO: 8170875 - DNA, 22 bp, Homo sapiens
agggccagagtacatcagggct

SEQ ID NO: 8170876 - DNA, 22 bp, Homo sapiens
agggccagagtacatcagggct

SEQ ID NO: 8170877 - DNA, 22 bp, Homo sapiens
agggccagagtacatcagggct

SEQ ID NO: 8170878 - DNA, 22 bp, Homo sapiens
agggccagagtacatcagggct

SEQ ID NO: 8170879 - DNA, 22 bp, Homo sapiens
agggccagagtacatcagggct

SEQ ID NO: 8170880 - DNA, 22 bp, Homo sapiens
agggccagagtacatcagggct

SEQ ID NO: 8170881 - DNA, 22 bp, Homo sapiens
agggccagagtctgtgtagata

SEQ ID NO: 8170882 - DNA, 22 bp, Homo sapiens
agggccagagtctgtgtagata

SEQ ID NO: 8170883 - DNA, 22 bp, Homo sapiens
agggctgcaggcaagatatggc

SEQ ID NO: 8170884 - DNA, 19 bp, Homo sapiens
cctctgccagcccgcctct

SEQ ID NO: 8170885 - DNA, 19 bp, Homo sapiens
cctctgccagcccgcctct

SEQ ID NO: 8170886 - DNA, 22 bp, Homo sapiens
agggctgcaccggggcttcgcg

SEQ ID NO: 8170887 - DNA, 19 bp, Homo sapiens
cctctgccagcccgcctct

SEQ ID NO: 8170888 - DNA, 18 bp, Homo sapiens
cctctgccatagccagca

SEQ ID NO: 8170889 - DNA, 22 bp, Homo sapiens
cctctgggaagccagtcctgct

SEQ ID NO: 8170890 - DNA, 22 bp, Homo sapiens
cctctgggaagccagtcctgct

SEQ ID NO: 8170891 - DNA, 22 bp, Homo sapiens
cctctgggagactgctactgag

SEQ ID NO: 8170892 - DNA, 22 bp, Homo sapiens
cctctgggagactgctactgag

SEQ ID NO: 8170893 - DNA, 21 bp, Homo sapiens
cctctggcttgtgctgtgccc

SEQ ID NO: 8170894 - DNA, 16 bp, Homo sapiens
cctctgggcctgcaag

SEQ ID NO: 8170895 - DNA, 22 bp, Homo sapiens
cctctgggcctggaagggcagt

SEQ ID NO: 8170896 - DNA, 22 bp, Homo sapiens
cctctgggcctggaagggcagt

SEQ ID NO: 8170897 - DNA, 22 bp, Homo sapiens
cctctgggccagcctggaccct

SEQ ID NO: 8170898 - DNA, 22 bp, Homo sapiens
cctctgggccagcctggaccct

SEQ ID NO: 8170899 - DNA, 16 bp, Homo sapiens
cctctgggcctgcaag

SEQ ID NO: 8170900 - DNA, 22 bp, Homo sapiens
cctctgggcggagatctgctgc

SEQ ID NO: 8170901 - DNA, 22 bp, Homo sapiens
cctctgggcggagatctgctgc

SEQ ID NO: 8170902 - DNA, 22 bp, Homo sapiens
cctctgggcggagatctgctgc

SEQ ID NO: 8170903 - DNA, 22 bp, Homo sapiens
cctctgggcggagatctgctgc

SEQ ID NO: 8170904 - DNA, 22 bp, Homo sapiens
cctctgggcctggaagggcagt

SEQ ID NO: 8170905 - DNA, 22 bp, Homo sapiens
cctctgggcaggtagcagcagc

SEQ ID NO: 8170906 - DNA, 22 bp, Homo sapiens
cctctgggcaggtagcagcagc

SEQ ID NO: 8170907 - DNA, 22 bp, Homo sapiens
cctctgggcaggtagcagcagc

SEQ ID NO: 8170908 - DNA, 16 bp, Homo sapiens
cctctgggatgtttgc

SEQ ID NO: 8170909 - DNA, 22 bp, Homo sapiens
cctctgggagactgctactgag

SEQ ID NO: 8170910 - DNA, 22 bp, Homo sapiens
agggctgcaatgggagataact

SEQ ID NO: 8170911 - DNA, 23 bp, Homo sapiens
agggctgatgccattgcagctct

SEQ ID NO: 8170912 - DNA, 23 bp, Homo sapiens
agggctgatgccattgcagctct

SEQ ID NO: 8170913 - DNA, 23 bp, Homo sapiens
agggctgatgccattgcagctct

SEQ ID NO: 8170914 - DNA, 23 bp, Homo sapiens
agggctgatgccattgcagctct

SEQ ID NO: 8170915 - DNA, 22 bp, Homo sapiens
agggctgatgcaccatgtagcc

SEQ ID NO: 8170916 - DNA, 22 bp, Homo sapiens
agggctgatgcaccatgtagcc

SEQ ID NO: 8170917 - DNA, 18 bp, Homo sapiens
agggctgatgagtttggg

SEQ ID NO: 8170918 - DNA, 22 bp, Homo sapiens
cctcctggccctgggcctggaa

SEQ ID NO: 8170919 - DNA, 22 bp, Homo sapiens
agggctgagtgggagagagttg

SEQ ID NO: 8170920 - DNA, 22 bp, Homo sapiens
cctcctggccctgggcctggaa

SEQ ID NO: 8170921 - DNA, 22 bp, Homo sapiens
cctcctggatggatttggtgga

SEQ ID NO: 8170922 - DNA, 22 bp, Homo sapiens
agggctgagtggtgcagtcaaa

SEQ ID NO: 8170923 - DNA, 22 bp, Homo sapiens
agggctgagtggtgcagtcaaa

SEQ ID NO: 8170924 - DNA, 22 bp, Homo sapiens
agggctgagtgggagagagttg

SEQ ID NO: 8170925 - DNA, 22 bp, Homo sapiens
agggctgagtgggagagagttg

SEQ ID NO: 8170926 - DNA, 22 bp, Homo sapiens
cctcctggaggctctagggaaa

SEQ ID NO: 8170927 - DNA, 22 bp, Homo sapiens
cctcctggaggctctagggaaa

SEQ ID NO: 8170928 - DNA, 22 bp, Homo sapiens
cctcctggatggatttggtgga

SEQ ID NO: 8170929 - DNA, 22 bp, Homo sapiens
cctcctggaggctctagggaaa

SEQ ID NO: 8170930 - DNA, 22 bp, Homo sapiens
cctcctggaggctctagggaaa

SEQ ID NO: 8170931 - DNA, 22 bp, Homo sapiens
cctcctggaggctctaagggag

SEQ ID NO: 8170932 - DNA, 22 bp, Homo sapiens
cctcctggaggctctaagggag

SEQ ID NO: 8170933 - DNA, 22 bp, Homo sapiens
cctcctggagcattggtgagga

SEQ ID NO: 8170934 - DNA, 22 bp, Homo sapiens
cctcctggagcattggtgagga

SEQ ID NO: 8170935 - DNA, 22 bp, Homo sapiens
cctcctggagcattggtgagga

SEQ ID NO: 8170936 - DNA, 22 bp, Homo sapiens
cctcctggaaaaattccctggc

SEQ ID NO: 8170937 - DNA, 22 bp, Homo sapiens
cctcctggaaaaattccctggc

SEQ ID NO: 8170938 - DNA, 22 bp, Homo sapiens
cctcctggaaaaattccctggc

SEQ ID NO: 8170939 - DNA, 22 bp, Homo sapiens
cctcctggaaaaattccctggc

SEQ ID NO: 8170940 - DNA, 19 bp, Homo sapiens
cctcctgctagatatgcaa

SEQ ID NO: 8170941 - DNA, 19 bp, Homo sapiens
cctcctgctagatatgcaa

SEQ ID NO: 8170942 - DNA, 21 bp, Homo sapiens
cctcctgcccgcaagctaggg

SEQ ID NO: 8170943 - DNA, 21 bp, Homo sapiens
cctcctgcccgcaagctaggg

SEQ ID NO: 8170944 - DNA, 22 bp, Homo sapiens
cctcctgcggcgtccgcgctct

SEQ ID NO: 8170945 - DNA, 22 bp, Homo sapiens
cctcctgcggcgtccgcgctct

SEQ ID NO: 8170946 - DNA, 22 bp, Homo sapiens
cctcctgcacttgctttccttc

SEQ ID NO: 8170947 - DNA, 22 bp, Homo sapiens
cctcctgcacttgctttccttc

SEQ ID NO: 8170948 - DNA, 22 bp, Homo sapiens
cctcctgcacctccaggaactc

SEQ ID NO: 8170949 - DNA, 22 bp, Homo sapiens
cctcctgcactgcaagcttgag

SEQ ID NO: 8170950 - DNA, 22 bp, Homo sapiens
aggggctggcttatctgagagt

SEQ ID NO: 8170951 - DNA, 22 bp, Homo sapiens
aggggctggagttcgaggttac

SEQ ID NO: 8170952 - DNA, 22 bp, Homo sapiens
aggggctgcctggcttggcact

SEQ ID NO: 8170953 - DNA, 22 bp, Homo sapiens
aggggctgctgggtccgcccct

SEQ ID NO: 8170954 - DNA, 22 bp, Homo sapiens
aggggctggcttatctgagagt

SEQ ID NO: 8170955 - DNA, 22 bp, Homo sapiens
aggggctggcttatctgagagt

SEQ ID NO: 8170956 - DNA, 22 bp, Homo sapiens
aggggctggcttatctgagagt

SEQ ID NO: 8170957 - DNA, 22 bp, Homo sapiens
aggggctggcttatctgagagt

SEQ ID NO: 8170958 - DNA, 22 bp, Homo sapiens
aggggctggcttatctgagagt

SEQ ID NO: 8170959 - DNA, 22 bp, Homo sapiens
aggggctgggacagagccaagc

SEQ ID NO: 8170960 - DNA, 22 bp, Homo sapiens
aggggctgggacagagccaagc

SEQ ID NO: 8170961 - DNA, 22 bp, Homo sapiens
aggggctgggacagagccaagc

SEQ ID NO: 8170962 - DNA, 22 bp, Homo sapiens
aggggctgggacagagccaagc

SEQ ID NO: 8170963 - DNA, 22 bp, Homo sapiens
cctgaggatgccagcatgggtg

SEQ ID NO: 8170964 - DNA, 22 bp, Homo sapiens
cctgaggatattcaccagcatg

SEQ ID NO: 8170965 - DNA, 22 bp, Homo sapiens
cctgaggagattgtggctgggg

SEQ ID NO: 8170966 - DNA, 22 bp, Homo sapiens
cctgaggagattgtggctgggg

SEQ ID NO: 8170967 - DNA, 22 bp, Homo sapiens
cctgaggagattgtggctgggg

SEQ ID NO: 8170968 - DNA, 22 bp, Homo sapiens
cctgaggagattgtggctgggg

SEQ ID NO: 8170969 - DNA, 22 bp, Homo sapiens
cctgaggcccctgaggatagca

SEQ ID NO: 8170970 - DNA, 22 bp, Homo sapiens
cctgaggccctggctgtgctga

SEQ ID NO: 8170971 - DNA, 22 bp, Homo sapiens
aggggctgcctggcttggcact

SEQ ID NO: 8170972 - DNA, 22 bp, Homo sapiens
cctgaggccctggctgtgctga

SEQ ID NO: 8170973 - DNA, 22 bp, Homo sapiens
cctgaggcaaggacttggtggc

SEQ ID NO: 8170974 - DNA, 22 bp, Homo sapiens
cctgaggcaaggacttggtggc

SEQ ID NO: 8170975 - DNA, 22 bp, Homo sapiens
cctgaggattgttggtgcttcc

SEQ ID NO: 8170976 - DNA, 22 bp, Homo sapiens
cctgaggcaaggacttggtggc

SEQ ID NO: 8170977 - DNA, 22 bp, Homo sapiens
aggggagagaacataaggaagt

SEQ ID NO: 8170978 - DNA, 21 bp, Homo sapiens
aggggacagagtagctccagg

SEQ ID NO: 8170979 - DNA, 21 bp, Homo sapiens
aggggacagagtagctccagg

SEQ ID NO: 8170980 - DNA, 22 bp, Homo sapiens
cctgaggacacacgctgcagga

SEQ ID NO: 8170981 - DNA, 22 bp, Homo sapiens
cctgaggacacacgctgcagga

SEQ ID NO: 8170982 - DNA, 22 bp, Homo sapiens
cctgaggacacacgctgcagga

SEQ ID NO: 8170983 - DNA, 22 bp, Homo sapiens
aggggagagttaatgtgaatgt

SEQ ID NO: 8170984 - DNA, 17 bp, Homo sapiens
aggggagagtgggaaga

SEQ ID NO: 8170985 - DNA, 17 bp, Homo sapiens
aggggagagtgggaaga

SEQ ID NO: 8170986 - DNA, 17 bp, Homo sapiens
aggggagagtgggaaga

SEQ ID NO: 8170987 - DNA, 22 bp, Homo sapiens
cctgagctttaaaagccatgta

SEQ ID NO: 8170988 - DNA, 22 bp, Homo sapiens
cctgagagtggtgtacaggaga

SEQ ID NO: 8170989 - DNA, 22 bp, Homo sapiens
aggctggctgagctgcagcctg

SEQ ID NO: 8170990 - DNA, 22 bp, Homo sapiens
aggctggctgagctgcagcctg

SEQ ID NO: 8170991 - DNA, 22 bp, Homo sapiens
aggctggctgagctgcagcctg

SEQ ID NO: 8170992 - DNA, 22 bp, Homo sapiens
aggctggctggcaggggacaca

SEQ ID NO: 8170993 - DNA, 22 bp, Homo sapiens
aggctggctggcaggggacaca

SEQ ID NO: 8170994 - DNA, 22 bp, Homo sapiens
aggctggctgagctgcagcctg

SEQ ID NO: 8170995 - DNA, 22 bp, Homo sapiens
aggctggctgagctgcagcctg

SEQ ID NO: 8170996 - DNA, 22 bp, Homo sapiens
aggctggctgagctgcagcctg

SEQ ID NO: 8170997 - DNA, 22 bp, Homo sapiens
aggctggctgacttctgaagca

SEQ ID NO: 8170998 - DNA, 22 bp, Homo sapiens
aggctggctgacttctgaagca

SEQ ID NO: 8170999 - DNA, 22 bp, Homo sapiens
aggctggctgacttctgaagca

SEQ ID NO: 8171000 - DNA, 22 bp, Homo sapiens
aggctggctgacttctgaagca

SEQ ID NO: 8171001 - DNA, 22 bp, Homo sapiens
aggctggctgacttctgaagca

SEQ ID NO: 8171002 - DNA, 22 bp, Homo sapiens
aggcttcctggaggaagaggta

SEQ ID NO: 8171003 - DNA, 22 bp, Homo sapiens
aggcttcctcgtgccttagata

SEQ ID NO: 8171004 - DNA, 19 bp, Homo sapiens
aggcttctaccctgtccag

SEQ ID NO: 8171005 - DNA, 22 bp, Homo sapiens
aggctggctggcaggggacaca

SEQ ID NO: 8171006 - DNA, 22 bp, Homo sapiens
aggctggctggcaggggacaca

SEQ ID NO: 8171007 - DNA, 22 bp, Homo sapiens
aggctggctggcaggggacaca

SEQ ID NO: 8171008 - DNA, 22 bp, Homo sapiens
aggcttcactcgacatgccaat

SEQ ID NO: 8171009 - DNA, 22 bp, Homo sapiens
aggcttctggaatccagtttct

SEQ ID NO: 8171010 - DNA, 22 bp, Homo sapiens
aggcttctacgtggtcccaggg

SEQ ID NO: 8171011 - DNA, 22 bp, Homo sapiens
aggcttctccttcctaccttcc

SEQ ID NO: 8171012 - DNA, 22 bp, Homo sapiens
aggcttctagggttggcagcgg

SEQ ID NO: 8171013 - DNA, 22 bp, Homo sapiens
cccaggaggtggaggctgcagt

SEQ ID NO: 8171014 - DNA, 22 bp, Homo sapiens
cccaggagttggaggctacggt

SEQ ID NO: 8171015 - DNA, 22 bp, Homo sapiens
cccaggagttggaggctacggt

SEQ ID NO: 8171016 - DNA, 22 bp, Homo sapiens
cccaggagttggaggctgcagt

SEQ ID NO: 8171017 - DNA, 22 bp, Homo sapiens
cccaggagttggaggctgcagt

SEQ ID NO: 8171018 - DNA, 22 bp, Homo sapiens
cccaggagttggaggctacggt

SEQ ID NO: 8171019 - DNA, 22 bp, Homo sapiens
aggcttggaggttctgtagcca

SEQ ID NO: 8171020 - DNA, 21 bp, Homo sapiens
aggcttggatctagacaggcc

SEQ ID NO: 8171021 - DNA, 21 bp, Homo sapiens
aggcttggatctagacaggcc

SEQ ID NO: 8171022 - DNA, 21 bp, Homo sapiens
aggcttggatctagacaggcc

SEQ ID NO: 8171023 - DNA, 21 bp, Homo sapiens
aggcttggatctagacaggcc

SEQ ID NO: 8171024 - DNA, 21 bp, Homo sapiens
aggcttggatctagacaggcc

SEQ ID NO: 8171025 - DNA, 21 bp, Homo sapiens
aggcttggatctagacaggcc

SEQ ID NO: 8171026 - DNA, 22 bp, Homo sapiens
aggcttgcaatggacacatgtg

SEQ ID NO: 8171027 - DNA, 22 bp, Homo sapiens
aggcttgccacttgttagtcta

SEQ ID NO: 8171028 - DNA, 22 bp, Homo sapiens
aggcttgccacttgttagtcta

SEQ ID NO: 8171029 - DNA, 22 bp, Homo sapiens
aggcttgcagaatttatgtaat

SEQ ID NO: 8171030 - DNA, 22 bp, Homo sapiens
aggcttgactgctgattttgcc

SEQ ID NO: 8171031 - DNA, 22 bp, Homo sapiens
aggcttgaaatgaaatctgtaa

SEQ ID NO: 8171032 - DNA, 22 bp, Homo sapiens
aggcttgaaatgaaatctgtaa

SEQ ID NO: 8171033 - DNA, 22 bp, Homo sapiens
aggcttcttgataaaatgcaga

SEQ ID NO: 8171034 - DNA, 18 bp, Homo sapiens
aggcttcttggctcagtc

SEQ ID NO: 8171035 - DNA, 22 bp, Homo sapiens
aggcttcttgagccccacaggc

SEQ ID NO: 8171036 - DNA, 22 bp, Homo sapiens
aggcttcttgagccccacaggc

SEQ ID NO: 8171037 - DNA, 22 bp, Homo sapiens
cccaggatgatcgagagtggga

SEQ ID NO: 8171038 - DNA, 23 bp, Homo sapiens
cccaggagtttcactgcaaaggt

SEQ ID NO: 8171039 - DNA, 22 bp, Homo sapiens
cccaggagtttgagttcagcat

SEQ ID NO: 8171040 - DNA, 22 bp, Homo sapiens
cccaggagttggaggctgcagt

SEQ ID NO: 8171041 - DNA, 22 bp, Homo sapiens
cccaggagttggaggctgcagt

SEQ ID NO: 8171042 - DNA, 22 bp, Homo sapiens
agggaacatttgcactgttggt

SEQ ID NO: 8171043 - DNA, 23 bp, Homo sapiens
agggaacaagcaagctgctagtc

SEQ ID NO: 8171044 - DNA, 20 bp, Homo sapiens
agggaacaatggacgctgtc

SEQ ID NO: 8171045 - DNA, 22 bp, Homo sapiens
agggaaattaatgtgagcaatg

SEQ ID NO: 8171046 - DNA, 22 bp, Homo sapiens
cccaggatggggctgcagttat

SEQ ID NO: 8171047 - DNA, 23 bp, Homo sapiens
agggaaatactgcaatttttgga

SEQ ID NO: 8171048 - DNA, 21 bp, Homo sapiens
agggaaatccagtcacttttc

SEQ ID NO: 8171049 - DNA, 22 bp, Homo sapiens
agggaaattaatgtgagcaatg

SEQ ID NO: 8171050 - DNA, 22 bp, Homo sapiens
agggaaattaatgtgagcaatg

SEQ ID NO: 8171051 - DNA, 22 bp, Homo sapiens
agggaaatctcagctctaaaat

SEQ ID NO: 8171052 - DNA, 22 bp, Homo sapiens
agggaaatctttcaacacttca

SEQ ID NO: 8171053 - DNA, 22 bp, Homo sapiens
agggaaatggagagtgtagttt

SEQ ID NO: 8171054 - DNA, 22 bp, Homo sapiens
cccagggctgcagatggaggct

SEQ ID NO: 8171055 - DNA, 22 bp, Homo sapiens
cccagggccctggacagctaca

SEQ ID NO: 8171056 - DNA, 22 bp, Homo sapiens
cccagggccctggacagctaca

SEQ ID NO: 8171057 - DNA, 22 bp, Homo sapiens
cccagggccctggacagctaca

SEQ ID NO: 8171058 - DNA, 21 bp, Homo sapiens
cccagggaagccgcagtcacc

SEQ ID NO: 8171059 - DNA, 22 bp, Homo sapiens
cccagggaagccatttctgact

SEQ ID NO: 8171060 - DNA, 23 bp, Homo sapiens
agggaagaaacatgaagggctgt

SEQ ID NO: 8171061 - DNA, 23 bp, Homo sapiens
agggaagaaacatgaagggctgt

SEQ ID NO: 8171062 - DNA, 23 bp, Homo sapiens
agggaagaaacatgaagggctgt

SEQ ID NO: 8171063 - DNA, 22 bp, Homo sapiens
cccaggggaggtcctcagggaa

SEQ ID NO: 8171064 - DNA, 19 bp, Homo sapiens
cccaggggacccagcccta

SEQ ID NO: 8171065 - DNA, 19 bp, Homo sapiens
cccaggggacccagcccta

SEQ ID NO: 8171066 - DNA, 22 bp, Homo sapiens
cccaggggtaaggcgcagcgtg

SEQ ID NO: 8171067 - DNA, 22 bp, Homo sapiens
cccaggggtaaggcgcagcgtg

SEQ ID NO: 8171068 - DNA, 22 bp, Homo sapiens
cccagggcttgagtcatccatg

SEQ ID NO: 8171069 - DNA, 22 bp, Homo sapiens
cccagggctgtagaatgtccaa

SEQ ID NO: 8171070 - DNA, 22 bp, Homo sapiens
cccagggctgtagaatgtccaa

SEQ ID NO: 8171071 - DNA, 22 bp, Homo sapiens
cccagggctgcagatggaggct

SEQ ID NO: 8171072 - DNA, 22 bp, Homo sapiens
cccagggcttttctcactagac

SEQ ID NO: 8171073 - DNA, 22 bp, Homo sapiens
cccagggcttttctcactagac

SEQ ID NO: 8171074 - DNA, 22 bp, Homo sapiens
cccagggcttttctcactagac

SEQ ID NO: 8171075 - DNA, 22 bp, Homo sapiens
agggatggaagctcgtctgcaa

SEQ ID NO: 8171076 - DNA, 22 bp, Homo sapiens
agggatggagtgcggcccggac

SEQ ID NO: 8171077 - DNA, 22 bp, Homo sapiens
agggatggagtgcggcccggac

SEQ ID NO: 8171078 - DNA, 22 bp, Homo sapiens
agggatggatcttggccctgga

SEQ ID NO: 8171079 - DNA, 22 bp, Homo sapiens
agggatggatcttggccctgga

SEQ ID NO: 8171080 - DNA, 22 bp, Homo sapiens
agggatggatcttggccctgga

SEQ ID NO: 8171081 - DNA, 22 bp, Homo sapiens
agggatggatcttggccctgga

SEQ ID NO: 8171082 - DNA, 22 bp, Homo sapiens
agggatgatggaaagaagcagg

SEQ ID NO: 8171083 - DNA, 22 bp, Homo sapiens
agggatgatttcagtgtctgcc

SEQ ID NO: 8171084 - DNA, 22 bp, Homo sapiens
agggatggaagctcgtctgcaa

SEQ ID NO: 8171085 - DNA, 18 bp, Homo sapiens
agggatctagatggagtc

SEQ ID NO: 8171086 - DNA, 22 bp, Homo sapiens
agggatcatcctgcaagtgcct

SEQ ID NO: 8171087 - DNA, 18 bp, Homo sapiens
agggatcatcactgcagc

SEQ ID NO: 8171088 - DNA, 22 bp, Homo sapiens
agggatcagtagggacggcagc

SEQ ID NO: 8171089 - DNA, 22 bp, Homo sapiens
agggatcagcagagggtgtggt

SEQ ID NO: 8171090 - DNA, 22 bp, Homo sapiens
agggatcagaatttcctccttt

SEQ ID NO: 8171091 - DNA, 22 bp, Homo sapiens
agggatgactcttggctgattc

SEQ ID NO: 8171092 - DNA, 22 bp, Homo sapiens
agggatgactcttggctgattc

SEQ ID NO: 8171093 - DNA, 22 bp, Homo sapiens
agggatgatcagggtagaggct

SEQ ID NO: 8171094 - DNA, 22 bp, Homo sapiens
agggatgatcagggtagaggct

SEQ ID NO: 8171095 - DNA, 22 bp, Homo sapiens
agggagtgttatattccatcag

SEQ ID NO: 8171096 - DNA, 22 bp, Homo sapiens
agggagttagaaatccaggata

SEQ ID NO: 8171097 - DNA, 22 bp, Homo sapiens
agggagtgtaaatggtgctcag

SEQ ID NO: 8171098 - DNA, 19 bp, Homo sapiens
agggagtttatatttgcac

SEQ ID NO: 8171099 - DNA, 22 bp, Homo sapiens
agggagttagtgatgtggtctc

SEQ ID NO: 8171100 - DNA, 22 bp, Homo sapiens
agggagttcagaggctggtttg

SEQ ID NO: 8171101 - DNA, 22 bp, Homo sapiens
agggagttccgatctgtgcacc

SEQ ID NO: 8171102 - DNA, 18 bp, Homo sapiens
agggagttttagggaagg

SEQ ID NO: 8171103 - DNA, 22 bp, Homo sapiens
agggatcacggtggacttggat

SEQ ID NO: 8171104 - DNA, 22 bp, Homo sapiens
agggatcaaaaaatgtacatgc

SEQ ID NO: 8171105 - DNA, 22 bp, Homo sapiens
agggagaaaattggatgcacaa

SEQ ID NO: 8171106 - DNA, 22 bp, Homo sapiens
agggagaacagttgcagcagac

SEQ ID NO: 8171107 - DNA, 22 bp, Homo sapiens
agggagaaaattggatgcacaa

SEQ ID NO: 8171108 - DNA, 22 bp, Homo sapiens
agggagaaaattggatgcacaa

SEQ ID NO: 8171109 - DNA, 22 bp, Homo sapiens
agggactggctctctgagcagg

SEQ ID NO: 8171110 - DNA, 22 bp, Homo sapiens
agggactggctctctgagcagg

SEQ ID NO: 8171111 - DNA, 22 bp, Homo sapiens
agggactccgtgcacagtggtt

SEQ ID NO: 8171112 - DNA, 22 bp, Homo sapiens
agggactcctctgctcggctgc

SEQ ID NO: 8171113 - DNA, 22 bp, Homo sapiens
agggactcggttgagtgcccct

SEQ ID NO: 8171114 - DNA, 22 bp, Homo sapiens
agggactcggttgagtgcccct

SEQ ID NO: 8171115 - DNA, 22 bp, Homo sapiens
agggagtggttaagaaggtgca

SEQ ID NO: 8171116 - DNA, 22 bp, Homo sapiens
agggagtggttaagaaggtgca

SEQ ID NO: 8171117 - DNA, 22 bp, Homo sapiens
agggagtccattttagaggtgg

SEQ ID NO: 8171118 - DNA, 17 bp, Homo sapiens
agggagtcagtaggagc

SEQ ID NO: 8171119 - DNA, 17 bp, Homo sapiens
agggagtcagaggatcg

SEQ ID NO: 8171120 - DNA, 22 bp, Homo sapiens
agggagaaggtttagctgtgag

SEQ ID NO: 8171121 - DNA, 22 bp, Homo sapiens
agggagaaggtccatgcctgtc

SEQ ID NO: 8171122 - DNA, 22 bp, Homo sapiens
agggagaaggtttagctgtgag

SEQ ID NO: 8171123 - DNA, 22 bp, Homo sapiens
agggaggagtcctcaaagtcat

SEQ ID NO: 8171124 - DNA, 22 bp, Homo sapiens
agggaggagtcctcaaagtcat

SEQ ID NO: 8171125 - DNA, 22 bp, Homo sapiens
ccctctggctcttctcaggccg

SEQ ID NO: 8171126 - DNA, 22 bp, Homo sapiens
ccctctggctcttctcaggccg

SEQ ID NO: 8171127 - DNA, 22 bp, Homo sapiens
ccctctggctcttctcaggccg

SEQ ID NO: 8171128 - DNA, 17 bp, Homo sapiens
ccctctggggagggagg

SEQ ID NO: 8171129 - DNA, 22 bp, Homo sapiens
ccctctggctgtgtgttcttag

SEQ ID NO: 8171130 - DNA, 22 bp, Homo sapiens
ccctctggtttgcccttgggtg

SEQ ID NO: 8171131 - DNA, 22 bp, Homo sapiens
ccctctgcctctgagtaggaca

SEQ ID NO: 8171132 - DNA, 20 bp, Homo sapiens
ccctctgctacactgggagc

SEQ ID NO: 8171133 - DNA, 22 bp, Homo sapiens
agggatgggtctaacccagaac

SEQ ID NO: 8171134 - DNA, 22 bp, Homo sapiens
ccctcccaggagtggccagaga

SEQ ID NO: 8171135 - DNA, 22 bp, Homo sapiens
ccctctctcggttgctgtggtt

SEQ ID NO: 8171136 - DNA, 22 bp, Homo sapiens
ccctctctcggttgctgtggtt

SEQ ID NO: 8171137 - DNA, 22 bp, Homo sapiens
ccctctctgacttctgaacttg

SEQ ID NO: 8171138 - DNA, 22 bp, Homo sapiens
ccctctctgctgcatagaggaa

SEQ ID NO: 8171139 - DNA, 22 bp, Homo sapiens
ccctctctgacttctgaacttg

SEQ ID NO: 8171140 - DNA, 22 bp, Homo sapiens
ccctctctctatcgggccccag

SEQ ID NO: 8171141 - DNA, 22 bp, Homo sapiens
ccctggaggaccccaatgtggc

SEQ ID NO: 8171142 - DNA, 22 bp, Homo sapiens
ccctggaggaccccaatgtggc

SEQ ID NO: 8171143 - DNA, 22 bp, Homo sapiens
ccctggaggaccccaatgtggc

SEQ ID NO: 8171144 - DNA, 22 bp, Homo sapiens
ccctggaggagcttagagcttg

SEQ ID NO: 8171145 - DNA, 22 bp, Homo sapiens
ccctggaggagcttagagcttg

SEQ ID NO: 8171146 - DNA, 19 bp, Homo sapiens
ccctggaggagtgttggct

SEQ ID NO: 8171147 - DNA, 19 bp, Homo sapiens
ccctggaggagtgttggct

SEQ ID NO: 8171148 - DNA, 22 bp, Homo sapiens
ccctggaggagcttagagcttg

SEQ ID NO: 8171149 - DNA, 22 bp, Homo sapiens
agggcagaggcggacacggaag

SEQ ID NO: 8171150 - DNA, 22 bp, Homo sapiens
agggcagaggcggacacggaag

SEQ ID NO: 8171151 - DNA, 21 bp, Homo sapiens
ccctggaatcctgagtgccag

SEQ ID NO: 8171152 - DNA, 21 bp, Homo sapiens
ccctggaatcctgagtgccag

SEQ ID NO: 8171153 - DNA, 22 bp, Homo sapiens
ccctggaaggttctctggctca

SEQ ID NO: 8171154 - DNA, 22 bp, Homo sapiens
agggcagagatctgagtgggca

SEQ ID NO: 8171155 - DNA, 22 bp, Homo sapiens
agggcagagagatgaatgggat

SEQ ID NO: 8171156 - DNA, 22 bp, Homo sapiens
agggcagagagatgaatgggat

SEQ ID NO: 8171157 - DNA, 22 bp, Homo sapiens
agggcagagagatgaatgggat

SEQ ID NO: 8171158 - DNA, 22 bp, Homo sapiens
agggcagagacatgcttcctga

SEQ ID NO: 8171159 - DNA, 18 bp, Homo sapiens
ccctcttgcacaaagcaa

SEQ ID NO: 8171160 - DNA, 18 bp, Homo sapiens
ccctcttgcacaaagcaa

SEQ ID NO: 8171161 - DNA, 18 bp, Homo sapiens
ccctcttgcacaaagcaa

SEQ ID NO: 8171162 - DNA, 18 bp, Homo sapiens
ccctcttgcacaaagcaa

SEQ ID NO: 8171163 - DNA, 22 bp, Homo sapiens
agggcagagcactgaattggga

SEQ ID NO: 8171164 - DNA, 22 bp, Homo sapiens
agggcagagattaattaagaca

SEQ ID NO: 8171165 - DNA, 22 bp, Homo sapiens
agggcagagatctgagtgggca

SEQ ID NO: 8171166 - DNA, 22 bp, Homo sapiens
agggcagagatctgagtgggca

SEQ ID NO: 8171167 - DNA, 22 bp, Homo sapiens
cagctgaattcttcagactcca

SEQ ID NO: 8171168 - DNA, 22 bp, Homo sapiens
cagctgaattcttcagactcca

SEQ ID NO: 8171169 - DNA, 22 bp, Homo sapiens
cagctgacactttgacctagag

SEQ ID NO: 8171170 - DNA, 22 bp, Homo sapiens
cagctgacatggtatttgtgcc

SEQ ID NO: 8171171 - DNA, 22 bp, Homo sapiens
cagctgacaaactctgagctta

SEQ ID NO: 8171172 - DNA, 22 bp, Homo sapiens
cagctgacgccagagtggaatt

SEQ ID NO: 8171173 - DNA, 22 bp, Homo sapiens
cagctgacctggctaagggagc

SEQ ID NO: 8171174 - DNA, 22 bp, Homo sapiens
cagctgagaaaggcaggctcac

SEQ ID NO: 8171175 - DNA, 22 bp, Homo sapiens
cagctgacttcataggaagaca

SEQ ID NO: 8171176 - DNA, 22 bp, Homo sapiens
cagctgaaggtaggaaccagga

SEQ ID NO: 8171177 - DNA, 22 bp, Homo sapiens
cagctctgtctgtagaaacttc

SEQ ID NO: 8171178 - DNA, 22 bp, Homo sapiens
cagctctgtaaattccttcatc

SEQ ID NO: 8171179 - DNA, 22 bp, Homo sapiens
cagctctgtaaattccttcatc

SEQ ID NO: 8171180 - DNA, 22 bp, Homo sapiens
cagctctgtaaattccttcatc

SEQ ID NO: 8171181 - DNA, 22 bp, Homo sapiens
cagctctgtaaattccttcatc

SEQ ID NO: 8171182 - DNA, 22 bp, Homo sapiens
cagctctggttcctgggcccag

SEQ ID NO: 8171183 - DNA, 22 bp, Homo sapiens
cagctctggttcctgggcccag

SEQ ID NO: 8171184 - DNA, 22 bp, Homo sapiens
cagctctgggtgacaggagggc

SEQ ID NO: 8171185 - DNA, 22 bp, Homo sapiens
cagctctgggtgacaggagggc

SEQ ID NO: 8171186 - DNA, 22 bp, Homo sapiens
cagctctgggtgacaggagggc

SEQ ID NO: 8171187 - DNA, 22 bp, Homo sapiens
cagctctggggcagagtgacta

SEQ ID NO: 8171188 - DNA, 22 bp, Homo sapiens
cagctctggggcagagtgacta

SEQ ID NO: 8171189 - DNA, 20 bp, Homo sapiens
cagctctgggcaggtcgagg

SEQ ID NO: 8171190 - DNA, 22 bp, Homo sapiens
cagctctgggtaggaggaatct

SEQ ID NO: 8171191 - DNA, 22 bp, Homo sapiens
cagctctggggcagagtgacta

SEQ ID NO: 8171192 - DNA, 22 bp, Homo sapiens
cagctgagaaaggcaggctcac

SEQ ID NO: 8171193 - DNA, 22 bp, Homo sapiens
cagctgagaaaggcaggctcac

SEQ ID NO: 8171194 - DNA, 22 bp, Homo sapiens
cagctgagaaatggggaaaggg

SEQ ID NO: 8171195 - DNA, 22 bp, Homo sapiens
cagctgagaccagaatgcaggt

SEQ ID NO: 8171196 - DNA, 22 bp, Homo sapiens
cagctgagaagtgatagctgca

SEQ ID NO: 8171197 - DNA, 22 bp, Homo sapiens
cagctgagaagtgatagctgca

SEQ ID NO: 8171198 - DNA, 22 bp, Homo sapiens
cagctgagaagtgatagctgca

SEQ ID NO: 8171199 - DNA, 22 bp, Homo sapiens
agctgagggcaggatggggtga

SEQ ID NO: 8171200 - DNA, 22 bp, Homo sapiens
agctgagggcaggatggggtga

SEQ ID NO: 8171201 - DNA, 22 bp, Homo sapiens
agctgattccactttttcccca

SEQ ID NO: 8171202 - DNA, 23 bp, Homo sapiens
agctgaggctgtgggtgtcagag

SEQ ID NO: 8171203 - DNA, 22 bp, Homo sapiens
cagctgagagacaatgagtcat

SEQ ID NO: 8171204 - DNA, 22 bp, Homo sapiens
cagctgagagacaatgagtcat

SEQ ID NO: 8171205 - DNA, 22 bp, Homo sapiens
cagctgagaccagaatgcaggt

SEQ ID NO: 8171206 - DNA, 22 bp, Homo sapiens
agctgcaagataaaagtgatgt

SEQ ID NO: 8171207 - DNA, 22 bp, Homo sapiens
agctgcaagatttcttttgtat

SEQ ID NO: 8171208 - DNA, 14 bp, Homo sapiens
agctgcaagcatcc

SEQ ID NO: 8171209 - DNA, 22 bp, Homo sapiens
agctgcaagtaagcttgctcct

SEQ ID NO: 8171210 - DNA, 22 bp, Homo sapiens
agctgcaagtccaaaggaatta

SEQ ID NO: 8171211 - DNA, 22 bp, Homo sapiens
agctgcaagtctgtgtggggag

SEQ ID NO: 8171212 - DNA, 22 bp, Homo sapiens
agctgcactgacctgtatgaag

SEQ ID NO: 8171213 - DNA, 22 bp, Homo sapiens
agctgcaattctggacatagtc

SEQ ID NO: 8171214 - DNA, 22 bp, Homo sapiens
agctgcaattaaagactgtgaa

SEQ ID NO: 8171215 - DNA, 22 bp, Homo sapiens
agctgcaatacccttcttcctt

SEQ ID NO: 8171216 - DNA, 22 bp, Homo sapiens
agctgcaagtgttgcctcctac

SEQ ID NO: 8171217 - DNA, 23 bp, Homo sapiens
agctgcaagactccctgtctgag

SEQ ID NO: 8171218 - DNA, 22 bp, Homo sapiens
agctgcaagaagaggtccctga

SEQ ID NO: 8171219 - DNA, 21 bp, Homo sapiens
agctgcaagagcaacatcttt

SEQ ID NO: 8171220 - DNA, 22 bp, Homo sapiens
agctgcaaccttagctataggc

SEQ ID NO: 8171221 - DNA, 22 bp, Homo sapiens
agctgcaactgtccttgccttg

SEQ ID NO: 8171222 - DNA, 22 bp, Homo sapiens
agctgcaacatctgcttgtccc

SEQ ID NO: 8171223 - DNA, 19 bp, Homo sapiens
agctgcaaaaggtggaact

SEQ ID NO: 8171224 - DNA, 21 bp, Homo sapiens
agctgcaaaaacatacagttc

SEQ ID NO: 8171225 - DNA, 22 bp, Homo sapiens
agctgcaaaccaggccggcgcg

SEQ ID NO: 8171226 - DNA, 22 bp, Homo sapiens
agctgcaaagatctgtcagtca

SEQ ID NO: 8171227 - DNA, 20 bp, Homo sapiens
agctgcaacagactgtatgg

SEQ ID NO: 8171228 - DNA, 22 bp, Homo sapiens
agctgcaaaggcacacttgggc

SEQ ID NO: 8171229 - DNA, 22 bp, Homo sapiens
agctgcaaagatgatttgttgt

SEQ ID NO: 8171230 - DNA, 22 bp, Homo sapiens
agctgcagtgaactgttttgtc

SEQ ID NO: 8171231 - DNA, 22 bp, Homo sapiens
agctgcagtgaattcgctaact

SEQ ID NO: 8171232 - DNA, 22 bp, Homo sapiens
agctgcagttagccccagatga

SEQ ID NO: 8171233 - DNA, 22 bp, Homo sapiens
agctgcagttcgttccagctct

SEQ ID NO: 8171234 - DNA, 22 bp, Homo sapiens
agctgcagttagccccagatga

SEQ ID NO: 8171235 - DNA, 22 bp, Homo sapiens
agctgcagttagccccagatga

SEQ ID NO: 8171236 - DNA, 22 bp, Homo sapiens
agctgcagtcaagctgggccac

SEQ ID NO: 8171237 - DNA, 22 bp, Homo sapiens
caggaaggggctcactctggcc

SEQ ID NO: 8171238 - DNA, 22 bp, Homo sapiens
agctgccacagagcctggccag

SEQ ID NO: 8171239 - DNA, 22 bp, Homo sapiens
agctgccacatgcccaagggca

SEQ ID NO: 8171240 - DNA, 22 bp, Homo sapiens
agctgccacagagcctggccag

SEQ ID NO: 8171241 - DNA, 22 bp, Homo sapiens
agctgccacagagcctggccag

SEQ ID NO: 8171242 - DNA, 22 bp, Homo sapiens
agctgccaagtttctcagttta

SEQ ID NO: 8171243 - DNA, 22 bp, Homo sapiens
agctgccaagtttctcagttta

SEQ ID NO: 8171244 - DNA, 22 bp, Homo sapiens
agctgccaagttggagtagcaa

SEQ ID NO: 8171245 - DNA, 22 bp, Homo sapiens
agctgccaagttggagtagcaa

SEQ ID NO: 8171246 - DNA, 22 bp, Homo sapiens
agctgcatttcagtgaaatatt

SEQ ID NO: 8171247 - DNA, 22 bp, Homo sapiens
agctgcagttcgttccagctct

SEQ ID NO: 8171248 - DNA, 22 bp, Homo sapiens
agctgcagttcgttccagctct

SEQ ID NO: 8171249 - DNA, 22 bp, Homo sapiens
caggaaggcgcggctgtgcctg

SEQ ID NO: 8171250 - DNA, 22 bp, Homo sapiens
caggaaggcccacctgtcctgt

SEQ ID NO: 8171251 - DNA, 22 bp, Homo sapiens
caggaaggcccacctgtcctgt

SEQ ID NO: 8171252 - DNA, 22 bp, Homo sapiens
caggaaggcccacctgtcctgt

SEQ ID NO: 8171253 - DNA, 22 bp, Homo sapiens
caggaaggcgcggctgtgcctg

SEQ ID NO: 8171254 - DNA, 22 bp, Homo sapiens
caggaaggcccacctgtcctgt

SEQ ID NO: 8171255 - DNA, 22 bp, Homo sapiens
caggaaggcccacctgtcctgt

SEQ ID NO: 8171256 - DNA, 22 bp, Homo sapiens
caggaaggcccacctgtcctgt

SEQ ID NO: 8171257 - DNA, 19 bp, Homo sapiens
caggaaggggcgaatctgg

SEQ ID NO: 8171258 - DNA, 22 bp, Homo sapiens
caggaaggggctcactctggcc

SEQ ID NO: 8171259 - DNA, 19 bp, Homo sapiens
caggaaggggcgaatctgg

SEQ ID NO: 8171260 - DNA, 22 bp, Homo sapiens
caggaaggcgcggctgtgcctg

SEQ ID NO: 8171261 - DNA, 22 bp, Homo sapiens
caggaaggcgcggctgtgcctg

SEQ ID NO: 8171262 - DNA, 22 bp, Homo sapiens
caggaaggcgcggctgtgcctg

SEQ ID NO: 8171263 - DNA, 22 bp, Homo sapiens
caggaaggcgcggctgtgcctg

SEQ ID NO: 8171264 - DNA, 19 bp, Homo sapiens
agctgcagaccagaagtgc

SEQ ID NO: 8171265 - DNA, 19 bp, Homo sapiens
agctgcagaccagaagtgc

SEQ ID NO: 8171266 - DNA, 22 bp, Homo sapiens
agctgcagaaaggacaactaat

SEQ ID NO: 8171267 - DNA, 22 bp, Homo sapiens
agctgcagaaaggacaactaat

SEQ ID NO: 8171268 - DNA, 20 bp, Homo sapiens
agctgcagaacccactggac

SEQ ID NO: 8171269 - DNA, 20 bp, Homo sapiens
agctgcagaacccactggac

SEQ ID NO: 8171270 - DNA, 19 bp, Homo sapiens
agctgcagaccagaagtgc

SEQ ID NO: 8171271 - DNA, 18 bp, Homo sapiens
agctgcagaccaggaggt

SEQ ID NO: 8171272 - DNA, 18 bp, Homo sapiens
agctgcagaccaggaggt

SEQ ID NO: 8171273 - DNA, 18 bp, Homo sapiens
agctgcagaccaggaggt

SEQ ID NO: 8171274 - DNA, 22 bp, Homo sapiens
agctgcagagaaaagaggctgg

SEQ ID NO: 8171275 - DNA, 22 bp, Homo sapiens
agctgcagagaaaagaggctgg

SEQ ID NO: 8171276 - DNA, 22 bp, Homo sapiens
agctgcagagaaaagaggctgg

SEQ ID NO: 8171277 - DNA, 22 bp, Homo sapiens
agctgcagatcaataggctcac

SEQ ID NO: 8171278 - DNA, 22 bp, Homo sapiens
agctgcagatcaataggctcac

SEQ ID NO: 8171279 - DNA, 22 bp, Homo sapiens
agctgcagataggatgttattt

SEQ ID NO: 8171280 - DNA, 22 bp, Homo sapiens
agctgcagaggtttgtgcaaca

SEQ ID NO: 8171281 - DNA, 22 bp, Homo sapiens
agctgcagaggtttgtgcaaca

SEQ ID NO: 8171282 - DNA, 17 bp, Homo sapiens
agctgcagatgaagttg

SEQ ID NO: 8171283 - DNA, 23 bp, Homo sapiens
agctgcagatgctcagcgggcag

SEQ ID NO: 8171284 - DNA, 22 bp, Homo sapiens
agctgcagattctatctagaag

SEQ ID NO: 8171285 - DNA, 22 bp, Homo sapiens
agctgcagcactccagtagccg

SEQ ID NO: 8171286 - DNA, 22 bp, Homo sapiens
agctgcagattctctacttcat

SEQ ID NO: 8171287 - DNA, 22 bp, Homo sapiens
agctgcagattctctacttcat

SEQ ID NO: 8171288 - DNA, 22 bp, Homo sapiens
agctgcagattctctacttcat

SEQ ID NO: 8171289 - DNA, 22 bp, Homo sapiens
agctgcagattctatctagaag

SEQ ID NO: 8171290 - DNA, 22 bp, Homo sapiens
agctgcagcactccagtagccg

SEQ ID NO: 8171291 - DNA, 22 bp, Homo sapiens
agctgcagcactccagtagccg

SEQ ID NO: 8171292 - DNA, 22 bp, Homo sapiens
agctgcagcactccagtagccg

SEQ ID NO: 8171293 - DNA, 22 bp, Homo sapiens
agctgcagcactccagtagccg

SEQ ID NO: 8171294 - DNA, 21 bp, Homo sapiens
agctgcagccatgtacatggc

SEQ ID NO: 8171295 - DNA, 22 bp, Homo sapiens
caggaagagaacatggaggctg

SEQ ID NO: 8171296 - DNA, 22 bp, Homo sapiens
caggaagagaacatggaggctg

SEQ ID NO: 8171297 - DNA, 22 bp, Homo sapiens
caggaaggaccgtccagatcag

SEQ ID NO: 8171298 - DNA, 22 bp, Homo sapiens
caggaaggaccgtccagatcag

SEQ ID NO: 8171299 - DNA, 22 bp, Homo sapiens
caggaaggaccgtccagatcag

SEQ ID NO: 8171300 - DNA, 22 bp, Homo sapiens
agctgggctgggctgagctgag

SEQ ID NO: 8171301 - DNA, 19 bp, Homo sapiens
agctgggctgtcacagtga

SEQ ID NO: 8171302 - DNA, 19 bp, Homo sapiens
agctgggctgtcacagtga

SEQ ID NO: 8171303 - DNA, 22 bp, Homo sapiens
agctgggcttggccaggtcgct

SEQ ID NO: 8171304 - DNA, 22 bp, Homo sapiens
caggccaggctgcatttgcccc

SEQ ID NO: 8171305 - DNA, 22 bp, Homo sapiens
caggccagggagaatatgaagc

SEQ ID NO: 8171306 - DNA, 22 bp, Homo sapiens
caggccagggagaatatgaagc

SEQ ID NO: 8171307 - DNA, 22 bp, Homo sapiens
caggccagggagaatatgaagc

SEQ ID NO: 8171308 - DNA, 22 bp, Homo sapiens
agctgggctggagctccaagcg

SEQ ID NO: 8171309 - DNA, 22 bp, Homo sapiens
agctgggctgggctgagctgag

SEQ ID NO: 8171310 - DNA, 22 bp, Homo sapiens
agctgggctgggctgagctgag

SEQ ID NO: 8171311 - DNA, 22 bp, Homo sapiens
caggccagcttcctgacatcct

SEQ ID NO: 8171312 - DNA, 22 bp, Homo sapiens
caggccagcgtccagaacaagc

SEQ ID NO: 8171313 - DNA, 22 bp, Homo sapiens
caggccagcgtccagaacaagc

SEQ ID NO: 8171314 - DNA, 22 bp, Homo sapiens
caggccagcgtccagaacaagc

SEQ ID NO: 8171315 - DNA, 22 bp, Homo sapiens
caggccagcgtccagaacaagc

SEQ ID NO: 8171316 - DNA, 22 bp, Homo sapiens
caggccagcgtccagaacaagc

SEQ ID NO: 8171317 - DNA, 22 bp, Homo sapiens
caggccagcgtccagaacaagc

SEQ ID NO: 8171318 - DNA, 22 bp, Homo sapiens
caggccaggctgcatttgcccc

SEQ ID NO: 8171319 - DNA, 22 bp, Homo sapiens
caggccaggctgcatttgcccc

SEQ ID NO: 8171320 - DNA, 22 bp, Homo sapiens
caggccaggctgcatttgcccc

SEQ ID NO: 8171321 - DNA, 22 bp, Homo sapiens
caggccaggctgcatttgcccc

SEQ ID NO: 8171322 - DNA, 22 bp, Homo sapiens
caggccagcttcctgacatcct

SEQ ID NO: 8171323 - DNA, 22 bp, Homo sapiens
caggccagcttcctgacatcct

SEQ ID NO: 8171324 - DNA, 22 bp, Homo sapiens
caggccagcttcctgacatcct

SEQ ID NO: 8171325 - DNA, 22 bp, Homo sapiens
caggccagcttcctgacatcct

SEQ ID NO: 8171326 - DNA, 22 bp, Homo sapiens
caggccagagtccaactccaga

SEQ ID NO: 8171327 - DNA, 20 bp, Homo sapiens
caggccagaggtttgatggc

SEQ ID NO: 8171328 - DNA, 20 bp, Homo sapiens
caggccagaggtttgatggc

SEQ ID NO: 8171329 - DNA, 22 bp, Homo sapiens
caggccagagtccaactccaga

SEQ ID NO: 8171330 - DNA, 22 bp, Homo sapiens
caggccagagtccaactccaga

SEQ ID NO: 8171331 - DNA, 22 bp, Homo sapiens
caggccagagtccaactccaga

SEQ ID NO: 8171332 - DNA, 22 bp, Homo sapiens
caggccagcagggcctccgtgg

SEQ ID NO: 8171333 - DNA, 22 bp, Homo sapiens
caggccagcagggcctccgtgg

SEQ ID NO: 8171334 - DNA, 22 bp, Homo sapiens
caggccagcggcccgcgcgttc

SEQ ID NO: 8171335 - DNA, 22 bp, Homo sapiens
caggccagcggcccgcgcgttc

SEQ ID NO: 8171336 - DNA, 22 bp, Homo sapiens
caggccagcagggcctccgtgg

SEQ ID NO: 8171337 - DNA, 22 bp, Homo sapiens
caggccagcagggcctccgtgg

SEQ ID NO: 8171338 - DNA, 22 bp, Homo sapiens
caggccagaggctgttgttgcg

SEQ ID NO: 8171339 - DNA, 20 bp, Homo sapiens
caggccagaggtttgatggc

SEQ ID NO: 8171340 - DNA, 22 bp, Homo sapiens
caggccagaggctgttgttgcg

SEQ ID NO: 8171341 - DNA, 22 bp, Homo sapiens
caggcatgagccaggcccctcc

SEQ ID NO: 8171342 - DNA, 22 bp, Homo sapiens
caggcatagaagggcaagaata

SEQ ID NO: 8171343 - DNA, 20 bp, Homo sapiens
caggcagtttgtggttaggg

SEQ ID NO: 8171344 - DNA, 22 bp, Homo sapiens
agctggcctccgggtgcctggg

SEQ ID NO: 8171345 - DNA, 22 bp, Homo sapiens
agctggcctccgggtgcctggg

SEQ ID NO: 8171346 - DNA, 22 bp, Homo sapiens
agctggcctcactgcagaatgc

SEQ ID NO: 8171347 - DNA, 22 bp, Homo sapiens
agctggcctccgggtgcctggg

SEQ ID NO: 8171348 - DNA, 18 bp, Homo sapiens
agctggccctggctgccg

SEQ ID NO: 8171349 - DNA, 22 bp, Homo sapiens
agctggccggcctccaggtgga

SEQ ID NO: 8171350 - DNA, 18 bp, Homo sapiens
agctggccctggctgccg

SEQ ID NO: 8171351 - DNA, 22 bp, Homo sapiens
agctggccggcctccaggtgga

SEQ ID NO: 8171352 - DNA, 22 bp, Homo sapiens
agctggccggcctccaggtgga

SEQ ID NO: 8171353 - DNA, 18 bp, Homo sapiens
agctggccctggctgccg

SEQ ID NO: 8171354 - DNA, 18 bp, Homo sapiens
agctggccctggctgccg

SEQ ID NO: 8171355 - DNA, 18 bp, Homo sapiens
agctggccctggctgccg

SEQ ID NO: 8171356 - DNA, 20 bp, Homo sapiens
agctggcccccggtggcctg

SEQ ID NO: 8171357 - DNA, 22 bp, Homo sapiens
agctggccctcgagagccaatt

SEQ ID NO: 8171358 - DNA, 22 bp, Homo sapiens
caggcacttctgctgcttgtct

SEQ ID NO: 8171359 - DNA, 22 bp, Homo sapiens
caggcactttgctgggggcgca

SEQ ID NO: 8171360 - DNA, 22 bp, Homo sapiens
caggcactgtgttaggcactgt

SEQ ID NO: 8171361 - DNA, 22 bp, Homo sapiens
caggcactgtgctgagctctgc

SEQ ID NO: 8171362 - DNA, 22 bp, Homo sapiens
agctggccattgtgagtggcct

SEQ ID NO: 8171363 - DNA, 22 bp, Homo sapiens
agctggccattgtgagtggcct

SEQ ID NO: 8171364 - DNA, 22 bp, Homo sapiens
agctggccattgtgagtggcct

SEQ ID NO: 8171365 - DNA, 22 bp, Homo sapiens
agctggcccactgtgtggtcca

SEQ ID NO: 8171366 - DNA, 20 bp, Homo sapiens
agctggcccacaggtgtggg

SEQ ID NO: 8171367 - DNA, 20 bp, Homo sapiens
agctggcccacaggtgtggg

SEQ ID NO: 8171368 - DNA, 22 bp, Homo sapiens
agctggccattgtgagtggcct

SEQ ID NO: 8171369 - DNA, 20 bp, Homo sapiens
agctggcccacaggtgtggg

SEQ ID NO: 8171370 - DNA, 20 bp, Homo sapiens
agctggcccacaggtgtggg

SEQ ID NO: 8171371 - DNA, 20 bp, Homo sapiens
agctggcccccggtggcctg

SEQ ID NO: 8171372 - DNA, 22 bp, Homo sapiens
agctggcccactgtgtggtcca

SEQ ID NO: 8171373 - DNA, 20 bp, Homo sapiens
agctggcccccggtggcctg

SEQ ID NO: 8171374 - DNA, 22 bp, Homo sapiens
agctggcccactgtgtggtcca

SEQ ID NO: 8171375 - DNA, 22 bp, Homo sapiens
agctggcccactgtgtggtcca

SEQ ID NO: 8171376 - DNA, 22 bp, Homo sapiens
caggcactcattcagagaggtg

SEQ ID NO: 8171377 - DNA, 22 bp, Homo sapiens
caggcacactgtctacactgag

SEQ ID NO: 8171378 - DNA, 22 bp, Homo sapiens
caggcacactgtctacactgag

SEQ ID NO: 8171379 - DNA, 22 bp, Homo sapiens
caggcactgcactaccactttt

SEQ ID NO: 8171380 - DNA, 22 bp, Homo sapiens
caggcactggccagtcagcaca

SEQ ID NO: 8171381 - DNA, 22 bp, Homo sapiens
caggcactgtgctagatccttg

SEQ ID NO: 8171382 - DNA, 22 bp, Homo sapiens
caggcactggggatgctgggat

SEQ ID NO: 8171383 - DNA, 22 bp, Homo sapiens
agctgctgcgcctcaccctggc

SEQ ID NO: 8171384 - DNA, 22 bp, Homo sapiens
agctgctgcgcctcaccctggc

SEQ ID NO: 8171385 - DNA, 22 bp, Homo sapiens
agctgctgcctcactggtctgt

SEQ ID NO: 8171386 - DNA, 22 bp, Homo sapiens
agctgctgccggtggccaccct

SEQ ID NO: 8171387 - DNA, 22 bp, Homo sapiens
agctgctgccggtggccaccct

SEQ ID NO: 8171388 - DNA, 22 bp, Homo sapiens
agctgctgccggtggccaccct

SEQ ID NO: 8171389 - DNA, 22 bp, Homo sapiens
agctgctgcaagtggtgctaac

SEQ ID NO: 8171390 - DNA, 22 bp, Homo sapiens
agctgctgcccataggtgacat

SEQ ID NO: 8171391 - DNA, 22 bp, Homo sapiens
agctgctgccggtggccaccct

SEQ ID NO: 8171392 - DNA, 22 bp, Homo sapiens
agctgctgcccataggtgacat

SEQ ID NO: 8171393 - DNA, 22 bp, Homo sapiens
agctgctgcccataggtgacat

SEQ ID NO: 8171394 - DNA, 22 bp, Homo sapiens
agctgctgcccataggtgacat

SEQ ID NO: 8171395 - DNA, 22 bp, Homo sapiens
agctgctgcccataggtgacat

SEQ ID NO: 8171396 - DNA, 22 bp, Homo sapiens
caggcacactgtctacactgag

SEQ ID NO: 8171397 - DNA, 19 bp, Homo sapiens
agctgctggcccagggacc

SEQ ID NO: 8171398 - DNA, 19 bp, Homo sapiens
agctgctggcccagggacc

SEQ ID NO: 8171399 - DNA, 22 bp, Homo sapiens
agctgctgcggaaagatgccac

SEQ ID NO: 8171400 - DNA, 19 bp, Homo sapiens
agctgctggcccagggacc

SEQ ID NO: 8171401 - DNA, 19 bp, Homo sapiens
agctgctggcccagggacc

SEQ ID NO: 8171402 - DNA, 19 bp, Homo sapiens
agctgctggcccagggacc

SEQ ID NO: 8171403 - DNA, 19 bp, Homo sapiens
agctgctggcccagggacc

SEQ ID NO: 8171404 - DNA, 22 bp, Homo sapiens
agctgctgcgcctcaccctggc

SEQ ID NO: 8171405 - DNA, 22 bp, Homo sapiens
agctgctgcggaaagatgccac

SEQ ID NO: 8171406 - DNA, 22 bp, Homo sapiens
agctgctgcggaaagatgccac

SEQ ID NO: 8171407 - DNA, 22 bp, Homo sapiens
agctgctgcggaaagatgccac

SEQ ID NO: 8171408 - DNA, 22 bp, Homo sapiens
caggaggagggtacaccatcag

SEQ ID NO: 8171409 - DNA, 22 bp, Homo sapiens
caggaggagggcagccgcctcc

SEQ ID NO: 8171410 - DNA, 22 bp, Homo sapiens
caggaggagggtacaccatcag

SEQ ID NO: 8171411 - DNA, 22 bp, Homo sapiens
caggaggagggcagccgcctcc

SEQ ID NO: 8171412 - DNA, 22 bp, Homo sapiens
caggaggagggcagccgcctcc

SEQ ID NO: 8171413 - DNA, 22 bp, Homo sapiens
caggaggagccagcgcccttca

SEQ ID NO: 8171414 - DNA, 22 bp, Homo sapiens
caggaggagctggccgcctcat

SEQ ID NO: 8171415 - DNA, 22 bp, Homo sapiens
caggaggagctggccgcctcat

SEQ ID NO: 8171416 - DNA, 22 bp, Homo sapiens
caggaggagctggccgcctcat

SEQ ID NO: 8171417 - DNA, 22 bp, Homo sapiens
caggaggagctggccgcctcat

SEQ ID NO: 8171418 - DNA, 22 bp, Homo sapiens
caggaggagggcagccgcctcc

SEQ ID NO: 8171419 - DNA, 22 bp, Homo sapiens
caggaggagggtacaccatcag

SEQ ID NO: 8171420 - DNA, 22 bp, Homo sapiens
caggaggagggtacaccatcag

SEQ ID NO: 8171421 - DNA, 22 bp, Homo sapiens
caggaggaggtgaggtagaact

SEQ ID NO: 8171422 - DNA, 19 bp, Homo sapiens
agctgctgattggtggagg

SEQ ID NO: 8171423 - DNA, 22 bp, Homo sapiens
agctgctgagccatgtcctgct

SEQ ID NO: 8171424 - DNA, 22 bp, Homo sapiens
agctgctgagccatgtcctgct

SEQ ID NO: 8171425 - DNA, 22 bp, Homo sapiens
agctgctgagccatgtcctgct

SEQ ID NO: 8171426 - DNA, 22 bp, Homo sapiens
caggaggattgcttgaggccag

SEQ ID NO: 8171427 - DNA, 22 bp, Homo sapiens
caggaggattgcttgaggccag

SEQ ID NO: 8171428 - DNA, 22 bp, Homo sapiens
caggaggattgcttgaggccag

SEQ ID NO: 8171429 - DNA, 22 bp, Homo sapiens
caggaggacatactggctcaca

SEQ ID NO: 8171430 - DNA, 22 bp, Homo sapiens
caggaggacatactggctcaca

SEQ ID NO: 8171431 - DNA, 22 bp, Homo sapiens
caggaggacatactggctcaca

SEQ ID NO: 8171432 - DNA, 22 bp, Homo sapiens
caggaggacatactggctcaca

SEQ ID NO: 8171433 - DNA, 22 bp, Homo sapiens
caggaggagccagcgcccttca

SEQ ID NO: 8171434 - DNA, 22 bp, Homo sapiens
caggaggagcattagcgtctca

SEQ ID NO: 8171435 - DNA, 22 bp, Homo sapiens
caggaggagcattagcgtctca

SEQ ID NO: 8171436 - DNA, 22 bp, Homo sapiens
caggaggagcattagcgtctca

SEQ ID NO: 8171437 - DNA, 23 bp, Homo sapiens
caggaggagaaggcttggttggc

SEQ ID NO: 8171438 - DNA, 22 bp, Homo sapiens
caggaggagcattagcgtctca

SEQ ID NO: 8171439 - DNA, 23 bp, Homo sapiens
caggaggagaaggcttggttggc

SEQ ID NO: 8171440 - DNA, 22 bp, Homo sapiens
agctgccacatggtgtcactgt

SEQ ID NO: 8171441 - DNA, 21 bp, Homo sapiens
agctgccaccctagcttctga

SEQ ID NO: 8171442 - DNA, 21 bp, Homo sapiens
agctgccaccctagcttctga

SEQ ID NO: 8171443 - DNA, 21 bp, Homo sapiens
agctgccaccctagcttctga

SEQ ID NO: 8171444 - DNA, 22 bp, Homo sapiens
agctgccacctctgcctttggg

SEQ ID NO: 8171445 - DNA, 22 bp, Homo sapiens
agctgccactgagggtgcacag

SEQ ID NO: 8171446 - DNA, 22 bp, Homo sapiens
agctgccacctctgcctttggg

SEQ ID NO: 8171447 - DNA, 22 bp, Homo sapiens
agctgccactgagggtgcacag

SEQ ID NO: 8171448 - DNA, 22 bp, Homo sapiens
caggagccccaggctgacaata

SEQ ID NO: 8171449 - DNA, 22 bp, Homo sapiens
caggagccccaggctgacaata

SEQ ID NO: 8171450 - DNA, 22 bp, Homo sapiens
cagggagctgacaaccaaggag

SEQ ID NO: 8171451 - DNA, 22 bp, Homo sapiens
cagggagctggagttggagtac

SEQ ID NO: 8171452 - DNA, 22 bp, Homo sapiens
cagggagctctgggccggactc

SEQ ID NO: 8171453 - DNA, 22 bp, Homo sapiens
cagggagctctgggccggactc

SEQ ID NO: 8171454 - DNA, 22 bp, Homo sapiens
cagggagctggctggctgtgcc

SEQ ID NO: 8171455 - DNA, 22 bp, Homo sapiens
cagggagctggctggcgtgagt

SEQ ID NO: 8171456 - DNA, 22 bp, Homo sapiens
cagggagctggctggcgtgagt

SEQ ID NO: 8171457 - DNA, 22 bp, Homo sapiens
cagggagctggctggctgtgcc

SEQ ID NO: 8171458 - DNA, 22 bp, Homo sapiens
cagggagctggctggctgtgcc

SEQ ID NO: 8171459 - DNA, 22 bp, Homo sapiens
cagggatgggatggagtcagtt

SEQ ID NO: 8171460 - DNA, 22 bp, Homo sapiens
cagggatgggatggagtcagtt

SEQ ID NO: 8171461 - DNA, 22 bp, Homo sapiens
cagggatggttgagaattggta

SEQ ID NO: 8171462 - DNA, 19 bp, Homo sapiens
cagggatgggtagggactc

SEQ ID NO: 8171463 - DNA, 19 bp, Homo sapiens
cagggatgggtagggactc

SEQ ID NO: 8171464 - DNA, 19 bp, Homo sapiens
cagggatgggtagggactc

SEQ ID NO: 8171465 - DNA, 22 bp, Homo sapiens
cagggatgggatggagtcagtt

SEQ ID NO: 8171466 - DNA, 22 bp, Homo sapiens
cagggatgggatggagtcagtt

SEQ ID NO: 8171467 - DNA, 22 bp, Homo sapiens
cagggagctttcccaggaccct

SEQ ID NO: 8171468 - DNA, 22 bp, Homo sapiens
cagggatggcgctggctgcccg

SEQ ID NO: 8171469 - DNA, 22 bp, Homo sapiens
cagggatggcgctggctgcccg

SEQ ID NO: 8171470 - DNA, 22 bp, Homo sapiens
cagggagctggtgccagccgac

SEQ ID NO: 8171471 - DNA, 22 bp, Homo sapiens
cagggagctttcccaggaccct

SEQ ID NO: 8171472 - DNA, 22 bp, Homo sapiens
caggctggagtgcagttgtgca

SEQ ID NO: 8171473 - DNA, 22 bp, Homo sapiens
caggctggagtgcagttgtgca

SEQ ID NO: 8171474 - DNA, 22 bp, Homo sapiens
caggctggagtgcagttgtgca

SEQ ID NO: 8171475 - DNA, 22 bp, Homo sapiens
caggctggagttacctttaggg

SEQ ID NO: 8171476 - DNA, 22 bp, Homo sapiens
caggctggagttacctttaggg

SEQ ID NO: 8171477 - DNA, 22 bp, Homo sapiens
caggctggagtgcagttgtgca

SEQ ID NO: 8171478 - DNA, 22 bp, Homo sapiens
cagggagcggagtcccatgcct

SEQ ID NO: 8171479 - DNA, 22 bp, Homo sapiens
cagggagaaatctccaggaggt

SEQ ID NO: 8171480 - DNA, 22 bp, Homo sapiens
cagggagaaatctccaggaggt

SEQ ID NO: 8171481 - DNA, 22 bp, Homo sapiens
cagggagaaatctccaggaggt

SEQ ID NO: 8171482 - DNA, 22 bp, Homo sapiens
cagggagctattagggttagtg

SEQ ID NO: 8171483 - DNA, 22 bp, Homo sapiens
cagggagcggagtcccatgcct

SEQ ID NO: 8171484 - DNA, 22 bp, Homo sapiens
caggctggagttacctttaggg

SEQ ID NO: 8171485 - DNA, 22 bp, Homo sapiens
cagggagaaatctccaggaggt

SEQ ID NO: 8171486 - DNA, 22 bp, Homo sapiens
caggctggagttacctttaggg

SEQ ID NO: 8171487 - DNA, 22 bp, Homo sapiens
cagggagaaatctccaggaggt

SEQ ID NO: 8171488 - DNA, 22 bp, Homo sapiens
caggctggagtgcagtggtgcc

SEQ ID NO: 8171489 - DNA, 22 bp, Homo sapiens
caggctggagtgcagtgtcgcc

SEQ ID NO: 8171490 - DNA, 22 bp, Homo sapiens
caggctggagtacaattgtgtg

SEQ ID NO: 8171491 - DNA, 22 bp, Homo sapiens
caggctggacattagatacata

SEQ ID NO: 8171492 - DNA, 22 bp, Homo sapiens
caggctgctgcctagaatgaca

SEQ ID NO: 8171493 - DNA, 22 bp, Homo sapiens
caggctgctgtccacaaagcat

SEQ ID NO: 8171494 - DNA, 22 bp, Homo sapiens
caggctgctgtccacaaagcat

SEQ ID NO: 8171495 - DNA, 22 bp, Homo sapiens
caggctggacattagatacata

SEQ ID NO: 8171496 - DNA, 22 bp, Homo sapiens
caggctgcggtcggctctggtc

SEQ ID NO: 8171497 - DNA, 22 bp, Homo sapiens
caggctgcggtcggctctggtc

SEQ ID NO: 8171498 - DNA, 22 bp, Homo sapiens
caggctgcggtcggctctggtc

SEQ ID NO: 8171499 - DNA, 22 bp, Homo sapiens
caggctgcggtcggctctggtc

SEQ ID NO: 8171500 - DNA, 22 bp, Homo sapiens
caggctgctccagggtaggaaa

SEQ ID NO: 8171501 - DNA, 22 bp, Homo sapiens
caggctgctgacaggcttggag

SEQ ID NO: 8171502 - DNA, 22 bp, Homo sapiens
caggctgctccagggtaggaaa

SEQ ID NO: 8171503 - DNA, 22 bp, Homo sapiens
caggctgcgtttgtgaaaggta

SEQ ID NO: 8171504 - DNA, 22 bp, Homo sapiens
caggctgcgtttgtgaaaggta

SEQ ID NO: 8171505 - DNA, 22 bp, Homo sapiens
caggctgcggccgtgtgagcat

SEQ ID NO: 8171506 - DNA, 22 bp, Homo sapiens
caggctgcggtcggctctggtc

SEQ ID NO: 8171507 - DNA, 22 bp, Homo sapiens
caggctgcggccgtgtgagcat

SEQ ID NO: 8171508 - DNA, 22 bp, Homo sapiens
caggctgcggtcggctctggtc

SEQ ID NO: 8171509 - DNA, 22 bp, Homo sapiens
caggctgcggtcggctctggtc

SEQ ID NO: 8171510 - DNA, 22 bp, Homo sapiens
caggctgcggccgtgtgagcat

SEQ ID NO: 8171511 - DNA, 22 bp, Homo sapiens
caggctgaggcagtagggtttg

SEQ ID NO: 8171512 - DNA, 22 bp, Homo sapiens
caggctgcggccgtgtgagcat

SEQ ID NO: 8171513 - DNA, 22 bp, Homo sapiens
caggctgagctctggcctgggc

SEQ ID NO: 8171514 - DNA, 19 bp, Homo sapiens
agctgtggatgtgggattt

SEQ ID NO: 8171515 - DNA, 22 bp, Homo sapiens
agctgtggcagcactttggagt

SEQ ID NO: 8171516 - DNA, 22 bp, Homo sapiens
caggctgagctctggcctgggc

SEQ ID NO: 8171517 - DNA, 22 bp, Homo sapiens
agctgtggcagcactttggagt

SEQ ID NO: 8171518 - DNA, 22 bp, Homo sapiens
agctgtgctgccaagttgctga

SEQ ID NO: 8171519 - DNA, 22 bp, Homo sapiens
agctgtggaaatcaggcaatga

SEQ ID NO: 8171520 - DNA, 22 bp, Homo sapiens
agctgtggaaatcaggcaatga

SEQ ID NO: 8171521 - DNA, 22 bp, Homo sapiens
agctgtgctgccaagttgctga

SEQ ID NO: 8171522 - DNA, 22 bp, Homo sapiens
agctgtgctgtggtcatctggg

SEQ ID NO: 8171523 - DNA, 22 bp, Homo sapiens
agctgtgcacactgtgaagtag

SEQ ID NO: 8171524 - DNA, 22 bp, Homo sapiens
agctgtgattatccactggaat

SEQ ID NO: 8171525 - DNA, 22 bp, Homo sapiens
agctgtgcctattcgtggcaag

SEQ ID NO: 8171526 - DNA, 22 bp, Homo sapiens
agctgtgccttgctgcacggtg

SEQ ID NO: 8171527 - DNA, 22 bp, Homo sapiens
agctggggcatttatccactaa

SEQ ID NO: 8171528 - DNA, 22 bp, Homo sapiens
agctggggcatttatccactaa

SEQ ID NO: 8171529 - DNA, 22 bp, Homo sapiens
agctggggcatttatccactaa

SEQ ID NO: 8171530 - DNA, 19 bp, Homo sapiens
agctggggcggtgtgtgtt

SEQ ID NO: 8171531 - DNA, 18 bp, Homo sapiens
agctggggcctctggtcc

SEQ ID NO: 8171532 - DNA, 18 bp, Homo sapiens
agctggggcctctggtcc

SEQ ID NO: 8171533 - DNA, 18 bp, Homo sapiens
agctggggcctctggtcc

SEQ ID NO: 8171534 - DNA, 18 bp, Homo sapiens
agctggggcctctggtcc

SEQ ID NO: 8171535 - DNA, 22 bp, Homo sapiens
caggctcactttctcagtcaca

SEQ ID NO: 8171536 - DNA, 22 bp, Homo sapiens
caggctcactttctcagtcaca

SEQ ID NO: 8171537 - DNA, 22 bp, Homo sapiens
caggctcactttctcagtcaca

SEQ ID NO: 8171538 - DNA, 22 bp, Homo sapiens
caggcctgtctgcacatgaggc

SEQ ID NO: 8171539 - DNA, 22 bp, Homo sapiens
caggcctgtctgcacatgaggc

SEQ ID NO: 8171540 - DNA, 22 bp, Homo sapiens
caggcctgtctgcacatgaggc

SEQ ID NO: 8171541 - DNA, 22 bp, Homo sapiens
caggcctgtctgcacatgaggc

SEQ ID NO: 8171542 - DNA, 22 bp, Homo sapiens
caggctcactgtaaggtcagct

SEQ ID NO: 8171543 - DNA, 22 bp, Homo sapiens
caggctcactgtaaggtcagct

SEQ ID NO: 8171544 - DNA, 22 bp, Homo sapiens
caggctcactgtaaggtcagct

SEQ ID NO: 8171545 - DNA, 22 bp, Homo sapiens
caggctcagatgccctgcgctg

SEQ ID NO: 8171546 - DNA, 22 bp, Homo sapiens
caggctcagatgccctgcgctg

SEQ ID NO: 8171547 - DNA, 22 bp, Homo sapiens
caggctcagatgccctgcgctg

SEQ ID NO: 8171548 - DNA, 22 bp, Homo sapiens
caggctcagatgccctgcgctg

SEQ ID NO: 8171549 - DNA, 22 bp, Homo sapiens
caggctcagaagccagtggagc

SEQ ID NO: 8171550 - DNA, 22 bp, Homo sapiens
caggctcagctctggccagtgc

SEQ ID NO: 8171551 - DNA, 22 bp, Homo sapiens
caggctcagctctggccagtgc

SEQ ID NO: 8171552 - DNA, 22 bp, Homo sapiens
caggctcagctctggccagtgc

SEQ ID NO: 8171553 - DNA, 22 bp, Homo sapiens
caggctcagctctggccagtgc

SEQ ID NO: 8171554 - DNA, 22 bp, Homo sapiens
caggctcagcaggagcctgacc

SEQ ID NO: 8171555 - DNA, 22 bp, Homo sapiens
caggctcagcaggagcctgacc

SEQ ID NO: 8171556 - DNA, 22 bp, Homo sapiens
caggctccacaggggaatccgg

SEQ ID NO: 8171557 - DNA, 22 bp, Homo sapiens
caggctccaagccctctgatgt

SEQ ID NO: 8171558 - DNA, 22 bp, Homo sapiens
caggctccactgtaggcagctc

SEQ ID NO: 8171559 - DNA, 22 bp, Homo sapiens
caggctccactgtaggcagctc

SEQ ID NO: 8171560 - DNA, 22 bp, Homo sapiens
agctgtgattatccactggaat

SEQ ID NO: 8171561 - DNA, 22 bp, Homo sapiens
cagggcctctcctccaggaact

SEQ ID NO: 8171562 - DNA, 22 bp, Homo sapiens
cagggcctctcctccaggaact

SEQ ID NO: 8171563 - DNA, 22 bp, Homo sapiens
cagggcctctcctccaggaact

SEQ ID NO: 8171564 - DNA, 22 bp, Homo sapiens
cagggcctctcatcccacgggc

SEQ ID NO: 8171565 - DNA, 22 bp, Homo sapiens
cagggcctctcatcccacgggc

SEQ ID NO: 8171566 - DNA, 22 bp, Homo sapiens
cagggcctctcatcccacgggc

SEQ ID NO: 8171567 - DNA, 22 bp, Homo sapiens
cagggcctcgaagcctctgggc

SEQ ID NO: 8171568 - DNA, 22 bp, Homo sapiens
cagggcctcgaagcctctgggc

SEQ ID NO: 8171569 - DNA, 22 bp, Homo sapiens
cagggcctcgaagcctctgggc

SEQ ID NO: 8171570 - DNA, 22 bp, Homo sapiens
cagggcctcgaagcctctgggc

SEQ ID NO: 8171571 - DNA, 22 bp, Homo sapiens
cagggcctcgaagcctctgggc

SEQ ID NO: 8171572 - DNA, 22 bp, Homo sapiens
cagggcctcctaaggcatctaa

SEQ ID NO: 8171573 - DNA, 22 bp, Homo sapiens
cagggcctgagggctgctctgc

SEQ ID NO: 8171574 - DNA, 22 bp, Homo sapiens
cagggcctgagggctgctctgc

SEQ ID NO: 8171575 - DNA, 22 bp, Homo sapiens
cagggcctgagggctgctctgc

SEQ ID NO: 8171576 - DNA, 22 bp, Homo sapiens
cagggcctctgtgggctctctc

SEQ ID NO: 8171577 - DNA, 22 bp, Homo sapiens
cagggcctctgtgggctctctc

SEQ ID NO: 8171578 - DNA, 22 bp, Homo sapiens
cagggcctctgtgggctctctc

SEQ ID NO: 8171579 - DNA, 22 bp, Homo sapiens
cagggcctgcaagagacctggg

SEQ ID NO: 8171580 - DNA, 22 bp, Homo sapiens
cagggcctgcaagagacctggg

SEQ ID NO: 8171581 - DNA, 22 bp, Homo sapiens
cagggcctcctaaggcatctaa

SEQ ID NO: 8171582 - DNA, 22 bp, Homo sapiens
cagggcctcctaaggcatctaa

SEQ ID NO: 8171583 - DNA, 22 bp, Homo sapiens
cagggcctcctaaggcatctaa

SEQ ID NO: 8171584 - DNA, 22 bp, Homo sapiens
cagggcctcctaaggcatctaa

SEQ ID NO: 8171585 - DNA, 22 bp, Homo sapiens
cagggccaggctgatggcctgg

SEQ ID NO: 8171586 - DNA, 22 bp, Homo sapiens
cagggcctccccggcagtcttt

SEQ ID NO: 8171587 - DNA, 22 bp, Homo sapiens
cagggcctccccggcagtcttt

SEQ ID NO: 8171588 - DNA, 23 bp, Homo sapiens
cagggccaggcagcagctgtcac

SEQ ID NO: 8171589 - DNA, 22 bp, Homo sapiens
cagggatgtgatgagctgagcc

SEQ ID NO: 8171590 - DNA, 22 bp, Homo sapiens
cagggatgtgatgagctgagcc

SEQ ID NO: 8171591 - DNA, 22 bp, Homo sapiens
cagggatgtgatgagctgagcc

SEQ ID NO: 8171592 - DNA, 22 bp, Homo sapiens
cagggatgtgatgagctgagcc

SEQ ID NO: 8171593 - DNA, 22 bp, Homo sapiens
cagggatgtctctggaagggag

SEQ ID NO: 8171594 - DNA, 22 bp, Homo sapiens
cagggatgtctctggaagggag

SEQ ID NO: 8171595 - DNA, 22 bp, Homo sapiens
cagggatggttgagaattggta

SEQ ID NO: 8171596 - DNA, 22 bp, Homo sapiens
cagggatgtctctggaagggag

SEQ ID NO: 8171597 - DNA, 22 bp, Homo sapiens
cagggctccccgcaccgcagcc

SEQ ID NO: 8171598 - DNA, 22 bp, Homo sapiens
cagggctccctctggctcccag

SEQ ID NO: 8171599 - DNA, 22 bp, Homo sapiens
cagggctccctgcagcctctgt

SEQ ID NO: 8171600 - DNA, 22 bp, Homo sapiens
cagggctccctgcagcctctgt

SEQ ID NO: 8171601 - DNA, 22 bp, Homo sapiens
cagggctccctctggctcccag

SEQ ID NO: 8171602 - DNA, 22 bp, Homo sapiens
cagggctccctgcagcctctgt

SEQ ID NO: 8171603 - DNA, 22 bp, Homo sapiens
cagggctccccagagagcctct

SEQ ID NO: 8171604 - DNA, 22 bp, Homo sapiens
cagggctccccagagagcctct

SEQ ID NO: 8171605 - DNA, 22 bp, Homo sapiens
cagggctccccagagagcctct

SEQ ID NO: 8171606 - DNA, 22 bp, Homo sapiens
cagggctccccgcaccgcagcc

SEQ ID NO: 8171607 - DNA, 22 bp, Homo sapiens
cagggctccatgcagggactcc

SEQ ID NO: 8171608 - DNA, 22 bp, Homo sapiens
cagggcctgcctggttcctgga

SEQ ID NO: 8171609 - DNA, 22 bp, Homo sapiens
cagggcctgcctggttcctgga

SEQ ID NO: 8171610 - DNA, 22 bp, Homo sapiens
cagggcctgcctggttcctgga

SEQ ID NO: 8171611 - DNA, 22 bp, Homo sapiens
cagggcctgcctggttcctgga

SEQ ID NO: 8171612 - DNA, 22 bp, Homo sapiens
cagggctcccaaatatctcttc

SEQ ID NO: 8171613 - DNA, 22 bp, Homo sapiens
cagggctcgctgccagcttcag

SEQ ID NO: 8171614 - DNA, 22 bp, Homo sapiens
cagggctcgctgccagcttcag

SEQ ID NO: 8171615 - DNA, 22 bp, Homo sapiens
cagggctcgctcttgcccttcg

SEQ ID NO: 8171616 - DNA, 22 bp, Homo sapiens
cagggctcgctcgctcgctcgc

SEQ ID NO: 8171617 - DNA, 22 bp, Homo sapiens
cagggctcgctcgctcgctcgc

SEQ ID NO: 8171618 - DNA, 22 bp, Homo sapiens
cagggctcgctcgctcgctcgc

SEQ ID NO: 8171619 - DNA, 22 bp, Homo sapiens
cagggctcgctcttgcccttcg

SEQ ID NO: 8171620 - DNA, 22 bp, Homo sapiens
caggggctccctgggtgccagt

SEQ ID NO: 8171621 - DNA, 22 bp, Homo sapiens
caggggctccctgggtgccagt

SEQ ID NO: 8171622 - DNA, 22 bp, Homo sapiens
caggggctccctgggtgccagt

SEQ ID NO: 8171623 - DNA, 22 bp, Homo sapiens
cagggcttgatctgcatcctgc

SEQ ID NO: 8171624 - DNA, 22 bp, Homo sapiens
cagggcttgatctgcatcctgc

SEQ ID NO: 8171625 - DNA, 22 bp, Homo sapiens
cagggcttggatctgtggtcag

SEQ ID NO: 8171626 - DNA, 22 bp, Homo sapiens
caggggctgagaaggaacgtcc

SEQ ID NO: 8171627 - DNA, 22 bp, Homo sapiens
caggggctctgggtgatgtgag

SEQ ID NO: 8171628 - DNA, 22 bp, Homo sapiens
caggggctgtggcacatggtgt

SEQ ID NO: 8171629 - DNA, 22 bp, Homo sapiens
caggggctgtggcacatggtgt

SEQ ID NO: 8171630 - DNA, 22 bp, Homo sapiens
caggggctctaatgcatgatca

SEQ ID NO: 8171631 - DNA, 22 bp, Homo sapiens
caggggctctaatgcatgatca

SEQ ID NO: 8171632 - DNA, 22 bp, Homo sapiens
caggggctctaatgcatgatca

SEQ ID NO: 8171633 - DNA, 22 bp, Homo sapiens
caggggctctaatgcatgatca

SEQ ID NO: 8171634 - DNA, 22 bp, Homo sapiens
caggggctctgggtgatgtgag

SEQ ID NO: 8171635 - DNA, 22 bp, Homo sapiens
caggggctgtttgcctcaggcc

SEQ ID NO: 8171636 - DNA, 22 bp, Homo sapiens
caggggctgtttgcctcaggcc

SEQ ID NO: 8171637 - DNA, 22 bp, Homo sapiens
caggggctgtgggcggagcctc

SEQ ID NO: 8171638 - DNA, 22 bp, Homo sapiens
cagggtgacaagtggcaaggag

SEQ ID NO: 8171639 - DNA, 22 bp, Homo sapiens
cagggtcttggcgccatcaccc

SEQ ID NO: 8171640 - DNA, 22 bp, Homo sapiens
caggggctgtttgcctcaggcc

SEQ ID NO: 8171641 - DNA, 22 bp, Homo sapiens
cagggtcttggcgccatcaccc

SEQ ID NO: 8171642 - DNA, 23 bp, Homo sapiens
cagggtgaccaatgtggccatca

SEQ ID NO: 8171643 - DNA, 22 bp, Homo sapiens
cagggtgcagagctagggtagt

SEQ ID NO: 8171644 - DNA, 22 bp, Homo sapiens
cagggtgcagtgtcgctgctag

SEQ ID NO: 8171645 - DNA, 22 bp, Homo sapiens
cagggtgcatacccatgcatac

SEQ ID NO: 8171646 - DNA, 22 bp, Homo sapiens
cagggtgcatacccatgcatac

SEQ ID NO: 8171647 - DNA, 22 bp, Homo sapiens
cagggtgagcctctggagccct

SEQ ID NO: 8171648 - DNA, 22 bp, Homo sapiens
cagggtgagcctctggagccct

SEQ ID NO: 8171649 - DNA, 22 bp, Homo sapiens
caggtgacatcaacaggaccac

SEQ ID NO: 8171650 - DNA, 22 bp, Homo sapiens
caggtgaccctctcacctgctt

SEQ ID NO: 8171651 - DNA, 22 bp, Homo sapiens
caggtgaccctctcacctgctt

SEQ ID NO: 8171652 - DNA, 22 bp, Homo sapiens
cagggtgcctgtcctcagcaaa

SEQ ID NO: 8171653 - DNA, 22 bp, Homo sapiens
cagggtgcctctgctcccacca

SEQ ID NO: 8171654 - DNA, 22 bp, Homo sapiens
cagggtgcctcccgctcgccgg

SEQ ID NO: 8171655 - DNA, 22 bp, Homo sapiens
cagggtgcctcccgctcgccgg

SEQ ID NO: 8171656 - DNA, 22 bp, Homo sapiens
cagggtgcgccactcagatgta

SEQ ID NO: 8171657 - DNA, 22 bp, Homo sapiens
cagggtgcctgtcctcagcaaa

SEQ ID NO: 8171658 - DNA, 22 bp, Homo sapiens
cagggtgcgggagatgtgcacc

SEQ ID NO: 8171659 - DNA, 22 bp, Homo sapiens
cagggtgcgccactcagatgta

SEQ ID NO: 8171660 - DNA, 22 bp, Homo sapiens
caggtgaggctgaacagatgaa

SEQ ID NO: 8171661 - DNA, 22 bp, Homo sapiens
caggtgaggctgaacagatgaa

SEQ ID NO: 8171662 - DNA, 22 bp, Homo sapiens
caggtgaggctgaacagatgaa

SEQ ID NO: 8171663 - DNA, 22 bp, Homo sapiens
caggtgagtttgctattgtaca

SEQ ID NO: 8171664 - DNA, 22 bp, Homo sapiens
caggtgattctaaagtctagcc

SEQ ID NO: 8171665 - DNA, 22 bp, Homo sapiens
caggtgataccctttaacaggc

SEQ ID NO: 8171666 - DNA, 20 bp, Homo sapiens
caggtgattccctggggaat

SEQ ID NO: 8171667 - DNA, 22 bp, Homo sapiens
caggtgagaggcggtcctgcat

SEQ ID NO: 8171668 - DNA, 22 bp, Homo sapiens
caggtgacctttgtcctaagtt

SEQ ID NO: 8171669 - DNA, 22 bp, Homo sapiens
caggtgacctcagcgcctgcag

SEQ ID NO: 8171670 - DNA, 22 bp, Homo sapiens
caggtgagctctatctagggag

SEQ ID NO: 8171671 - DNA, 22 bp, Homo sapiens
caggtgagctctatctagggag

SEQ ID NO: 8171672 - DNA, 22 bp, Homo sapiens
caggtgagctctatctagggag

SEQ ID NO: 8171673 - DNA, 22 bp, Homo sapiens
catagagtgatgtaaggtatgt

SEQ ID NO: 8171674 - DNA, 22 bp, Homo sapiens
catagcaacagcatcaagtcaa

SEQ ID NO: 8171675 - DNA, 22 bp, Homo sapiens
catagcaagatcacattctgta

SEQ ID NO: 8171676 - DNA, 22 bp, Homo sapiens
catagcaaggtgctttccacat

SEQ ID NO: 8171677 - DNA, 22 bp, Homo sapiens
catagccatctttagcttccag

SEQ ID NO: 8171678 - DNA, 22 bp, Homo sapiens
catagccagccattgctcccaa

SEQ ID NO: 8171679 - DNA, 22 bp, Homo sapiens
catagcaacagcatcaagtcaa

SEQ ID NO: 8171680 - DNA, 22 bp, Homo sapiens
cagttttatacactgcagctcc

SEQ ID NO: 8171681 - DNA, 22 bp, Homo sapiens
cagttttatgaatgcttattag

SEQ ID NO: 8171682 - DNA, 22 bp, Homo sapiens
cagttttatgtcgaatgtatac

SEQ ID NO: 8171683 - DNA, 22 bp, Homo sapiens
catacatatgtggatgtcatat

SEQ ID NO: 8171684 - DNA, 22 bp, Homo sapiens
catacatatgtggatgtcatat

SEQ ID NO: 8171685 - DNA, 22 bp, Homo sapiens
catacatatgtggatgtcatat

SEQ ID NO: 8171686 - DNA, 22 bp, Homo sapiens
catacattacctaacttaatgc

SEQ ID NO: 8171687 - DNA, 22 bp, Homo sapiens
catacattacctaacttaatgc

SEQ ID NO: 8171688 - DNA, 22 bp, Homo sapiens
cataggaatgaggacaattagc

SEQ ID NO: 8171689 - DNA, 22 bp, Homo sapiens
catagcggtattccacgtggtt

SEQ ID NO: 8171690 - DNA, 22 bp, Homo sapiens
catagcggtattccacgtggtt

SEQ ID NO: 8171691 - DNA, 22 bp, Homo sapiens
catagtgactcatgcctataat

SEQ ID NO: 8171692 - DNA, 22 bp, Homo sapiens
cataggtcactgtacaggttaa

SEQ ID NO: 8171693 - DNA, 22 bp, Homo sapiens
cataggaatgaggacaattagc

SEQ ID NO: 8171694 - DNA, 22 bp, Homo sapiens
catataaatacaacatgtgtta

SEQ ID NO: 8171695 - DNA, 22 bp, Homo sapiens
catataaatacaacatgtgtta

SEQ ID NO: 8171696 - DNA, 22 bp, Homo sapiens
catataaatacaacatgtgtta

SEQ ID NO: 8171697 - DNA, 22 bp, Homo sapiens
catataaatacaacatgtgtta

SEQ ID NO: 8171698 - DNA, 22 bp, Homo sapiens
catataaatacaacatgtgtta

SEQ ID NO: 8171699 - DNA, 22 bp, Homo sapiens
catagtgtctggtaacatagta

SEQ ID NO: 8171700 - DNA, 22 bp, Homo sapiens
catagtgtctggtaacatagta

SEQ ID NO: 8171701 - DNA, 22 bp, Homo sapiens
catattctttaagcaatgctct

SEQ ID NO: 8171702 - DNA, 22 bp, Homo sapiens
catattctgttggtcacataga

SEQ ID NO: 8171703 - DNA, 22 bp, Homo sapiens
catattcaaggggtaaggcaaa

SEQ ID NO: 8171704 - DNA, 22 bp, Homo sapiens
catattctgttggtcacataga

SEQ ID NO: 8171705 - DNA, 22 bp, Homo sapiens
catattaaggtctgtaaggggt

SEQ ID NO: 8171706 - DNA, 21 bp, Homo sapiens
catattaaatcggtgccttta

SEQ ID NO: 8171707 - DNA, 22 bp, Homo sapiens
catattagacacttatgtccac

SEQ ID NO: 8171708 - DNA, 22 bp, Homo sapiens
catattagcctccactgggaca

SEQ ID NO: 8171709 - DNA, 22 bp, Homo sapiens
catatttatagatctggcattt

SEQ ID NO: 8171710 - DNA, 22 bp, Homo sapiens
catatttatagatctggcattt

SEQ ID NO: 8171711 - DNA, 22 bp, Homo sapiens
catatttagtgtttggagatcg

SEQ ID NO: 8171712 - DNA, 22 bp, Homo sapiens
catatttagtgtttggagatcg

SEQ ID NO: 8171713 - DNA, 22 bp, Homo sapiens
catatttagtgtttggagatcg

SEQ ID NO: 8171714 - DNA, 22 bp, Homo sapiens
catatttagtgtttggagatcg

SEQ ID NO: 8171715 - DNA, 22 bp, Homo sapiens
catatttagtgtttggagatcg

SEQ ID NO: 8171716 - DNA, 22 bp, Homo sapiens
catatttattcttctgccagtg

SEQ ID NO: 8171717 - DNA, 22 bp, Homo sapiens
catatttattcttctgccagtg

SEQ ID NO: 8171718 - DNA, 22 bp, Homo sapiens
catatttcagtctaagatgtgt

SEQ ID NO: 8171719 - DNA, 22 bp, Homo sapiens
catattttagttgctgaacagc

SEQ ID NO: 8171720 - DNA, 21 bp, Homo sapiens
aggaggctgtctctttcagct

SEQ ID NO: 8171721 - DNA, 21 bp, Homo sapiens
aggaggctgtctctttcagct

SEQ ID NO: 8171722 - DNA, 22 bp, Homo sapiens
aggagggagcttaagccaggca

SEQ ID NO: 8171723 - DNA, 22 bp, Homo sapiens
aggagggagcactatatgggga

SEQ ID NO: 8171724 - DNA, 22 bp, Homo sapiens
aggagggagcactatatgggga

SEQ ID NO: 8171725 - DNA, 22 bp, Homo sapiens
aggagggagcactatatgggga

SEQ ID NO: 8171726 - DNA, 22 bp, Homo sapiens
aggagggagcttaagccaggca

SEQ ID NO: 8171727 - DNA, 22 bp, Homo sapiens
aggagggagcttaagccaggca

SEQ ID NO: 8171728 - DNA, 22 bp, Homo sapiens
aggagggagcttaagccaggca

SEQ ID NO: 8171729 - DNA, 22 bp, Homo sapiens
aggagggagcttaagccaggca

SEQ ID NO: 8171730 - DNA, 22 bp, Homo sapiens
aggagggagcttaagccaggca

SEQ ID NO: 8171731 - DNA, 22 bp, Homo sapiens
cagtggtatttgagagaatgga

SEQ ID NO: 8171732 - DNA, 22 bp, Homo sapiens
cagtgggtggctaagtggctga

SEQ ID NO: 8171733 - DNA, 22 bp, Homo sapiens
cagtgggtggctaagtggctga

SEQ ID NO: 8171734 - DNA, 22 bp, Homo sapiens
cagtgggtggcctcttgagtca

SEQ ID NO: 8171735 - DNA, 22 bp, Homo sapiens
cagtgggtgcctctcattatat

SEQ ID NO: 8171736 - DNA, 22 bp, Homo sapiens
cagtgggtgccatcgtgccctt

SEQ ID NO: 8171737 - DNA, 22 bp, Homo sapiens
cagtgggtggctaagtggctga

SEQ ID NO: 8171738 - DNA, 22 bp, Homo sapiens
cagtggcctttcctgctgctca

SEQ ID NO: 8171739 - DNA, 22 bp, Homo sapiens
cagtggcctttcctgctgctca

SEQ ID NO: 8171740 - DNA, 22 bp, Homo sapiens
cagtggcgtgatctctgctcac

SEQ ID NO: 8171741 - DNA, 22 bp, Homo sapiens
cagtggcgtgatctctgctcac

SEQ ID NO: 8171742 - DNA, 22 bp, Homo sapiens
cagtggcgtgatctctgctcac

SEQ ID NO: 8171743 - DNA, 22 bp, Homo sapiens
cagtggctgagagtggacactg

SEQ ID NO: 8171744 - DNA, 22 bp, Homo sapiens
cagtgggtgatgagtcctgggg

SEQ ID NO: 8171745 - DNA, 22 bp, Homo sapiens
cagtgggtgccatcgtgccctt

SEQ ID NO: 8171746 - DNA, 22 bp, Homo sapiens
cagtggcgtgatctctgctcac

SEQ ID NO: 8171747 - DNA, 22 bp, Homo sapiens
cagtggcgtgatctctgctcac

SEQ ID NO: 8171748 - DNA, 22 bp, Homo sapiens
cagtggcgtgatctctgctcac

SEQ ID NO: 8171749 - DNA, 22 bp, Homo sapiens
cagtttatattctagtgctgtt

SEQ ID NO: 8171750 - DNA, 22 bp, Homo sapiens
cagtttatattctagtgctgtt

SEQ ID NO: 8171751 - DNA, 22 bp, Homo sapiens
cagtttatattctagtgctgtt

SEQ ID NO: 8171752 - DNA, 20 bp, Homo sapiens
cagtttatctttccggagct

SEQ ID NO: 8171753 - DNA, 20 bp, Homo sapiens
cagtttatctttccggagct

SEQ ID NO: 8171754 - DNA, 20 bp, Homo sapiens
cagtttatctttccggagct

SEQ ID NO: 8171755 - DNA, 22 bp, Homo sapiens
cagtttatgcagctggaataga

SEQ ID NO: 8171756 - DNA, 22 bp, Homo sapiens
cagtttatgcagctggaataga

SEQ ID NO: 8171757 - DNA, 22 bp, Homo sapiens
cagtttatgcagctggaataga

SEQ ID NO: 8171758 - DNA, 22 bp, Homo sapiens
cagtttatgcagctggaataga

SEQ ID NO: 8171759 - DNA, 22 bp, Homo sapiens
cagtttatgcagctggaataga

SEQ ID NO: 8171760 - DNA, 21 bp, Homo sapiens
cagtggtctgtctccattttt

SEQ ID NO: 8171761 - DNA, 22 bp, Homo sapiens
cagtggtctgtgcttctgtaca

SEQ ID NO: 8171762 - DNA, 22 bp, Homo sapiens
cagtggtgaagagcaggggctc

SEQ ID NO: 8171763 - DNA, 18 bp, Homo sapiens
cagtggtgctgggatgtg

SEQ ID NO: 8171764 - DNA, 22 bp, Homo sapiens
cagtggttatacttactgtttc

SEQ ID NO: 8171765 - DNA, 22 bp, Homo sapiens
cagtggttatacttactgtttc

SEQ ID NO: 8171766 - DNA, 22 bp, Homo sapiens
cagttttacccaagcttatttt

SEQ ID NO: 8171767 - DNA, 22 bp, Homo sapiens
cagttttagctagagcaaacca

SEQ ID NO: 8171768 - DNA, 22 bp, Homo sapiens
cagttttaggacatgtggatgt

SEQ ID NO: 8171769 - DNA, 22 bp, Homo sapiens
cagttttaggacatgtggatgt

SEQ ID NO: 8171770 - DNA, 22 bp, Homo sapiens
cagttttagggcaatgtgaaga

SEQ ID NO: 8171771 - DNA, 22 bp, Homo sapiens
cagttttaaattttgaatgtct

SEQ ID NO: 8171772 - DNA, 22 bp, Homo sapiens
cagttttaaattgttagataat

SEQ ID NO: 8171773 - DNA, 22 bp, Homo sapiens
cagtttctctcaataagcatcg

SEQ ID NO: 8171774 - DNA, 22 bp, Homo sapiens
cagtttctctcaataagcatcg

SEQ ID NO: 8171775 - DNA, 22 bp, Homo sapiens
cagtttctctcaataagcatcg

SEQ ID NO: 8171776 - DNA, 22 bp, Homo sapiens
cagtttctacgacttaagcaca

SEQ ID NO: 8171777 - DNA, 22 bp, Homo sapiens
cagtttctacgacttaagcaca

SEQ ID NO: 8171778 - DNA, 22 bp, Homo sapiens
cagtttctacgaaggtcaaccc

SEQ ID NO: 8171779 - DNA, 22 bp, Homo sapiens
cagtttctccaaacgcaggctg

SEQ ID NO: 8171780 - DNA, 22 bp, Homo sapiens
cagtttctctcaataagcatcg

SEQ ID NO: 8171781 - DNA, 22 bp, Homo sapiens
cagtttatttccaagatgacaa

SEQ ID NO: 8171782 - DNA, 22 bp, Homo sapiens
cagtttatttccaagatgacaa

SEQ ID NO: 8171783 - DNA, 22 bp, Homo sapiens
cagtttatttccaagatgacaa

SEQ ID NO: 8171784 - DNA, 22 bp, Homo sapiens
cagtttatttccaagatgacaa

SEQ ID NO: 8171785 - DNA, 22 bp, Homo sapiens
cagtttattgttgcgttcacat

SEQ ID NO: 8171786 - DNA, 22 bp, Homo sapiens
cagtttattgttgcgttcacat

SEQ ID NO: 8171787 - DNA, 22 bp, Homo sapiens
cagtttattgttgcgttcacat

SEQ ID NO: 8171788 - DNA, 22 bp, Homo sapiens
cagtttattgttgcgttcacat

SEQ ID NO: 8171789 - DNA, 19 bp, Homo sapiens
cagtttatgctttggggac

SEQ ID NO: 8171790 - DNA, 19 bp, Homo sapiens
cagtttatgctttggggac

SEQ ID NO: 8171791 - DNA, 19 bp, Homo sapiens
cagtttatgctttggggac

SEQ ID NO: 8171792 - DNA, 22 bp, Homo sapiens
cagtttcagaatcaaaacatca

SEQ ID NO: 8171793 - DNA, 22 bp, Homo sapiens
cagtttatttccaagatgacaa

SEQ ID NO: 8171794 - DNA, 22 bp, Homo sapiens
cagtttccctgcttgaaaacgt

SEQ ID NO: 8171795 - DNA, 22 bp, Homo sapiens
cagtttcagctcaagcactcag

SEQ ID NO: 8171796 - DNA, 22 bp, Homo sapiens
cagtgcctggcatagaggcggc

SEQ ID NO: 8171797 - DNA, 22 bp, Homo sapiens
cagtgcctggccggcttccatt

SEQ ID NO: 8171798 - DNA, 22 bp, Homo sapiens
cagtgctaccccggaagttggt

SEQ ID NO: 8171799 - DNA, 22 bp, Homo sapiens
cagtgcctcttaagtgtcaccc

SEQ ID NO: 8171800 - DNA, 20 bp, Homo sapiens
cagtgcctgccccttgggtt

SEQ ID NO: 8171801 - DNA, 22 bp, Homo sapiens
cagtgcctggatagcaacatga

SEQ ID NO: 8171802 - DNA, 22 bp, Homo sapiens
cagtgctcctgatgtacccttg

SEQ ID NO: 8171803 - DNA, 22 bp, Homo sapiens
aggagaaggaagtgcatcacta

SEQ ID NO: 8171804 - DNA, 22 bp, Homo sapiens
cagtgctcatagctgttcctcc

SEQ ID NO: 8171805 - DNA, 21 bp, Homo sapiens
cagtgctcaggaatagagaga

SEQ ID NO: 8171806 - DNA, 21 bp, Homo sapiens
cagtgctcaggaatagagaga

SEQ ID NO: 8171807 - DNA, 22 bp, Homo sapiens
cagtgctcatagctgttcctcc

SEQ ID NO: 8171808 - DNA, 22 bp, Homo sapiens
cagtgctcccgctgccgctgtg

SEQ ID NO: 8171809 - DNA, 22 bp, Homo sapiens
cagtgctataatccagtgtcgt

SEQ ID NO: 8171810 - DNA, 22 bp, Homo sapiens
cagtgctagggcagagcactcc

SEQ ID NO: 8171811 - DNA, 21 bp, Homo sapiens
cagtgctcaatctgacagtgg

SEQ ID NO: 8171812 - DNA, 21 bp, Homo sapiens
cagtgctcaatctgacagtgg

SEQ ID NO: 8171813 - DNA, 22 bp, Homo sapiens
aggactccatgtgtcctggaga

SEQ ID NO: 8171814 - DNA, 22 bp, Homo sapiens
aggacgctctcgctgaacttct

SEQ ID NO: 8171815 - DNA, 19 bp, Homo sapiens
aggactctggaggcatgag

SEQ ID NO: 8171816 - DNA, 22 bp, Homo sapiens
aggactgacttttgccatgaaa

SEQ ID NO: 8171817 - DNA, 21 bp, Homo sapiens
cagtgcaggggttagcgtgta

SEQ ID NO: 8171818 - DNA, 22 bp, Homo sapiens
cagtgcaggtggcagaggacag

SEQ ID NO: 8171819 - DNA, 21 bp, Homo sapiens
cagtgcaggggttagcgtgta

SEQ ID NO: 8171820 - DNA, 19 bp, Homo sapiens
aggactctggaggcatgag

SEQ ID NO: 8171821 - DNA, 19 bp, Homo sapiens
cagtgcccgacgcaggtct

SEQ ID NO: 8171822 - DNA, 22 bp, Homo sapiens
cagtgcccttccaggactgcag

SEQ ID NO: 8171823 - DNA, 22 bp, Homo sapiens
cagtgcctcaggccagcctgca

SEQ ID NO: 8171824 - DNA, 22 bp, Homo sapiens
cagtgcctcttaagtgtcaccc

SEQ ID NO: 8171825 - DNA, 22 bp, Homo sapiens
cagtgcctcaggccagcctgca

SEQ ID NO: 8171826 - DNA, 22 bp, Homo sapiens
cagtggccatggtggcaggggt

SEQ ID NO: 8171827 - DNA, 22 bp, Homo sapiens
cagtggccaacttcctgcctct

SEQ ID NO: 8171828 - DNA, 22 bp, Homo sapiens
cagtggccaacttcctgcctct

SEQ ID NO: 8171829 - DNA, 18 bp, Homo sapiens
cagtggcatagttgagta

SEQ ID NO: 8171830 - DNA, 22 bp, Homo sapiens
cagtggcatggttgactgcagt

SEQ ID NO: 8171831 - DNA, 22 bp, Homo sapiens
cagtggcatggttgactgcagt

SEQ ID NO: 8171832 - DNA, 22 bp, Homo sapiens
cagtggcatggttgactgcagt

SEQ ID NO: 8171833 - DNA, 22 bp, Homo sapiens
cagtggagaggcatgcttggca

SEQ ID NO: 8171834 - DNA, 22 bp, Homo sapiens
cagtggcatacttggctgatat

SEQ ID NO: 8171835 - DNA, 22 bp, Homo sapiens
cagtggcatacttggctgatat

SEQ ID NO: 8171836 - DNA, 22 bp, Homo sapiens
cagtggcatacttggctgatat

SEQ ID NO: 8171837 - DNA, 22 bp, Homo sapiens
cagtggccgcggggctgtgggt

SEQ ID NO: 8171838 - DNA, 22 bp, Homo sapiens
cagtggccaacttcctgcctct

SEQ ID NO: 8171839 - DNA, 22 bp, Homo sapiens
cagtggccatggtggcaggggt

SEQ ID NO: 8171840 - DNA, 22 bp, Homo sapiens
cagtggcctgagccaggcttcc

SEQ ID NO: 8171841 - DNA, 22 bp, Homo sapiens
cagtggcctctggctttgctgt

SEQ ID NO: 8171842 - DNA, 22 bp, Homo sapiens
cagtggcctctggctttgctgt

SEQ ID NO: 8171843 - DNA, 22 bp, Homo sapiens
cagtggcctctggctttgctgt

SEQ ID NO: 8171844 - DNA, 22 bp, Homo sapiens
cagtggccttgatgcctcattc

SEQ ID NO: 8171845 - DNA, 19 bp, Homo sapiens
cagtggcctggaggtctct

SEQ ID NO: 8171846 - DNA, 19 bp, Homo sapiens
cagtggcctggaggtctct

SEQ ID NO: 8171847 - DNA, 22 bp, Homo sapiens
cagtggcctgagccaggcttcc

SEQ ID NO: 8171848 - DNA, 22 bp, Homo sapiens
cagtggcctgagccaggcttcc

SEQ ID NO: 8171849 - DNA, 19 bp, Homo sapiens
aggagaagtagcagaaatt

SEQ ID NO: 8171850 - DNA, 19 bp, Homo sapiens
aggagaagtagcagaaatt

SEQ ID NO: 8171851 - DNA, 19 bp, Homo sapiens
aggagaagtagcagaaatt

SEQ ID NO: 8171852 - DNA, 19 bp, Homo sapiens
aggagaagtagcagaaatt

SEQ ID NO: 8171853 - DNA, 19 bp, Homo sapiens
aggagaagtagcagaaatt

SEQ ID NO: 8171854 - DNA, 22 bp, Homo sapiens
aggagaagtaaggctagatgat

SEQ ID NO: 8171855 - DNA, 22 bp, Homo sapiens
aggagaagtaaggctagatgat

SEQ ID NO: 8171856 - DNA, 22 bp, Homo sapiens
aggagaagtaaggctagatgat

SEQ ID NO: 8171857 - DNA, 22 bp, Homo sapiens
aggagaaggaggcccctcacac

SEQ ID NO: 8171858 - DNA, 22 bp, Homo sapiens
aggacattcatttcaaggagga

SEQ ID NO: 8171859 - DNA, 22 bp, Homo sapiens
aggacatgtttgtatcttcctt

SEQ ID NO: 8171860 - DNA, 22 bp, Homo sapiens
aggacatgtgcctccagggcag

SEQ ID NO: 8171861 - DNA, 22 bp, Homo sapiens
aggacatgtgcctccagggcag

SEQ ID NO: 8171862 - DNA, 22 bp, Homo sapiens
aggacaggattgagctgaactg

SEQ ID NO: 8171863 - DNA, 22 bp, Homo sapiens
aggacaggattgagctgaactg

SEQ ID NO: 8171864 - DNA, 22 bp, Homo sapiens
aggacaggattgagctgaactg

SEQ ID NO: 8171865 - DNA, 22 bp, Homo sapiens
aggacatgtaaatggagaggga

SEQ ID NO: 8171866 - DNA, 22 bp, Homo sapiens
caggtgggagcggagactgatt

SEQ ID NO: 8171867 - DNA, 22 bp, Homo sapiens
caggtgggagcgaggagctact

SEQ ID NO: 8171868 - DNA, 22 bp, Homo sapiens
caggtgggagcgaggagctact

SEQ ID NO: 8171869 - DNA, 22 bp, Homo sapiens
caggtgggagcgaggagctact

SEQ ID NO: 8171870 - DNA, 22 bp, Homo sapiens
caggtgggagcgaggagctact

SEQ ID NO: 8171871 - DNA, 22 bp, Homo sapiens
caggtgggagccacagcgtaca

SEQ ID NO: 8171872 - DNA, 22 bp, Homo sapiens
caggtgggaccatgatagggca

SEQ ID NO: 8171873 - DNA, 22 bp, Homo sapiens
caggtgggaccatgatagggca

SEQ ID NO: 8171874 - DNA, 22 bp, Homo sapiens
caggtggcttctctgcagcctt

SEQ ID NO: 8171875 - DNA, 22 bp, Homo sapiens
caggtggcttctctgcagcctt

SEQ ID NO: 8171876 - DNA, 22 bp, Homo sapiens
caggtggcttctctgcagcctt

SEQ ID NO: 8171877 - DNA, 22 bp, Homo sapiens
caggtggcttctctgcagcctt

SEQ ID NO: 8171878 - DNA, 22 bp, Homo sapiens
caggtgcagctggatggaagcc

SEQ ID NO: 8171879 - DNA, 22 bp, Homo sapiens
caggtgcagctggatggaagcc

SEQ ID NO: 8171880 - DNA, 22 bp, Homo sapiens
caggtgcagctggatggaagcc

SEQ ID NO: 8171881 - DNA, 22 bp, Homo sapiens
caggtgccatagacgggcctgg

SEQ ID NO: 8171882 - DNA, 22 bp, Homo sapiens
caggtgcagggagttcaggatg

SEQ ID NO: 8171883 - DNA, 22 bp, Homo sapiens
caggtgccatagacgggcctgg

SEQ ID NO: 8171884 - DNA, 22 bp, Homo sapiens
caggtggcttctccctaggcca

SEQ ID NO: 8171885 - DNA, 22 bp, Homo sapiens
caggtggcttctccctaggcca

SEQ ID NO: 8171886 - DNA, 22 bp, Homo sapiens
caggtggcttctccctaggcca

SEQ ID NO: 8171887 - DNA, 22 bp, Homo sapiens
caggtggcttctccctaggcca

SEQ ID NO: 8171888 - DNA, 22 bp, Homo sapiens
caggtggcttctccctaggcca

SEQ ID NO: 8171889 - DNA, 22 bp, Homo sapiens
caggtggcttctccctaggcca

SEQ ID NO: 8171890 - DNA, 22 bp, Homo sapiens
caggtggcttctccctaggcca

SEQ ID NO: 8171891 - DNA, 22 bp, Homo sapiens
caggtggcttctccctaggcca

SEQ ID NO: 8171892 - DNA, 23 bp, Homo sapiens
aggaccaggttcccaaaagtcaa

SEQ ID NO: 8171893 - DNA, 22 bp, Homo sapiens
aggaccagtatgagagcatctg

SEQ ID NO: 8171894 - DNA, 22 bp, Homo sapiens
aggaccagtgagtctggcaagt

SEQ ID NO: 8171895 - DNA, 22 bp, Homo sapiens
aggaccagtgagtctggcaagt

SEQ ID NO: 8171896 - DNA, 22 bp, Homo sapiens
aggaccagtatgagagcatctg

SEQ ID NO: 8171897 - DNA, 22 bp, Homo sapiens
aggaccagtgagtctggcaagt

SEQ ID NO: 8171898 - DNA, 22 bp, Homo sapiens
aggaccattatgcttgctgaaa

SEQ ID NO: 8171899 - DNA, 22 bp, Homo sapiens
aggaccagcctccaggtctctt

SEQ ID NO: 8171900 - DNA, 22 bp, Homo sapiens
aggaccagcctccaggtctctt

SEQ ID NO: 8171901 - DNA, 22 bp, Homo sapiens
aggaccagaggccagagtcagc

SEQ ID NO: 8171902 - DNA, 22 bp, Homo sapiens
aggaccaacatagcagcagtgg

SEQ ID NO: 8171903 - DNA, 22 bp, Homo sapiens
aggaccaagagcagaggcatca

SEQ ID NO: 8171904 - DNA, 22 bp, Homo sapiens
aggaccagaccgaactagctaa

SEQ ID NO: 8171905 - DNA, 22 bp, Homo sapiens
aggacccacgcacaggaacccc

SEQ ID NO: 8171906 - DNA, 22 bp, Homo sapiens
aggacccagaggcagaggacgt

SEQ ID NO: 8171907 - DNA, 22 bp, Homo sapiens
aggacccacgcacaggaacccc

SEQ ID NO: 8171908 - DNA, 22 bp, Homo sapiens
aggaccctgctcaagcatctcc

SEQ ID NO: 8171909 - DNA, 22 bp, Homo sapiens
aggacctgacattgtgttttct

SEQ ID NO: 8171910 - DNA, 22 bp, Homo sapiens
aggaccttggaataacaaattc

SEQ ID NO: 8171911 - DNA, 22 bp, Homo sapiens
aggacctgtagggcctgcatcc

SEQ ID NO: 8171912 - DNA, 22 bp, Homo sapiens
aggacgctctcgctgaacttct

SEQ ID NO: 8171913 - DNA, 22 bp, Homo sapiens
aggacctgactggctcctgctt

SEQ ID NO: 8171914 - DNA, 22 bp, Homo sapiens
catgtcagggcttcctcctctc

SEQ ID NO: 8171915 - DNA, 22 bp, Homo sapiens
catgtcagggaagagagtcagt

SEQ ID NO: 8171916 - DNA, 22 bp, Homo sapiens
catgtcagggaagagagtcagt

SEQ ID NO: 8171917 - DNA, 22 bp, Homo sapiens
catgtcaataaatataactgca

SEQ ID NO: 8171918 - DNA, 22 bp, Homo sapiens
catgtcaagcttatctctgtgg

SEQ ID NO: 8171919 - DNA, 22 bp, Homo sapiens
aggcactggtctaccccttagt

SEQ ID NO: 8171920 - DNA, 22 bp, Homo sapiens
aggcactgcagattacaggcgc

SEQ ID NO: 8171921 - DNA, 22 bp, Homo sapiens
catgtatagttggaactacatc

SEQ ID NO: 8171922 - DNA, 22 bp, Homo sapiens
catgtatagttggaactacatc

SEQ ID NO: 8171923 - DNA, 22 bp, Homo sapiens
catgtatatttctgtatgtgca

SEQ ID NO: 8171924 - DNA, 22 bp, Homo sapiens
catgtatatttctgtatgtgca

SEQ ID NO: 8171925 - DNA, 22 bp, Homo sapiens
catgtatattttatgtggagag

SEQ ID NO: 8171926 - DNA, 22 bp, Homo sapiens
catgtatatttctgtatgtgca

SEQ ID NO: 8171927 - DNA, 17 bp, Homo sapiens
catgtatttgaaacaga

SEQ ID NO: 8171928 - DNA, 22 bp, Homo sapiens
catgtacattctgtagatggag

SEQ ID NO: 8171929 - DNA, 22 bp, Homo sapiens
catgtacccctgagagtcttgc

SEQ ID NO: 8171930 - DNA, 22 bp, Homo sapiens
catgtacattctgtagatggag

SEQ ID NO: 8171931 - DNA, 22 bp, Homo sapiens
catgtataagcgctaggagtgc

SEQ ID NO: 8171932 - DNA, 22 bp, Homo sapiens
catgtagtcctaatgctggtga

SEQ ID NO: 8171933 - DNA, 22 bp, Homo sapiens
catgtatacagtagaatactat

SEQ ID NO: 8171934 - DNA, 22 bp, Homo sapiens
catgtatagacactcatacagt

SEQ ID NO: 8171935 - DNA, 22 bp, Homo sapiens
catgtataggtccatagtgaat

SEQ ID NO: 8171936 - DNA, 22 bp, Homo sapiens
catgtataggtccatagtgaat

SEQ ID NO: 8171937 - DNA, 22 bp, Homo sapiens
catgtatagttggaactacatc

SEQ ID NO: 8171938 - DNA, 22 bp, Homo sapiens
catgtatagttggaactacatc

SEQ ID NO: 8171939 - DNA, 22 bp, Homo sapiens
catgtatagacactcatacagt

SEQ ID NO: 8171940 - DNA, 22 bp, Homo sapiens
catgtatacagtagaatactat

SEQ ID NO: 8171941 - DNA, 22 bp, Homo sapiens
catgtatagcaaatatttgttc

SEQ ID NO: 8171942 - DNA, 22 bp, Homo sapiens
catgtatagcaaatatttgttc

SEQ ID NO: 8171943 - DNA, 22 bp, Homo sapiens
catgtatagacactcatacagt

SEQ ID NO: 8171944 - DNA, 22 bp, Homo sapiens
catggtcatgctgagctacaaa

SEQ ID NO: 8171945 - DNA, 22 bp, Homo sapiens
catgtacattctgtagatggag

SEQ ID NO: 8171946 - DNA, 19 bp, Homo sapiens
catggtgaaaccccgtctc

SEQ ID NO: 8171947 - DNA, 18 bp, Homo sapiens
catgggtgacaggtggat

SEQ ID NO: 8171948 - DNA, 18 bp, Homo sapiens
catgggtgacaggtggat

SEQ ID NO: 8171949 - DNA, 21 bp, Homo sapiens
catggggttgctatagcaaaa

SEQ ID NO: 8171950 - DNA, 22 bp, Homo sapiens
aggatttctgtgcctggaaaat

SEQ ID NO: 8171951 - DNA, 22 bp, Homo sapiens
aggatttctgtgcctggaaaat

SEQ ID NO: 8171952 - DNA, 21 bp, Homo sapiens
aggatttctgtcatttcagat

SEQ ID NO: 8171953 - DNA, 22 bp, Homo sapiens
catggctgaaattcttcgcttg

SEQ ID NO: 8171954 - DNA, 22 bp, Homo sapiens
catggctgaacactcagtgact

SEQ ID NO: 8171955 - DNA, 22 bp, Homo sapiens
catggctgaaattcttcgcttg

SEQ ID NO: 8171956 - DNA, 22 bp, Homo sapiens
catggctgaaattcttcgcttg

SEQ ID NO: 8171957 - DNA, 22 bp, Homo sapiens
catggctcggggacaggaggta

SEQ ID NO: 8171958 - DNA, 22 bp, Homo sapiens
aggattgtgcctccagtcagaa

SEQ ID NO: 8171959 - DNA, 22 bp, Homo sapiens
aggattgttgcagggcttcgtt

SEQ ID NO: 8171960 - DNA, 22 bp, Homo sapiens
aggatttaaatccttaaccact

SEQ ID NO: 8171961 - DNA, 22 bp, Homo sapiens
aggatttacaatgattctaggt

SEQ ID NO: 8171962 - DNA, 22 bp, Homo sapiens
aggatttacaatgattctaggt

SEQ ID NO: 8171963 - DNA, 22 bp, Homo sapiens
aggatttacctccagctaggct

SEQ ID NO: 8171964 - DNA, 22 bp, Homo sapiens
aggatttactagcaaggattct

SEQ ID NO: 8171965 - DNA, 22 bp, Homo sapiens
aggatttatcaggaactctctt

SEQ ID NO: 8171966 - DNA, 22 bp, Homo sapiens
aggatttagcatgaaatgtgaa

SEQ ID NO: 8171967 - DNA, 19 bp, Homo sapiens
aggatttattatgtgctca

SEQ ID NO: 8171968 - DNA, 22 bp, Homo sapiens
aggatttattccagaaatgcaa

SEQ ID NO: 8171969 - DNA, 22 bp, Homo sapiens
catggggatgaggctgagactt

SEQ ID NO: 8171970 - DNA, 22 bp, Homo sapiens
catggggatgaggctgagactt

SEQ ID NO: 8171971 - DNA, 22 bp, Homo sapiens
catggggcccatgtgctccaag

SEQ ID NO: 8171972 - DNA, 22 bp, Homo sapiens
catggggcccatgtgctccaag

SEQ ID NO: 8171973 - DNA, 22 bp, Homo sapiens
catgggggctgaggctgctgta

SEQ ID NO: 8171974 - DNA, 22 bp, Homo sapiens
catgggctgctgacaggggctc

SEQ ID NO: 8171975 - DNA, 22 bp, Homo sapiens
catgggctgctgacaggggctc

SEQ ID NO: 8171976 - DNA, 22 bp, Homo sapiens
catgggctgtgaacccaggctg

SEQ ID NO: 8171977 - DNA, 22 bp, Homo sapiens
catgggcttgctctctgagctc

SEQ ID NO: 8171978 - DNA, 22 bp, Homo sapiens
catgggcttgctctctgagctc

SEQ ID NO: 8171979 - DNA, 22 bp, Homo sapiens
catgggctttggaggctggagg

SEQ ID NO: 8171980 - DNA, 22 bp, Homo sapiens
catgggctttggaggctggagg

SEQ ID NO: 8171981 - DNA, 22 bp, Homo sapiens
catgggctttggaggctggagg

SEQ ID NO: 8171982 - DNA, 22 bp, Homo sapiens
catggggagacacctagggaaa

SEQ ID NO: 8171983 - DNA, 22 bp, Homo sapiens
catggggagacacctagggaaa

SEQ ID NO: 8171984 - DNA, 22 bp, Homo sapiens
catgctaaccagagacataaag

SEQ ID NO: 8171985 - DNA, 22 bp, Homo sapiens
catggacagtgggacagtgtgt

SEQ ID NO: 8171986 - DNA, 22 bp, Homo sapiens
catggaggaccctcagggagct

SEQ ID NO: 8171987 - DNA, 22 bp, Homo sapiens
catggaggaccctcagggagct

SEQ ID NO: 8171988 - DNA, 22 bp, Homo sapiens
catggattcgggaaggtcagta

SEQ ID NO: 8171989 - DNA, 22 bp, Homo sapiens
catggaggccaggaaacagcct

SEQ ID NO: 8171990 - DNA, 22 bp, Homo sapiens
catggattgaatataaattaga

SEQ ID NO: 8171991 - DNA, 22 bp, Homo sapiens
catggaggaggaagggcgttgt

SEQ ID NO: 8171992 - DNA, 22 bp, Homo sapiens
catggaggaccctcagggagct

SEQ ID NO: 8171993 - DNA, 22 bp, Homo sapiens
aggatgtgttttgagctgacta

SEQ ID NO: 8171994 - DNA, 22 bp, Homo sapiens
aggatgtgttttgagctgacta

SEQ ID NO: 8171995 - DNA, 22 bp, Homo sapiens
aggatgtgttcatagctgacgc

SEQ ID NO: 8171996 - DNA, 22 bp, Homo sapiens
catggcagagaaggggaactgg

SEQ ID NO: 8171997 - DNA, 22 bp, Homo sapiens
aggatgtgttcatagctgacgc

SEQ ID NO: 8171998 - DNA, 22 bp, Homo sapiens
catggcagaaacctgagctgct

SEQ ID NO: 8171999 - DNA, 22 bp, Homo sapiens
catggcactgagcaggtatgca

SEQ ID NO: 8172000 - DNA, 22 bp, Homo sapiens
catggcactgagcaggtatgca

SEQ ID NO: 8172001 - DNA, 22 bp, Homo sapiens
aggattctgtaatctgtgaaat

SEQ ID NO: 8172002 - DNA, 22 bp, Homo sapiens
aggattgtatacctaagtgtta

SEQ ID NO: 8172003 - DNA, 22 bp, Homo sapiens
aggattgtgcctccagtcagaa

SEQ ID NO: 8172004 - DNA, 22 bp, Homo sapiens
aggattgtatacctaagtgtta

SEQ ID NO: 8172005 - DNA, 22 bp, Homo sapiens
aggattaaagtatatttttgag

SEQ ID NO: 8172006 - DNA, 22 bp, Homo sapiens
aggattaaaacagtgggatttg

SEQ ID NO: 8172007 - DNA, 22 bp, Homo sapiens
aggattcatggtgcagacaaag

SEQ ID NO: 8172008 - DNA, 19 bp, Homo sapiens
aggattccagaacagtgtt

SEQ ID NO: 8172009 - DNA, 22 bp, Homo sapiens
aggattcagaatgtatgcagtg

SEQ ID NO: 8172010 - DNA, 22 bp, Homo sapiens
aggattcagaatgtatgcagtg

SEQ ID NO: 8172011 - DNA, 22 bp, Homo sapiens
aggattaactgacctagtgttt

SEQ ID NO: 8172012 - DNA, 22 bp, Homo sapiens
aggagggcaggctggctgccta

SEQ ID NO: 8172013 - DNA, 22 bp, Homo sapiens
aggagggcaggctggctgccta

SEQ ID NO: 8172014 - DNA, 22 bp, Homo sapiens
aggagggcaggctggctgccta

SEQ ID NO: 8172015 - DNA, 22 bp, Homo sapiens
aggagggctaggaaaaccagga

SEQ ID NO: 8172016 - DNA, 22 bp, Homo sapiens
aggagggcaggctggctgccta

SEQ ID NO: 8172017 - DNA, 22 bp, Homo sapiens
aggagggctaggaaaaccagga

SEQ ID NO: 8172018 - DNA, 22 bp, Homo sapiens
aggagggctaggaaaaccagga

SEQ ID NO: 8172019 - DNA, 21 bp, Homo sapiens
aggagggcacaaggccaggaa

SEQ ID NO: 8172020 - DNA, 21 bp, Homo sapiens
aggagggcacaaggccaggaa

SEQ ID NO: 8172021 - DNA, 21 bp, Homo sapiens
aggagggcacaaggccaggaa

SEQ ID NO: 8172022 - DNA, 21 bp, Homo sapiens
aggagggcacaaggccaggaa

SEQ ID NO: 8172023 - DNA, 16 bp, Homo sapiens
aggaggggaattagga

SEQ ID NO: 8172024 - DNA, 22 bp, Homo sapiens
aggagggctaggaaaaccagga

SEQ ID NO: 8172025 - DNA, 20 bp, Homo sapiens
aggaggggatagaatcaaag

SEQ ID NO: 8172026 - DNA, 20 bp, Homo sapiens
aggaggggatagaatcaaag

SEQ ID NO: 8172027 - DNA, 22 bp, Homo sapiens
catgctaaaatatctgaagatt

SEQ ID NO: 8172028 - DNA, 22 bp, Homo sapiens
catgcgggttccaggctgcact

SEQ ID NO: 8172029 - DNA, 22 bp, Homo sapiens
catgctaaaccagaacatagga

SEQ ID NO: 8172030 - DNA, 22 bp, Homo sapiens
catgcggctctttccaaaccgg

SEQ ID NO: 8172031 - DNA, 22 bp, Homo sapiens
aggaggggcaatgatagtctgg

SEQ ID NO: 8172032 - DNA, 22 bp, Homo sapiens
catttgttctgatttcaaaagg

SEQ ID NO: 8172033 - DNA, 22 bp, Homo sapiens
catttgttcaaccattctcgct

SEQ ID NO: 8172034 - DNA, 18 bp, Homo sapiens
catttgttattgtgtgtg

SEQ ID NO: 8172035 - DNA, 20 bp, Homo sapiens
catttgttagctttctactg

SEQ ID NO: 8172036 - DNA, 22 bp, Homo sapiens
catttgttaattactattatct

SEQ ID NO: 8172037 - DNA, 20 bp, Homo sapiens
catttgttagctttctactg

SEQ ID NO: 8172038 - DNA, 22 bp, Homo sapiens
catttgttaatgctgcttttaa

SEQ ID NO: 8172039 - DNA, 22 bp, Homo sapiens
catttgttaatgctgcttttaa

SEQ ID NO: 8172040 - DNA, 22 bp, Homo sapiens
catttgaaattcttagaacaaa

SEQ ID NO: 8172041 - DNA, 22 bp, Homo sapiens
catttgttaaccagtgtggatt

SEQ ID NO: 8172042 - DNA, 22 bp, Homo sapiens
catttgttaagaaggaaaaagg

SEQ ID NO: 8172043 - DNA, 22 bp, Homo sapiens
catttgttaatgctgcttttaa

SEQ ID NO: 8172044 - DNA, 22 bp, Homo sapiens
catttgttaagaaggaaaaagg

SEQ ID NO: 8172045 - DNA, 22 bp, Homo sapiens
cattaacaattgtttatgctgt

SEQ ID NO: 8172046 - DNA, 22 bp, Homo sapiens
cattaacaatgactgcttgact

SEQ ID NO: 8172047 - DNA, 22 bp, Homo sapiens
cattaacaattgtttatgctgt

SEQ ID NO: 8172048 - DNA, 22 bp, Homo sapiens
catttgtttataagttccccag

SEQ ID NO: 8172049 - DNA, 22 bp, Homo sapiens
catttgtttagaagtctttata

SEQ ID NO: 8172050 - DNA, 22 bp, Homo sapiens
catttgttggtcagattgtagt

SEQ ID NO: 8172051 - DNA, 22 bp, Homo sapiens
catttgttggttgctgtcttat

SEQ ID NO: 8172052 - DNA, 17 bp, Homo sapiens
catttgttgatcagttg

SEQ ID NO: 8172053 - DNA, 17 bp, Homo sapiens
catttgttgatcagttg

SEQ ID NO: 8172054 - DNA, 22 bp, Homo sapiens
catttgttgggacaatgaaaag

SEQ ID NO: 8172055 - DNA, 22 bp, Homo sapiens
catttgttgggacaatgaaaag

SEQ ID NO: 8172056 - DNA, 22 bp, Homo sapiens
catttgttgggacaatgaaaag

SEQ ID NO: 8172057 - DNA, 19 bp, Homo sapiens
aggcagcaggccagggatg

SEQ ID NO: 8172058 - DNA, 22 bp, Homo sapiens
cattttaaatgatttaagccaa

SEQ ID NO: 8172059 - DNA, 21 bp, Homo sapiens
aggcagcaggatccagggaca

SEQ ID NO: 8172060 - DNA, 22 bp, Homo sapiens
cattttaaatgatttaagccaa

SEQ ID NO: 8172061 - DNA, 22 bp, Homo sapiens
aggcactgtgcttcttatatgt

SEQ ID NO: 8172062 - DNA, 22 bp, Homo sapiens
aggcactgtggaagacatggtt

SEQ ID NO: 8172063 - DNA, 22 bp, Homo sapiens
aggcactgtggaagacatggtt

SEQ ID NO: 8172064 - DNA, 15 bp, Homo sapiens
aggcactgtgggacc

SEQ ID NO: 8172065 - DNA, 22 bp, Homo sapiens
aggcactgtggaagacatggtt

SEQ ID NO: 8172066 - DNA, 22 bp, Homo sapiens
aggcactgtggaagacatggtt

SEQ ID NO: 8172067 - DNA, 22 bp, Homo sapiens
aggcactgtactaggtacaggg

SEQ ID NO: 8172068 - DNA, 22 bp, Homo sapiens
aggcactgtactaggtacaggg

SEQ ID NO: 8172069 - DNA, 22 bp, Homo sapiens
aggcactgtactaggtacaggg

SEQ ID NO: 8172070 - DNA, 22 bp, Homo sapiens
aggcactgtgcagtcccaagca

SEQ ID NO: 8172071 - DNA, 22 bp, Homo sapiens
aggcactgtgctgatgtcttat

SEQ ID NO: 8172072 - DNA, 22 bp, Homo sapiens
cattaaaatatctcatggtgtt

SEQ ID NO: 8172073 - DNA, 22 bp, Homo sapiens
cattaaaatatctcatggtgtt

SEQ ID NO: 8172074 - DNA, 22 bp, Homo sapiens
cattaaaatatctcatggtgtt

SEQ ID NO: 8172075 - DNA, 23 bp, Homo sapiens
catgtttttctatctcagcgtgt

SEQ ID NO: 8172076 - DNA, 23 bp, Homo sapiens
catgtttttctatctcagcgtgt

SEQ ID NO: 8172077 - DNA, 22 bp, Homo sapiens
cattaaaatatctcatggtgtt

SEQ ID NO: 8172078 - DNA, 22 bp, Homo sapiens
aggcactgtgggtgtggccgga

SEQ ID NO: 8172079 - DNA, 22 bp, Homo sapiens
catgttttgtgtacagaatatt

SEQ ID NO: 8172080 - DNA, 22 bp, Homo sapiens
cattaaatatcaacctagacta

SEQ ID NO: 8172081 - DNA, 22 bp, Homo sapiens
cattaaacaaccttgaatcaat

SEQ ID NO: 8172082 - DNA, 22 bp, Homo sapiens
cattaaacaaccttgaatcaat

SEQ ID NO: 8172083 - DNA, 22 bp, Homo sapiens
cattaaatcttccagacctcac

SEQ ID NO: 8172084 - DNA, 22 bp, Homo sapiens
cattaaattccttgttctcaaa

SEQ ID NO: 8172085 - DNA, 22 bp, Homo sapiens
cattaaattccttgttctcaaa

SEQ ID NO: 8172086 - DNA, 22 bp, Homo sapiens
cattaacaatgactgcttgact

SEQ ID NO: 8172087 - DNA, 22 bp, Homo sapiens
ccaatacactttatagaagaaa

SEQ ID NO: 8172088 - DNA, 22 bp, Homo sapiens
ccaataactgtaactttctgtg

SEQ ID NO: 8172089 - DNA, 18 bp, Homo sapiens
aggcaggctggagtgact

SEQ ID NO: 8172090 - DNA, 22 bp, Homo sapiens
aggcaggctggtctgaagagtg

SEQ ID NO: 8172091 - DNA, 18 bp, Homo sapiens
aggcaggctggagtgact

SEQ ID NO: 8172092 - DNA, 18 bp, Homo sapiens
aggcaggctggagtgact

SEQ ID NO: 8172093 - DNA, 18 bp, Homo sapiens
aggcaggctggagtgact

SEQ ID NO: 8172094 - DNA, 22 bp, Homo sapiens
ccaagtcttggttctgtatctt

SEQ ID NO: 8172095 - DNA, 22 bp, Homo sapiens
ccaagtgagttgcgtaaatgga

SEQ ID NO: 8172096 - DNA, 20 bp, Homo sapiens
ccaataaagctctataggga

SEQ ID NO: 8172097 - DNA, 22 bp, Homo sapiens
ccaagtgatacacccgcctcgg

SEQ ID NO: 8172098 - DNA, 22 bp, Homo sapiens
ccaagtgatttctaagtttatt

SEQ ID NO: 8172099 - DNA, 22 bp, Homo sapiens
ccaagtgagttgcgtaaatgga

SEQ ID NO: 8172100 - DNA, 22 bp, Homo sapiens
ccaagtgatacacccgcctcgg

SEQ ID NO: 8172101 - DNA, 22 bp, Homo sapiens
ccaagtcctgctgccactctac

SEQ ID NO: 8172102 - DNA, 18 bp, Homo sapiens
ccaagtatggcagaggct

SEQ ID NO: 8172103 - DNA, 20 bp, Homo sapiens
ccaaggttggaggcagggtg

SEQ ID NO: 8172104 - DNA, 19 bp, Homo sapiens
ccaaggttggcagctgggc

SEQ ID NO: 8172105 - DNA, 22 bp, Homo sapiens
ccaaggttttctggcactattt

SEQ ID NO: 8172106 - DNA, 22 bp, Homo sapiens
ccaaggtttattttgatacatt

SEQ ID NO: 8172107 - DNA, 22 bp, Homo sapiens
ccaaggttagaaaaggtacttt

SEQ ID NO: 8172108 - DNA, 22 bp, Homo sapiens
ccaaggttgagaaactgtagga

SEQ ID NO: 8172109 - DNA, 22 bp, Homo sapiens
ccaaggttgcaggcctcagaga

SEQ ID NO: 8172110 - DNA, 22 bp, Homo sapiens
ccaaggtgggaggattgcttga

SEQ ID NO: 8172111 - DNA, 22 bp, Homo sapiens
ccaaggggattgcagaagcagc

SEQ ID NO: 8172112 - DNA, 22 bp, Homo sapiens
ccaagggctgctgaggtgtcca

SEQ ID NO: 8172113 - DNA, 22 bp, Homo sapiens
ccaaggagaaatgctgtgcttt

SEQ ID NO: 8172114 - DNA, 22 bp, Homo sapiens
ccaaggactggacacacaggtt

SEQ ID NO: 8172115 - DNA, 22 bp, Homo sapiens
ccaagggctctgacttgcctgc

SEQ ID NO: 8172116 - DNA, 22 bp, Homo sapiens
ccaagcgggaatgcaatggcgt

SEQ ID NO: 8172117 - DNA, 22 bp, Homo sapiens
ccaagcatttctagccagtcac

SEQ ID NO: 8172118 - DNA, 22 bp, Homo sapiens
ccaagcatggggttcagtagga

SEQ ID NO: 8172119 - DNA, 22 bp, Homo sapiens
ccaagcagtctgctaggagttt

SEQ ID NO: 8172120 - DNA, 22 bp, Homo sapiens
ccaagctggacagcagcaagga

SEQ ID NO: 8172121 - DNA, 22 bp, Homo sapiens
ccaagctggacagcagcaagga

SEQ ID NO: 8172122 - DNA, 22 bp, Homo sapiens
ccaagctgactgtgctgttgtg

SEQ ID NO: 8172123 - DNA, 22 bp, Homo sapiens
ccaagctgagcaccatctgatc

SEQ ID NO: 8172124 - DNA, 22 bp, Homo sapiens
ccaagctacttaggagtctgag

SEQ ID NO: 8172125 - DNA, 22 bp, Homo sapiens
ccaagctacttaggagtctgag

SEQ ID NO: 8172126 - DNA, 22 bp, Homo sapiens
ccaagctacttaggagtctgag

SEQ ID NO: 8172127 - DNA, 22 bp, Homo sapiens
ccaagctacttaggagtctgag

SEQ ID NO: 8172128 - DNA, 22 bp, Homo sapiens
ccaagcagaaccattcaggcac

SEQ ID NO: 8172129 - DNA, 17 bp, Homo sapiens
ccaagatgatagaggga

SEQ ID NO: 8172130 - DNA, 22 bp, Homo sapiens
ccaagatgagctggctccatgg

SEQ ID NO: 8172131 - DNA, 16 bp, Homo sapiens
ccaagcagcagcagct

SEQ ID NO: 8172132 - DNA, 22 bp, Homo sapiens
ccaagcagagcagcctctctgg

SEQ ID NO: 8172133 - DNA, 22 bp, Homo sapiens
ccaaaggccaggcactgaggtt

SEQ ID NO: 8172134 - DNA, 23 bp, Homo sapiens
aggcagcaggttgtccagggtga

SEQ ID NO: 8172135 - DNA, 23 bp, Homo sapiens
aggcagcaggttgtccagggtga

SEQ ID NO: 8172136 - DNA, 23 bp, Homo sapiens
aggcagcaggttgtccagggtga

SEQ ID NO: 8172137 - DNA, 22 bp, Homo sapiens
aggcagcagggccactggctga

SEQ ID NO: 8172138 - DNA, 22 bp, Homo sapiens
aggcagcagggccactggctga

SEQ ID NO: 8172139 - DNA, 20 bp, Homo sapiens
acatatcatggtagagtcct

SEQ ID NO: 8172140 - DNA, 22 bp, Homo sapiens
acatatctgtgaggttttgttg

SEQ ID NO: 8172141 - DNA, 22 bp, Homo sapiens
acatattaactgcactacacta

SEQ ID NO: 8172142 - DNA, 22 bp, Homo sapiens
acatattaactgcactacacta

SEQ ID NO: 8172143 - DNA, 22 bp, Homo sapiens
acatatattttcacacatggtt

SEQ ID NO: 8172144 - DNA, 22 bp, Homo sapiens
acatatattttcacacatggtt

SEQ ID NO: 8172145 - DNA, 22 bp, Homo sapiens
acatattggcttagctctgtga

SEQ ID NO: 8172146 - DNA, 22 bp, Homo sapiens
acatattgagctctaaaagtac

SEQ ID NO: 8172147 - DNA, 22 bp, Homo sapiens
acatatttccatgcagcatgtc

SEQ ID NO: 8172148 - DNA, 22 bp, Homo sapiens
acatatttccatgcagcatgtc

SEQ ID NO: 8172149 - DNA, 22 bp, Homo sapiens
acatattttgaaagctttctaa

SEQ ID NO: 8172150 - DNA, 22 bp, Homo sapiens
aggcagctgccctctccttcct

SEQ ID NO: 8172151 - DNA, 21 bp, Homo sapiens
aggcagctggaaggcctggct

SEQ ID NO: 8172152 - DNA, 22 bp, Homo sapiens
aggcagctctgtggcctcccag

SEQ ID NO: 8172153 - DNA, 21 bp, Homo sapiens
aggcagctcaggcccagagag

SEQ ID NO: 8172154 - DNA, 17 bp, Homo sapiens
aggcagctcagaacatc

SEQ ID NO: 8172155 - DNA, 22 bp, Homo sapiens
acatagctcagtatcacttact

SEQ ID NO: 8172156 - DNA, 22 bp, Homo sapiens
acatagcagaggactgagcaga

SEQ ID NO: 8172157 - DNA, 21 bp, Homo sapiens
acataggcgaatgttcgggag

SEQ ID NO: 8172158 - DNA, 22 bp, Homo sapiens
acatagtaagtgctcagtaaat

SEQ ID NO: 8172159 - DNA, 22 bp, Homo sapiens
acatagtaagtgctcagtaaat

SEQ ID NO: 8172160 - DNA, 22 bp, Homo sapiens
acatagtgttttgagagacagc

SEQ ID NO: 8172161 - DNA, 17 bp, Homo sapiens
aggcagctcagaacatc

SEQ ID NO: 8172162 - DNA, 22 bp, Homo sapiens
aggcagctagagagtgaaactg

SEQ ID NO: 8172163 - DNA, 22 bp, Homo sapiens
acatagaagtgatgcttatcca

SEQ ID NO: 8172164 - DNA, 22 bp, Homo sapiens
acatagatttaagagcaattag

SEQ ID NO: 8172165 - DNA, 22 bp, Homo sapiens
acatagatgcctctgctgcttc

SEQ ID NO: 8172166 - DNA, 22 bp, Homo sapiens
acatagaacttcccagtgagca

SEQ ID NO: 8172167 - DNA, 22 bp, Homo sapiens
acatagaacttcccagtgagca

SEQ ID NO: 8172168 - DNA, 22 bp, Homo sapiens
acatagaaggaagagtagtagg

SEQ ID NO: 8172169 - DNA, 22 bp, Homo sapiens
acatagaaggaagagtagtagg

SEQ ID NO: 8172170 - DNA, 22 bp, Homo sapiens
acagtttaggatgagagaacac

SEQ ID NO: 8172171 - DNA, 22 bp, Homo sapiens
acagtttagagcatgatgacca

SEQ ID NO: 8172172 - DNA, 22 bp, Homo sapiens
acagtttataaaaataatgagg

SEQ ID NO: 8172173 - DNA, 22 bp, Homo sapiens
acagtttataaaaataatgagg

SEQ ID NO: 8172174 - DNA, 22 bp, Homo sapiens
acagtttataaaaataatgagg

SEQ ID NO: 8172175 - DNA, 20 bp, Homo sapiens
acagtttatccagttagcag

SEQ ID NO: 8172176 - DNA, 22 bp, Homo sapiens
aggatggattctgtatgtggga

SEQ ID NO: 8172177 - DNA, 19 bp, Homo sapiens
aggatggagcaggcggtga

SEQ ID NO: 8172178 - DNA, 19 bp, Homo sapiens
aggatggagcaggcggtga

SEQ ID NO: 8172179 - DNA, 22 bp, Homo sapiens
aggatgagccgcgcaagctgac

SEQ ID NO: 8172180 - DNA, 22 bp, Homo sapiens
aggatgagattgctgtgttgta

SEQ ID NO: 8172181 - DNA, 22 bp, Homo sapiens
aggatgagattccagggtcaat

SEQ ID NO: 8172182 - DNA, 22 bp, Homo sapiens
aggatgagattccagggtcaat

SEQ ID NO: 8172183 - DNA, 22 bp, Homo sapiens
aggatgagagatacatggagca

SEQ ID NO: 8172184 - DNA, 22 bp, Homo sapiens
acagtgttacttgatagtgtat

SEQ ID NO: 8172185 - DNA, 20 bp, Homo sapiens
aggatgcagggagtctgcag

SEQ ID NO: 8172186 - DNA, 22 bp, Homo sapiens
aggatgagccgcgcaagctgac

SEQ ID NO: 8172187 - DNA, 22 bp, Homo sapiens
aggatgccttcattgcatggcc

SEQ ID NO: 8172188 - DNA, 20 bp, Homo sapiens
aggatgcagggagtctgcag

SEQ ID NO: 8172189 - DNA, 21 bp, Homo sapiens
aggatggaaaggactaggggt

SEQ ID NO: 8172190 - DNA, 22 bp, Homo sapiens
aggatggaattaggtagcaagt

SEQ ID NO: 8172191 - DNA, 22 bp, Homo sapiens
aggatgccttcattgcatggcc

SEQ ID NO: 8172192 - DNA, 22 bp, Homo sapiens
acagtttgaataatttagatag

SEQ ID NO: 8172193 - DNA, 22 bp, Homo sapiens
aggcactgcttctaagtaggaa

SEQ ID NO: 8172194 - DNA, 22 bp, Homo sapiens
acagtttgccctgacattctcc

SEQ ID NO: 8172195 - DNA, 17 bp, Homo sapiens
acagtttgattttagca

SEQ ID NO: 8172196 - DNA, 22 bp, Homo sapiens
acagtttccccctagggcagca

SEQ ID NO: 8172197 - DNA, 20 bp, Homo sapiens
acagtttattttacttggtt

SEQ ID NO: 8172198 - DNA, 20 bp, Homo sapiens
acagtttattttacttggtt

SEQ ID NO: 8172199 - DNA, 21 bp, Homo sapiens
acagtttattagagtaagtgc

SEQ ID NO: 8172200 - DNA, 22 bp, Homo sapiens
acagtttatggtgttttatata

SEQ ID NO: 8172201 - DNA, 22 bp, Homo sapiens
acagtttatggtgttttatata

SEQ ID NO: 8172202 - DNA, 22 bp, Homo sapiens
acagtttatggtgttttatata

SEQ ID NO: 8172203 - DNA, 20 bp, Homo sapiens
aggcactggatttcttatat

SEQ ID NO: 8172204 - DNA, 18 bp, Homo sapiens
aggcactggaattaaggg

SEQ ID NO: 8172205 - DNA, 22 bp, Homo sapiens
aggcactgggaatatgctgagg

SEQ ID NO: 8172206 - DNA, 22 bp, Homo sapiens
aggcactgggggatgagcaagg

SEQ ID NO: 8172207 - DNA, 22 bp, Homo sapiens
aggcactgggtaattagtagct

SEQ ID NO: 8172208 - DNA, 20 bp, Homo sapiens
aggcactggggataggtaag

SEQ ID NO: 8172209 - DNA, 22 bp, Homo sapiens
aggcactgggggatgagcaagg

SEQ ID NO: 8172210 - DNA, 22 bp, Homo sapiens
acaggtgttttggaggatgatt

SEQ ID NO: 8172211 - DNA, 22 bp, Homo sapiens
acaggtgttttggaggatgatt

SEQ ID NO: 8172212 - DNA, 20 bp, Homo sapiens
acaggttcattctgtgtgac

SEQ ID NO: 8172213 - DNA, 22 bp, Homo sapiens
acaggtttagctcttagtagtc

SEQ ID NO: 8172214 - DNA, 22 bp, Homo sapiens
acaggtgtacaatgcatgacag

SEQ ID NO: 8172215 - DNA, 22 bp, Homo sapiens
acaggtgtaatttgcccgaggt

SEQ ID NO: 8172216 - DNA, 22 bp, Homo sapiens
acaggtgtacaatgcatgacag

SEQ ID NO: 8172217 - DNA, 22 bp, Homo sapiens
acaggtgttgactcacaggccc

SEQ ID NO: 8172218 - DNA, 22 bp, Homo sapiens
acaggtgttgaatgatgtcaca

SEQ ID NO: 8172219 - DNA, 22 bp, Homo sapiens
acaggtgtacaatgcatgacag

SEQ ID NO: 8172220 - DNA, 22 bp, Homo sapiens
acaggtgttgactcacaggccc

SEQ ID NO: 8172221 - DNA, 22 bp, Homo sapiens
acaggtgttgactcacaggccc

SEQ ID NO: 8172222 - DNA, 22 bp, Homo sapiens
aggacacagctgctctgcagag

SEQ ID NO: 8172223 - DNA, 22 bp, Homo sapiens
aggacacagctgctctgcagag

SEQ ID NO: 8172224 - DNA, 22 bp, Homo sapiens
aggacacaggcaggaggagatc

SEQ ID NO: 8172225 - DNA, 21 bp, Homo sapiens
aggacacagagacacctattg

SEQ ID NO: 8172226 - DNA, 21 bp, Homo sapiens
aggacacagagacacctattg

SEQ ID NO: 8172227 - DNA, 22 bp, Homo sapiens
acagtaaaaagccttagaattt

SEQ ID NO: 8172228 - DNA, 22 bp, Homo sapiens
acagtaaagccttctggttgac

SEQ ID NO: 8172229 - DNA, 22 bp, Homo sapiens
acagtaaagccttctggttgac

SEQ ID NO: 8172230 - DNA, 22 bp, Homo sapiens
acagtaaataatgcatgttgat

SEQ ID NO: 8172231 - DNA, 22 bp, Homo sapiens
aggagcagaactgttgtggagg

SEQ ID NO: 8172232 - DNA, 22 bp, Homo sapiens
aggagcagaactgttgtggagg

SEQ ID NO: 8172233 - DNA, 22 bp, Homo sapiens
aggagcagaactgattctgact

SEQ ID NO: 8172234 - DNA, 22 bp, Homo sapiens
aggagattgtggtgcaaggaat

SEQ ID NO: 8172235 - DNA, 22 bp, Homo sapiens
aggagcaaatgatgagacagca

SEQ ID NO: 8172236 - DNA, 22 bp, Homo sapiens
aggagcaaatgatgagacagca

SEQ ID NO: 8172237 - DNA, 22 bp, Homo sapiens
acagtaaatcaacagaatatct

SEQ ID NO: 8172238 - DNA, 22 bp, Homo sapiens
aggagatggagctcagtgggca

SEQ ID NO: 8172239 - DNA, 22 bp, Homo sapiens
aggagattgtactgtcatcact

SEQ ID NO: 8172240 - DNA, 22 bp, Homo sapiens
aggagcagaccgtagtcctgca

SEQ ID NO: 8172241 - DNA, 22 bp, Homo sapiens
aggagcagaccgtagtcctgca

SEQ ID NO: 8172242 - DNA, 22 bp, Homo sapiens
aggagcagaccgtagtcctgca

SEQ ID NO: 8172243 - DNA, 22 bp, Homo sapiens
aggagcagaatttaatgtgcag

SEQ ID NO: 8172244 - DNA, 22 bp, Homo sapiens
aggagcagaccgtagtcctgca

SEQ ID NO: 8172245 - DNA, 22 bp, Homo sapiens
aggagcagaccgtagtcctgca

SEQ ID NO: 8172246 - DNA, 22 bp, Homo sapiens
acagtacaccactgtgtacagt

SEQ ID NO: 8172247 - DNA, 22 bp, Homo sapiens
acagtatagggcttatattgta

SEQ ID NO: 8172248 - DNA, 22 bp, Homo sapiens
acagtatatatagtctaaaagc

SEQ ID NO: 8172249 - DNA, 22 bp, Homo sapiens
acagtcaggccgagatgggcct

SEQ ID NO: 8172250 - DNA, 21 bp, Homo sapiens
acagtcacaaaaccaaggcag

SEQ ID NO: 8172251 - DNA, 22 bp, Homo sapiens
acagtcaatcagaacagcatgt

SEQ ID NO: 8172252 - DNA, 22 bp, Homo sapiens
acagtcaatcagaacagcatgt

SEQ ID NO: 8172253 - DNA, 22 bp, Homo sapiens
acagtcaatcagaacagcatgt

SEQ ID NO: 8172254 - DNA, 22 bp, Homo sapiens
acagtatttgcgatactgatga

SEQ ID NO: 8172255 - DNA, 22 bp, Homo sapiens
acagtcagggcttactcaggga

SEQ ID NO: 8172256 - DNA, 22 bp, Homo sapiens
acagtcagtatcccaggcaaat

SEQ ID NO: 8172257 - DNA, 22 bp, Homo sapiens
acagtcagttgaatccaaggag

SEQ ID NO: 8172258 - DNA, 22 bp, Homo sapiens
acagtcattagatacaatgtct

SEQ ID NO: 8172259 - DNA, 22 bp, Homo sapiens
acagtctaatcttgtgttctgt

SEQ ID NO: 8172260 - DNA, 23 bp, Homo sapiens
acagtcgtaggtatccttttcct

SEQ ID NO: 8172261 - DNA, 22 bp, Homo sapiens
acagtctacaaagtgatgtgtg

SEQ ID NO: 8172262 - DNA, 22 bp, Homo sapiens
acagtctactaaacatcatcag

SEQ ID NO: 8172263 - DNA, 22 bp, Homo sapiens
acagtccttgtttcggtcagat

SEQ ID NO: 8172264 - DNA, 23 bp, Homo sapiens
acagtcgtaggtatccttttcct

SEQ ID NO: 8172265 - DNA, 22 bp, Homo sapiens
acagtcctgttgtcaaagcaat

SEQ ID NO: 8172266 - DNA, 22 bp, Homo sapiens
acagtcctgtacaggccatatc

SEQ ID NO: 8172267 - DNA, 22 bp, Homo sapiens
acagtctctccacactgcaggg

SEQ ID NO: 8172268 - DNA, 22 bp, Homo sapiens
acagtctcttgcttgaatacta

SEQ ID NO: 8172269 - DNA, 22 bp, Homo sapiens
acagtctctgttgctgctgttt

SEQ ID NO: 8172270 - DNA, 22 bp, Homo sapiens
acagtctactaaacatcatcag

SEQ ID NO: 8172271 - DNA, 22 bp, Homo sapiens
acagtctacttgagcttgtata

SEQ ID NO: 8172272 - DNA, 22 bp, Homo sapiens
acagtctaggcctaggtcaaaa

SEQ ID NO: 8172273 - DNA, 22 bp, Homo sapiens
acagtgggatgaggctggcccc

SEQ ID NO: 8172274 - DNA, 22 bp, Homo sapiens
acagtggggtcttaatagaaca

SEQ ID NO: 8172275 - DNA, 22 bp, Homo sapiens
acagtgtctcactgctgaaatc

SEQ ID NO: 8172276 - DNA, 22 bp, Homo sapiens
acagtgtctcctggtacccagt

SEQ ID NO: 8172277 - DNA, 22 bp, Homo sapiens
acagtgtctgacacgtaggaag

SEQ ID NO: 8172278 - DNA, 23 bp, Homo sapiens
acagtgtctgctgcaagatatct

SEQ ID NO: 8172279 - DNA, 22 bp, Homo sapiens
acagtgtctcctggtacccagt

SEQ ID NO: 8172280 - DNA, 22 bp, Homo sapiens
acagtgtctgacacattgtagc

SEQ ID NO: 8172281 - DNA, 22 bp, Homo sapiens
acagtgtctgacacattgtagc

SEQ ID NO: 8172282 - DNA, 22 bp, Homo sapiens
acagtctgcttgtctccatggt

SEQ ID NO: 8172283 - DNA, 17 bp, Homo sapiens
acagtctgcctgacagt

SEQ ID NO: 8172284 - DNA, 22 bp, Homo sapiens
acagtctgcatatgacctgtag

SEQ ID NO: 8172285 - DNA, 22 bp, Homo sapiens
acagtctgcagggtgaacatgt

SEQ ID NO: 8172286 - DNA, 22 bp, Homo sapiens
acagtctgcatatgacctgtag

SEQ ID NO: 8172287 - DNA, 22 bp, Homo sapiens
acagtctgagaattactgctct

SEQ ID NO: 8172288 - DNA, 22 bp, Homo sapiens
acagtctgcaggcaagttctac

SEQ ID NO: 8172289 - DNA, 22 bp, Homo sapiens
acagtgtggttgtttctggtta

SEQ ID NO: 8172290 - DNA, 22 bp, Homo sapiens
acagtgtggttgtttctggtta

SEQ ID NO: 8172291 - DNA, 22 bp, Homo sapiens
acagtgtggtttgagcactggg

SEQ ID NO: 8172292 - DNA, 22 bp, Homo sapiens
acagtgtggtttgagcactggg

SEQ ID NO: 8172293 - DNA, 22 bp, Homo sapiens
acagtgtgtgctttcccttacg

SEQ ID NO: 8172294 - DNA, 22 bp, Homo sapiens
acagtgtggtttgagcactggg

SEQ ID NO: 8172295 - DNA, 22 bp, Homo sapiens
acagtgtggtttgagcactggg

SEQ ID NO: 8172296 - DNA, 22 bp, Homo sapiens
acagtgtggtgatggcacttgc

SEQ ID NO: 8172297 - DNA, 22 bp, Homo sapiens
acagtgtggggtgagatggaac

SEQ ID NO: 8172298 - DNA, 22 bp, Homo sapiens
acagtgtggaaagtcaacttga

SEQ ID NO: 8172299 - DNA, 22 bp, Homo sapiens
acagtgtggggtgagatggaac

SEQ ID NO: 8172300 - DNA, 22 bp, Homo sapiens
acagtgtgacaattgtgtcaga

SEQ ID NO: 8172301 - DNA, 22 bp, Homo sapiens
acagtgtgacaattgtgtcaga

SEQ ID NO: 8172302 - DNA, 19 bp, Homo sapiens
acagtgtctgtatataaat

SEQ ID NO: 8172303 - DNA, 22 bp, Homo sapiens
acagggaccttggaagctggaa

SEQ ID NO: 8172304 - DNA, 22 bp, Homo sapiens
acagggaccttggaagctggaa

SEQ ID NO: 8172305 - DNA, 22 bp, Homo sapiens
acagggagatatcttcaatatc

SEQ ID NO: 8172306 - DNA, 22 bp, Homo sapiens
acagggacctgtgagctccata

SEQ ID NO: 8172307 - DNA, 22 bp, Homo sapiens
acagggacctgtgagctccata

SEQ ID NO: 8172308 - DNA, 22 bp, Homo sapiens
acagggaatggagggatcagta

SEQ ID NO: 8172309 - DNA, 22 bp, Homo sapiens
acagggaagttctgcaacagga

SEQ ID NO: 8172310 - DNA, 22 bp, Homo sapiens
acagggaatggagggatcagta

SEQ ID NO: 8172311 - DNA, 22 bp, Homo sapiens
acagggaaggagcatagaaaaa

SEQ ID NO: 8172312 - DNA, 22 bp, Homo sapiens
acaggcaggcttcggccagagc

SEQ ID NO: 8172313 - DNA, 22 bp, Homo sapiens
acaggcagggacctcttgagtt

SEQ ID NO: 8172314 - DNA, 22 bp, Homo sapiens
acaggcagggacctcttgagtt

SEQ ID NO: 8172315 - DNA, 22 bp, Homo sapiens
acaggcaggcttcggccagagc

SEQ ID NO: 8172316 - DNA, 22 bp, Homo sapiens
acaggcaggcttcggccagagc

SEQ ID NO: 8172317 - DNA, 22 bp, Homo sapiens
acaggcaggcttcggccagagc

SEQ ID NO: 8172318 - DNA, 22 bp, Homo sapiens
acaggcaggcttcggccagagc

SEQ ID NO: 8172319 - DNA, 22 bp, Homo sapiens
acaggcagggaccttggctaag

SEQ ID NO: 8172320 - DNA, 22 bp, Homo sapiens
acaggcagggacctcttgagtt

SEQ ID NO: 8172321 - DNA, 22 bp, Homo sapiens
acaggcagggacctcttgagtt

SEQ ID NO: 8172322 - DNA, 22 bp, Homo sapiens
acaggctgttggggtccagggt

SEQ ID NO: 8172323 - DNA, 22 bp, Homo sapiens
acaggctgttggggtccagggt

SEQ ID NO: 8172324 - DNA, 22 bp, Homo sapiens
acaggcagggaccttggctaag

SEQ ID NO: 8172325 - DNA, 22 bp, Homo sapiens
acaggcagggaccttggctaag

SEQ ID NO: 8172326 - DNA, 22 bp, Homo sapiens
acaggcagggaccttggctaag

SEQ ID NO: 8172327 - DNA, 22 bp, Homo sapiens
acagggaagctcaggggctctg

SEQ ID NO: 8172328 - DNA, 22 bp, Homo sapiens
acaggctgttggggtccagggt

SEQ ID NO: 8172329 - DNA, 22 bp, Homo sapiens
acagggaaggacatgacttggc

SEQ ID NO: 8172330 - DNA, 23 bp, Homo sapiens
acaggcaggcatggccaaatgtg

SEQ ID NO: 8172331 - DNA, 23 bp, Homo sapiens
acaggcaggcatggccaaatgtg

SEQ ID NO: 8172332 - DNA, 23 bp, Homo sapiens
acaggcaggcatggccaaatgtg

SEQ ID NO: 8172333 - DNA, 22 bp, Homo sapiens
acaggcaggcgggacagcccga

SEQ ID NO: 8172334 - DNA, 22 bp, Homo sapiens
acaggcaggcgggacagcccga

SEQ ID NO: 8172335 - DNA, 22 bp, Homo sapiens
acaggcaggcttcggccagagc

SEQ ID NO: 8172336 - DNA, 22 bp, Homo sapiens
acaggcaggcttcggccagagc

SEQ ID NO: 8172337 - DNA, 22 bp, Homo sapiens
acaggcaggcgggacagcccga

SEQ ID NO: 8172338 - DNA, 22 bp, Homo sapiens
acaggcaggcgggacagcccga

SEQ ID NO: 8172339 - DNA, 22 bp, Homo sapiens
acaggcaggcgggacagcccga

SEQ ID NO: 8172340 - DNA, 22 bp, Homo sapiens
acaggcagcgtcattgctgctc

SEQ ID NO: 8172341 - DNA, 22 bp, Homo sapiens
acaggcagccctctccctggtt

SEQ ID NO: 8172342 - DNA, 22 bp, Homo sapiens
acaggcagcactaatctctggt

SEQ ID NO: 8172343 - DNA, 22 bp, Homo sapiens
acaggcaggagctccccattcc

SEQ ID NO: 8172344 - DNA, 22 bp, Homo sapiens
acaggcaggagctccccattcc

SEQ ID NO: 8172345 - DNA, 22 bp, Homo sapiens
acaggcagcgtcattgctgctc

SEQ ID NO: 8172346 - DNA, 22 bp, Homo sapiens
acaggcagcgtcattgctgctc

SEQ ID NO: 8172347 - DNA, 22 bp, Homo sapiens
acaggcagcgtcattgctgctc

SEQ ID NO: 8172348 - DNA, 22 bp, Homo sapiens
acaggcagatgttttagttgta

SEQ ID NO: 8172349 - DNA, 22 bp, Homo sapiens
acaggcagattaagggtaggca

SEQ ID NO: 8172350 - DNA, 17 bp, Homo sapiens
acaggcagatcacctga

SEQ ID NO: 8172351 - DNA, 17 bp, Homo sapiens
acaggcagatcacctga

SEQ ID NO: 8172352 - DNA, 22 bp, Homo sapiens
acaggcagattaagggtaggca

SEQ ID NO: 8172353 - DNA, 22 bp, Homo sapiens
acaggcagattaagggtaggca

SEQ ID NO: 8172354 - DNA, 14 bp, Homo sapiens
acaggcagatttct

SEQ ID NO: 8172355 - DNA, 22 bp, Homo sapiens
acaggcagcaaaatcagcctca

SEQ ID NO: 8172356 - DNA, 22 bp, Homo sapiens
acaggcagcaaaatcagcctca

SEQ ID NO: 8172357 - DNA, 22 bp, Homo sapiens
acaggcagcaaaatcagcctca

SEQ ID NO: 8172358 - DNA, 22 bp, Homo sapiens
acaggcagcactaatctctggt

SEQ ID NO: 8172359 - DNA, 22 bp, Homo sapiens
acaggcagcaaaatcagcctca

SEQ ID NO: 8172360 - DNA, 22 bp, Homo sapiens
acaggcagcactaatctctggt

SEQ ID NO: 8172361 - DNA, 22 bp, Homo sapiens
acaggcagcaaaatcagcctca

SEQ ID NO: 8172362 - DNA, 22 bp, Homo sapiens
acaggcagcactaatctctggt

SEQ ID NO: 8172363 - DNA, 22 bp, Homo sapiens
acaggcagcactaatctctggt

SEQ ID NO: 8172364 - DNA, 22 bp, Homo sapiens
aggacacacaaagagtgagaac

SEQ ID NO: 8172365 - DNA, 19 bp, Homo sapiens
acaggggctagcggaagca

SEQ ID NO: 8172366 - DNA, 19 bp, Homo sapiens
acaggggcctttccagggt

SEQ ID NO: 8172367 - DNA, 22 bp, Homo sapiens
aggacacactgttctcacgtaa

SEQ ID NO: 8172368 - DNA, 22 bp, Homo sapiens
aggacacactgcaagagcctgg

SEQ ID NO: 8172369 - DNA, 22 bp, Homo sapiens
aggacacactgcaagagcctgg

SEQ ID NO: 8172370 - DNA, 22 bp, Homo sapiens
aggacacactgcaagagcctgg

SEQ ID NO: 8172371 - DNA, 22 bp, Homo sapiens
aggacacacagaatacaaatcc

SEQ ID NO: 8172372 - DNA, 22 bp, Homo sapiens
aggacacaccaggtccagctgt

SEQ ID NO: 8172373 - DNA, 22 bp, Homo sapiens
aggacacacccagctcacgggg

SEQ ID NO: 8172374 - DNA, 22 bp, Homo sapiens
aggacacacccagctcacgggg

SEQ ID NO: 8172375 - DNA, 22 bp, Homo sapiens
acaggggaatttactgtcatta

SEQ ID NO: 8172376 - DNA, 22 bp, Homo sapiens
acaggggattgattggaagtct

SEQ ID NO: 8172377 - DNA, 22 bp, Homo sapiens
acaggggcaagggctcacggcc

SEQ ID NO: 8172378 - DNA, 22 bp, Homo sapiens
acaggggacctaggaccctcgg

SEQ ID NO: 8172379 - DNA, 22 bp, Homo sapiens
acagggcttttaatcagtagtt

SEQ ID NO: 8172380 - DNA, 22 bp, Homo sapiens
acagggcttgttgaaagcggag

SEQ ID NO: 8172381 - DNA, 22 bp, Homo sapiens
acagggcttgtgacaactttaa

SEQ ID NO: 8172382 - DNA, 22 bp, Homo sapiens
acagggcttttaatcagtagtt

SEQ ID NO: 8172383 - DNA, 22 bp, Homo sapiens
acagggcttttaatcagtagtt

SEQ ID NO: 8172384 - DNA, 19 bp, Homo sapiens
acaggggcctttccagggt

SEQ ID NO: 8172385 - DNA, 19 bp, Homo sapiens
acaggggcctttccagggt

SEQ ID NO: 8172386 - DNA, 22 bp, Homo sapiens
acaggggcaggcaggacccttt

SEQ ID NO: 8172387 - DNA, 22 bp, Homo sapiens
acaggggcaggcaggacccttt

SEQ ID NO: 8172388 - DNA, 22 bp, Homo sapiens
acaggggcaagggctcacggcc

SEQ ID NO: 8172389 - DNA, 22 bp, Homo sapiens
acaggggcaagggctcacggcc

SEQ ID NO: 8172390 - DNA, 22 bp, Homo sapiens
acaggggcaagggctcacggcc

SEQ ID NO: 8172391 - DNA, 22 bp, Homo sapiens
acaggggcaagggctcacggcc

SEQ ID NO: 8172392 - DNA, 20 bp, Homo sapiens
acaggggcagcacaataatg

SEQ ID NO: 8172393 - DNA, 19 bp, Homo sapiens
acagggcttggcctgacat

SEQ ID NO: 8172394 - DNA, 19 bp, Homo sapiens
acagggcttggcctgacat

SEQ ID NO: 8172395 - DNA, 19 bp, Homo sapiens
acagggcttggcctgacat

SEQ ID NO: 8172396 - DNA, 22 bp, Homo sapiens
acagggctcccagcaggtctgt

SEQ ID NO: 8172397 - DNA, 22 bp, Homo sapiens
aggaagagcatctttgggtctg

SEQ ID NO: 8172398 - DNA, 22 bp, Homo sapiens
aggaagagcatctttgggtctg

SEQ ID NO: 8172399 - DNA, 22 bp, Homo sapiens
aggaagagcatctttgggtctg

SEQ ID NO: 8172400 - DNA, 22 bp, Homo sapiens
acagggctatattcctcagagt

SEQ ID NO: 8172401 - DNA, 22 bp, Homo sapiens
acagggctatattcctcagagt

SEQ ID NO: 8172402 - DNA, 22 bp, Homo sapiens
aggaagagcattcacatggtag

SEQ ID NO: 8172403 - DNA, 22 bp, Homo sapiens
acagggctatattcctcagagt

SEQ ID NO: 8172404 - DNA, 22 bp, Homo sapiens
aggaagagcatctttgggtctg

SEQ ID NO: 8172405 - DNA, 22 bp, Homo sapiens
aggaagacaatctgtgtgctgt

SEQ ID NO: 8172406 - DNA, 18 bp, Homo sapiens
aggaagaccatcagatat

SEQ ID NO: 8172407 - DNA, 22 bp, Homo sapiens
aggaagaatgtttacatatcaa

SEQ ID NO: 8172408 - DNA, 18 bp, Homo sapiens
acagggagggcgctgggg

SEQ ID NO: 8172409 - DNA, 22 bp, Homo sapiens
acagggagccccagcatttcca

SEQ ID NO: 8172410 - DNA, 22 bp, Homo sapiens
aggaagaacctaagaaagtctc

SEQ ID NO: 8172411 - DNA, 22 bp, Homo sapiens
aggaagaaatgtgacttcaaac

SEQ ID NO: 8172412 - DNA, 22 bp, Homo sapiens
aggaagaacagataatggacgc

SEQ ID NO: 8172413 - DNA, 23 bp, Homo sapiens
agctggaggctgtctactcccaa

SEQ ID NO: 8172414 - DNA, 22 bp, Homo sapiens
acagctgtatccccagagctca

SEQ ID NO: 8172415 - DNA, 22 bp, Homo sapiens
agctggaggggccagcaggtgt

SEQ ID NO: 8172416 - DNA, 22 bp, Homo sapiens
agctggaggggccagcaggtgt

SEQ ID NO: 8172417 - DNA, 22 bp, Homo sapiens
agctggaggggccagcaggtgt

SEQ ID NO: 8172418 - DNA, 22 bp, Homo sapiens
agctggaggggccagcaggtgt

SEQ ID NO: 8172419 - DNA, 22 bp, Homo sapiens
agctggaggggccagcaggtgt

SEQ ID NO: 8172420 - DNA, 22 bp, Homo sapiens
acagctgggtgctgctcagagc

SEQ ID NO: 8172421 - DNA, 22 bp, Homo sapiens
acagctgggtgtcccacttctg

SEQ ID NO: 8172422 - DNA, 22 bp, Homo sapiens
acagctggtgaatgttctctgt

SEQ ID NO: 8172423 - DNA, 21 bp, Homo sapiens
acagctggtgcagggcgggga

SEQ ID NO: 8172424 - DNA, 21 bp, Homo sapiens
acagctggtgcagggcgggga

SEQ ID NO: 8172425 - DNA, 22 bp, Homo sapiens
acagctgtatccccagagctca

SEQ ID NO: 8172426 - DNA, 21 bp, Homo sapiens
acagctggtgcagggcgggga

SEQ ID NO: 8172427 - DNA, 22 bp, Homo sapiens
acagctggtgaatgttctctgt

SEQ ID NO: 8172428 - DNA, 21 bp, Homo sapiens
acagctggtgcagggcgggga

SEQ ID NO: 8172429 - DNA, 22 bp, Homo sapiens
acagctgggaatcagctgggga

SEQ ID NO: 8172430 - DNA, 22 bp, Homo sapiens
acagctgggtgctgctcagagc

SEQ ID NO: 8172431 - DNA, 22 bp, Homo sapiens
acagctgggaatcagctgggga

SEQ ID NO: 8172432 - DNA, 22 bp, Homo sapiens
acagctggccgaggctcaggga

SEQ ID NO: 8172433 - DNA, 22 bp, Homo sapiens
acagctggccgaggctcaggga

SEQ ID NO: 8172434 - DNA, 21 bp, Homo sapiens
acagctggccgcgcgggtcgg

SEQ ID NO: 8172435 - DNA, 22 bp, Homo sapiens
acagctgggaactcacacagca

SEQ ID NO: 8172436 - DNA, 22 bp, Homo sapiens
acagctgctcacctgtgagccc

SEQ ID NO: 8172437 - DNA, 21 bp, Homo sapiens
acagctgcctgccatgggggt

SEQ ID NO: 8172438 - DNA, 22 bp, Homo sapiens
acagctggcaggggggcatgaa

SEQ ID NO: 8172439 - DNA, 22 bp, Homo sapiens
acagctggcaggggggcatgaa

SEQ ID NO: 8172440 - DNA, 22 bp, Homo sapiens
acagctggcaggggggcatgaa

SEQ ID NO: 8172441 - DNA, 22 bp, Homo sapiens
acagctggcaggggggcatgaa

SEQ ID NO: 8172442 - DNA, 22 bp, Homo sapiens
agctgaagtttagaattgtgaa

SEQ ID NO: 8172443 - DNA, 17 bp, Homo sapiens
agctgaccagatggact

SEQ ID NO: 8172444 - DNA, 22 bp, Homo sapiens
agctgacctggaagggggcacg

SEQ ID NO: 8172445 - DNA, 22 bp, Homo sapiens
agctgaagcactgggatggaag

SEQ ID NO: 8172446 - DNA, 22 bp, Homo sapiens
agctgaagcactgggatggaag

SEQ ID NO: 8172447 - DNA, 22 bp, Homo sapiens
agctctggttattgaagcaggg

SEQ ID NO: 8172448 - DNA, 22 bp, Homo sapiens
agctctggttattgaagcaggg

SEQ ID NO: 8172449 - DNA, 22 bp, Homo sapiens
agctgaagcaacaacaggatgg

SEQ ID NO: 8172450 - DNA, 22 bp, Homo sapiens
agctgaagcaacaacaggatgg

SEQ ID NO: 8172451 - DNA, 22 bp, Homo sapiens
agctctggttattgaagcaggg

SEQ ID NO: 8172452 - DNA, 22 bp, Homo sapiens
agctctggttattgaagcaggg

SEQ ID NO: 8172453 - DNA, 22 bp, Homo sapiens
agctctgggtcacggctgccga

SEQ ID NO: 8172454 - DNA, 22 bp, Homo sapiens
agctctggggtggagcccagga

SEQ ID NO: 8172455 - DNA, 22 bp, Homo sapiens
agctctggttattgaagcaggg

SEQ ID NO: 8172456 - DNA, 22 bp, Homo sapiens
agctctggttattgaagcaggg

SEQ ID NO: 8172457 - DNA, 22 bp, Homo sapiens
agctctggtgagatgttattca

SEQ ID NO: 8172458 - DNA, 22 bp, Homo sapiens
acaggagaattatctggaacaa

SEQ ID NO: 8172459 - DNA, 22 bp, Homo sapiens
acaggagaattatctggaacaa

SEQ ID NO: 8172460 - DNA, 22 bp, Homo sapiens
acaggagaattatctggaacaa

SEQ ID NO: 8172461 - DNA, 22 bp, Homo sapiens
acaggagggacaccttcctgct

SEQ ID NO: 8172462 - DNA, 22 bp, Homo sapiens
acaggagggacaccttcctgct

SEQ ID NO: 8172463 - DNA, 23 bp, Homo sapiens
acaggaggggacaggtggccgtg

SEQ ID NO: 8172464 - DNA, 23 bp, Homo sapiens
acaggaggggacaggtggccgtg

SEQ ID NO: 8172465 - DNA, 22 bp, Homo sapiens
acaggagggacaccttcctgct

SEQ ID NO: 8172466 - DNA, 22 bp, Homo sapiens
acaggagtgaatctggcactta

SEQ ID NO: 8172467 - DNA, 22 bp, Homo sapiens
acaggagtagggctggtggaga

SEQ ID NO: 8172468 - DNA, 22 bp, Homo sapiens
acaggagtgaatctggcactta

SEQ ID NO: 8172469 - DNA, 22 bp, Homo sapiens
acaggagtggctctaccagacc

SEQ ID NO: 8172470 - DNA, 22 bp, Homo sapiens
acaggagtggagaggtgcctct

SEQ ID NO: 8172471 - DNA, 22 bp, Homo sapiens
agctggcagagcatttgtggcc

SEQ ID NO: 8172472 - DNA, 21 bp, Homo sapiens
agctggcagatatggtgtctg

SEQ ID NO: 8172473 - DNA, 22 bp, Homo sapiens
agctggcagagcatttgtggcc

SEQ ID NO: 8172474 - DNA, 22 bp, Homo sapiens
agctggcagagcatttgtggcc

SEQ ID NO: 8172475 - DNA, 22 bp, Homo sapiens
agctggcagctctcaggggtac

SEQ ID NO: 8172476 - DNA, 21 bp, Homo sapiens
agctggcagatatggtgtctg

SEQ ID NO: 8172477 - DNA, 21 bp, Homo sapiens
agctggcagatatggtgtctg

SEQ ID NO: 8172478 - DNA, 22 bp, Homo sapiens
agctggcagctctcaggggtac

SEQ ID NO: 8172479 - DNA, 22 bp, Homo sapiens
agctggcagctctcaggggtac

SEQ ID NO: 8172480 - DNA, 22 bp, Homo sapiens
agctggcaccaaatatagtaaa

SEQ ID NO: 8172481 - DNA, 22 bp, Homo sapiens
agctggcacagaccaggagatc

SEQ ID NO: 8172482 - DNA, 22 bp, Homo sapiens
agctggcacagaccaggagatc

SEQ ID NO: 8172483 - DNA, 22 bp, Homo sapiens
agctggcaccaaatatagtaaa

SEQ ID NO: 8172484 - DNA, 19 bp, Homo sapiens
agctggcactagaatccag

SEQ ID NO: 8172485 - DNA, 22 bp, Homo sapiens
agctggcactagcgtttccaag

SEQ ID NO: 8172486 - DNA, 19 bp, Homo sapiens
agctggcactagaatccag

SEQ ID NO: 8172487 - DNA, 22 bp, Homo sapiens
agctggcagaaagctttgcccg

SEQ ID NO: 8172488 - DNA, 22 bp, Homo sapiens
agctggcaatgtaagtccctgg

SEQ ID NO: 8172489 - DNA, 21 bp, Homo sapiens
agctggcaatgttgtcctctt

SEQ ID NO: 8172490 - DNA, 21 bp, Homo sapiens
agctggcaatgttgtcctctt

SEQ ID NO: 8172491 - DNA, 22 bp, Homo sapiens
agctggcaatgtaagtccctgg

SEQ ID NO: 8172492 - DNA, 22 bp, Homo sapiens
agctggcaaggctttagattca

SEQ ID NO: 8172493 - DNA, 22 bp, Homo sapiens
agctggcaagttgaaggtggct

SEQ ID NO: 8172494 - DNA, 22 bp, Homo sapiens
agctggcaatctttctaaatac

SEQ ID NO: 8172495 - DNA, 22 bp, Homo sapiens
agctggcaagttgaaggtggct

SEQ ID NO: 8172496 - DNA, 22 bp, Homo sapiens
agctggcaaaactaatgggaag

SEQ ID NO: 8172497 - DNA, 22 bp, Homo sapiens
agctggcaaaactaatgggaag

SEQ ID NO: 8172498 - DNA, 22 bp, Homo sapiens
agctggcaaaactaatgggaag

SEQ ID NO: 8172499 - DNA, 22 bp, Homo sapiens
agctggcaaacagcttacggcc

SEQ ID NO: 8172500 - DNA, 22 bp, Homo sapiens
agctggcaaggcaatttggatt

SEQ ID NO: 8172501 - DNA, 22 bp, Homo sapiens
agctggcaagttgaaggtggct

SEQ ID NO: 8172502 - DNA, 22 bp, Homo sapiens
agctggcaagttgaaggtggct

SEQ ID NO: 8172503 - DNA, 22 bp, Homo sapiens
agctggcaaggcaatttggatt

SEQ ID NO: 8172504 - DNA, 22 bp, Homo sapiens
agctggcaaggcaatttggatt

SEQ ID NO: 8172505 - DNA, 22 bp, Homo sapiens
agctggcaaggcaatttggatt

SEQ ID NO: 8172506 - DNA, 22 bp, Homo sapiens
acaggatcgccctgttgcccag

SEQ ID NO: 8172507 - DNA, 22 bp, Homo sapiens
acaggatcgccctgttgcccag

SEQ ID NO: 8172508 - DNA, 22 bp, Homo sapiens
agctggtggagcctttctgttt

SEQ ID NO: 8172509 - DNA, 22 bp, Homo sapiens
agctggtggagaagcagacctc

SEQ ID NO: 8172510 - DNA, 22 bp, Homo sapiens
acaggagtttctgacagagaca

SEQ ID NO: 8172511 - DNA, 22 bp, Homo sapiens
acaggagtttaagaaatatttc

SEQ ID NO: 8172512 - DNA, 22 bp, Homo sapiens
acaggagttcagaggacacccc

SEQ ID NO: 8172513 - DNA, 22 bp, Homo sapiens
acaggagttaaggctgagttga

SEQ ID NO: 8172514 - DNA, 22 bp, Homo sapiens
acaggagttaaccatgggaagt

SEQ ID NO: 8172515 - DNA, 22 bp, Homo sapiens
acaggagttaaggctgagttga

SEQ ID NO: 8172516 - DNA, 22 bp, Homo sapiens
agctggtggattatgctgtaca

SEQ ID NO: 8172517 - DNA, 22 bp, Homo sapiens
agctggtggattatgctgtaca

SEQ ID NO: 8172518 - DNA, 22 bp, Homo sapiens
agctggtggattatgctgtaca

SEQ ID NO: 8172519 - DNA, 22 bp, Homo sapiens
agctggtggggaagctgcaggt

SEQ ID NO: 8172520 - DNA, 22 bp, Homo sapiens
agctggtggggaagctgcaggt

SEQ ID NO: 8172521 - DNA, 22 bp, Homo sapiens
agctggtggattatgctgtaca

SEQ ID NO: 8172522 - DNA, 22 bp, Homo sapiens
agctggtggggaagctgcaggt

SEQ ID NO: 8172523 - DNA, 18 bp, Homo sapiens
agctggtggggagacagc

SEQ ID NO: 8172524 - DNA, 18 bp, Homo sapiens
agctggtggggagacagc

SEQ ID NO: 8172525 - DNA, 18 bp, Homo sapiens
agctggtggggagacagc

SEQ ID NO: 8172526 - DNA, 22 bp, Homo sapiens
acaggcagagtcaggttgggtt

SEQ ID NO: 8172527 - DNA, 22 bp, Homo sapiens
acaggcacctgccaccacatct

SEQ ID NO: 8172528 - DNA, 22 bp, Homo sapiens
agctggtgtgctctggaatcct

SEQ ID NO: 8172529 - DNA, 22 bp, Homo sapiens
agctggtgtgctctggaatcct

SEQ ID NO: 8172530 - DNA, 22 bp, Homo sapiens
agctggtgtgccagttccagtt

SEQ ID NO: 8172531 - DNA, 22 bp, Homo sapiens
agctggtgtgccagttccagtt

SEQ ID NO: 8172532 - DNA, 21 bp, Homo sapiens
agctggtgtcagagctctggg

SEQ ID NO: 8172533 - DNA, 21 bp, Homo sapiens
agctggtgtcagagctctggg

SEQ ID NO: 8172534 - DNA, 21 bp, Homo sapiens
agctggtgtcagagctctggg

SEQ ID NO: 8172535 - DNA, 22 bp, Homo sapiens
agctggtgtcacctccagtcca

SEQ ID NO: 8172536 - DNA, 22 bp, Homo sapiens
agctggtgtgccactgttgggg

SEQ ID NO: 8172537 - DNA, 22 bp, Homo sapiens
agctggtgtcctcctggagctg

SEQ ID NO: 8172538 - DNA, 22 bp, Homo sapiens
acatgtgttttcctacttatga

SEQ ID NO: 8172539 - DNA, 22 bp, Homo sapiens
acatgtgttttcctacttatga

SEQ ID NO: 8172540 - DNA, 22 bp, Homo sapiens
acatgtgttttcctacttatga

SEQ ID NO: 8172541 - DNA, 22 bp, Homo sapiens
acatgtgtaaggtctctcagtc

SEQ ID NO: 8172542 - DNA, 22 bp, Homo sapiens
acatgtgtaagatgtgatatat

SEQ ID NO: 8172543 - DNA, 22 bp, Homo sapiens
acatgtgtaagatgtgatatat

SEQ ID NO: 8172544 - DNA, 22 bp, Homo sapiens
acatgtgtaagatgtgatatat

SEQ ID NO: 8172545 - DNA, 22 bp, Homo sapiens
aggccagggtagggcccattgt

SEQ ID NO: 8172546 - DNA, 22 bp, Homo sapiens
aggccagggtcccacactcgca

SEQ ID NO: 8172547 - DNA, 22 bp, Homo sapiens
aggccagggtagggcccattgt

SEQ ID NO: 8172548 - DNA, 22 bp, Homo sapiens
aggccagggtcccacactcgca

SEQ ID NO: 8172549 - DNA, 22 bp, Homo sapiens
aggccagggtcccacactcgca

SEQ ID NO: 8172550 - DNA, 22 bp, Homo sapiens
aggccagggtcccacactcgca

SEQ ID NO: 8172551 - DNA, 22 bp, Homo sapiens
aggccagggtcccacactcgca

SEQ ID NO: 8172552 - DNA, 22 bp, Homo sapiens
aggccagggtcccacactcgca

SEQ ID NO: 8172553 - DNA, 22 bp, Homo sapiens
acatgttcatgcatgcacaggt

SEQ ID NO: 8172554 - DNA, 22 bp, Homo sapiens
acatgttagggacagagtatgt

SEQ ID NO: 8172555 - DNA, 22 bp, Homo sapiens
acatgttgctaaatccaatggt

SEQ ID NO: 8172556 - DNA, 22 bp, Homo sapiens
acatgttagaaatgcagaatct

SEQ ID NO: 8172557 - DNA, 22 bp, Homo sapiens
acatgttagctactattgttat

SEQ ID NO: 8172558 - DNA, 22 bp, Homo sapiens
acatgttagctactattgttat

SEQ ID NO: 8172559 - DNA, 22 bp, Homo sapiens
aggccaggcctttctccattcc

SEQ ID NO: 8172560 - DNA, 22 bp, Homo sapiens
aggccaggcctttctccattcc

SEQ ID NO: 8172561 - DNA, 22 bp, Homo sapiens
aggccagggcactgctctttag

SEQ ID NO: 8172562 - DNA, 22 bp, Homo sapiens
aggccagggcactgctctttag

SEQ ID NO: 8172563 - DNA, 22 bp, Homo sapiens
aggccaggcgagacacccggct

SEQ ID NO: 8172564 - DNA, 22 bp, Homo sapiens
aggccagggtagggcccattgt

SEQ ID NO: 8172565 - DNA, 22 bp, Homo sapiens
aggccaggggtgagcacttctg

SEQ ID NO: 8172566 - DNA, 22 bp, Homo sapiens
aggccaggggtgagcacttctg

SEQ ID NO: 8172567 - DNA, 22 bp, Homo sapiens
aggccaggggtgagcacttctg

SEQ ID NO: 8172568 - DNA, 22 bp, Homo sapiens
aggccagggccagattagccac

SEQ ID NO: 8172569 - DNA, 22 bp, Homo sapiens
aggccagggccagattagccac

SEQ ID NO: 8172570 - DNA, 22 bp, Homo sapiens
aggcctctgggtctcctctgac

SEQ ID NO: 8172571 - DNA, 22 bp, Homo sapiens
aggcctctgggtctcctctgac

SEQ ID NO: 8172572 - DNA, 22 bp, Homo sapiens
acatgtttggctctatgctata

SEQ ID NO: 8172573 - DNA, 22 bp, Homo sapiens
acatgtttgataaatatttggg

SEQ ID NO: 8172574 - DNA, 22 bp, Homo sapiens
acatgtttgataaatatttggg

SEQ ID NO: 8172575 - DNA, 22 bp, Homo sapiens
acatgtttaagtttgttatatg

SEQ ID NO: 8172576 - DNA, 22 bp, Homo sapiens
aggcctctgtagggccctgaag

SEQ ID NO: 8172577 - DNA, 22 bp, Homo sapiens
aggcctctgtagggccctgaag

SEQ ID NO: 8172578 - DNA, 22 bp, Homo sapiens
aggcctctgtctttatatgact

SEQ ID NO: 8172579 - DNA, 18 bp, Homo sapiens
aggcctctgtgtgcccag

SEQ ID NO: 8172580 - DNA, 18 bp, Homo sapiens
aggcctctgtgtgcccag

SEQ ID NO: 8172581 - DNA, 22 bp, Homo sapiens
aggcctctgttccccatgtttt

SEQ ID NO: 8172582 - DNA, 22 bp, Homo sapiens
aggcctctgttccccatgtttt

SEQ ID NO: 8172583 - DNA, 22 bp, Homo sapiens
aggcctctgttccccatgtttt

SEQ ID NO: 8172584 - DNA, 21 bp, Homo sapiens
aggcctcttcatggccatgat

SEQ ID NO: 8172585 - DNA, 20 bp, Homo sapiens
aggcctcttcatgacagctg

SEQ ID NO: 8172586 - DNA, 20 bp, Homo sapiens
aggcctcttcatgacagctg

SEQ ID NO: 8172587 - DNA, 20 bp, Homo sapiens
aggcctcttcatgacagctg

SEQ ID NO: 8172588 - DNA, 22 bp, Homo sapiens
aggcctcttcagggagcatgga

SEQ ID NO: 8172589 - DNA, 22 bp, Homo sapiens
aggcctcttcagggagcatgga

SEQ ID NO: 8172590 - DNA, 20 bp, Homo sapiens
aggcctgagagatgactggg

SEQ ID NO: 8172591 - DNA, 22 bp, Homo sapiens
aggcctgaggaccttctggagg

SEQ ID NO: 8172592 - DNA, 22 bp, Homo sapiens
aggcctgaggaccttctggagg

SEQ ID NO: 8172593 - DNA, 22 bp, Homo sapiens
aggcctgaaggaagatgagctg

SEQ ID NO: 8172594 - DNA, 22 bp, Homo sapiens
aggcctcttgtcttcctcacat

SEQ ID NO: 8172595 - DNA, 22 bp, Homo sapiens
acatcatcgtgcacatacataa

SEQ ID NO: 8172596 - DNA, 22 bp, Homo sapiens
acatcattcagggcctcgttgg

SEQ ID NO: 8172597 - DNA, 22 bp, Homo sapiens
acatcattgtccgttgtcatga

SEQ ID NO: 8172598 - DNA, 22 bp, Homo sapiens
acatcatttctagttcctgtca

SEQ ID NO: 8172599 - DNA, 22 bp, Homo sapiens
acatcattgtttataaagggag

SEQ ID NO: 8172600 - DNA, 22 bp, Homo sapiens
acatccagatctcagcatggct

SEQ ID NO: 8172601 - DNA, 22 bp, Homo sapiens
acatccagatctcagcatggct

SEQ ID NO: 8172602 - DNA, 22 bp, Homo sapiens
acatccagaggcgtggaaggct

SEQ ID NO: 8172603 - DNA, 22 bp, Homo sapiens
acatcattttcttcagtgtttg

SEQ ID NO: 8172604 - DNA, 22 bp, Homo sapiens
acatcatttgtctgtagctgaa

SEQ ID NO: 8172605 - DNA, 22 bp, Homo sapiens
acatattttgaaagctttctaa

SEQ ID NO: 8172606 - DNA, 22 bp, Homo sapiens
acatattttgaaagctttctaa

SEQ ID NO: 8172607 - DNA, 22 bp, Homo sapiens
acatcacacgccttccaggagg

SEQ ID NO: 8172608 - DNA, 20 bp, Homo sapiens
acatcaactagtcacagaca

SEQ ID NO: 8172609 - DNA, 22 bp, Homo sapiens
acatcacagagcccagataaag

SEQ ID NO: 8172610 - DNA, 22 bp, Homo sapiens
acatcacagagcccagataaag

SEQ ID NO: 8172611 - DNA, 22 bp, Homo sapiens
acatcacagagcccagataaag

SEQ ID NO: 8172612 - DNA, 21 bp, Homo sapiens
acatcagagttgtgaaggtag

SEQ ID NO: 8172613 - DNA, 23 bp, Homo sapiens
acatcagagttagttcaatcagg

SEQ ID NO: 8172614 - DNA, 22 bp, Homo sapiens
acatcagagggctcacatgatc

SEQ ID NO: 8172615 - DNA, 22 bp, Homo sapiens
acatcagattatgctttgctta

SEQ ID NO: 8172616 - DNA, 22 bp, Homo sapiens
acatcacagtagttaagccaga

SEQ ID NO: 8172617 - DNA, 22 bp, Homo sapiens
acatcagagggctcacatgatc

SEQ ID NO: 8172618 - DNA, 22 bp, Homo sapiens
acatgcctccattgagctgtgg

SEQ ID NO: 8172619 - DNA, 22 bp, Homo sapiens
acatgcctccattgagctgtgg

SEQ ID NO: 8172620 - DNA, 22 bp, Homo sapiens
acatgccatcactttcattcct

SEQ ID NO: 8172621 - DNA, 22 bp, Homo sapiens
acatgctatgagagattacttc

SEQ ID NO: 8172622 - DNA, 22 bp, Homo sapiens
acatgctaattgcaaagtcttg

SEQ ID NO: 8172623 - DNA, 22 bp, Homo sapiens
acatgctacacagagctcctcg

SEQ ID NO: 8172624 - DNA, 22 bp, Homo sapiens
acatgccaatttggttagttca

SEQ ID NO: 8172625 - DNA, 22 bp, Homo sapiens
acatgccagcccatttaaatgg

SEQ ID NO: 8172626 - DNA, 22 bp, Homo sapiens
acatccatcttctgcctgtgaa

SEQ ID NO: 8172627 - DNA, 22 bp, Homo sapiens
acatccatcttatgagataggt

SEQ ID NO: 8172628 - DNA, 22 bp, Homo sapiens
acatgcatacaagcacatgtag

SEQ ID NO: 8172629 - DNA, 22 bp, Homo sapiens
acatgcttgtttttcacaacct

SEQ ID NO: 8172630 - DNA, 20 bp, Homo sapiens
acatgcttgagaggatgcag

SEQ ID NO: 8172631 - DNA, 22 bp, Homo sapiens
acatgctggatgaattacctac

SEQ ID NO: 8172632 - DNA, 22 bp, Homo sapiens
acatgctctcctaaggccctgt

SEQ ID NO: 8172633 - DNA, 22 bp, Homo sapiens
acatgctggatgaattacctac

SEQ ID NO: 8172634 - DNA, 22 bp, Homo sapiens
acatgctttatcggattgacac

SEQ ID NO: 8172635 - DNA, 22 bp, Homo sapiens
acatgctttctaggtccttctg

SEQ ID NO: 8172636 - DNA, 22 bp, Homo sapiens
acatgcttttcccacaattata

SEQ ID NO: 8172637 - DNA, 22 bp, Homo sapiens
aggccaggcctttctccattcc

SEQ ID NO: 8172638 - DNA, 22 bp, Homo sapiens
acatgcttttcccacaattata

SEQ ID NO: 8172639 - DNA, 22 bp, Homo sapiens
acatttctagttgttcatctcc

SEQ ID NO: 8172640 - DNA, 22 bp, Homo sapiens
acatttctagttgttcatctcc

SEQ ID NO: 8172641 - DNA, 22 bp, Homo sapiens
acatttctatcatcctgtaatg

SEQ ID NO: 8172642 - DNA, 22 bp, Homo sapiens
acatttctatcatcctgtaatg

SEQ ID NO: 8172643 - DNA, 22 bp, Homo sapiens
acatttctatagtgcatctgtt

SEQ ID NO: 8172644 - DNA, 22 bp, Homo sapiens
acatttctatagtgcatctgtt

SEQ ID NO: 8172645 - DNA, 22 bp, Homo sapiens
acatttctatagtgcatctgtt

SEQ ID NO: 8172646 - DNA, 22 bp, Homo sapiens
acatttctatagtgcatctgtt

SEQ ID NO: 8172647 - DNA, 22 bp, Homo sapiens
acatttctaatttaatgtaaca

SEQ ID NO: 8172648 - DNA, 22 bp, Homo sapiens
acatttctaatttaatgtaaca

SEQ ID NO: 8172649 - DNA, 17 bp, Homo sapiens
acatttcctaactgaag

SEQ ID NO: 8172650 - DNA, 17 bp, Homo sapiens
acatttcctaactgaag

SEQ ID NO: 8172651 - DNA, 17 bp, Homo sapiens
acatttcctaactgaag

SEQ ID NO: 8172652 - DNA, 18 bp, Homo sapiens
acatttctaggtgaaagc

SEQ ID NO: 8172653 - DNA, 22 bp, Homo sapiens
acatttctaatttaatgtaaca

SEQ ID NO: 8172654 - DNA, 22 bp, Homo sapiens
acatttctaatttaatgtaaca

SEQ ID NO: 8172655 - DNA, 22 bp, Homo sapiens
acattgtaagcatattagctga

SEQ ID NO: 8172656 - DNA, 22 bp, Homo sapiens
acattgtaagcatattagctga

SEQ ID NO: 8172657 - DNA, 22 bp, Homo sapiens
acattgtaagcatattagctga

SEQ ID NO: 8172658 - DNA, 22 bp, Homo sapiens
acattgtaaatacctttatcac

SEQ ID NO: 8172659 - DNA, 22 bp, Homo sapiens
acattggtcactgaagaatgag

SEQ ID NO: 8172660 - DNA, 22 bp, Homo sapiens
acattgctgcattctccttccc

SEQ ID NO: 8172661 - DNA, 19 bp, Homo sapiens
acattggacatggatcttg

SEQ ID NO: 8172662 - DNA, 22 bp, Homo sapiens
acattgtagttgttctgcagca

SEQ ID NO: 8172663 - DNA, 22 bp, Homo sapiens
acattgtagttgttctgcagca

SEQ ID NO: 8172664 - DNA, 22 bp, Homo sapiens
acattgtagacttttcatatgt

SEQ ID NO: 8172665 - DNA, 22 bp, Homo sapiens
acatttcagaatcacacagctt

SEQ ID NO: 8172666 - DNA, 22 bp, Homo sapiens
acatttcctaacgtatacactg

SEQ ID NO: 8172667 - DNA, 22 bp, Homo sapiens
acatttcatttgcagtatggat

SEQ ID NO: 8172668 - DNA, 22 bp, Homo sapiens
acattgtataatgattatcaca

SEQ ID NO: 8172669 - DNA, 22 bp, Homo sapiens
acattgtataatgattatcaca

SEQ ID NO: 8172670 - DNA, 22 bp, Homo sapiens
acattgtatacagacttagtca

SEQ ID NO: 8172671 - DNA, 22 bp, Homo sapiens
acattgtatacagacttagtca

SEQ ID NO: 8172672 - DNA, 22 bp, Homo sapiens
acattgcaattaggtacctatg

SEQ ID NO: 8172673 - DNA, 22 bp, Homo sapiens
acattgcagatgtgtttaatgt

SEQ ID NO: 8172674 - DNA, 22 bp, Homo sapiens
acattgcagatgtgtttaatgt

SEQ ID NO: 8172675 - DNA, 22 bp, Homo sapiens
acattgctgcattctccttccc

SEQ ID NO: 8172676 - DNA, 22 bp, Homo sapiens
aggctgagaaagtgggaagatg

SEQ ID NO: 8172677 - DNA, 22 bp, Homo sapiens
aggctgagaaagtgggaagatg

SEQ ID NO: 8172678 - DNA, 22 bp, Homo sapiens
aggctgagaaagtgggaagatg

SEQ ID NO: 8172679 - DNA, 22 bp, Homo sapiens
aggctgagaaagtgggaagatg

SEQ ID NO: 8172680 - DNA, 22 bp, Homo sapiens
aggctgagactgtgcattagtg

SEQ ID NO: 8172681 - DNA, 22 bp, Homo sapiens
aggctgagaaagtgggaagatg

SEQ ID NO: 8172682 - DNA, 22 bp, Homo sapiens
aggctgagaaagtgggaagatg

SEQ ID NO: 8172683 - DNA, 22 bp, Homo sapiens
aggctgagactgtgcattagtg

SEQ ID NO: 8172684 - DNA, 22 bp, Homo sapiens
aggctgagactgtgcattagtg

SEQ ID NO: 8172685 - DNA, 22 bp, Homo sapiens
aggctgaaaacgagatggcaat

SEQ ID NO: 8172686 - DNA, 22 bp, Homo sapiens
aggctgaaaacgagatggcaat

SEQ ID NO: 8172687 - DNA, 22 bp, Homo sapiens
aggctgacaagttcgtctaaag

SEQ ID NO: 8172688 - DNA, 22 bp, Homo sapiens
aggctctttgagactacctgga

SEQ ID NO: 8172689 - DNA, 22 bp, Homo sapiens
aggctctttgagactacctgga

SEQ ID NO: 8172690 - DNA, 22 bp, Homo sapiens
aggctctttccactctggtgca

SEQ ID NO: 8172691 - DNA, 22 bp, Homo sapiens
aggctctttccactctggtgca

SEQ ID NO: 8172692 - DNA, 22 bp, Homo sapiens
aggctctgtttgctgtggtacc

SEQ ID NO: 8172693 - DNA, 22 bp, Homo sapiens
aggctctgttattctagagggc

SEQ ID NO: 8172694 - DNA, 22 bp, Homo sapiens
aggctctgttattctagagggc

SEQ ID NO: 8172695 - DNA, 22 bp, Homo sapiens
aggctctgtttgctgtggtacc

SEQ ID NO: 8172696 - DNA, 22 bp, Homo sapiens
aggcctgcagcaggagcaaacc

SEQ ID NO: 8172697 - DNA, 22 bp, Homo sapiens
aggcctgaggttcctgtgctca

SEQ ID NO: 8172698 - DNA, 22 bp, Homo sapiens
aggcctgaggttcctgtgctca

SEQ ID NO: 8172699 - DNA, 22 bp, Homo sapiens
aggctctggctactacagagct

SEQ ID NO: 8172700 - DNA, 22 bp, Homo sapiens
aggctctggctactacagagct

SEQ ID NO: 8172701 - DNA, 22 bp, Homo sapiens
aggctctgttattctagagggc

SEQ ID NO: 8172702 - DNA, 22 bp, Homo sapiens
aggctctggctactacagagct

SEQ ID NO: 8172703 - DNA, 22 bp, Homo sapiens
aggctctggctactacagagct

SEQ ID NO: 8172704 - DNA, 22 bp, Homo sapiens
aggcctgcccgtgggacctgtg

SEQ ID NO: 8172705 - DNA, 22 bp, Homo sapiens
aggctgaggagggatgttgctt

SEQ ID NO: 8172706 - DNA, 22 bp, Homo sapiens
aggctgaggagggatgttgctt

SEQ ID NO: 8172707 - DNA, 22 bp, Homo sapiens
aggctgaggagggatgttgctt

SEQ ID NO: 8172708 - DNA, 22 bp, Homo sapiens
aggctgagctggtagtgagtac

SEQ ID NO: 8172709 - DNA, 22 bp, Homo sapiens
aggctgagctggtagtgagtac

SEQ ID NO: 8172710 - DNA, 22 bp, Homo sapiens
aggctgagctggtagtgagtac

SEQ ID NO: 8172711 - DNA, 22 bp, Homo sapiens
aggctgagctggtagtgagtac

SEQ ID NO: 8172712 - DNA, 22 bp, Homo sapiens
aggctgagctggtagtgagtac

SEQ ID NO: 8172713 - DNA, 22 bp, Homo sapiens
aggctgagctggtagtgagtac

SEQ ID NO: 8172714 - DNA, 22 bp, Homo sapiens
aggctgagctggtagtgagtac

SEQ ID NO: 8172715 - DNA, 22 bp, Homo sapiens
aggctgagctggtagtgagtac

SEQ ID NO: 8172716 - DNA, 22 bp, Homo sapiens
aggctgagctggcccttgaaat

SEQ ID NO: 8172717 - DNA, 22 bp, Homo sapiens
aggctgagctgacctggtttgg

SEQ ID NO: 8172718 - DNA, 22 bp, Homo sapiens
aggctgagctggcccttgaaat

SEQ ID NO: 8172719 - DNA, 22 bp, Homo sapiens
aggctgagctggcccttgaaat

SEQ ID NO: 8172720 - DNA, 22 bp, Homo sapiens
aggctgagctggcccttgaaat

SEQ ID NO: 8172721 - DNA, 18 bp, Homo sapiens
acatttctatgcttctgg

SEQ ID NO: 8172722 - DNA, 18 bp, Homo sapiens
acatttctatgcttctgg

SEQ ID NO: 8172723 - DNA, 18 bp, Homo sapiens
acatttctatgcttctgg

SEQ ID NO: 8172724 - DNA, 22 bp, Homo sapiens
acatttctcagggagttttgct

SEQ ID NO: 8172725 - DNA, 22 bp, Homo sapiens
acatttctttctattcagtagc

SEQ ID NO: 8172726 - DNA, 22 bp, Homo sapiens
acatttctttctattcagtagc

SEQ ID NO: 8172727 - DNA, 22 bp, Homo sapiens
acatttctttctattcagtagc

SEQ ID NO: 8172728 - DNA, 22 bp, Homo sapiens
acatttctttgctagacagcag

SEQ ID NO: 8172729 - DNA, 22 bp, Homo sapiens
acatttctttgctagacagcag

SEQ ID NO: 8172730 - DNA, 22 bp, Homo sapiens
acatttctttgctagacagcag

SEQ ID NO: 8172731 - DNA, 22 bp, Homo sapiens
acatttctttgctagacagcag

SEQ ID NO: 8172732 - DNA, 22 bp, Homo sapiens
acatttcttgatgcctctgtga

SEQ ID NO: 8172733 - DNA, 22 bp, Homo sapiens
acatttctcttgatgtctctat

SEQ ID NO: 8172734 - DNA, 22 bp, Homo sapiens
aggctgaggagggatgttgctt

SEQ ID NO: 8172735 - DNA, 22 bp, Homo sapiens
aggctgaggagggatgttgctt

SEQ ID NO: 8172736 - DNA, 22 bp, Homo sapiens
acatttctcttgatgtctctat

SEQ ID NO: 8172737 - DNA, 22 bp, Homo sapiens
acatttctcttagagttggact

SEQ ID NO: 8172738 - DNA, 22 bp, Homo sapiens
acatttggtaacacttgagcat

SEQ ID NO: 8172739 - DNA, 22 bp, Homo sapiens
acatttgggaccctctcttcac

SEQ ID NO: 8172740 - DNA, 22 bp, Homo sapiens
acatttggcaagaaagagaaac

SEQ ID NO: 8172741 - DNA, 22 bp, Homo sapiens
acatttgattgatgaatcaaat

SEQ ID NO: 8172742 - DNA, 22 bp, Homo sapiens
acatttgagtcatatttgctta

SEQ ID NO: 8172743 - DNA, 22 bp, Homo sapiens
acatttgatatggagttgtgta

SEQ ID NO: 8172744 - DNA, 22 bp, Homo sapiens
acatttgatggagttagtaggt

SEQ ID NO: 8172745 - DNA, 22 bp, Homo sapiens
acatttgatatggagttgtgta

SEQ ID NO: 8172746 - DNA, 22 bp, Homo sapiens
acatttgagtcatatttgctta

SEQ ID NO: 8172747 - DNA, 22 bp, Homo sapiens
acatttgacccatggagggtag

SEQ ID NO: 8172748 - DNA, 22 bp, Homo sapiens
acatttgactctgttcatatta

SEQ ID NO: 8172749 - DNA, 22 bp, Homo sapiens
acatttgactacatttatatat

SEQ ID NO: 8172750 - DNA, 22 bp, Homo sapiens
acatttgagcatatttcttgtc

SEQ ID NO: 8172751 - DNA, 22 bp, Homo sapiens
acatttgagatgccttttaggt

SEQ ID NO: 8172752 - DNA, 22 bp, Homo sapiens
acatttgagcatctactaagtg

SEQ ID NO: 8172753 - DNA, 22 bp, Homo sapiens
acatttgaaatgccatgtgagg

SEQ ID NO: 8172754 - DNA, 22 bp, Homo sapiens
acatttgaaaaagttgatggag

SEQ ID NO: 8172755 - DNA, 22 bp, Homo sapiens
acatttcttttcatctctatat

SEQ ID NO: 8172756 - DNA, 22 bp, Homo sapiens
acatttcttttcatctctatat

SEQ ID NO: 8172757 - DNA, 22 bp, Homo sapiens
acatttcttttcatctctatat

SEQ ID NO: 8172758 - DNA, 22 bp, Homo sapiens
acatttcttttcatctctatat

SEQ ID NO: 8172759 - DNA, 22 bp, Homo sapiens
acatttgacatttagtatcagc

SEQ ID NO: 8172760 - DNA, 22 bp, Homo sapiens
accagccaccaccaggagatcg

SEQ ID NO: 8172761 - DNA, 22 bp, Homo sapiens
accagccagccacagtggctcc

SEQ ID NO: 8172762 - DNA, 22 bp, Homo sapiens
accagcaggccaggggcactgc

SEQ ID NO: 8172763 - DNA, 22 bp, Homo sapiens
accagcaggtggcagtatgtat

SEQ ID NO: 8172764 - DNA, 22 bp, Homo sapiens
accagcagttatgaggccagga

SEQ ID NO: 8172765 - DNA, 22 bp, Homo sapiens
acatttgtatatatgcagcata

SEQ ID NO: 8172766 - DNA, 22 bp, Homo sapiens
accagagctggctctgagcacc

SEQ ID NO: 8172767 - DNA, 22 bp, Homo sapiens
accagagctggcagagtatcaa

SEQ ID NO: 8172768 - DNA, 22 bp, Homo sapiens
accagagctcttcagcacagga

SEQ ID NO: 8172769 - DNA, 22 bp, Homo sapiens
acatttgtctggctagaaagtt

SEQ ID NO: 8172770 - DNA, 22 bp, Homo sapiens
accagcagagttgaggaggaca

SEQ ID NO: 8172771 - DNA, 22 bp, Homo sapiens
aggcttggttaattctgtgtga

SEQ ID NO: 8172772 - DNA, 20 bp, Homo sapiens
aggcttgtgaagtatggcac

SEQ ID NO: 8172773 - DNA, 22 bp, Homo sapiens
aggcttggtgccaaggagcctg

SEQ ID NO: 8172774 - DNA, 21 bp, Homo sapiens
aggcttgggtaaaaaggtcat

SEQ ID NO: 8172775 - DNA, 18 bp, Homo sapiens
aggcttgggcccagcagc

SEQ ID NO: 8172776 - DNA, 20 bp, Homo sapiens
aggcttggcttggcaggaac

SEQ ID NO: 8172777 - DNA, 20 bp, Homo sapiens
aggcttggcttggcaggaac

SEQ ID NO: 8172778 - DNA, 20 bp, Homo sapiens
aggcttggcttggcaggaac

SEQ ID NO: 8172779 - DNA, 20 bp, Homo sapiens
aggcttggcttggcaggaac

SEQ ID NO: 8172780 - DNA, 22 bp, Homo sapiens
aggcttgtggattggagcgagt

SEQ ID NO: 8172781 - DNA, 22 bp, Homo sapiens
aggctttaagtggcctacagct

SEQ ID NO: 8172782 - DNA, 22 bp, Homo sapiens
aggctttaagtggcctacagct

SEQ ID NO: 8172783 - DNA, 22 bp, Homo sapiens
aggctttaattatctacaggag

SEQ ID NO: 8172784 - DNA, 22 bp, Homo sapiens
agggacagtctactgttcactg

SEQ ID NO: 8172785 - DNA, 22 bp, Homo sapiens
agggacagtatccatctcacag

SEQ ID NO: 8172786 - DNA, 22 bp, Homo sapiens
agggacagtatccatctcacag

SEQ ID NO: 8172787 - DNA, 22 bp, Homo sapiens
aggctttaattatctacaggag

SEQ ID NO: 8172788 - DNA, 22 bp, Homo sapiens
agggagagaagttatacaagat

SEQ ID NO: 8172789 - DNA, 22 bp, Homo sapiens
agggagacacatgaggaagtca

SEQ ID NO: 8172790 - DNA, 22 bp, Homo sapiens
agggagacaaaagcagctgcca

SEQ ID NO: 8172791 - DNA, 19 bp, Homo sapiens
agggagaattccaagagga

SEQ ID NO: 8172792 - DNA, 22 bp, Homo sapiens
agggagacaaaagcagctgcca

SEQ ID NO: 8172793 - DNA, 22 bp, Homo sapiens
agggcacttcagtcagactgag

SEQ ID NO: 8172794 - DNA, 22 bp, Homo sapiens
agggcacttgaggctgggcctg

SEQ ID NO: 8172795 - DNA, 22 bp, Homo sapiens
accagctcttctgctctagttg

SEQ ID NO: 8172796 - DNA, 22 bp, Homo sapiens
agggcactttacccatagcttg

SEQ ID NO: 8172797 - DNA, 22 bp, Homo sapiens
agggcactttacccatagcttg

SEQ ID NO: 8172798 - DNA, 22 bp, Homo sapiens
agggcagcaaagtttgacctca

SEQ ID NO: 8172799 - DNA, 22 bp, Homo sapiens
agggcagcaatgcagctgctgc

SEQ ID NO: 8172800 - DNA, 22 bp, Homo sapiens
agggcagcaatgcagctgctgc

SEQ ID NO: 8172801 - DNA, 22 bp, Homo sapiens
agggcagcacaaggcatggact

SEQ ID NO: 8172802 - DNA, 22 bp, Homo sapiens
agggcagcacaaggcatggact

SEQ ID NO: 8172803 - DNA, 22 bp, Homo sapiens
agggcagcacaaggcatggact

SEQ ID NO: 8172804 - DNA, 22 bp, Homo sapiens
agggcagcagcggcccaggcct

SEQ ID NO: 8172805 - DNA, 19 bp, Homo sapiens
accaggcctcagaggccct

SEQ ID NO: 8172806 - DNA, 22 bp, Homo sapiens
agggcagcagcccatggctctg

SEQ ID NO: 8172807 - DNA, 22 bp, Homo sapiens
agggcagcagcccatggctctg

SEQ ID NO: 8172808 - DNA, 22 bp, Homo sapiens
agggcagcagcccatggctctg

SEQ ID NO: 8172809 - DNA, 22 bp, Homo sapiens
accagctcagaagccagaaaga

SEQ ID NO: 8172810 - DNA, 22 bp, Homo sapiens
accagcctgtctgagtcgtggg

SEQ ID NO: 8172811 - DNA, 17 bp, Homo sapiens
accagcctctcctgggg

SEQ ID NO: 8172812 - DNA, 22 bp, Homo sapiens
agggagagaagttatacaagat

SEQ ID NO: 8172813 - DNA, 22 bp, Homo sapiens
agggagagacatttccttcttg

SEQ ID NO: 8172814 - DNA, 22 bp, Homo sapiens
agggagagacatttccttcttg

SEQ ID NO: 8172815 - DNA, 18 bp, Homo sapiens
agggagagaccgcgggtc

SEQ ID NO: 8172816 - DNA, 18 bp, Homo sapiens
agggagagaccgcgggtc

SEQ ID NO: 8172817 - DNA, 16 bp, Homo sapiens
agggagagaggaacat

SEQ ID NO: 8172818 - DNA, 18 bp, Homo sapiens
agggagagaccgcgggtc

SEQ ID NO: 8172819 - DNA, 22 bp, Homo sapiens
agggagaggagcgtttcacatc

SEQ ID NO: 8172820 - DNA, 16 bp, Homo sapiens
agggagagaggaacat

SEQ ID NO: 8172821 - DNA, 22 bp, Homo sapiens
agggagaggagggtcttgttga

SEQ ID NO: 8172822 - DNA, 22 bp, Homo sapiens
agggagaggagcgtttcacatc

SEQ ID NO: 8172823 - DNA, 22 bp, Homo sapiens
agggagaggagcgtttcacatc

SEQ ID NO: 8172824 - DNA, 22 bp, Homo sapiens
acccagctggatgcatggaggc

SEQ ID NO: 8172825 - DNA, 22 bp, Homo sapiens
acccagctctttgatggtcttg

SEQ ID NO: 8172826 - DNA, 22 bp, Homo sapiens
acccagctggatgcatggaggc

SEQ ID NO: 8172827 - DNA, 22 bp, Homo sapiens
acccagctggatgcatggaggc

SEQ ID NO: 8172828 - DNA, 20 bp, Homo sapiens
acccagctctgtgccctggg

SEQ ID NO: 8172829 - DNA, 20 bp, Homo sapiens
acccagctctgtgccctggg

SEQ ID NO: 8172830 - DNA, 22 bp, Homo sapiens
acccagctaaccctaccctgga

SEQ ID NO: 8172831 - DNA, 22 bp, Homo sapiens
acccaggacacagagatgaccc

SEQ ID NO: 8172832 - DNA, 22 bp, Homo sapiens
acccaggacaaaataaccaggt

SEQ ID NO: 8172833 - DNA, 22 bp, Homo sapiens
acccaggacatgggcacccgtg

SEQ ID NO: 8172834 - DNA, 22 bp, Homo sapiens
acccaggaaaacatggtgcaga

SEQ ID NO: 8172835 - DNA, 22 bp, Homo sapiens
acccaggaaaacatggtgcaga

SEQ ID NO: 8172836 - DNA, 22 bp, Homo sapiens
acccaggaaaacatggtgcaga

SEQ ID NO: 8172837 - DNA, 22 bp, Homo sapiens
agggctgcccagtgtgagagct

SEQ ID NO: 8172838 - DNA, 22 bp, Homo sapiens
agggctgcccagtgtgagagct

SEQ ID NO: 8172839 - DNA, 22 bp, Homo sapiens
agggctgcccagtgtgagagct

SEQ ID NO: 8172840 - DNA, 22 bp, Homo sapiens
agggctgacagtgaggagtcaa

SEQ ID NO: 8172841 - DNA, 22 bp, Homo sapiens
agggctgccatttctggcccaa

SEQ ID NO: 8172842 - DNA, 22 bp, Homo sapiens
agggctgccatttctggcccaa

SEQ ID NO: 8172843 - DNA, 22 bp, Homo sapiens
agggctgacagtgaggagtcaa

SEQ ID NO: 8172844 - DNA, 22 bp, Homo sapiens
acccaggagagagctataaaat

SEQ ID NO: 8172845 - DNA, 22 bp, Homo sapiens
acccaggagacggaggtgcagt

SEQ ID NO: 8172846 - DNA, 22 bp, Homo sapiens
acccaggagacaggttgcagtg

SEQ ID NO: 8172847 - DNA, 22 bp, Homo sapiens
acccaggacttggcaacctcat

SEQ ID NO: 8172848 - DNA, 22 bp, Homo sapiens
acccaggactctcttccagtag

SEQ ID NO: 8172849 - DNA, 22 bp, Homo sapiens
accaggcctggctgggcagcca

SEQ ID NO: 8172850 - DNA, 22 bp, Homo sapiens
accaggcctggctgggcagcca

SEQ ID NO: 8172851 - DNA, 22 bp, Homo sapiens
accaggctccccttggatcctg

SEQ ID NO: 8172852 - DNA, 22 bp, Homo sapiens
accaggctccccttggatcctg

SEQ ID NO: 8172853 - DNA, 22 bp, Homo sapiens
accaggcctggctgggcagcca

SEQ ID NO: 8172854 - DNA, 22 bp, Homo sapiens
accaggctccccttggatcctg

SEQ ID NO: 8172855 - DNA, 22 bp, Homo sapiens
accaggctctgccagtgtttac

SEQ ID NO: 8172856 - DNA, 22 bp, Homo sapiens
accaggctccccttggatcctg

SEQ ID NO: 8172857 - DNA, 22 bp, Homo sapiens
accaggctggagtgcagtggcg

SEQ ID NO: 8172858 - DNA, 22 bp, Homo sapiens
accaggctctgccagtgtttac

SEQ ID NO: 8172859 - DNA, 22 bp, Homo sapiens
accaggctctgccagtgtttac

SEQ ID NO: 8172860 - DNA, 22 bp, Homo sapiens
accaggctgtgaagtgagacta

SEQ ID NO: 8172861 - DNA, 22 bp, Homo sapiens
accaggctggagtgcagtggcg

SEQ ID NO: 8172862 - DNA, 22 bp, Homo sapiens
accaggctggagtgcagtggcg

SEQ ID NO: 8172863 - DNA, 22 bp, Homo sapiens
accaggctgtgaagtgagacta

SEQ ID NO: 8172864 - DNA, 22 bp, Homo sapiens
acccagataaatgacagggctt

SEQ ID NO: 8172865 - DNA, 19 bp, Homo sapiens
agggctgctctggcctggg

SEQ ID NO: 8172866 - DNA, 22 bp, Homo sapiens
agggctgctcctccttcaggcc

SEQ ID NO: 8172867 - DNA, 22 bp, Homo sapiens
acccaggctggagtgcagtgat

SEQ ID NO: 8172868 - DNA, 22 bp, Homo sapiens
agggctgctgaggaagccttgc

SEQ ID NO: 8172869 - DNA, 22 bp, Homo sapiens
acccaggctggagtgcagtgac

SEQ ID NO: 8172870 - DNA, 22 bp, Homo sapiens
agggctgcctgctctgcattga

SEQ ID NO: 8172871 - DNA, 22 bp, Homo sapiens
agggctgctaccttaatcagtt

SEQ ID NO: 8172872 - DNA, 22 bp, Homo sapiens
agggctgctatgttgattcaga

SEQ ID NO: 8172873 - DNA, 22 bp, Homo sapiens
agggctgcctgactccagagcc

SEQ ID NO: 8172874 - DNA, 22 bp, Homo sapiens
agggctgccccagtccagccgg

SEQ ID NO: 8172875 - DNA, 22 bp, Homo sapiens
agggctgccccagtccagccgg

SEQ ID NO: 8172876 - DNA, 22 bp, Homo sapiens
agggctgcctgactccagagcc

SEQ ID NO: 8172877 - DNA, 22 bp, Homo sapiens
agggctgcctgactccagagcc

SEQ ID NO: 8172878 - DNA, 22 bp, Homo sapiens
agggctgcctgactccagagcc

SEQ ID NO: 8172879 - DNA, 22 bp, Homo sapiens
acccaggctggagtgcagtgat

SEQ ID NO: 8172880 - DNA, 22 bp, Homo sapiens
acccaggctggagtgcagtggc

SEQ ID NO: 8172881 - DNA, 22 bp, Homo sapiens
acccaggctggagtgcagtggc

SEQ ID NO: 8172882 - DNA, 22 bp, Homo sapiens
acccaggctggagtgcagtggg

SEQ ID NO: 8172883 - DNA, 22 bp, Homo sapiens
acccaggctggagtgcagtggg

SEQ ID NO: 8172884 - DNA, 22 bp, Homo sapiens
acccaggctggcagaggctcct

SEQ ID NO: 8172885 - DNA, 22 bp, Homo sapiens
acccaggctggcgtgcagtggc

SEQ ID NO: 8172886 - DNA, 22 bp, Homo sapiens
acccaggctggagtgcagtgtc

SEQ ID NO: 8172887 - DNA, 22 bp, Homo sapiens
acccaggctggagtgcagtgtc

SEQ ID NO: 8172888 - DNA, 22 bp, Homo sapiens
acccaggctggagtgcagtggt

SEQ ID NO: 8172889 - DNA, 22 bp, Homo sapiens
acccaggctggagtgcagtggt

SEQ ID NO: 8172890 - DNA, 22 bp, Homo sapiens
agggggaggctgtgctgcgtct

SEQ ID NO: 8172891 - DNA, 22 bp, Homo sapiens
agggggaggctgtgctgcgtct

SEQ ID NO: 8172892 - DNA, 22 bp, Homo sapiens
agggggaggctgtgctgcgtct

SEQ ID NO: 8172893 - DNA, 22 bp, Homo sapiens
aggggcctggttggcctctgtt

SEQ ID NO: 8172894 - DNA, 22 bp, Homo sapiens
acccaggctggcgtgcagtggc

SEQ ID NO: 8172895 - DNA, 22 bp, Homo sapiens
aggggcctggacatggacgcgc

SEQ ID NO: 8172896 - DNA, 22 bp, Homo sapiens
aggggcctggcactgagctggc

SEQ ID NO: 8172897 - DNA, 22 bp, Homo sapiens
agggggcaggagagacctgctg

SEQ ID NO: 8172898 - DNA, 22 bp, Homo sapiens
agggggagtttcagttagaaag

SEQ ID NO: 8172899 - DNA, 22 bp, Homo sapiens
agggggcatcaggtcctggctc

SEQ ID NO: 8172900 - DNA, 22 bp, Homo sapiens
agggggctcagcatggatggag

SEQ ID NO: 8172901 - DNA, 22 bp, Homo sapiens
accctcagtaatcgtgcagttt

SEQ ID NO: 8172902 - DNA, 22 bp, Homo sapiens
accctcagtaatcgtgcagttt

SEQ ID NO: 8172903 - DNA, 22 bp, Homo sapiens
accctccactttatctgtcttt

SEQ ID NO: 8172904 - DNA, 20 bp, Homo sapiens
accctccactgttcactgtg

SEQ ID NO: 8172905 - DNA, 22 bp, Homo sapiens
accctccacaccagtcttattt

SEQ ID NO: 8172906 - DNA, 22 bp, Homo sapiens
agtcaacaaaaatgtggagcct

SEQ ID NO: 8172907 - DNA, 22 bp, Homo sapiens
agtcaaatgagtaaatatataa

SEQ ID NO: 8172908 - DNA, 22 bp, Homo sapiens
agtcaaataagactgtcataag

SEQ ID NO: 8172909 - DNA, 22 bp, Homo sapiens
actcagcttgcacacatcaatg

SEQ ID NO: 8172910 - DNA, 22 bp, Homo sapiens
actcagcttgcacacatcaatg

SEQ ID NO: 8172911 - DNA, 22 bp, Homo sapiens
actcaggaaatgagaggctctc

SEQ ID NO: 8172912 - DNA, 22 bp, Homo sapiens
actcaggaaattgagataatgg

SEQ ID NO: 8172913 - DNA, 22 bp, Homo sapiens
actcaggaagaaagcagctggt

SEQ ID NO: 8172914 - DNA, 22 bp, Homo sapiens
agtcccagctcagaaccactag

SEQ ID NO: 8172915 - DNA, 22 bp, Homo sapiens
agtcccagctctgccacttact

SEQ ID NO: 8172916 - DNA, 22 bp, Homo sapiens
agtcccagctctgccacttact

SEQ ID NO: 8172917 - DNA, 22 bp, Homo sapiens
agtccaggcgggtatagaggct

SEQ ID NO: 8172918 - DNA, 22 bp, Homo sapiens
agtccaggcgggtatagaggct

SEQ ID NO: 8172919 - DNA, 22 bp, Homo sapiens
actcaggcttcaggcacagctg

SEQ ID NO: 8172920 - DNA, 22 bp, Homo sapiens
actcaggctgttttttccttgt

SEQ ID NO: 8172921 - DNA, 22 bp, Homo sapiens
actcaggctgttttttccttgt

SEQ ID NO: 8172922 - DNA, 22 bp, Homo sapiens
actcaggcctccttctgtcctt

SEQ ID NO: 8172923 - DNA, 22 bp, Homo sapiens
actcaggcctccttctgtcctt

SEQ ID NO: 8172924 - DNA, 22 bp, Homo sapiens
actcaggccccatcgcccatct

SEQ ID NO: 8172925 - DNA, 22 bp, Homo sapiens
actcaggctacaacgcgtggct

SEQ ID NO: 8172926 - DNA, 22 bp, Homo sapiens
actcaggctagggaaaaagtgg

SEQ ID NO: 8172927 - DNA, 22 bp, Homo sapiens
actcaggctacaggggcagaag

SEQ ID NO: 8172928 - DNA, 21 bp, Homo sapiens
actcaggcaccaggggatggc

SEQ ID NO: 8172929 - DNA, 22 bp, Homo sapiens
actcaggcactcagccctcgcc

SEQ ID NO: 8172930 - DNA, 21 bp, Homo sapiens
actcaggcaccaggggatggc

SEQ ID NO: 8172931 - DNA, 19 bp, Homo sapiens
actcaggcaatgagaaaca

SEQ ID NO: 8172932 - DNA, 19 bp, Homo sapiens
actcaggcaatgagaaaca

SEQ ID NO: 8172933 - DNA, 22 bp, Homo sapiens
actagtattgcctactgtacat

SEQ ID NO: 8172934 - DNA, 22 bp, Homo sapiens
actagtattagactaaaagtca

SEQ ID NO: 8172935 - DNA, 22 bp, Homo sapiens
actaggggctcaggcccaggga

SEQ ID NO: 8172936 - DNA, 22 bp, Homo sapiens
agtatactgaaagtaaatatga

SEQ ID NO: 8172937 - DNA, 22 bp, Homo sapiens
agtatatagtggcgctgtatgc

SEQ ID NO: 8172938 - DNA, 22 bp, Homo sapiens
actagtgaagaagatttgactg

SEQ ID NO: 8172939 - DNA, 22 bp, Homo sapiens
agtatacatatattagccttcg

SEQ ID NO: 8172940 - DNA, 21 bp, Homo sapiens
actagctttctggagaagtgt

SEQ ID NO: 8172941 - DNA, 22 bp, Homo sapiens
actagcttgggcctgggtcaga

SEQ ID NO: 8172942 - DNA, 22 bp, Homo sapiens
actagctttacagcatgagtgg

SEQ ID NO: 8172943 - DNA, 22 bp, Homo sapiens
actaggaaggcatatgggcaga

SEQ ID NO: 8172944 - DNA, 22 bp, Homo sapiens
actaggggctcaggcccaggga

SEQ ID NO: 8172945 - DNA, 22 bp, Homo sapiens
actaggggctcaggcccaggga

SEQ ID NO: 8172946 - DNA, 22 bp, Homo sapiens
actagggaaagttatgttcaca

SEQ ID NO: 8172947 - DNA, 22 bp, Homo sapiens
agtatttcttcatatgattact

SEQ ID NO: 8172948 - DNA, 22 bp, Homo sapiens
agtatttggtgtggtattgacc

SEQ ID NO: 8172949 - DNA, 22 bp, Homo sapiens
agtcaaagatgaccgagttcct

SEQ ID NO: 8172950 - DNA, 22 bp, Homo sapiens
agtattttcgccatcacaagaa

SEQ ID NO: 8172951 - DNA, 22 bp, Homo sapiens
actagctgtgacagctgcgtgt

SEQ ID NO: 8172952 - DNA, 22 bp, Homo sapiens
actagcagggatattatataag

SEQ ID NO: 8172953 - DNA, 22 bp, Homo sapiens
agtaaacagaaagcaagatgat

SEQ ID NO: 8172954 - DNA, 22 bp, Homo sapiens
agtaaacagaaagcaagatgat

SEQ ID NO: 8172955 - DNA, 22 bp, Homo sapiens
agtaaacagaaagcaagatgat

SEQ ID NO: 8172956 - DNA, 22 bp, Homo sapiens
actagaaattactcagaataaa

SEQ ID NO: 8172957 - DNA, 22 bp, Homo sapiens
agtaaacagtaggaactgagaa

SEQ ID NO: 8172958 - DNA, 22 bp, Homo sapiens
agtaaacacgtggggtttcttt

SEQ ID NO: 8172959 - DNA, 22 bp, Homo sapiens
agtaaaattgtattggaaaaca

SEQ ID NO: 8172960 - DNA, 22 bp, Homo sapiens
agtaaaattgtattggaaaaca

SEQ ID NO: 8172961 - DNA, 22 bp, Homo sapiens
agtaaaacagagaaatcactca

SEQ ID NO: 8172962 - DNA, 22 bp, Homo sapiens
agtaaaatcaccatctctttgt

SEQ ID NO: 8172963 - DNA, 22 bp, Homo sapiens
agtaaaatcaccatctctttgt

SEQ ID NO: 8172964 - DNA, 22 bp, Homo sapiens
agtaaaatcaccatctctttgt

SEQ ID NO: 8172965 - DNA, 22 bp, Homo sapiens
agtaaaatcaccatctctttgt

SEQ ID NO: 8172966 - DNA, 22 bp, Homo sapiens
agtaaaatcaccatctctttgt

SEQ ID NO: 8172967 - DNA, 22 bp, Homo sapiens
agtaaaattaatggatcagaag

SEQ ID NO: 8172968 - DNA, 22 bp, Homo sapiens
acggcaggctcagagctggaat

SEQ ID NO: 8172969 - DNA, 22 bp, Homo sapiens
agtaaaaattgaggtgcaaaat

SEQ ID NO: 8172970 - DNA, 22 bp, Homo sapiens
agtaaaaattgaggtgcaaaat

SEQ ID NO: 8172971 - DNA, 22 bp, Homo sapiens
aggttgaacccccaagacctat

SEQ ID NO: 8172972 - DNA, 21 bp, Homo sapiens
acgctggggatggggtctaga

SEQ ID NO: 8172973 - DNA, 21 bp, Homo sapiens
acgctgcaccacgttctgcgg

SEQ ID NO: 8172974 - DNA, 23 bp, Homo sapiens
acgctgggtggccagaacgacag

SEQ ID NO: 8172975 - DNA, 23 bp, Homo sapiens
acgctgggtggccagaacgacag

SEQ ID NO: 8172976 - DNA, 22 bp, Homo sapiens
acgcctgtaatcccagcacttt

SEQ ID NO: 8172977 - DNA, 22 bp, Homo sapiens
acgcctgtaatcccagcacttt

SEQ ID NO: 8172978 - DNA, 22 bp, Homo sapiens
acgatgatgaaagagaacattc

SEQ ID NO: 8172979 - DNA, 22 bp, Homo sapiens
acgcaggagtgggtggagtgga

SEQ ID NO: 8172980 - DNA, 22 bp, Homo sapiens
acgcagaagggcctggcgtgcc

SEQ ID NO: 8172981 - DNA, 22 bp, Homo sapiens
aggtggctcctcccatggctgg

SEQ ID NO: 8172982 - DNA, 22 bp, Homo sapiens
aggtggctcctcccatggctgg

SEQ ID NO: 8172983 - DNA, 22 bp, Homo sapiens
aggtggctcctcccatggctgg

SEQ ID NO: 8172984 - DNA, 20 bp, Homo sapiens
aggtggctcctgctgggggt

SEQ ID NO: 8172985 - DNA, 20 bp, Homo sapiens
aggtggctcctgctgggggt

SEQ ID NO: 8172986 - DNA, 20 bp, Homo sapiens
aggtggctcctgctgggggt

SEQ ID NO: 8172987 - DNA, 20 bp, Homo sapiens
aggtggctcctgctgggggt

SEQ ID NO: 8172988 - DNA, 20 bp, Homo sapiens
aggtggctcctgctgggggt

SEQ ID NO: 8172989 - DNA, 22 bp, Homo sapiens
acgcctctgcagctgccgggcc

SEQ ID NO: 8172990 - DNA, 22 bp, Homo sapiens
acgcctgtaatcccagcacttt

SEQ ID NO: 8172991 - DNA, 22 bp, Homo sapiens
acgcagtttgtggacatttttt

SEQ ID NO: 8172992 - DNA, 22 bp, Homo sapiens
acgcccagactcccatactttg

SEQ ID NO: 8172993 - DNA, 22 bp, Homo sapiens
acctgaatccccagggccttcc

SEQ ID NO: 8172994 - DNA, 22 bp, Homo sapiens
acctgaattttggatgagctgt

SEQ ID NO: 8172995 - DNA, 22 bp, Homo sapiens
acctgaaaccaacttgtgtact

SEQ ID NO: 8172996 - DNA, 22 bp, Homo sapiens
acctgaaactcaactttatctc

SEQ ID NO: 8172997 - DNA, 22 bp, Homo sapiens
acctgaaaattattatttccgc

SEQ ID NO: 8172998 - DNA, 22 bp, Homo sapiens
acctcctgatgagagtaaagga

SEQ ID NO: 8172999 - DNA, 22 bp, Homo sapiens
acctcctgatgagagtaaagga

SEQ ID NO: 8173000 - DNA, 22 bp, Homo sapiens
acctctggccttcaggcatcat

SEQ ID NO: 8173001 - DNA, 22 bp, Homo sapiens
acctctggccttcaggcatcat

SEQ ID NO: 8173002 - DNA, 22 bp, Homo sapiens
acctctgggaaaagtatggaaa

SEQ ID NO: 8173003 - DNA, 22 bp, Homo sapiens
acctctgggaaaagtatggaaa

SEQ ID NO: 8173004 - DNA, 22 bp, Homo sapiens
acctctgggcagcacctttgta

SEQ ID NO: 8173005 - DNA, 22 bp, Homo sapiens
acctcctccaaggagccatagg

SEQ ID NO: 8173006 - DNA, 22 bp, Homo sapiens
accctctgcatcagcttcttta

SEQ ID NO: 8173007 - DNA, 19 bp, Homo sapiens
accctctcagtgcctgagg

SEQ ID NO: 8173008 - DNA, 19 bp, Homo sapiens
accctctcagtgcctgagg

SEQ ID NO: 8173009 - DNA, 19 bp, Homo sapiens
accctctccccactgggtc

SEQ ID NO: 8173010 - DNA, 19 bp, Homo sapiens
accctctccccactgggtc

SEQ ID NO: 8173011 - DNA, 19 bp, Homo sapiens
accctctctgtagaaagat

SEQ ID NO: 8173012 - DNA, 20 bp, Homo sapiens
accctctgaatagtatctgg

SEQ ID NO: 8173013 - DNA, 22 bp, Homo sapiens
accctccaggctgcagctcctg

SEQ ID NO: 8173014 - DNA, 22 bp, Homo sapiens
accctccaggcgggcttgtgac

SEQ ID NO: 8173015 - DNA, 22 bp, Homo sapiens
accctcccatttccatgtagca

SEQ ID NO: 8173016 - DNA, 22 bp, Homo sapiens
accctccccaagaggtcgtgcc

SEQ ID NO: 8173017 - DNA, 22 bp, Homo sapiens
accctccccaagaggtcgtgcc

SEQ ID NO: 8173018 - DNA, 22 bp, Homo sapiens
acctgcatgatggaacatgagg

SEQ ID NO: 8173019 - DNA, 22 bp, Homo sapiens
acctgcccacacttccttccca

SEQ ID NO: 8173020 - DNA, 22 bp, Homo sapiens
aggtccagttgccagaatggcc

SEQ ID NO: 8173021 - DNA, 22 bp, Homo sapiens
aggtccagttgccagaatggcc

SEQ ID NO: 8173022 - DNA, 22 bp, Homo sapiens
acctgcagctaaagatgtaggg

SEQ ID NO: 8173023 - DNA, 22 bp, Homo sapiens
acctgcaggcacaggtgtgcgc

SEQ ID NO: 8173024 - DNA, 20 bp, Homo sapiens
acctgaggtccctatggtct

SEQ ID NO: 8173025 - DNA, 22 bp, Homo sapiens
acctgaggcctccccagcagac

SEQ ID NO: 8173026 - DNA, 22 bp, Homo sapiens
acctgagacctaatctgactgt

SEQ ID NO: 8173027 - DNA, 22 bp, Homo sapiens
acctgagcatgccaggagagtg

SEQ ID NO: 8173028 - DNA, 22 bp, Homo sapiens
acctgaggcctccccagcagac

SEQ ID NO: 8173029 - DNA, 22 bp, Homo sapiens
acctgaggactggatggtagaa

SEQ ID NO: 8173030 - DNA, 22 bp, Homo sapiens
acctgaggactggatggtagaa

SEQ ID NO: 8173031 - DNA, 21 bp, Homo sapiens
acctgagctccacctcctgcc

SEQ ID NO: 8173032 - DNA, 22 bp, Homo sapiens
acctgagcctagggaggttgag

SEQ ID NO: 8173033 - DNA, 20 bp, Homo sapiens
acctggctctcaggagcaac

SEQ ID NO: 8173034 - DNA, 22 bp, Homo sapiens
aggtggagatcagggactaagg

SEQ ID NO: 8173035 - DNA, 22 bp, Homo sapiens
acctggctgagaacgtgcagct

SEQ ID NO: 8173036 - DNA, 22 bp, Homo sapiens
aggtggcatgcctgagacataa

SEQ ID NO: 8173037 - DNA, 22 bp, Homo sapiens
aggtggcatgcctgagacataa

SEQ ID NO: 8173038 - DNA, 22 bp, Homo sapiens
aggtggagatcagggactaagg

SEQ ID NO: 8173039 - DNA, 22 bp, Homo sapiens
acctggcatgaagcatgcctta

SEQ ID NO: 8173040 - DNA, 22 bp, Homo sapiens
acctggcatgaagcatgcctta

SEQ ID NO: 8173041 - DNA, 22 bp, Homo sapiens
acctggccagtggggccgcgct

SEQ ID NO: 8173042 - DNA, 22 bp, Homo sapiens
acctggcactacaggcacctgt

SEQ ID NO: 8173043 - DNA, 22 bp, Homo sapiens
acctggcactacaggcacctgt

SEQ ID NO: 8173044 - DNA, 22 bp, Homo sapiens
acctggcaggaaggtgggtgat

SEQ ID NO: 8173045 - DNA, 22 bp, Homo sapiens
acctggcaggaaggtgggtgat

SEQ ID NO: 8173046 - DNA, 22 bp, Homo sapiens
acctggcataagggcttgagtc

SEQ ID NO: 8173047 - DNA, 18 bp, Homo sapiens
aggtggcctgggagcttt

SEQ ID NO: 8173048 - DNA, 22 bp, Homo sapiens
aggtggccggtgccagccgggc

SEQ ID NO: 8173049 - DNA, 22 bp, Homo sapiens
aggtggcctaaggtggcactgg

SEQ ID NO: 8173050 - DNA, 18 bp, Homo sapiens
aggtggcctgggagcttt

SEQ ID NO: 8173051 - DNA, 18 bp, Homo sapiens
aggtggcctgggagcttt

SEQ ID NO: 8173052 - DNA, 22 bp, Homo sapiens
aggtggctcctcccatggctgg

SEQ ID NO: 8173053 - DNA, 22 bp, Homo sapiens
aggtggctcccagtgttgttgt

SEQ ID NO: 8173054 - DNA, 22 bp, Homo sapiens
aggtggctatgaggatgcagtc

SEQ ID NO: 8173055 - DNA, 23 bp, Homo sapiens
aggtggcctttgcctctttctct

SEQ ID NO: 8173056 - DNA, 23 bp, Homo sapiens
aggtggcctttgcctctttctct

SEQ ID NO: 8173057 - DNA, 22 bp, Homo sapiens
aggtggctatgaggatgcagtc

SEQ ID NO: 8173058 - DNA, 22 bp, Homo sapiens
aggtggctatgaggatgcagtc

SEQ ID NO: 8173059 - DNA, 22 bp, Homo sapiens
aggtggctatgaggatgcagtc

SEQ ID NO: 8173060 - DNA, 22 bp, Homo sapiens
aggtggcatttacaccatggga

SEQ ID NO: 8173061 - DNA, 22 bp, Homo sapiens
aggtggccaagactgtttgaca

SEQ ID NO: 8173062 - DNA, 22 bp, Homo sapiens
aggtggccaataaatgttggag

SEQ ID NO: 8173063 - DNA, 22 bp, Homo sapiens
aggtggcatttacaccatggga

SEQ ID NO: 8173064 - DNA, 22 bp, Homo sapiens
aggtggcatgcctgagacataa

SEQ ID NO: 8173065 - DNA, 22 bp, Homo sapiens
aggtggcatgcctgagacataa

SEQ ID NO: 8173066 - DNA, 21 bp, Homo sapiens
aggtggccacaaatctgtttc

SEQ ID NO: 8173067 - DNA, 23 bp, Homo sapiens
aggtggccaccagaatgttaagg

SEQ ID NO: 8173068 - DNA, 19 bp, Homo sapiens
aggtggccatgtccagcct

SEQ ID NO: 8173069 - DNA, 19 bp, Homo sapiens
aggtggccatgtccagcct

SEQ ID NO: 8173070 - DNA, 20 bp, Homo sapiens
aggtggcccattatagtgga

SEQ ID NO: 8173071 - DNA, 22 bp, Homo sapiens
aggtggcccagctgacagatag

SEQ ID NO: 8173072 - DNA, 22 bp, Homo sapiens
aggtggccccaggcctctgcca

SEQ ID NO: 8173073 - DNA, 22 bp, Homo sapiens
aggtggccccaggcctctgcca

SEQ ID NO: 8173074 - DNA, 22 bp, Homo sapiens
acctggagggaagttctgactt

SEQ ID NO: 8173075 - DNA, 22 bp, Homo sapiens
acctggagggaagttctgactt

SEQ ID NO: 8173076 - DNA, 22 bp, Homo sapiens
acctggaggcagaggttgcagt

SEQ ID NO: 8173077 - DNA, 22 bp, Homo sapiens
aggtctcttgctgtctctgggc

SEQ ID NO: 8173078 - DNA, 22 bp, Homo sapiens
aggtctcttgctgtctctgggc

SEQ ID NO: 8173079 - DNA, 22 bp, Homo sapiens
acctggaggcagaggttgcagt

SEQ ID NO: 8173080 - DNA, 22 bp, Homo sapiens
aggtctcttgctgtctctgggc

SEQ ID NO: 8173081 - DNA, 22 bp, Homo sapiens
acctggcacacactggggagtg

SEQ ID NO: 8173082 - DNA, 22 bp, Homo sapiens
acctggcacattctaccacagt

SEQ ID NO: 8173083 - DNA, 22 bp, Homo sapiens
acctggcacagagtatgctctc

SEQ ID NO: 8173084 - DNA, 22 bp, Homo sapiens
acctggcacacactggggagtg

SEQ ID NO: 8173085 - DNA, 22 bp, Homo sapiens
acctggagtcatttgaggagta

SEQ ID NO: 8173086 - DNA, 22 bp, Homo sapiens
acctggagtcatttgaggagta

SEQ ID NO: 8173087 - DNA, 22 bp, Homo sapiens
acctggatgctggccttgcctt

SEQ ID NO: 8173088 - DNA, 22 bp, Homo sapiens
acctggagtcatttgaggagta

SEQ ID NO: 8173089 - DNA, 22 bp, Homo sapiens
aggtctctgagtactgctggac

SEQ ID NO: 8173090 - DNA, 22 bp, Homo sapiens
aggtctctcacactcacagggc

SEQ ID NO: 8173091 - DNA, 22 bp, Homo sapiens
aggtctctcagccctgacattc

SEQ ID NO: 8173092 - DNA, 22 bp, Homo sapiens
aggtctctcagccctgacattc

SEQ ID NO: 8173093 - DNA, 22 bp, Homo sapiens
aggtctctggggaactccaggg

SEQ ID NO: 8173094 - DNA, 22 bp, Homo sapiens
aggtctctggggaactccaggg

SEQ ID NO: 8173095 - DNA, 22 bp, Homo sapiens
aggtctctggggaactccaggg

SEQ ID NO: 8173096 - DNA, 22 bp, Homo sapiens
aggtctctgcccacacaggctt

SEQ ID NO: 8173097 - DNA, 22 bp, Homo sapiens
aggtctctcacactcacagggc

SEQ ID NO: 8173098 - DNA, 22 bp, Homo sapiens
aggtctctagaaattcagccag

SEQ ID NO: 8173099 - DNA, 22 bp, Homo sapiens
aggtctccttgtgggtcttgcc

SEQ ID NO: 8173100 - DNA, 22 bp, Homo sapiens
aggtcctgtcttatctctgtaa

SEQ ID NO: 8173101 - DNA, 22 bp, Homo sapiens
aggtccagttttcagttctcat

SEQ ID NO: 8173102 - DNA, 22 bp, Homo sapiens
aggtccagttgccagaatggcc

SEQ ID NO: 8173103 - DNA, 22 bp, Homo sapiens
aggtcctgtgtccaggggcctg

SEQ ID NO: 8173104 - DNA, 22 bp, Homo sapiens
aggtcctgtggtttgggtaaaa

SEQ ID NO: 8173105 - DNA, 20 bp, Homo sapiens
aggtcctgttccttgtctcc

SEQ ID NO: 8173106 - DNA, 22 bp, Homo sapiens
aggtcctgtttcttccctgggg

SEQ ID NO: 8173107 - DNA, 22 bp, Homo sapiens
aggtccttaacatagtgatatc

SEQ ID NO: 8173108 - DNA, 22 bp, Homo sapiens
aggtccttggttgtctgaagaa

SEQ ID NO: 8173109 - DNA, 22 bp, Homo sapiens
aggtcgagtttcggggctactt

SEQ ID NO: 8173110 - DNA, 22 bp, Homo sapiens
aggtctcaaactggcaccctgt

SEQ ID NO: 8173111 - DNA, 22 bp, Homo sapiens
aggtctcaattcctgctcctgt

SEQ ID NO: 8173112 - DNA, 22 bp, Homo sapiens
actggaaaattcaaatggggtc

SEQ ID NO: 8173113 - DNA, 22 bp, Homo sapiens
actgcttttgatctcttctgta

SEQ ID NO: 8173114 - DNA, 22 bp, Homo sapiens
actgcttttgatctcttctgta

SEQ ID NO: 8173115 - DNA, 22 bp, Homo sapiens
actggaattaggtttgtataca

SEQ ID NO: 8173116 - DNA, 22 bp, Homo sapiens
actggaagtatctgcttgtttt

SEQ ID NO: 8173117 - DNA, 21 bp, Homo sapiens
actggaagtgggtcaggaagt

SEQ ID NO: 8173118 - DNA, 22 bp, Homo sapiens
actggaagtatctgcttgtttt

SEQ ID NO: 8173119 - DNA, 22 bp, Homo sapiens
actggaagccagttgacaatca

SEQ ID NO: 8173120 - DNA, 22 bp, Homo sapiens
actggaaattgagaggtcactg

SEQ ID NO: 8173121 - DNA, 21 bp, Homo sapiens
agtgtaggtcattagctgttg

SEQ ID NO: 8173122 - DNA, 20 bp, Homo sapiens
agtgtatgaatctggatggg

SEQ ID NO: 8173123 - DNA, 22 bp, Homo sapiens
agtgtattaagttatgaagtta

SEQ ID NO: 8173124 - DNA, 22 bp, Homo sapiens
agtgtattaagttatgaagtta

SEQ ID NO: 8173125 - DNA, 22 bp, Homo sapiens
agtgtatgtcaagtatatacac

SEQ ID NO: 8173126 - DNA, 22 bp, Homo sapiens
agtgtatgtcaagtatatacac

SEQ ID NO: 8173127 - DNA, 22 bp, Homo sapiens
actgctttatctgagaagtcct

SEQ ID NO: 8173128 - DNA, 23 bp, Homo sapiens
actgctttattcatgaggctctc

SEQ ID NO: 8173129 - DNA, 22 bp, Homo sapiens
actgctttatctgagaagtcct

SEQ ID NO: 8173130 - DNA, 22 bp, Homo sapiens
actgcttttcagagtctgcctg

SEQ ID NO: 8173131 - DNA, 16 bp, Homo sapiens
actgcttttcataaga

SEQ ID NO: 8173132 - DNA, 22 bp, Homo sapiens
actgcttttctaagattctgtg

SEQ ID NO: 8173133 - DNA, 22 bp, Homo sapiens
actgcttttagaaatctataga

SEQ ID NO: 8173134 - DNA, 22 bp, Homo sapiens
actgcttttagaaatctataga

SEQ ID NO: 8173135 - DNA, 22 bp, Homo sapiens
actgctttgctctgcccccagg

SEQ ID NO: 8173136 - DNA, 21 bp, Homo sapiens
actggcttggctctggctgaa

SEQ ID NO: 8173137 - DNA, 22 bp, Homo sapiens
agtgtttatattatggaaatat

SEQ ID NO: 8173138 - DNA, 22 bp, Homo sapiens
agtgtttatattatggaaatat

SEQ ID NO: 8173139 - DNA, 22 bp, Homo sapiens
agtgtttaccccaatcagttta

SEQ ID NO: 8173140 - DNA, 20 bp, Homo sapiens
agtgtttagaatactattat

SEQ ID NO: 8173141 - DNA, 22 bp, Homo sapiens
agtgtttagtcaagtaagacgc

SEQ ID NO: 8173142 - DNA, 22 bp, Homo sapiens
agtgtttagtgatgaaagagaa

SEQ ID NO: 8173143 - DNA, 22 bp, Homo sapiens
agtgtttagaggaggaaagatg

SEQ ID NO: 8173144 - DNA, 22 bp, Homo sapiens
agtgtttagaggaggaaagatg

SEQ ID NO: 8173145 - DNA, 22 bp, Homo sapiens
agtgttgcatgaggcagtacca

SEQ ID NO: 8173146 - DNA, 22 bp, Homo sapiens
agtgttggaccgaggtggagcc

SEQ ID NO: 8173147 - DNA, 22 bp, Homo sapiens
agtgttggaccgaggtggagcc

SEQ ID NO: 8173148 - DNA, 22 bp, Homo sapiens
agtgttcttcttcaaagctctg

SEQ ID NO: 8173149 - DNA, 21 bp, Homo sapiens
agtgtgtgataggcaggaaga

SEQ ID NO: 8173150 - DNA, 22 bp, Homo sapiens
agtgtttaatgccttttccagc

SEQ ID NO: 8173151 - DNA, 22 bp, Homo sapiens
agtgtttacagagtagtggaaa

SEQ ID NO: 8173152 - DNA, 22 bp, Homo sapiens
agtgtttacagagtagtggaaa

SEQ ID NO: 8173153 - DNA, 22 bp, Homo sapiens
agtgtttaagttacacacatat

SEQ ID NO: 8173154 - DNA, 23 bp, Homo sapiens
agtgttggttgggaagccaagca

SEQ ID NO: 8173155 - DNA, 22 bp, Homo sapiens
agtgttgtatgggatgactgct

SEQ ID NO: 8173156 - DNA, 22 bp, Homo sapiens
agtgtttaaactgaagtgatga

SEQ ID NO: 8173157 - DNA, 22 bp, Homo sapiens
agtgttgtcaaacggctcagca

SEQ ID NO: 8173158 - DNA, 22 bp, Homo sapiens
agtgtagatgaaattaaaccca

SEQ ID NO: 8173159 - DNA, 22 bp, Homo sapiens
agtgtagggtggtcagagcaga

SEQ ID NO: 8173160 - DNA, 22 bp, Homo sapiens
agtgtagcctagtggttaaggg

SEQ ID NO: 8173161 - DNA, 19 bp, Homo sapiens
agtgtagctaggatgtgct

SEQ ID NO: 8173162 - DNA, 22 bp, Homo sapiens
agtgtacatcagaacatatcaa

SEQ ID NO: 8173163 - DNA, 22 bp, Homo sapiens
agtgtacatcagaacatatcaa

SEQ ID NO: 8173164 - DNA, 22 bp, Homo sapiens
agtgtacagtttgtagtactac

SEQ ID NO: 8173165 - DNA, 22 bp, Homo sapiens
agtgtacagttctatgaatttc

SEQ ID NO: 8173166 - DNA, 22 bp, Homo sapiens
agtgtacagttctatgaatttc

SEQ ID NO: 8173167 - DNA, 20 bp, Homo sapiens
agtgtacagacactagaaat

SEQ ID NO: 8173168 - DNA, 21 bp, Homo sapiens
agtggggtctctgtggaggcc

SEQ ID NO: 8173169 - DNA, 22 bp, Homo sapiens
agtgtacaagaccttattgttg

SEQ ID NO: 8173170 - DNA, 22 bp, Homo sapiens
actgcagcaaagcccgtgtctt

SEQ ID NO: 8173171 - DNA, 22 bp, Homo sapiens
actgcagcaaagcccgtgtctt

SEQ ID NO: 8173172 - DNA, 21 bp, Homo sapiens
agtggggtctctgtggaggcc

SEQ ID NO: 8173173 - DNA, 21 bp, Homo sapiens
agtggggtctctgtggaggcc

SEQ ID NO: 8173174 - DNA, 22 bp, Homo sapiens
actgcactttaggccaactagg

SEQ ID NO: 8173175 - DNA, 22 bp, Homo sapiens
actgcagagcttttcagttgag

SEQ ID NO: 8173176 - DNA, 22 bp, Homo sapiens
actgcacttcagcctgggtgtc

SEQ ID NO: 8173177 - DNA, 22 bp, Homo sapiens
actgcacttcagcctgggtgtc

SEQ ID NO: 8173178 - DNA, 22 bp, Homo sapiens
actgcagactctacagttataa

SEQ ID NO: 8173179 - DNA, 22 bp, Homo sapiens
agtggcagtggctgggcagagc

SEQ ID NO: 8173180 - DNA, 22 bp, Homo sapiens
agtggcagtggctgggcagagc

SEQ ID NO: 8173181 - DNA, 22 bp, Homo sapiens
agtggcagtggctgggcagagc

SEQ ID NO: 8173182 - DNA, 22 bp, Homo sapiens
agtggcagtggctgggcagagc

SEQ ID NO: 8173183 - DNA, 22 bp, Homo sapiens
agtggcagtggaaagcacacgg

SEQ ID NO: 8173184 - DNA, 22 bp, Homo sapiens
actgcacttcagcctgggtgac

SEQ ID NO: 8173185 - DNA, 22 bp, Homo sapiens
actgcacttcagcctgggtgac

SEQ ID NO: 8173186 - DNA, 22 bp, Homo sapiens
actgcacttcagcctgggtgtc

SEQ ID NO: 8173187 - DNA, 22 bp, Homo sapiens
agtggcagtagatgagctggtt

SEQ ID NO: 8173188 - DNA, 22 bp, Homo sapiens
agtggcagtaacattccacaat

SEQ ID NO: 8173189 - DNA, 22 bp, Homo sapiens
agtggcagtagatgagctggtt

SEQ ID NO: 8173190 - DNA, 22 bp, Homo sapiens
agtggcagtagatgagctggtt

SEQ ID NO: 8173191 - DNA, 22 bp, Homo sapiens
agtggcaggtgtttcgtggtgc

SEQ ID NO: 8173192 - DNA, 22 bp, Homo sapiens
agtggcaggtgtttcgtggtgc

SEQ ID NO: 8173193 - DNA, 22 bp, Homo sapiens
agtggcaggtgtttcgtggtgc

SEQ ID NO: 8173194 - DNA, 22 bp, Homo sapiens
agtggcagggctggctgctgca

SEQ ID NO: 8173195 - DNA, 22 bp, Homo sapiens
agtggcagggctggctgctgca

SEQ ID NO: 8173196 - DNA, 22 bp, Homo sapiens
agtggcagggctggctgctgca

SEQ ID NO: 8173197 - DNA, 22 bp, Homo sapiens
agtggcagagctgtgtcttgaa

SEQ ID NO: 8173198 - DNA, 22 bp, Homo sapiens
agtggcagggctggctgctgca

SEQ ID NO: 8173199 - DNA, 21 bp, Homo sapiens
actgagggccagagaggacct

SEQ ID NO: 8173200 - DNA, 21 bp, Homo sapiens
actgagggccagagaggacct

SEQ ID NO: 8173201 - DNA, 22 bp, Homo sapiens
actgaggggctttcaggcccag

SEQ ID NO: 8173202 - DNA, 21 bp, Homo sapiens
actgagggccagagaggacct

SEQ ID NO: 8173203 - DNA, 22 bp, Homo sapiens
actgaggggttggagagtgagg

SEQ ID NO: 8173204 - DNA, 22 bp, Homo sapiens
actgaggggttggagagtgagg

SEQ ID NO: 8173205 - DNA, 22 bp, Homo sapiens
agtggcagagccagggttggga

SEQ ID NO: 8173206 - DNA, 22 bp, Homo sapiens
actgaggatggataggtcatat

SEQ ID NO: 8173207 - DNA, 22 bp, Homo sapiens
actgaggagaaatttgagtgaa

SEQ ID NO: 8173208 - DNA, 22 bp, Homo sapiens
actgaggacagtgaggagggct

SEQ ID NO: 8173209 - DNA, 22 bp, Homo sapiens
actgaggaacatatataagatg

SEQ ID NO: 8173210 - DNA, 22 bp, Homo sapiens
actgaggaacatatataagatg

SEQ ID NO: 8173211 - DNA, 22 bp, Homo sapiens
actgagctcttgactgggagtt

SEQ ID NO: 8173212 - DNA, 22 bp, Homo sapiens
actgagctgcaagtcagggagg

SEQ ID NO: 8173213 - DNA, 22 bp, Homo sapiens
actgaggattagcccaggctag

SEQ ID NO: 8173214 - DNA, 22 bp, Homo sapiens
actgaggcagaagggtaagtgg

SEQ ID NO: 8173215 - DNA, 22 bp, Homo sapiens
actgaggcagtgaggtcggtct

SEQ ID NO: 8173216 - DNA, 21 bp, Homo sapiens
actgaggcaatggatttttgt

SEQ ID NO: 8173217 - DNA, 22 bp, Homo sapiens
actgaggcccgaggatctcctg

SEQ ID NO: 8173218 - DNA, 22 bp, Homo sapiens
actgaggcagtgaggtcggtct

SEQ ID NO: 8173219 - DNA, 22 bp, Homo sapiens
actgaggcccgaggatctcctg

SEQ ID NO: 8173220 - DNA, 22 bp, Homo sapiens
actgaggcttaaagagattagg

SEQ ID NO: 8173221 - DNA, 22 bp, Homo sapiens
actgaggcgcagtccggctgtc

SEQ ID NO: 8173222 - DNA, 22 bp, Homo sapiens
actgaggctagattgctgttct

SEQ ID NO: 8173223 - DNA, 21 bp, Homo sapiens
actgagggccagagaggacct

SEQ ID NO: 8173224 - DNA, 22 bp, Homo sapiens
actgaggcttacaaaggtaaag

SEQ ID NO: 8173225 - DNA, 22 bp, Homo sapiens
agtgcatagggggatgcacagc

SEQ ID NO: 8173226 - DNA, 22 bp, Homo sapiens
agtgcatagctgcgaagcattt

SEQ ID NO: 8173227 - DNA, 22 bp, Homo sapiens
agtgcataatgaaggagcttga

SEQ ID NO: 8173228 - DNA, 22 bp, Homo sapiens
agtgcatgccttcctgtggatg

SEQ ID NO: 8173229 - DNA, 22 bp, Homo sapiens
agtgcatgccttcctgtggatg

SEQ ID NO: 8173230 - DNA, 22 bp, Homo sapiens
agtgcatgccttcctgtggatg

SEQ ID NO: 8173231 - DNA, 22 bp, Homo sapiens
agtgcatgcgcttgggaggggt

SEQ ID NO: 8173232 - DNA, 22 bp, Homo sapiens
agtgcatgcgcttgggaggggt

SEQ ID NO: 8173233 - DNA, 20 bp, Homo sapiens
actgagctgcatggagagga

SEQ ID NO: 8173234 - DNA, 22 bp, Homo sapiens
actgagctcttgactgggagtt

SEQ ID NO: 8173235 - DNA, 22 bp, Homo sapiens
agtgcatgtatctacagtcaca

SEQ ID NO: 8173236 - DNA, 22 bp, Homo sapiens
agtgcatgtatctacagtcaca

SEQ ID NO: 8173237 - DNA, 22 bp, Homo sapiens
agtgcatgtccagtagtttatg

SEQ ID NO: 8173238 - DNA, 23 bp, Homo sapiens
agtgcatgcttgacttagcaagc

SEQ ID NO: 8173239 - DNA, 18 bp, Homo sapiens
agtgcatgctaggggaag

SEQ ID NO: 8173240 - DNA, 18 bp, Homo sapiens
agtgcatgctaggggaag

SEQ ID NO: 8173241 - DNA, 19 bp, Homo sapiens
agtgcatgggcgaggtgca

SEQ ID NO: 8173242 - DNA, 19 bp, Homo sapiens
agtgcatgggcgaggtgca

SEQ ID NO: 8173243 - DNA, 20 bp, Homo sapiens
agtgcatggagggagagggc

SEQ ID NO: 8173244 - DNA, 20 bp, Homo sapiens
agtgcatggagggagagggc

SEQ ID NO: 8173245 - DNA, 20 bp, Homo sapiens
agtgcatggagggagagggc

SEQ ID NO: 8173246 - DNA, 22 bp, Homo sapiens
agtgcagggggaaagggtgtct

SEQ ID NO: 8173247 - DNA, 22 bp, Homo sapiens
agtgcagggggaaagggtgtct

SEQ ID NO: 8173248 - DNA, 22 bp, Homo sapiens
agtgcagggggaaagggtgtct

SEQ ID NO: 8173249 - DNA, 22 bp, Homo sapiens
agtgcagggggaaagggtgtct

SEQ ID NO: 8173250 - DNA, 22 bp, Homo sapiens
agtgcagggggaaagggtgtct

SEQ ID NO: 8173251 - DNA, 22 bp, Homo sapiens
agtgcaggttaaggaactggcc

SEQ ID NO: 8173252 - DNA, 22 bp, Homo sapiens
agtgcaggttaaggaactggcc

SEQ ID NO: 8173253 - DNA, 22 bp, Homo sapiens
agtgcaggttaaggaactggcc

SEQ ID NO: 8173254 - DNA, 22 bp, Homo sapiens
agtgcaggttaaggaactggcc

SEQ ID NO: 8173255 - DNA, 22 bp, Homo sapiens
agtgcaggttaaggaactggcc

SEQ ID NO: 8173256 - DNA, 22 bp, Homo sapiens
actcttcacacttgtctccagg

SEQ ID NO: 8173257 - DNA, 22 bp, Homo sapiens
actcttcaccgctactgaaata

SEQ ID NO: 8173258 - DNA, 22 bp, Homo sapiens
agtgcaatgaataacagccacc

SEQ ID NO: 8173259 - DNA, 22 bp, Homo sapiens
actctgtatccctctcaaattg

SEQ ID NO: 8173260 - DNA, 22 bp, Homo sapiens
actctgtcacctactcactgta

SEQ ID NO: 8173261 - DNA, 22 bp, Homo sapiens
actctgtagatgtggaaatgcg

SEQ ID NO: 8173262 - DNA, 22 bp, Homo sapiens
actctgtagagtataccaatgt

SEQ ID NO: 8173263 - DNA, 22 bp, Homo sapiens
actctgtagggacggttctccc

SEQ ID NO: 8173264 - DNA, 21 bp, Homo sapiens
actctgtcttgagccatctgt

SEQ ID NO: 8173265 - DNA, 22 bp, Homo sapiens
actctgtcacctactcactgta

SEQ ID NO: 8173266 - DNA, 22 bp, Homo sapiens
actctgtgaagtcttattatgc

SEQ ID NO: 8173267 - DNA, 22 bp, Homo sapiens
actctgtgaagatgcaggcttg

SEQ ID NO: 8173268 - DNA, 22 bp, Homo sapiens
actctgtgggtgagcctggaca

SEQ ID NO: 8173269 - DNA, 22 bp, Homo sapiens
actctgtgtgagtagagcctgt

SEQ ID NO: 8173270 - DNA, 22 bp, Homo sapiens
actctgtgtgagtagagcctgt

SEQ ID NO: 8173271 - DNA, 22 bp, Homo sapiens
actctgtgccaggcactttggg

SEQ ID NO: 8173272 - DNA, 22 bp, Homo sapiens
actcttatagtattggttatta

SEQ ID NO: 8173273 - DNA, 22 bp, Homo sapiens
actcttatggaaattttaacta

SEQ ID NO: 8173274 - DNA, 22 bp, Homo sapiens
actctgtgttttggtggcagca

SEQ ID NO: 8173275 - DNA, 22 bp, Homo sapiens
agtctttaacatttggagattg

SEQ ID NO: 8173276 - DNA, 18 bp, Homo sapiens
agtcttgttctgttgccc

SEQ ID NO: 8173277 - DNA, 18 bp, Homo sapiens
agtcttgttctgttgccc

SEQ ID NO: 8173278 - DNA, 20 bp, Homo sapiens
actctgtactgtcaatgttg

SEQ ID NO: 8173279 - DNA, 20 bp, Homo sapiens
actctgtactgtcaatgttg

SEQ ID NO: 8173280 - DNA, 22 bp, Homo sapiens
actctgtacgcaagagatggag

SEQ ID NO: 8173281 - DNA, 22 bp, Homo sapiens
agtctttactaaacagaccacc

SEQ ID NO: 8173282 - DNA, 22 bp, Homo sapiens
agtctttacatgtgttatatat

SEQ ID NO: 8173283 - DNA, 22 bp, Homo sapiens
agtctttaagtaatgataggca

SEQ ID NO: 8173284 - DNA, 22 bp, Homo sapiens
agtcttgctcttgcatctgctt

SEQ ID NO: 8173285 - DNA, 22 bp, Homo sapiens
agtcttgcattttctgaagatg

SEQ ID NO: 8173286 - DNA, 22 bp, Homo sapiens
agtcttcttgatcttttcagtg

SEQ ID NO: 8173287 - DNA, 22 bp, Homo sapiens
agtcttctttcatttactcagt

SEQ ID NO: 8173288 - DNA, 22 bp, Homo sapiens
agtcttctgggtgtttccagag

SEQ ID NO: 8173289 - DNA, 20 bp, Homo sapiens
agtctgtcaatttacagtgg

SEQ ID NO: 8173290 - DNA, 22 bp, Homo sapiens
agtctgtcagtcattctaacaa

SEQ ID NO: 8173291 - DNA, 22 bp, Homo sapiens
actctaaaatgctatgagatct

SEQ ID NO: 8173292 - DNA, 20 bp, Homo sapiens
agtctgtcaatttacagtgg

SEQ ID NO: 8173293 - DNA, 22 bp, Homo sapiens
actcggcagcctgagagttcac

SEQ ID NO: 8173294 - DNA, 23 bp, Homo sapiens
actcgtggaattctctgcgatcg

SEQ ID NO: 8173295 - DNA, 23 bp, Homo sapiens
actcgtggaattctctgcgatcg

SEQ ID NO: 8173296 - DNA, 22 bp, Homo sapiens
actctaaaagtgaagtgtggtc

SEQ ID NO: 8173297 - DNA, 21 bp, Homo sapiens
agtcccaggggtgagtgatgt

SEQ ID NO: 8173298 - DNA, 22 bp, Homo sapiens
agtcccagtgacttggccagaa

SEQ ID NO: 8173299 - DNA, 22 bp, Homo sapiens
agtcccaggcagccgagccggt

SEQ ID NO: 8173300 - DNA, 22 bp, Homo sapiens
agtcccagcttcccccatgcag

SEQ ID NO: 8173301 - DNA, 22 bp, Homo sapiens
agtcccagcttcccccatgcag

SEQ ID NO: 8173302 - DNA, 22 bp, Homo sapiens
agtcccagtgagatgagccacg

SEQ ID NO: 8173303 - DNA, 22 bp, Homo sapiens
agtcccagtgagatgagccacg

SEQ ID NO: 8173304 - DNA, 22 bp, Homo sapiens
agtcccagtgagatgaaccagg

SEQ ID NO: 8173305 - DNA, 22 bp, Homo sapiens
agtcccagttcggttcttcctc

SEQ ID NO: 8173306 - DNA, 22 bp, Homo sapiens
agtcccagtgagatgagccacg

SEQ ID NO: 8173307 - DNA, 22 bp, Homo sapiens
agtcccagtgagatgagccacg

SEQ ID NO: 8173308 - DNA, 17 bp, Homo sapiens
actcctggtctgaaggg

SEQ ID NO: 8173309 - DNA, 22 bp, Homo sapiens
actcctggtgctgatgaagaga

SEQ ID NO: 8173310 - DNA, 22 bp, Homo sapiens
actcctggtgctgatgaagaga

SEQ ID NO: 8173311 - DNA, 22 bp, Homo sapiens
actcctggttcccagttgagat

SEQ ID NO: 8173312 - DNA, 22 bp, Homo sapiens
actcctggtttgtgtcctggct

SEQ ID NO: 8173313 - DNA, 22 bp, Homo sapiens
actcctggtttgtgtcctggct

SEQ ID NO: 8173314 - DNA, 22 bp, Homo sapiens
actcctgtgaggtaggtggcaa

SEQ ID NO: 8173315 - DNA, 22 bp, Homo sapiens
actcctgtgtggctgggaggtt

SEQ ID NO: 8173316 - DNA, 22 bp, Homo sapiens
actcctgtgggcatggcacccc

SEQ ID NO: 8173317 - DNA, 17 bp, Homo sapiens
actcctggtctgaaggg

SEQ ID NO: 8173318 - DNA, 17 bp, Homo sapiens
actcctggtctgaaggg

SEQ ID NO: 8173319 - DNA, 20 bp, Homo sapiens
actcctggtaacttttgtga

SEQ ID NO: 8173320 - DNA, 22 bp, Homo sapiens
actcctgggttgcagtcctcaa

SEQ ID NO: 8173321 - DNA, 22 bp, Homo sapiens
actcctgggttgcagtcctcaa

SEQ ID NO: 8173322 - DNA, 18 bp, Homo sapiens
agtcccatcttcagctct

SEQ ID NO: 8173323 - DNA, 22 bp, Homo sapiens
actcctgggttctaaatttgaa

SEQ ID NO: 8173324 - DNA, 22 bp, Homo sapiens
actcctgggttccggagattct

SEQ ID NO: 8173325 - DNA, 22 bp, Homo sapiens
atacatctatgcctttctgaca

SEQ ID NO: 8173326 - DNA, 22 bp, Homo sapiens
atacatgttcgtgtacatgttc

SEQ ID NO: 8173327 - DNA, 22 bp, Homo sapiens
atacatgttcgtgtacatgttc

SEQ ID NO: 8173328 - DNA, 22 bp, Homo sapiens
atacatgttcgtgtacatgttc

SEQ ID NO: 8173329 - DNA, 22 bp, Homo sapiens
atacatgttcgtgtacatgttc

SEQ ID NO: 8173330 - DNA, 22 bp, Homo sapiens
atacatgttgagaaaatatctg

SEQ ID NO: 8173331 - DNA, 22 bp, Homo sapiens
atacatgttgagaaaatatctg

SEQ ID NO: 8173332 - DNA, 22 bp, Homo sapiens
acttcttcttcagctgggggat

SEQ ID NO: 8173333 - DNA, 22 bp, Homo sapiens
acttctgtatgtcctgcattca

SEQ ID NO: 8173334 - DNA, 22 bp, Homo sapiens
acttctgtcctccaagccacgt

SEQ ID NO: 8173335 - DNA, 22 bp, Homo sapiens
acttctgtcctccaagccacgt

SEQ ID NO: 8173336 - DNA, 22 bp, Homo sapiens
acttctgtatgtcctgcattca

SEQ ID NO: 8173337 - DNA, 22 bp, Homo sapiens
acttctgtatgtcctgcattca

SEQ ID NO: 8173338 - DNA, 22 bp, Homo sapiens
acttctgtaaagggaagacagt

SEQ ID NO: 8173339 - DNA, 22 bp, Homo sapiens
acttctgtaaagggaagacagt

SEQ ID NO: 8173340 - DNA, 22 bp, Homo sapiens
acttctggtgtcatactgcatt

SEQ ID NO: 8173341 - DNA, 22 bp, Homo sapiens
acttctggatagagtcagcttt

SEQ ID NO: 8173342 - DNA, 22 bp, Homo sapiens
acttctggaggcctagggaaga

SEQ ID NO: 8173343 - DNA, 22 bp, Homo sapiens
atacatgttgagaaaatatctg

SEQ ID NO: 8173344 - DNA, 22 bp, Homo sapiens
atacatgttgagaaaatatctg

SEQ ID NO: 8173345 - DNA, 22 bp, Homo sapiens
atacatgttgtaccatatgttt

SEQ ID NO: 8173346 - DNA, 22 bp, Homo sapiens
atacatgttgtaccatatgttt

SEQ ID NO: 8173347 - DNA, 22 bp, Homo sapiens
atacatgttgtaccatatgttt

SEQ ID NO: 8173348 - DNA, 22 bp, Homo sapiens
atacattagctcatatgattaa

SEQ ID NO: 8173349 - DNA, 22 bp, Homo sapiens
atacattagctcatatgattaa

SEQ ID NO: 8173350 - DNA, 22 bp, Homo sapiens
atacattagctcatatgattaa

SEQ ID NO: 8173351 - DNA, 22 bp, Homo sapiens
atacattagctcatatgattaa

SEQ ID NO: 8173352 - DNA, 22 bp, Homo sapiens
atacattagtgaacaaaagaga

SEQ ID NO: 8173353 - DNA, 22 bp, Homo sapiens
atacattagtgaacaaaagaga

SEQ ID NO: 8173354 - DNA, 22 bp, Homo sapiens
atacattattgttaaagaacat

SEQ ID NO: 8173355 - DNA, 22 bp, Homo sapiens
atactgtaatacctaaatgaac

SEQ ID NO: 8173356 - DNA, 22 bp, Homo sapiens
atactgtaatacctaaatgaac

SEQ ID NO: 8173357 - DNA, 22 bp, Homo sapiens
atactgtaatacctaaatgaac

SEQ ID NO: 8173358 - DNA, 22 bp, Homo sapiens
atactgtacgtcccagatagga

SEQ ID NO: 8173359 - DNA, 22 bp, Homo sapiens
atactgattgatattcccatga

SEQ ID NO: 8173360 - DNA, 22 bp, Homo sapiens
atactgctgctgctgaaatcac

SEQ ID NO: 8173361 - DNA, 22 bp, Homo sapiens
atacattattgttaaagaacat

SEQ ID NO: 8173362 - DNA, 22 bp, Homo sapiens
atactgaaggcattcagataac

SEQ ID NO: 8173363 - DNA, 22 bp, Homo sapiens
atactgaattaggtaaagcata

SEQ ID NO: 8173364 - DNA, 23 bp, Homo sapiens
actttatcctatatctttgttct

SEQ ID NO: 8173365 - DNA, 22 bp, Homo sapiens
actttatcaggaatcacacagc

SEQ ID NO: 8173366 - DNA, 22 bp, Homo sapiens
actttatttcctattgcatcca

SEQ ID NO: 8173367 - DNA, 22 bp, Homo sapiens
actttcaaatatcatgattcta

SEQ ID NO: 8173368 - DNA, 22 bp, Homo sapiens
actttatttcctattgcatcca

SEQ ID NO: 8173369 - DNA, 22 bp, Homo sapiens
atactgtatatttcacatcttg

SEQ ID NO: 8173370 - DNA, 22 bp, Homo sapiens
atactgtatcacttgtgagtga

SEQ ID NO: 8173371 - DNA, 22 bp, Homo sapiens
atactgtagttgtccaactatc

SEQ ID NO: 8173372 - DNA, 22 bp, Homo sapiens
atactgtagaggcatagctagt

SEQ ID NO: 8173373 - DNA, 22 bp, Homo sapiens
atactgtagaggcatagctagt

SEQ ID NO: 8173374 - DNA, 22 bp, Homo sapiens
acttctcttccccggaactcta

SEQ ID NO: 8173375 - DNA, 22 bp, Homo sapiens
acttctcttccccggaactcta

SEQ ID NO: 8173376 - DNA, 22 bp, Homo sapiens
acttctctttagtactaaatgt

SEQ ID NO: 8173377 - DNA, 22 bp, Homo sapiens
acttctcttccccggaactcta

SEQ ID NO: 8173378 - DNA, 19 bp, Homo sapiens
acttctgaggaactgcaca

SEQ ID NO: 8173379 - DNA, 22 bp, Homo sapiens
acttctctttagtactaaatgt

SEQ ID NO: 8173380 - DNA, 22 bp, Homo sapiens
acttctctttagtactaaatgt

SEQ ID NO: 8173381 - DNA, 19 bp, Homo sapiens
acttctgaggaactgcaca

SEQ ID NO: 8173382 - DNA, 22 bp, Homo sapiens
acttctgcaggtggtgactgaa

SEQ ID NO: 8173383 - DNA, 22 bp, Homo sapiens
acttctgcaggtggtgactgaa

SEQ ID NO: 8173384 - DNA, 22 bp, Homo sapiens
acttctgcttgcccagtgacta

SEQ ID NO: 8173385 - DNA, 22 bp, Homo sapiens
atacagcttacagttctaatgc

SEQ ID NO: 8173386 - DNA, 22 bp, Homo sapiens
atacagccagcttcctgacctt

SEQ ID NO: 8173387 - DNA, 22 bp, Homo sapiens
atacagcagtgaataagataaa

SEQ ID NO: 8173388 - DNA, 22 bp, Homo sapiens
atacagggacatccagtttttc

SEQ ID NO: 8173389 - DNA, 22 bp, Homo sapiens
atacagctttctttcacatgag

SEQ ID NO: 8173390 - DNA, 22 bp, Homo sapiens
atacagcttatgcatatatctc

SEQ ID NO: 8173391 - DNA, 22 bp, Homo sapiens
atacagcttacagttctaatgc

SEQ ID NO: 8173392 - DNA, 22 bp, Homo sapiens
acttactactcctttgcaattt

SEQ ID NO: 8173393 - DNA, 22 bp, Homo sapiens
atacagatgttaaagcaatttc

SEQ ID NO: 8173394 - DNA, 22 bp, Homo sapiens
atacacttgtacattttttaat

SEQ ID NO: 8173395 - DNA, 22 bp, Homo sapiens
atacagatgttaaagcaatttc

SEQ ID NO: 8173396 - DNA, 22 bp, Homo sapiens
acttaacagacattatttacct

SEQ ID NO: 8173397 - DNA, 21 bp, Homo sapiens
acttaaattccttgatattta

SEQ ID NO: 8173398 - DNA, 22 bp, Homo sapiens
acttaaagttataatttgctaa

SEQ ID NO: 8173399 - DNA, 21 bp, Homo sapiens
acttaaattccttgatattta

SEQ ID NO: 8173400 - DNA, 22 bp, Homo sapiens
ataatgcatttagaataattca

SEQ ID NO: 8173401 - DNA, 22 bp, Homo sapiens
ataatgccattgtctcatccag

SEQ ID NO: 8173402 - DNA, 22 bp, Homo sapiens
ataatgcatttagaataattca

SEQ ID NO: 8173403 - DNA, 22 bp, Homo sapiens
acttaaagttataatttgctaa

SEQ ID NO: 8173404 - DNA, 22 bp, Homo sapiens
actgtattggaaatatagcaaa

SEQ ID NO: 8173405 - DNA, 22 bp, Homo sapiens
actgtatttccaacagacaaat

SEQ ID NO: 8173406 - DNA, 22 bp, Homo sapiens
actgtcaaatgcaatgaactca

SEQ ID NO: 8173407 - DNA, 22 bp, Homo sapiens
actgtcaaatgcaatgaactca

SEQ ID NO: 8173408 - DNA, 22 bp, Homo sapiens
actgtattttgggtgtattttc

SEQ ID NO: 8173409 - DNA, 22 bp, Homo sapiens
actgtatttttgaatcattgtg

SEQ ID NO: 8173410 - DNA, 22 bp, Homo sapiens
actgtattctagtcatgtttgt

SEQ ID NO: 8173411 - DNA, 22 bp, Homo sapiens
actgtatagtatttattcttag

SEQ ID NO: 8173412 - DNA, 22 bp, Homo sapiens
actgtatagatggagttgattt

SEQ ID NO: 8173413 - DNA, 22 bp, Homo sapiens
actgtagtctaaatatagtctt

SEQ ID NO: 8173414 - DNA, 22 bp, Homo sapiens
actgtcatcagaagatgaaaat

SEQ ID NO: 8173415 - DNA, 22 bp, Homo sapiens
actgtcatcttgtaagcaatgt

SEQ ID NO: 8173416 - DNA, 22 bp, Homo sapiens
ataaaaactgacccatcctttg

SEQ ID NO: 8173417 - DNA, 22 bp, Homo sapiens
actgtcatctggtagatgatgg

SEQ ID NO: 8173418 - DNA, 22 bp, Homo sapiens
ataaaaactgacccatcctttg

SEQ ID NO: 8173419 - DNA, 22 bp, Homo sapiens
actgtcacttgcaactgtgagg

SEQ ID NO: 8173420 - DNA, 22 bp, Homo sapiens
actgtcacttgcaactgtgagg

SEQ ID NO: 8173421 - DNA, 22 bp, Homo sapiens
actgtcactgtgatgttagaga

SEQ ID NO: 8173422 - DNA, 22 bp, Homo sapiens
actgtcacttgcaactgtgagg

SEQ ID NO: 8173423 - DNA, 22 bp, Homo sapiens
actgtcactgacagaatcaaca

SEQ ID NO: 8173424 - DNA, 22 bp, Homo sapiens
actgtcaagagattcaaattca

SEQ ID NO: 8173425 - DNA, 19 bp, Homo sapiens
actgtcacataaaggaagg

SEQ ID NO: 8173426 - DNA, 19 bp, Homo sapiens
actgtcacataaaggaagg

SEQ ID NO: 8173427 - DNA, 22 bp, Homo sapiens
actgtcactccaactgagtcgt

SEQ ID NO: 8173428 - DNA, 22 bp, Homo sapiens
actgtcactccaactgagtcgt

SEQ ID NO: 8173429 - DNA, 22 bp, Homo sapiens
actgtcactaactaagtctagt

SEQ ID NO: 8173430 - DNA, 22 bp, Homo sapiens
actgtcaccatcagagcgggaa

SEQ ID NO: 8173431 - DNA, 23 bp, Homo sapiens
actgggaagtttggagagacgca

SEQ ID NO: 8173432 - DNA, 22 bp, Homo sapiens
actgggaagtcagagagaggct

SEQ ID NO: 8173433 - DNA, 22 bp, Homo sapiens
actgggagaaactgacacctta

SEQ ID NO: 8173434 - DNA, 22 bp, Homo sapiens
actgggactgtatgtgctggac

SEQ ID NO: 8173435 - DNA, 22 bp, Homo sapiens
actgggagagtttgcttataat

SEQ ID NO: 8173436 - DNA, 22 bp, Homo sapiens
actgggagagtttgcttataat

SEQ ID NO: 8173437 - DNA, 22 bp, Homo sapiens
actgggagagcgaccagattct

SEQ ID NO: 8173438 - DNA, 22 bp, Homo sapiens
actgggagagcgaccagattct

SEQ ID NO: 8173439 - DNA, 21 bp, Homo sapiens
actgggagaacgagcctttcc

SEQ ID NO: 8173440 - DNA, 22 bp, Homo sapiens
actgggaagagagaattctgtc

SEQ ID NO: 8173441 - DNA, 19 bp, Homo sapiens
actgggaaaaaggcactgg

SEQ ID NO: 8173442 - DNA, 22 bp, Homo sapiens
actgggaaagtgctgcctgcag

SEQ ID NO: 8173443 - DNA, 22 bp, Homo sapiens
actgggaacaaggtgctcagcg

SEQ ID NO: 8173444 - DNA, 22 bp, Homo sapiens
actgtacatgtaaacattgtca

SEQ ID NO: 8173445 - DNA, 22 bp, Homo sapiens
actgtacatgtaaacattgtca

SEQ ID NO: 8173446 - DNA, 22 bp, Homo sapiens
actgtaaattttggttgcaggt

SEQ ID NO: 8173447 - DNA, 20 bp, Homo sapiens
actgggagctaacggagatt

SEQ ID NO: 8173448 - DNA, 20 bp, Homo sapiens
actgggagctaacggagatt

SEQ ID NO: 8173449 - DNA, 22 bp, Homo sapiens
actgtacatgtaaacattgtca

SEQ ID NO: 8173450 - DNA, 22 bp, Homo sapiens
actgtagagaatctgagaaaaa

SEQ ID NO: 8173451 - DNA, 22 bp, Homo sapiens
actgtagaggcctggattgagg

SEQ ID NO: 8173452 - DNA, 22 bp, Homo sapiens
actgtagctgccactggatgca

SEQ ID NO: 8173453 - DNA, 22 bp, Homo sapiens
actgtagtctaaatatagtctt

SEQ ID NO: 8173454 - DNA, 22 bp, Homo sapiens
actgtacttacgcatatacagg

SEQ ID NO: 8173455 - DNA, 22 bp, Homo sapiens
ataatctgtggatggttttgag

SEQ ID NO: 8173456 - DNA, 22 bp, Homo sapiens
ataatcttgtatttcctaaagt

SEQ ID NO: 8173457 - DNA, 22 bp, Homo sapiens
ataatctggtctttgtatgagt

SEQ ID NO: 8173458 - DNA, 22 bp, Homo sapiens
ataatctgacaaagacttaagc

SEQ ID NO: 8173459 - DNA, 22 bp, Homo sapiens
ataatccatgtctagagtaaag

SEQ ID NO: 8173460 - DNA, 22 bp, Homo sapiens
ataatgaatgcagagttatttt

SEQ ID NO: 8173461 - DNA, 22 bp, Homo sapiens
ataatgaatgcagagttatttt

SEQ ID NO: 8173462 - DNA, 22 bp, Homo sapiens
ataatgagcttttgaatactga

SEQ ID NO: 8173463 - DNA, 22 bp, Homo sapiens
ataatgagcttttgaatactga

SEQ ID NO: 8173464 - DNA, 22 bp, Homo sapiens
actgtgcaggtagatgcctggg

SEQ ID NO: 8173465 - DNA, 22 bp, Homo sapiens
actgtgcaccctggacagtgtc

SEQ ID NO: 8173466 - DNA, 22 bp, Homo sapiens
actgtgcattccccaacctgtg

SEQ ID NO: 8173467 - DNA, 22 bp, Homo sapiens
actgtgccacaattcaccaggg

SEQ ID NO: 8173468 - DNA, 22 bp, Homo sapiens
ataaggttggtcttaactacct

SEQ ID NO: 8173469 - DNA, 22 bp, Homo sapiens
ataaacagtaaatgtgagcagt

SEQ ID NO: 8173470 - DNA, 22 bp, Homo sapiens
ataaacagtaaatgtgagcagt

SEQ ID NO: 8173471 - DNA, 21 bp, Homo sapiens
ataaacagcatgtgatccatg

SEQ ID NO: 8173472 - DNA, 22 bp, Homo sapiens
actgtgatgttctctatcttgg

SEQ ID NO: 8173473 - DNA, 22 bp, Homo sapiens
actgtgagtgatttccttctgg

SEQ ID NO: 8173474 - DNA, 21 bp, Homo sapiens
actgtgataatgctttttctg

SEQ ID NO: 8173475 - DNA, 22 bp, Homo sapiens
actgtgagtgatttccttctgg

SEQ ID NO: 8173476 - DNA, 22 bp, Homo sapiens
actgtgcaatgagtaataaact

SEQ ID NO: 8173477 - DNA, 22 bp, Homo sapiens
actgtgcaaatgacaggcacac

SEQ ID NO: 8173478 - DNA, 22 bp, Homo sapiens
actgtgcaaatgacaggcacac

SEQ ID NO: 8173479 - DNA, 22 bp, Homo sapiens
ataaaatttgctactgttaaat

SEQ ID NO: 8173480 - DNA, 22 bp, Homo sapiens
ataaaatttgctactgttaaat

SEQ ID NO: 8173481 - DNA, 22 bp, Homo sapiens
ataaaatttgctactgttaaat

SEQ ID NO: 8173482 - DNA, 22 bp, Homo sapiens
ataaacaagactggccaacttt

SEQ ID NO: 8173483 - DNA, 22 bp, Homo sapiens
ataaaatggtaaacgaagctga

SEQ ID NO: 8173484 - DNA, 22 bp, Homo sapiens
ataaaatggtaaacgaagctga

SEQ ID NO: 8173485 - DNA, 22 bp, Homo sapiens
ataaaaactgacccatcctttg

SEQ ID NO: 8173486 - DNA, 22 bp, Homo sapiens
ataaaatgtctccactgggctc

SEQ ID NO: 8173487 - DNA, 22 bp, Homo sapiens
ataaaatttgctactgttaaat

SEQ ID NO: 8173488 - DNA, 22 bp, Homo sapiens
ataaaatttgctactgttaaat

SEQ ID NO: 8173489 - DNA, 22 bp, Homo sapiens
ataaaatttgctactgttaaat

SEQ ID NO: 8173490 - DNA, 22 bp, Homo sapiens
atcctttataagacttgtattc

SEQ ID NO: 8173491 - DNA, 22 bp, Homo sapiens
atcctgggcaaagtatgctgtc

SEQ ID NO: 8173492 - DNA, 18 bp, Homo sapiens
atcctgggagcagacagc

SEQ ID NO: 8173493 - DNA, 18 bp, Homo sapiens
atcctgggagcagacagc

SEQ ID NO: 8173494 - DNA, 22 bp, Homo sapiens
atcatcttatctgactcatttt

SEQ ID NO: 8173495 - DNA, 22 bp, Homo sapiens
atcatcttaaggtatctcaagc

SEQ ID NO: 8173496 - DNA, 22 bp, Homo sapiens
atcatcttaaatctagaatgtg

SEQ ID NO: 8173497 - DNA, 22 bp, Homo sapiens
atcatcttaaatctagaatgtg

SEQ ID NO: 8173498 - DNA, 22 bp, Homo sapiens
atcatcttaaggtatctcaagc

SEQ ID NO: 8173499 - DNA, 22 bp, Homo sapiens
atcatcttgaaagtctatgttt

SEQ ID NO: 8173500 - DNA, 22 bp, Homo sapiens
atcatcttgaaagtctatgttt

SEQ ID NO: 8173501 - DNA, 22 bp, Homo sapiens
atcatcttcgaaaaaagtcaga

SEQ ID NO: 8173502 - DNA, 22 bp, Homo sapiens
atcatcttcatattcctcagct

SEQ ID NO: 8173503 - DNA, 22 bp, Homo sapiens
atcatcattcttggataaagca

SEQ ID NO: 8173504 - DNA, 22 bp, Homo sapiens
atcatccaagcgtagttcttct

SEQ ID NO: 8173505 - DNA, 22 bp, Homo sapiens
atcatccactggagccggcagg

SEQ ID NO: 8173506 - DNA, 22 bp, Homo sapiens
atcatccaagcgtagttcttct

SEQ ID NO: 8173507 - DNA, 22 bp, Homo sapiens
atcatccatctagcgcgggggg

SEQ ID NO: 8173508 - DNA, 22 bp, Homo sapiens
agaacaggaggaagccagctcc

SEQ ID NO: 8173509 - DNA, 22 bp, Homo sapiens
agaacaggcagttggttggatt

SEQ ID NO: 8173510 - DNA, 19 bp, Homo sapiens
atcatcctgggtcatgcac

SEQ ID NO: 8173511 - DNA, 19 bp, Homo sapiens
atcatcctgggtcatgcac

SEQ ID NO: 8173512 - DNA, 22 bp, Homo sapiens
atcatcgtcccttctcttgtca

SEQ ID NO: 8173513 - DNA, 19 bp, Homo sapiens
atcatcctgggtcatgcac

SEQ ID NO: 8173514 - DNA, 22 bp, Homo sapiens
atcatcctattgtgccccaggt

SEQ ID NO: 8173515 - DNA, 22 bp, Homo sapiens
atcatccatggctgatcataaa

SEQ ID NO: 8173516 - DNA, 22 bp, Homo sapiens
atcatccagtttttcagcctct

SEQ ID NO: 8173517 - DNA, 22 bp, Homo sapiens
atcatcctattgtgccccaggt

SEQ ID NO: 8173518 - DNA, 22 bp, Homo sapiens
atcatctggcattcagattggc

SEQ ID NO: 8173519 - DNA, 22 bp, Homo sapiens
atcatctaaattgagtccagct

SEQ ID NO: 8173520 - DNA, 22 bp, Homo sapiens
atcatctagtttaactttcttt

SEQ ID NO: 8173521 - DNA, 20 bp, Homo sapiens
atcatctcaaagctgaggtt

SEQ ID NO: 8173522 - DNA, 22 bp, Homo sapiens
atctcaaacatctttgaccata

SEQ ID NO: 8173523 - DNA, 22 bp, Homo sapiens
atctaataccctctttatttct

SEQ ID NO: 8173524 - DNA, 22 bp, Homo sapiens
atctcaaatgattacaccaagc

SEQ ID NO: 8173525 - DNA, 22 bp, Homo sapiens
atctcacatcctcagtagtgca

SEQ ID NO: 8173526 - DNA, 21 bp, Homo sapiens
atctcacagcccagagaagcc

SEQ ID NO: 8173527 - DNA, 21 bp, Homo sapiens
atctcacagcccagagaagcc

SEQ ID NO: 8173528 - DNA, 22 bp, Homo sapiens
atctaaagtgtcataagtagct

SEQ ID NO: 8173529 - DNA, 20 bp, Homo sapiens
atcggcttgcctggaaacaa

SEQ ID NO: 8173530 - DNA, 22 bp, Homo sapiens
atctaaaaggagctctttatct

SEQ ID NO: 8173531 - DNA, 22 bp, Homo sapiens
atctaaaaggagctctttatct

SEQ ID NO: 8173532 - DNA, 22 bp, Homo sapiens
agaacagaggccttatgtttca

SEQ ID NO: 8173533 - DNA, 22 bp, Homo sapiens
agaacagaggccttatgtttca

SEQ ID NO: 8173534 - DNA, 22 bp, Homo sapiens
agaacagaggccttatgtttca

SEQ ID NO: 8173535 - DNA, 22 bp, Homo sapiens
agaacacttttaaatggcttgt

SEQ ID NO: 8173536 - DNA, 22 bp, Homo sapiens
agaacagcagttatggttcatt

SEQ ID NO: 8173537 - DNA, 22 bp, Homo sapiens
agaacagccaactgtgtaggag

SEQ ID NO: 8173538 - DNA, 22 bp, Homo sapiens
agaacagcagcacgtcaagctg

SEQ ID NO: 8173539 - DNA, 22 bp, Homo sapiens
agaacagcagtagtatacagta

SEQ ID NO: 8173540 - DNA, 22 bp, Homo sapiens
agaacagcaggaaggccaggta

SEQ ID NO: 8173541 - DNA, 22 bp, Homo sapiens
agaacagcagcacgtcaagctg

SEQ ID NO: 8173542 - DNA, 22 bp, Homo sapiens
agaaattatgcagtagttttat

SEQ ID NO: 8173543 - DNA, 22 bp, Homo sapiens
agaacactgctagtataatcac

SEQ ID NO: 8173544 - DNA, 22 bp, Homo sapiens
agaacactgtaaagtcattgaa

SEQ ID NO: 8173545 - DNA, 22 bp, Homo sapiens
agaacactctcctgaaaattaa

SEQ ID NO: 8173546 - DNA, 22 bp, Homo sapiens
agaacacatagagaagttttat

SEQ ID NO: 8173547 - DNA, 22 bp, Homo sapiens
agaacactgctagtataatcac

SEQ ID NO: 8173548 - DNA, 23 bp, Homo sapiens
agaaagtttgtgccttgtgacac

SEQ ID NO: 8173549 - DNA, 22 bp, Homo sapiens
agaaagtttggggctgggcacg

SEQ ID NO: 8173550 - DNA, 22 bp, Homo sapiens
agaaagtttatttcttgatgga

SEQ ID NO: 8173551 - DNA, 22 bp, Homo sapiens
agaaagtttgagaactgtagat

SEQ ID NO: 8173552 - DNA, 22 bp, Homo sapiens
agaaagtttgagaactgtagat

SEQ ID NO: 8173553 - DNA, 22 bp, Homo sapiens
agaaagtttattcctatctagc

SEQ ID NO: 8173554 - DNA, 22 bp, Homo sapiens
agaaagtttattcctatctagc

SEQ ID NO: 8173555 - DNA, 22 bp, Homo sapiens
agaaagggttctctgaggtgct

SEQ ID NO: 8173556 - DNA, 22 bp, Homo sapiens
agaaagggttctctgaggtgct

SEQ ID NO: 8173557 - DNA, 22 bp, Homo sapiens
agaaaggtcacttagcctcagc

SEQ ID NO: 8173558 - DNA, 22 bp, Homo sapiens
agaaaggtcaaaatcgtgacat

SEQ ID NO: 8173559 - DNA, 22 bp, Homo sapiens
agaaagggttctctgaggtgct

SEQ ID NO: 8173560 - DNA, 22 bp, Homo sapiens
agaaagggttctctgaggtgct

SEQ ID NO: 8173561 - DNA, 22 bp, Homo sapiens
agaaagggttctctgaggtgct

SEQ ID NO: 8173562 - DNA, 23 bp, Homo sapiens
agaaagtcatggccaggtttgat

SEQ ID NO: 8173563 - DNA, 22 bp, Homo sapiens
agaaaggtggatgctctggaat

SEQ ID NO: 8173564 - DNA, 22 bp, Homo sapiens
agaaagggctattttgaggtag

SEQ ID NO: 8173565 - DNA, 22 bp, Homo sapiens
agaaagggtcactgaaagagga

SEQ ID NO: 8173566 - DNA, 22 bp, Homo sapiens
agaaagggctattttgaggtag

SEQ ID NO: 8173567 - DNA, 22 bp, Homo sapiens
agaaagggctattttgaggtag

SEQ ID NO: 8173568 - DNA, 22 bp, Homo sapiens
agaaagggttctctgaggtgct

SEQ ID NO: 8173569 - DNA, 22 bp, Homo sapiens
agaaagggttctctgaggtgct

SEQ ID NO: 8173570 - DNA, 22 bp, Homo sapiens
agaaagggtcactgaaagagga

SEQ ID NO: 8173571 - DNA, 22 bp, Homo sapiens
agaaagggtcactgaaagagga

SEQ ID NO: 8173572 - DNA, 22 bp, Homo sapiens
agaaagggtcactgaaagagga

SEQ ID NO: 8173573 - DNA, 22 bp, Homo sapiens
agaaagggtcactgaaagagga

SEQ ID NO: 8173574 - DNA, 22 bp, Homo sapiens
agaaagttatcacaaaattgag

SEQ ID NO: 8173575 - DNA, 22 bp, Homo sapiens
agaaagttcactggtatatttt

SEQ ID NO: 8173576 - DNA, 22 bp, Homo sapiens
agaaagttatcacaaaattgag

SEQ ID NO: 8173577 - DNA, 22 bp, Homo sapiens
agaaagttagcagactcttggc

SEQ ID NO: 8173578 - DNA, 22 bp, Homo sapiens
agaaagttagcagactcttggc

SEQ ID NO: 8173579 - DNA, 22 bp, Homo sapiens
agaaagttgttttagccaaacc

SEQ ID NO: 8173580 - DNA, 22 bp, Homo sapiens
agaaagttgttttagccaaacc

SEQ ID NO: 8173581 - DNA, 22 bp, Homo sapiens
agaaagttgttggaggaaatga

SEQ ID NO: 8173582 - DNA, 22 bp, Homo sapiens
agaaagttgttggaggaaatga

SEQ ID NO: 8173583 - DNA, 22 bp, Homo sapiens
agaaagttctgtgagttgttca

SEQ ID NO: 8173584 - DNA, 22 bp, Homo sapiens
agaaagtgaacgtgttcagttt

SEQ ID NO: 8173585 - DNA, 22 bp, Homo sapiens
agaaagtgaacgtgttcagttt

SEQ ID NO: 8173586 - DNA, 22 bp, Homo sapiens
agaaagtctgctttctggatgg

SEQ ID NO: 8173587 - DNA, 22 bp, Homo sapiens
agaaagttaaacagtgataaga

SEQ ID NO: 8173588 - DNA, 22 bp, Homo sapiens
agaaagttaaacagtgataaga

SEQ ID NO: 8173589 - DNA, 22 bp, Homo sapiens
agaaagtgtgtcatactaagtg

SEQ ID NO: 8173590 - DNA, 22 bp, Homo sapiens
atattctctgctgcttttgtgt

SEQ ID NO: 8173591 - DNA, 22 bp, Homo sapiens
atattctgcttttgatgcattc

SEQ ID NO: 8173592 - DNA, 22 bp, Homo sapiens
atattacacacggtatcacggg

SEQ ID NO: 8173593 - DNA, 22 bp, Homo sapiens
agaaaataaattgatggtggaa

SEQ ID NO: 8173594 - DNA, 22 bp, Homo sapiens
atattacacacggtatcacggg

SEQ ID NO: 8173595 - DNA, 22 bp, Homo sapiens
atattacacacggtatcacggg

SEQ ID NO: 8173596 - DNA, 22 bp, Homo sapiens
atattacacacggtatcacggg

SEQ ID NO: 8173597 - DNA, 21 bp, Homo sapiens
agaaaagtatttgaatcaaga

SEQ ID NO: 8173598 - DNA, 22 bp, Homo sapiens
agaaaagtgctctagtgagagc

SEQ ID NO: 8173599 - DNA, 21 bp, Homo sapiens
agaaaagtatttgaatcaaga

SEQ ID NO: 8173600 - DNA, 22 bp, Homo sapiens
agaaaagttttctgagactgac

SEQ ID NO: 8173601 - DNA, 22 bp, Homo sapiens
agaaaataaattgatggtggaa

SEQ ID NO: 8173602 - DNA, 22 bp, Homo sapiens
agaaaataaattgatggtggaa

SEQ ID NO: 8173603 - DNA, 22 bp, Homo sapiens
atatttcatggggttccatact

SEQ ID NO: 8173604 - DNA, 23 bp, Homo sapiens
atatttccaggttagtgaggtaa

SEQ ID NO: 8173605 - DNA, 22 bp, Homo sapiens
atatttcatggggttccatact

SEQ ID NO: 8173606 - DNA, 21 bp, Homo sapiens
atatttctcataaggttatgg

SEQ ID NO: 8173607 - DNA, 21 bp, Homo sapiens
atatttctcataaggttatgg

SEQ ID NO: 8173608 - DNA, 23 bp, Homo sapiens
atatttccaggttagtgaggtaa

SEQ ID NO: 8173609 - DNA, 23 bp, Homo sapiens
atatttccaggttagtgaggtaa

SEQ ID NO: 8173610 - DNA, 21 bp, Homo sapiens
atatttctcataaggttatgg

SEQ ID NO: 8173611 - DNA, 22 bp, Homo sapiens
agaaagctccccatgagatgat

SEQ ID NO: 8173612 - DNA, 22 bp, Homo sapiens
agaaagctccccatgagatgat

SEQ ID NO: 8173613 - DNA, 21 bp, Homo sapiens
atatttctcataaggttatgg

SEQ ID NO: 8173614 - DNA, 21 bp, Homo sapiens
atatttctcataaggttatgg

SEQ ID NO: 8173615 - DNA, 21 bp, Homo sapiens
atatttcagatttccgtaatc

SEQ ID NO: 8173616 - DNA, 22 bp, Homo sapiens
atatttcacgtaggttgttttc

SEQ ID NO: 8173617 - DNA, 22 bp, Homo sapiens
atatttataaggcaggcaagta

SEQ ID NO: 8173618 - DNA, 22 bp, Homo sapiens
atatttcacgtaggttgttttc

SEQ ID NO: 8173619 - DNA, 22 bp, Homo sapiens
atatttcacgtaggttgttttc

SEQ ID NO: 8173620 - DNA, 22 bp, Homo sapiens
atatttcagctttacttaggaa

SEQ ID NO: 8173621 - DNA, 22 bp, Homo sapiens
atatttcagctttacttaggaa

SEQ ID NO: 8173622 - DNA, 22 bp, Homo sapiens
atatttcagctttacttaggaa

SEQ ID NO: 8173623 - DNA, 22 bp, Homo sapiens
atatttcaggttttgcaggccg

SEQ ID NO: 8173624 - DNA, 20 bp, Homo sapiens
atatttcaggtagtgtgccc

SEQ ID NO: 8173625 - DNA, 20 bp, Homo sapiens
atatttcaggtagtgtgccc

SEQ ID NO: 8173626 - DNA, 22 bp, Homo sapiens
atatttataagcaagcaggact

SEQ ID NO: 8173627 - DNA, 22 bp, Homo sapiens
atatttataaggcaggcaagta

SEQ ID NO: 8173628 - DNA, 22 bp, Homo sapiens
atatttataaggcaggcaagta

SEQ ID NO: 8173629 - DNA, 22 bp, Homo sapiens
atatttataagcaagcaggact

SEQ ID NO: 8173630 - DNA, 22 bp, Homo sapiens
atatttataagcaagcaggact

SEQ ID NO: 8173631 - DNA, 22 bp, Homo sapiens
atattcttcttgttcagactat

SEQ ID NO: 8173632 - DNA, 22 bp, Homo sapiens
atattcttccaaaacatcattt

SEQ ID NO: 8173633 - DNA, 22 bp, Homo sapiens
atattcttatccttttctctgt

SEQ ID NO: 8173634 - DNA, 22 bp, Homo sapiens
atattctgggttagatatgttt

SEQ ID NO: 8173635 - DNA, 22 bp, Homo sapiens
atattcttatccttttctctgt

SEQ ID NO: 8173636 - DNA, 22 bp, Homo sapiens
atattcttatccttttctctgt

SEQ ID NO: 8173637 - DNA, 22 bp, Homo sapiens
atattcttccaaaacatcattt

SEQ ID NO: 8173638 - DNA, 22 bp, Homo sapiens
atattcttccaaaacatcattt

SEQ ID NO: 8173639 - DNA, 22 bp, Homo sapiens
atattcttccaaaacatcattt

SEQ ID NO: 8173640 - DNA, 22 bp, Homo sapiens
atattcttccaaaacatcattt

SEQ ID NO: 8173641 - DNA, 22 bp, Homo sapiens
actttctcaggaattcacagac

SEQ ID NO: 8173642 - DNA, 22 bp, Homo sapiens
actttctccagaaaaccaagga

SEQ ID NO: 8173643 - DNA, 22 bp, Homo sapiens
actttctccagaaaaccaagga

SEQ ID NO: 8173644 - DNA, 19 bp, Homo sapiens
actttctccaggacctgtt

SEQ ID NO: 8173645 - DNA, 20 bp, Homo sapiens
actttctcggtttctcacct

SEQ ID NO: 8173646 - DNA, 20 bp, Homo sapiens
actttctcggtttctcacct

SEQ ID NO: 8173647 - DNA, 22 bp, Homo sapiens
actttctcccacccacccgtct

SEQ ID NO: 8173648 - DNA, 22 bp, Homo sapiens
actttctcccacccacccgtct

SEQ ID NO: 8173649 - DNA, 20 bp, Homo sapiens
actttctcggtttctcacct

SEQ ID NO: 8173650 - DNA, 20 bp, Homo sapiens
actttctcggtttctcacct

SEQ ID NO: 8173651 - DNA, 22 bp, Homo sapiens
atatgaaagtaagcatgtgtgt

SEQ ID NO: 8173652 - DNA, 22 bp, Homo sapiens
atatgaaagtaagcatgtgtgt

SEQ ID NO: 8173653 - DNA, 22 bp, Homo sapiens
atatgaaagtaagcatgtgtgt

SEQ ID NO: 8173654 - DNA, 22 bp, Homo sapiens
agaaaaggttgaaagtaggatt

SEQ ID NO: 8173655 - DNA, 22 bp, Homo sapiens
atatggacttaaaatttgatgt

SEQ ID NO: 8173656 - DNA, 22 bp, Homo sapiens
atatggagaactcaaaaagtga

SEQ ID NO: 8173657 - DNA, 22 bp, Homo sapiens
atatggaatggtaatctacaat

SEQ ID NO: 8173658 - DNA, 22 bp, Homo sapiens
atatggaatggtaatctacaat

SEQ ID NO: 8173659 - DNA, 22 bp, Homo sapiens
atatggaatggtaatctacaat

SEQ ID NO: 8173660 - DNA, 22 bp, Homo sapiens
atatggaaatagcaatatggtt

SEQ ID NO: 8173661 - DNA, 22 bp, Homo sapiens
atatggaactattctgtgtaga

SEQ ID NO: 8173662 - DNA, 22 bp, Homo sapiens
atatggaagagcctgggaattt

SEQ ID NO: 8173663 - DNA, 22 bp, Homo sapiens
atatggaactattctgtgtaga

SEQ ID NO: 8173664 - DNA, 22 bp, Homo sapiens
atatggaagttacctgacttca

SEQ ID NO: 8173665 - DNA, 22 bp, Homo sapiens
atatggaagttacctgacttca

SEQ ID NO: 8173666 - DNA, 18 bp, Homo sapiens
atatggaatgcctggcta

SEQ ID NO: 8173667 - DNA, 22 bp, Homo sapiens
actttcctggccctgtcctctg

SEQ ID NO: 8173668 - DNA, 22 bp, Homo sapiens
actttcctagacttcagtgaca

SEQ ID NO: 8173669 - DNA, 22 bp, Homo sapiens
actttctaggtctcagtccttt

SEQ ID NO: 8173670 - DNA, 22 bp, Homo sapiens
actttctattcccacagagata

SEQ ID NO: 8173671 - DNA, 22 bp, Homo sapiens
actttctattcccacagagata

SEQ ID NO: 8173672 - DNA, 22 bp, Homo sapiens
actttctattgtttagattctg

SEQ ID NO: 8173673 - DNA, 22 bp, Homo sapiens
actttctcaggaattcacagac

SEQ ID NO: 8173674 - DNA, 22 bp, Homo sapiens
actttctcaggaattcacagac

SEQ ID NO: 8173675 - DNA, 22 bp, Homo sapiens
actttctcaaatcagactttaa

SEQ ID NO: 8173676 - DNA, 22 bp, Homo sapiens
actttctcaaatcagactttaa

SEQ ID NO: 8173677 - DNA, 22 bp, Homo sapiens
actttcaagcaagaacactttg

SEQ ID NO: 8173678 - DNA, 22 bp, Homo sapiens
actttcaaatatcatgattcta

SEQ ID NO: 8173679 - DNA, 22 bp, Homo sapiens
actttcaagccctctagagaca

SEQ ID NO: 8173680 - DNA, 22 bp, Homo sapiens
actttcaagccctctagagaca

SEQ ID NO: 8173681 - DNA, 22 bp, Homo sapiens
actttcaattcccttagcaact

SEQ ID NO: 8173682 - DNA, 22 bp, Homo sapiens
actttcaattcactgagatata

SEQ ID NO: 8173683 - DNA, 22 bp, Homo sapiens
actttcacatgtgtgcagacag

SEQ ID NO: 8173684 - DNA, 22 bp, Homo sapiens
actttcagaattgtacagagtc

SEQ ID NO: 8173685 - DNA, 22 bp, Homo sapiens
actttcatttgtaataaacttc

SEQ ID NO: 8173686 - DNA, 22 bp, Homo sapiens
actttcatttgtaataaacttc

SEQ ID NO: 8173687 - DNA, 22 bp, Homo sapiens
cacagtttgcataggaaaaaca

SEQ ID NO: 8173688 - DNA, 22 bp, Homo sapiens
cacagtttctgaacactttgca

SEQ ID NO: 8173689 - DNA, 22 bp, Homo sapiens
cacagtttcaataattattctt

SEQ ID NO: 8173690 - DNA, 22 bp, Homo sapiens
cacagtttcaataattattctt

SEQ ID NO: 8173691 - DNA, 22 bp, Homo sapiens
cacagtttctataggtcagaat

SEQ ID NO: 8173692 - DNA, 22 bp, Homo sapiens
cacagtttggttttgctgtaat

SEQ ID NO: 8173693 - DNA, 22 bp, Homo sapiens
agcaggctccaggctggccatc

SEQ ID NO: 8173694 - DNA, 22 bp, Homo sapiens
agcaggctccaggctggccatc

SEQ ID NO: 8173695 - DNA, 22 bp, Homo sapiens
agcaggctccaggctggccatc

SEQ ID NO: 8173696 - DNA, 22 bp, Homo sapiens
agcaggctccaggctggccatc

SEQ ID NO: 8173697 - DNA, 22 bp, Homo sapiens
agcaggctccttccttctctgg

SEQ ID NO: 8173698 - DNA, 22 bp, Homo sapiens
agcaggctgagcacccaggggg

SEQ ID NO: 8173699 - DNA, 22 bp, Homo sapiens
agcaggctccttccttctctgg

SEQ ID NO: 8173700 - DNA, 22 bp, Homo sapiens
agcaggctgagcacccaggggg

SEQ ID NO: 8173701 - DNA, 22 bp, Homo sapiens
agcaggctccttccttctctgg

SEQ ID NO: 8173702 - DNA, 22 bp, Homo sapiens
agcaggctccttccttctctgg

SEQ ID NO: 8173703 - DNA, 22 bp, Homo sapiens
agcaggctccttccttctctgg

SEQ ID NO: 8173704 - DNA, 22 bp, Homo sapiens
agcaggctgatgggcatgcttg

SEQ ID NO: 8173705 - DNA, 22 bp, Homo sapiens
agcaggctgatgggcatgcttg

SEQ ID NO: 8173706 - DNA, 22 bp, Homo sapiens
agcaggctgatgggcatgcttg

SEQ ID NO: 8173707 - DNA, 17 bp, Homo sapiens
agcaggctgcagaggcc

SEQ ID NO: 8173708 - DNA, 22 bp, Homo sapiens
agcaggcaggcccagcggctgg

SEQ ID NO: 8173709 - DNA, 22 bp, Homo sapiens
agcaggcaggaatggtggaaca

SEQ ID NO: 8173710 - DNA, 22 bp, Homo sapiens
agcaggcaggaatggtggaaca

SEQ ID NO: 8173711 - DNA, 22 bp, Homo sapiens
cacagtgttccagagcagtggt

SEQ ID NO: 8173712 - DNA, 22 bp, Homo sapiens
cacagtgttccagagcagtggt

SEQ ID NO: 8173713 - DNA, 22 bp, Homo sapiens
cacagtgttccagagcagtggt

SEQ ID NO: 8173714 - DNA, 22 bp, Homo sapiens
cacagtgtttgatttaggggcc

SEQ ID NO: 8173715 - DNA, 22 bp, Homo sapiens
cacagttagctccagtcttagc

SEQ ID NO: 8173716 - DNA, 22 bp, Homo sapiens
cacagttatatgttcacaagga

SEQ ID NO: 8173717 - DNA, 22 bp, Homo sapiens
cacagttagctccagtcttagc

SEQ ID NO: 8173718 - DNA, 22 bp, Homo sapiens
agcaggcactatgccaggatct

SEQ ID NO: 8173719 - DNA, 22 bp, Homo sapiens
agcaggcactatgccaggatct

SEQ ID NO: 8173720 - DNA, 22 bp, Homo sapiens
agcaggcactatgccaggatct

SEQ ID NO: 8173721 - DNA, 22 bp, Homo sapiens
agcaggcagcatgggaccctcc

SEQ ID NO: 8173722 - DNA, 22 bp, Homo sapiens
agcaggcagcatgggaccctcc

SEQ ID NO: 8173723 - DNA, 22 bp, Homo sapiens
agcaggcagccatttggaaggc

SEQ ID NO: 8173724 - DNA, 22 bp, Homo sapiens
agcaggcagccatttggaaggc

SEQ ID NO: 8173725 - DNA, 22 bp, Homo sapiens
agcaggcaggaaggcagcactg

SEQ ID NO: 8173726 - DNA, 22 bp, Homo sapiens
agcaggcagctgggggagttga

SEQ ID NO: 8173727 - DNA, 22 bp, Homo sapiens
agcaggcaggaaggcagcactg

SEQ ID NO: 8173728 - DNA, 22 bp, Homo sapiens
agcaggcagcctaggaagtgaa

SEQ ID NO: 8173729 - DNA, 22 bp, Homo sapiens
agcaggcagctgggggagttga

SEQ ID NO: 8173730 - DNA, 22 bp, Homo sapiens
agcaggcagcctaggaagtgaa

SEQ ID NO: 8173731 - DNA, 22 bp, Homo sapiens
agcaggcagcctaggaagtgaa

SEQ ID NO: 8173732 - DNA, 22 bp, Homo sapiens
agcagctgctccacttgcttaa

SEQ ID NO: 8173733 - DNA, 22 bp, Homo sapiens
cacaatttttcttaggtcctgg

SEQ ID NO: 8173734 - DNA, 22 bp, Homo sapiens
cacaattttcctttaagtgtat

SEQ ID NO: 8173735 - DNA, 22 bp, Homo sapiens
cacacaattatgtgtgcacaat

SEQ ID NO: 8173736 - DNA, 22 bp, Homo sapiens
cacacaattatgtgtgcacaat

SEQ ID NO: 8173737 - DNA, 22 bp, Homo sapiens
cacacacagttttgtattctgt

SEQ ID NO: 8173738 - DNA, 22 bp, Homo sapiens
cacacacagttttgtattctgt

SEQ ID NO: 8173739 - DNA, 22 bp, Homo sapiens
agcagctgccagagagagttcc

SEQ ID NO: 8173740 - DNA, 22 bp, Homo sapiens
agcagctgccagagagagttcc

SEQ ID NO: 8173741 - DNA, 21 bp, Homo sapiens
agcagctgcagtttctatctg

SEQ ID NO: 8173742 - DNA, 21 bp, Homo sapiens
agcagctgcagtttctatctg

SEQ ID NO: 8173743 - DNA, 22 bp, Homo sapiens
agcagctgccactggaatagga

SEQ ID NO: 8173744 - DNA, 22 bp, Homo sapiens
agcagctgccactggaatagga

SEQ ID NO: 8173745 - DNA, 22 bp, Homo sapiens
agcagctgatggggaaggagtt

SEQ ID NO: 8173746 - DNA, 22 bp, Homo sapiens
agcagctgatcaaagcacttat

SEQ ID NO: 8173747 - DNA, 22 bp, Homo sapiens
agcagctgatcaaagcacttat

SEQ ID NO: 8173748 - DNA, 22 bp, Homo sapiens
agcagctgatggggaaggagtt

SEQ ID NO: 8173749 - DNA, 22 bp, Homo sapiens
agcagctgatggggaaggagtt

SEQ ID NO: 8173750 - DNA, 22 bp, Homo sapiens
agcagctgatggggaaggagtt

SEQ ID NO: 8173751 - DNA, 22 bp, Homo sapiens
agcagctgatggggaaggagtt

SEQ ID NO: 8173752 - DNA, 22 bp, Homo sapiens
agcagctgcagagggctccccc

SEQ ID NO: 8173753 - DNA, 22 bp, Homo sapiens
agcagctgcagagggctccccc

SEQ ID NO: 8173754 - DNA, 22 bp, Homo sapiens
agcagctgcagagggctccccc

SEQ ID NO: 8173755 - DNA, 22 bp, Homo sapiens
agcagctgcagggagggtctgc

SEQ ID NO: 8173756 - DNA, 22 bp, Homo sapiens
agcagctgcagggagggtctgc

SEQ ID NO: 8173757 - DNA, 22 bp, Homo sapiens
agcagctgcagggagggtctgc

SEQ ID NO: 8173758 - DNA, 22 bp, Homo sapiens
agcagctgcagggagggtctgc

SEQ ID NO: 8173759 - DNA, 22 bp, Homo sapiens
agcaggcaaggtccgtgcctcg

SEQ ID NO: 8173760 - DNA, 22 bp, Homo sapiens
agcaggcaaggtccgtgcctcg

SEQ ID NO: 8173761 - DNA, 22 bp, Homo sapiens
agcaggcaagcgtgagttctct

SEQ ID NO: 8173762 - DNA, 22 bp, Homo sapiens
agcaggcaagcgtgagttctct

SEQ ID NO: 8173763 - DNA, 23 bp, Homo sapiens
agcaggataattttattatgccc

SEQ ID NO: 8173764 - DNA, 22 bp, Homo sapiens
agcaggagtttgatgcttttat

SEQ ID NO: 8173765 - DNA, 21 bp, Homo sapiens
agcaggcaaaggtgaagtctt

SEQ ID NO: 8173766 - DNA, 22 bp, Homo sapiens
agcaggattttgaagtgcaagt

SEQ ID NO: 8173767 - DNA, 22 bp, Homo sapiens
agcaggattttgaagtgcaagt

SEQ ID NO: 8173768 - DNA, 22 bp, Homo sapiens
agcaggcacgctccctgcgcga

SEQ ID NO: 8173769 - DNA, 17 bp, Homo sapiens
agcaggcacgtcagcac

SEQ ID NO: 8173770 - DNA, 22 bp, Homo sapiens
agcaggcacaagaaagggaggt

SEQ ID NO: 8173771 - DNA, 22 bp, Homo sapiens
agcaggcaccagggctcgtcct

SEQ ID NO: 8173772 - DNA, 22 bp, Homo sapiens
agcaggcaccagggctcgtcct

SEQ ID NO: 8173773 - DNA, 22 bp, Homo sapiens
cacacactcttcctggcaccta

SEQ ID NO: 8173774 - DNA, 22 bp, Homo sapiens
cacacactcttcctggcaccta

SEQ ID NO: 8173775 - DNA, 22 bp, Homo sapiens
cacacactgacaccttatcttg

SEQ ID NO: 8173776 - DNA, 22 bp, Homo sapiens
cacacactgacaccttatcttg

SEQ ID NO: 8173777 - DNA, 22 bp, Homo sapiens
cacacacagttttgtattctgt

SEQ ID NO: 8173778 - DNA, 22 bp, Homo sapiens
cacacacagttttgtattctgt

SEQ ID NO: 8173779 - DNA, 22 bp, Homo sapiens
cacacacagttttgtattctgt

SEQ ID NO: 8173780 - DNA, 22 bp, Homo sapiens
cacacacagttttgtattctgt

SEQ ID NO: 8173781 - DNA, 22 bp, Homo sapiens
agcaggagcccttatcaccagg

SEQ ID NO: 8173782 - DNA, 22 bp, Homo sapiens
agcaggagcatttccatgattc

SEQ ID NO: 8173783 - DNA, 22 bp, Homo sapiens
agcaggagtgtcccctggctgt

SEQ ID NO: 8173784 - DNA, 22 bp, Homo sapiens
agcaggagtgtcccctggctgt

SEQ ID NO: 8173785 - DNA, 22 bp, Homo sapiens
agcaggagtgtcccctggctgt

SEQ ID NO: 8173786 - DNA, 22 bp, Homo sapiens
agcaggagtttgatgcttttat

SEQ ID NO: 8173787 - DNA, 22 bp, Homo sapiens
cactgcttcagtcagagaaatt

SEQ ID NO: 8173788 - DNA, 22 bp, Homo sapiens
cactgcttccattgttcacctg

SEQ ID NO: 8173789 - DNA, 22 bp, Homo sapiens
cactgcttatgtctccttttca

SEQ ID NO: 8173790 - DNA, 22 bp, Homo sapiens
cactgcttataaattctaggca

SEQ ID NO: 8173791 - DNA, 22 bp, Homo sapiens
cactgcttataaattctaggca

SEQ ID NO: 8173792 - DNA, 22 bp, Homo sapiens
cactgcttagttggtaaatgtg

SEQ ID NO: 8173793 - DNA, 22 bp, Homo sapiens
cactgcttagttggtaaatgtg

SEQ ID NO: 8173794 - DNA, 22 bp, Homo sapiens
cactgctcgctgcagcatggcc

SEQ ID NO: 8173795 - DNA, 22 bp, Homo sapiens
cactgcttagatcttccttcaa

SEQ ID NO: 8173796 - DNA, 22 bp, Homo sapiens
cactgctgatttcataggcagg

SEQ ID NO: 8173797 - DNA, 22 bp, Homo sapiens
cactgctatgatgatgatattt

SEQ ID NO: 8173798 - DNA, 22 bp, Homo sapiens
cactgctattattagacaatgt

SEQ ID NO: 8173799 - DNA, 22 bp, Homo sapiens
cactgctagtctgaagtactgg

SEQ ID NO: 8173800 - DNA, 22 bp, Homo sapiens
cactgctacctctgcctcccgg

SEQ ID NO: 8173801 - DNA, 23 bp, Homo sapiens
cactgccttcagttgcttcacct

SEQ ID NO: 8173802 - DNA, 23 bp, Homo sapiens
cactgccttcagttgcttcacct

SEQ ID NO: 8173803 - DNA, 23 bp, Homo sapiens
cactgccttcagttgcttcacct

SEQ ID NO: 8173804 - DNA, 22 bp, Homo sapiens
cactgctacctctgcctcccgg

SEQ ID NO: 8173805 - DNA, 22 bp, Homo sapiens
agcatacaggtctgaaacagct

SEQ ID NO: 8173806 - DNA, 22 bp, Homo sapiens
agcatacaggtctgaaacagct

SEQ ID NO: 8173807 - DNA, 20 bp, Homo sapiens
agcatacatcataagaaacc

SEQ ID NO: 8173808 - DNA, 20 bp, Homo sapiens
agcatacatcataagaaacc

SEQ ID NO: 8173809 - DNA, 22 bp, Homo sapiens
agcatacaggtctgaaacagct

SEQ ID NO: 8173810 - DNA, 22 bp, Homo sapiens
cactgctttaaggctgagtaac

SEQ ID NO: 8173811 - DNA, 22 bp, Homo sapiens
cactgctttaaggctgagtaac

SEQ ID NO: 8173812 - DNA, 22 bp, Homo sapiens
cactgcttggccctgagggcag

SEQ ID NO: 8173813 - DNA, 22 bp, Homo sapiens
cactgcttgcagtatgagtgga

SEQ ID NO: 8173814 - DNA, 22 bp, Homo sapiens
cactgcttggttgcaacattgc

SEQ ID NO: 8173815 - DNA, 22 bp, Homo sapiens
cactgcttggttgcaacattgc

SEQ ID NO: 8173816 - DNA, 22 bp, Homo sapiens
cactgcttgattgacatgcacg

SEQ ID NO: 8173817 - DNA, 22 bp, Homo sapiens
cactgcttgcagtatgagtgga

SEQ ID NO: 8173818 - DNA, 22 bp, Homo sapiens
cactgcttgattgacatgcacg

SEQ ID NO: 8173819 - DNA, 22 bp, Homo sapiens
cactgcttctggaggaatttgg

SEQ ID NO: 8173820 - DNA, 22 bp, Homo sapiens
cacctgagactcctcaccatga

SEQ ID NO: 8173821 - DNA, 22 bp, Homo sapiens
cactgcctgtgagctgtgtgcc

SEQ ID NO: 8173822 - DNA, 22 bp, Homo sapiens
cactgcagatcagaggctgaga

SEQ ID NO: 8173823 - DNA, 22 bp, Homo sapiens
cactgcctgtgagctgtgtgcc

SEQ ID NO: 8173824 - DNA, 22 bp, Homo sapiens
cactgcctgtgagctgtgtgcc

SEQ ID NO: 8173825 - DNA, 22 bp, Homo sapiens
cactgcctgtgagctgtgtgcc

SEQ ID NO: 8173826 - DNA, 22 bp, Homo sapiens
cactgcctgtgagctgtgtgcc

SEQ ID NO: 8173827 - DNA, 22 bp, Homo sapiens
cacctctgctgtccacaggatg

SEQ ID NO: 8173828 - DNA, 22 bp, Homo sapiens
cacctcaggcagcaaagtctca

SEQ ID NO: 8173829 - DNA, 22 bp, Homo sapiens
cacccagggctgtgcctgccca

SEQ ID NO: 8173830 - DNA, 22 bp, Homo sapiens
cacccaggctggagtgcagtgg

SEQ ID NO: 8173831 - DNA, 22 bp, Homo sapiens
cacccaggctggagtgcagtgg

SEQ ID NO: 8173832 - DNA, 22 bp, Homo sapiens
cacccaggctggagtgcattgg

SEQ ID NO: 8173833 - DNA, 22 bp, Homo sapiens
cacctagggcatccctgcccca

SEQ ID NO: 8173834 - DNA, 22 bp, Homo sapiens
caccgtggaggagctggagggc

SEQ ID NO: 8173835 - DNA, 22 bp, Homo sapiens
cacccttcagctttcttagctc

SEQ ID NO: 8173836 - DNA, 22 bp, Homo sapiens
agcagggctttgtctctgtgaa

SEQ ID NO: 8173837 - DNA, 22 bp, Homo sapiens
agcaggggcagggttttgtgct

SEQ ID NO: 8173838 - DNA, 22 bp, Homo sapiens
agcaggggcagggttttgtgct

SEQ ID NO: 8173839 - DNA, 22 bp, Homo sapiens
agcagggctggggcacgagcca

SEQ ID NO: 8173840 - DNA, 22 bp, Homo sapiens
agcagggctgtgctccttccga

SEQ ID NO: 8173841 - DNA, 23 bp, Homo sapiens
agcaggctgcttctccacagctg

SEQ ID NO: 8173842 - DNA, 23 bp, Homo sapiens
agcaggctgcttctccacagctg

SEQ ID NO: 8173843 - DNA, 23 bp, Homo sapiens
agcaggctgcttctccacagctg

SEQ ID NO: 8173844 - DNA, 22 bp, Homo sapiens
agcaggctgccttccaaagcct

SEQ ID NO: 8173845 - DNA, 22 bp, Homo sapiens
agcaggctgccttccaaagcct

SEQ ID NO: 8173846 - DNA, 22 bp, Homo sapiens
agcagggggagttagactagat

SEQ ID NO: 8173847 - DNA, 22 bp, Homo sapiens
agcagggggagttagactagat

SEQ ID NO: 8173848 - DNA, 22 bp, Homo sapiens
agcagggggagttagactagat

SEQ ID NO: 8173849 - DNA, 22 bp, Homo sapiens
agcagggggcatccttgccctt

SEQ ID NO: 8173850 - DNA, 22 bp, Homo sapiens
agcagggggccacagtcacagc

SEQ ID NO: 8173851 - DNA, 22 bp, Homo sapiens
agcagggggccacagtcacagc

SEQ ID NO: 8173852 - DNA, 22 bp, Homo sapiens
agcagggggccacagtcacagc

SEQ ID NO: 8173853 - DNA, 22 bp, Homo sapiens
agcaggggtaacagaaggaaag

SEQ ID NO: 8173854 - DNA, 22 bp, Homo sapiens
agcaggggtaacagaaggaaag

SEQ ID NO: 8173855 - DNA, 22 bp, Homo sapiens
cacccaggctggagtgcagtga

SEQ ID NO: 8173856 - DNA, 22 bp, Homo sapiens
cacccaggctggagtgcagtga

SEQ ID NO: 8173857 - DNA, 22 bp, Homo sapiens
cacccaggctggagtgcagtgg

SEQ ID NO: 8173858 - DNA, 22 bp, Homo sapiens
cacccaggctggagtgcagggg

SEQ ID NO: 8173859 - DNA, 22 bp, Homo sapiens
cacccaggctggagtgcagtga

SEQ ID NO: 8173860 - DNA, 22 bp, Homo sapiens
caccaggttccgggcagagctg

SEQ ID NO: 8173861 - DNA, 22 bp, Homo sapiens
caccaggtggaaatgtcacagc

SEQ ID NO: 8173862 - DNA, 22 bp, Homo sapiens
caccaggtggaaatgtcacagc

SEQ ID NO: 8173863 - DNA, 20 bp, Homo sapiens
agcaggtaaggcacagcagt

SEQ ID NO: 8173864 - DNA, 22 bp, Homo sapiens
agcagggtttggggattggcac

SEQ ID NO: 8173865 - DNA, 20 bp, Homo sapiens
agcaggtaaggcacagcagt

SEQ ID NO: 8173866 - DNA, 20 bp, Homo sapiens
agcaggtaaggcacagcagt

SEQ ID NO: 8173867 - DNA, 22 bp, Homo sapiens
cacccaggctggagagcagtgg

SEQ ID NO: 8173868 - DNA, 22 bp, Homo sapiens
cacccaggctggagtgcagggg

SEQ ID NO: 8173869 - DNA, 22 bp, Homo sapiens
agcagggtcctgaggtgagtca

SEQ ID NO: 8173870 - DNA, 22 bp, Homo sapiens
agcagggtatgttagagctgta

SEQ ID NO: 8173871 - DNA, 22 bp, Homo sapiens
agcagggtgtggtggccctgga

SEQ ID NO: 8173872 - DNA, 22 bp, Homo sapiens
agcagggtcctgaggtgagtca

SEQ ID NO: 8173873 - DNA, 22 bp, Homo sapiens
agcagggtttggggattggcac

SEQ ID NO: 8173874 - DNA, 22 bp, Homo sapiens
agcagggttctcagttggtgct

SEQ ID NO: 8173875 - DNA, 22 bp, Homo sapiens
agcagggttctcagttggtgct

SEQ ID NO: 8173876 - DNA, 22 bp, Homo sapiens
agcagggttccaggagttgcag

SEQ ID NO: 8173877 - DNA, 22 bp, Homo sapiens
agcagggttccaggagttgcag

SEQ ID NO: 8173878 - DNA, 22 bp, Homo sapiens
agcaggggtctctgctaatgaa

SEQ ID NO: 8173879 - DNA, 22 bp, Homo sapiens
agcaggggtggaaggtagcttt

SEQ ID NO: 8173880 - DNA, 22 bp, Homo sapiens
agcaggggtggaaggtagcttt

SEQ ID NO: 8173881 - DNA, 22 bp, Homo sapiens
agcaggggtggaaggtagcttt

SEQ ID NO: 8173882 - DNA, 22 bp, Homo sapiens
caaaagtctgtcctttaacttc

SEQ ID NO: 8173883 - DNA, 22 bp, Homo sapiens
caaaataccacgacttgtttta

SEQ ID NO: 8173884 - DNA, 22 bp, Homo sapiens
agcaaagaagacacaggcttca

SEQ ID NO: 8173885 - DNA, 22 bp, Homo sapiens
agcaaagaaatggaggctcaga

SEQ ID NO: 8173886 - DNA, 22 bp, Homo sapiens
agcaaagacagggacgaccaag

SEQ ID NO: 8173887 - DNA, 22 bp, Homo sapiens
agcacaggtacggagatgctac

SEQ ID NO: 8173888 - DNA, 22 bp, Homo sapiens
agcacaggtacggagatgctac

SEQ ID NO: 8173889 - DNA, 18 bp, Homo sapiens
agcaaagcaagagatcac

SEQ ID NO: 8173890 - DNA, 22 bp, Homo sapiens
agcaaagcaccatatggcagtt

SEQ ID NO: 8173891 - DNA, 22 bp, Homo sapiens
agcaaagccgagacagccagtg

SEQ ID NO: 8173892 - DNA, 22 bp, Homo sapiens
agcaaagcagtggctaagctga

SEQ ID NO: 8173893 - DNA, 22 bp, Homo sapiens
caaatagacttcaatctcttga

SEQ ID NO: 8173894 - DNA, 22 bp, Homo sapiens
agcacatgagctgatggtgggc

SEQ ID NO: 8173895 - DNA, 22 bp, Homo sapiens
agcacatgcacagtgctacact

SEQ ID NO: 8173896 - DNA, 22 bp, Homo sapiens
agcacatgcacagtgctacact

SEQ ID NO: 8173897 - DNA, 22 bp, Homo sapiens
caaatagtatgagcaatgattc

SEQ ID NO: 8173898 - DNA, 18 bp, Homo sapiens
caaatagcatgatgtcct

SEQ ID NO: 8173899 - DNA, 22 bp, Homo sapiens
caaatagattgttcaatcctga

SEQ ID NO: 8173900 - DNA, 22 bp, Homo sapiens
caaatagattgttcaatcctga

SEQ ID NO: 8173901 - DNA, 22 bp, Homo sapiens
agcacaggtgaaacagtcaggt

SEQ ID NO: 8173902 - DNA, 22 bp, Homo sapiens
agcacagtaattgatattactg

SEQ ID NO: 8173903 - DNA, 22 bp, Homo sapiens
agcacaggtgaaacagtcaggt

SEQ ID NO: 8173904 - DNA, 22 bp, Homo sapiens
agcacaggtgaaacagtcaggt

SEQ ID NO: 8173905 - DNA, 19 bp, Homo sapiens
agcacagtttccacatgca

SEQ ID NO: 8173906 - DNA, 22 bp, Homo sapiens
agcacagttctttctctagctg

SEQ ID NO: 8173907 - DNA, 22 bp, Homo sapiens
caacagaaggaagcagggtcag

SEQ ID NO: 8173908 - DNA, 22 bp, Homo sapiens
caacacttcttatacttactga

SEQ ID NO: 8173909 - DNA, 22 bp, Homo sapiens
caacacttcttatacttactga

SEQ ID NO: 8173910 - DNA, 22 bp, Homo sapiens
caaattaccctcaacatctaga

SEQ ID NO: 8173911 - DNA, 20 bp, Homo sapiens
caacactgcccattgtttgc

SEQ ID NO: 8173912 - DNA, 23 bp, Homo sapiens
caacactgccttcaggtgaagaa

SEQ ID NO: 8173913 - DNA, 20 bp, Homo sapiens
caacactgcccattgtttgc

SEQ ID NO: 8173914 - DNA, 23 bp, Homo sapiens
caacactgccttcaggtgaagaa

SEQ ID NO: 8173915 - DNA, 22 bp, Homo sapiens
caaatattccaggtacatccct

SEQ ID NO: 8173916 - DNA, 22 bp, Homo sapiens
caaatattccaggtacatccct

SEQ ID NO: 8173917 - DNA, 22 bp, Homo sapiens
caaatatctttggcaaagagaa

SEQ ID NO: 8173918 - DNA, 22 bp, Homo sapiens
caaatagtttttcatgtattat

SEQ ID NO: 8173919 - DNA, 22 bp, Homo sapiens
agcacattagtatctaagaaca

SEQ ID NO: 8173920 - DNA, 22 bp, Homo sapiens
agcacattcccacctgtacttc

SEQ ID NO: 8173921 - DNA, 22 bp, Homo sapiens
caacagctttagaaacactttc

SEQ ID NO: 8173922 - DNA, 22 bp, Homo sapiens
caacagctggaggcttggcccg

SEQ ID NO: 8173923 - DNA, 23 bp, Homo sapiens
caacagctgttagatatgggctt

SEQ ID NO: 8173924 - DNA, 22 bp, Homo sapiens
caacagctgatctttgatgaag

SEQ ID NO: 8173925 - DNA, 22 bp, Homo sapiens
caacagctgatctttgatgaag

SEQ ID NO: 8173926 - DNA, 22 bp, Homo sapiens
caacagctcagacacgggacct

SEQ ID NO: 8173927 - DNA, 22 bp, Homo sapiens
caacagaggagtggcctgatcc

SEQ ID NO: 8173928 - DNA, 22 bp, Homo sapiens
caacagagagaccagaaacagg

SEQ ID NO: 8173929 - DNA, 22 bp, Homo sapiens
caacagagagaccagaaacagg

SEQ ID NO: 8173930 - DNA, 22 bp, Homo sapiens
caacagaaggtgtactactgaa

SEQ ID NO: 8173931 - DNA, 22 bp, Homo sapiens
caacagaaggtgtactactgaa

SEQ ID NO: 8173932 - DNA, 22 bp, Homo sapiens
agcacattctgccttgctttgc

SEQ ID NO: 8173933 - DNA, 22 bp, Homo sapiens
agcacattttatttaagaaaat

SEQ ID NO: 8173934 - DNA, 22 bp, Homo sapiens
agcacattctgccttgctttgc

SEQ ID NO: 8173935 - DNA, 22 bp, Homo sapiens
agcacatttaagtatgaaatat

SEQ ID NO: 8173936 - DNA, 22 bp, Homo sapiens
agcaccagcaactatgggctgc

SEQ ID NO: 8173937 - DNA, 22 bp, Homo sapiens
caagacaatgggtaagtgtaac

SEQ ID NO: 8173938 - DNA, 22 bp, Homo sapiens
caagaccaatttgaattaacca

SEQ ID NO: 8173939 - DNA, 22 bp, Homo sapiens
caagagacttatgtggaaacct

SEQ ID NO: 8173940 - DNA, 22 bp, Homo sapiens
agcaccaggctgttggaagccc

SEQ ID NO: 8173941 - DNA, 22 bp, Homo sapiens
agcaccaggcagtatatcaaag

SEQ ID NO: 8173942 - DNA, 22 bp, Homo sapiens
caacttggctctctggctatcc

SEQ ID NO: 8173943 - DNA, 22 bp, Homo sapiens
caacttgttcttggtagatcta

SEQ ID NO: 8173944 - DNA, 22 bp, Homo sapiens
caagacaatgggtaagtgtaac

SEQ ID NO: 8173945 - DNA, 22 bp, Homo sapiens
cacaagatggtcacataagtgc

SEQ ID NO: 8173946 - DNA, 22 bp, Homo sapiens
cacaagctccttatgtggagaa

SEQ ID NO: 8173947 - DNA, 22 bp, Homo sapiens
cacaagctccttatgtggagaa

SEQ ID NO: 8173948 - DNA, 22 bp, Homo sapiens
cacaagctgggcaagtgtatat

SEQ ID NO: 8173949 - DNA, 22 bp, Homo sapiens
cacaaggaggtcctgaggaagc

SEQ ID NO: 8173950 - DNA, 22 bp, Homo sapiens
cacaaggctgggacaagtgctg

SEQ ID NO: 8173951 - DNA, 22 bp, Homo sapiens
cacaaggccctgggtcaccaca

SEQ ID NO: 8173952 - DNA, 22 bp, Homo sapiens
agcagccaaggtaacctgtgct

SEQ ID NO: 8173953 - DNA, 22 bp, Homo sapiens
agcagccaaggtaacctgtgct

SEQ ID NO: 8173954 - DNA, 22 bp, Homo sapiens
agcagccagaaagggcagtcga

SEQ ID NO: 8173955 - DNA, 22 bp, Homo sapiens
agcagccagaaatccagaggtg

SEQ ID NO: 8173956 - DNA, 22 bp, Homo sapiens
agcagccagaaatccagaggtg

SEQ ID NO: 8173957 - DNA, 22 bp, Homo sapiens
agcagccagaaatccagaggtg

SEQ ID NO: 8173958 - DNA, 22 bp, Homo sapiens
agcagccagaaatccagaggtg

SEQ ID NO: 8173959 - DNA, 22 bp, Homo sapiens
agcagctgagccccagctgtga

SEQ ID NO: 8173960 - DNA, 22 bp, Homo sapiens
agcagctcctctaggaacggat

SEQ ID NO: 8173961 - DNA, 22 bp, Homo sapiens
agcagccacccagctgctcatt

SEQ ID NO: 8173962 - DNA, 22 bp, Homo sapiens
agcagccacagtctgggacagg

SEQ ID NO: 8173963 - DNA, 22 bp, Homo sapiens
agcagccacccagctgctcatt

SEQ ID NO: 8173964 - DNA, 22 bp, Homo sapiens
agcagccacacgcctccttctc

SEQ ID NO: 8173965 - DNA, 22 bp, Homo sapiens
caattttttccatgctcttaca

SEQ ID NO: 8173966 - DNA, 21 bp, Homo sapiens
cacaagacacatagggtgttt

SEQ ID NO: 8173967 - DNA, 20 bp, Homo sapiens
cacaagagaatacacactgg

SEQ ID NO: 8173968 - DNA, 20 bp, Homo sapiens
cacaagagaatacacactgg

SEQ ID NO: 8173969 - DNA, 22 bp, Homo sapiens
cacaagagagtgcgcgttgcaa

SEQ ID NO: 8173970 - DNA, 22 bp, Homo sapiens
caatttttgtacttatagtact

SEQ ID NO: 8173971 - DNA, 22 bp, Homo sapiens
agcagcagggtgatagtgccca

SEQ ID NO: 8173972 - DNA, 22 bp, Homo sapiens
agcagcagggtgatagtgccca

SEQ ID NO: 8173973 - DNA, 22 bp, Homo sapiens
agcagcagggtgatagtgccca

SEQ ID NO: 8173974 - DNA, 22 bp, Homo sapiens
agcagcagggtgatagtgccca

SEQ ID NO: 8173975 - DNA, 22 bp, Homo sapiens
agcagcagggtgatagtgccca

SEQ ID NO: 8173976 - DNA, 22 bp, Homo sapiens
agcagcagggtcattgctcttt

SEQ ID NO: 8173977 - DNA, 22 bp, Homo sapiens
agcagcagggtcattgctcttt

SEQ ID NO: 8173978 - DNA, 22 bp, Homo sapiens
agcagcagggtcattgctcttt

SEQ ID NO: 8173979 - DNA, 22 bp, Homo sapiens
agcagcagggtcattgctcttt

SEQ ID NO: 8173980 - DNA, 21 bp, Homo sapiens
agcagcagggaagcctcatcc

SEQ ID NO: 8173981 - DNA, 21 bp, Homo sapiens
agcagcagggaagcctcatcc

SEQ ID NO: 8173982 - DNA, 21 bp, Homo sapiens
agcagcagggaagcctcatcc

SEQ ID NO: 8173983 - DNA, 21 bp, Homo sapiens
agcagcagggaagcctcatcc

SEQ ID NO: 8173984 - DNA, 21 bp, Homo sapiens
agcagcagggaagcctcatcc

SEQ ID NO: 8173985 - DNA, 22 bp, Homo sapiens
agcagcaggcttaaggaaaagt

SEQ ID NO: 8173986 - DNA, 22 bp, Homo sapiens
agcagcaggcttaaggaaaagt

SEQ ID NO: 8173987 - DNA, 22 bp, Homo sapiens
agcagcagggtcattgctcttt

SEQ ID NO: 8173988 - DNA, 22 bp, Homo sapiens
agcagcagggctctgcccgtgc

SEQ ID NO: 8173989 - DNA, 22 bp, Homo sapiens
agcagcagggctctgcccgtgc

SEQ ID NO: 8173990 - DNA, 22 bp, Homo sapiens
agcagcagggctctgcccgtgc

SEQ ID NO: 8173991 - DNA, 22 bp, Homo sapiens
agcagcagggctctgcccgtgc

SEQ ID NO: 8173992 - DNA, 22 bp, Homo sapiens
agcagcagggcatgtcttactc

SEQ ID NO: 8173993 - DNA, 22 bp, Homo sapiens
agcagcagggcatgtcttactc

SEQ ID NO: 8173994 - DNA, 22 bp, Homo sapiens
agcagcagggacaaaggaacag

SEQ ID NO: 8173995 - DNA, 22 bp, Homo sapiens
agcagcagggacaaaggaacag

SEQ ID NO: 8173996 - DNA, 22 bp, Homo sapiens
agcagcagggacaaaggaacag

SEQ ID NO: 8173997 - DNA, 22 bp, Homo sapiens
agcagcagggcatgtcttactc

SEQ ID NO: 8173998 - DNA, 22 bp, Homo sapiens
agcagcagggcatgtcttactc

SEQ ID NO: 8173999 - DNA, 22 bp, Homo sapiens
agcagcagggacaaaggaacag

SEQ ID NO: 8174000 - DNA, 22 bp, Homo sapiens
agcagcagggacaaaggaacag

SEQ ID NO: 8174001 - DNA, 22 bp, Homo sapiens
caagcaccatgtgctccatgtt

SEQ ID NO: 8174002 - DNA, 22 bp, Homo sapiens
caagcagacagtaggcctagaa

SEQ ID NO: 8174003 - DNA, 22 bp, Homo sapiens
caagcagagaagtctctaggct

SEQ ID NO: 8174004 - DNA, 22 bp, Homo sapiens
caagcagaaatctagaactcca

SEQ ID NO: 8174005 - DNA, 22 bp, Homo sapiens
caagcagaagcctcaggggcat

SEQ ID NO: 8174006 - DNA, 22 bp, Homo sapiens
caagcagaagcctcaggggcat

SEQ ID NO: 8174007 - DNA, 22 bp, Homo sapiens
caagcagacagtaggcctagaa

SEQ ID NO: 8174008 - DNA, 22 bp, Homo sapiens
caagattttatctccgtttctg

SEQ ID NO: 8174009 - DNA, 22 bp, Homo sapiens
caagatttgtattgggcctctg

SEQ ID NO: 8174010 - DNA, 22 bp, Homo sapiens
caagatttggcaactttgtcat

SEQ ID NO: 8174011 - DNA, 22 bp, Homo sapiens
caagatttggcattctgaggag

SEQ ID NO: 8174012 - DNA, 22 bp, Homo sapiens
caagatttgacttcgtggtttg

SEQ ID NO: 8174013 - DNA, 22 bp, Homo sapiens
caagatttccaaccctgggtaa

SEQ ID NO: 8174014 - DNA, 22 bp, Homo sapiens
caagagatacatttctagtagg

SEQ ID NO: 8174015 - DNA, 22 bp, Homo sapiens
caagagcacgtgccctccataa

SEQ ID NO: 8174016 - DNA, 22 bp, Homo sapiens
caagagatacatttctagtagg

SEQ ID NO: 8174017 - DNA, 22 bp, Homo sapiens
caagagcatccctgcatccagc

SEQ ID NO: 8174018 - DNA, 22 bp, Homo sapiens
caagagcatccctgcatccagc

SEQ ID NO: 8174019 - DNA, 22 bp, Homo sapiens
caagagcatccctgcatccagc

SEQ ID NO: 8174020 - DNA, 22 bp, Homo sapiens
caagagacttatgtggaaacct

SEQ ID NO: 8174021 - DNA, 22 bp, Homo sapiens
caagagcatttagttagctggt

SEQ ID NO: 8174022 - DNA, 22 bp, Homo sapiens
caagagctaccctgtgccatat

SEQ ID NO: 8174023 - DNA, 22 bp, Homo sapiens
caagagcctttgggcagaagga

SEQ ID NO: 8174024 - DNA, 22 bp, Homo sapiens
caagatttagcctgctgcctgt

SEQ ID NO: 8174025 - DNA, 22 bp, Homo sapiens
caagagctagactttgtcagga

SEQ ID NO: 8174026 - DNA, 22 bp, Homo sapiens
caagagctagaaattggttaga

SEQ ID NO: 8174027 - DNA, 22 bp, Homo sapiens
agcagcaggaggccattgtctt

SEQ ID NO: 8174028 - DNA, 22 bp, Homo sapiens
agcagcaggaggctgtccacca

SEQ ID NO: 8174029 - DNA, 22 bp, Homo sapiens
agcagcaggaggctgtccacca

SEQ ID NO: 8174030 - DNA, 22 bp, Homo sapiens
agcagcaggaggctgtccacca

SEQ ID NO: 8174031 - DNA, 22 bp, Homo sapiens
agcagcaggaggccattgtctt

SEQ ID NO: 8174032 - DNA, 22 bp, Homo sapiens
agcagcaggagccgtggggtga

SEQ ID NO: 8174033 - DNA, 22 bp, Homo sapiens
agcagcaggagccgtggggtga

SEQ ID NO: 8174034 - DNA, 22 bp, Homo sapiens
agcagcaggagccgtggggtga

SEQ ID NO: 8174035 - DNA, 22 bp, Homo sapiens
caagcagagactagatagctgt

SEQ ID NO: 8174036 - DNA, 22 bp, Homo sapiens
caagcagagactagatagctgt

SEQ ID NO: 8174037 - DNA, 22 bp, Homo sapiens
caagcagagaagtctctaggct

SEQ ID NO: 8174038 - DNA, 20 bp, Homo sapiens
agcagcagatgttggaggtg

SEQ ID NO: 8174039 - DNA, 22 bp, Homo sapiens
agcagcagctctgttgccctac

SEQ ID NO: 8174040 - DNA, 22 bp, Homo sapiens
agcagcagctctgttgccctac

SEQ ID NO: 8174041 - DNA, 22 bp, Homo sapiens
agcagcagattatggtctacat

SEQ ID NO: 8174042 - DNA, 22 bp, Homo sapiens
agcagcagctctgttgccctac

SEQ ID NO: 8174043 - DNA, 22 bp, Homo sapiens
agcagcaggctgggatgagtct

SEQ ID NO: 8174044 - DNA, 22 bp, Homo sapiens
agcagcaggctgggatgagtct

SEQ ID NO: 8174045 - DNA, 22 bp, Homo sapiens
agcagcaggctgggatgagtct

SEQ ID NO: 8174046 - DNA, 22 bp, Homo sapiens
agcagcaggctgggatgagtct

SEQ ID NO: 8174047 - DNA, 22 bp, Homo sapiens
agcagcaggctgtgtggactga

SEQ ID NO: 8174048 - DNA, 22 bp, Homo sapiens
agcagcaggctgtgtggactga

SEQ ID NO: 8174049 - DNA, 22 bp, Homo sapiens
agcagcaggcttaaggaaaagt

SEQ ID NO: 8174050 - DNA, 22 bp, Homo sapiens
agcagcaggctgtgtggactga

SEQ ID NO: 8174051 - DNA, 22 bp, Homo sapiens
agcagcaggctgtgtggactga

SEQ ID NO: 8174052 - DNA, 22 bp, Homo sapiens
agcagcaggctgtgtggactga

SEQ ID NO: 8174053 - DNA, 22 bp, Homo sapiens
agcagcaggctagggaactgct

SEQ ID NO: 8174054 - DNA, 22 bp, Homo sapiens
agcagcaggctagggaactgct

SEQ ID NO: 8174055 - DNA, 22 bp, Homo sapiens
agcagcaggctagggaactgct

SEQ ID NO: 8174056 - DNA, 22 bp, Homo sapiens
agcagcaggctagggaactgct

SEQ ID NO: 8174057 - DNA, 22 bp, Homo sapiens
agcagcaggctagggaactgct

SEQ ID NO: 8174058 - DNA, 22 bp, Homo sapiens
agcagcaggattttcgttggga

SEQ ID NO: 8174059 - DNA, 23 bp, Homo sapiens
agcagcaggaggtattgataagg

SEQ ID NO: 8174060 - DNA, 22 bp, Homo sapiens
agcagcaggattttcgttggga

SEQ ID NO: 8174061 - DNA, 22 bp, Homo sapiens
agcctggcactgccccatccat

SEQ ID NO: 8174062 - DNA, 22 bp, Homo sapiens
cagcaggatatggtggagagag

SEQ ID NO: 8174063 - DNA, 22 bp, Homo sapiens
agcctggcactgaggcagggcg

SEQ ID NO: 8174064 - DNA, 22 bp, Homo sapiens
agcctggcactgaggcagggcg

SEQ ID NO: 8174065 - DNA, 22 bp, Homo sapiens
agcctggcactgaggcagggcg

SEQ ID NO: 8174066 - DNA, 22 bp, Homo sapiens
cagcagggcccccgggtgcgcc

SEQ ID NO: 8174067 - DNA, 22 bp, Homo sapiens
cagcagggctgtgctaccccat

SEQ ID NO: 8174068 - DNA, 22 bp, Homo sapiens
cagcaggggaactgtgggccag

SEQ ID NO: 8174069 - DNA, 22 bp, Homo sapiens
cagcaggggaactgtgggccag

SEQ ID NO: 8174070 - DNA, 22 bp, Homo sapiens
cagcagggcccccgggtgcgcc

SEQ ID NO: 8174071 - DNA, 22 bp, Homo sapiens
cagcagggcccccgggtgcgcc

SEQ ID NO: 8174072 - DNA, 22 bp, Homo sapiens
cagcagggcccccgggtgcgcc

SEQ ID NO: 8174073 - DNA, 22 bp, Homo sapiens
cagcagggcccccgggtgcgcc

SEQ ID NO: 8174074 - DNA, 22 bp, Homo sapiens
cagcagggcccccgggtgcgcc

SEQ ID NO: 8174075 - DNA, 22 bp, Homo sapiens
cagcagggcccccgggtgcgcc

SEQ ID NO: 8174076 - DNA, 22 bp, Homo sapiens
cagcagctgaggcgctggcgtg

SEQ ID NO: 8174077 - DNA, 22 bp, Homo sapiens
agcctggaggtaatgaggaaac

SEQ ID NO: 8174078 - DNA, 22 bp, Homo sapiens
agcctggagttcccaggagaag

SEQ ID NO: 8174079 - DNA, 22 bp, Homo sapiens
agcctggaggtaatgaggaaac

SEQ ID NO: 8174080 - DNA, 22 bp, Homo sapiens
agcctggagttcccaggagaag

SEQ ID NO: 8174081 - DNA, 22 bp, Homo sapiens
agcctggagttcccaggagaag

SEQ ID NO: 8174082 - DNA, 22 bp, Homo sapiens
agcctggatccatgtggctacc

SEQ ID NO: 8174083 - DNA, 22 bp, Homo sapiens
agcctggatccatgtggctacc

SEQ ID NO: 8174084 - DNA, 22 bp, Homo sapiens
agcctggagttcccaggagaag

SEQ ID NO: 8174085 - DNA, 22 bp, Homo sapiens
agcctggatcctaggctcagct

SEQ ID NO: 8174086 - DNA, 22 bp, Homo sapiens
agcctggatcctaggctcagct

SEQ ID NO: 8174087 - DNA, 22 bp, Homo sapiens
agcctggatcctaggctcagct

SEQ ID NO: 8174088 - DNA, 22 bp, Homo sapiens
agcctggatcctaggctcagct

SEQ ID NO: 8174089 - DNA, 22 bp, Homo sapiens
agcctggattcgtgcatccaca

SEQ ID NO: 8174090 - DNA, 22 bp, Homo sapiens
agcctggattcgtgcatccaca

SEQ ID NO: 8174091 - DNA, 22 bp, Homo sapiens
agcctggattcgtgcatccaca

SEQ ID NO: 8174092 - DNA, 22 bp, Homo sapiens
agcctggattcgtgcatccaca

SEQ ID NO: 8174093 - DNA, 22 bp, Homo sapiens
agcctggattcgtgcatccaca

SEQ ID NO: 8174094 - DNA, 22 bp, Homo sapiens
agcctggcactgaggcagggcg

SEQ ID NO: 8174095 - DNA, 23 bp, Homo sapiens
agcctcttgtggatggtcagcga

SEQ ID NO: 8174096 - DNA, 23 bp, Homo sapiens
agcctcttttctcctgccctgca

SEQ ID NO: 8174097 - DNA, 22 bp, Homo sapiens
agcctctttttcaaggtccaca

SEQ ID NO: 8174098 - DNA, 21 bp, Homo sapiens
agcctgaatcccaccagttca

SEQ ID NO: 8174099 - DNA, 22 bp, Homo sapiens
agcctgagagccaagctgtgca

SEQ ID NO: 8174100 - DNA, 22 bp, Homo sapiens
agcctgagagccaagctgtgca

SEQ ID NO: 8174101 - DNA, 22 bp, Homo sapiens
agcctgagccccatccagctga

SEQ ID NO: 8174102 - DNA, 22 bp, Homo sapiens
agcctgagagccaagctgtgca

SEQ ID NO: 8174103 - DNA, 22 bp, Homo sapiens
agcctgagccccatccagctga

SEQ ID NO: 8174104 - DNA, 22 bp, Homo sapiens
cagcagctcactcaggtggctc

SEQ ID NO: 8174105 - DNA, 22 bp, Homo sapiens
cagcagctcactcaggtggctc

SEQ ID NO: 8174106 - DNA, 20 bp, Homo sapiens
cagcagccaaacttctattc

SEQ ID NO: 8174107 - DNA, 20 bp, Homo sapiens
cagcagccaaacttctattc

SEQ ID NO: 8174108 - DNA, 22 bp, Homo sapiens
cagcagcattgctctggattcc

SEQ ID NO: 8174109 - DNA, 22 bp, Homo sapiens
agcctgagctgcctgccgcctc

SEQ ID NO: 8174110 - DNA, 22 bp, Homo sapiens
cagcagctccaaagaatagcca

SEQ ID NO: 8174111 - DNA, 22 bp, Homo sapiens
cagcagctcagtctctcagtag

SEQ ID NO: 8174112 - DNA, 22 bp, Homo sapiens
cagcagctccaaagaatagcca

SEQ ID NO: 8174113 - DNA, 22 bp, Homo sapiens
cagcagctcccatccgctgagc

SEQ ID NO: 8174114 - DNA, 22 bp, Homo sapiens
cagcagctgactccaagagagc

SEQ ID NO: 8174115 - DNA, 22 bp, Homo sapiens
cagcagctgactccaagagagc

SEQ ID NO: 8174116 - DNA, 22 bp, Homo sapiens
cagcagctcagtctctcagtag

SEQ ID NO: 8174117 - DNA, 22 bp, Homo sapiens
cagcagctcagtctctcagtag

SEQ ID NO: 8174118 - DNA, 22 bp, Homo sapiens
cagcagctcagtctctcagtag

SEQ ID NO: 8174119 - DNA, 22 bp, Homo sapiens
cagcagctcaggctgcttccca

SEQ ID NO: 8174120 - DNA, 22 bp, Homo sapiens
cagcagctcagtctctcagtag

SEQ ID NO: 8174121 - DNA, 22 bp, Homo sapiens
cagcagctcaggctgcttccca

SEQ ID NO: 8174122 - DNA, 22 bp, Homo sapiens
cagcagctcaggctgcttccca

SEQ ID NO: 8174123 - DNA, 22 bp, Homo sapiens
cagcagctcaggctgcttccca

SEQ ID NO: 8174124 - DNA, 22 bp, Homo sapiens
cagcagctcaggctccttccca

SEQ ID NO: 8174125 - DNA, 22 bp, Homo sapiens
cagcagctcaggctccttccca

SEQ ID NO: 8174126 - DNA, 22 bp, Homo sapiens
cagaggtgcatacaggtcatta

SEQ ID NO: 8174127 - DNA, 22 bp, Homo sapiens
cagaggtgcatacaggtcatta

SEQ ID NO: 8174128 - DNA, 22 bp, Homo sapiens
agcctcctggagtttctgggat

SEQ ID NO: 8174129 - DNA, 22 bp, Homo sapiens
agcctcctggagtttctgggat

SEQ ID NO: 8174130 - DNA, 21 bp, Homo sapiens
cagaggtcatcctgaggacaa

SEQ ID NO: 8174131 - DNA, 22 bp, Homo sapiens
cagaggtccagcatacatttcc

SEQ ID NO: 8174132 - DNA, 21 bp, Homo sapiens
cagaggtcatcctgaggacaa

SEQ ID NO: 8174133 - DNA, 22 bp, Homo sapiens
cagaggtccctgttcttaagga

SEQ ID NO: 8174134 - DNA, 22 bp, Homo sapiens
cagaggtccctgttcttaagga

SEQ ID NO: 8174135 - DNA, 22 bp, Homo sapiens
cagaggtccctatttctttgtt

SEQ ID NO: 8174136 - DNA, 22 bp, Homo sapiens
cagaggtccctatttctttgtt

SEQ ID NO: 8174137 - DNA, 22 bp, Homo sapiens
cagaggtctgatgcgtccctgc

SEQ ID NO: 8174138 - DNA, 22 bp, Homo sapiens
cagaggtctgacactgaatggt

SEQ ID NO: 8174139 - DNA, 19 bp, Homo sapiens
cagaggtgatatatgccca

SEQ ID NO: 8174140 - DNA, 22 bp, Homo sapiens
cagaggtctgacactgaatggt

SEQ ID NO: 8174141 - DNA, 22 bp, Homo sapiens
cagaggtctgacactgaatggt

SEQ ID NO: 8174142 - DNA, 22 bp, Homo sapiens
cagaggtctgacactgaatggt

SEQ ID NO: 8174143 - DNA, 22 bp, Homo sapiens
cagaggtctccatcaccctcct

SEQ ID NO: 8174144 - DNA, 22 bp, Homo sapiens
cagaggtctccatcaccctcct

SEQ ID NO: 8174145 - DNA, 22 bp, Homo sapiens
cagagggcactcggagtgacat

SEQ ID NO: 8174146 - DNA, 22 bp, Homo sapiens
cagagggagtttctgaggttgc

SEQ ID NO: 8174147 - DNA, 22 bp, Homo sapiens
cagagggatcatcttcctgaag

SEQ ID NO: 8174148 - DNA, 22 bp, Homo sapiens
cagaggtattttgataaacgcc

SEQ ID NO: 8174149 - DNA, 22 bp, Homo sapiens
cagaggtcaagatctgaagtga

SEQ ID NO: 8174150 - DNA, 22 bp, Homo sapiens
cagaggtcaggttggacattat

SEQ ID NO: 8174151 - DNA, 22 bp, Homo sapiens
cagaggtcaagatctgaagtga

SEQ ID NO: 8174152 - DNA, 22 bp, Homo sapiens
cagaggtcaggacttcattata

SEQ ID NO: 8174153 - DNA, 22 bp, Homo sapiens
cagaggtcaagatctgaagtga

SEQ ID NO: 8174154 - DNA, 22 bp, Homo sapiens
cagagggccatctctatcttca

SEQ ID NO: 8174155 - DNA, 22 bp, Homo sapiens
cagaggtattgcaaaagcctag

SEQ ID NO: 8174156 - DNA, 22 bp, Homo sapiens
agcctctgcttatgcaaaggta

SEQ ID NO: 8174157 - DNA, 22 bp, Homo sapiens
agcctctggccctagactgctt

SEQ ID NO: 8174158 - DNA, 18 bp, Homo sapiens
agcctctggcagagagaa

SEQ ID NO: 8174159 - DNA, 18 bp, Homo sapiens
agcctctggcagagagaa

SEQ ID NO: 8174160 - DNA, 18 bp, Homo sapiens
agcctctggcagagagaa

SEQ ID NO: 8174161 - DNA, 18 bp, Homo sapiens
agcctctggcagagagaa

SEQ ID NO: 8174162 - DNA, 22 bp, Homo sapiens
agcctctgcacttcttacaggt

SEQ ID NO: 8174163 - DNA, 22 bp, Homo sapiens
agcctctgcacttcttacaggt

SEQ ID NO: 8174164 - DNA, 22 bp, Homo sapiens
agcctctgctggccctggcact

SEQ ID NO: 8174165 - DNA, 22 bp, Homo sapiens
agcctctggtcctccctcagct

SEQ ID NO: 8174166 - DNA, 22 bp, Homo sapiens
agcctctgggggagctgggagc

SEQ ID NO: 8174167 - DNA, 22 bp, Homo sapiens
agcctctgggggagctgggagc

SEQ ID NO: 8174168 - DNA, 22 bp, Homo sapiens
agcctctgtagaaagcagtgtg

SEQ ID NO: 8174169 - DNA, 22 bp, Homo sapiens
agcctctgtagaaagcagtgtg

SEQ ID NO: 8174170 - DNA, 22 bp, Homo sapiens
agcctctgtagaaagcagtgtg

SEQ ID NO: 8174171 - DNA, 22 bp, Homo sapiens
agcctctgtgactcacaggtca

SEQ ID NO: 8174172 - DNA, 22 bp, Homo sapiens
agcctctgtcaagcttttcaaa

SEQ ID NO: 8174173 - DNA, 22 bp, Homo sapiens
cagctcaggcactggcgcggga

SEQ ID NO: 8174174 - DNA, 22 bp, Homo sapiens
cagctcaggcactggcgcggga

SEQ ID NO: 8174175 - DNA, 19 bp, Homo sapiens
cagctcaggactcagcccc

SEQ ID NO: 8174176 - DNA, 22 bp, Homo sapiens
cagctcaggctctccatgctcc

SEQ ID NO: 8174177 - DNA, 22 bp, Homo sapiens
cagctcagtctggagagatgca

SEQ ID NO: 8174178 - DNA, 22 bp, Homo sapiens
cagctcagtctggagagatgca

SEQ ID NO: 8174179 - DNA, 22 bp, Homo sapiens
cagctcaggctctccatgctcc

SEQ ID NO: 8174180 - DNA, 22 bp, Homo sapiens
cagctcaggctctccatgctcc

SEQ ID NO: 8174181 - DNA, 22 bp, Homo sapiens
cagctcaggctctccatgctcc

SEQ ID NO: 8174182 - DNA, 19 bp, Homo sapiens
cagctcaggactcagcccc

SEQ ID NO: 8174183 - DNA, 19 bp, Homo sapiens
cagctcaggactcagcccc

SEQ ID NO: 8174184 - DNA, 22 bp, Homo sapiens
cagctcaggaaggaaggccggc

SEQ ID NO: 8174185 - DNA, 22 bp, Homo sapiens
cagctcaggaaggaaggccggc

SEQ ID NO: 8174186 - DNA, 22 bp, Homo sapiens
cagctcaggaaggaaggccggc

SEQ ID NO: 8174187 - DNA, 22 bp, Homo sapiens
agctcaggcaactctgggcccc

SEQ ID NO: 8174188 - DNA, 22 bp, Homo sapiens
cagctaagaatgtctgagatca

SEQ ID NO: 8174189 - DNA, 22 bp, Homo sapiens
cagctaagaatgtctgagatca

SEQ ID NO: 8174190 - DNA, 22 bp, Homo sapiens
cagcgtgggatttggaaaccag

SEQ ID NO: 8174191 - DNA, 22 bp, Homo sapiens
agctcagcttcctctccatgct

SEQ ID NO: 8174192 - DNA, 22 bp, Homo sapiens
agctcaggcaactctgggcccc

SEQ ID NO: 8174193 - DNA, 22 bp, Homo sapiens
agctcagcgggcttctggtaag

SEQ ID NO: 8174194 - DNA, 22 bp, Homo sapiens
agctcagcttcctctccatgct

SEQ ID NO: 8174195 - DNA, 22 bp, Homo sapiens
agctcagcttcctctccatgct

SEQ ID NO: 8174196 - DNA, 22 bp, Homo sapiens
agctcagcttcctctccatgct

SEQ ID NO: 8174197 - DNA, 22 bp, Homo sapiens
agctcagcgggcttctggtaag

SEQ ID NO: 8174198 - DNA, 21 bp, Homo sapiens
agctcagccgggcacagtggc

SEQ ID NO: 8174199 - DNA, 21 bp, Homo sapiens
agctcagccgggcacagtggc

SEQ ID NO: 8174200 - DNA, 21 bp, Homo sapiens
agctcagccgggcacagtggc

SEQ ID NO: 8174201 - DNA, 22 bp, Homo sapiens
agctcagccctcctgtgcagct

SEQ ID NO: 8174202 - DNA, 22 bp, Homo sapiens
agctcagccctcctgtgcagct

SEQ ID NO: 8174203 - DNA, 22 bp, Homo sapiens
agctcagccctcctgtgcagct

SEQ ID NO: 8174204 - DNA, 22 bp, Homo sapiens
agctcagcccgttagtaagccc

SEQ ID NO: 8174205 - DNA, 22 bp, Homo sapiens
agctcagagggaggtgaagtgg

SEQ ID NO: 8174206 - DNA, 21 bp, Homo sapiens
agctcagcaagatggaggctc

SEQ ID NO: 8174207 - DNA, 22 bp, Homo sapiens
agctcagcactgtcagcactcc

SEQ ID NO: 8174208 - DNA, 22 bp, Homo sapiens
agctcagcactgtcagcactcc

SEQ ID NO: 8174209 - DNA, 22 bp, Homo sapiens
agctcagcactgtcagcactcc

SEQ ID NO: 8174210 - DNA, 22 bp, Homo sapiens
agctcagagctcgggaggatgg

SEQ ID NO: 8174211 - DNA, 22 bp, Homo sapiens
agctcagagctcgggaggatgg

SEQ ID NO: 8174212 - DNA, 22 bp, Homo sapiens
agctcagagataatcaagagac

SEQ ID NO: 8174213 - DNA, 22 bp, Homo sapiens
agctcagagggaggtgaagtgg

SEQ ID NO: 8174214 - DNA, 22 bp, Homo sapiens
agctcagagctcgggaggatgg

SEQ ID NO: 8174215 - DNA, 22 bp, Homo sapiens
agctcagagataatcaagagac

SEQ ID NO: 8174216 - DNA, 22 bp, Homo sapiens
agctcagagataatcaagagac

SEQ ID NO: 8174217 - DNA, 22 bp, Homo sapiens
cagctccaaagccccactgtcc

SEQ ID NO: 8174218 - DNA, 22 bp, Homo sapiens
cagctccaaagccccactgtcc

SEQ ID NO: 8174219 - DNA, 22 bp, Homo sapiens
cagctcattcctcaatctagga

SEQ ID NO: 8174220 - DNA, 22 bp, Homo sapiens
agctcctgaaaatccagactgg

SEQ ID NO: 8174221 - DNA, 22 bp, Homo sapiens
agctcctgaaaatccagactgg

SEQ ID NO: 8174222 - DNA, 18 bp, Homo sapiens
agctcctgaactctgtgg

SEQ ID NO: 8174223 - DNA, 22 bp, Homo sapiens
cagctcagtcttgaagcactgg

SEQ ID NO: 8174224 - DNA, 22 bp, Homo sapiens
cagctcagtgatgccttcacag

SEQ ID NO: 8174225 - DNA, 22 bp, Homo sapiens
cagctcagtgatgccttcacag

SEQ ID NO: 8174226 - DNA, 22 bp, Homo sapiens
cagctcagtgatgccttcacag

SEQ ID NO: 8174227 - DNA, 22 bp, Homo sapiens
cagctcagtcttgaagcactgg

SEQ ID NO: 8174228 - DNA, 22 bp, Homo sapiens
cagctcagtcttgaagcactgg

SEQ ID NO: 8174229 - DNA, 22 bp, Homo sapiens
cagctcagtcttgaagcactgg

SEQ ID NO: 8174230 - DNA, 19 bp, Homo sapiens
cagctcagtttgattctct

SEQ ID NO: 8174231 - DNA, 19 bp, Homo sapiens
cagctcagtttgattctct

SEQ ID NO: 8174232 - DNA, 19 bp, Homo sapiens
cagctcagtttgattctct

SEQ ID NO: 8174233 - DNA, 22 bp, Homo sapiens
cagctcagtttcaataccaggt

SEQ ID NO: 8174234 - DNA, 22 bp, Homo sapiens
cagctcagtttcaataccaggt

SEQ ID NO: 8174235 - DNA, 22 bp, Homo sapiens
agctcctgatacatgcaggaat

SEQ ID NO: 8174236 - DNA, 20 bp, Homo sapiens
agctcctgagggttactttc

SEQ ID NO: 8174237 - DNA, 23 bp, Homo sapiens
agctcctgaggccagcctctcct

SEQ ID NO: 8174238 - DNA, 22 bp, Homo sapiens
agctcctgatacatgcaggaat

SEQ ID NO: 8174239 - DNA, 22 bp, Homo sapiens
agctcctgattctcagagatag

SEQ ID NO: 8174240 - DNA, 22 bp, Homo sapiens
agctcctgatacatgcaggaat

SEQ ID NO: 8174241 - DNA, 22 bp, Homo sapiens
cagctctgagactgaggctatg

SEQ ID NO: 8174242 - DNA, 22 bp, Homo sapiens
cagctctgacacagtacaaaat

SEQ ID NO: 8174243 - DNA, 20 bp, Homo sapiens
cagctctgggcaggtcgagg

SEQ ID NO: 8174244 - DNA, 22 bp, Homo sapiens
cagcatcaacattctcagctct

SEQ ID NO: 8174245 - DNA, 23 bp, Homo sapiens
cagccctgaaatcgaggtgacac

SEQ ID NO: 8174246 - DNA, 22 bp, Homo sapiens
cagccctgagaaggaggatctc

SEQ ID NO: 8174247 - DNA, 22 bp, Homo sapiens
cagccctgagaaggaggatctc

SEQ ID NO: 8174248 - DNA, 22 bp, Homo sapiens
cagccctgagaaggaggatctc

SEQ ID NO: 8174249 - DNA, 22 bp, Homo sapiens
cagccctgagaaggaggatctc

SEQ ID NO: 8174250 - DNA, 22 bp, Homo sapiens
cagccctgagcaaggcttttaa

SEQ ID NO: 8174251 - DNA, 22 bp, Homo sapiens
cagccctgagagaaccatctat

SEQ ID NO: 8174252 - DNA, 22 bp, Homo sapiens
cagccctgagagaaccatctat

SEQ ID NO: 8174253 - DNA, 22 bp, Homo sapiens
cagccctgagagaaccatctat

SEQ ID NO: 8174254 - DNA, 22 bp, Homo sapiens
cagccctgcacgctgcctccgc

SEQ ID NO: 8174255 - DNA, 22 bp, Homo sapiens
cagccctgcagagggcgctcct

SEQ ID NO: 8174256 - DNA, 22 bp, Homo sapiens
cagccctgcagagggcgctcct

SEQ ID NO: 8174257 - DNA, 22 bp, Homo sapiens
cagccctgcagagggcgctcct

SEQ ID NO: 8174258 - DNA, 22 bp, Homo sapiens
agctcagagataatcaagagac

SEQ ID NO: 8174259 - DNA, 22 bp, Homo sapiens
agctcagagaatagggcttgag

SEQ ID NO: 8174260 - DNA, 22 bp, Homo sapiens
cagccctgcacgctgcctccgc

SEQ ID NO: 8174261 - DNA, 22 bp, Homo sapiens
cagccctgcacgctgcctccgc

SEQ ID NO: 8174262 - DNA, 22 bp, Homo sapiens
cagccctgcacgctgcctccgc

SEQ ID NO: 8174263 - DNA, 22 bp, Homo sapiens
cagccctgcacgctgcctccgc

SEQ ID NO: 8174264 - DNA, 22 bp, Homo sapiens
cagccctgagttagcccacgga

SEQ ID NO: 8174265 - DNA, 16 bp, Homo sapiens
cagccctgaggaagaa

SEQ ID NO: 8174266 - DNA, 22 bp, Homo sapiens
cagcagtttcctatggttcagc

SEQ ID NO: 8174267 - DNA, 22 bp, Homo sapiens
cagcagttctgtactttagagt

SEQ ID NO: 8174268 - DNA, 22 bp, Homo sapiens
cagcagttttgaagtgtggaga

SEQ ID NO: 8174269 - DNA, 22 bp, Homo sapiens
cagcataaaataaatctacatg

SEQ ID NO: 8174270 - DNA, 22 bp, Homo sapiens
cagcataaaataaatctacatg

SEQ ID NO: 8174271 - DNA, 22 bp, Homo sapiens
cagcagtgtggaagctgagggg

SEQ ID NO: 8174272 - DNA, 22 bp, Homo sapiens
cagcagtgtggaagctgagggg

SEQ ID NO: 8174273 - DNA, 21 bp, Homo sapiens
cagcagtgtgtctgagctaga

SEQ ID NO: 8174274 - DNA, 21 bp, Homo sapiens
cagcagtgtgtctgagctaga

SEQ ID NO: 8174275 - DNA, 21 bp, Homo sapiens
cagcagtgtgtctgagctaga

SEQ ID NO: 8174276 - DNA, 22 bp, Homo sapiens
cagcagttatgagtagaatagt

SEQ ID NO: 8174277 - DNA, 22 bp, Homo sapiens
cagcagttatgagtagaatagt

SEQ ID NO: 8174278 - DNA, 22 bp, Homo sapiens
cagcaggggtgtcattgtagtt

SEQ ID NO: 8174279 - DNA, 22 bp, Homo sapiens
cagcagggtaggttgtatcagt

SEQ ID NO: 8174280 - DNA, 22 bp, Homo sapiens
cagcagggggcagcgcagatca

SEQ ID NO: 8174281 - DNA, 22 bp, Homo sapiens
cagcaggggaactgtgggccag

SEQ ID NO: 8174282 - DNA, 22 bp, Homo sapiens
cagcaggggaactgtgggccag

SEQ ID NO: 8174283 - DNA, 22 bp, Homo sapiens
cagcaggggaactgtgggccag

SEQ ID NO: 8174284 - DNA, 22 bp, Homo sapiens
cagcagggttaagtgactcacc

SEQ ID NO: 8174285 - DNA, 22 bp, Homo sapiens
cagcagtgtctccagcatcaca

SEQ ID NO: 8174286 - DNA, 22 bp, Homo sapiens
cagcagtgtgcaggtgtgctgg

SEQ ID NO: 8174287 - DNA, 22 bp, Homo sapiens
cagcagtgtgcaggtgtgctgg

SEQ ID NO: 8174288 - DNA, 22 bp, Homo sapiens
cagcagtgtctccagcatcaca

SEQ ID NO: 8174289 - DNA, 22 bp, Homo sapiens
cagcagggtatacagggaattt

SEQ ID NO: 8174290 - DNA, 22 bp, Homo sapiens
cagcagggtatacagggaattt

SEQ ID NO: 8174291 - DNA, 22 bp, Homo sapiens
cagcagggtatacagggaattt

SEQ ID NO: 8174292 - DNA, 22 bp, Homo sapiens
cagaaatatatatgggtcagag

SEQ ID NO: 8174293 - DNA, 19 bp, Homo sapiens
cagaaatagcgaagtgtaa

SEQ ID NO: 8174294 - DNA, 22 bp, Homo sapiens
agccactgtctgaacttctgtg

SEQ ID NO: 8174295 - DNA, 22 bp, Homo sapiens
agccactggtaaactggtagga

SEQ ID NO: 8174296 - DNA, 22 bp, Homo sapiens
agccactggcctgggcagctct

SEQ ID NO: 8174297 - DNA, 22 bp, Homo sapiens
cagaaatatcagttgaaagtgc

SEQ ID NO: 8174298 - DNA, 22 bp, Homo sapiens
cagaaatatatatgggtcagag

SEQ ID NO: 8174299 - DNA, 22 bp, Homo sapiens
cagaaatatcacctggactcta

SEQ ID NO: 8174300 - DNA, 22 bp, Homo sapiens
cagaaatatcacctggactcta

SEQ ID NO: 8174301 - DNA, 21 bp, Homo sapiens
cagaaatatgaatgatggtga

SEQ ID NO: 8174302 - DNA, 22 bp, Homo sapiens
cagaaatatcagttgaaagtgc

SEQ ID NO: 8174303 - DNA, 22 bp, Homo sapiens
cagaaatatcagttgaaagtgc

SEQ ID NO: 8174304 - DNA, 22 bp, Homo sapiens
cagaaatatcagttgaaagtgc

SEQ ID NO: 8174305 - DNA, 22 bp, Homo sapiens
cagaaatattccaagtactgca

SEQ ID NO: 8174306 - DNA, 22 bp, Homo sapiens
cagaaatatttattgagtgaca

SEQ ID NO: 8174307 - DNA, 22 bp, Homo sapiens
cagaaatattccaagtactgca

SEQ ID NO: 8174308 - DNA, 22 bp, Homo sapiens
cagaaatatgtgccatgcctta

SEQ ID NO: 8174309 - DNA, 22 bp, Homo sapiens
cagaaatatgtgccatgcctta

SEQ ID NO: 8174310 - DNA, 22 bp, Homo sapiens
cagaaggcaaacaaaaggattt

SEQ ID NO: 8174311 - DNA, 22 bp, Homo sapiens
cagaaggagggggcaagccctg

SEQ ID NO: 8174312 - DNA, 22 bp, Homo sapiens
cagaataagctgtgttgtcaag

SEQ ID NO: 8174313 - DNA, 18 bp, Homo sapiens
cagaaatcacaccagcac

SEQ ID NO: 8174314 - DNA, 22 bp, Homo sapiens
cagaaatatttattgagtgaca

SEQ ID NO: 8174315 - DNA, 22 bp, Homo sapiens
agccaccaccactgaaaggtta

SEQ ID NO: 8174316 - DNA, 22 bp, Homo sapiens
agccacatttttctgctcctga

SEQ ID NO: 8174317 - DNA, 22 bp, Homo sapiens
agccacagtgggctaccagctc

SEQ ID NO: 8174318 - DNA, 22 bp, Homo sapiens
agccacagtgcaagagagaaaa

SEQ ID NO: 8174319 - DNA, 22 bp, Homo sapiens
agccacctcacctgctgccgtt

SEQ ID NO: 8174320 - DNA, 22 bp, Homo sapiens
agccacctctatcttgggctcc

SEQ ID NO: 8174321 - DNA, 22 bp, Homo sapiens
agccacctctgtgcaggcctcg

SEQ ID NO: 8174322 - DNA, 22 bp, Homo sapiens
agccacctctgtgcaggcctcg

SEQ ID NO: 8174323 - DNA, 22 bp, Homo sapiens
agccactccttcagcgtctgct

SEQ ID NO: 8174324 - DNA, 22 bp, Homo sapiens
agcatataaatggacatatttg

SEQ ID NO: 8174325 - DNA, 22 bp, Homo sapiens
agcatagtatgataagtgacaa

SEQ ID NO: 8174326 - DNA, 23 bp, Homo sapiens
agcatagttgtggggccttttga

SEQ ID NO: 8174327 - DNA, 22 bp, Homo sapiens
agcatagatacattgagccaca

SEQ ID NO: 8174328 - DNA, 22 bp, Homo sapiens
agcatatacaaactcatataca

SEQ ID NO: 8174329 - DNA, 22 bp, Homo sapiens
agcatataaatggacatatttg

SEQ ID NO: 8174330 - DNA, 22 bp, Homo sapiens
agcatataaatggacatatttg

SEQ ID NO: 8174331 - DNA, 22 bp, Homo sapiens
agccacaggaaacagagacagc

SEQ ID NO: 8174332 - DNA, 22 bp, Homo sapiens
agccacaggaaacagagacagc

SEQ ID NO: 8174333 - DNA, 22 bp, Homo sapiens
agccacaggaaacagagacagc

SEQ ID NO: 8174334 - DNA, 22 bp, Homo sapiens
agcatatagctatctttgattg

SEQ ID NO: 8174335 - DNA, 22 bp, Homo sapiens
agcatataggaaatgttgaatc

SEQ ID NO: 8174336 - DNA, 22 bp, Homo sapiens
agccacagtctgtagccagctt

SEQ ID NO: 8174337 - DNA, 22 bp, Homo sapiens
agccacagtgcaagagagaaaa

SEQ ID NO: 8174338 - DNA, 22 bp, Homo sapiens
agccacagtctgtagccagctt

SEQ ID NO: 8174339 - DNA, 22 bp, Homo sapiens
agccacagtctgtagccagctt

SEQ ID NO: 8174340 - DNA, 22 bp, Homo sapiens
cagacaggttgcaaaacttcaa

SEQ ID NO: 8174341 - DNA, 22 bp, Homo sapiens
cagacaggtagggacagaacat

SEQ ID NO: 8174342 - DNA, 22 bp, Homo sapiens
cagacagtggacttgataaagg

SEQ ID NO: 8174343 - DNA, 22 bp, Homo sapiens
cagacatatgttttaacagatt

SEQ ID NO: 8174344 - DNA, 22 bp, Homo sapiens
cagacatatgttttaacagatt

SEQ ID NO: 8174345 - DNA, 22 bp, Homo sapiens
cagacatccaggtacgagcttt

SEQ ID NO: 8174346 - DNA, 22 bp, Homo sapiens
cagacatgatgtaagcagaggc

SEQ ID NO: 8174347 - DNA, 22 bp, Homo sapiens
cagacatgatgtaagcagaggc

SEQ ID NO: 8174348 - DNA, 22 bp, Homo sapiens
cagacagggttttggtctttgg

SEQ ID NO: 8174349 - DNA, 22 bp, Homo sapiens
cagacaggaagttcagaagaaa

SEQ ID NO: 8174350 - DNA, 22 bp, Homo sapiens
cagacagggtgggtttctgggc

SEQ ID NO: 8174351 - DNA, 22 bp, Homo sapiens
agccagagagtgttggagatgt

SEQ ID NO: 8174352 - DNA, 22 bp, Homo sapiens
agccagagagtgttggagatgt

SEQ ID NO: 8174353 - DNA, 22 bp, Homo sapiens
agccagagagccccaggttcta

SEQ ID NO: 8174354 - DNA, 22 bp, Homo sapiens
agccagagagccccaggttcta

SEQ ID NO: 8174355 - DNA, 22 bp, Homo sapiens
agccagagaacagcaggaaatg

SEQ ID NO: 8174356 - DNA, 22 bp, Homo sapiens
agccagacatggctcctgctcc

SEQ ID NO: 8174357 - DNA, 20 bp, Homo sapiens
agccagaagaaggctggaga

SEQ ID NO: 8174358 - DNA, 22 bp, Homo sapiens
agccagagaacagcaggaaatg

SEQ ID NO: 8174359 - DNA, 22 bp, Homo sapiens
agccactgtgtgaccagctgtc

SEQ ID NO: 8174360 - DNA, 22 bp, Homo sapiens
agccactgtgtgaccagctgtc

SEQ ID NO: 8174361 - DNA, 22 bp, Homo sapiens
agccagaaaaacaccaagagga

SEQ ID NO: 8174362 - DNA, 22 bp, Homo sapiens
agccactttactttcatatttt

SEQ ID NO: 8174363 - DNA, 22 bp, Homo sapiens
agccagaacgcatcgccaaggc

SEQ ID NO: 8174364 - DNA, 22 bp, Homo sapiens
agccagaacgcatcgccaaggc

SEQ ID NO: 8174365 - DNA, 22 bp, Homo sapiens
cagaatgggaaggactgcagtt

SEQ ID NO: 8174366 - DNA, 22 bp, Homo sapiens
agccactgtgagaggaccaggg

SEQ ID NO: 8174367 - DNA, 22 bp, Homo sapiens
agccactgtgagaggaccaggg

SEQ ID NO: 8174368 - DNA, 22 bp, Homo sapiens
cagaatatgactcgggcactac

SEQ ID NO: 8174369 - DNA, 22 bp, Homo sapiens
cagaatatgaccctaggccttt

SEQ ID NO: 8174370 - DNA, 22 bp, Homo sapiens
cagaatgagataacccagattg

SEQ ID NO: 8174371 - DNA, 22 bp, Homo sapiens
cagaatgaaatgtaagaacacc

SEQ ID NO: 8174372 - DNA, 22 bp, Homo sapiens
cagaatgagataacccagattg

SEQ ID NO: 8174373 - DNA, 22 bp, Homo sapiens
cagaatgagataacccagattg

SEQ ID NO: 8174374 - DNA, 22 bp, Homo sapiens
cagaatgagtagcatcttcacc

SEQ ID NO: 8174375 - DNA, 22 bp, Homo sapiens
agcccagatggtagccctagaa

SEQ ID NO: 8174376 - DNA, 22 bp, Homo sapiens
agcccagagggtagcagaagaa

SEQ ID NO: 8174377 - DNA, 22 bp, Homo sapiens
agcccagagggtagcagaagaa

SEQ ID NO: 8174378 - DNA, 22 bp, Homo sapiens
agcccagaggctgggcgtgcat

SEQ ID NO: 8174379 - DNA, 22 bp, Homo sapiens
agcccagagccccggccatgtt

SEQ ID NO: 8174380 - DNA, 22 bp, Homo sapiens
agcccaaggccacacagttagt

SEQ ID NO: 8174381 - DNA, 22 bp, Homo sapiens
agcccaaggcttccctgctggc

SEQ ID NO: 8174382 - DNA, 22 bp, Homo sapiens
agcccagcccgggctgcgcttt

SEQ ID NO: 8174383 - DNA, 22 bp, Homo sapiens
agcccagcccgggctgcgcttt

SEQ ID NO: 8174384 - DNA, 23 bp, Homo sapiens
agcccagcagagaacctaggtcc

SEQ ID NO: 8174385 - DNA, 22 bp, Homo sapiens
agcccagcagaaagtccagcct

SEQ ID NO: 8174386 - DNA, 22 bp, Homo sapiens
agcccagcactgggggcccagc

SEQ ID NO: 8174387 - DNA, 22 bp, Homo sapiens
agcccagcactgggggcccagc

SEQ ID NO: 8174388 - DNA, 22 bp, Homo sapiens
agcccagcagaaagtccagcct

SEQ ID NO: 8174389 - DNA, 22 bp, Homo sapiens
cagacttttgacattaatacag

SEQ ID NO: 8174390 - DNA, 22 bp, Homo sapiens
cagacttttgacattaatacag

SEQ ID NO: 8174391 - DNA, 22 bp, Homo sapiens
cagagaaagaagcccattcatt

SEQ ID NO: 8174392 - DNA, 22 bp, Homo sapiens
cagagaaactcagatagctgat

SEQ ID NO: 8174393 - DNA, 22 bp, Homo sapiens
cagagaaactcagatagctgat

SEQ ID NO: 8174394 - DNA, 22 bp, Homo sapiens
agccagtttgcttgtaataaca

SEQ ID NO: 8174395 - DNA, 22 bp, Homo sapiens
cagagaaagggtgaattccttc

SEQ ID NO: 8174396 - DNA, 22 bp, Homo sapiens
cagagaaagaagcccattcatt

SEQ ID NO: 8174397 - DNA, 22 bp, Homo sapiens
agcccaagcataggagggaggc

SEQ ID NO: 8174398 - DNA, 22 bp, Homo sapiens
agcccaagaagagctttcttgc

SEQ ID NO: 8174399 - DNA, 22 bp, Homo sapiens
agcccaagctatgaggtgacct

SEQ ID NO: 8174400 - DNA, 22 bp, Homo sapiens
agcccaagctatgaggtgacct

SEQ ID NO: 8174401 - DNA, 22 bp, Homo sapiens
agcccaagctatgaggtgacct

SEQ ID NO: 8174402 - DNA, 22 bp, Homo sapiens
agcccaagcctggctggcgatg

SEQ ID NO: 8174403 - DNA, 22 bp, Homo sapiens
cagagggacagtatgatgaaag

SEQ ID NO: 8174404 - DNA, 22 bp, Homo sapiens
cagagggacagtatgatgaaag

SEQ ID NO: 8174405 - DNA, 22 bp, Homo sapiens
cagagggaaaaggggagtaata

SEQ ID NO: 8174406 - DNA, 22 bp, Homo sapiens
cagaggctgacaaaatattgct

SEQ ID NO: 8174407 - DNA, 22 bp, Homo sapiens
agcccagggaaccaggaagtgg

SEQ ID NO: 8174408 - DNA, 22 bp, Homo sapiens
cagagggacagtgtaatgcata

SEQ ID NO: 8174409 - DNA, 22 bp, Homo sapiens
cagagggaccagaacatactgt

SEQ ID NO: 8174410 - DNA, 22 bp, Homo sapiens
cagagggaccagaacatactgt

SEQ ID NO: 8174411 - DNA, 22 bp, Homo sapiens
cagagggagccctccaggagca

SEQ ID NO: 8174412 - DNA, 22 bp, Homo sapiens
cagagggagccctccaggagca

SEQ ID NO: 8174413 - DNA, 22 bp, Homo sapiens
agcccagggaaccaggaagtgg

SEQ ID NO: 8174414 - DNA, 22 bp, Homo sapiens
agcccagggaaccaggaagtgg

SEQ ID NO: 8174415 - DNA, 22 bp, Homo sapiens
agcccagggaaccaggaagtgg

SEQ ID NO: 8174416 - DNA, 22 bp, Homo sapiens
agcccaggctggagtgcagtgg

SEQ ID NO: 8174417 - DNA, 22 bp, Homo sapiens
agcccaggctggagtgcagtgg

SEQ ID NO: 8174418 - DNA, 22 bp, Homo sapiens
agcccaggctggagtgcagtgg

SEQ ID NO: 8174419 - DNA, 22 bp, Homo sapiens
agcccaggctggagtgcagtgg

SEQ ID NO: 8174420 - DNA, 18 bp, Homo sapiens
agcccaggcatcgtctgc

SEQ ID NO: 8174421 - DNA, 18 bp, Homo sapiens
agcccaggcatcgtctgc

SEQ ID NO: 8174422 - DNA, 20 bp, Homo sapiens
agcccaggcctgtgtgagtc

SEQ ID NO: 8174423 - DNA, 20 bp, Homo sapiens
agcccaggcctgtgtgagtc

SEQ ID NO: 8174424 - DNA, 20 bp, Homo sapiens
agcccaggcctgtgtgagtc

SEQ ID NO: 8174425 - DNA, 22 bp, Homo sapiens
agcccaggctggagtgcagtgg

SEQ ID NO: 8174426 - DNA, 22 bp, Homo sapiens
agcccaggcagagggatgcttg

SEQ ID NO: 8174427 - DNA, 22 bp, Homo sapiens
agcccaggcagagggatgcttg

SEQ ID NO: 8174428 - DNA, 22 bp, Homo sapiens
agcccaggcagagggatgcttg

SEQ ID NO: 8174429 - DNA, 22 bp, Homo sapiens
agcccaggcagagggatgcttg

SEQ ID NO: 8174430 - DNA, 22 bp, Homo sapiens
cagaggcattactgaaaaggtg

SEQ ID NO: 8174431 - DNA, 22 bp, Homo sapiens
cagaggcattactgaaaaggtg

SEQ ID NO: 8174432 - DNA, 22 bp, Homo sapiens
cagaggcattactgaaaaggtg

SEQ ID NO: 8174433 - DNA, 23 bp, Homo sapiens
cagaggcatcggattcaacatca

SEQ ID NO: 8174434 - DNA, 22 bp, Homo sapiens
cagaggcatataattgctgggg

SEQ ID NO: 8174435 - DNA, 23 bp, Homo sapiens
cagaggcatcggattcaacatca

SEQ ID NO: 8174436 - DNA, 22 bp, Homo sapiens
cagaggcatataattgctgggg

SEQ ID NO: 8174437 - DNA, 22 bp, Homo sapiens
cagaggcatataattgctgggg

SEQ ID NO: 8174438 - DNA, 22 bp, Homo sapiens
cagaggcatataattgctgggg

SEQ ID NO: 8174439 - DNA, 22 bp, Homo sapiens
cagaggcatactcccagtcttg

SEQ ID NO: 8174440 - DNA, 22 bp, Homo sapiens
cagaggcagtggggttgctcct

SEQ ID NO: 8174441 - DNA, 22 bp, Homo sapiens
cagaggcagtggggttgctcct

SEQ ID NO: 8174442 - DNA, 21 bp, Homo sapiens
cagaggcaggtcctgggacgg

SEQ ID NO: 8174443 - DNA, 21 bp, Homo sapiens
cagaggcaggtcctgggacgg

SEQ ID NO: 8174444 - DNA, 21 bp, Homo sapiens
cagaggcaggtcctgggacgg

SEQ ID NO: 8174445 - DNA, 21 bp, Homo sapiens
cagaggcaggtcctgggacgg

SEQ ID NO: 8174446 - DNA, 21 bp, Homo sapiens
cagaggcaggtcctgggacgg

SEQ ID NO: 8174447 - DNA, 21 bp, Homo sapiens
cagaggcaggtcctgggacgg

SEQ ID NO: 8174448 - DNA, 22 bp, Homo sapiens
agcccagccggattcccagttc

SEQ ID NO: 8174449 - DNA, 22 bp, Homo sapiens
cagaggagttcagtacacagcc

SEQ ID NO: 8174450 - DNA, 22 bp, Homo sapiens
agcccagccggattcccagttc

SEQ ID NO: 8174451 - DNA, 22 bp, Homo sapiens
cagaggagttcagtacacagcc

SEQ ID NO: 8174452 - DNA, 22 bp, Homo sapiens
cagaggagttcagtacacagcc

SEQ ID NO: 8174453 - DNA, 21 bp, Homo sapiens
cagaggcaggtcctgggacgg

SEQ ID NO: 8174454 - DNA, 21 bp, Homo sapiens
cagaggcaggctctgtgtgtg

SEQ ID NO: 8174455 - DNA, 22 bp, Homo sapiens
cagaggagttcagtacacagcc

SEQ ID NO: 8174456 - DNA, 21 bp, Homo sapiens
cagaggcaggctctgtgtgtg

SEQ ID NO: 8174457 - DNA, 22 bp, Homo sapiens
agagacatggagaggcaaagtt

SEQ ID NO: 8174458 - DNA, 22 bp, Homo sapiens
agagacatgcagttgttgtgaa

SEQ ID NO: 8174459 - DNA, 22 bp, Homo sapiens
agagacatgcagttgttgtgaa

SEQ ID NO: 8174460 - DNA, 22 bp, Homo sapiens
agagacagggttttgtcgtgtt

SEQ ID NO: 8174461 - DNA, 22 bp, Homo sapiens
agagacagggttttgtcgtgtt

SEQ ID NO: 8174462 - DNA, 22 bp, Homo sapiens
agagacagggttttgtcgtgtt

SEQ ID NO: 8174463 - DNA, 22 bp, Homo sapiens
agagacagggttttgtcgtgtt

SEQ ID NO: 8174464 - DNA, 19 bp, Homo sapiens
agagaccacagagctgcct

SEQ ID NO: 8174465 - DNA, 19 bp, Homo sapiens
agagaccacagagctgcct

SEQ ID NO: 8174466 - DNA, 19 bp, Homo sapiens
agagaccacagagctgcct

SEQ ID NO: 8174467 - DNA, 22 bp, Homo sapiens
agagaccagaatccagctgcct

SEQ ID NO: 8174468 - DNA, 22 bp, Homo sapiens
agagaccagaatccagctgcct

SEQ ID NO: 8174469 - DNA, 21 bp, Homo sapiens
agagaccagctgttactccca

SEQ ID NO: 8174470 - DNA, 22 bp, Homo sapiens
agagacagaggcaatatagctt

SEQ ID NO: 8174471 - DNA, 22 bp, Homo sapiens
agagacagggttttgtcgtgtt

SEQ ID NO: 8174472 - DNA, 22 bp, Homo sapiens
agagaaggaaagctgacatggg

SEQ ID NO: 8174473 - DNA, 22 bp, Homo sapiens
agagaagagtcttgtcaaatta

SEQ ID NO: 8174474 - DNA, 22 bp, Homo sapiens
agagaagattcttatatgtctt

SEQ ID NO: 8174475 - DNA, 22 bp, Homo sapiens
agagaagcagggagtcatctgt

SEQ ID NO: 8174476 - DNA, 22 bp, Homo sapiens
agagaagctgacaggggcgtgc

SEQ ID NO: 8174477 - DNA, 22 bp, Homo sapiens
agagactaagccagcatagtgc

SEQ ID NO: 8174478 - DNA, 22 bp, Homo sapiens
agagactgatggagctcactct

SEQ ID NO: 8174479 - DNA, 22 bp, Homo sapiens
atggcctgatgcacctgtccca

SEQ ID NO: 8174480 - DNA, 22 bp, Homo sapiens
atggcctgatgcacctgtccca

SEQ ID NO: 8174481 - DNA, 22 bp, Homo sapiens
agagacctgaagagcttcctca

SEQ ID NO: 8174482 - DNA, 22 bp, Homo sapiens
agagacctttctcctgcctttc

SEQ ID NO: 8174483 - DNA, 22 bp, Homo sapiens
atggcctggggattcctgagca

SEQ ID NO: 8174484 - DNA, 22 bp, Homo sapiens
atggcctggggattcctgagca

SEQ ID NO: 8174485 - DNA, 22 bp, Homo sapiens
atggcctggggattcctgagca

SEQ ID NO: 8174486 - DNA, 22 bp, Homo sapiens
atggcctgggcccgcttcagat

SEQ ID NO: 8174487 - DNA, 22 bp, Homo sapiens
atggcctggggagcatgggaag

SEQ ID NO: 8174488 - DNA, 22 bp, Homo sapiens
atggcctgcagtgctgccacag

SEQ ID NO: 8174489 - DNA, 22 bp, Homo sapiens
atggcctgcagtgctgccacag

SEQ ID NO: 8174490 - DNA, 22 bp, Homo sapiens
atggcctggccagagctctgct

SEQ ID NO: 8174491 - DNA, 22 bp, Homo sapiens
atggcctgggcccgcttcagat

SEQ ID NO: 8174492 - DNA, 22 bp, Homo sapiens
atggctagttgatatggtgttt

SEQ ID NO: 8174493 - DNA, 17 bp, Homo sapiens
atggctcacctgtgggc

SEQ ID NO: 8174494 - DNA, 22 bp, Homo sapiens
atggctagcaccgcgttgctgg

SEQ ID NO: 8174495 - DNA, 17 bp, Homo sapiens
atggctcacctgtgggc

SEQ ID NO: 8174496 - DNA, 22 bp, Homo sapiens
atggcggcgccaggccctaatt

SEQ ID NO: 8174497 - DNA, 22 bp, Homo sapiens
atggcctttctcagtggtgctt

SEQ ID NO: 8174498 - DNA, 22 bp, Homo sapiens
agagatgaagggcattccccag

SEQ ID NO: 8174499 - DNA, 22 bp, Homo sapiens
agagagttgtatgtttctaaaa

SEQ ID NO: 8174500 - DNA, 22 bp, Homo sapiens
agagatgaaaagtggagactgg

SEQ ID NO: 8174501 - DNA, 22 bp, Homo sapiens
agagatgaaaagtggagactgg

SEQ ID NO: 8174502 - DNA, 22 bp, Homo sapiens
atggctcagcccatggaagaaa

SEQ ID NO: 8174503 - DNA, 22 bp, Homo sapiens
agagagttgtaccacactcata

SEQ ID NO: 8174504 - DNA, 22 bp, Homo sapiens
agaccacagtcaggctcctggt

SEQ ID NO: 8174505 - DNA, 22 bp, Homo sapiens
agaccacaggcatgcacagagc

SEQ ID NO: 8174506 - DNA, 22 bp, Homo sapiens
agaccaagtgcaggtgccacta

SEQ ID NO: 8174507 - DNA, 22 bp, Homo sapiens
agacattttggaaagtattact

SEQ ID NO: 8174508 - DNA, 22 bp, Homo sapiens
agacattttggaaagtattact

SEQ ID NO: 8174509 - DNA, 22 bp, Homo sapiens
agacattttggaaagtattact

SEQ ID NO: 8174510 - DNA, 22 bp, Homo sapiens
agacattttagacataaaagat

SEQ ID NO: 8174511 - DNA, 22 bp, Homo sapiens
agacattttagacataaaagat

SEQ ID NO: 8174512 - DNA, 22 bp, Homo sapiens
agacattttacattcttccatt

SEQ ID NO: 8174513 - DNA, 23 bp, Homo sapiens
agacattttaataaggacttttt

SEQ ID NO: 8174514 - DNA, 22 bp, Homo sapiens
agacattttgcaatgggtagct

SEQ ID NO: 8174515 - DNA, 22 bp, Homo sapiens
agacattttgcattccctgaag

SEQ ID NO: 8174516 - DNA, 22 bp, Homo sapiens
agacattttgatacccctaccg

SEQ ID NO: 8174517 - DNA, 22 bp, Homo sapiens
agacattttgcaatgggtagct

SEQ ID NO: 8174518 - DNA, 22 bp, Homo sapiens
agacattttgatacccctaccg

SEQ ID NO: 8174519 - DNA, 22 bp, Homo sapiens
agacattttcgttggagaggtt

SEQ ID NO: 8174520 - DNA, 22 bp, Homo sapiens
agacattttcgttggagaggtt

SEQ ID NO: 8174521 - DNA, 22 bp, Homo sapiens
agaccactggcctcctgcagac

SEQ ID NO: 8174522 - DNA, 18 bp, Homo sapiens
agaccagacaagaatggt

SEQ ID NO: 8174523 - DNA, 22 bp, Homo sapiens
agaccaggaaggcctacagata

SEQ ID NO: 8174524 - DNA, 22 bp, Homo sapiens
agaccagctgcctcccagggcc

SEQ ID NO: 8174525 - DNA, 22 bp, Homo sapiens
agaccaggggttgagtcctagc

SEQ ID NO: 8174526 - DNA, 22 bp, Homo sapiens
agaccagggtcccacagagtct

SEQ ID NO: 8174527 - DNA, 22 bp, Homo sapiens
agacccagaaagcagctgcatt

SEQ ID NO: 8174528 - DNA, 22 bp, Homo sapiens
agacccagaaagcagctgcatt

SEQ ID NO: 8174529 - DNA, 22 bp, Homo sapiens
agacccagaaagcagctgcatt

SEQ ID NO: 8174530 - DNA, 22 bp, Homo sapiens
agaccatgacctgccactaagc

SEQ ID NO: 8174531 - DNA, 22 bp, Homo sapiens
atggccagggtggcactgtggt

SEQ ID NO: 8174532 - DNA, 22 bp, Homo sapiens
atggccagggtggcactgtggt

SEQ ID NO: 8174533 - DNA, 22 bp, Homo sapiens
atggccagggtggcactgtggt

SEQ ID NO: 8174534 - DNA, 22 bp, Homo sapiens
atggccagtcaagcctctggct

SEQ ID NO: 8174535 - DNA, 22 bp, Homo sapiens
atggccagggtggcactgtggt

SEQ ID NO: 8174536 - DNA, 22 bp, Homo sapiens
atggccagggccaaaagagatg

SEQ ID NO: 8174537 - DNA, 22 bp, Homo sapiens
atggccaggcacctctggctga

SEQ ID NO: 8174538 - DNA, 22 bp, Homo sapiens
atggccaggcacctctggctga

SEQ ID NO: 8174539 - DNA, 22 bp, Homo sapiens
atggccagcttataggggctca

SEQ ID NO: 8174540 - DNA, 22 bp, Homo sapiens
atggccagcttataggggctca

SEQ ID NO: 8174541 - DNA, 22 bp, Homo sapiens
atggccagtcaagcctctggct

SEQ ID NO: 8174542 - DNA, 22 bp, Homo sapiens
agagaagagcaatgataaattt

SEQ ID NO: 8174543 - DNA, 21 bp, Homo sapiens
agagaagaggactttctcaca

SEQ ID NO: 8174544 - DNA, 18 bp, Homo sapiens
agagaagaggtgttagtc

SEQ ID NO: 8174545 - DNA, 22 bp, Homo sapiens
atggccagcaagttcagaattt

SEQ ID NO: 8174546 - DNA, 22 bp, Homo sapiens
atggccagcaagttcagaattt

SEQ ID NO: 8174547 - DNA, 22 bp, Homo sapiens
atggccagcaagttcagaattt

SEQ ID NO: 8174548 - DNA, 22 bp, Homo sapiens
atggcagcggagctggaaatga

SEQ ID NO: 8174549 - DNA, 22 bp, Homo sapiens
atggcagcggagctggaaatga

SEQ ID NO: 8174550 - DNA, 22 bp, Homo sapiens
atggcagcctgtggacagtcaa

SEQ ID NO: 8174551 - DNA, 22 bp, Homo sapiens
atggcagcctgtggacagtcaa

SEQ ID NO: 8174552 - DNA, 22 bp, Homo sapiens
agacccagagggctgctgggag

SEQ ID NO: 8174553 - DNA, 22 bp, Homo sapiens
agacccagagggctgctgggag

SEQ ID NO: 8174554 - DNA, 22 bp, Homo sapiens
atggcagcctgagcagaggaat

SEQ ID NO: 8174555 - DNA, 22 bp, Homo sapiens
atggcagcctgagcagaggaat

SEQ ID NO: 8174556 - DNA, 23 bp, Homo sapiens
agacccagagactggctctgctc

SEQ ID NO: 8174557 - DNA, 23 bp, Homo sapiens
agacccagagactggctctgctc

SEQ ID NO: 8174558 - DNA, 22 bp, Homo sapiens
atggccagccactcctgatggc

SEQ ID NO: 8174559 - DNA, 22 bp, Homo sapiens
atggccagcccttcccgcagct

SEQ ID NO: 8174560 - DNA, 22 bp, Homo sapiens
atggccagcccttcccgcagct

SEQ ID NO: 8174561 - DNA, 22 bp, Homo sapiens
atggccagcccttcccgcagct

SEQ ID NO: 8174562 - DNA, 22 bp, Homo sapiens
atggccagcccttcccgcagct

SEQ ID NO: 8174563 - DNA, 22 bp, Homo sapiens
atggccagcctggtacttggca

SEQ ID NO: 8174564 - DNA, 22 bp, Homo sapiens
atggccagctagcacttgcatt

SEQ ID NO: 8174565 - DNA, 22 bp, Homo sapiens
atggccagctagcacttgcatt

SEQ ID NO: 8174566 - DNA, 22 bp, Homo sapiens
atggccagctcagagcactcag

SEQ ID NO: 8174567 - DNA, 22 bp, Homo sapiens
atggccagctcagagcactcag

SEQ ID NO: 8174568 - DNA, 22 bp, Homo sapiens
atggccagctcagagcactcag

SEQ ID NO: 8174569 - DNA, 22 bp, Homo sapiens
atgtcaaatcagttttatcaga

SEQ ID NO: 8174570 - DNA, 22 bp, Homo sapiens
atgtattttgccagactgtctc

SEQ ID NO: 8174571 - DNA, 22 bp, Homo sapiens
atgtattttgccagactgtctc

SEQ ID NO: 8174572 - DNA, 22 bp, Homo sapiens
atgtattttaagatttgcctca

SEQ ID NO: 8174573 - DNA, 22 bp, Homo sapiens
atgtattttaagatttgcctca

SEQ ID NO: 8174574 - DNA, 22 bp, Homo sapiens
atgtattttaagatttgcctca

SEQ ID NO: 8174575 - DNA, 22 bp, Homo sapiens
atgtattttaagatttgcctca

SEQ ID NO: 8174576 - DNA, 22 bp, Homo sapiens
atgtattttaagatttgcctca

SEQ ID NO: 8174577 - DNA, 22 bp, Homo sapiens
agagcctgcatcaggcttgggg

SEQ ID NO: 8174578 - DNA, 22 bp, Homo sapiens
agagcctgggaatttgcatgtt

SEQ ID NO: 8174579 - DNA, 22 bp, Homo sapiens
agagcctggctcccagctaccg

SEQ ID NO: 8174580 - DNA, 22 bp, Homo sapiens
agagcctgcagtggagaccttg

SEQ ID NO: 8174581 - DNA, 22 bp, Homo sapiens
agagcctgcagtggagaccttg

SEQ ID NO: 8174582 - DNA, 22 bp, Homo sapiens
agagcctgggcagctcctctgg

SEQ ID NO: 8174583 - DNA, 22 bp, Homo sapiens
agagcctggggattggcaaggg

SEQ ID NO: 8174584 - DNA, 22 bp, Homo sapiens
agagcctgggcagctcctctgg

SEQ ID NO: 8174585 - DNA, 22 bp, Homo sapiens
agagcctggggattggcaaggg

SEQ ID NO: 8174586 - DNA, 22 bp, Homo sapiens
agagccagcaactctagccctg

SEQ ID NO: 8174587 - DNA, 22 bp, Homo sapiens
agagccagcaactctagccctg

SEQ ID NO: 8174588 - DNA, 22 bp, Homo sapiens
agagccagcaactctagccctg

SEQ ID NO: 8174589 - DNA, 22 bp, Homo sapiens
agagccagatggagccgtgtgt

SEQ ID NO: 8174590 - DNA, 22 bp, Homo sapiens
agagccagcaagtgaatagtga

SEQ ID NO: 8174591 - DNA, 22 bp, Homo sapiens
agagccagcaagtgaatagtga

SEQ ID NO: 8174592 - DNA, 22 bp, Homo sapiens
atgtatttgaaatttgagacat

SEQ ID NO: 8174593 - DNA, 22 bp, Homo sapiens
atgtatttgaaatttgagacat

SEQ ID NO: 8174594 - DNA, 22 bp, Homo sapiens
atgtatttgcgaggttaggaaa

SEQ ID NO: 8174595 - DNA, 22 bp, Homo sapiens
atgtatttgcttgttatggatt

SEQ ID NO: 8174596 - DNA, 22 bp, Homo sapiens
atgtatttgcttgttatggatt

SEQ ID NO: 8174597 - DNA, 22 bp, Homo sapiens
atgtattttaagatttgcctca

SEQ ID NO: 8174598 - DNA, 22 bp, Homo sapiens
atgtatttgcttgttatggatt

SEQ ID NO: 8174599 - DNA, 22 bp, Homo sapiens
atgtatttgcgtatggacatac

SEQ ID NO: 8174600 - DNA, 22 bp, Homo sapiens
atgtatttgcgtatggacatac

SEQ ID NO: 8174601 - DNA, 22 bp, Homo sapiens
atgtatttgcgaggttaggaaa

SEQ ID NO: 8174602 - DNA, 22 bp, Homo sapiens
atgtatttgcgtatggacatac

SEQ ID NO: 8174603 - DNA, 22 bp, Homo sapiens
atgtatttgcgtatggacatac

SEQ ID NO: 8174604 - DNA, 22 bp, Homo sapiens
atgtatttgcgtatggacatac

SEQ ID NO: 8174605 - DNA, 22 bp, Homo sapiens
atgtatttgcgtatggacatac

SEQ ID NO: 8174606 - DNA, 22 bp, Homo sapiens
atgtatttgcgtatggacatac

SEQ ID NO: 8174607 - DNA, 22 bp, Homo sapiens
atgtgggttgatggaggtgtca

SEQ ID NO: 8174608 - DNA, 22 bp, Homo sapiens
atgtgggtgagtgagagataga

SEQ ID NO: 8174609 - DNA, 22 bp, Homo sapiens
atgtggggactctgagagaatt

SEQ ID NO: 8174610 - DNA, 22 bp, Homo sapiens
atgtgtaatgtggtattttaat

SEQ ID NO: 8174611 - DNA, 22 bp, Homo sapiens
atgtgtacaaccaagcactaaa

SEQ ID NO: 8174612 - DNA, 22 bp, Homo sapiens
atgtgggccgtgcgggtgtcct

SEQ ID NO: 8174613 - DNA, 22 bp, Homo sapiens
atgtgggccgtgcgggtgtcct

SEQ ID NO: 8174614 - DNA, 22 bp, Homo sapiens
atgtgggccgtgcgggtgtcct

SEQ ID NO: 8174615 - DNA, 22 bp, Homo sapiens
atgtgggagatttcaggaggtg

SEQ ID NO: 8174616 - DNA, 22 bp, Homo sapiens
atgtggggacaaaatgatggcc

SEQ ID NO: 8174617 - DNA, 22 bp, Homo sapiens
atgtggggactctgagagaatt

SEQ ID NO: 8174618 - DNA, 22 bp, Homo sapiens
atgtggggactctgagagaatt

SEQ ID NO: 8174619 - DNA, 22 bp, Homo sapiens
agagcctgttcggaggcgcccc

SEQ ID NO: 8174620 - DNA, 22 bp, Homo sapiens
agagcctgttttgtgggagatg

SEQ ID NO: 8174621 - DNA, 22 bp, Homo sapiens
agagcctgttcggaggcgcccc

SEQ ID NO: 8174622 - DNA, 22 bp, Homo sapiens
agagcctgtgggagatgcagct

SEQ ID NO: 8174623 - DNA, 22 bp, Homo sapiens
agagcctgtgggagatgcagct

SEQ ID NO: 8174624 - DNA, 22 bp, Homo sapiens
agagcctgtgattgtcatcacc

SEQ ID NO: 8174625 - DNA, 22 bp, Homo sapiens
agagcctgtgattgtcatcacc

SEQ ID NO: 8174626 - DNA, 22 bp, Homo sapiens
agagcctgtcaattgtaaagag

SEQ ID NO: 8174627 - DNA, 22 bp, Homo sapiens
agagcctgtctgcctttctacc

SEQ ID NO: 8174628 - DNA, 22 bp, Homo sapiens
agagcctgtcaattgtaaagag

SEQ ID NO: 8174629 - DNA, 22 bp, Homo sapiens
agagcctgtacttttctgtgaa

SEQ ID NO: 8174630 - DNA, 22 bp, Homo sapiens
agagcctgtaacatctttctta

SEQ ID NO: 8174631 - DNA, 22 bp, Homo sapiens
agagcctggttcaaattttacc

SEQ ID NO: 8174632 - DNA, 22 bp, Homo sapiens
agagcctggtctgagataggac

SEQ ID NO: 8174633 - DNA, 22 bp, Homo sapiens
agagcctggtctgagataggac

SEQ ID NO: 8174634 - DNA, 22 bp, Homo sapiens
agagatggccttaggtgggaat

SEQ ID NO: 8174635 - DNA, 22 bp, Homo sapiens
agagatggccttaggtgggaat

SEQ ID NO: 8174636 - DNA, 22 bp, Homo sapiens
agagatggatgttattatgggt

SEQ ID NO: 8174637 - DNA, 22 bp, Homo sapiens
agagatggatgttattatgggt

SEQ ID NO: 8174638 - DNA, 22 bp, Homo sapiens
agagatggccttaggtgggaat

SEQ ID NO: 8174639 - DNA, 22 bp, Homo sapiens
atgggggaaagtacgagcatgg

SEQ ID NO: 8174640 - DNA, 22 bp, Homo sapiens
atgggggaaagtacgagcatgg

SEQ ID NO: 8174641 - DNA, 22 bp, Homo sapiens
atggggctgttctctgccctgc

SEQ ID NO: 8174642 - DNA, 22 bp, Homo sapiens
atggggtgagactaggattaaa

SEQ ID NO: 8174643 - DNA, 20 bp, Homo sapiens
atggggtgagtgacgccctc

SEQ ID NO: 8174644 - DNA, 22 bp, Homo sapiens
atggggtgcatgcagattggga

SEQ ID NO: 8174645 - DNA, 22 bp, Homo sapiens
atggggtgaccatgagcattta

SEQ ID NO: 8174646 - DNA, 16 bp, Homo sapiens
atggggtacaaccagt

SEQ ID NO: 8174647 - DNA, 22 bp, Homo sapiens
atggggtgaccatgagcattta

SEQ ID NO: 8174648 - DNA, 22 bp, Homo sapiens
agagatgactgatggctgatta

SEQ ID NO: 8174649 - DNA, 22 bp, Homo sapiens
agagatgagaacatgcttggat

SEQ ID NO: 8174650 - DNA, 22 bp, Homo sapiens
agagatgagaacatgcttggat

SEQ ID NO: 8174651 - DNA, 22 bp, Homo sapiens
agagatgaatcttgagactctg

SEQ ID NO: 8174652 - DNA, 22 bp, Homo sapiens
agagatgaatcttgagactctg

SEQ ID NO: 8174653 - DNA, 22 bp, Homo sapiens
agagatgacatgagggacttaa

SEQ ID NO: 8174654 - DNA, 22 bp, Homo sapiens
agagatggagagcactggggct

SEQ ID NO: 8174655 - DNA, 22 bp, Homo sapiens
agagatggagagcactggggct

SEQ ID NO: 8174656 - DNA, 22 bp, Homo sapiens
agagatggagagcactggggct

SEQ ID NO: 8174657 - DNA, 22 bp, Homo sapiens
agagatggagagcactggggct

SEQ ID NO: 8174658 - DNA, 19 bp, Homo sapiens
agagatgctaagagtcttt

SEQ ID NO: 8174659 - DNA, 22 bp, Homo sapiens
agagatgcggttccatggttat

SEQ ID NO: 8174660 - DNA, 22 bp, Homo sapiens
atggggtggagtccgggcagcg

SEQ ID NO: 8174661 - DNA, 22 bp, Homo sapiens
atggggtggagtccgggcagcg

SEQ ID NO: 8174662 - DNA, 22 bp, Homo sapiens
atgggtaggatttactcagatg

SEQ ID NO: 8174663 - DNA, 22 bp, Homo sapiens
atggggtggagtccgggcagcg

SEQ ID NO: 8174664 - DNA, 22 bp, Homo sapiens
atgggtggagggtgacacggat

SEQ ID NO: 8174665 - DNA, 22 bp, Homo sapiens
atgggtggaggagaaaggcatc

SEQ ID NO: 8174666 - DNA, 22 bp, Homo sapiens
atgggtgcagcatggtgggaac

SEQ ID NO: 8174667 - DNA, 22 bp, Homo sapiens
atgggtgcagcatggtgggaac

SEQ ID NO: 8174668 - DNA, 22 bp, Homo sapiens
atgggtcagttcagtggccaac

SEQ ID NO: 8174669 - DNA, 22 bp, Homo sapiens
agagcatctaacacataagcct

SEQ ID NO: 8174670 - DNA, 22 bp, Homo sapiens
agagccaaggcctcagtctcaa

SEQ ID NO: 8174671 - DNA, 17 bp, Homo sapiens
agagcatgtgtaggagc

SEQ ID NO: 8174672 - DNA, 22 bp, Homo sapiens
agagcagtcattaatacatgta

SEQ ID NO: 8174673 - DNA, 22 bp, Homo sapiens
agagcagtgctgaagagtaggg

SEQ ID NO: 8174674 - DNA, 22 bp, Homo sapiens
agagcagcctgtgatgatgcac

SEQ ID NO: 8174675 - DNA, 22 bp, Homo sapiens
agagcagcctgtgatgatgcac

SEQ ID NO: 8174676 - DNA, 22 bp, Homo sapiens
agagcagcctcagctccctgtg

SEQ ID NO: 8174677 - DNA, 22 bp, Homo sapiens
agagccacggcaggcctaggaa

SEQ ID NO: 8174678 - DNA, 22 bp, Homo sapiens
agagccacagtggataggagcc

SEQ ID NO: 8174679 - DNA, 19 bp, Homo sapiens
agagccagacagcatagga

SEQ ID NO: 8174680 - DNA, 19 bp, Homo sapiens
agagccagacagcatagga

SEQ ID NO: 8174681 - DNA, 22 bp, Homo sapiens
agagccacggcaggcctaggaa

SEQ ID NO: 8174682 - DNA, 22 bp, Homo sapiens
agagccagagacctgggttcac

SEQ ID NO: 8174683 - DNA, 22 bp, Homo sapiens
agagccagaccattgccgtgca

SEQ ID NO: 8174684 - DNA, 19 bp, Homo sapiens
agagccagacagcatagga

SEQ ID NO: 8174685 - DNA, 19 bp, Homo sapiens
agagccagacagcatagga

SEQ ID NO: 8174686 - DNA, 22 bp, Homo sapiens
agagccagaccattgccgtgca

SEQ ID NO: 8174687 - DNA, 22 bp, Homo sapiens
agagccagaccattgccgtgca

SEQ ID NO: 8174688 - DNA, 22 bp, Homo sapiens
agagccagaccattgccgtgca

SEQ ID NO: 8174689 - DNA, 22 bp, Homo sapiens
agagccagaccattgccgtgca

SEQ ID NO: 8174690 - DNA, 22 bp, Homo sapiens
agaagtcaccctgttgctgtga

SEQ ID NO: 8174691 - DNA, 22 bp, Homo sapiens
agaagtcagccacagtgggaga

SEQ ID NO: 8174692 - DNA, 23 bp, Homo sapiens
agaagtggaatggccgtggggtc

SEQ ID NO: 8174693 - DNA, 22 bp, Homo sapiens
agaagtgccgaaaggaagacag

SEQ ID NO: 8174694 - DNA, 22 bp, Homo sapiens
agaagtgctccagtgagttggg

SEQ ID NO: 8174695 - DNA, 22 bp, Homo sapiens
agaagtgccatactgtggtcca

SEQ ID NO: 8174696 - DNA, 22 bp, Homo sapiens
agaagtgagtgtgactcagcag

SEQ ID NO: 8174697 - DNA, 22 bp, Homo sapiens
atctcagaaacatatctaatcc

SEQ ID NO: 8174698 - DNA, 22 bp, Homo sapiens
atctcagaaacatatctaatcc

SEQ ID NO: 8174699 - DNA, 22 bp, Homo sapiens
atctcaggaggaccctgatgct

SEQ ID NO: 8174700 - DNA, 22 bp, Homo sapiens
atctcaggaggaccctgatgct

SEQ ID NO: 8174701 - DNA, 22 bp, Homo sapiens
atctcagagaaatttgaatgca

SEQ ID NO: 8174702 - DNA, 22 bp, Homo sapiens
atctcagatctacagatctaca

SEQ ID NO: 8174703 - DNA, 22 bp, Homo sapiens
atctcaggaggaccctgatgct

SEQ ID NO: 8174704 - DNA, 22 bp, Homo sapiens
agaagtattctgcatgtactga

SEQ ID NO: 8174705 - DNA, 22 bp, Homo sapiens
agaagtcaatgatgagagtgct

SEQ ID NO: 8174706 - DNA, 19 bp, Homo sapiens
agaagttagacattgcaat

SEQ ID NO: 8174707 - DNA, 22 bp, Homo sapiens
agaagtttcacaatgggtttta

SEQ ID NO: 8174708 - DNA, 20 bp, Homo sapiens
agaagtggctgcagacacta

SEQ ID NO: 8174709 - DNA, 22 bp, Homo sapiens
agaagtttggtcctataaactc

SEQ ID NO: 8174710 - DNA, 20 bp, Homo sapiens
agaagtttgggggtgtggag

SEQ ID NO: 8174711 - DNA, 22 bp, Homo sapiens
agaagtttggtcctataaactc

SEQ ID NO: 8174712 - DNA, 22 bp, Homo sapiens
agaagtttggtcctataaactc

SEQ ID NO: 8174713 - DNA, 22 bp, Homo sapiens
agaagtttgaaattaggagaaa

SEQ ID NO: 8174714 - DNA, 22 bp, Homo sapiens
agaagtttggatgccatcatag

SEQ ID NO: 8174715 - DNA, 22 bp, Homo sapiens
atctttgttgctctcatttctg

SEQ ID NO: 8174716 - DNA, 22 bp, Homo sapiens
atctttgttgctctcatttctg

SEQ ID NO: 8174717 - DNA, 22 bp, Homo sapiens
atctttgttatctcagatcttg

SEQ ID NO: 8174718 - DNA, 23 bp, Homo sapiens
atgaaagttcttaaaatgtcatg

SEQ ID NO: 8174719 - DNA, 22 bp, Homo sapiens
atgaaatttgaccaattattta

SEQ ID NO: 8174720 - DNA, 22 bp, Homo sapiens
atgaaatttgaccaattattta

SEQ ID NO: 8174721 - DNA, 22 bp, Homo sapiens
atgaaatttgaccaattattta

SEQ ID NO: 8174722 - DNA, 22 bp, Homo sapiens
atgaaattgatcttgaactttt

SEQ ID NO: 8174723 - DNA, 22 bp, Homo sapiens
atgaacaagtatttgcatgagc

SEQ ID NO: 8174724 - DNA, 22 bp, Homo sapiens
atgaacaataaaatagatcaca

SEQ ID NO: 8174725 - DNA, 22 bp, Homo sapiens
atgaacaataaaatagatcaca

SEQ ID NO: 8174726 - DNA, 22 bp, Homo sapiens
atgaacaagagagggaagattc

SEQ ID NO: 8174727 - DNA, 22 bp, Homo sapiens
atgaacaataaaatagatcaca

SEQ ID NO: 8174728 - DNA, 22 bp, Homo sapiens
atgaacaataaaatagatcaca

SEQ ID NO: 8174729 - DNA, 22 bp, Homo sapiens
atgaacaataaaatagatcaca

SEQ ID NO: 8174730 - DNA, 22 bp, Homo sapiens
atgaacaaaaacaaggcctgtt

SEQ ID NO: 8174731 - DNA, 22 bp, Homo sapiens
atgaaattttaattatacctct

SEQ ID NO: 8174732 - DNA, 22 bp, Homo sapiens
atgaaagatgatttaaagtact

SEQ ID NO: 8174733 - DNA, 22 bp, Homo sapiens
atgaaagcacgtgggaagataa

SEQ ID NO: 8174734 - DNA, 22 bp, Homo sapiens
atgaaagatgatttaaagtact

SEQ ID NO: 8174735 - DNA, 22 bp, Homo sapiens
atgaaagtgtttaagtttatgt

SEQ ID NO: 8174736 - DNA, 22 bp, Homo sapiens
atgaaagtacctgtaatatgtt

SEQ ID NO: 8174737 - DNA, 22 bp, Homo sapiens
agacaaaggattaatgatgatg

SEQ ID NO: 8174738 - DNA, 22 bp, Homo sapiens
agacaaaggattaatgatgatg

SEQ ID NO: 8174739 - DNA, 22 bp, Homo sapiens
agacaaatgaacaaatatgtga

SEQ ID NO: 8174740 - DNA, 22 bp, Homo sapiens
agacaaatttcctgcaatgaag

SEQ ID NO: 8174741 - DNA, 18 bp, Homo sapiens
agaattgctgcttcttct

SEQ ID NO: 8174742 - DNA, 22 bp, Homo sapiens
atgaacaatgactacatattga

SEQ ID NO: 8174743 - DNA, 22 bp, Homo sapiens
atgaacaatgactacatattga

SEQ ID NO: 8174744 - DNA, 22 bp, Homo sapiens
atgaacaatctgttgacttctg

SEQ ID NO: 8174745 - DNA, 22 bp, Homo sapiens
atgaacaatctgttgacttctg

SEQ ID NO: 8174746 - DNA, 22 bp, Homo sapiens
atgaacaatctggcaagaactt

SEQ ID NO: 8174747 - DNA, 22 bp, Homo sapiens
atgaacaataaaatagatcaca

SEQ ID NO: 8174748 - DNA, 22 bp, Homo sapiens
atgaacaataatcatgtctatg

SEQ ID NO: 8174749 - DNA, 22 bp, Homo sapiens
atgaacaataatcatgtctatg

SEQ ID NO: 8174750 - DNA, 18 bp, Homo sapiens
agacaaacttcttctgcc

SEQ ID NO: 8174751 - DNA, 22 bp, Homo sapiens
agacaaagaaaccgtagaagca

SEQ ID NO: 8174752 - DNA, 22 bp, Homo sapiens
agacaaagaaaccgtagaagca

SEQ ID NO: 8174753 - DNA, 22 bp, Homo sapiens
agacaaagaaaccgtagaagca

SEQ ID NO: 8174754 - DNA, 22 bp, Homo sapiens
atgacaaaggctgaaagggaaa

SEQ ID NO: 8174755 - DNA, 22 bp, Homo sapiens
atgacaaaggctgaaagggaaa

SEQ ID NO: 8174756 - DNA, 22 bp, Homo sapiens
atgacaaacccaggatgtaaca

SEQ ID NO: 8174757 - DNA, 22 bp, Homo sapiens
atgacaaaattcacaggtgtga

SEQ ID NO: 8174758 - DNA, 23 bp, Homo sapiens
atgacaaacaggacatcttgtgc

SEQ ID NO: 8174759 - DNA, 23 bp, Homo sapiens
atgacaaacaggacatcttgtgc

SEQ ID NO: 8174760 - DNA, 22 bp, Homo sapiens
atgacaaaattcacaggtgtga

SEQ ID NO: 8174761 - DNA, 22 bp, Homo sapiens
atgacaaaatgaatgcagctag

SEQ ID NO: 8174762 - DNA, 22 bp, Homo sapiens
atgacaaaataaatggtctctg

SEQ ID NO: 8174763 - DNA, 22 bp, Homo sapiens
atgacaaaagaagacatgaggt

SEQ ID NO: 8174764 - DNA, 22 bp, Homo sapiens
atgacaaaagaagacatgaggt

SEQ ID NO: 8174765 - DNA, 20 bp, Homo sapiens
atgcacatacgcatgcacat

SEQ ID NO: 8174766 - DNA, 22 bp, Homo sapiens
atgcacataggccaaatcattt

SEQ ID NO: 8174767 - DNA, 20 bp, Homo sapiens
atgcacatacgcatgcacat

SEQ ID NO: 8174768 - DNA, 22 bp, Homo sapiens
atgcacataggccaaatcattt

SEQ ID NO: 8174769 - DNA, 22 bp, Homo sapiens
atgcacatcactctgaagaaaa

SEQ ID NO: 8174770 - DNA, 22 bp, Homo sapiens
atgcacatacatatgctctata

SEQ ID NO: 8174771 - DNA, 22 bp, Homo sapiens
atgacaagggttgacacatgtc

SEQ ID NO: 8174772 - DNA, 22 bp, Homo sapiens
atgacaaattcagaccatagca

SEQ ID NO: 8174773 - DNA, 22 bp, Homo sapiens
atgcacatgtatgtcaatattt

SEQ ID NO: 8174774 - DNA, 22 bp, Homo sapiens
atgcacatgtatctatatacaa

SEQ ID NO: 8174775 - DNA, 22 bp, Homo sapiens
atgcactgtaagactagccatg

SEQ ID NO: 8174776 - DNA, 22 bp, Homo sapiens
atgcactgggccacagtatgac

SEQ ID NO: 8174777 - DNA, 22 bp, Homo sapiens
atgcacctgaactccatcagct

SEQ ID NO: 8174778 - DNA, 22 bp, Homo sapiens
atgcacccttatgaatatgatc

SEQ ID NO: 8174779 - DNA, 22 bp, Homo sapiens
atgcacctgaactccatcagct

SEQ ID NO: 8174780 - DNA, 22 bp, Homo sapiens
atgcacctgaactccatcagct

SEQ ID NO: 8174781 - DNA, 22 bp, Homo sapiens
atgcactgttggatatatttgt

SEQ ID NO: 8174782 - DNA, 22 bp, Homo sapiens
agacagacatgctagttttctt

SEQ ID NO: 8174783 - DNA, 22 bp, Homo sapiens
agacagacatgctagttttctt

SEQ ID NO: 8174784 - DNA, 22 bp, Homo sapiens
agacagaccatggctattcaga

SEQ ID NO: 8174785 - DNA, 22 bp, Homo sapiens
agacagaccatggctattcaga

SEQ ID NO: 8174786 - DNA, 22 bp, Homo sapiens
agacagaccatggctattcaga

SEQ ID NO: 8174787 - DNA, 22 bp, Homo sapiens
agacagacattctagagccacc

SEQ ID NO: 8174788 - DNA, 22 bp, Homo sapiens
agacagactggtttgaattggt

SEQ ID NO: 8174789 - DNA, 21 bp, Homo sapiens
agacagactgcctgacccacg

SEQ ID NO: 8174790 - DNA, 22 bp, Homo sapiens
agacagacgtagtgtgagagta

SEQ ID NO: 8174791 - DNA, 22 bp, Homo sapiens
agacagacggctttatacacag

SEQ ID NO: 8174792 - DNA, 22 bp, Homo sapiens
agacagacggctttatacacag

SEQ ID NO: 8174793 - DNA, 17 bp, Homo sapiens
agacagacctctgcatc

SEQ ID NO: 8174794 - DNA, 22 bp, Homo sapiens
agacatcaatgatcagaggtag

SEQ ID NO: 8174795 - DNA, 22 bp, Homo sapiens
agacatatggtgaaacatttta

SEQ ID NO: 8174796 - DNA, 22 bp, Homo sapiens
agacatatgcctaatactggtt

SEQ ID NO: 8174797 - DNA, 22 bp, Homo sapiens
agacatttattcacacatttat

SEQ ID NO: 8174798 - DNA, 22 bp, Homo sapiens
agacatttattgaacacctagc

SEQ ID NO: 8174799 - DNA, 22 bp, Homo sapiens
agacatttcctagacatcaatg

SEQ ID NO: 8174800 - DNA, 22 bp, Homo sapiens
agacatttcctagacatcaatg

SEQ ID NO: 8174801 - DNA, 23 bp, Homo sapiens
agacattttaataaggacttttt

SEQ ID NO: 8174802 - DNA, 23 bp, Homo sapiens
agacattttaataaggacttttt

SEQ ID NO: 8174803 - DNA, 22 bp, Homo sapiens
agacattttaacatctgggttt

SEQ ID NO: 8174804 - DNA, 22 bp, Homo sapiens
agacatttggagccaactttcc

SEQ ID NO: 8174805 - DNA, 22 bp, Homo sapiens
agacattttaacatctgggttt

SEQ ID NO: 8174806 - DNA, 22 bp, Homo sapiens
agacatttggagccaactttcc

SEQ ID NO: 8174807 - DNA, 22 bp, Homo sapiens
agacatttggaagatacacata

SEQ ID NO: 8174808 - DNA, 22 bp, Homo sapiens
agacatttggaagatacacata

SEQ ID NO: 8174809 - DNA, 22 bp, Homo sapiens
agacatttcctgtgaacctact

SEQ ID NO: 8174810 - DNA, 22 bp, Homo sapiens
agacagctgttccttcatgttt

SEQ ID NO: 8174811 - DNA, 23 bp, Homo sapiens
agacagcttagagtttgcctctc

SEQ ID NO: 8174812 - DNA, 22 bp, Homo sapiens
agacaggacacaagctgcataa

SEQ ID NO: 8174813 - DNA, 22 bp, Homo sapiens
agacaggacacaagctgcataa

SEQ ID NO: 8174814 - DNA, 22 bp, Homo sapiens
agacaggacacaagctgcataa

SEQ ID NO: 8174815 - DNA, 22 bp, Homo sapiens
agacaggacacaagctgcataa

SEQ ID NO: 8174816 - DNA, 22 bp, Homo sapiens
agacaggagagggaactgccgg

SEQ ID NO: 8174817 - DNA, 22 bp, Homo sapiens
agacaggagagggaactgccgg

SEQ ID NO: 8174818 - DNA, 22 bp, Homo sapiens
agacaggagagggaactgccgg

SEQ ID NO: 8174819 - DNA, 22 bp, Homo sapiens
agacaggagagggaactgccgg

SEQ ID NO: 8174820 - DNA, 22 bp, Homo sapiens
agacaggacacaagctgcataa

SEQ ID NO: 8174821 - DNA, 22 bp, Homo sapiens
agacaggagagggaactgccgg

SEQ ID NO: 8174822 - DNA, 20 bp, Homo sapiens
agacaggagcccccattcag

SEQ ID NO: 8174823 - DNA, 22 bp, Homo sapiens
agacaggatgcatactcttggt

SEQ ID NO: 8174824 - DNA, 22 bp, Homo sapiens
agacaggatgcatactcttggt

SEQ ID NO: 8174825 - DNA, 22 bp, Homo sapiens
agacaggcagaggctgcagagg

SEQ ID NO: 8174826 - DNA, 22 bp, Homo sapiens
agacagctccaagtgtctctgt

SEQ ID NO: 8174827 - DNA, 22 bp, Homo sapiens
agacagctccaagtgtctctgt

SEQ ID NO: 8174828 - DNA, 22 bp, Homo sapiens
agacagctatcaacaactttct

SEQ ID NO: 8174829 - DNA, 22 bp, Homo sapiens
agacagctagggctgcagggac

SEQ ID NO: 8174830 - DNA, 22 bp, Homo sapiens
agacagctaataaatgagtgtg

SEQ ID NO: 8174831 - DNA, 22 bp, Homo sapiens
agacagcgaggacagaggggtg

SEQ ID NO: 8174832 - DNA, 22 bp, Homo sapiens
agacagcatgatacatgatgct

SEQ ID NO: 8174833 - DNA, 22 bp, Homo sapiens
agacagcatttctagcaccagg

SEQ ID NO: 8174834 - DNA, 22 bp, Homo sapiens
agacagcatgagcctgctgatg

SEQ ID NO: 8174835 - DNA, 22 bp, Homo sapiens
agacagcagaaactagagcact

SEQ ID NO: 8174836 - DNA, 22 bp, Homo sapiens
agacagacttgaaaatgttctt

SEQ ID NO: 8174837 - DNA, 22 bp, Homo sapiens
agacagactgtgtttgaatcct

SEQ ID NO: 8174838 - DNA, 22 bp, Homo sapiens
agagctgtttattgatgtcaca

SEQ ID NO: 8174839 - DNA, 22 bp, Homo sapiens
agagctgtttggacatctgagt

SEQ ID NO: 8174840 - DNA, 22 bp, Homo sapiens
agagctgttcagcagccaggtt

SEQ ID NO: 8174841 - DNA, 22 bp, Homo sapiens
agagctgttcaacgtagcaatg

SEQ ID NO: 8174842 - DNA, 22 bp, Homo sapiens
agagctgtgtcctgtgcactag

SEQ ID NO: 8174843 - DNA, 22 bp, Homo sapiens
agagctgtatccccttaccagt

SEQ ID NO: 8174844 - DNA, 22 bp, Homo sapiens
agagctgtagcttcctagagcc

SEQ ID NO: 8174845 - DNA, 22 bp, Homo sapiens
agagctgtgaaaatgaggtttg

SEQ ID NO: 8174846 - DNA, 22 bp, Homo sapiens
agagctgtgctttgcaccacgt

SEQ ID NO: 8174847 - DNA, 22 bp, Homo sapiens
agagctgtggatagtcctggat

SEQ ID NO: 8174848 - DNA, 21 bp, Homo sapiens
agagctggtaggtaggtaggt

SEQ ID NO: 8174849 - DNA, 22 bp, Homo sapiens
agagctgggacttggactcaat

SEQ ID NO: 8174850 - DNA, 22 bp, Homo sapiens
agagctggtgcatattcagaaa

SEQ ID NO: 8174851 - DNA, 22 bp, Homo sapiens
agagctggtgcatattcagaaa

SEQ ID NO: 8174852 - DNA, 22 bp, Homo sapiens
agagctggtttactcaggaatt

SEQ ID NO: 8174853 - DNA, 22 bp, Homo sapiens
agagctggtttactcaggaatt

SEQ ID NO: 8174854 - DNA, 22 bp, Homo sapiens
agagctggtttactcaggaatt

SEQ ID NO: 8174855 - DNA, 22 bp, Homo sapiens
atgtgtatatttattgtagttt

SEQ ID NO: 8174856 - DNA, 22 bp, Homo sapiens
atgtgtatatttattgtagttt

SEQ ID NO: 8174857 - DNA, 22 bp, Homo sapiens
atgtgtatatttggtgtcaata

SEQ ID NO: 8174858 - DNA, 22 bp, Homo sapiens
atgtgtatatttattgtagttt

SEQ ID NO: 8174859 - DNA, 22 bp, Homo sapiens
atgtgtatatttggtgtcaata

SEQ ID NO: 8174860 - DNA, 22 bp, Homo sapiens
atgtgtatatttggtgtcaata

SEQ ID NO: 8174861 - DNA, 21 bp, Homo sapiens
agagctgggacttgcctgaga

SEQ ID NO: 8174862 - DNA, 22 bp, Homo sapiens
atgtgtaggtgaatcgaggctg

SEQ ID NO: 8174863 - DNA, 22 bp, Homo sapiens
atgtgtaggtgaatcgaggctg

SEQ ID NO: 8174864 - DNA, 22 bp, Homo sapiens
atgtgtatacttgtgcttactc

SEQ ID NO: 8174865 - DNA, 22 bp, Homo sapiens
atgtgtatacttgtgcttactc

SEQ ID NO: 8174866 - DNA, 22 bp, Homo sapiens
agaggacacatctttcctcaaa

SEQ ID NO: 8174867 - DNA, 22 bp, Homo sapiens
agaggacaaaatgagaagtgct

SEQ ID NO: 8174868 - DNA, 22 bp, Homo sapiens
agaggacagacggaaagtgcca

SEQ ID NO: 8174869 - DNA, 22 bp, Homo sapiens
agaggacagacggaaagtgcca

SEQ ID NO: 8174870 - DNA, 22 bp, Homo sapiens
agaggacagcccccttgtctgg

SEQ ID NO: 8174871 - DNA, 22 bp, Homo sapiens
agaggacaggttttccatgggc

SEQ ID NO: 8174872 - DNA, 22 bp, Homo sapiens
agaggacaggttttccatgggc

SEQ ID NO: 8174873 - DNA, 22 bp, Homo sapiens
agaggacagagtgctggattta

SEQ ID NO: 8174874 - DNA, 22 bp, Homo sapiens
agaggacagcccccttgtctgg

SEQ ID NO: 8174875 - DNA, 22 bp, Homo sapiens
agaggacagagtgctggattta

SEQ ID NO: 8174876 - DNA, 22 bp, Homo sapiens
agaggaagctgagatgcctctt

SEQ ID NO: 8174877 - DNA, 22 bp, Homo sapiens
agaggaagctgagatgcctctt

SEQ ID NO: 8174878 - DNA, 22 bp, Homo sapiens
agaggacaaaatgagaagtgct

SEQ ID NO: 8174879 - DNA, 22 bp, Homo sapiens
atgtttatggagcaggtattag

SEQ ID NO: 8174880 - DNA, 22 bp, Homo sapiens
atgtttatggagcaggtattag

SEQ ID NO: 8174881 - DNA, 22 bp, Homo sapiens
atgtttatggagcaggtattag

SEQ ID NO: 8174882 - DNA, 22 bp, Homo sapiens
atgtttacagaggaagtgcctc

SEQ ID NO: 8174883 - DNA, 22 bp, Homo sapiens
atgtttactgaaaagatttcaa

SEQ ID NO: 8174884 - DNA, 21 bp, Homo sapiens
atgtttacactgactactgtg

SEQ ID NO: 8174885 - DNA, 19 bp, Homo sapiens
atgtttacactcaggggct

SEQ ID NO: 8174886 - DNA, 22 bp, Homo sapiens
atgtttacaattcagtattaca

SEQ ID NO: 8174887 - DNA, 22 bp, Homo sapiens
atgtttacaattcagtattaca

SEQ ID NO: 8174888 - DNA, 22 bp, Homo sapiens
atgtttacaaaaaggaggcttg

SEQ ID NO: 8174889 - DNA, 22 bp, Homo sapiens
atgtttactggtttatagaata

SEQ ID NO: 8174890 - DNA, 22 bp, Homo sapiens
atgtttatgcaaacatgtgagt

SEQ ID NO: 8174891 - DNA, 22 bp, Homo sapiens
agaggagctgggaggccctcgt

SEQ ID NO: 8174892 - DNA, 22 bp, Homo sapiens
agaggagaatccgtttccttgc

SEQ ID NO: 8174893 - DNA, 22 bp, Homo sapiens
agaggagcctcagtttgcagcc

SEQ ID NO: 8174894 - DNA, 22 bp, Homo sapiens
agaggacaggttttccatgggc

SEQ ID NO: 8174895 - DNA, 22 bp, Homo sapiens
agaggagaatccgtttccttgc

SEQ ID NO: 8174896 - DNA, 22 bp, Homo sapiens
agaggacaggttttccatgggc

SEQ ID NO: 8174897 - DNA, 22 bp, Homo sapiens
agaggacaggttttccatgggc

SEQ ID NO: 8174898 - DNA, 22 bp, Homo sapiens
agaggaggatttgtaaaggtct

SEQ ID NO: 8174899 - DNA, 22 bp, Homo sapiens
agaggaggatttgtaaaggtct

SEQ ID NO: 8174900 - DNA, 22 bp, Homo sapiens
agaggaggatttgtaaaggtct

SEQ ID NO: 8174901 - DNA, 22 bp, Homo sapiens
agaggaggatttgtaaaggtct

SEQ ID NO: 8174902 - DNA, 20 bp, Homo sapiens
agaggaggattattttattc

SEQ ID NO: 8174903 - DNA, 20 bp, Homo sapiens
agaggaggattattttattc

SEQ ID NO: 8174904 - DNA, 22 bp, Homo sapiens
agaggaggaagagctttaaaat

SEQ ID NO: 8174905 - DNA, 22 bp, Homo sapiens
agaggaggaagagctttaaaat

SEQ ID NO: 8174906 - DNA, 22 bp, Homo sapiens
agaggaggatttgtaaaggtct

SEQ ID NO: 8174907 - DNA, 22 bp, Homo sapiens
agaggaggcagcttaactcagt

SEQ ID NO: 8174908 - DNA, 22 bp, Homo sapiens
agaggaggcagcttaactcagt

SEQ ID NO: 8174909 - DNA, 22 bp, Homo sapiens
agaggaggcagcttaactcagt

SEQ ID NO: 8174910 - DNA, 22 bp, Homo sapiens
agaggaggccaggcccacacct

SEQ ID NO: 8174911 - DNA, 22 bp, Homo sapiens
agaggaggccaggcccacacct

SEQ ID NO: 8174912 - DNA, 22 bp, Homo sapiens
agaggaggccaggcccacacct

SEQ ID NO: 8174913 - DNA, 22 bp, Homo sapiens
agaggaggctctgggatcgtcc

SEQ ID NO: 8174914 - DNA, 22 bp, Homo sapiens
agaggaggctctgggatcgtcc

SEQ ID NO: 8174915 - DNA, 22 bp, Homo sapiens
agaggaggctctgggatcgtcc

SEQ ID NO: 8174916 - DNA, 22 bp, Homo sapiens
agaggaggctctgggatcgtcc

SEQ ID NO: 8174917 - DNA, 22 bp, Homo sapiens
agaggaggctgggtccagataa

SEQ ID NO: 8174918 - DNA, 22 bp, Homo sapiens
agaggaggctgggtccagataa

SEQ ID NO: 8174919 - DNA, 22 bp, Homo sapiens
agaggaggctgggtccagataa

SEQ ID NO: 8174920 - DNA, 22 bp, Homo sapiens
agaggaggctgggtccagataa

SEQ ID NO: 8174921 - DNA, 22 bp, Homo sapiens
attataggcttgagccaccgtg

SEQ ID NO: 8174922 - DNA, 22 bp, Homo sapiens
attattattgttgatgttaggg

SEQ ID NO: 8174923 - DNA, 22 bp, Homo sapiens
attattcaaattcccactatac

SEQ ID NO: 8174924 - DNA, 22 bp, Homo sapiens
attattattgttgatgttaggg

SEQ ID NO: 8174925 - DNA, 22 bp, Homo sapiens
agaggcagaagtgttcaaaccc

SEQ ID NO: 8174926 - DNA, 22 bp, Homo sapiens
agaggcactgttcttagcgact

SEQ ID NO: 8174927 - DNA, 22 bp, Homo sapiens
attattcaacacttgagaaatt

SEQ ID NO: 8174928 - DNA, 22 bp, Homo sapiens
attattcaaattcccactatac

SEQ ID NO: 8174929 - DNA, 22 bp, Homo sapiens
attattcaacacttgagaaatt

SEQ ID NO: 8174930 - DNA, 22 bp, Homo sapiens
attattaaagcttaggtcttat

SEQ ID NO: 8174931 - DNA, 22 bp, Homo sapiens
attattactcctgattgtactg

SEQ ID NO: 8174932 - DNA, 22 bp, Homo sapiens
attattagacttatatggtagt

SEQ ID NO: 8174933 - DNA, 22 bp, Homo sapiens
attattaaagcttaggtcttat

SEQ ID NO: 8174934 - DNA, 23 bp, Homo sapiens
attattaaggacatggactttgt

SEQ ID NO: 8174935 - DNA, 22 bp, Homo sapiens
attattaggactactggggttg

SEQ ID NO: 8174936 - DNA, 22 bp, Homo sapiens
attattagattcttaattgtaa

SEQ ID NO: 8174937 - DNA, 22 bp, Homo sapiens
attattaggtgctctctgacaa

SEQ ID NO: 8174938 - DNA, 22 bp, Homo sapiens
attattataaagtgcatgacct

SEQ ID NO: 8174939 - DNA, 22 bp, Homo sapiens
attcatgtggggagccttctgt

SEQ ID NO: 8174940 - DNA, 22 bp, Homo sapiens
attcatgttagcccacatgtag

SEQ ID NO: 8174941 - DNA, 22 bp, Homo sapiens
attcatgttttcttgcttcaag

SEQ ID NO: 8174942 - DNA, 22 bp, Homo sapiens
attcattccaggtcagtcagac

SEQ ID NO: 8174943 - DNA, 22 bp, Homo sapiens
attcatgttttcttgcttcaag

SEQ ID NO: 8174944 - DNA, 22 bp, Homo sapiens
attcattagccactaactagca

SEQ ID NO: 8174945 - DNA, 22 bp, Homo sapiens
attcattctgacctcaagagaa

SEQ ID NO: 8174946 - DNA, 22 bp, Homo sapiens
attcattccaggtcagtcagac

SEQ ID NO: 8174947 - DNA, 22 bp, Homo sapiens
attcattcttggtatgaacagc

SEQ ID NO: 8174948 - DNA, 22 bp, Homo sapiens
attcatgtaacattagagaaat

SEQ ID NO: 8174949 - DNA, 22 bp, Homo sapiens
attcagtagaagttagctatta

SEQ ID NO: 8174950 - DNA, 22 bp, Homo sapiens
attcagtagaagttagctatta

SEQ ID NO: 8174951 - DNA, 22 bp, Homo sapiens
agaggcaggaggttgacttgag

SEQ ID NO: 8174952 - DNA, 22 bp, Homo sapiens
agaggcaggaggttgacttgag

SEQ ID NO: 8174953 - DNA, 22 bp, Homo sapiens
agaggcaggaagagctgatttt

SEQ ID NO: 8174954 - DNA, 22 bp, Homo sapiens
agaggcagccgtatttcaaagg

SEQ ID NO: 8174955 - DNA, 22 bp, Homo sapiens
agaggcaggaagagctgatttt

SEQ ID NO: 8174956 - DNA, 22 bp, Homo sapiens
agaggcaggaagagctgatttt

SEQ ID NO: 8174957 - DNA, 22 bp, Homo sapiens
agaggcagcagtcatactacag

SEQ ID NO: 8174958 - DNA, 22 bp, Homo sapiens
agaggcagcagtcatactacag

SEQ ID NO: 8174959 - DNA, 17 bp, Homo sapiens
agaggcagatacttgga

SEQ ID NO: 8174960 - DNA, 17 bp, Homo sapiens
agaggcagatacttgga

SEQ ID NO: 8174961 - DNA, 17 bp, Homo sapiens
agaggcagatacttgga

SEQ ID NO: 8174962 - DNA, 17 bp, Homo sapiens
agaggcagatacttgga

SEQ ID NO: 8174963 - DNA, 22 bp, Homo sapiens
attcatttaggtattcacttac

SEQ ID NO: 8174964 - DNA, 22 bp, Homo sapiens
attcatttaggtattcacttac

SEQ ID NO: 8174965 - DNA, 19 bp, Homo sapiens
attcattggccagggtggt

SEQ ID NO: 8174966 - DNA, 22 bp, Homo sapiens
attcatttagagggattaagca

SEQ ID NO: 8174967 - DNA, 22 bp, Homo sapiens
attcatttagagggattaagca

SEQ ID NO: 8174968 - DNA, 22 bp, Homo sapiens
attcatttagagggattaagca

SEQ ID NO: 8174969 - DNA, 22 bp, Homo sapiens
attcatttgctattgtgtatgg

SEQ ID NO: 8174970 - DNA, 22 bp, Homo sapiens
attcatttgctattgtgtatgg

SEQ ID NO: 8174971 - DNA, 22 bp, Homo sapiens
attcatttgctattgtgtatgg

SEQ ID NO: 8174972 - DNA, 22 bp, Homo sapiens
attcatttgctattgtgtatgg

SEQ ID NO: 8174973 - DNA, 22 bp, Homo sapiens
agaggcctgtgtgctccagtgg

SEQ ID NO: 8174974 - DNA, 22 bp, Homo sapiens
attcatttgctattgtgtatgg

SEQ ID NO: 8174975 - DNA, 22 bp, Homo sapiens
agaggcctgtgtgctccagtgg

SEQ ID NO: 8174976 - DNA, 22 bp, Homo sapiens
agaggcctgtgtgctccagtgg

SEQ ID NO: 8174977 - DNA, 22 bp, Homo sapiens
agaggcgcagactcttgagtgt

SEQ ID NO: 8174978 - DNA, 22 bp, Homo sapiens
agaggctcactcttggaaccca

SEQ ID NO: 8174979 - DNA, 22 bp, Homo sapiens
agaggctaggaccatgtatcat

SEQ ID NO: 8174980 - DNA, 22 bp, Homo sapiens
agaggctccaccttctctgtcc

SEQ ID NO: 8174981 - DNA, 22 bp, Homo sapiens
agaggctccgtcatccctcttt

SEQ ID NO: 8174982 - DNA, 22 bp, Homo sapiens
agaggctccaccttctctgtcc

SEQ ID NO: 8174983 - DNA, 22 bp, Homo sapiens
agaggctcctcggtgcctcgtg

SEQ ID NO: 8174984 - DNA, 22 bp, Homo sapiens
agagggacaataagataaaatg

SEQ ID NO: 8174985 - DNA, 22 bp, Homo sapiens
agagggaatgtgattgcaccat

SEQ ID NO: 8174986 - DNA, 22 bp, Homo sapiens
agagggagaaaagaatcagttg

SEQ ID NO: 8174987 - DNA, 22 bp, Homo sapiens
agagggagaaaagaatcagttg

SEQ ID NO: 8174988 - DNA, 22 bp, Homo sapiens
agagggagaagctaaaataact

SEQ ID NO: 8174989 - DNA, 21 bp, Homo sapiens
agagggagagtggcccttcca

SEQ ID NO: 8174990 - DNA, 21 bp, Homo sapiens
agagggagagtggcccttcca

SEQ ID NO: 8174991 - DNA, 22 bp, Homo sapiens
attccagaataccggcaagatg

SEQ ID NO: 8174992 - DNA, 22 bp, Homo sapiens
attccagatggcttcaagtaag

SEQ ID NO: 8174993 - DNA, 22 bp, Homo sapiens
attccagatgaattgcatagtt

SEQ ID NO: 8174994 - DNA, 22 bp, Homo sapiens
attccagatgaattgcatagtt

SEQ ID NO: 8174995 - DNA, 22 bp, Homo sapiens
attccagatgaattgcatagtt

SEQ ID NO: 8174996 - DNA, 23 bp, Homo sapiens
attccagagctagagtcaagtgg

SEQ ID NO: 8174997 - DNA, 23 bp, Homo sapiens
attccagagctagagtcaagtgg

SEQ ID NO: 8174998 - DNA, 22 bp, Homo sapiens
attccagacaggtaaattaggt

SEQ ID NO: 8174999 - DNA, 22 bp, Homo sapiens
attccagagaggttctggaggt

SEQ ID NO: 8175000 - DNA, 22 bp, Homo sapiens
agagggaaatccaggagtgctt

SEQ ID NO: 8175001 - DNA, 18 bp, Homo sapiens
agagggaatcagttggat

SEQ ID NO: 8175002 - DNA, 22 bp, Homo sapiens
agagggaaggacagatgtttca

SEQ ID NO: 8175003 - DNA, 22 bp, Homo sapiens
agagggaaatccaggagtgctt

SEQ ID NO: 8175004 - DNA, 22 bp, Homo sapiens
agagggaaatccaggagtgctt

SEQ ID NO: 8175005 - DNA, 18 bp, Homo sapiens
agagggaaagcaggctga

SEQ ID NO: 8175006 - DNA, 17 bp, Homo sapiens
agagggaaaatgcggtt

SEQ ID NO: 8175007 - DNA, 22 bp, Homo sapiens
agagggaaaaactcatgtcatt

SEQ ID NO: 8175008 - DNA, 22 bp, Homo sapiens
agaggctgtgcagagggagtgc

SEQ ID NO: 8175009 - DNA, 22 bp, Homo sapiens
agaggctgtgcagagggagtgc

SEQ ID NO: 8175010 - DNA, 22 bp, Homo sapiens
agaggctgtgcagagggagtgc

SEQ ID NO: 8175011 - DNA, 22 bp, Homo sapiens
attgcagtgtgtgttccatgag

SEQ ID NO: 8175012 - DNA, 22 bp, Homo sapiens
attgcattcattgacatatgag

SEQ ID NO: 8175013 - DNA, 22 bp, Homo sapiens
attgcagtgatggttgcataat

SEQ ID NO: 8175014 - DNA, 22 bp, Homo sapiens
attgataaattgcaatggggct

SEQ ID NO: 8175015 - DNA, 22 bp, Homo sapiens
attgcagatgatccccaagtta

SEQ ID NO: 8175016 - DNA, 22 bp, Homo sapiens
attccagttgggttctaataca

SEQ ID NO: 8175017 - DNA, 22 bp, Homo sapiens
attccagttctcctctctaaag

SEQ ID NO: 8175018 - DNA, 22 bp, Homo sapiens
attccagtccaaatgttttcct

SEQ ID NO: 8175019 - DNA, 22 bp, Homo sapiens
attccaggttgtagaaaagttt

SEQ ID NO: 8175020 - DNA, 22 bp, Homo sapiens
attccaggattccaggacaaat

SEQ ID NO: 8175021 - DNA, 22 bp, Homo sapiens
attccaggcaaagcagagaaga

SEQ ID NO: 8175022 - DNA, 22 bp, Homo sapiens
attccaggcagaccagagagat

SEQ ID NO: 8175023 - DNA, 22 bp, Homo sapiens
attccaggcatgcaggaacaag

SEQ ID NO: 8175024 - DNA, 22 bp, Homo sapiens
attccaggaagtgtgggaccaa

SEQ ID NO: 8175025 - DNA, 22 bp, Homo sapiens
attccaggactaaaggaacagc

SEQ ID NO: 8175026 - DNA, 22 bp, Homo sapiens
attccaggagctaactgtggtc

SEQ ID NO: 8175027 - DNA, 22 bp, Homo sapiens
attccagatgttactgaaaggc

SEQ ID NO: 8175028 - DNA, 22 bp, Homo sapiens
attccagatgttactgaaaggc

SEQ ID NO: 8175029 - DNA, 22 bp, Homo sapiens
attccagatgttactgaaaggc

SEQ ID NO: 8175030 - DNA, 23 bp, Homo sapiens
attccaggaaatacttggctttc

SEQ ID NO: 8175031 - DNA, 23 bp, Homo sapiens
attccaggaaatacttggctttc

SEQ ID NO: 8175032 - DNA, 17 bp, Homo sapiens
agagttttaagaaattt

SEQ ID NO: 8175033 - DNA, 22 bp, Homo sapiens
atttcacagctgctgttcaggt

SEQ ID NO: 8175034 - DNA, 22 bp, Homo sapiens
atttcacagctgctgttcaggt

SEQ ID NO: 8175035 - DNA, 22 bp, Homo sapiens
atttcacagcgtggttgactgc

SEQ ID NO: 8175036 - DNA, 22 bp, Homo sapiens
atttattgagacttaacaaccc

SEQ ID NO: 8175037 - DNA, 22 bp, Homo sapiens
atttattgaagcttattacgtt

SEQ ID NO: 8175038 - DNA, 22 bp, Homo sapiens
atttattgaagcttattacgtt

SEQ ID NO: 8175039 - DNA, 22 bp, Homo sapiens
atttattgaagcttattacgtt

SEQ ID NO: 8175040 - DNA, 22 bp, Homo sapiens
agataaattcctaagatttcag

SEQ ID NO: 8175041 - DNA, 22 bp, Homo sapiens
atttcacattaatttgatgctc

SEQ ID NO: 8175042 - DNA, 22 bp, Homo sapiens
atttcacattaatttgatgctc

SEQ ID NO: 8175043 - DNA, 22 bp, Homo sapiens
atttcacatctatctcagattt

SEQ ID NO: 8175044 - DNA, 17 bp, Homo sapiens
atttcacttagcatgag

SEQ ID NO: 8175045 - DNA, 22 bp, Homo sapiens
atttcacaggccagtggtgggg

SEQ ID NO: 8175046 - DNA, 22 bp, Homo sapiens
atttcacagctgtcagtgttac

SEQ ID NO: 8175047 - DNA, 22 bp, Homo sapiens
atttcacagctgtcagtgttac

SEQ ID NO: 8175048 - DNA, 22 bp, Homo sapiens
atttcacatctatctcagattt

SEQ ID NO: 8175049 - DNA, 22 bp, Homo sapiens
atttcacagctgctgttcaggt

SEQ ID NO: 8175050 - DNA, 22 bp, Homo sapiens
atttcacagctgtcagtgttac

SEQ ID NO: 8175051 - DNA, 22 bp, Homo sapiens
agatacatagctgtgagcacac

SEQ ID NO: 8175052 - DNA, 22 bp, Homo sapiens
agatacatagctgtgagcacac

SEQ ID NO: 8175053 - DNA, 22 bp, Homo sapiens
agatacatagctgtgagcacac

SEQ ID NO: 8175054 - DNA, 22 bp, Homo sapiens
agatacatatagaaaacatcaa

SEQ ID NO: 8175055 - DNA, 22 bp, Homo sapiens
agatacatatagaaaacatcaa

SEQ ID NO: 8175056 - DNA, 22 bp, Homo sapiens
agatacatggaacgtcaaacct

SEQ ID NO: 8175057 - DNA, 22 bp, Homo sapiens
attgctcagcacaagcagcaga

SEQ ID NO: 8175058 - DNA, 22 bp, Homo sapiens
attgctgaaagtattttatgac

SEQ ID NO: 8175059 - DNA, 22 bp, Homo sapiens
attgccaggagggttgagaata

SEQ ID NO: 8175060 - DNA, 22 bp, Homo sapiens
attgcattgcagctagattttg

SEQ ID NO: 8175061 - DNA, 23 bp, Homo sapiens
attgccaggatgctgaagcttac

SEQ ID NO: 8175062 - DNA, 22 bp, Homo sapiens
agaggtcagaacaggaaagtgt

SEQ ID NO: 8175063 - DNA, 22 bp, Homo sapiens
agaggtattaggtaattcagta

SEQ ID NO: 8175064 - DNA, 22 bp, Homo sapiens
agaggtattagatttgcatagg

SEQ ID NO: 8175065 - DNA, 22 bp, Homo sapiens
agaggtcagctgcatgccacat

SEQ ID NO: 8175066 - DNA, 22 bp, Homo sapiens
agaggtcagagcaggaaaggca

SEQ ID NO: 8175067 - DNA, 22 bp, Homo sapiens
agaggtctcagttatgtttaaa

SEQ ID NO: 8175068 - DNA, 22 bp, Homo sapiens
agaggtctgactcagcagatta

SEQ ID NO: 8175069 - DNA, 22 bp, Homo sapiens
agaggtctgagcaatctcaagc

SEQ ID NO: 8175070 - DNA, 22 bp, Homo sapiens
agaggtctgagcaatctcaagc

SEQ ID NO: 8175071 - DNA, 22 bp, Homo sapiens
agaggtctatgctaggggaact

SEQ ID NO: 8175072 - DNA, 21 bp, Homo sapiens
agaggtctaagattctagctt

SEQ ID NO: 8175073 - DNA, 22 bp, Homo sapiens
agaggtcttaagatctagactg

SEQ ID NO: 8175074 - DNA, 22 bp, Homo sapiens
agaggtcttaagatctagactg

SEQ ID NO: 8175075 - DNA, 22 bp, Homo sapiens
agaggtcttcacatggcaatga

SEQ ID NO: 8175076 - DNA, 22 bp, Homo sapiens
agaggtcttaagttccttgatg

SEQ ID NO: 8175077 - DNA, 22 bp, Homo sapiens
agaggtcttttggtctgcagaa

SEQ ID NO: 8175078 - DNA, 22 bp, Homo sapiens
agaggtcttttggtctgcagaa

SEQ ID NO: 8175079 - DNA, 22 bp, Homo sapiens
agaggtcttcagcatttgaact

SEQ ID NO: 8175080 - DNA, 22 bp, Homo sapiens
agaggtgaaagaatttggctct

SEQ ID NO: 8175081 - DNA, 22 bp, Homo sapiens
agaggtgacataggagaggctc

SEQ ID NO: 8175082 - DNA, 22 bp, Homo sapiens
agaggtgacataggagaggctc

SEQ ID NO: 8175083 - DNA, 22 bp, Homo sapiens
agagtgggtgatctctgttgtc

SEQ ID NO: 8175084 - DNA, 22 bp, Homo sapiens
agagtgggtgatctctgttgtc

SEQ ID NO: 8175085 - DNA, 22 bp, Homo sapiens
agagttctgaattttattctct

SEQ ID NO: 8175086 - DNA, 22 bp, Homo sapiens
agagttctgctcttctcagtga

SEQ ID NO: 8175087 - DNA, 22 bp, Homo sapiens
agagttctgaaattatctttac

SEQ ID NO: 8175088 - DNA, 22 bp, Homo sapiens
agagtgggtgatctctgttgtc

SEQ ID NO: 8175089 - DNA, 20 bp, Homo sapiens
agagtgggtgtcacaggctg

SEQ ID NO: 8175090 - DNA, 21 bp, Homo sapiens
agagttcttgctgagcaagcc

SEQ ID NO: 8175091 - DNA, 22 bp, Homo sapiens
agagttgccagcttatggccaa

SEQ ID NO: 8175092 - DNA, 22 bp, Homo sapiens
agagttgcatagtgcttttaag

SEQ ID NO: 8175093 - DNA, 22 bp, Homo sapiens
agagttgcaaacagatacctac

SEQ ID NO: 8175094 - DNA, 21 bp, Homo sapiens
agagttgcagcaaatggggga

SEQ ID NO: 8175095 - DNA, 22 bp, Homo sapiens
agagttctgtctgccacacgaa

SEQ ID NO: 8175096 - DNA, 22 bp, Homo sapiens
agagtttaggggacacagaata

SEQ ID NO: 8175097 - DNA, 19 bp, Homo sapiens
agagtttaggtctatcagg

SEQ ID NO: 8175098 - DNA, 22 bp, Homo sapiens
agagtttaggggtaagcatagt

SEQ ID NO: 8175099 - DNA, 22 bp, Homo sapiens
agagtttaaacactgtcacaga

SEQ ID NO: 8175100 - DNA, 22 bp, Homo sapiens
agagtttaacacaagaaaagtt

SEQ ID NO: 8175101 - DNA, 22 bp, Homo sapiens
agagtttaccactatttttggt

SEQ ID NO: 8175102 - DNA, 22 bp, Homo sapiens
agagttgctaccaagatgctag

SEQ ID NO: 8175103 - DNA, 22 bp, Homo sapiens
agagttgctaatgtgcagaata

SEQ ID NO: 8175104 - DNA, 22 bp, Homo sapiens
agagttgctaaattcaggtctt

SEQ ID NO: 8175105 - DNA, 23 bp, Homo sapiens
agagttgctaaaaacactcagat

SEQ ID NO: 8175106 - DNA, 22 bp, Homo sapiens
agagttgcgtccatgcagagtt

SEQ ID NO: 8175107 - DNA, 22 bp, Homo sapiens
agagttgcttatgtcaggtgag

SEQ ID NO: 8175108 - DNA, 22 bp, Homo sapiens
agagttgcttatttgagtttct

SEQ ID NO: 8175109 - DNA, 22 bp, Homo sapiens
agagttgcttatgtcaggtgag

SEQ ID NO: 8175110 - DNA, 22 bp, Homo sapiens
agagttgctgttggagcagtga

SEQ ID NO: 8175111 - DNA, 22 bp, Homo sapiens
agagttgctatagaaggatgga

SEQ ID NO: 8175112 - DNA, 22 bp, Homo sapiens
agagttgctgagtatataccca

SEQ ID NO: 8175113 - DNA, 22 bp, Homo sapiens
agagttgctccattagaactta

SEQ ID NO: 8175114 - DNA, 22 bp, Homo sapiens
atttgtgaattaagcatgtcaa

SEQ ID NO: 8175115 - DNA, 22 bp, Homo sapiens
atttgttccatgagtaaggcta

SEQ ID NO: 8175116 - DNA, 22 bp, Homo sapiens
atttgttccacacatatttact

SEQ ID NO: 8175117 - DNA, 22 bp, Homo sapiens
atttgttccatgagtaaggcta

SEQ ID NO: 8175118 - DNA, 22 bp, Homo sapiens
atttgttcacaatcagggcagg

SEQ ID NO: 8175119 - DNA, 22 bp, Homo sapiens
atttgttcacaatcagggcagg

SEQ ID NO: 8175120 - DNA, 22 bp, Homo sapiens
atttgttaattatgaggcatac

SEQ ID NO: 8175121 - DNA, 22 bp, Homo sapiens
atttgttgctagcagcactgat

SEQ ID NO: 8175122 - DNA, 22 bp, Homo sapiens
atttgttgctagcagcactgat

SEQ ID NO: 8175123 - DNA, 22 bp, Homo sapiens
atttgtttatcgtcgattgtag

SEQ ID NO: 8175124 - DNA, 22 bp, Homo sapiens
attttaaccctcttatatatac

SEQ ID NO: 8175125 - DNA, 22 bp, Homo sapiens
attttttgttaactcaggatag

SEQ ID NO: 8175126 - DNA, 22 bp, Homo sapiens
attttaaccctcttatatatac

SEQ ID NO: 8175127 - DNA, 22 bp, Homo sapiens
attttaaccctcttatatatac

SEQ ID NO: 8175128 - DNA, 22 bp, Homo sapiens
attttttgttaactcaggatag

SEQ ID NO: 8175129 - DNA, 21 bp, Homo sapiens
caaaaggataggaaattaggg

SEQ ID NO: 8175130 - DNA, 22 bp, Homo sapiens
caaaaaacacagatgtctgtgt

SEQ ID NO: 8175131 - DNA, 22 bp, Homo sapiens
caaaagtaattgcagtttttgc

SEQ ID NO: 8175132 - DNA, 22 bp, Homo sapiens
caaaagtaccttgtgtgctttg

SEQ ID NO: 8175133 - DNA, 22 bp, Homo sapiens
caaaaggccagtactttgtttg

SEQ ID NO: 8175134 - DNA, 22 bp, Homo sapiens
caaaagtaattgcagtttttgc

SEQ ID NO: 8175135 - DNA, 22 bp, Homo sapiens
atttctctgcctcagcttctgc

SEQ ID NO: 8175136 - DNA, 22 bp, Homo sapiens
atttctctgcctcagcttctgc

SEQ ID NO: 8175137 - DNA, 22 bp, Homo sapiens
atttgctttcccttccctgaca

SEQ ID NO: 8175138 - DNA, 22 bp, Homo sapiens
atttctcttagcaagacattac

SEQ ID NO: 8175139 - DNA, 22 bp, Homo sapiens
atttctcttagcaagacattac

SEQ ID NO: 8175140 - DNA, 22 bp, Homo sapiens
atttctcatgtacaaaaacact

SEQ ID NO: 8175141 - DNA, 22 bp, Homo sapiens
atttctcattaagatcttccaa

SEQ ID NO: 8175142 - DNA, 22 bp, Homo sapiens
atttctcattttgcttcaaagg

SEQ ID NO: 8175143 - DNA, 22 bp, Homo sapiens
atttccttcatcagcctatcct

SEQ ID NO: 8175144 - DNA, 22 bp, Homo sapiens
atttctcagttcctactgttta

SEQ ID NO: 8175145 - DNA, 22 bp, Homo sapiens
atttctcatcaagtgccaactc

SEQ ID NO: 8175146 - DNA, 22 bp, Homo sapiens
atttctcatcaagtgccaactc

SEQ ID NO: 8175147 - DNA, 22 bp, Homo sapiens
atttctcatctttgtgaatggt

SEQ ID NO: 8175148 - DNA, 22 bp, Homo sapiens
atttctccttgttgcaatgcag

SEQ ID NO: 8175149 - DNA, 22 bp, Homo sapiens
atttctccttgttgcaatgcag

SEQ ID NO: 8175150 - DNA, 22 bp, Homo sapiens
atttctcctccagatggtggtt

SEQ ID NO: 8175151 - DNA, 22 bp, Homo sapiens
atttctctaagcatccgtttgc

SEQ ID NO: 8175152 - DNA, 22 bp, Homo sapiens
atttctcctccagatggtggtt

SEQ ID NO: 8175153 - DNA, 22 bp, Homo sapiens
atttctcctccagatggtggtt

SEQ ID NO: 8175154 - DNA, 22 bp, Homo sapiens
atttctccttgttgcaatgcag

SEQ ID NO: 8175155 - DNA, 22 bp, Homo sapiens
atttctctaagcatccgtttgc

SEQ ID NO: 8175156 - DNA, 22 bp, Homo sapiens
atttctctcattgttagctagg

SEQ ID NO: 8175157 - DNA, 17 bp, Homo sapiens
atttccagagtggccct

SEQ ID NO: 8175158 - DNA, 17 bp, Homo sapiens
atttccagagtggccct

SEQ ID NO: 8175159 - DNA, 17 bp, Homo sapiens
atttccagagtggccct

SEQ ID NO: 8175160 - DNA, 22 bp, Homo sapiens
atttccagactttttccaggaa

SEQ ID NO: 8175161 - DNA, 16 bp, Homo sapiens
atttccagattatgca

SEQ ID NO: 8175162 - DNA, 22 bp, Homo sapiens
atttccagcataggcttattga

SEQ ID NO: 8175163 - DNA, 22 bp, Homo sapiens
atttccagcataggcttattga

SEQ ID NO: 8175164 - DNA, 22 bp, Homo sapiens
atttcctatacagttgtccata

SEQ ID NO: 8175165 - DNA, 22 bp, Homo sapiens
atttccagcagcatatttgtct

SEQ ID NO: 8175166 - DNA, 22 bp, Homo sapiens
atttccagcagcatatttgtct

SEQ ID NO: 8175167 - DNA, 16 bp, Homo sapiens
atttccagattatgca

SEQ ID NO: 8175168 - DNA, 22 bp, Homo sapiens
atttccagcagcatatttgtct

SEQ ID NO: 8175169 - DNA, 22 bp, Homo sapiens
atttcctaggtgctcgagtgct

SEQ ID NO: 8175170 - DNA, 22 bp, Homo sapiens
atttcctatcctggtcttaaaa

SEQ ID NO: 8175171 - DNA, 22 bp, Homo sapiens
atttcctatagatatggtgagt

SEQ ID NO: 8175172 - DNA, 22 bp, Homo sapiens
atttcctatttcttgtccccta

SEQ ID NO: 8175173 - DNA, 22 bp, Homo sapiens
atttcctatggatacaggcaga

SEQ ID NO: 8175174 - DNA, 22 bp, Homo sapiens
agatactaagcatttccagcac

SEQ ID NO: 8175175 - DNA, 22 bp, Homo sapiens
agatactacatgaatgggaatt

SEQ ID NO: 8175176 - DNA, 22 bp, Homo sapiens
agatactatggaattttatgag

SEQ ID NO: 8175177 - DNA, 22 bp, Homo sapiens
agatactatggaattttatgag

SEQ ID NO: 8175178 - DNA, 22 bp, Homo sapiens
agatactatggaattttatgag

SEQ ID NO: 8175179 - DNA, 21 bp, Homo sapiens
agatagttgggcatgcagctg

SEQ ID NO: 8175180 - DNA, 22 bp, Homo sapiens
atttccagactttttccaggaa

SEQ ID NO: 8175181 - DNA, 22 bp, Homo sapiens
agataggagccaggacttaaca

SEQ ID NO: 8175182 - DNA, 22 bp, Homo sapiens
atttcctgatctgtaaaatagc

SEQ ID NO: 8175183 - DNA, 22 bp, Homo sapiens
atttcctgacttccattgaggc

SEQ ID NO: 8175184 - DNA, 22 bp, Homo sapiens
atttcctgcagagcccctccga

SEQ ID NO: 8175185 - DNA, 17 bp, Homo sapiens
atttcctgcaagcccct

SEQ ID NO: 8175186 - DNA, 22 bp, Homo sapiens
atttcctgatttgtaaaattcc

SEQ ID NO: 8175187 - DNA, 22 bp, Homo sapiens
atttccttcagtgtttaatact

SEQ ID NO: 8175188 - DNA, 22 bp, Homo sapiens
atttcctggttgcattggcttt

SEQ ID NO: 8175189 - DNA, 22 bp, Homo sapiens
acagcaggcatgaagaaatgtt

SEQ ID NO: 8175190 - DNA, 22 bp, Homo sapiens
acagcaggcacacaaggataga

SEQ ID NO: 8175191 - DNA, 22 bp, Homo sapiens
acagcaggcacacaaggataga

SEQ ID NO: 8175192 - DNA, 22 bp, Homo sapiens
acagcaggatttggcgatgttg

SEQ ID NO: 8175193 - DNA, 22 bp, Homo sapiens
acagcaggatttggcgatgttg

SEQ ID NO: 8175194 - DNA, 22 bp, Homo sapiens
acagcaggatttggcgatgttg

SEQ ID NO: 8175195 - DNA, 22 bp, Homo sapiens
acagcaggcacacaaggataga

SEQ ID NO: 8175196 - DNA, 22 bp, Homo sapiens
acagcaggcatgaagaaatgtt

SEQ ID NO: 8175197 - DNA, 22 bp, Homo sapiens
acagcaggcatgaagaaatgtt

SEQ ID NO: 8175198 - DNA, 22 bp, Homo sapiens
acagcaggcatgaatgacactg

SEQ ID NO: 8175199 - DNA, 22 bp, Homo sapiens
acagcaggcatgaagaaatgtt

SEQ ID NO: 8175200 - DNA, 22 bp, Homo sapiens
acagcaggcatgaagaaatgtt

SEQ ID NO: 8175201 - DNA, 22 bp, Homo sapiens
acagcaggcatgaagaaatgtt

SEQ ID NO: 8175202 - DNA, 22 bp, Homo sapiens
acagcaggcatgaatgacactg

SEQ ID NO: 8175203 - DNA, 22 bp, Homo sapiens
acagcaggcatgaatgacactg

SEQ ID NO: 8175204 - DNA, 22 bp, Homo sapiens
agctatttcaggaaatttgtga

SEQ ID NO: 8175205 - DNA, 21 bp, Homo sapiens
agctatttcagatttgagagc

SEQ ID NO: 8175206 - DNA, 22 bp, Homo sapiens
agctatttcaaagtttgagaca

SEQ ID NO: 8175207 - DNA, 22 bp, Homo sapiens
acagcagctaaaggtgtctcct

SEQ ID NO: 8175208 - DNA, 22 bp, Homo sapiens
acagcagctaaaggtgtctcct

SEQ ID NO: 8175209 - DNA, 22 bp, Homo sapiens
acagcagctaaaggtgtctcct

SEQ ID NO: 8175210 - DNA, 22 bp, Homo sapiens
acagcaggaattaacatataag

SEQ ID NO: 8175211 - DNA, 22 bp, Homo sapiens
acagcaggaattaacatataag

SEQ ID NO: 8175212 - DNA, 22 bp, Homo sapiens
acagcaggagccttcatatgct

SEQ ID NO: 8175213 - DNA, 22 bp, Homo sapiens
acagcaggatttggcgatgttg

SEQ ID NO: 8175214 - DNA, 22 bp, Homo sapiens
acagcaggagccttcatatgct

SEQ ID NO: 8175215 - DNA, 22 bp, Homo sapiens
agctctgggggaaagtctgctc

SEQ ID NO: 8175216 - DNA, 22 bp, Homo sapiens
agctctgggggaaagtctgctc

SEQ ID NO: 8175217 - DNA, 22 bp, Homo sapiens
agctctggggtagggcccaaca

SEQ ID NO: 8175218 - DNA, 22 bp, Homo sapiens
agctctggggtggagcccagga

SEQ ID NO: 8175219 - DNA, 18 bp, Homo sapiens
agctctggggagatgggc

SEQ ID NO: 8175220 - DNA, 18 bp, Homo sapiens
agctctggggagatgggc

SEQ ID NO: 8175221 - DNA, 18 bp, Homo sapiens
agctctggggagatgggc

SEQ ID NO: 8175222 - DNA, 22 bp, Homo sapiens
agctctggggcctgtcccacat

SEQ ID NO: 8175223 - DNA, 22 bp, Homo sapiens
agctctgggggaaagtctgctc

SEQ ID NO: 8175224 - DNA, 22 bp, Homo sapiens
agctctccacacataggactag

SEQ ID NO: 8175225 - DNA, 22 bp, Homo sapiens
agctctccatctatctgtgatg

SEQ ID NO: 8175226 - DNA, 22 bp, Homo sapiens
agctctgggctgacatgctccc

SEQ ID NO: 8175227 - DNA, 22 bp, Homo sapiens
agctctcccaccttcttcttac

SEQ ID NO: 8175228 - DNA, 18 bp, Homo sapiens
agctctggggagatgggc

SEQ ID NO: 8175229 - DNA, 18 bp, Homo sapiens
agctctggggagatgggc

SEQ ID NO: 8175230 - DNA, 22 bp, Homo sapiens
agctctgggctgacatgctccc

SEQ ID NO: 8175231 - DNA, 22 bp, Homo sapiens
agctctgggctgacatgctccc

SEQ ID NO: 8175232 - DNA, 19 bp, Homo sapiens
agctcctgttcagcagctc

SEQ ID NO: 8175233 - DNA, 19 bp, Homo sapiens
agctcctgttcagcagctc

SEQ ID NO: 8175234 - DNA, 19 bp, Homo sapiens
agctcctgttcagcagctc

SEQ ID NO: 8175235 - DNA, 22 bp, Homo sapiens
agctcctgttctgagagcagga

SEQ ID NO: 8175236 - DNA, 22 bp, Homo sapiens
agctccttgaaggcagtagctg

SEQ ID NO: 8175237 - DNA, 22 bp, Homo sapiens
agctccttgaaggcagtagctg

SEQ ID NO: 8175238 - DNA, 22 bp, Homo sapiens
agctctccacacataggactag

SEQ ID NO: 8175239 - DNA, 22 bp, Homo sapiens
agctctagggaagaaaggcaca

SEQ ID NO: 8175240 - DNA, 20 bp, Homo sapiens
agctcctttgtgtccaggat

SEQ ID NO: 8175241 - DNA, 22 bp, Homo sapiens
agctctaaatggaattttgcct

SEQ ID NO: 8175242 - DNA, 23 bp, Homo sapiens
agctcctttgaaagtatgttttt

SEQ ID NO: 8175243 - DNA, 22 bp, Homo sapiens
agctccttgcaggttgccttgg

SEQ ID NO: 8175244 - DNA, 22 bp, Homo sapiens
agctccttgaagggctctggga

SEQ ID NO: 8175245 - DNA, 22 bp, Homo sapiens
acagcaagccagcttgtcactg

SEQ ID NO: 8175246 - DNA, 21 bp, Homo sapiens
acagcaagccttcacatgagt

SEQ ID NO: 8175247 - DNA, 22 bp, Homo sapiens
acagcaagccagcttgtcactg

SEQ ID NO: 8175248 - DNA, 22 bp, Homo sapiens
acagcaagacccctagcatggt

SEQ ID NO: 8175249 - DNA, 23 bp, Homo sapiens
acagcaagaggaccagatgtgag

SEQ ID NO: 8175250 - DNA, 23 bp, Homo sapiens
acagcaagaggaccagatgtgag

SEQ ID NO: 8175251 - DNA, 22 bp, Homo sapiens
acagcaataggaaatacttgca

SEQ ID NO: 8175252 - DNA, 21 bp, Homo sapiens
acagcaagccttcacatgagt

SEQ ID NO: 8175253 - DNA, 21 bp, Homo sapiens
acagcaagccttcacatgagt

SEQ ID NO: 8175254 - DNA, 21 bp, Homo sapiens
acagcaagccttcctttcagg

SEQ ID NO: 8175255 - DNA, 22 bp, Homo sapiens
agctatctgcatgttttgctag

SEQ ID NO: 8175256 - DNA, 22 bp, Homo sapiens
agctatgtccctatgaattctg

SEQ ID NO: 8175257 - DNA, 22 bp, Homo sapiens
agctatgttatagcatgtatca

SEQ ID NO: 8175258 - DNA, 22 bp, Homo sapiens
agctagggctttcgtagacagt

SEQ ID NO: 8175259 - DNA, 22 bp, Homo sapiens
agctagggcaaatatgagatac

SEQ ID NO: 8175260 - DNA, 22 bp, Homo sapiens
agctaggccatttgttcagtga

SEQ ID NO: 8175261 - DNA, 22 bp, Homo sapiens
agctagtatttcattgaggatt

SEQ ID NO: 8175262 - DNA, 22 bp, Homo sapiens
agctagtatttcattgaggatt

SEQ ID NO: 8175263 - DNA, 22 bp, Homo sapiens
agctaggggaccaaggtggccc

SEQ ID NO: 8175264 - DNA, 22 bp, Homo sapiens
agctaggggaccaaggtggccc

SEQ ID NO: 8175265 - DNA, 22 bp, Homo sapiens
acagcaagacccctagcatggt

SEQ ID NO: 8175266 - DNA, 22 bp, Homo sapiens
agcctgcgcggcctggggcgaa

SEQ ID NO: 8175267 - DNA, 22 bp, Homo sapiens
agcctgcgatcccacctggcct

SEQ ID NO: 8175268 - DNA, 22 bp, Homo sapiens
acagatttaggactgtagcgat

SEQ ID NO: 8175269 - DNA, 21 bp, Homo sapiens
acagattgctgagctctacct

SEQ ID NO: 8175270 - DNA, 22 bp, Homo sapiens
agcctgagtgcttaggactgtt

SEQ ID NO: 8175271 - DNA, 22 bp, Homo sapiens
agcctgcacctgaccaacctgc

SEQ ID NO: 8175272 - DNA, 20 bp, Homo sapiens
agcctgccagctggcccaga

SEQ ID NO: 8175273 - DNA, 22 bp, Homo sapiens
agcctgcaggatgggcagcacc

SEQ ID NO: 8175274 - DNA, 20 bp, Homo sapiens
agcctgccagctggcccaga

SEQ ID NO: 8175275 - DNA, 20 bp, Homo sapiens
agcctgccagctggcccaga

SEQ ID NO: 8175276 - DNA, 22 bp, Homo sapiens
agcctgccaggcgctgcctgga

SEQ ID NO: 8175277 - DNA, 22 bp, Homo sapiens
agcctgcctcagactcaggata

SEQ ID NO: 8175278 - DNA, 17 bp, Homo sapiens
agcctgccccatgctgc

SEQ ID NO: 8175279 - DNA, 17 bp, Homo sapiens
agcctgccccatgctgc

SEQ ID NO: 8175280 - DNA, 22 bp, Homo sapiens
agcctgcctcagactcaggata

SEQ ID NO: 8175281 - DNA, 22 bp, Homo sapiens
acagagtttatgtgtgtacaaa

SEQ ID NO: 8175282 - DNA, 22 bp, Homo sapiens
acagataaaagttgtttaaaat

SEQ ID NO: 8175283 - DNA, 22 bp, Homo sapiens
acagataaaagttgtttaaaat

SEQ ID NO: 8175284 - DNA, 22 bp, Homo sapiens
acagataatacattgtgctaca

SEQ ID NO: 8175285 - DNA, 22 bp, Homo sapiens
agcctgagtgcttaggactgtt

SEQ ID NO: 8175286 - DNA, 22 bp, Homo sapiens
acagataatacattgtgctaca

SEQ ID NO: 8175287 - DNA, 22 bp, Homo sapiens
acagataaggcagttaagagtt

SEQ ID NO: 8175288 - DNA, 22 bp, Homo sapiens
acagataaggcagttaagagtt

SEQ ID NO: 8175289 - DNA, 22 bp, Homo sapiens
acagagttgtgtttgtacaacg

SEQ ID NO: 8175290 - DNA, 22 bp, Homo sapiens
acagagttgtgtttgtacaacg

SEQ ID NO: 8175291 - DNA, 22 bp, Homo sapiens
acagagttagcagaaagttgga

SEQ ID NO: 8175292 - DNA, 22 bp, Homo sapiens
acagagtggagttcagtaaata

SEQ ID NO: 8175293 - DNA, 22 bp, Homo sapiens
acagagtgtttttaagtatatt

SEQ ID NO: 8175294 - DNA, 22 bp, Homo sapiens
acagagttaaagtggagtttaa

SEQ ID NO: 8175295 - DNA, 22 bp, Homo sapiens
acagagtcttacgtggtgataa

SEQ ID NO: 8175296 - DNA, 22 bp, Homo sapiens
acagagtcttacgtggtgataa

SEQ ID NO: 8175297 - DNA, 22 bp, Homo sapiens
acagagtctcagggatgaaagc

SEQ ID NO: 8175298 - DNA, 22 bp, Homo sapiens
acagagtctgacaggtaggcgc

SEQ ID NO: 8175299 - DNA, 22 bp, Homo sapiens
agcccctgtaccctgagtgctt

SEQ ID NO: 8175300 - DNA, 22 bp, Homo sapiens
acagagtcattcattgtccagt

SEQ ID NO: 8175301 - DNA, 22 bp, Homo sapiens
acagagtctcaaacctacaaag

SEQ ID NO: 8175302 - DNA, 22 bp, Homo sapiens
agcccctgggagtagctgctgc

SEQ ID NO: 8175303 - DNA, 22 bp, Homo sapiens
agcccctgggagtagctgctgc

SEQ ID NO: 8175304 - DNA, 22 bp, Homo sapiens
agcccctgtaccctgagtgctt

SEQ ID NO: 8175305 - DNA, 22 bp, Homo sapiens
agcccctgtaccctgagtgctt

SEQ ID NO: 8175306 - DNA, 23 bp, Homo sapiens
acagaggtccaaacagtataagc

SEQ ID NO: 8175307 - DNA, 22 bp, Homo sapiens
agcccctctgtggctctgcctc

SEQ ID NO: 8175308 - DNA, 22 bp, Homo sapiens
agcccctgggagtagctgctgc

SEQ ID NO: 8175309 - DNA, 22 bp, Homo sapiens
agcccctgctgggtgtagctca

SEQ ID NO: 8175310 - DNA, 22 bp, Homo sapiens
agcccctgctgggtgtagctca

SEQ ID NO: 8175311 - DNA, 22 bp, Homo sapiens
agcccccaggagtctccacgcc

SEQ ID NO: 8175312 - DNA, 22 bp, Homo sapiens
agcccccaggagtctccacgcc

SEQ ID NO: 8175313 - DNA, 22 bp, Homo sapiens
acagagcatttgggacagagag

SEQ ID NO: 8175314 - DNA, 22 bp, Homo sapiens
acagagcatttgggacagagag

SEQ ID NO: 8175315 - DNA, 22 bp, Homo sapiens
acagagcatttgggacagagag

SEQ ID NO: 8175316 - DNA, 23 bp, Homo sapiens
agcccctcatatctgctttctct

SEQ ID NO: 8175317 - DNA, 23 bp, Homo sapiens
agcccctcatggtgtctagacag

SEQ ID NO: 8175318 - DNA, 22 bp, Homo sapiens
agccccctccctagtgactgga

SEQ ID NO: 8175319 - DNA, 22 bp, Homo sapiens
agcccctctgtggctctgcctc

SEQ ID NO: 8175320 - DNA, 22 bp, Homo sapiens
acagagcatataaagtgctttg

SEQ ID NO: 8175321 - DNA, 22 bp, Homo sapiens
acagagcatataaagtgctttg

SEQ ID NO: 8175322 - DNA, 22 bp, Homo sapiens
acagagcatataaagtgctttg

SEQ ID NO: 8175323 - DNA, 22 bp, Homo sapiens
acagagcatataaagtgctttg

SEQ ID NO: 8175324 - DNA, 22 bp, Homo sapiens
acagagcatataaagtgctttg

SEQ ID NO: 8175325 - DNA, 22 bp, Homo sapiens
acagagcatcagatgaaatcaa

SEQ ID NO: 8175326 - DNA, 22 bp, Homo sapiens
acagagcatgctcagtgtgtga

SEQ ID NO: 8175327 - DNA, 22 bp, Homo sapiens
acagagcatttgggacagagag

SEQ ID NO: 8175328 - DNA, 22 bp, Homo sapiens
acagagcatgctcagtgtgtga

SEQ ID NO: 8175329 - DNA, 22 bp, Homo sapiens
acagagcatgatggaagatcga

SEQ ID NO: 8175330 - DNA, 22 bp, Homo sapiens
acagagcagttctggagctggc

SEQ ID NO: 8175331 - DNA, 22 bp, Homo sapiens
acagagcagttctggagctggc

SEQ ID NO: 8175332 - DNA, 22 bp, Homo sapiens
acagagcagttctggagctggc

SEQ ID NO: 8175333 - DNA, 22 bp, Homo sapiens
acagagcagttctggagctggc

SEQ ID NO: 8175334 - DNA, 22 bp, Homo sapiens
acagagcataatgtctagcaca

SEQ ID NO: 8175335 - DNA, 22 bp, Homo sapiens
acagagcataatgtctagcaca

SEQ ID NO: 8175336 - DNA, 22 bp, Homo sapiens
acagagcataatgtctagcaca

SEQ ID NO: 8175337 - DNA, 21 bp, Homo sapiens
acagagcataatggtgtggca

SEQ ID NO: 8175338 - DNA, 22 bp, Homo sapiens
acagagcagtaagaacacagct

SEQ ID NO: 8175339 - DNA, 22 bp, Homo sapiens
acagagcagtaagaacacagct

SEQ ID NO: 8175340 - DNA, 22 bp, Homo sapiens
acagagcactgccctgtgccgc

SEQ ID NO: 8175341 - DNA, 22 bp, Homo sapiens
acagagcaggtccagaagtgcc

SEQ ID NO: 8175342 - DNA, 22 bp, Homo sapiens
acagagcaggtccagaagtgcc

SEQ ID NO: 8175343 - DNA, 17 bp, Homo sapiens
acagagcacatcaagat

SEQ ID NO: 8175344 - DNA, 22 bp, Homo sapiens
acagagcactgccctgtgccgc

SEQ ID NO: 8175345 - DNA, 22 bp, Homo sapiens
acagagcactgccctgtgccgc

SEQ ID NO: 8175346 - DNA, 22 bp, Homo sapiens
acagagaggtaaaatatatagt

SEQ ID NO: 8175347 - DNA, 22 bp, Homo sapiens
acagagagggagtgataaatcc

SEQ ID NO: 8175348 - DNA, 22 bp, Homo sapiens
acagagagggagtgataaatcc

SEQ ID NO: 8175349 - DNA, 22 bp, Homo sapiens
agcccagctgcctgcctgctgt

SEQ ID NO: 8175350 - DNA, 22 bp, Homo sapiens
agccacagtctgatgcctgaga

SEQ ID NO: 8175351 - DNA, 22 bp, Homo sapiens
agccacagtcaacctgtccata

SEQ ID NO: 8175352 - DNA, 22 bp, Homo sapiens
agccacagtcaacctgtccata

SEQ ID NO: 8175353 - DNA, 22 bp, Homo sapiens
agccacagtcaacctgtccata

SEQ ID NO: 8175354 - DNA, 22 bp, Homo sapiens
agccacagtcaacctgtccata

SEQ ID NO: 8175355 - DNA, 22 bp, Homo sapiens
agccacagtcaacctgtccata

SEQ ID NO: 8175356 - DNA, 22 bp, Homo sapiens
agccacaggtgttggccagtgt

SEQ ID NO: 8175357 - DNA, 22 bp, Homo sapiens
agccacagtcaacctgtccata

SEQ ID NO: 8175358 - DNA, 21 bp, Homo sapiens
agccatcctgaatggtgccat

SEQ ID NO: 8175359 - DNA, 21 bp, Homo sapiens
agccatcctgaatggtgccat

SEQ ID NO: 8175360 - DNA, 22 bp, Homo sapiens
agccagggtgggtgaatgctat

SEQ ID NO: 8175361 - DNA, 22 bp, Homo sapiens
agccagggtgggtgaatgctat

SEQ ID NO: 8175362 - DNA, 22 bp, Homo sapiens
agccatgttaaatggacttgat

SEQ ID NO: 8175363 - DNA, 22 bp, Homo sapiens
agccatgttaaatggacttgat

SEQ ID NO: 8175364 - DNA, 22 bp, Homo sapiens
agccattcattgtgctctcaga

SEQ ID NO: 8175365 - DNA, 22 bp, Homo sapiens
agccatggtctcagggccataa

SEQ ID NO: 8175366 - DNA, 22 bp, Homo sapiens
agccatggtctcagggccataa

SEQ ID NO: 8175367 - DNA, 22 bp, Homo sapiens
agccatggcgccactagaggga

SEQ ID NO: 8175368 - DNA, 22 bp, Homo sapiens
agccatggcgccactagaggga

SEQ ID NO: 8175369 - DNA, 22 bp, Homo sapiens
agccatggcgccactagaggga

SEQ ID NO: 8175370 - DNA, 22 bp, Homo sapiens
agccatgctcagttcctggagc

SEQ ID NO: 8175371 - DNA, 22 bp, Homo sapiens
agccatgcaccttactcttgct

SEQ ID NO: 8175372 - DNA, 22 bp, Homo sapiens
agccatgcaccttactcttgct

SEQ ID NO: 8175373 - DNA, 22 bp, Homo sapiens
agccatgctcagttcctggagc

SEQ ID NO: 8175374 - DNA, 22 bp, Homo sapiens
acacaggaactctgagaggtgg

SEQ ID NO: 8175375 - DNA, 22 bp, Homo sapiens
acacaggaagagagataataat

SEQ ID NO: 8175376 - DNA, 22 bp, Homo sapiens
acacaggaagagagataataat

SEQ ID NO: 8175377 - DNA, 22 bp, Homo sapiens
acacaggaagagagataataat

SEQ ID NO: 8175378 - DNA, 22 bp, Homo sapiens
acacaggaactctgagaggtgg

SEQ ID NO: 8175379 - DNA, 22 bp, Homo sapiens
acaattttaagccagagtgggt

SEQ ID NO: 8175380 - DNA, 22 bp, Homo sapiens
acaattttccccataggttatc

SEQ ID NO: 8175381 - DNA, 22 bp, Homo sapiens
acaatttctgatcagtgaattt

SEQ ID NO: 8175382 - DNA, 22 bp, Homo sapiens
acacaggcaagagtgcaggtct

SEQ ID NO: 8175383 - DNA, 23 bp, Homo sapiens
acacaggatacatacggaagcaa

SEQ ID NO: 8175384 - DNA, 22 bp, Homo sapiens
acacaggaggaggatggtggtc

SEQ ID NO: 8175385 - DNA, 22 bp, Homo sapiens
acacaggagaaaagatctccca

SEQ ID NO: 8175386 - DNA, 22 bp, Homo sapiens
acacaggagatatgtaatggct

SEQ ID NO: 8175387 - DNA, 22 bp, Homo sapiens
acacaggaggaggatggtggtc

SEQ ID NO: 8175388 - DNA, 22 bp, Homo sapiens
acacaggaagtcagcactgatg

SEQ ID NO: 8175389 - DNA, 22 bp, Homo sapiens
acacaggaagtcagcactgatg

SEQ ID NO: 8175390 - DNA, 22 bp, Homo sapiens
acacaggaagtcagcactgatg

SEQ ID NO: 8175391 - DNA, 22 bp, Homo sapiens
acacaggaagtcagcactgatg

SEQ ID NO: 8175392 - DNA, 22 bp, Homo sapiens
acacaggacggccctgtggctt

SEQ ID NO: 8175393 - DNA, 22 bp, Homo sapiens
acacaggacagggatgtgtttt

SEQ ID NO: 8175394 - DNA, 22 bp, Homo sapiens
agcaccctggggaagcacaaag

SEQ ID NO: 8175395 - DNA, 22 bp, Homo sapiens
agcaccattgcaaatatggcag

SEQ ID NO: 8175396 - DNA, 22 bp, Homo sapiens
agcaccatgaccttgccattga

SEQ ID NO: 8175397 - DNA, 20 bp, Homo sapiens
agcacctcccatatgctaga

SEQ ID NO: 8175398 - DNA, 22 bp, Homo sapiens
acaattctgggtatttatatag

SEQ ID NO: 8175399 - DNA, 22 bp, Homo sapiens
acaattctgtggttgtctgtgg

SEQ ID NO: 8175400 - DNA, 22 bp, Homo sapiens
acaattctgggtatttatatag

SEQ ID NO: 8175401 - DNA, 22 bp, Homo sapiens
acaattctgatggtttcccagt

SEQ ID NO: 8175402 - DNA, 22 bp, Homo sapiens
agcacctgcctgcattggctat

SEQ ID NO: 8175403 - DNA, 22 bp, Homo sapiens
acaattctgatggtttcccagt

SEQ ID NO: 8175404 - DNA, 22 bp, Homo sapiens
acaattctgatggtttcccagt

SEQ ID NO: 8175405 - DNA, 22 bp, Homo sapiens
acaatttatccattgtatagtt

SEQ ID NO: 8175406 - DNA, 22 bp, Homo sapiens
acaattgactgtatttttagct

SEQ ID NO: 8175407 - DNA, 21 bp, Homo sapiens
acaattgatggcttaagttgc

SEQ ID NO: 8175408 - DNA, 22 bp, Homo sapiens
acaattgctaatgcttctgttg

SEQ ID NO: 8175409 - DNA, 22 bp, Homo sapiens
acaatttatccattgtatagtt

SEQ ID NO: 8175410 - DNA, 22 bp, Homo sapiens
acaatttatccattgtatagtt

SEQ ID NO: 8175411 - DNA, 20 bp, Homo sapiens
acaatttcctcactatatgc

SEQ ID NO: 8175412 - DNA, 22 bp, Homo sapiens
acaatttatccattgtatagtt

SEQ ID NO: 8175413 - DNA, 22 bp, Homo sapiens
acacatatctaagatagatgac

SEQ ID NO: 8175414 - DNA, 22 bp, Homo sapiens
acacatatatttgcatatacac

SEQ ID NO: 8175415 - DNA, 22 bp, Homo sapiens
acacatatatttgcatatacac

SEQ ID NO: 8175416 - DNA, 22 bp, Homo sapiens
acacatatatttgcatatacac

SEQ ID NO: 8175417 - DNA, 22 bp, Homo sapiens
acacatatatttgcatatacac

SEQ ID NO: 8175418 - DNA, 22 bp, Homo sapiens
acacatatatttgcatatacac

SEQ ID NO: 8175419 - DNA, 22 bp, Homo sapiens
acacatatatttgcatatacac

SEQ ID NO: 8175420 - DNA, 23 bp, Homo sapiens
acacatatattcagatacagatg

SEQ ID NO: 8175421 - DNA, 23 bp, Homo sapiens
acacatatattcagatacagatg

SEQ ID NO: 8175422 - DNA, 23 bp, Homo sapiens
acacatatattcagatacagatg

SEQ ID NO: 8175423 - DNA, 23 bp, Homo sapiens
acacatatattcagatacagatg

SEQ ID NO: 8175424 - DNA, 23 bp, Homo sapiens
acacatatattcagatacagatg

SEQ ID NO: 8175425 - DNA, 22 bp, Homo sapiens
acacatatatttgcatatacac

SEQ ID NO: 8175426 - DNA, 22 bp, Homo sapiens
acacatatgccattacagcaaa

SEQ ID NO: 8175427 - DNA, 22 bp, Homo sapiens
acacatatgccattacagcaaa

SEQ ID NO: 8175428 - DNA, 22 bp, Homo sapiens
acacatatggttgctgcagtga

SEQ ID NO: 8175429 - DNA, 22 bp, Homo sapiens
acacatatgccattacagcaaa

SEQ ID NO: 8175430 - DNA, 22 bp, Homo sapiens
acacatatggttgctgcagtga

SEQ ID NO: 8175431 - DNA, 22 bp, Homo sapiens
acacatatggttgctgcagtga

SEQ ID NO: 8175432 - DNA, 22 bp, Homo sapiens
acacatatgcagatcccccaca

SEQ ID NO: 8175433 - DNA, 22 bp, Homo sapiens
acacatatgcagatcccccaca

SEQ ID NO: 8175434 - DNA, 22 bp, Homo sapiens
acacatatctaagatagatgac

SEQ ID NO: 8175435 - DNA, 22 bp, Homo sapiens
acacatatctaagatagatgac

SEQ ID NO: 8175436 - DNA, 22 bp, Homo sapiens
acacatatctaagatagatgac

SEQ ID NO: 8175437 - DNA, 22 bp, Homo sapiens
acacatatctaagatagatgac

SEQ ID NO: 8175438 - DNA, 22 bp, Homo sapiens
acacatatctaagatagatgac

SEQ ID NO: 8175439 - DNA, 22 bp, Homo sapiens
acacatatctaagatagatgac

SEQ ID NO: 8175440 - DNA, 20 bp, Homo sapiens
agcaggaaaagtgccagtct

SEQ ID NO: 8175441 - DNA, 23 bp, Homo sapiens
agcaggaaaccgagggtgatgtt

SEQ ID NO: 8175442 - DNA, 20 bp, Homo sapiens
agcaggaaaagtgccagtct

SEQ ID NO: 8175443 - DNA, 20 bp, Homo sapiens
agcaggaaaagtgccagtct

SEQ ID NO: 8175444 - DNA, 18 bp, Homo sapiens
agcagctttgtgcttgat

SEQ ID NO: 8175445 - DNA, 21 bp, Homo sapiens
agcagctttggttgaagcaga

SEQ ID NO: 8175446 - DNA, 18 bp, Homo sapiens
agcagctttgacaggaaa

SEQ ID NO: 8175447 - DNA, 22 bp, Homo sapiens
agcagctttaagtcactggtta

SEQ ID NO: 8175448 - DNA, 22 bp, Homo sapiens
agcagctttcctctggggtcag

SEQ ID NO: 8175449 - DNA, 22 bp, Homo sapiens
agcagctttcacctccccgcct

SEQ ID NO: 8175450 - DNA, 22 bp, Homo sapiens
agcagcttgttaaaaagttcca

SEQ ID NO: 8175451 - DNA, 22 bp, Homo sapiens
agcagcttggttttaggcatgg

SEQ ID NO: 8175452 - DNA, 22 bp, Homo sapiens
agcagcttgggtctctcctgct

SEQ ID NO: 8175453 - DNA, 21 bp, Homo sapiens
agcagcttgagtctggagctc

SEQ ID NO: 8175454 - DNA, 22 bp, Homo sapiens
agcagcttgaggctggattcca

SEQ ID NO: 8175455 - DNA, 22 bp, Homo sapiens
agcagcttggggccgagataga

SEQ ID NO: 8175456 - DNA, 21 bp, Homo sapiens
agcagcttgagtctggagctc

SEQ ID NO: 8175457 - DNA, 22 bp, Homo sapiens
agcagcttgggtctctcctgct

SEQ ID NO: 8175458 - DNA, 22 bp, Homo sapiens
agcagcttggggccgagataga

SEQ ID NO: 8175459 - DNA, 22 bp, Homo sapiens
agcagcttggggccgagataga

SEQ ID NO: 8175460 - DNA, 22 bp, Homo sapiens
agcagcttgggtctctcctgct

SEQ ID NO: 8175461 - DNA, 22 bp, Homo sapiens
acacatatgtatgcatcatgtg

SEQ ID NO: 8175462 - DNA, 22 bp, Homo sapiens
acacatatgtatgcatcatgtg

SEQ ID NO: 8175463 - DNA, 22 bp, Homo sapiens
acacatatgtcattgaaaaatc

SEQ ID NO: 8175464 - DNA, 22 bp, Homo sapiens
acacatatgtatgcatcatgtg

SEQ ID NO: 8175465 - DNA, 22 bp, Homo sapiens
acacatatggttggtaggagtt

SEQ ID NO: 8175466 - DNA, 22 bp, Homo sapiens
acacatatgtatgcatcatgtg

SEQ ID NO: 8175467 - DNA, 22 bp, Homo sapiens
acacatatgtatgcatcatgtg

SEQ ID NO: 8175468 - DNA, 22 bp, Homo sapiens
agcagcagtatccttccccggc

SEQ ID NO: 8175469 - DNA, 22 bp, Homo sapiens
agcagcagtacatataagacta

SEQ ID NO: 8175470 - DNA, 22 bp, Homo sapiens
agcagcagtacatataagacta

SEQ ID NO: 8175471 - DNA, 22 bp, Homo sapiens
agcagcaggtgcttctggatct

SEQ ID NO: 8175472 - DNA, 22 bp, Homo sapiens
agcagcagtacatataagacta

SEQ ID NO: 8175473 - DNA, 22 bp, Homo sapiens
agcagcagtacatataagacta

SEQ ID NO: 8175474 - DNA, 22 bp, Homo sapiens
agcagcagtcatgcctatgctc

SEQ ID NO: 8175475 - DNA, 22 bp, Homo sapiens
agcagcagtcatgcctatgctc

SEQ ID NO: 8175476 - DNA, 22 bp, Homo sapiens
agcagcagtatccttccccggc

SEQ ID NO: 8175477 - DNA, 22 bp, Homo sapiens
agcagcagtcatgcctatgctc

SEQ ID NO: 8175478 - DNA, 22 bp, Homo sapiens
agcagcagtcctttgtgtaatt

SEQ ID NO: 8175479 - DNA, 22 bp, Homo sapiens
acacaggcaagagtgcaggtct

SEQ ID NO: 8175480 - DNA, 22 bp, Homo sapiens
acacaggcaatgtgagtgggag

SEQ ID NO: 8175481 - DNA, 22 bp, Homo sapiens
acacaggcaatgtgagtgggag

SEQ ID NO: 8175482 - DNA, 22 bp, Homo sapiens
agcagcaggtgcttctggatct

SEQ ID NO: 8175483 - DNA, 22 bp, Homo sapiens
agcagcaggtgacctcgatgcc

SEQ ID NO: 8175484 - DNA, 22 bp, Homo sapiens
agcagcaggtgacctcgatgcc

SEQ ID NO: 8175485 - DNA, 22 bp, Homo sapiens
acacatatatgtgcgtgtatat

SEQ ID NO: 8175486 - DNA, 22 bp, Homo sapiens
acacatatatgtgcgtgtatat

SEQ ID NO: 8175487 - DNA, 22 bp, Homo sapiens
acacatatattatttgtggctc

SEQ ID NO: 8175488 - DNA, 22 bp, Homo sapiens
acacatatatgtgcgtgtatat

SEQ ID NO: 8175489 - DNA, 22 bp, Homo sapiens
agcagcagtgtgtggtcatgtt

SEQ ID NO: 8175490 - DNA, 22 bp, Homo sapiens
agcagcagtgtgtggtcatgtt

SEQ ID NO: 8175491 - DNA, 22 bp, Homo sapiens
agcagcagttgctgacgttcta

SEQ ID NO: 8175492 - DNA, 22 bp, Homo sapiens
agcagcagtgttctggaattct

SEQ ID NO: 8175493 - DNA, 23 bp, Homo sapiens
agcagcagtgagaggtgtcttac

SEQ ID NO: 8175494 - DNA, 22 bp, Homo sapiens
agcagcagtgacagccgaaagc

SEQ ID NO: 8175495 - DNA, 22 bp, Homo sapiens
agcagcagtcctttgtgtaatt

SEQ ID NO: 8175496 - DNA, 22 bp, Homo sapiens
agcagcagtgtggtttggggaa

SEQ ID NO: 8175497 - DNA, 23 bp, Homo sapiens
agcagcagtgagaggtgtcttac

SEQ ID NO: 8175498 - DNA, 23 bp, Homo sapiens
agcagcagtgagaggtgtcttac

SEQ ID NO: 8175499 - DNA, 23 bp, Homo sapiens
agcagcagtgagaggtgtcttac

SEQ ID NO: 8175500 - DNA, 22 bp, Homo sapiens
acagaaattctgggacagaaaa

SEQ ID NO: 8175501 - DNA, 22 bp, Homo sapiens
acagaaattgggcaaatggaag

SEQ ID NO: 8175502 - DNA, 22 bp, Homo sapiens
acagaaattgctaatagctcat

SEQ ID NO: 8175503 - DNA, 22 bp, Homo sapiens
acagaaattagcagtgagttta

SEQ ID NO: 8175504 - DNA, 19 bp, Homo sapiens
acagaaattagttattttc

SEQ ID NO: 8175505 - DNA, 19 bp, Homo sapiens
acagaaattagttattttc

SEQ ID NO: 8175506 - DNA, 22 bp, Homo sapiens
acagaaattcaaactggaattt

SEQ ID NO: 8175507 - DNA, 22 bp, Homo sapiens
acagaacaagacctgcttattg

SEQ ID NO: 8175508 - DNA, 22 bp, Homo sapiens
acagaacaagacctgcttattg

SEQ ID NO: 8175509 - DNA, 22 bp, Homo sapiens
acagaaattgggcaaatggaag

SEQ ID NO: 8175510 - DNA, 22 bp, Homo sapiens
acagaaattgggcaaatggaag

SEQ ID NO: 8175511 - DNA, 22 bp, Homo sapiens
agccacaggtgttggccagtgt

SEQ ID NO: 8175512 - DNA, 22 bp, Homo sapiens
agccacaggccatgagatacca

SEQ ID NO: 8175513 - DNA, 22 bp, Homo sapiens
agccacagggggtgagggacaa

SEQ ID NO: 8175514 - DNA, 22 bp, Homo sapiens
agccacaggccatgagatacca

SEQ ID NO: 8175515 - DNA, 22 bp, Homo sapiens
acactgtgcatgcatatacaca

SEQ ID NO: 8175516 - DNA, 22 bp, Homo sapiens
acactgtgcatgcatatacaca

SEQ ID NO: 8175517 - DNA, 21 bp, Homo sapiens
acactgtgtcataatgcttaa

SEQ ID NO: 8175518 - DNA, 22 bp, Homo sapiens
agcagtggtgtgaggagggctc

SEQ ID NO: 8175519 - DNA, 22 bp, Homo sapiens
agcagtggtccccaacctttct

SEQ ID NO: 8175520 - DNA, 22 bp, Homo sapiens
agcagtgggtgacagagctgag

SEQ ID NO: 8175521 - DNA, 22 bp, Homo sapiens
agcagtgggtgacagagctgag

SEQ ID NO: 8175522 - DNA, 22 bp, Homo sapiens
agcagtgggtgacagagctgag

SEQ ID NO: 8175523 - DNA, 22 bp, Homo sapiens
agcagtgggggagtgttagttt

SEQ ID NO: 8175524 - DNA, 22 bp, Homo sapiens
agcagtgggggagtgttagttt

SEQ ID NO: 8175525 - DNA, 22 bp, Homo sapiens
agcagtggctggatggtgtgct

SEQ ID NO: 8175526 - DNA, 22 bp, Homo sapiens
agcagtggctggatggtgtgct

SEQ ID NO: 8175527 - DNA, 18 bp, Homo sapiens
agcagtgtgacctgaaga

SEQ ID NO: 8175528 - DNA, 18 bp, Homo sapiens
agcagtgtgacctgaaga

SEQ ID NO: 8175529 - DNA, 22 bp, Homo sapiens
agcagtgtgcttcgtttcatga

SEQ ID NO: 8175530 - DNA, 22 bp, Homo sapiens
agcagtggtgtgaggagggctc

SEQ ID NO: 8175531 - DNA, 18 bp, Homo sapiens
agcagtgtggcaagcaga

SEQ ID NO: 8175532 - DNA, 22 bp, Homo sapiens
agcagtgttcaatgatacactg

SEQ ID NO: 8175533 - DNA, 22 bp, Homo sapiens
agcagtgttttagccatttctg

SEQ ID NO: 8175534 - DNA, 22 bp, Homo sapiens
agcagtgttttagccatttctg

SEQ ID NO: 8175535 - DNA, 22 bp, Homo sapiens
acagaaagataggcacaaggtc

SEQ ID NO: 8175536 - DNA, 22 bp, Homo sapiens
acagaaagataggcacaaggtc

SEQ ID NO: 8175537 - DNA, 22 bp, Homo sapiens
acagaaagatgatttgaaatgg

SEQ ID NO: 8175538 - DNA, 22 bp, Homo sapiens
acagaaagataggcacaaggtc

SEQ ID NO: 8175539 - DNA, 23 bp, Homo sapiens
acacatttttcccgttctgaggt

SEQ ID NO: 8175540 - DNA, 23 bp, Homo sapiens
acacatttttcccgttctgaggt

SEQ ID NO: 8175541 - DNA, 22 bp, Homo sapiens
acaccagggatatgaggaagga

SEQ ID NO: 8175542 - DNA, 22 bp, Homo sapiens
agcagggcagttaaagggtcct

SEQ ID NO: 8175543 - DNA, 22 bp, Homo sapiens
agcagggcagtgcttcagctct

SEQ ID NO: 8175544 - DNA, 22 bp, Homo sapiens
acacattttctaacagggatca

SEQ ID NO: 8175545 - DNA, 22 bp, Homo sapiens
acacattttcaacactgtcaag

SEQ ID NO: 8175546 - DNA, 22 bp, Homo sapiens
acacattttcaacactgtcaag

SEQ ID NO: 8175547 - DNA, 22 bp, Homo sapiens
acacattttcaacactgtcaag

SEQ ID NO: 8175548 - DNA, 22 bp, Homo sapiens
acacatttgggctcctacataa

SEQ ID NO: 8175549 - DNA, 20 bp, Homo sapiens
agcaggaaaagtgccagtct

SEQ ID NO: 8175550 - DNA, 23 bp, Homo sapiens
agcaggaaaccgagggtgatgtt

SEQ ID NO: 8175551 - DNA, 23 bp, Homo sapiens
agcaggaaaccgagggtgatgtt

SEQ ID NO: 8175552 - DNA, 22 bp, Homo sapiens
agcaggaaagaaaaatctgtgt

SEQ ID NO: 8175553 - DNA, 22 bp, Homo sapiens
acacattatctcattaaatact

SEQ ID NO: 8175554 - DNA, 22 bp, Homo sapiens
acacattatctcattaaatact

SEQ ID NO: 8175555 - DNA, 22 bp, Homo sapiens
acacatttctctttttgtaagt

SEQ ID NO: 8175556 - DNA, 22 bp, Homo sapiens
acactgtgagctgaagggctgc

SEQ ID NO: 8175557 - DNA, 22 bp, Homo sapiens
acactgtgacaagaaagagctg

SEQ ID NO: 8175558 - DNA, 23 bp, Homo sapiens
acactgtctcatggatagactgc

SEQ ID NO: 8175559 - DNA, 22 bp, Homo sapiens
acactgtctgggactcaggagt

SEQ ID NO: 8175560 - DNA, 22 bp, Homo sapiens
acactgtctgggactcaggagt

SEQ ID NO: 8175561 - DNA, 23 bp, Homo sapiens
acactgtctcatggatagactgc

SEQ ID NO: 8175562 - DNA, 22 bp, Homo sapiens
acactgtctcatatgaggggac

SEQ ID NO: 8175563 - DNA, 22 bp, Homo sapiens
agcagggccaacagtaaacacc

SEQ ID NO: 8175564 - DNA, 22 bp, Homo sapiens
agcagggccaacagtaaacacc

SEQ ID NO: 8175565 - DNA, 22 bp, Homo sapiens
agcagggccaacagtaaacacc

SEQ ID NO: 8175566 - DNA, 18 bp, Homo sapiens
agcagggcattttgccat

SEQ ID NO: 8175567 - DNA, 22 bp, Homo sapiens
agcagggcatgaataagggttt

SEQ ID NO: 8175568 - DNA, 22 bp, Homo sapiens
agcagggcatgaataagggttt

SEQ ID NO: 8175569 - DNA, 22 bp, Homo sapiens
agcagggcagttaaagggtcct

SEQ ID NO: 8175570 - DNA, 22 bp, Homo sapiens
agcagggcagttaaagggtcct

SEQ ID NO: 8175571 - DNA, 22 bp, Homo sapiens
acactgcagatgtaatttgagt

SEQ ID NO: 8175572 - DNA, 22 bp, Homo sapiens
agcagggcccactaggggagat

SEQ ID NO: 8175573 - DNA, 22 bp, Homo sapiens
agcagggcccactaggggagat

SEQ ID NO: 8175574 - DNA, 22 bp, Homo sapiens
agcagggcccactaggggagat

SEQ ID NO: 8175575 - DNA, 23 bp, Homo sapiens
agcagggccagaatacttgctgt

SEQ ID NO: 8175576 - DNA, 22 bp, Homo sapiens
agcagggcccactaggggagat

SEQ ID NO: 8175577 - DNA, 22 bp, Homo sapiens
agcagggcccactaggggagat

SEQ ID NO: 8175578 - DNA, 22 bp, Homo sapiens
aatgttatttctgcatagtagt

SEQ ID NO: 8175579 - DNA, 22 bp, Homo sapiens
aatgttattgtcctttccaaaa

SEQ ID NO: 8175580 - DNA, 22 bp, Homo sapiens
aatgtgtttagttaatgagttg

SEQ ID NO: 8175581 - DNA, 22 bp, Homo sapiens
aatgttcaaacagatcacttag

SEQ ID NO: 8175582 - DNA, 22 bp, Homo sapiens
aatgttatttctgcatagtagt

SEQ ID NO: 8175583 - DNA, 22 bp, Homo sapiens
aatgttcagaggacaatataaa

SEQ ID NO: 8175584 - DNA, 22 bp, Homo sapiens
aatgttctgatgtagggtttag

SEQ ID NO: 8175585 - DNA, 22 bp, Homo sapiens
aatgttgacagtggtgatctca

SEQ ID NO: 8175586 - DNA, 22 bp, Homo sapiens
aatgttgacctcctgaatgttt

SEQ ID NO: 8175587 - DNA, 22 bp, Homo sapiens
aatgttgacctcctgaatgttt

SEQ ID NO: 8175588 - DNA, 22 bp, Homo sapiens
aatgttgcagagtgattgtcca

SEQ ID NO: 8175589 - DNA, 22 bp, Homo sapiens
aatgttgcagagtgattgtcca

SEQ ID NO: 8175590 - DNA, 22 bp, Homo sapiens
aatgttcattgattaaatgaat

SEQ ID NO: 8175591 - DNA, 22 bp, Homo sapiens
aatgttcagtagaataggaatg

SEQ ID NO: 8175592 - DNA, 22 bp, Homo sapiens
aatgtttgcatctattcacatg

SEQ ID NO: 8175593 - DNA, 22 bp, Homo sapiens
aattaccaggatttttcagtat

SEQ ID NO: 8175594 - DNA, 22 bp, Homo sapiens
aattagctttacctaggattgt

SEQ ID NO: 8175595 - DNA, 22 bp, Homo sapiens
aattagcttcagcttgtggggc

SEQ ID NO: 8175596 - DNA, 22 bp, Homo sapiens
aattagcttatgtgtacttttc

SEQ ID NO: 8175597 - DNA, 22 bp, Homo sapiens
aattactgatctacaaaatcca

SEQ ID NO: 8175598 - DNA, 20 bp, Homo sapiens
aattagcttaagtcaatcag

SEQ ID NO: 8175599 - DNA, 22 bp, Homo sapiens
aattagctgtcaatgaggatct

SEQ ID NO: 8175600 - DNA, 22 bp, Homo sapiens
aattagctgcaaaggatgttat

SEQ ID NO: 8175601 - DNA, 22 bp, Homo sapiens
aattagctttccgccatcacac

SEQ ID NO: 8175602 - DNA, 22 bp, Homo sapiens
aattagcttatgtgtacttttc

SEQ ID NO: 8175603 - DNA, 22 bp, Homo sapiens
aattaggaaattcagccatttt

SEQ ID NO: 8175604 - DNA, 22 bp, Homo sapiens
aattagtattgcgattcattag

SEQ ID NO: 8175605 - DNA, 22 bp, Homo sapiens
aattagtaacctaattccatct

SEQ ID NO: 8175606 - DNA, 22 bp, Homo sapiens
aattagtaacctaattccatct

SEQ ID NO: 8175607 - DNA, 22 bp, Homo sapiens
aatgtttgcatctattcacatg

SEQ ID NO: 8175608 - DNA, 22 bp, Homo sapiens
aatgtttgagcatctacatgct

SEQ ID NO: 8175609 - DNA, 22 bp, Homo sapiens
aatgtttcaattaagtctttta

SEQ ID NO: 8175610 - DNA, 22 bp, Homo sapiens
aatgtttcaattaagtctttta

SEQ ID NO: 8175611 - DNA, 22 bp, Homo sapiens
aatgttgtgcatgtattttgta

SEQ ID NO: 8175612 - DNA, 19 bp, Homo sapiens
aatgtttaagagaaaaagg

SEQ ID NO: 8175613 - DNA, 22 bp, Homo sapiens
aatgtttaatgttagtggtaat

SEQ ID NO: 8175614 - DNA, 22 bp, Homo sapiens
aatgtttaatgttagtggtaat

SEQ ID NO: 8175615 - DNA, 19 bp, Homo sapiens
aatgtttaagagaaaaagg

SEQ ID NO: 8175616 - DNA, 22 bp, Homo sapiens
aatttagattgataaacatgga

SEQ ID NO: 8175617 - DNA, 19 bp, Homo sapiens
aatttagttcttgtttaga

SEQ ID NO: 8175618 - DNA, 22 bp, Homo sapiens
aatttataataaatagggcttt

SEQ ID NO: 8175619 - DNA, 22 bp, Homo sapiens
agagctggggccagagtcaagg

SEQ ID NO: 8175620 - DNA, 22 bp, Homo sapiens
agagctggggccagagtcaagg

SEQ ID NO: 8175621 - DNA, 22 bp, Homo sapiens
agagctggggcataaatgccac

SEQ ID NO: 8175622 - DNA, 22 bp, Homo sapiens
agagctgggacttggactcaat

SEQ ID NO: 8175623 - DNA, 22 bp, Homo sapiens
agagctgggacttggactcaat

SEQ ID NO: 8175624 - DNA, 22 bp, Homo sapiens
agagctgggacttggactcaat

SEQ ID NO: 8175625 - DNA, 22 bp, Homo sapiens
aatttatatgtaattaggcaca

SEQ ID NO: 8175626 - DNA, 22 bp, Homo sapiens
aatttacacttcatttggaggg

SEQ ID NO: 8175627 - DNA, 22 bp, Homo sapiens
aatttacacttcatttggaggg

SEQ ID NO: 8175628 - DNA, 22 bp, Homo sapiens
aatttacacttcatttggaggg

SEQ ID NO: 8175629 - DNA, 22 bp, Homo sapiens
aatttacacttcatttggaggg

SEQ ID NO: 8175630 - DNA, 22 bp, Homo sapiens
aatttacaggtgcactcgccat

SEQ ID NO: 8175631 - DNA, 22 bp, Homo sapiens
aatttacaggtgcactcgccat

SEQ ID NO: 8175632 - DNA, 22 bp, Homo sapiens
aatttacaggtgcactcgccat

SEQ ID NO: 8175633 - DNA, 22 bp, Homo sapiens
aatttacagttgctgatggtac

SEQ ID NO: 8175634 - DNA, 22 bp, Homo sapiens
aatttacagttgctgatggtac

SEQ ID NO: 8175635 - DNA, 22 bp, Homo sapiens
aatttacagttgctgatggtac

SEQ ID NO: 8175636 - DNA, 22 bp, Homo sapiens
aatttacagttgctgatggtac

SEQ ID NO: 8175637 - DNA, 20 bp, Homo sapiens
aattatataactccaacatt

SEQ ID NO: 8175638 - DNA, 22 bp, Homo sapiens
aattatatgttaatcttcaatt

SEQ ID NO: 8175639 - DNA, 22 bp, Homo sapiens
aattatatgttaatcttcaatt

SEQ ID NO: 8175640 - DNA, 22 bp, Homo sapiens
aattatatgttaatcttcaatt

SEQ ID NO: 8175641 - DNA, 22 bp, Homo sapiens
aattatattgaagttgaatgtc

SEQ ID NO: 8175642 - DNA, 22 bp, Homo sapiens
aattatatgttaatcttcaatt

SEQ ID NO: 8175643 - DNA, 22 bp, Homo sapiens
aattatatgttaatcttcaatt

SEQ ID NO: 8175644 - DNA, 20 bp, Homo sapiens
aattatataactccaacatt

SEQ ID NO: 8175645 - DNA, 20 bp, Homo sapiens
aattatataactccaacatt

SEQ ID NO: 8175646 - DNA, 22 bp, Homo sapiens
aattatacattgaacaatctag

SEQ ID NO: 8175647 - DNA, 22 bp, Homo sapiens
aattatacattgaacaatctag

SEQ ID NO: 8175648 - DNA, 22 bp, Homo sapiens
aattatacatgaaggcattata

SEQ ID NO: 8175649 - DNA, 22 bp, Homo sapiens
aattagtattgcgattcattag

SEQ ID NO: 8175650 - DNA, 21 bp, Homo sapiens
aattagtgctccttgtttcaa

SEQ ID NO: 8175651 - DNA, 22 bp, Homo sapiens
aattatggaatttttagagaag

SEQ ID NO: 8175652 - DNA, 22 bp, Homo sapiens
aattatggtatgttcaacaact

SEQ ID NO: 8175653 - DNA, 22 bp, Homo sapiens
aattatggtcactgttcctggg

SEQ ID NO: 8175654 - DNA, 22 bp, Homo sapiens
aattatggtgtgtggttaaggg

SEQ ID NO: 8175655 - DNA, 22 bp, Homo sapiens
aattatggtggatcccagtggg

SEQ ID NO: 8175656 - DNA, 22 bp, Homo sapiens
aattggaaaaagacttaattgc

SEQ ID NO: 8175657 - DNA, 22 bp, Homo sapiens
aattatattgtggtgtgaatgt

SEQ ID NO: 8175658 - DNA, 22 bp, Homo sapiens
aattatattgtggtgtgaatgt

SEQ ID NO: 8175659 - DNA, 22 bp, Homo sapiens
aattatcagatataaaactgca

SEQ ID NO: 8175660 - DNA, 22 bp, Homo sapiens
aattatattgtggtgtgaatgt

SEQ ID NO: 8175661 - DNA, 22 bp, Homo sapiens
aattatattgaagttgaatgtc

SEQ ID NO: 8175662 - DNA, 22 bp, Homo sapiens
aattatctgtaaatggcaattt

SEQ ID NO: 8175663 - DNA, 22 bp, Homo sapiens
aattatcagatataaaactgca

SEQ ID NO: 8175664 - DNA, 22 bp, Homo sapiens
aatgtcatttaggattatgttt

SEQ ID NO: 8175665 - DNA, 22 bp, Homo sapiens
aatgtccaccgtgatgatggaa

SEQ ID NO: 8175666 - DNA, 22 bp, Homo sapiens
aatgtcattggtaaagattagg

SEQ ID NO: 8175667 - DNA, 22 bp, Homo sapiens
aatgtcattggtaaagattagg

SEQ ID NO: 8175668 - DNA, 22 bp, Homo sapiens
aatgtcattgtgagttaggctt

SEQ ID NO: 8175669 - DNA, 22 bp, Homo sapiens
aatgtcctaggcatgattttgt

SEQ ID NO: 8175670 - DNA, 22 bp, Homo sapiens
aatgtcctaggcatgattttgt

SEQ ID NO: 8175671 - DNA, 22 bp, Homo sapiens
aatgtctgtgccttaaaacttc

SEQ ID NO: 8175672 - DNA, 22 bp, Homo sapiens
aatgtctcaccgtaaatgtaac

SEQ ID NO: 8175673 - DNA, 22 bp, Homo sapiens
aatgtctgctctactcaggagg

SEQ ID NO: 8175674 - DNA, 22 bp, Homo sapiens
aatgtcatagcatttcttcaat

SEQ ID NO: 8175675 - DNA, 22 bp, Homo sapiens
aatgtcatagcaaagagagtga

SEQ ID NO: 8175676 - DNA, 22 bp, Homo sapiens
aatgtcagtgttactgctattg

SEQ ID NO: 8175677 - DNA, 22 bp, Homo sapiens
aatgtcatgagcctgctcttgt

SEQ ID NO: 8175678 - DNA, 22 bp, Homo sapiens
aatgtcatgggaatttattcat

SEQ ID NO: 8175679 - DNA, 22 bp, Homo sapiens
aatgtcatagcatttcttcaat

SEQ ID NO: 8175680 - DNA, 22 bp, Homo sapiens
aatgtcatagcatttcttcaat

SEQ ID NO: 8175681 - DNA, 22 bp, Homo sapiens
aatgtcatgggaatttattcat

SEQ ID NO: 8175682 - DNA, 22 bp, Homo sapiens
aatgtcatgggaatttattcat

SEQ ID NO: 8175683 - DNA, 22 bp, Homo sapiens
agacagggtgatcgcttgagcc

SEQ ID NO: 8175684 - DNA, 22 bp, Homo sapiens
agacagggtgatcgcttgagcc

SEQ ID NO: 8175685 - DNA, 22 bp, Homo sapiens
agacagggtgatcgcttgagcc

SEQ ID NO: 8175686 - DNA, 22 bp, Homo sapiens
agacagggagggagcgcggctg

SEQ ID NO: 8175687 - DNA, 22 bp, Homo sapiens
agacagggccactcatcctcac

SEQ ID NO: 8175688 - DNA, 22 bp, Homo sapiens
agacagggtcttgatcagagct

SEQ ID NO: 8175689 - DNA, 22 bp, Homo sapiens
agaaggtggctactcagtcatc

SEQ ID NO: 8175690 - DNA, 23 bp, Homo sapiens
agaagggtccttggcagcgacag

SEQ ID NO: 8175691 - DNA, 22 bp, Homo sapiens
agaagggtagttgtaagagtga

SEQ ID NO: 8175692 - DNA, 22 bp, Homo sapiens
agaagtatcttgggaaggcact

SEQ ID NO: 8175693 - DNA, 22 bp, Homo sapiens
agaagtatgtgagaaattatcc

SEQ ID NO: 8175694 - DNA, 22 bp, Homo sapiens
agaagtataaagaatgtttatg

SEQ ID NO: 8175695 - DNA, 22 bp, Homo sapiens
agaagtaggcagggctgtatca

SEQ ID NO: 8175696 - DNA, 22 bp, Homo sapiens
agaagggctacacgggctctcc

SEQ ID NO: 8175697 - DNA, 22 bp, Homo sapiens
agaagggccagctggacacctg

SEQ ID NO: 8175698 - DNA, 22 bp, Homo sapiens
aatgcaaacttcttgttacttg

SEQ ID NO: 8175699 - DNA, 22 bp, Homo sapiens
aatgcaaagcaagcagagattt

SEQ ID NO: 8175700 - DNA, 22 bp, Homo sapiens
aatgcaaagtgaggtgagtggc

SEQ ID NO: 8175701 - DNA, 22 bp, Homo sapiens
aatgcaaagtgaggtgagtggc

SEQ ID NO: 8175702 - DNA, 22 bp, Homo sapiens
aatgcaagatcaaatctaacac

SEQ ID NO: 8175703 - DNA, 23 bp, Homo sapiens
agacagaggctgaggctggccgc

SEQ ID NO: 8175704 - DNA, 23 bp, Homo sapiens
agacagaggctgaggctggccgc

SEQ ID NO: 8175705 - DNA, 23 bp, Homo sapiens
agacagaggctgaggctggccgc

SEQ ID NO: 8175706 - DNA, 23 bp, Homo sapiens
agacagaggctgaggctggccgc

SEQ ID NO: 8175707 - DNA, 23 bp, Homo sapiens
agacagaggctgaggctggccgc

SEQ ID NO: 8175708 - DNA, 21 bp, Homo sapiens
agacagagtgcagtctacata

SEQ ID NO: 8175709 - DNA, 21 bp, Homo sapiens
agacagagtgcagtctacata

SEQ ID NO: 8175710 - DNA, 21 bp, Homo sapiens
agacagagtgcagtctacata

SEQ ID NO: 8175711 - DNA, 22 bp, Homo sapiens
agacagcagaaactagagcact

SEQ ID NO: 8175712 - DNA, 22 bp, Homo sapiens
agacagcagaaactagagcact

SEQ ID NO: 8175713 - DNA, 22 bp, Homo sapiens
agacaggcatgaggctggattg

SEQ ID NO: 8175714 - DNA, 22 bp, Homo sapiens
agacagcagaaactagagcact

SEQ ID NO: 8175715 - DNA, 22 bp, Homo sapiens
agacagcaatatgggagacgga

SEQ ID NO: 8175716 - DNA, 22 bp, Homo sapiens
agacaggccactctggtctggt

SEQ ID NO: 8175717 - DNA, 22 bp, Homo sapiens
agacaggctgctgtctgctagg

SEQ ID NO: 8175718 - DNA, 22 bp, Homo sapiens
agacaggctgctgtctgctagg

SEQ ID NO: 8175719 - DNA, 22 bp, Homo sapiens
agacaggccactctggtctggt

SEQ ID NO: 8175720 - DNA, 22 bp, Homo sapiens
agacaggccactctggtctggt

SEQ ID NO: 8175721 - DNA, 22 bp, Homo sapiens
agacaggccactctggtctggt

SEQ ID NO: 8175722 - DNA, 23 bp, Homo sapiens
agacactgtaaagaattgcagtt

SEQ ID NO: 8175723 - DNA, 22 bp, Homo sapiens
agacagactttgatctggatgt

SEQ ID NO: 8175724 - DNA, 23 bp, Homo sapiens
agacactgtaaagaattgcagtt

SEQ ID NO: 8175725 - DNA, 22 bp, Homo sapiens
aatgcaatgcagcacctccttg

SEQ ID NO: 8175726 - DNA, 22 bp, Homo sapiens
aatgcaagtcaatgctataccc

SEQ ID NO: 8175727 - DNA, 22 bp, Homo sapiens
aatgcaatacctttttatgctg

SEQ ID NO: 8175728 - DNA, 19 bp, Homo sapiens
agacagagctcagtgggtt

SEQ ID NO: 8175729 - DNA, 19 bp, Homo sapiens
agacagagctcagtgggtt

SEQ ID NO: 8175730 - DNA, 22 bp, Homo sapiens
agacagagatactatgttgtca

SEQ ID NO: 8175731 - DNA, 19 bp, Homo sapiens
agacagagactgaaataga

SEQ ID NO: 8175732 - DNA, 22 bp, Homo sapiens
agacagagatactatgttgtca

SEQ ID NO: 8175733 - DNA, 22 bp, Homo sapiens
acaaaattatgaagaggccttg

SEQ ID NO: 8175734 - DNA, 22 bp, Homo sapiens
acaaaattgtgttaaactttat

SEQ ID NO: 8175735 - DNA, 22 bp, Homo sapiens
acaaaattgtgttaaactttat

SEQ ID NO: 8175736 - DNA, 22 bp, Homo sapiens
acaaaatttttagacaaggctt

SEQ ID NO: 8175737 - DNA, 22 bp, Homo sapiens
acaaaattacctagttattttc

SEQ ID NO: 8175738 - DNA, 22 bp, Homo sapiens
acaaaattacctagttattttc

SEQ ID NO: 8175739 - DNA, 22 bp, Homo sapiens
acaaaattacctagttattttc

SEQ ID NO: 8175740 - DNA, 22 bp, Homo sapiens
acaaaattacctagttattttc

SEQ ID NO: 8175741 - DNA, 22 bp, Homo sapiens
acaaacatcttgacctcagatt

SEQ ID NO: 8175742 - DNA, 22 bp, Homo sapiens
acaaactaaaattctttattga

SEQ ID NO: 8175743 - DNA, 22 bp, Homo sapiens
acaaactaaaattctttattga

SEQ ID NO: 8175744 - DNA, 22 bp, Homo sapiens
acaaacagagttgaaaaatagg

SEQ ID NO: 8175745 - DNA, 22 bp, Homo sapiens
acaaacagagttgaaaaatagg

SEQ ID NO: 8175746 - DNA, 22 bp, Homo sapiens
acaaacttcccagacaagctcc

SEQ ID NO: 8175747 - DNA, 22 bp, Homo sapiens
acaaacttccatcatgaatttt

SEQ ID NO: 8175748 - DNA, 22 bp, Homo sapiens
acaaactacctacagatgttca

SEQ ID NO: 8175749 - DNA, 22 bp, Homo sapiens
acaaactaaaattctttattga

SEQ ID NO: 8175750 - DNA, 22 bp, Homo sapiens
acaaatatggtactcggagaaa

SEQ ID NO: 8175751 - DNA, 22 bp, Homo sapiens
acaaacttcccagacaagctcc

SEQ ID NO: 8175752 - DNA, 19 bp, Homo sapiens
acaaatagttacatatcct

SEQ ID NO: 8175753 - DNA, 22 bp, Homo sapiens
acaaatgagaatgtagacagag

SEQ ID NO: 8175754 - DNA, 22 bp, Homo sapiens
acaaatgactcaaacaccactt

SEQ ID NO: 8175755 - DNA, 22 bp, Homo sapiens
acaaatgactatttggtacagg

SEQ ID NO: 8175756 - DNA, 22 bp, Homo sapiens
acaaatatggtactcggagaaa

SEQ ID NO: 8175757 - DNA, 19 bp, Homo sapiens
acaaatgatgttgcactga

SEQ ID NO: 8175758 - DNA, 22 bp, Homo sapiens
acaaatgattatcacagaggag

SEQ ID NO: 8175759 - DNA, 22 bp, Homo sapiens
acaaatgagaatgtagacagag

SEQ ID NO: 8175760 - DNA, 22 bp, Homo sapiens
acaaatgagaatgtagacagag

SEQ ID NO: 8175761 - DNA, 22 bp, Homo sapiens
acaaatgcagcataaagtgaac

SEQ ID NO: 8175762 - DNA, 22 bp, Homo sapiens
acaaatgccatatataaattct

SEQ ID NO: 8175763 - DNA, 23 bp, Homo sapiens
acaaatgcccatacatctagttc

SEQ ID NO: 8175764 - DNA, 22 bp, Homo sapiens
acaaatgcttagttcaccaaaa

SEQ ID NO: 8175765 - DNA, 22 bp, Homo sapiens
aattttattaactggatgtagc

SEQ ID NO: 8175766 - DNA, 22 bp, Homo sapiens
aattttattaactggatgtagc

SEQ ID NO: 8175767 - DNA, 22 bp, Homo sapiens
aattttattaactggatgtagc

SEQ ID NO: 8175768 - DNA, 22 bp, Homo sapiens
aattttattaactggatgtagc

SEQ ID NO: 8175769 - DNA, 22 bp, Homo sapiens
aattttatgccttgcacgttgg

SEQ ID NO: 8175770 - DNA, 22 bp, Homo sapiens
aattttatgccttgcacgttgg

SEQ ID NO: 8175771 - DNA, 22 bp, Homo sapiens
aattttatgccttgcacgttgg

SEQ ID NO: 8175772 - DNA, 22 bp, Homo sapiens
aattttatgccttgcacgttgg

SEQ ID NO: 8175773 - DNA, 22 bp, Homo sapiens
aattttattagaaggcaagggg

SEQ ID NO: 8175774 - DNA, 22 bp, Homo sapiens
aattttattagaaggcaagggg

SEQ ID NO: 8175775 - DNA, 22 bp, Homo sapiens
aattttattagaaggcaagggg

SEQ ID NO: 8175776 - DNA, 22 bp, Homo sapiens
aattttattagaaggcaagggg

SEQ ID NO: 8175777 - DNA, 22 bp, Homo sapiens
aattttcacagtgctgtgagat

SEQ ID NO: 8175778 - DNA, 22 bp, Homo sapiens
aattttcacagtgctgtgagat

SEQ ID NO: 8175779 - DNA, 22 bp, Homo sapiens
aattttcacagtgctgtgagat

SEQ ID NO: 8175780 - DNA, 22 bp, Homo sapiens
agagctgggtggtggtgactca

SEQ ID NO: 8175781 - DNA, 22 bp, Homo sapiens
aatttgttaaaagtgagtgaca

SEQ ID NO: 8175782 - DNA, 22 bp, Homo sapiens
aatttgttaaaagtgagtgaca

SEQ ID NO: 8175783 - DNA, 22 bp, Homo sapiens
agagctgggtggtggtgactca

SEQ ID NO: 8175784 - DNA, 22 bp, Homo sapiens
agagctgggtggtggtgactca

SEQ ID NO: 8175785 - DNA, 22 bp, Homo sapiens
agagctgggtggtggtgactca

SEQ ID NO: 8175786 - DNA, 22 bp, Homo sapiens
agagctgggtggacttgtagtt

SEQ ID NO: 8175787 - DNA, 22 bp, Homo sapiens
agagctggggcccgtaaagcca

SEQ ID NO: 8175788 - DNA, 22 bp, Homo sapiens
agagctggggccagagtcaagg

SEQ ID NO: 8175789 - DNA, 22 bp, Homo sapiens
agagctggggccagagtcaagg

SEQ ID NO: 8175790 - DNA, 22 bp, Homo sapiens
agagctggggctctgggtttaa

SEQ ID NO: 8175791 - DNA, 22 bp, Homo sapiens
agagctggggctctgggtttaa

SEQ ID NO: 8175792 - DNA, 22 bp, Homo sapiens
agagctgggtgaagtgccatca

SEQ ID NO: 8175793 - DNA, 22 bp, Homo sapiens
agagctgggtgaagtgccatca

SEQ ID NO: 8175794 - DNA, 22 bp, Homo sapiens
agagctgggtgaagtgccatca

SEQ ID NO: 8175795 - DNA, 22 bp, Homo sapiens
agaggccatgctagaggcctgg

SEQ ID NO: 8175796 - DNA, 22 bp, Homo sapiens
agaggccatgctagaggcctgg

SEQ ID NO: 8175797 - DNA, 22 bp, Homo sapiens
agaggccccaggtgagcatgcc

SEQ ID NO: 8175798 - DNA, 22 bp, Homo sapiens
agaggccccatgggatggcggt

SEQ ID NO: 8175799 - DNA, 21 bp, Homo sapiens
agaggccctcggactgggcgt

SEQ ID NO: 8175800 - DNA, 21 bp, Homo sapiens
agaggccctcggactgggcgt

SEQ ID NO: 8175801 - DNA, 21 bp, Homo sapiens
agaggccctcggactgggcgt

SEQ ID NO: 8175802 - DNA, 20 bp, Homo sapiens
acaaaataggtactgggtag

SEQ ID NO: 8175803 - DNA, 20 bp, Homo sapiens
acaaaataggtactgggtag

SEQ ID NO: 8175804 - DNA, 22 bp, Homo sapiens
acaaaaagggagatgaggtaga

SEQ ID NO: 8175805 - DNA, 22 bp, Homo sapiens
acaaaatagagttctcccctgg

SEQ ID NO: 8175806 - DNA, 22 bp, Homo sapiens
acaaaaagggagatgaggtaga

SEQ ID NO: 8175807 - DNA, 21 bp, Homo sapiens
agaggccctcggactgggcgt

SEQ ID NO: 8175808 - DNA, 22 bp, Homo sapiens
agaggccatgctagaggcctgg

SEQ ID NO: 8175809 - DNA, 22 bp, Homo sapiens
agaggccatgctagaggcctgg

SEQ ID NO: 8175810 - DNA, 20 bp, Homo sapiens
agaggccagttaggagtcta

SEQ ID NO: 8175811 - DNA, 22 bp, Homo sapiens
aattttctgcctagcaaaaact

SEQ ID NO: 8175812 - DNA, 22 bp, Homo sapiens
aattttctgcctagcaaaaact

SEQ ID NO: 8175813 - DNA, 22 bp, Homo sapiens
aattttctgcctagcaaaaact

SEQ ID NO: 8175814 - DNA, 22 bp, Homo sapiens
aattttctgatgatgaagcacg

SEQ ID NO: 8175815 - DNA, 22 bp, Homo sapiens
aattttctgatgatgaagcacg

SEQ ID NO: 8175816 - DNA, 22 bp, Homo sapiens
aattttctgatgatgaagcacg

SEQ ID NO: 8175817 - DNA, 22 bp, Homo sapiens
acaattctctcatatcttatta

SEQ ID NO: 8175818 - DNA, 22 bp, Homo sapiens
agcaagattgaggcttcctcag

SEQ ID NO: 8175819 - DNA, 22 bp, Homo sapiens
acaattctgatggtttcccagt

SEQ ID NO: 8175820 - DNA, 22 bp, Homo sapiens
acaattctgatggtttcccagt

SEQ ID NO: 8175821 - DNA, 22 bp, Homo sapiens
acaattctctcatatcttatta

SEQ ID NO: 8175822 - DNA, 22 bp, Homo sapiens
acaattctctcatatcttatta

SEQ ID NO: 8175823 - DNA, 22 bp, Homo sapiens
acaattctctcatatcttatta

SEQ ID NO: 8175824 - DNA, 22 bp, Homo sapiens
acaattcctgagaatacttgtt

SEQ ID NO: 8175825 - DNA, 22 bp, Homo sapiens
acaattcaagatgagattcagg

SEQ ID NO: 8175826 - DNA, 22 bp, Homo sapiens
acaattcaagatgagattcagg

SEQ ID NO: 8175827 - DNA, 22 bp, Homo sapiens
acaatgcttggtttttctagaa

SEQ ID NO: 8175828 - DNA, 22 bp, Homo sapiens
acaattaccctggcttgataaa

SEQ ID NO: 8175829 - DNA, 22 bp, Homo sapiens
acaattactcaactttgctgct

SEQ ID NO: 8175830 - DNA, 22 bp, Homo sapiens
acaattactcaactttgctgct

SEQ ID NO: 8175831 - DNA, 22 bp, Homo sapiens
acaattagctgtgtgtctatct

SEQ ID NO: 8175832 - DNA, 22 bp, Homo sapiens
acaatgtttttgttcaaagagt

SEQ ID NO: 8175833 - DNA, 22 bp, Homo sapiens
acaatgttttgaaacatctagg

SEQ ID NO: 8175834 - DNA, 22 bp, Homo sapiens
acaatgttttgaaacatctagg

SEQ ID NO: 8175835 - DNA, 22 bp, Homo sapiens
acaatgctgttgagacattctt

SEQ ID NO: 8175836 - DNA, 22 bp, Homo sapiens
acaatgcttggtttttctagaa

SEQ ID NO: 8175837 - DNA, 22 bp, Homo sapiens
acaatgcttggtttttctagaa

SEQ ID NO: 8175838 - DNA, 22 bp, Homo sapiens
agatgggtaactggagtctgct

SEQ ID NO: 8175839 - DNA, 22 bp, Homo sapiens
acaatgctgttgagacattctt

SEQ ID NO: 8175840 - DNA, 22 bp, Homo sapiens
agatggggtttcatcatgttgg

SEQ ID NO: 8175841 - DNA, 22 bp, Homo sapiens
agatggggctgaaagttccaat

SEQ ID NO: 8175842 - DNA, 22 bp, Homo sapiens
agatggggctcagtgtggaggc

SEQ ID NO: 8175843 - DNA, 22 bp, Homo sapiens
agatggggctcagtgtggaggc

SEQ ID NO: 8175844 - DNA, 22 bp, Homo sapiens
agatggggctcagtgtggaggc

SEQ ID NO: 8175845 - DNA, 22 bp, Homo sapiens
agcaaggcagtcagctggctgg

SEQ ID NO: 8175846 - DNA, 22 bp, Homo sapiens
agcacaggtacggagatgctac

SEQ ID NO: 8175847 - DNA, 21 bp, Homo sapiens
agcaaggcagcctctcagcct

SEQ ID NO: 8175848 - DNA, 22 bp, Homo sapiens
agcaccatcacagctgtatgtc

SEQ ID NO: 8175849 - DNA, 22 bp, Homo sapiens
agcacaggtacggagatgctac

SEQ ID NO: 8175850 - DNA, 22 bp, Homo sapiens
agcaagcagaaatgccatggca

SEQ ID NO: 8175851 - DNA, 22 bp, Homo sapiens
agcaagattgaggcttcctcag

SEQ ID NO: 8175852 - DNA, 22 bp, Homo sapiens
agcaagatttaaacccaggtca

SEQ ID NO: 8175853 - DNA, 22 bp, Homo sapiens
agcaagctcttggaaatgagct

SEQ ID NO: 8175854 - DNA, 22 bp, Homo sapiens
agcaagctggaggggctcatga

SEQ ID NO: 8175855 - DNA, 22 bp, Homo sapiens
agcaaggaaactatggagagat

SEQ ID NO: 8175856 - DNA, 22 bp, Homo sapiens
agcaagcaggatggtcaaacta

SEQ ID NO: 8175857 - DNA, 22 bp, Homo sapiens
agcaagctacctagatagtcta

SEQ ID NO: 8175858 - DNA, 22 bp, Homo sapiens
agatggggcagaatggagccat

SEQ ID NO: 8175859 - DNA, 22 bp, Homo sapiens
agatggggctcagtgtggaggc

SEQ ID NO: 8175860 - DNA, 19 bp, Homo sapiens
agatggggaagagtgtgag

SEQ ID NO: 8175861 - DNA, 22 bp, Homo sapiens
acaagttaccaaaaaagattca

SEQ ID NO: 8175862 - DNA, 22 bp, Homo sapiens
acaagtttatttgattagaaca

SEQ ID NO: 8175863 - DNA, 19 bp, Homo sapiens
agatggggaagagtgtgag

SEQ ID NO: 8175864 - DNA, 22 bp, Homo sapiens
acaagtttcattgtttagaacc

SEQ ID NO: 8175865 - DNA, 22 bp, Homo sapiens
acaaggttctatggcgtctgtg

SEQ ID NO: 8175866 - DNA, 22 bp, Homo sapiens
acaaggttggctctttctttgt

SEQ ID NO: 8175867 - DNA, 22 bp, Homo sapiens
acaaggttgattctggcatctg

SEQ ID NO: 8175868 - DNA, 22 bp, Homo sapiens
acaaggttgttctgaggattta

SEQ ID NO: 8175869 - DNA, 22 bp, Homo sapiens
acaaggttcttgtggaggaatt

SEQ ID NO: 8175870 - DNA, 22 bp, Homo sapiens
acaaggttcttagagctgggat

SEQ ID NO: 8175871 - DNA, 22 bp, Homo sapiens
acaagtatttaaggttagtata

SEQ ID NO: 8175872 - DNA, 22 bp, Homo sapiens
acaagtcactctatcattttca

SEQ ID NO: 8175873 - DNA, 22 bp, Homo sapiens
acaaggtttggtcctatatttt

SEQ ID NO: 8175874 - DNA, 22 bp, Homo sapiens
acaaggtttggtaccacatcca

SEQ ID NO: 8175875 - DNA, 22 bp, Homo sapiens
acaaggtttaaatagccatcag

SEQ ID NO: 8175876 - DNA, 22 bp, Homo sapiens
acaagtgttgcattttgccatt

SEQ ID NO: 8175877 - DNA, 22 bp, Homo sapiens
acaagtgttgcattttgccatt

SEQ ID NO: 8175878 - DNA, 22 bp, Homo sapiens
acaagtgggtcctacataaagc

SEQ ID NO: 8175879 - DNA, 22 bp, Homo sapiens
acaagtggctacctagattata

SEQ ID NO: 8175880 - DNA, 22 bp, Homo sapiens
acaagtgggtcctacataaagc

SEQ ID NO: 8175881 - DNA, 22 bp, Homo sapiens
acaagtgtgtgcagtttgtaaa

SEQ ID NO: 8175882 - DNA, 22 bp, Homo sapiens
acaagtgtgtgcagtttgtaaa

SEQ ID NO: 8175883 - DNA, 19 bp, Homo sapiens
acaagtcacttacttagta

SEQ ID NO: 8175884 - DNA, 22 bp, Homo sapiens
acaagtctttttcatgtcttct

SEQ ID NO: 8175885 - DNA, 22 bp, Homo sapiens
acaagtctttttcatgtcttct

SEQ ID NO: 8175886 - DNA, 22 bp, Homo sapiens
acaagtctttttcatgtcttct

SEQ ID NO: 8175887 - DNA, 22 bp, Homo sapiens
acaagtgcatggaatcagctgt

SEQ ID NO: 8175888 - DNA, 22 bp, Homo sapiens
acaaatgtggacatggataatg

SEQ ID NO: 8175889 - DNA, 22 bp, Homo sapiens
acaaatgtgattgtttctgaaa

SEQ ID NO: 8175890 - DNA, 22 bp, Homo sapiens
acaaatgtgattgtttctgaaa

SEQ ID NO: 8175891 - DNA, 22 bp, Homo sapiens
acaaatgtctcctcttttgtta

SEQ ID NO: 8175892 - DNA, 22 bp, Homo sapiens
acaaatgtggacatggataatg

SEQ ID NO: 8175893 - DNA, 22 bp, Homo sapiens
acaaatgtggacatggataatg

SEQ ID NO: 8175894 - DNA, 22 bp, Homo sapiens
acaaatgtggacatggataatg

SEQ ID NO: 8175895 - DNA, 22 bp, Homo sapiens
acaaatgtgtctaattgtgcct

SEQ ID NO: 8175896 - DNA, 18 bp, Homo sapiens
acaaatgtgtcacaggaa

SEQ ID NO: 8175897 - DNA, 22 bp, Homo sapiens
acaaatggagaaactgaggccc

SEQ ID NO: 8175898 - DNA, 22 bp, Homo sapiens
acaaatgtctacattgagaata

SEQ ID NO: 8175899 - DNA, 22 bp, Homo sapiens
acaaatgtctacattgagaata

SEQ ID NO: 8175900 - DNA, 22 bp, Homo sapiens
acaaatgtctacattgagaata

SEQ ID NO: 8175901 - DNA, 22 bp, Homo sapiens
acaaatgtctacattgagaata

SEQ ID NO: 8175902 - DNA, 22 bp, Homo sapiens
acaaatgtgtctaattgtgcct

SEQ ID NO: 8175903 - DNA, 22 bp, Homo sapiens
acaaatgttacataagtttgga

SEQ ID NO: 8175904 - DNA, 22 bp, Homo sapiens
acaaatgttggatttgtcttcc

SEQ ID NO: 8175905 - DNA, 22 bp, Homo sapiens
acaaggaacaagcatgtagttt

SEQ ID NO: 8175906 - DNA, 22 bp, Homo sapiens
acaagctttgtgatagtagaga

SEQ ID NO: 8175907 - DNA, 22 bp, Homo sapiens
acaaattctttctgcctattgg

SEQ ID NO: 8175908 - DNA, 22 bp, Homo sapiens
acaaattgaccgcaagattcat

SEQ ID NO: 8175909 - DNA, 22 bp, Homo sapiens
acaaattgaccgcaagattcat

SEQ ID NO: 8175910 - DNA, 22 bp, Homo sapiens
acaagctttgtgatagtagaga

SEQ ID NO: 8175911 - DNA, 22 bp, Homo sapiens
accatgtcatttattggccaaa

SEQ ID NO: 8175912 - DNA, 22 bp, Homo sapiens
accatgttggccaagctggtct

SEQ ID NO: 8175913 - DNA, 22 bp, Homo sapiens
accatgacgtcacagaggcttc

SEQ ID NO: 8175914 - DNA, 22 bp, Homo sapiens
accatgcaggctattttcaaat

SEQ ID NO: 8175915 - DNA, 22 bp, Homo sapiens
accatgccagtggcagccagac

SEQ ID NO: 8175916 - DNA, 22 bp, Homo sapiens
accatgggtcagccacctcagc

SEQ ID NO: 8175917 - DNA, 22 bp, Homo sapiens
aaggtggtaggctatatcagta

SEQ ID NO: 8175918 - DNA, 22 bp, Homo sapiens
accatccaaactgctttctgtg

SEQ ID NO: 8175919 - DNA, 22 bp, Homo sapiens
aaggtgggtggatcacgaggtc

SEQ ID NO: 8175920 - DNA, 22 bp, Homo sapiens
aaggtgggtggatcacgaggtc

SEQ ID NO: 8175921 - DNA, 22 bp, Homo sapiens
aaggtggtaatagtgcaggatt

SEQ ID NO: 8175922 - DNA, 22 bp, Homo sapiens
aaggtggtaggctatatcagta

SEQ ID NO: 8175923 - DNA, 22 bp, Homo sapiens
aaggtggtaatagtgcaggatt

SEQ ID NO: 8175924 - DNA, 22 bp, Homo sapiens
aaggtggcatgtcccctggcca

SEQ ID NO: 8175925 - DNA, 22 bp, Homo sapiens
aaggtggcgctggagctggtcc

SEQ ID NO: 8175926 - DNA, 22 bp, Homo sapiens
aaggtggccctgagcatgacaa

SEQ ID NO: 8175927 - DNA, 22 bp, Homo sapiens
aaggtgaactggtaatgacaga

SEQ ID NO: 8175928 - DNA, 22 bp, Homo sapiens
aaggtgaaactggaagctggcc

SEQ ID NO: 8175929 - DNA, 22 bp, Homo sapiens
aaggtgaactggtaatgacaga

SEQ ID NO: 8175930 - DNA, 22 bp, Homo sapiens
aaggtctgttgagtgaatagta

SEQ ID NO: 8175931 - DNA, 22 bp, Homo sapiens
aaggtctgttctaggtgagggt

SEQ ID NO: 8175932 - DNA, 22 bp, Homo sapiens
aaggtgccacagttcttttagc

SEQ ID NO: 8175933 - DNA, 22 bp, Homo sapiens
aaggtgccagcccctccactga

SEQ ID NO: 8175934 - DNA, 22 bp, Homo sapiens
aaggtgccacttccctcagact

SEQ ID NO: 8175935 - DNA, 22 bp, Homo sapiens
aaggtggaggttgcagtgagct

SEQ ID NO: 8175936 - DNA, 22 bp, Homo sapiens
aaggtgctcgttatggccagtg

SEQ ID NO: 8175937 - DNA, 22 bp, Homo sapiens
aaggtgccatattttggaatag

SEQ ID NO: 8175938 - DNA, 22 bp, Homo sapiens
aaggtgcctggctttgccttct

SEQ ID NO: 8175939 - DNA, 22 bp, Homo sapiens
aaggtgccccctcctgaacctt

SEQ ID NO: 8175940 - DNA, 22 bp, Homo sapiens
aaggtgcctgtctgcaaacctg

SEQ ID NO: 8175941 - DNA, 22 bp, Homo sapiens
aaggtgctcacgggctcaggga

SEQ ID NO: 8175942 - DNA, 22 bp, Homo sapiens
aagggctgaatgaagggttgaa

SEQ ID NO: 8175943 - DNA, 22 bp, Homo sapiens
aagggctgaatgaagggttgaa

SEQ ID NO: 8175944 - DNA, 22 bp, Homo sapiens
aagggctgaatgaagggttgaa

SEQ ID NO: 8175945 - DNA, 22 bp, Homo sapiens
aagggctgaatgaagggttgaa

SEQ ID NO: 8175946 - DNA, 22 bp, Homo sapiens
aagggctgaaagaccttgggca

SEQ ID NO: 8175947 - DNA, 22 bp, Homo sapiens
aagggctgaaagaccttgggca

SEQ ID NO: 8175948 - DNA, 22 bp, Homo sapiens
aagggctcttctatttatggcc

SEQ ID NO: 8175949 - DNA, 22 bp, Homo sapiens
aagggctgagaagtggggctgg

SEQ ID NO: 8175950 - DNA, 22 bp, Homo sapiens
aagggctgagaagtggggctgg

SEQ ID NO: 8175951 - DNA, 22 bp, Homo sapiens
aagggctgagaagtggggctgg

SEQ ID NO: 8175952 - DNA, 22 bp, Homo sapiens
aagggctgaatgaagggttgaa

SEQ ID NO: 8175953 - DNA, 22 bp, Homo sapiens
aagggctgagcacagtgagcca

SEQ ID NO: 8175954 - DNA, 22 bp, Homo sapiens
aagggctgagcacagtgagcca

SEQ ID NO: 8175955 - DNA, 22 bp, Homo sapiens
aagggctgagcacagtgagcca

SEQ ID NO: 8175956 - DNA, 22 bp, Homo sapiens
aagggctgagcacagtgagcca

SEQ ID NO: 8175957 - DNA, 22 bp, Homo sapiens
aagggctgagcacagtgagcca

SEQ ID NO: 8175958 - DNA, 22 bp, Homo sapiens
aaggtagcttgcttcctgagta

SEQ ID NO: 8175959 - DNA, 22 bp, Homo sapiens
aaggtagatgttgtcatgccca

SEQ ID NO: 8175960 - DNA, 22 bp, Homo sapiens
aagggctgatctcactttcttt

SEQ ID NO: 8175961 - DNA, 22 bp, Homo sapiens
aagggctgatctcactttcttt

SEQ ID NO: 8175962 - DNA, 22 bp, Homo sapiens
aagtacatgttgctcaacagcc

SEQ ID NO: 8175963 - DNA, 22 bp, Homo sapiens
aagtacatggaggatagctgct

SEQ ID NO: 8175964 - DNA, 22 bp, Homo sapiens
aagtacattatatgagcagaat

SEQ ID NO: 8175965 - DNA, 22 bp, Homo sapiens
aagtacatggaggatagctgct

SEQ ID NO: 8175966 - DNA, 22 bp, Homo sapiens
aagtacatggaggatagctgct

SEQ ID NO: 8175967 - DNA, 22 bp, Homo sapiens
aagtacatgctgtaatgattgg

SEQ ID NO: 8175968 - DNA, 22 bp, Homo sapiens
aagtacatgctttattcagagt

SEQ ID NO: 8175969 - DNA, 23 bp, Homo sapiens
aagtacatatatttagatagtga

SEQ ID NO: 8175970 - DNA, 22 bp, Homo sapiens
aagtacataaaggaattagcca

SEQ ID NO: 8175971 - DNA, 22 bp, Homo sapiens
aagtacatcaaatgtttggcta

SEQ ID NO: 8175972 - DNA, 22 bp, Homo sapiens
aagtacatcctagtctctttca

SEQ ID NO: 8175973 - DNA, 22 bp, Homo sapiens
aagtacatatatttatgattct

SEQ ID NO: 8175974 - DNA, 22 bp, Homo sapiens
aagtacttctagatggataatc

SEQ ID NO: 8175975 - DNA, 22 bp, Homo sapiens
aagtacatttttaacttacagc

SEQ ID NO: 8175976 - DNA, 22 bp, Homo sapiens
aagtacatttttaacttacagc

SEQ ID NO: 8175977 - DNA, 22 bp, Homo sapiens
accccaggtccaggttacagag

SEQ ID NO: 8175978 - DNA, 22 bp, Homo sapiens
accccaggtccaggttacagag

SEQ ID NO: 8175979 - DNA, 22 bp, Homo sapiens
accccaggtctccaggctctgg

SEQ ID NO: 8175980 - DNA, 22 bp, Homo sapiens
accccaggtctccaggctctgg

SEQ ID NO: 8175981 - DNA, 22 bp, Homo sapiens
accccagggctgccagcctcct

SEQ ID NO: 8175982 - DNA, 22 bp, Homo sapiens
accccagggctgccagcctcct

SEQ ID NO: 8175983 - DNA, 22 bp, Homo sapiens
accccaggtcatctgagagtcc

SEQ ID NO: 8175984 - DNA, 22 bp, Homo sapiens
accccagggctgccagcctcct

SEQ ID NO: 8175985 - DNA, 23 bp, Homo sapiens
accccaggcatcgcattcctctt

SEQ ID NO: 8175986 - DNA, 23 bp, Homo sapiens
accccaggcatcgcattcctctt

SEQ ID NO: 8175987 - DNA, 22 bp, Homo sapiens
aagtcacacagttaacatgagg

SEQ ID NO: 8175988 - DNA, 22 bp, Homo sapiens
aagtcacaagcatatatgcatt

SEQ ID NO: 8175989 - DNA, 22 bp, Homo sapiens
aagtcacaaagtgctgtacatg

SEQ ID NO: 8175990 - DNA, 22 bp, Homo sapiens
acccccttcgcacactctttca

SEQ ID NO: 8175991 - DNA, 22 bp, Homo sapiens
acatgtgtgacaacagaggtga

SEQ ID NO: 8175992 - DNA, 22 bp, Homo sapiens
acatgtgtggacatgaatctac

SEQ ID NO: 8175993 - DNA, 22 bp, Homo sapiens
acatgtgtggacatgaatctac

SEQ ID NO: 8175994 - DNA, 22 bp, Homo sapiens
acatgtgtggccgctgtagaca

SEQ ID NO: 8175995 - DNA, 22 bp, Homo sapiens
acatgtgtggacatgaatctac

SEQ ID NO: 8175996 - DNA, 22 bp, Homo sapiens
acatgtgtgacaacagaggtga

SEQ ID NO: 8175997 - DNA, 22 bp, Homo sapiens
acatgtgtctaagaatgaaaga

SEQ ID NO: 8175998 - DNA, 22 bp, Homo sapiens
acatgtgtatagcctgtataga

SEQ ID NO: 8175999 - DNA, 22 bp, Homo sapiens
acatgtgtgacaacagaggtga

SEQ ID NO: 8176000 - DNA, 22 bp, Homo sapiens
acatgtgtctaagaatgaaaga

SEQ ID NO: 8176001 - DNA, 22 bp, Homo sapiens
acatgtgtatagcctgtataga

SEQ ID NO: 8176002 - DNA, 22 bp, Homo sapiens
acatgtgtatagcctgtataga

SEQ ID NO: 8176003 - DNA, 22 bp, Homo sapiens
acatgtgtacttttaaggatgt

SEQ ID NO: 8176004 - DNA, 22 bp, Homo sapiens
acatgtgtacttttaaggatgt

SEQ ID NO: 8176005 - DNA, 22 bp, Homo sapiens
aaggctggtttccttgatgttt

SEQ ID NO: 8176006 - DNA, 22 bp, Homo sapiens
aaggctggggtgcagacggcct

SEQ ID NO: 8176007 - DNA, 22 bp, Homo sapiens
aaggctgggaaacatgcaggcc

SEQ ID NO: 8176008 - DNA, 22 bp, Homo sapiens
aaggctgggaaacatgcaggcc

SEQ ID NO: 8176009 - DNA, 22 bp, Homo sapiens
acatgtgtgtatacgtatttat

SEQ ID NO: 8176010 - DNA, 22 bp, Homo sapiens
acatgtgtggccgctgtagaca

SEQ ID NO: 8176011 - DNA, 22 bp, Homo sapiens
acatgtgtggccgctgtagaca

SEQ ID NO: 8176012 - DNA, 22 bp, Homo sapiens
aaggctgtgtcagaagctccct

SEQ ID NO: 8176013 - DNA, 22 bp, Homo sapiens
aaggctttatgtgaccaaaaga

SEQ ID NO: 8176014 - DNA, 22 bp, Homo sapiens
aaggcttgtgtgttcagtgagg

SEQ ID NO: 8176015 - DNA, 22 bp, Homo sapiens
aaggcttgtagatttgggcttt

SEQ ID NO: 8176016 - DNA, 19 bp, Homo sapiens
aaggcttggctgagctggg

SEQ ID NO: 8176017 - DNA, 19 bp, Homo sapiens
aaggcttggctgagctggg

SEQ ID NO: 8176018 - DNA, 22 bp, Homo sapiens
aaggcttggagtaagcttggct

SEQ ID NO: 8176019 - DNA, 22 bp, Homo sapiens
aaggcatggcagggtttacaca

SEQ ID NO: 8176020 - DNA, 22 bp, Homo sapiens
aaggctcttgagtggtgatagt

SEQ ID NO: 8176021 - DNA, 22 bp, Homo sapiens
aaggcatgatgtaatcaatgat

SEQ ID NO: 8176022 - DNA, 22 bp, Homo sapiens
aaggcatatgctgtgtacagtt

SEQ ID NO: 8176023 - DNA, 22 bp, Homo sapiens
aaggcataggacaaatcagtga

SEQ ID NO: 8176024 - DNA, 22 bp, Homo sapiens
aaggctgaggagggcctgcagg

SEQ ID NO: 8176025 - DNA, 22 bp, Homo sapiens
aaggctgaggagggcctgcagg

SEQ ID NO: 8176026 - DNA, 22 bp, Homo sapiens
aaggctgaggctggagaattac

SEQ ID NO: 8176027 - DNA, 22 bp, Homo sapiens
aaggctgaggcagtgaggcaga

SEQ ID NO: 8176028 - DNA, 22 bp, Homo sapiens
aaggctgaggcagtgaggcaga

SEQ ID NO: 8176029 - DNA, 22 bp, Homo sapiens
aaggctgaggagggcctgcagg

SEQ ID NO: 8176030 - DNA, 22 bp, Homo sapiens
aaggctgaggcagtgaggcaga

SEQ ID NO: 8176031 - DNA, 22 bp, Homo sapiens
aaggctgcttttaacatgcata

SEQ ID NO: 8176032 - DNA, 22 bp, Homo sapiens
acatgtgtacatatatatgtgc

SEQ ID NO: 8176033 - DNA, 22 bp, Homo sapiens
acatgtgtaaggtctctcagtc

SEQ ID NO: 8176034 - DNA, 22 bp, Homo sapiens
acatgtgtacatatatatgtgc

SEQ ID NO: 8176035 - DNA, 22 bp, Homo sapiens
acatgtgtacttttaaggatgt

SEQ ID NO: 8176036 - DNA, 22 bp, Homo sapiens
acatgtgtacatatatatgtgc

SEQ ID NO: 8176037 - DNA, 22 bp, Homo sapiens
acatgtgtacatatatatgtgc

SEQ ID NO: 8176038 - DNA, 22 bp, Homo sapiens
aaggctgcctctgccagaggag

SEQ ID NO: 8176039 - DNA, 22 bp, Homo sapiens
aaggctgcctctgccagaggag

SEQ ID NO: 8176040 - DNA, 22 bp, Homo sapiens
aaggctgattagactgatagct

SEQ ID NO: 8176041 - DNA, 16 bp, Homo sapiens
aaggctgattttccct

SEQ ID NO: 8176042 - DNA, 16 bp, Homo sapiens
aaggctgattttccct

SEQ ID NO: 8176043 - DNA, 22 bp, Homo sapiens
aaggctgagggctgtacctggc

SEQ ID NO: 8176044 - DNA, 22 bp, Homo sapiens
aaggctgagggctgtacctggc

SEQ ID NO: 8176045 - DNA, 22 bp, Homo sapiens
aaggctgagggctgtacctggc

SEQ ID NO: 8176046 - DNA, 22 bp, Homo sapiens
aaggctgaggtagggcctaaaa

SEQ ID NO: 8176047 - DNA, 22 bp, Homo sapiens
aaggctgagtaaaacagagaac

SEQ ID NO: 8176048 - DNA, 22 bp, Homo sapiens
aaggctgagtaaaacagagaac

SEQ ID NO: 8176049 - DNA, 22 bp, Homo sapiens
aaggctgattagactgatagct

SEQ ID NO: 8176050 - DNA, 22 bp, Homo sapiens
aagggcaggaaaagatggatgt

SEQ ID NO: 8176051 - DNA, 22 bp, Homo sapiens
aagggcaggaaaagatggatgt

SEQ ID NO: 8176052 - DNA, 22 bp, Homo sapiens
aagggagaaaacttgtggctta

SEQ ID NO: 8176053 - DNA, 22 bp, Homo sapiens
aagggagaaaacttgtggctta

SEQ ID NO: 8176054 - DNA, 22 bp, Homo sapiens
aagggacatagactgtacatct

SEQ ID NO: 8176055 - DNA, 22 bp, Homo sapiens
aagggaaatggccaggcagaga

SEQ ID NO: 8176056 - DNA, 22 bp, Homo sapiens
aagggaaactttcacaatgtcc

SEQ ID NO: 8176057 - DNA, 22 bp, Homo sapiens
aagggaaatcatatggtgcagt

SEQ ID NO: 8176058 - DNA, 22 bp, Homo sapiens
aagggaaaatagttgatgacca

SEQ ID NO: 8176059 - DNA, 22 bp, Homo sapiens
aaggctttgaaaaccaaaaggt

SEQ ID NO: 8176060 - DNA, 22 bp, Homo sapiens
aagggcatgggatgaaaagtag

SEQ ID NO: 8176061 - DNA, 22 bp, Homo sapiens
aagggccattgctgagagcagt

SEQ ID NO: 8176062 - DNA, 22 bp, Homo sapiens
aagggccattgctgagagcagt

SEQ ID NO: 8176063 - DNA, 22 bp, Homo sapiens
aagggccatcccagaacagaaa

SEQ ID NO: 8176064 - DNA, 22 bp, Homo sapiens
aagggccataacttgcagtgtt

SEQ ID NO: 8176065 - DNA, 22 bp, Homo sapiens
aagggcctcctggggagcctgg

SEQ ID NO: 8176066 - DNA, 19 bp, Homo sapiens
aagggcctctgctgtcttc

SEQ ID NO: 8176067 - DNA, 22 bp, Homo sapiens
aagggcctcctggggagcctgg

SEQ ID NO: 8176068 - DNA, 22 bp, Homo sapiens
aagggccttgccaggtgaagag

SEQ ID NO: 8176069 - DNA, 22 bp, Homo sapiens
aagggccttcactgtctaagca

SEQ ID NO: 8176070 - DNA, 22 bp, Homo sapiens
aagggccttgccaggtgaagag

SEQ ID NO: 8176071 - DNA, 22 bp, Homo sapiens
aagggctagctgcatatatatt

SEQ ID NO: 8176072 - DNA, 22 bp, Homo sapiens
aagggcctttcaaaggtgatta

SEQ ID NO: 8176073 - DNA, 22 bp, Homo sapiens
aagggctgaaagaccttgggca

SEQ ID NO: 8176074 - DNA, 22 bp, Homo sapiens
aagggctctgtgcttgtcccat

SEQ ID NO: 8176075 - DNA, 22 bp, Homo sapiens
aaggaaatagatgcagatggta

SEQ ID NO: 8176076 - DNA, 22 bp, Homo sapiens
aaggaaatacttctgcagagca

SEQ ID NO: 8176077 - DNA, 22 bp, Homo sapiens
aaggaaaggatgagcatgcatt

SEQ ID NO: 8176078 - DNA, 22 bp, Homo sapiens
aaggaaagattctctctctaga

SEQ ID NO: 8176079 - DNA, 22 bp, Homo sapiens
aaggaaagagtatgcaccttgt

SEQ ID NO: 8176080 - DNA, 22 bp, Homo sapiens
aaggaaagctgtggttctgaga

SEQ ID NO: 8176081 - DNA, 22 bp, Homo sapiens
aaggaaaggatgagcatgcatt

SEQ ID NO: 8176082 - DNA, 22 bp, Homo sapiens
aaggaaagctgtggttctgaga

SEQ ID NO: 8176083 - DNA, 22 bp, Homo sapiens
aaggaaagacatataaatgact

SEQ ID NO: 8176084 - DNA, 22 bp, Homo sapiens
aagctttaagtgtcagtcagcc

SEQ ID NO: 8176085 - DNA, 22 bp, Homo sapiens
aagctttaaggaattttatgga

SEQ ID NO: 8176086 - DNA, 22 bp, Homo sapiens
acaggccagaggtggggcagcc

SEQ ID NO: 8176087 - DNA, 22 bp, Homo sapiens
acaggccacagtggagtctctg

SEQ ID NO: 8176088 - DNA, 22 bp, Homo sapiens
acaggccacagtggagtctctg

SEQ ID NO: 8176089 - DNA, 22 bp, Homo sapiens
acaggccacagtggagtctctg

SEQ ID NO: 8176090 - DNA, 22 bp, Homo sapiens
acaggcagttgaggtttgtgtg

SEQ ID NO: 8176091 - DNA, 22 bp, Homo sapiens
acagggcttagaaatctgttgc

SEQ ID NO: 8176092 - DNA, 22 bp, Homo sapiens
acagggcttagaacttggcctc

SEQ ID NO: 8176093 - DNA, 22 bp, Homo sapiens
acagggcttagaacttggcctc

SEQ ID NO: 8176094 - DNA, 23 bp, Homo sapiens
acagggctgtccagggctaggtc

SEQ ID NO: 8176095 - DNA, 23 bp, Homo sapiens
acagggctgtccagggctaggtc

SEQ ID NO: 8176096 - DNA, 22 bp, Homo sapiens
acaggtgttgaatgatgtcaca

SEQ ID NO: 8176097 - DNA, 22 bp, Homo sapiens
acaggtgtgttcccggaaagcc

SEQ ID NO: 8176098 - DNA, 22 bp, Homo sapiens
acaggtgtgttcccggaaagcc

SEQ ID NO: 8176099 - DNA, 22 bp, Homo sapiens
acaggtgtggggctgtggtact

SEQ ID NO: 8176100 - DNA, 22 bp, Homo sapiens
acagtactaagtgctcacatga

SEQ ID NO: 8176101 - DNA, 22 bp, Homo sapiens
acagtacctgctctcaagcaaa

SEQ ID NO: 8176102 - DNA, 22 bp, Homo sapiens
acagtacatagatctctaccct

SEQ ID NO: 8176103 - DNA, 22 bp, Homo sapiens
acagtacagctgaaactttagt

SEQ ID NO: 8176104 - DNA, 22 bp, Homo sapiens
acagtacaggacgagttttcct

SEQ ID NO: 8176105 - DNA, 22 bp, Homo sapiens
acagtacagtgcagaggaagat

SEQ ID NO: 8176106 - DNA, 23 bp, Homo sapiens
acagggctggcagctgcaagacc

SEQ ID NO: 8176107 - DNA, 23 bp, Homo sapiens
acagggctggcagctgcaagacc

SEQ ID NO: 8176108 - DNA, 22 bp, Homo sapiens
acagggctgaggctggcttctt

SEQ ID NO: 8176109 - DNA, 22 bp, Homo sapiens
acagggctgaggctggcttctt

SEQ ID NO: 8176110 - DNA, 22 bp, Homo sapiens
acagggctggcgttgggacaga

SEQ ID NO: 8176111 - DNA, 22 bp, Homo sapiens
acagggctggggaaagaggcta

SEQ ID NO: 8176112 - DNA, 22 bp, Homo sapiens
acagggctggcgttgggacaga

SEQ ID NO: 8176113 - DNA, 22 bp, Homo sapiens
acagggctggggcacttggctg

SEQ ID NO: 8176114 - DNA, 22 bp, Homo sapiens
acagggctggggcacttggctg

SEQ ID NO: 8176115 - DNA, 22 bp, Homo sapiens
acagggctggggaaagaggcta

SEQ ID NO: 8176116 - DNA, 22 bp, Homo sapiens
acagggctggggaaagaggcta

SEQ ID NO: 8176117 - DNA, 22 bp, Homo sapiens
acagggctccttgggctgacac

SEQ ID NO: 8176118 - DNA, 19 bp, Homo sapiens
acagggctctggacgccat

SEQ ID NO: 8176119 - DNA, 22 bp, Homo sapiens
acagggctctgacaccaaggta

SEQ ID NO: 8176120 - DNA, 22 bp, Homo sapiens
acagggctcgtcgggccctcgg

SEQ ID NO: 8176121 - DNA, 22 bp, Homo sapiens
acagggctcgtcgggccctcgg

SEQ ID NO: 8176122 - DNA, 22 bp, Homo sapiens
acagggctccttgggctgacac

SEQ ID NO: 8176123 - DNA, 22 bp, Homo sapiens
acagggctcctaggtggtgtgc

SEQ ID NO: 8176124 - DNA, 22 bp, Homo sapiens
acagggctcccagcaggtctgt

SEQ ID NO: 8176125 - DNA, 22 bp, Homo sapiens
acaggcagtgatttcctctggt

SEQ ID NO: 8176126 - DNA, 22 bp, Homo sapiens
acaggcagtgatttcctctggt

SEQ ID NO: 8176127 - DNA, 22 bp, Homo sapiens
acaggcaggttgagaaacattt

SEQ ID NO: 8176128 - DNA, 22 bp, Homo sapiens
acaggcaggttgagaaacattt

SEQ ID NO: 8176129 - DNA, 22 bp, Homo sapiens
acaggcaggttgagaaacattt

SEQ ID NO: 8176130 - DNA, 22 bp, Homo sapiens
acaggcagtgatttcctctggt

SEQ ID NO: 8176131 - DNA, 22 bp, Homo sapiens
acaggcagtgggccagatttgt

SEQ ID NO: 8176132 - DNA, 22 bp, Homo sapiens
acaggcagtgatttcctctggt

SEQ ID NO: 8176133 - DNA, 22 bp, Homo sapiens
acaggcagtgatttcctctggt

SEQ ID NO: 8176134 - DNA, 22 bp, Homo sapiens
aagctgcccaagactgaagcat

SEQ ID NO: 8176135 - DNA, 22 bp, Homo sapiens
aagctgccatagaacgagaggt

SEQ ID NO: 8176136 - DNA, 23 bp, Homo sapiens
aagctgccagtctgaagcctggg

SEQ ID NO: 8176137 - DNA, 22 bp, Homo sapiens
acaggcaggtcctgtcccagct

SEQ ID NO: 8176138 - DNA, 22 bp, Homo sapiens
acaggcaggtcctgtcccagct

SEQ ID NO: 8176139 - DNA, 18 bp, Homo sapiens
aagctgccctcaggcagg

SEQ ID NO: 8176140 - DNA, 22 bp, Homo sapiens
acaggcaggtcctgtcccagct

SEQ ID NO: 8176141 - DNA, 22 bp, Homo sapiens
aagctgccagctgagctgaggc

SEQ ID NO: 8176142 - DNA, 22 bp, Homo sapiens
aagctgccagctgagctgaggc

SEQ ID NO: 8176143 - DNA, 22 bp, Homo sapiens
aagctgccagattcagtctgct

SEQ ID NO: 8176144 - DNA, 22 bp, Homo sapiens
aagctgccaatggtaagctgct

SEQ ID NO: 8176145 - DNA, 22 bp, Homo sapiens
aagctgccaccagcccagggca

SEQ ID NO: 8176146 - DNA, 22 bp, Homo sapiens
aagctgccacacggtgagtact

SEQ ID NO: 8176147 - DNA, 22 bp, Homo sapiens
aagctgcaggttgaatccaggt

SEQ ID NO: 8176148 - DNA, 22 bp, Homo sapiens
aagctgcatgaagttgagtaga

SEQ ID NO: 8176149 - DNA, 22 bp, Homo sapiens
aagctgcagcacagagaggtgg

SEQ ID NO: 8176150 - DNA, 22 bp, Homo sapiens
aagctgcagatgtgcctgtgga

SEQ ID NO: 8176151 - DNA, 22 bp, Homo sapiens
aagctgcagatgtgcctgtgga

SEQ ID NO: 8176152 - DNA, 22 bp, Homo sapiens
aagctgcagaccccctgtctca

SEQ ID NO: 8176153 - DNA, 22 bp, Homo sapiens
aagctgcagatgtgcctgtgga

SEQ ID NO: 8176154 - DNA, 22 bp, Homo sapiens
aagctgcagaccccctgtctca

SEQ ID NO: 8176155 - DNA, 22 bp, Homo sapiens
aagctgcagaccccctgtctca

SEQ ID NO: 8176156 - DNA, 22 bp, Homo sapiens
aagctgcactacttgagggacc

SEQ ID NO: 8176157 - DNA, 22 bp, Homo sapiens
aagccaggctgcacttgctggg

SEQ ID NO: 8176158 - DNA, 22 bp, Homo sapiens
aagccaggccattctctggttc

SEQ ID NO: 8176159 - DNA, 22 bp, Homo sapiens
aagccagggattcctgagggag

SEQ ID NO: 8176160 - DNA, 22 bp, Homo sapiens
aagccagggatggaatgatagg

SEQ ID NO: 8176161 - DNA, 22 bp, Homo sapiens
aagccagggattcctgagggag

SEQ ID NO: 8176162 - DNA, 22 bp, Homo sapiens
aagccaggggttggtatgctat

SEQ ID NO: 8176163 - DNA, 22 bp, Homo sapiens
aagccaggggttggtatgctat

SEQ ID NO: 8176164 - DNA, 22 bp, Homo sapiens
aagccagggtcaggggcctcct

SEQ ID NO: 8176165 - DNA, 22 bp, Homo sapiens
aagccagggtcaggggcctcct

SEQ ID NO: 8176166 - DNA, 18 bp, Homo sapiens
aagccaggtcaagataag

SEQ ID NO: 8176167 - DNA, 22 bp, Homo sapiens
aagccaggtgtttaggccagcg

SEQ ID NO: 8176168 - DNA, 22 bp, Homo sapiens
aagccaggtgttgtggtaagag

SEQ ID NO: 8176169 - DNA, 22 bp, Homo sapiens
aagccaggtgtttaggccagcg

SEQ ID NO: 8176170 - DNA, 22 bp, Homo sapiens
aagccaggttccatggaggagc

SEQ ID NO: 8176171 - DNA, 22 bp, Homo sapiens
aagctgcaaggaagtgtgccag

SEQ ID NO: 8176172 - DNA, 22 bp, Homo sapiens
aagctgcaaggaagtgtgccag

SEQ ID NO: 8176173 - DNA, 22 bp, Homo sapiens
aaggcagatataaagactagag

SEQ ID NO: 8176174 - DNA, 22 bp, Homo sapiens
aaggcagatataaagactagag

SEQ ID NO: 8176175 - DNA, 22 bp, Homo sapiens
aaggcagccgtgtgactgcatg

SEQ ID NO: 8176176 - DNA, 22 bp, Homo sapiens
aaggcagccgtgtgactgcatg

SEQ ID NO: 8176177 - DNA, 22 bp, Homo sapiens
acagttgaggacttaaacaaaa

SEQ ID NO: 8176178 - DNA, 22 bp, Homo sapiens
acagttgttttccagatatgtt

SEQ ID NO: 8176179 - DNA, 22 bp, Homo sapiens
aaggcagctcagctcatggcag

SEQ ID NO: 8176180 - DNA, 22 bp, Homo sapiens
aaggcagctcagctcatggcag

SEQ ID NO: 8176181 - DNA, 22 bp, Homo sapiens
aaggcagcctttgtttgattga

SEQ ID NO: 8176182 - DNA, 22 bp, Homo sapiens
aaggcagccgtgtgactgcatg

SEQ ID NO: 8176183 - DNA, 22 bp, Homo sapiens
aaggcagcctctgccagccggg

SEQ ID NO: 8176184 - DNA, 22 bp, Homo sapiens
aaggcagcctctgccagccggg

SEQ ID NO: 8176185 - DNA, 22 bp, Homo sapiens
acagttgacagggagagggtta

SEQ ID NO: 8176186 - DNA, 22 bp, Homo sapiens
acagttctgtcctagacttcgt

SEQ ID NO: 8176187 - DNA, 22 bp, Homo sapiens
acagttctgcctgtttgagaag

SEQ ID NO: 8176188 - DNA, 19 bp, Homo sapiens
acagttctaatttctgtgg

SEQ ID NO: 8176189 - DNA, 22 bp, Homo sapiens
acagttctccagtgcctttgag

SEQ ID NO: 8176190 - DNA, 22 bp, Homo sapiens
acagttctagcttttacatttt

SEQ ID NO: 8176191 - DNA, 22 bp, Homo sapiens
acagttctcttgtcacttcctc

SEQ ID NO: 8176192 - DNA, 22 bp, Homo sapiens
aaggcaggatgggaaaagattt

SEQ ID NO: 8176193 - DNA, 22 bp, Homo sapiens
aaggcaggatgcggacccatct

SEQ ID NO: 8176194 - DNA, 22 bp, Homo sapiens
aaggcaggatgggaaaagattt

SEQ ID NO: 8176195 - DNA, 22 bp, Homo sapiens
aaggcaggatgggaaaagattt

SEQ ID NO: 8176196 - DNA, 22 bp, Homo sapiens
aaggcagggaaagtggattagg

SEQ ID NO: 8176197 - DNA, 22 bp, Homo sapiens
aaggcaggatgggaaaagattt

SEQ ID NO: 8176198 - DNA, 22 bp, Homo sapiens
aaggcaggatgggaaaagattt

SEQ ID NO: 8176199 - DNA, 22 bp, Homo sapiens
aaggcagggaaagtggattagg

SEQ ID NO: 8176200 - DNA, 22 bp, Homo sapiens
aaggcagcttcaccacagcatt

SEQ ID NO: 8176201 - DNA, 22 bp, Homo sapiens
aaggcaggatgcggacccatct

SEQ ID NO: 8176202 - DNA, 22 bp, Homo sapiens
aaggcaggatgcggacccatct

SEQ ID NO: 8176203 - DNA, 22 bp, Homo sapiens
aaggcaggatgcggacccatct

SEQ ID NO: 8176204 - DNA, 22 bp, Homo sapiens
aaggcaggagctgtatcttatt

SEQ ID NO: 8176205 - DNA, 22 bp, Homo sapiens
aaggcaggagctgtatcttatt

SEQ ID NO: 8176206 - DNA, 22 bp, Homo sapiens
aaggcaggagctgtatcttatt

SEQ ID NO: 8176207 - DNA, 22 bp, Homo sapiens
aaggcagttcactcacgcagcc

SEQ ID NO: 8176208 - DNA, 22 bp, Homo sapiens
aaggcagttcactcacgcagcc

SEQ ID NO: 8176209 - DNA, 22 bp, Homo sapiens
aaggcagttaatttggctagaa

SEQ ID NO: 8176210 - DNA, 22 bp, Homo sapiens
aaggcagtggttgggtggagga

SEQ ID NO: 8176211 - DNA, 22 bp, Homo sapiens
aaggcagtggttgggtggagga

SEQ ID NO: 8176212 - DNA, 22 bp, Homo sapiens
aaggcaggtattgatgccacag

SEQ ID NO: 8176213 - DNA, 22 bp, Homo sapiens
aaggcaggtattgatgccacag

SEQ ID NO: 8176214 - DNA, 22 bp, Homo sapiens
aaggcaggtattgatgccacag

SEQ ID NO: 8176215 - DNA, 22 bp, Homo sapiens
aaggcaggtattgatgccacag

SEQ ID NO: 8176216 - DNA, 22 bp, Homo sapiens
acagtagagtaaatggttagat

SEQ ID NO: 8176217 - DNA, 22 bp, Homo sapiens
acagtagagtaaaagggagcct

SEQ ID NO: 8176218 - DNA, 22 bp, Homo sapiens
acagtagatggctcagagacag

SEQ ID NO: 8176219 - DNA, 22 bp, Homo sapiens
acagtagaaacaggcaggcaga

SEQ ID NO: 8176220 - DNA, 22 bp, Homo sapiens
acagtactgtgttaactgaacc

SEQ ID NO: 8176221 - DNA, 22 bp, Homo sapiens
acagtagatggctcagagacag

SEQ ID NO: 8176222 - DNA, 22 bp, Homo sapiens
acagtagtacacatctatgtcc

SEQ ID NO: 8176223 - DNA, 22 bp, Homo sapiens
acagtagtacacatctatgtcc

SEQ ID NO: 8176224 - DNA, 22 bp, Homo sapiens
acagtagtgctcaatcagtgtt

SEQ ID NO: 8176225 - DNA, 22 bp, Homo sapiens
acagtataccattgtgactttg

SEQ ID NO: 8176226 - DNA, 22 bp, Homo sapiens
acagtataaactcctaaaagcc

SEQ ID NO: 8176227 - DNA, 22 bp, Homo sapiens
aaggaaatctttgtaacatctt

SEQ ID NO: 8176228 - DNA, 22 bp, Homo sapiens
aaggaaatgaagctgatgttgg

SEQ ID NO: 8176229 - DNA, 22 bp, Homo sapiens
aaggaaattaggttattttgct

SEQ ID NO: 8176230 - DNA, 22 bp, Homo sapiens
aaggaaatgaggttgatggatg

SEQ ID NO: 8176231 - DNA, 22 bp, Homo sapiens
aaggaagaaatgaataggtgga

SEQ ID NO: 8176232 - DNA, 22 bp, Homo sapiens
aaggaagaagactctttactcc

SEQ ID NO: 8176233 - DNA, 22 bp, Homo sapiens
aaggaagaagactctttactcc

SEQ ID NO: 8176234 - DNA, 22 bp, Homo sapiens
aaggcactagcaagctgcctgg

SEQ ID NO: 8176235 - DNA, 22 bp, Homo sapiens
aaggcactacgctgctggggcg

SEQ ID NO: 8176236 - DNA, 22 bp, Homo sapiens
aaggcacttgcccagagctgca

SEQ ID NO: 8176237 - DNA, 22 bp, Homo sapiens
aaggcagaaagggatgtgagtg

SEQ ID NO: 8176238 - DNA, 22 bp, Homo sapiens
aaggcagaaagggatgtgagtg

SEQ ID NO: 8176239 - DNA, 22 bp, Homo sapiens
aaggcagaaagggatgtgagtg

SEQ ID NO: 8176240 - DNA, 22 bp, Homo sapiens
aaggcagaaagggatgtgagtg

SEQ ID NO: 8176241 - DNA, 21 bp, Homo sapiens
aaggcagaagcatggaatgag

SEQ ID NO: 8176242 - DNA, 21 bp, Homo sapiens
aaggcagaagcatggaatgag

SEQ ID NO: 8176243 - DNA, 19 bp, Homo sapiens
aaggcagaagttggatatg

SEQ ID NO: 8176244 - DNA, 22 bp, Homo sapiens
aaggcagaaagggatgtgagtg

SEQ ID NO: 8176245 - DNA, 22 bp, Homo sapiens
aaggcagaaattcaactactgg

SEQ ID NO: 8176246 - DNA, 22 bp, Homo sapiens
aaggcagaaattcaactactgg

SEQ ID NO: 8176247 - DNA, 20 bp, Homo sapiens
aatgagattccttatgatag

SEQ ID NO: 8176248 - DNA, 22 bp, Homo sapiens
aatgagctagacctgcttcctc

SEQ ID NO: 8176249 - DNA, 22 bp, Homo sapiens
aatgagatggcaatgacttaaa

SEQ ID NO: 8176250 - DNA, 22 bp, Homo sapiens
aatgagatggaattcccgccta

SEQ ID NO: 8176251 - DNA, 22 bp, Homo sapiens
aatgagatggaggactcttaat

SEQ ID NO: 8176252 - DNA, 22 bp, Homo sapiens
aatgagatggaattcccgccta

SEQ ID NO: 8176253 - DNA, 22 bp, Homo sapiens
aatgagatggaattcccgccta

SEQ ID NO: 8176254 - DNA, 22 bp, Homo sapiens
aatgagatggaattcccgccta

SEQ ID NO: 8176255 - DNA, 22 bp, Homo sapiens
aatgagatcagagataactcaa

SEQ ID NO: 8176256 - DNA, 22 bp, Homo sapiens
aatgagggggatgggaaagtgt

SEQ ID NO: 8176257 - DNA, 22 bp, Homo sapiens
aatgagctgctgctgttccacc

SEQ ID NO: 8176258 - DNA, 22 bp, Homo sapiens
aatgagcttctataatcttgtc

SEQ ID NO: 8176259 - DNA, 23 bp, Homo sapiens
aatgagcttcattcttggaagac

SEQ ID NO: 8176260 - DNA, 22 bp, Homo sapiens
agaagggagagaaagttggtta

SEQ ID NO: 8176261 - DNA, 22 bp, Homo sapiens
aatgagttctgacacttcacga

SEQ ID NO: 8176262 - DNA, 20 bp, Homo sapiens
aatgagttattttgtatatg

SEQ ID NO: 8176263 - DNA, 20 bp, Homo sapiens
aatgagttattttgtatatg

SEQ ID NO: 8176264 - DNA, 18 bp, Homo sapiens
agaaggagctatgggcag

SEQ ID NO: 8176265 - DNA, 22 bp, Homo sapiens
aatgaggttttttaaagccaga

SEQ ID NO: 8176266 - DNA, 22 bp, Homo sapiens
aatgagttattaggtgtaagtg

SEQ ID NO: 8176267 - DNA, 22 bp, Homo sapiens
agaaatacttaatctttgcagg

SEQ ID NO: 8176268 - DNA, 22 bp, Homo sapiens
agaaatactgtgagagcagcct

SEQ ID NO: 8176269 - DNA, 22 bp, Homo sapiens
agaaatactgcctaagactgta

SEQ ID NO: 8176270 - DNA, 22 bp, Homo sapiens
agaaatactgcctaagactgta

SEQ ID NO: 8176271 - DNA, 22 bp, Homo sapiens
aatgacctgggtgtcatttcat

SEQ ID NO: 8176272 - DNA, 22 bp, Homo sapiens
aatgacatggagcatcttttca

SEQ ID NO: 8176273 - DNA, 22 bp, Homo sapiens
aatgaatgtttgttgagtgaag

SEQ ID NO: 8176274 - DNA, 22 bp, Homo sapiens
aatgaatgtttgttgagtgaag

SEQ ID NO: 8176275 - DNA, 19 bp, Homo sapiens
aatgactgagtacattgtc

SEQ ID NO: 8176276 - DNA, 22 bp, Homo sapiens
aatgactgtagtcatattaagg

SEQ ID NO: 8176277 - DNA, 23 bp, Homo sapiens
aatgagagaccatgtggagcaga

SEQ ID NO: 8176278 - DNA, 22 bp, Homo sapiens
aatgagaagcctaggtgtactg

SEQ ID NO: 8176279 - DNA, 22 bp, Homo sapiens
agaaaacattacataggtgtgt

SEQ ID NO: 8176280 - DNA, 22 bp, Homo sapiens
agaaaacattacataggtgtgt

SEQ ID NO: 8176281 - DNA, 22 bp, Homo sapiens
aatgaaactatatttagagagg

SEQ ID NO: 8176282 - DNA, 22 bp, Homo sapiens
aatgaaactatatttagagagg

SEQ ID NO: 8176283 - DNA, 22 bp, Homo sapiens
agaaaactctacatctgtatgt

SEQ ID NO: 8176284 - DNA, 22 bp, Homo sapiens
agaaaacataggagacaggaaa

SEQ ID NO: 8176285 - DNA, 22 bp, Homo sapiens
agaaaacataggagacaggaaa

SEQ ID NO: 8176286 - DNA, 22 bp, Homo sapiens
agaaaacagaaagtcattggtg

SEQ ID NO: 8176287 - DNA, 22 bp, Homo sapiens
agaaaacataggagacaggaaa

SEQ ID NO: 8176288 - DNA, 22 bp, Homo sapiens
agaaaacactgccccctctctc

SEQ ID NO: 8176289 - DNA, 22 bp, Homo sapiens
agaaaacactgccccctctctc

SEQ ID NO: 8176290 - DNA, 22 bp, Homo sapiens
agaaaacactgccccctctctc

SEQ ID NO: 8176291 - DNA, 22 bp, Homo sapiens
agaaaaatcttggcgcttgtct

SEQ ID NO: 8176292 - DNA, 22 bp, Homo sapiens
agaaaaatcttggcgcttgtct

SEQ ID NO: 8176293 - DNA, 22 bp, Homo sapiens
aatcctggcatgtgccttggga

SEQ ID NO: 8176294 - DNA, 22 bp, Homo sapiens
aatcctggaatgagtttgctga

SEQ ID NO: 8176295 - DNA, 22 bp, Homo sapiens
aatgaacatataaagagatctt

SEQ ID NO: 8176296 - DNA, 22 bp, Homo sapiens
aatgaactccgaacatttacat

SEQ ID NO: 8176297 - DNA, 23 bp, Homo sapiens
aatgaactgagaatctgtacagt

SEQ ID NO: 8176298 - DNA, 22 bp, Homo sapiens
aatgaacagtgggtgaggtacc

SEQ ID NO: 8176299 - DNA, 22 bp, Homo sapiens
aatgaacaggtgaatgtcagat

SEQ ID NO: 8176300 - DNA, 22 bp, Homo sapiens
agaaataagagctttccttggg

SEQ ID NO: 8176301 - DNA, 22 bp, Homo sapiens
agaaataagagctttccttggg

SEQ ID NO: 8176302 - DNA, 22 bp, Homo sapiens
agaaataagagctttccttggg

SEQ ID NO: 8176303 - DNA, 22 bp, Homo sapiens
agaaataagagctttccttggg

SEQ ID NO: 8176304 - DNA, 22 bp, Homo sapiens
agaaataagagctttccttggg

SEQ ID NO: 8176305 - DNA, 22 bp, Homo sapiens
agaaatacaaagtactaagata

SEQ ID NO: 8176306 - DNA, 21 bp, Homo sapiens
agaaatacagcagggatgatc

SEQ ID NO: 8176307 - DNA, 22 bp, Homo sapiens
agaaatactaggaatattcata

SEQ ID NO: 8176308 - DNA, 22 bp, Homo sapiens
agaaatactaggaatattcata

SEQ ID NO: 8176309 - DNA, 22 bp, Homo sapiens
agaaatactaggaatattcata

SEQ ID NO: 8176310 - DNA, 20 bp, Homo sapiens
agaaatacatgcatgcatga

SEQ ID NO: 8176311 - DNA, 20 bp, Homo sapiens
agaaatacatgcatgcatga

SEQ ID NO: 8176312 - DNA, 20 bp, Homo sapiens
agaaatacatgcatgcatga

SEQ ID NO: 8176313 - DNA, 22 bp, Homo sapiens
agaaatacattctctggtgtgt

SEQ ID NO: 8176314 - DNA, 20 bp, Homo sapiens
agaaataccacatttggcaa

SEQ ID NO: 8176315 - DNA, 18 bp, Homo sapiens
agaaataccagtattgga

SEQ ID NO: 8176316 - DNA, 18 bp, Homo sapiens
agaaataccagtattgga

SEQ ID NO: 8176317 - DNA, 20 bp, Homo sapiens
agaaataccacatttggcaa

SEQ ID NO: 8176318 - DNA, 22 bp, Homo sapiens
aatattttaggctttccaggct

SEQ ID NO: 8176319 - DNA, 22 bp, Homo sapiens
aatattttaggctttccaggct

SEQ ID NO: 8176320 - DNA, 22 bp, Homo sapiens
aatatttttgaggccctgttat

SEQ ID NO: 8176321 - DNA, 22 bp, Homo sapiens
aatatttttgaggccctgttat

SEQ ID NO: 8176322 - DNA, 22 bp, Homo sapiens
aatatttttgaggccctgttat

SEQ ID NO: 8176323 - DNA, 22 bp, Homo sapiens
aatatttttgaggccctgttat

SEQ ID NO: 8176324 - DNA, 22 bp, Homo sapiens
aatcaaaacctacagaggtaat

SEQ ID NO: 8176325 - DNA, 22 bp, Homo sapiens
aatcaaaacctacagaggtaat

SEQ ID NO: 8176326 - DNA, 22 bp, Homo sapiens
aatcaaagaatgggctagttgg

SEQ ID NO: 8176327 - DNA, 22 bp, Homo sapiens
aatcaacattgttttaagtcaa

SEQ ID NO: 8176328 - DNA, 22 bp, Homo sapiens
acttgttcattgagtacatatg

SEQ ID NO: 8176329 - DNA, 22 bp, Homo sapiens
acttgtctttgtaaaatagaaa

SEQ ID NO: 8176330 - DNA, 22 bp, Homo sapiens
acttgtgtaacacagaaagaac

SEQ ID NO: 8176331 - DNA, 22 bp, Homo sapiens
acttgtctggcagatcatgcaa

SEQ ID NO: 8176332 - DNA, 22 bp, Homo sapiens
acttgtctaccatgaatattta

SEQ ID NO: 8176333 - DNA, 22 bp, Homo sapiens
acttgtctatggttacatccta

SEQ ID NO: 8176334 - DNA, 22 bp, Homo sapiens
acttgtatggagacttggaacc

SEQ ID NO: 8176335 - DNA, 22 bp, Homo sapiens
acttggttggtctcaccctgtt

SEQ ID NO: 8176336 - DNA, 22 bp, Homo sapiens
acttgtaagctctgtatttgag

SEQ ID NO: 8176337 - DNA, 22 bp, Homo sapiens
aatcaagaataagttgtaaagc

SEQ ID NO: 8176338 - DNA, 22 bp, Homo sapiens
aatcaagagctgactatatttt

SEQ ID NO: 8176339 - DNA, 22 bp, Homo sapiens
aatcaagagctgactatatttt

SEQ ID NO: 8176340 - DNA, 22 bp, Homo sapiens
aatcataattgtatacattcat

SEQ ID NO: 8176341 - DNA, 22 bp, Homo sapiens
aatcataattgtatacattcat

SEQ ID NO: 8176342 - DNA, 22 bp, Homo sapiens
aatccaggtggcggaggttgtg

SEQ ID NO: 8176343 - DNA, 22 bp, Homo sapiens
aatccataatgttgtggggttt

SEQ ID NO: 8176344 - DNA, 22 bp, Homo sapiens
aatccataggtttttccaagag

SEQ ID NO: 8176345 - DNA, 22 bp, Homo sapiens
aatccatagaataaaattgcag

SEQ ID NO: 8176346 - DNA, 22 bp, Homo sapiens
aatccagctgtgtcacaggtga

SEQ ID NO: 8176347 - DNA, 22 bp, Homo sapiens
acttgtttgaatctctctagag

SEQ ID NO: 8176348 - DNA, 22 bp, Homo sapiens
acttgtttcaactgtactctcc

SEQ ID NO: 8176349 - DNA, 22 bp, Homo sapiens
acttgtttcaactgtactctca

SEQ ID NO: 8176350 - DNA, 22 bp, Homo sapiens
acttgtttggtctcatgtttaa

SEQ ID NO: 8176351 - DNA, 22 bp, Homo sapiens
acttgtttggtctcatgtttaa

SEQ ID NO: 8176352 - DNA, 22 bp, Homo sapiens
aatcccaagtccaggccattcc

SEQ ID NO: 8176353 - DNA, 22 bp, Homo sapiens
aatcccagctactcaggaagtt

SEQ ID NO: 8176354 - DNA, 22 bp, Homo sapiens
aatccatttactctttacaaga

SEQ ID NO: 8176355 - DNA, 22 bp, Homo sapiens
aatccataggtttttccaagag

SEQ ID NO: 8176356 - DNA, 22 bp, Homo sapiens
aatcctgaggcaaagagatgag

SEQ ID NO: 8176357 - DNA, 22 bp, Homo sapiens
aatcctaagcatccttttctgc

SEQ ID NO: 8176358 - DNA, 22 bp, Homo sapiens
aatcctaagcatccttttctgc

SEQ ID NO: 8176359 - DNA, 22 bp, Homo sapiens
aatccctctgtcgggcatctgt

SEQ ID NO: 8176360 - DNA, 19 bp, Homo sapiens
aatattttagcctcttcct

SEQ ID NO: 8176361 - DNA, 22 bp, Homo sapiens
aatatttgttagtgttttaatg

SEQ ID NO: 8176362 - DNA, 22 bp, Homo sapiens
aatattctaataaatgcccatc

SEQ ID NO: 8176363 - DNA, 22 bp, Homo sapiens
aatattctaataaatgcccatc

SEQ ID NO: 8176364 - DNA, 22 bp, Homo sapiens
aatatatttgaatcaggaacaa

SEQ ID NO: 8176365 - DNA, 22 bp, Homo sapiens
aatatatttgaatcaggaacaa

SEQ ID NO: 8176366 - DNA, 23 bp, Homo sapiens
aatatatgtgtttttctgcttca

SEQ ID NO: 8176367 - DNA, 22 bp, Homo sapiens
aatatatgtggtattgaccagc

SEQ ID NO: 8176368 - DNA, 22 bp, Homo sapiens
aatatatgagggagctatttga

SEQ ID NO: 8176369 - DNA, 21 bp, Homo sapiens
aatatatgcaatgctttctgc

SEQ ID NO: 8176370 - DNA, 22 bp, Homo sapiens
aatatatgagggagctatttga

SEQ ID NO: 8176371 - DNA, 22 bp, Homo sapiens
aatatatgactccactgcatga

SEQ ID NO: 8176372 - DNA, 22 bp, Homo sapiens
aatatatgactccactgcatga

SEQ ID NO: 8176373 - DNA, 22 bp, Homo sapiens
aatatatagaagtacccgttgt

SEQ ID NO: 8176374 - DNA, 22 bp, Homo sapiens
aatatatagaagtacccgttgt

SEQ ID NO: 8176375 - DNA, 22 bp, Homo sapiens
aatatatagaagtacccgttgt

SEQ ID NO: 8176376 - DNA, 22 bp, Homo sapiens
aatatatagaagtacccgttgt

SEQ ID NO: 8176377 - DNA, 22 bp, Homo sapiens
aatatatagaagtacccgttgt

SEQ ID NO: 8176378 - DNA, 22 bp, Homo sapiens
aatatatgaccaggaagttctg

SEQ ID NO: 8176379 - DNA, 22 bp, Homo sapiens
aatatatgaccaggaagttctg

SEQ ID NO: 8176380 - DNA, 22 bp, Homo sapiens
aatatatagaagtacccgttgt

SEQ ID NO: 8176381 - DNA, 22 bp, Homo sapiens
acttgaggaagcagcaagggat

SEQ ID NO: 8176382 - DNA, 22 bp, Homo sapiens
aatatatagaagtacccgttgt

SEQ ID NO: 8176383 - DNA, 22 bp, Homo sapiens
aatatatagaagtacccgttgt

SEQ ID NO: 8176384 - DNA, 22 bp, Homo sapiens
acttgaaaccttggcaaacaat

SEQ ID NO: 8176385 - DNA, 22 bp, Homo sapiens
acttgaaaccctgagatgataa

SEQ ID NO: 8176386 - DNA, 22 bp, Homo sapiens
acttgaaaagctcagcagtagt

SEQ ID NO: 8176387 - DNA, 22 bp, Homo sapiens
acttgaaaagctcagcagtagt

SEQ ID NO: 8176388 - DNA, 19 bp, Homo sapiens
acttgaaagcagagagttt

SEQ ID NO: 8176389 - DNA, 22 bp, Homo sapiens
acttgaaaccttggcaaacaat

SEQ ID NO: 8176390 - DNA, 22 bp, Homo sapiens
aatacaatcaaattcactagca

SEQ ID NO: 8176391 - DNA, 22 bp, Homo sapiens
aatacaatcaaattcactagca

SEQ ID NO: 8176392 - DNA, 22 bp, Homo sapiens
aatacagagaatgttatttgga

SEQ ID NO: 8176393 - DNA, 22 bp, Homo sapiens
acttcctgctatgagcttctgt

SEQ ID NO: 8176394 - DNA, 22 bp, Homo sapiens
acttcctggattcccaagggct

SEQ ID NO: 8176395 - DNA, 19 bp, Homo sapiens
acttcttttcaacacagga

SEQ ID NO: 8176396 - DNA, 22 bp, Homo sapiens
acttcttttcaaatcatgcaaa

SEQ ID NO: 8176397 - DNA, 22 bp, Homo sapiens
acttcttttcaaatcatgcaaa

SEQ ID NO: 8176398 - DNA, 22 bp, Homo sapiens
acttcttttcaaatcatgcaaa

SEQ ID NO: 8176399 - DNA, 19 bp, Homo sapiens
aagtcacttgagggcagga

SEQ ID NO: 8176400 - DNA, 17 bp, Homo sapiens
aagtcacttctgggcca

SEQ ID NO: 8176401 - DNA, 20 bp, Homo sapiens
aagtcacttaagatgggcag

SEQ ID NO: 8176402 - DNA, 22 bp, Homo sapiens
aagtcactggcaaaagctgcag

SEQ ID NO: 8176403 - DNA, 22 bp, Homo sapiens
aagtcactggcaaaagctgcag

SEQ ID NO: 8176404 - DNA, 22 bp, Homo sapiens
aagtcacagaacccattgtaac

SEQ ID NO: 8176405 - DNA, 22 bp, Homo sapiens
aagtcacagagttggaagtcag

SEQ ID NO: 8176406 - DNA, 22 bp, Homo sapiens
aagtcacagaacccattgtaac

SEQ ID NO: 8176407 - DNA, 22 bp, Homo sapiens
aagtcacagaacccattgtaac

SEQ ID NO: 8176408 - DNA, 22 bp, Homo sapiens
aagtcacagaacccattgtaac

SEQ ID NO: 8176409 - DNA, 22 bp, Homo sapiens
aagtcacactgctgggaactct

SEQ ID NO: 8176410 - DNA, 22 bp, Homo sapiens
aagtcacattctgaggtattgg

SEQ ID NO: 8176411 - DNA, 22 bp, Homo sapiens
aagtcagcactccaggaagcca

SEQ ID NO: 8176412 - DNA, 22 bp, Homo sapiens
aagtcagacagctgagctgcct

SEQ ID NO: 8176413 - DNA, 22 bp, Homo sapiens
aagtcagaaaacagagcaatta

SEQ ID NO: 8176414 - DNA, 22 bp, Homo sapiens
aagtcacttgattgttgacaga

SEQ ID NO: 8176415 - DNA, 22 bp, Homo sapiens
aagtcagaaatatctgccatca

SEQ ID NO: 8176416 - DNA, 22 bp, Homo sapiens
aagtggagccagggaaactgaa

SEQ ID NO: 8176417 - DNA, 22 bp, Homo sapiens
aagtggagccagggaaactgaa

SEQ ID NO: 8176418 - DNA, 22 bp, Homo sapiens
aagtggagctataggctcagat

SEQ ID NO: 8176419 - DNA, 22 bp, Homo sapiens
aagtggagagccctggaggtct

SEQ ID NO: 8176420 - DNA, 22 bp, Homo sapiens
aagtggagagccctggaggtct

SEQ ID NO: 8176421 - DNA, 22 bp, Homo sapiens
aagtggagagccctggaggtct

SEQ ID NO: 8176422 - DNA, 21 bp, Homo sapiens
aagtggagaagaaaagctgga

SEQ ID NO: 8176423 - DNA, 21 bp, Homo sapiens
aagtggagaagaaaagctgga

SEQ ID NO: 8176424 - DNA, 22 bp, Homo sapiens
aagtggactaatacaaggacta

SEQ ID NO: 8176425 - DNA, 22 bp, Homo sapiens
aagtggactaatacaaggacta

SEQ ID NO: 8176426 - DNA, 22 bp, Homo sapiens
actaacatgttaatcaaaagaa

SEQ ID NO: 8176427 - DNA, 22 bp, Homo sapiens
actaaatgaactattaatactt

SEQ ID NO: 8176428 - DNA, 22 bp, Homo sapiens
actaaatggaatgattactata

SEQ ID NO: 8176429 - DNA, 22 bp, Homo sapiens
actaaatgctgcataaatgctt

SEQ ID NO: 8176430 - DNA, 22 bp, Homo sapiens
aagtgctttataaacaatgaag

SEQ ID NO: 8176431 - DNA, 22 bp, Homo sapiens
aagtgctttcatatagtcttaa

SEQ ID NO: 8176432 - DNA, 22 bp, Homo sapiens
aagtgctttacaaatgtctgtt

SEQ ID NO: 8176433 - DNA, 22 bp, Homo sapiens
aagtgctttttcttgagctgct

SEQ ID NO: 8176434 - DNA, 23 bp, Homo sapiens
aagtgctttgggatggagtctgg

SEQ ID NO: 8176435 - DNA, 22 bp, Homo sapiens
aagtggactaatacaaggacta

SEQ ID NO: 8176436 - DNA, 22 bp, Homo sapiens
aagtggaagagaagttatctta

SEQ ID NO: 8176437 - DNA, 22 bp, Homo sapiens
aagtgcatacactagttaattg

SEQ ID NO: 8176438 - DNA, 22 bp, Homo sapiens
aagtcaggcttctcccagagcc

SEQ ID NO: 8176439 - DNA, 22 bp, Homo sapiens
aagtcaggcttctcccagagcc

SEQ ID NO: 8176440 - DNA, 22 bp, Homo sapiens
aagtcaggaagtgcaaaagttg

SEQ ID NO: 8176441 - DNA, 22 bp, Homo sapiens
aagttatatcatctcattgacg

SEQ ID NO: 8176442 - DNA, 22 bp, Homo sapiens
aagttatatcatctcattgacg

SEQ ID NO: 8176443 - DNA, 22 bp, Homo sapiens
aagttactatgactcttctttt

SEQ ID NO: 8176444 - DNA, 22 bp, Homo sapiens
aagttactttacctctttagct

SEQ ID NO: 8176445 - DNA, 22 bp, Homo sapiens
aagttacattttggtctaattg

SEQ ID NO: 8176446 - DNA, 22 bp, Homo sapiens
aagttacattttggtctaattg

SEQ ID NO: 8176447 - DNA, 22 bp, Homo sapiens
aagtgttttgtaaacagaaaag

SEQ ID NO: 8176448 - DNA, 22 bp, Homo sapiens
aagttactggcaagggctgcag

SEQ ID NO: 8176449 - DNA, 22 bp, Homo sapiens
actacacagggatgtgactacc

SEQ ID NO: 8176450 - DNA, 22 bp, Homo sapiens
actacaatactcttagtaaaag

SEQ ID NO: 8176451 - DNA, 21 bp, Homo sapiens
actaagagatctctgtctcat

SEQ ID NO: 8176452 - DNA, 22 bp, Homo sapiens
actaacttgctgagtgaccatg

SEQ ID NO: 8176453 - DNA, 20 bp, Homo sapiens
actaaggtggtagcagcagg

SEQ ID NO: 8176454 - DNA, 22 bp, Homo sapiens
actaagatgcaggaaatgctag

SEQ ID NO: 8176455 - DNA, 22 bp, Homo sapiens
actaagtgggacatttactagg

SEQ ID NO: 8176456 - DNA, 22 bp, Homo sapiens
actaattcaattaggaaaggaa

SEQ ID NO: 8176457 - DNA, 20 bp, Homo sapiens
actccaggtggcatgaggac

SEQ ID NO: 8176458 - DNA, 22 bp, Homo sapiens
actccaggtaggcacattgaca

SEQ ID NO: 8176459 - DNA, 20 bp, Homo sapiens
actccaggtggcatgaggac

SEQ ID NO: 8176460 - DNA, 22 bp, Homo sapiens
actccaggttttctctcaagtt

SEQ ID NO: 8176461 - DNA, 22 bp, Homo sapiens
aagttcaaaaatgtaatcagtg

SEQ ID NO: 8176462 - DNA, 22 bp, Homo sapiens
aagttattggtggagagcactg

SEQ ID NO: 8176463 - DNA, 22 bp, Homo sapiens
aagttcaagagtgacatattag

SEQ ID NO: 8176464 - DNA, 22 bp, Homo sapiens
aagttcaagctctgcctaaaat

SEQ ID NO: 8176465 - DNA, 18 bp, Homo sapiens
actccccacaggctctgt

SEQ ID NO: 8176466 - DNA, 18 bp, Homo sapiens
actccccacaggctctgt

SEQ ID NO: 8176467 - DNA, 22 bp, Homo sapiens
actccccagactgccatgctgg

SEQ ID NO: 8176468 - DNA, 22 bp, Homo sapiens
aagttctaattttgcattcagg

SEQ ID NO: 8176469 - DNA, 23 bp, Homo sapiens
actccccagtctcttcttgccaa

SEQ ID NO: 8176470 - DNA, 22 bp, Homo sapiens
actccccagactgccatgctgg

SEQ ID NO: 8176471 - DNA, 22 bp, Homo sapiens
actccccagactgccatgctgg

SEQ ID NO: 8176472 - DNA, 22 bp, Homo sapiens
actcccaggttgcctggcaggc

SEQ ID NO: 8176473 - DNA, 21 bp, Homo sapiens
actcccatcataactggtggg

SEQ ID NO: 8176474 - DNA, 18 bp, Homo sapiens
actccccacaggctctgt

SEQ ID NO: 8176475 - DNA, 18 bp, Homo sapiens
actccccacaggctctgt

SEQ ID NO: 8176476 - DNA, 22 bp, Homo sapiens
actccccaaaactaaccatgca

SEQ ID NO: 8176477 - DNA, 22 bp, Homo sapiens
actccccaaaactaaccatgca

SEQ ID NO: 8176478 - DNA, 22 bp, Homo sapiens
actccccaaaactaaccatgca

SEQ ID NO: 8176479 - DNA, 22 bp, Homo sapiens
actccccaaaactaaccatgca

SEQ ID NO: 8176480 - DNA, 22 bp, Homo sapiens
actccaggttttctctcaagtt

SEQ ID NO: 8176481 - DNA, 22 bp, Homo sapiens
actccaggttttttcactgaag

SEQ ID NO: 8176482 - DNA, 22 bp, Homo sapiens
actccatacaatggcaggctgt

SEQ ID NO: 8176483 - DNA, 22 bp, Homo sapiens
actcccagaacatgctcttctt

SEQ ID NO: 8176484 - DNA, 22 bp, Homo sapiens
actcccaggttgcctggcaggc

SEQ ID NO: 8176485 - DNA, 22 bp, Homo sapiens
aagtttatgttggtaagatatc

SEQ ID NO: 8176486 - DNA, 22 bp, Homo sapiens
aagtttatgttctttgaaggca

SEQ ID NO: 8176487 - DNA, 22 bp, Homo sapiens
aagtttatgttctttgaaggca

SEQ ID NO: 8176488 - DNA, 22 bp, Homo sapiens
aagtttatgttctttgaaggca

SEQ ID NO: 8176489 - DNA, 22 bp, Homo sapiens
aagtttatgttctttgaaggca

SEQ ID NO: 8176490 - DNA, 22 bp, Homo sapiens
aagtttatgttctttgaaggca

SEQ ID NO: 8176491 - DNA, 22 bp, Homo sapiens
aagtttatccctctcacagtta

SEQ ID NO: 8176492 - DNA, 22 bp, Homo sapiens
aagtttatccctctcacagtta

SEQ ID NO: 8176493 - DNA, 22 bp, Homo sapiens
aagtttatccctctcacagtta

SEQ ID NO: 8176494 - DNA, 22 bp, Homo sapiens
aagtttatctttgctgggtact

SEQ ID NO: 8176495 - DNA, 22 bp, Homo sapiens
aagtttatctttgctgggtact

SEQ ID NO: 8176496 - DNA, 22 bp, Homo sapiens
aagtttatctttgctgggtact

SEQ ID NO: 8176497 - DNA, 22 bp, Homo sapiens
aagtttatctttgctgggtact

SEQ ID NO: 8176498 - DNA, 22 bp, Homo sapiens
aagtttatgaagtctaagccaa

SEQ ID NO: 8176499 - DNA, 22 bp, Homo sapiens
aagtttatgaagtctaagccaa

SEQ ID NO: 8176500 - DNA, 22 bp, Homo sapiens
aagtttatgaagtctaagccaa

SEQ ID NO: 8176501 - DNA, 22 bp, Homo sapiens
aagtttatgaagtctaagccaa

SEQ ID NO: 8176502 - DNA, 22 bp, Homo sapiens
aagtttatccctctcacagtta

SEQ ID NO: 8176503 - DNA, 22 bp, Homo sapiens
aagtttatccctctcacagtta

SEQ ID NO: 8176504 - DNA, 22 bp, Homo sapiens
aagtttatccctctcacagtta

SEQ ID NO: 8176505 - DNA, 22 bp, Homo sapiens
aagtttacataagtgatgatga

SEQ ID NO: 8176506 - DNA, 22 bp, Homo sapiens
aagttggagctggagctatgga

SEQ ID NO: 8176507 - DNA, 22 bp, Homo sapiens
aagttggtgtatgagacagaag

SEQ ID NO: 8176508 - DNA, 22 bp, Homo sapiens
aagttggtaggagacagaaggt

SEQ ID NO: 8176509 - DNA, 22 bp, Homo sapiens
aagtttacataagtgatgatga

SEQ ID NO: 8176510 - DNA, 22 bp, Homo sapiens
aagtttaacttgaattctttct

SEQ ID NO: 8176511 - DNA, 23 bp, Homo sapiens
aagttgtttttggccagggaaag

SEQ ID NO: 8176512 - DNA, 22 bp, Homo sapiens
aagtttaacttgaattctttct

SEQ ID NO: 8176513 - DNA, 22 bp, Homo sapiens
aagttgttgttgaggtgggtaa

SEQ ID NO: 8176514 - DNA, 22 bp, Homo sapiens
aagttgtatgtcttagaaagta

SEQ ID NO: 8176515 - DNA, 22 bp, Homo sapiens
aataagaattgccagatttgaa

SEQ ID NO: 8176516 - DNA, 22 bp, Homo sapiens
aataagaattgccagatttgaa

SEQ ID NO: 8176517 - DNA, 22 bp, Homo sapiens
aataagaattgccagatttgaa

SEQ ID NO: 8176518 - DNA, 22 bp, Homo sapiens
aataagaattgccagatttgaa

SEQ ID NO: 8176519 - DNA, 22 bp, Homo sapiens
aataacttaagaaatttcccca

SEQ ID NO: 8176520 - DNA, 22 bp, Homo sapiens
aataagaatttacttgtcaaga

SEQ ID NO: 8176521 - DNA, 22 bp, Homo sapiens
aataagatcctgaagatatgtt

SEQ ID NO: 8176522 - DNA, 22 bp, Homo sapiens
aataagataagatttctgctct

SEQ ID NO: 8176523 - DNA, 22 bp, Homo sapiens
aataagataagatttctgctct

SEQ ID NO: 8176524 - DNA, 22 bp, Homo sapiens
aagtttcatgacttggttatta

SEQ ID NO: 8176525 - DNA, 22 bp, Homo sapiens
aagtttcatgatgtaattattg

SEQ ID NO: 8176526 - DNA, 20 bp, Homo sapiens
aagtttcatgctctggggat

SEQ ID NO: 8176527 - DNA, 22 bp, Homo sapiens
aagtttcaagaggttctttgaa

SEQ ID NO: 8176528 - DNA, 22 bp, Homo sapiens
aagtttcaaatgttgattatgc

SEQ ID NO: 8176529 - DNA, 22 bp, Homo sapiens
aagtttcaaatgttgattatgc

SEQ ID NO: 8176530 - DNA, 22 bp, Homo sapiens
aagtttattaattgacttgtgc

SEQ ID NO: 8176531 - DNA, 22 bp, Homo sapiens
aagtttattaattgacttgtgc

SEQ ID NO: 8176532 - DNA, 22 bp, Homo sapiens
aagtttattaattgacttgtgc

SEQ ID NO: 8176533 - DNA, 22 bp, Homo sapiens
aagtttatgttggtaagatatc

SEQ ID NO: 8176534 - DNA, 22 bp, Homo sapiens
aagtttattaattgacttgtgc

SEQ ID NO: 8176535 - DNA, 22 bp, Homo sapiens
aagtttatgttggtaagatatc

SEQ ID NO: 8176536 - DNA, 22 bp, Homo sapiens
aagtttatgttggtaagatatc

SEQ ID NO: 8176537 - DNA, 22 bp, Homo sapiens
aagtttatgttggtaagatatc

SEQ ID NO: 8176538 - DNA, 22 bp, Homo sapiens
aagtttatgttggtaagatatc

SEQ ID NO: 8176539 - DNA, 22 bp, Homo sapiens
aagtttatgttggtaagatatc

SEQ ID NO: 8176540 - DNA, 22 bp, Homo sapiens
aataattttagctcagagttgt

SEQ ID NO: 8176541 - DNA, 22 bp, Homo sapiens
aatacaatcaaattcactagca

SEQ ID NO: 8176542 - DNA, 22 bp, Homo sapiens
aatacaatcaaattcactagca

SEQ ID NO: 8176543 - DNA, 22 bp, Homo sapiens
aataatttccagccaactggaa

SEQ ID NO: 8176544 - DNA, 22 bp, Homo sapiens
aataattatttgagagcagacc

SEQ ID NO: 8176545 - DNA, 22 bp, Homo sapiens
aataattatttgagagcagacc

SEQ ID NO: 8176546 - DNA, 22 bp, Homo sapiens
aataattatttgagagcagacc

SEQ ID NO: 8176547 - DNA, 22 bp, Homo sapiens
aataattatttgagagcagacc

SEQ ID NO: 8176548 - DNA, 22 bp, Homo sapiens
aataattacccatctttttgta

SEQ ID NO: 8176549 - DNA, 22 bp, Homo sapiens
aataattacccatctttttgta

SEQ ID NO: 8176550 - DNA, 22 bp, Homo sapiens
aataattagtgggacagagaac

SEQ ID NO: 8176551 - DNA, 22 bp, Homo sapiens
aataattagtgggacagagaac

SEQ ID NO: 8176552 - DNA, 22 bp, Homo sapiens
aataattagtgggacagagaac

SEQ ID NO: 8176553 - DNA, 22 bp, Homo sapiens
aataatgttgacgatagtctta

SEQ ID NO: 8176554 - DNA, 19 bp, Homo sapiens
aataatgttcatgagattg

SEQ ID NO: 8176555 - DNA, 22 bp, Homo sapiens
actgccttatatgctgtgtgtg

SEQ ID NO: 8176556 - DNA, 22 bp, Homo sapiens
actgccttataatatgtcaaca

SEQ ID NO: 8176557 - DNA, 22 bp, Homo sapiens
actgccttataatatgtcaaca

SEQ ID NO: 8176558 - DNA, 22 bp, Homo sapiens
actgccttccacctatggatga

SEQ ID NO: 8176559 - DNA, 22 bp, Homo sapiens
actgccttcaaacagcgccacc

SEQ ID NO: 8176560 - DNA, 22 bp, Homo sapiens
actgccttcatgcagacccctg

SEQ ID NO: 8176561 - DNA, 22 bp, Homo sapiens
actgccttcttggccttcaaaa

SEQ ID NO: 8176562 - DNA, 22 bp, Homo sapiens
actgccttctttaatcctagtt

SEQ ID NO: 8176563 - DNA, 22 bp, Homo sapiens
actgccttctgctcagggttca

SEQ ID NO: 8176564 - DNA, 22 bp, Homo sapiens
actgccttgaaagattgttgag

SEQ ID NO: 8176565 - DNA, 22 bp, Homo sapiens
actgccttgattcatgctgatg

SEQ ID NO: 8176566 - DNA, 22 bp, Homo sapiens
actgccttgattgccagtttcc

SEQ ID NO: 8176567 - DNA, 22 bp, Homo sapiens
aataatagttgcaaagtgttta

SEQ ID NO: 8176568 - DNA, 22 bp, Homo sapiens
aataatagttgcaaagtgttta

SEQ ID NO: 8176569 - DNA, 22 bp, Homo sapiens
aataatagttgcaaagtgttta

SEQ ID NO: 8176570 - DNA, 20 bp, Homo sapiens
actgcctttaggtatccttg

SEQ ID NO: 8176571 - DNA, 22 bp, Homo sapiens
actgccttttccattacttaat

SEQ ID NO: 8176572 - DNA, 20 bp, Homo sapiens
actgccttggttcagtaggt

SEQ ID NO: 8176573 - DNA, 22 bp, Homo sapiens
actgccttgtctcttgcctgtt

SEQ ID NO: 8176574 - DNA, 22 bp, Homo sapiens
actgccttagaacaaagcagga

SEQ ID NO: 8176575 - DNA, 23 bp, Homo sapiens
actgcctgtgccgatctctctca

SEQ ID NO: 8176576 - DNA, 22 bp, Homo sapiens
aataagcaagcctgtgtgcaag

SEQ ID NO: 8176577 - DNA, 22 bp, Homo sapiens
actgcctgtgtcccttcagtgc

SEQ ID NO: 8176578 - DNA, 22 bp, Homo sapiens
actgcctgtgtcccttcagtgc

SEQ ID NO: 8176579 - DNA, 22 bp, Homo sapiens
aataagatcttaaaggttatat

SEQ ID NO: 8176580 - DNA, 22 bp, Homo sapiens
aataagatcttaaaggttatat

SEQ ID NO: 8176581 - DNA, 22 bp, Homo sapiens
aataagatcttaaaggttatat

SEQ ID NO: 8176582 - DNA, 22 bp, Homo sapiens
aataagatcctgaagatatgtt

SEQ ID NO: 8176583 - DNA, 22 bp, Homo sapiens
aataagattgacacaagtacct

SEQ ID NO: 8176584 - DNA, 22 bp, Homo sapiens
aataagatgtgcttgagtttgg

SEQ ID NO: 8176585 - DNA, 22 bp, Homo sapiens
aataagattactggttgtctga

SEQ ID NO: 8176586 - DNA, 22 bp, Homo sapiens
aacagcagctttcaggatcatc

SEQ ID NO: 8176587 - DNA, 22 bp, Homo sapiens
aacagcagctttcaggatcatc

SEQ ID NO: 8176588 - DNA, 22 bp, Homo sapiens
aacagcaggcaccaaggctatg

SEQ ID NO: 8176589 - DNA, 22 bp, Homo sapiens
aacagcaggcaccaaggctatg

SEQ ID NO: 8176590 - DNA, 23 bp, Homo sapiens
aacagcaggatgatagaggaggt

SEQ ID NO: 8176591 - DNA, 23 bp, Homo sapiens
aacagcaggatgatagaggaggt

SEQ ID NO: 8176592 - DNA, 22 bp, Homo sapiens
aaggtctggatgatgggtgtgc

SEQ ID NO: 8176593 - DNA, 22 bp, Homo sapiens
aacagagcttgggtcatctcat

SEQ ID NO: 8176594 - DNA, 22 bp, Homo sapiens
aaggtccttttgcagtgtgatc

SEQ ID NO: 8176595 - DNA, 22 bp, Homo sapiens
aacagcatcaccccataacatt

SEQ ID NO: 8176596 - DNA, 22 bp, Homo sapiens
aacagcatatttcatatattga

SEQ ID NO: 8176597 - DNA, 22 bp, Homo sapiens
aacagcataccaatgtacatat

SEQ ID NO: 8176598 - DNA, 22 bp, Homo sapiens
aacagcagggatgacatggcca

SEQ ID NO: 8176599 - DNA, 22 bp, Homo sapiens
aacagcagggacttgaatggaa

SEQ ID NO: 8176600 - DNA, 22 bp, Homo sapiens
aacagcagggacttgaatggaa

SEQ ID NO: 8176601 - DNA, 22 bp, Homo sapiens
aacagcaggtcctggcatgggt

SEQ ID NO: 8176602 - DNA, 22 bp, Homo sapiens
aacagcagggggacctgctggt

SEQ ID NO: 8176603 - DNA, 22 bp, Homo sapiens
aacagcctcagtgagattagga

SEQ ID NO: 8176604 - DNA, 22 bp, Homo sapiens
aagtcattatctcttctaatct

SEQ ID NO: 8176605 - DNA, 22 bp, Homo sapiens
aagtcatgagtcctcttctgtg

SEQ ID NO: 8176606 - DNA, 22 bp, Homo sapiens
aagtcatcttgagtctaagatt

SEQ ID NO: 8176607 - DNA, 22 bp, Homo sapiens
aagtcattggtagcttgatagg

SEQ ID NO: 8176608 - DNA, 22 bp, Homo sapiens
aagtcattggtagcttgatagg

SEQ ID NO: 8176609 - DNA, 22 bp, Homo sapiens
aagtccaaggctgggtgcagtg

SEQ ID NO: 8176610 - DNA, 22 bp, Homo sapiens
aagtccaaggtcaccattcaca

SEQ ID NO: 8176611 - DNA, 22 bp, Homo sapiens
aagtccaggtccaggaggttcc

SEQ ID NO: 8176612 - DNA, 22 bp, Homo sapiens
aacagcttgaggaatatcatca

SEQ ID NO: 8176613 - DNA, 22 bp, Homo sapiens
aacaggaatgaggagaaaaggt

SEQ ID NO: 8176614 - DNA, 22 bp, Homo sapiens
aacagcttgaggaatatcatca

SEQ ID NO: 8176615 - DNA, 22 bp, Homo sapiens
aacagcttgaggaatatcatca

SEQ ID NO: 8176616 - DNA, 22 bp, Homo sapiens
aacaggaattgatgggagtcct

SEQ ID NO: 8176617 - DNA, 22 bp, Homo sapiens
aacaaagtttcaggaagataga

SEQ ID NO: 8176618 - DNA, 22 bp, Homo sapiens
aacaaatgacctgatttcttcc

SEQ ID NO: 8176619 - DNA, 22 bp, Homo sapiens
aacaaatgataccagttctcaa

SEQ ID NO: 8176620 - DNA, 22 bp, Homo sapiens
aacaaatgacctgatttcttcc

SEQ ID NO: 8176621 - DNA, 22 bp, Homo sapiens
aacaaatgacctgatttcttcc

SEQ ID NO: 8176622 - DNA, 22 bp, Homo sapiens
aacaaatggggccttgtatgaa

SEQ ID NO: 8176623 - DNA, 22 bp, Homo sapiens
aacaaatggggccttgtatgaa

SEQ ID NO: 8176624 - DNA, 22 bp, Homo sapiens
aacaaatggaacacaaatcttt

SEQ ID NO: 8176625 - DNA, 22 bp, Homo sapiens
aacaaatgattgttggttggag

SEQ ID NO: 8176626 - DNA, 22 bp, Homo sapiens
aacaaatgtaaaatgcagatgc

SEQ ID NO: 8176627 - DNA, 22 bp, Homo sapiens
aacaccagtcccaagagaggct

SEQ ID NO: 8176628 - DNA, 19 bp, Homo sapiens
aacaccagagtcaggagtc

SEQ ID NO: 8176629 - DNA, 22 bp, Homo sapiens
aacactctctgttggtaaggct

SEQ ID NO: 8176630 - DNA, 22 bp, Homo sapiens
aacactctctgttggtaaggct

SEQ ID NO: 8176631 - DNA, 22 bp, Homo sapiens
aacactgaaacattgattgaca

SEQ ID NO: 8176632 - DNA, 22 bp, Homo sapiens
aaggtcactgatcagttgagta

SEQ ID NO: 8176633 - DNA, 22 bp, Homo sapiens
aaggtcaacactgattttagtc

SEQ ID NO: 8176634 - DNA, 22 bp, Homo sapiens
aaggtcaaagacagtaactttt

SEQ ID NO: 8176635 - DNA, 22 bp, Homo sapiens
aaggtcaagacacaggaatcta

SEQ ID NO: 8176636 - DNA, 22 bp, Homo sapiens
aaggtcaaagacagtaactttt

SEQ ID NO: 8176637 - DNA, 22 bp, Homo sapiens
aaggtcaagacacaggaatcta

SEQ ID NO: 8176638 - DNA, 22 bp, Homo sapiens
aaggtatcagtaaagctctgcc

SEQ ID NO: 8176639 - DNA, 22 bp, Homo sapiens
aacactgagaacaatacagagt

SEQ ID NO: 8176640 - DNA, 22 bp, Homo sapiens
aacactgacgacgtgaactaaa

SEQ ID NO: 8176641 - DNA, 22 bp, Homo sapiens
aacactgacgacgtgaactaaa

SEQ ID NO: 8176642 - DNA, 22 bp, Homo sapiens
aacactgacgacgtgaactaaa

SEQ ID NO: 8176643 - DNA, 22 bp, Homo sapiens
aacactgaagaccaggtaattt

SEQ ID NO: 8176644 - DNA, 22 bp, Homo sapiens
aacactgaaatgtcttaagatt

SEQ ID NO: 8176645 - DNA, 22 bp, Homo sapiens
aacactgacctctaccctcagt

SEQ ID NO: 8176646 - DNA, 22 bp, Homo sapiens
aaatgttttgctcccatgtggt

SEQ ID NO: 8176647 - DNA, 22 bp, Homo sapiens
aaatgtttaagtgtaggagcaa

SEQ ID NO: 8176648 - DNA, 22 bp, Homo sapiens
aaatgtttctacttgtgagcat

SEQ ID NO: 8176649 - DNA, 22 bp, Homo sapiens
aaatgtttctacttgtgagcat

SEQ ID NO: 8176650 - DNA, 22 bp, Homo sapiens
aaatgtttctacttgtgagcat

SEQ ID NO: 8176651 - DNA, 22 bp, Homo sapiens
aaattccattttgtgactattc

SEQ ID NO: 8176652 - DNA, 22 bp, Homo sapiens
aaattccattttgtgactattc

SEQ ID NO: 8176653 - DNA, 22 bp, Homo sapiens
aaatgtgtttagatggtttatt

SEQ ID NO: 8176654 - DNA, 22 bp, Homo sapiens
aaatgtgtttgataggaatatt

SEQ ID NO: 8176655 - DNA, 22 bp, Homo sapiens
aaatgtgtttctttgtgaatgg

SEQ ID NO: 8176656 - DNA, 22 bp, Homo sapiens
aaatgtgtttgataggaatatt

SEQ ID NO: 8176657 - DNA, 22 bp, Homo sapiens
aaatgttcccaatatgaagctg

SEQ ID NO: 8176658 - DNA, 22 bp, Homo sapiens
aaatgttcccaatatgaagctg

SEQ ID NO: 8176659 - DNA, 22 bp, Homo sapiens
aaatgttccgggtaaggagaaa

SEQ ID NO: 8176660 - DNA, 22 bp, Homo sapiens
aaatgtctatctggcatattcc

SEQ ID NO: 8176661 - DNA, 19 bp, Homo sapiens
aaatgtgatggtacaattc

SEQ ID NO: 8176662 - DNA, 19 bp, Homo sapiens
aaatgtgatggtacaattc

SEQ ID NO: 8176663 - DNA, 22 bp, Homo sapiens
aagctgaggtcaagtagctagt

SEQ ID NO: 8176664 - DNA, 22 bp, Homo sapiens
aagctgaggcccatggcaaggt

SEQ ID NO: 8176665 - DNA, 22 bp, Homo sapiens
aagctgaggctcccctgaggga

SEQ ID NO: 8176666 - DNA, 19 bp, Homo sapiens
aagctgagggctgtccacc

SEQ ID NO: 8176667 - DNA, 22 bp, Homo sapiens
aagctgagccagtggcaagtgc

SEQ ID NO: 8176668 - DNA, 22 bp, Homo sapiens
aagctgagccagtggcaagtgc

SEQ ID NO: 8176669 - DNA, 22 bp, Homo sapiens
aaatgtgtgtatgtacatatat

SEQ ID NO: 8176670 - DNA, 22 bp, Homo sapiens
aaatgtgtgtatgtacatatat

SEQ ID NO: 8176671 - DNA, 22 bp, Homo sapiens
aaattttagaccaggcaaaact

SEQ ID NO: 8176672 - DNA, 22 bp, Homo sapiens
aaattgcattcaggatgcagga

SEQ ID NO: 8176673 - DNA, 22 bp, Homo sapiens
aaattgcattcaggatgcagga

SEQ ID NO: 8176674 - DNA, 22 bp, Homo sapiens
aacaaacagttaagtgtggatg

SEQ ID NO: 8176675 - DNA, 22 bp, Homo sapiens
aacaaacattacctggtgctgg

SEQ ID NO: 8176676 - DNA, 22 bp, Homo sapiens
aacaaacattacctggtgctgg

SEQ ID NO: 8176677 - DNA, 22 bp, Homo sapiens
aacaaacattacctggtgctgg

SEQ ID NO: 8176678 - DNA, 20 bp, Homo sapiens
aacaaactacaaaattatgt

SEQ ID NO: 8176679 - DNA, 20 bp, Homo sapiens
aacaaactacaaaattatgt

SEQ ID NO: 8176680 - DNA, 22 bp, Homo sapiens
aacaaagatgggtgggaaagag

SEQ ID NO: 8176681 - DNA, 22 bp, Homo sapiens
aacaaagcaccactgagtcagt

SEQ ID NO: 8176682 - DNA, 22 bp, Homo sapiens
aacaaagatgggtgggaaagag

SEQ ID NO: 8176683 - DNA, 22 bp, Homo sapiens
aacaaagatgggtgggaaagag

SEQ ID NO: 8176684 - DNA, 22 bp, Homo sapiens
aacaaagtagctgctgttctta

SEQ ID NO: 8176685 - DNA, 22 bp, Homo sapiens
aacaaagccctgcccaagagct

SEQ ID NO: 8176686 - DNA, 22 bp, Homo sapiens
aacaaaggccgttaataaccac

SEQ ID NO: 8176687 - DNA, 22 bp, Homo sapiens
aaattctatgtcaatgtttatt

SEQ ID NO: 8176688 - DNA, 22 bp, Homo sapiens
aaattctatgtcaatgtttatt

SEQ ID NO: 8176689 - DNA, 22 bp, Homo sapiens
aaattctaaggtcacaatgttg

SEQ ID NO: 8176690 - DNA, 22 bp, Homo sapiens
aaattctaaggtcacaatgttg

SEQ ID NO: 8176691 - DNA, 22 bp, Homo sapiens
aaattctaaggtcacaatgttg

SEQ ID NO: 8176692 - DNA, 22 bp, Homo sapiens
aaattctaaggtcacaatgttg

SEQ ID NO: 8176693 - DNA, 22 bp, Homo sapiens
aaattctctaaagaaaacatga

SEQ ID NO: 8176694 - DNA, 22 bp, Homo sapiens
aaattctcaagtgatcctgttg

SEQ ID NO: 8176695 - DNA, 22 bp, Homo sapiens
aaattctatgtcaatgtttatt

SEQ ID NO: 8176696 - DNA, 22 bp, Homo sapiens
aaattctgtcctgaatgccatt

SEQ ID NO: 8176697 - DNA, 22 bp, Homo sapiens
aaattctggcctatcacagtga

SEQ ID NO: 8176698 - DNA, 19 bp, Homo sapiens
aaattctgacagtctttta

SEQ ID NO: 8176699 - DNA, 22 bp, Homo sapiens
aaattctggcctatcacagtga

SEQ ID NO: 8176700 - DNA, 22 bp, Homo sapiens
aaattctgatttaataagtgta

SEQ ID NO: 8176701 - DNA, 22 bp, Homo sapiens
aaattctgcaatttgacaagat

SEQ ID NO: 8176702 - DNA, 22 bp, Homo sapiens
aaattctgcaatttgacaagat

SEQ ID NO: 8176703 - DNA, 22 bp, Homo sapiens
aaattgcacaatatagacatga

SEQ ID NO: 8176704 - DNA, 22 bp, Homo sapiens
aaattgatgttcccagttgaaa

SEQ ID NO: 8176705 - DNA, 22 bp, Homo sapiens
aaattgcaaaagtacttttagg

SEQ ID NO: 8176706 - DNA, 22 bp, Homo sapiens
aaattgatgttcccagttgaaa

SEQ ID NO: 8176707 - DNA, 22 bp, Homo sapiens
aaattgaatttgggaaacattg

SEQ ID NO: 8176708 - DNA, 22 bp, Homo sapiens
aaattctttggcctactttgaa

SEQ ID NO: 8176709 - DNA, 22 bp, Homo sapiens
aaattgaatgattaagtggtga

SEQ ID NO: 8176710 - DNA, 22 bp, Homo sapiens
aaattctttcatggctaataag

SEQ ID NO: 8176711 - DNA, 22 bp, Homo sapiens
aaattctttcatggctaataag

SEQ ID NO: 8176712 - DNA, 22 bp, Homo sapiens
aaattctttcatggctaataag

SEQ ID NO: 8176713 - DNA, 22 bp, Homo sapiens
aaattctttcatggctaataag

SEQ ID NO: 8176714 - DNA, 22 bp, Homo sapiens
aaattctttggcctactttgaa

SEQ ID NO: 8176715 - DNA, 22 bp, Homo sapiens
aaattctttggcctactttgaa

SEQ ID NO: 8176716 - DNA, 22 bp, Homo sapiens
aacatgaaacccaaacagaata

SEQ ID NO: 8176717 - DNA, 22 bp, Homo sapiens
aacatgaaacccaaacagaata

SEQ ID NO: 8176718 - DNA, 22 bp, Homo sapiens
aacagtaaaaatcatttagttg

SEQ ID NO: 8176719 - DNA, 22 bp, Homo sapiens
aacagtaaaaatcatttagttg

SEQ ID NO: 8176720 - DNA, 22 bp, Homo sapiens
aacatgctatgtgtctgaatca

SEQ ID NO: 8176721 - DNA, 22 bp, Homo sapiens
aacatgctatgtgtctgaatca

SEQ ID NO: 8176722 - DNA, 18 bp, Homo sapiens
aacatgcattagaactgc

SEQ ID NO: 8176723 - DNA, 18 bp, Homo sapiens
aacatgcattagaactgc

SEQ ID NO: 8176724 - DNA, 18 bp, Homo sapiens
aacatgcattagaactgc

SEQ ID NO: 8176725 - DNA, 22 bp, Homo sapiens
aacatgcatgttatttatcagt

SEQ ID NO: 8176726 - DNA, 22 bp, Homo sapiens
aacatgcatgaagaagttatat

SEQ ID NO: 8176727 - DNA, 22 bp, Homo sapiens
aacatgcttgcttagaatcagc

SEQ ID NO: 8176728 - DNA, 22 bp, Homo sapiens
aacatgcttgcttagaatcagc

SEQ ID NO: 8176729 - DNA, 22 bp, Homo sapiens
aacatgctgggtgtttttgatg

SEQ ID NO: 8176730 - DNA, 22 bp, Homo sapiens
aacatgctgggtgtttttgatg

SEQ ID NO: 8176731 - DNA, 22 bp, Homo sapiens
aacatgctgcctttctacgagt

SEQ ID NO: 8176732 - DNA, 22 bp, Homo sapiens
aacatgctgcctttctacgagt

SEQ ID NO: 8176733 - DNA, 22 bp, Homo sapiens
aacatgctgcctttctacgagt

SEQ ID NO: 8176734 - DNA, 22 bp, Homo sapiens
aacatgctcttcctggctagtc

SEQ ID NO: 8176735 - DNA, 22 bp, Homo sapiens
aacatgctctgtttcttggatg

SEQ ID NO: 8176736 - DNA, 22 bp, Homo sapiens
aacatgctctgtttcttggatg

SEQ ID NO: 8176737 - DNA, 22 bp, Homo sapiens
aacatgctctggattgctgtga

SEQ ID NO: 8176738 - DNA, 20 bp, Homo sapiens
aacagggcagaagcggagac

SEQ ID NO: 8176739 - DNA, 22 bp, Homo sapiens
aacagggctttggaagtctccg

SEQ ID NO: 8176740 - DNA, 20 bp, Homo sapiens
aacagggcagaagcggagac

SEQ ID NO: 8176741 - DNA, 22 bp, Homo sapiens
aacaggcttttggaaagttaca

SEQ ID NO: 8176742 - DNA, 22 bp, Homo sapiens
aacaggctggccttgaagcagt

SEQ ID NO: 8176743 - DNA, 22 bp, Homo sapiens
aacaggcttcttctgggctcct

SEQ ID NO: 8176744 - DNA, 22 bp, Homo sapiens
aacaggcaggagaattctgcct

SEQ ID NO: 8176745 - DNA, 22 bp, Homo sapiens
aacaggcaggagaattctgcct

SEQ ID NO: 8176746 - DNA, 22 bp, Homo sapiens
aacaggcagcagactgaatctg

SEQ ID NO: 8176747 - DNA, 22 bp, Homo sapiens
aacaggcctatagggaaggcgc

SEQ ID NO: 8176748 - DNA, 22 bp, Homo sapiens
aacaggccttgtttttgttcat

SEQ ID NO: 8176749 - DNA, 22 bp, Homo sapiens
aacaggctagttttaaagcata

SEQ ID NO: 8176750 - DNA, 22 bp, Homo sapiens
aacaggagaggggaatgtagag

SEQ ID NO: 8176751 - DNA, 22 bp, Homo sapiens
aacaggaattgcaggcagatct

SEQ ID NO: 8176752 - DNA, 22 bp, Homo sapiens
aacaggaattgcaggcagatct

SEQ ID NO: 8176753 - DNA, 22 bp, Homo sapiens
aacaggaggccttccagtccag

SEQ ID NO: 8176754 - DNA, 22 bp, Homo sapiens
aacaggagtcattgtcattatt

SEQ ID NO: 8176755 - DNA, 22 bp, Homo sapiens
aacaggagtcattgtcattatt

SEQ ID NO: 8176756 - DNA, 22 bp, Homo sapiens
aacaggagagtaaatatatgat

SEQ ID NO: 8176757 - DNA, 22 bp, Homo sapiens
aacaggagaggggaatgtagag

SEQ ID NO: 8176758 - DNA, 22 bp, Homo sapiens
aacaggagagtaaatatatgat

SEQ ID NO: 8176759 - DNA, 22 bp, Homo sapiens
aacaggaggccttccagtccag

SEQ ID NO: 8176760 - DNA, 22 bp, Homo sapiens
aacaggcaacagttgactctga

SEQ ID NO: 8176761 - DNA, 22 bp, Homo sapiens
aacaggcaatttaggactcttt

SEQ ID NO: 8176762 - DNA, 22 bp, Homo sapiens
aacaggcaacagttgactctga

SEQ ID NO: 8176763 - DNA, 22 bp, Homo sapiens
aacaggcaatttaggactcttt

SEQ ID NO: 8176764 - DNA, 22 bp, Homo sapiens
aacaggagtcattgtcattatt

SEQ ID NO: 8176765 - DNA, 22 bp, Homo sapiens
aacaggcaaactgtgggatccc

SEQ ID NO: 8176766 - DNA, 22 bp, Homo sapiens
aacaggcaacagttgactctga

SEQ ID NO: 8176767 - DNA, 21 bp, Homo sapiens
aacatttcaggatccaaattg

SEQ ID NO: 8176768 - DNA, 22 bp, Homo sapiens
aacatttttaagaccaagtgct

SEQ ID NO: 8176769 - DNA, 20 bp, Homo sapiens
aaccaacagaatcatgtctc

SEQ ID NO: 8176770 - DNA, 22 bp, Homo sapiens
aataagaaagagtcagcttcag

SEQ ID NO: 8176771 - DNA, 22 bp, Homo sapiens
aataacttttaaaagaccctgg

SEQ ID NO: 8176772 - DNA, 22 bp, Homo sapiens
aataagaacaactaaggtttat

SEQ ID NO: 8176773 - DNA, 22 bp, Homo sapiens
aataagaacaactaaggtttat

SEQ ID NO: 8176774 - DNA, 22 bp, Homo sapiens
aataagaacaactaaggtttat

SEQ ID NO: 8176775 - DNA, 22 bp, Homo sapiens
aataagaacaactaaggtttat

SEQ ID NO: 8176776 - DNA, 22 bp, Homo sapiens
aataagaactccatttactcgt

SEQ ID NO: 8176777 - DNA, 22 bp, Homo sapiens
aataagaactccatttactcgt

SEQ ID NO: 8176778 - DNA, 22 bp, Homo sapiens
aataacttcatgtaacatttaa

SEQ ID NO: 8176779 - DNA, 22 bp, Homo sapiens
aataacttcatgtaacatttaa

SEQ ID NO: 8176780 - DNA, 22 bp, Homo sapiens
aataacttcatcttcaggatag

SEQ ID NO: 8176781 - DNA, 22 bp, Homo sapiens
aataacttcatcttcaggatag

SEQ ID NO: 8176782 - DNA, 22 bp, Homo sapiens
aataacttgaagatctcttcca

SEQ ID NO: 8176783 - DNA, 22 bp, Homo sapiens
aataacttgaagatctcttcca

SEQ ID NO: 8176784 - DNA, 22 bp, Homo sapiens
aataacttgtatggttattcca

SEQ ID NO: 8176785 - DNA, 22 bp, Homo sapiens
aataacttgtatggttattcca

SEQ ID NO: 8176786 - DNA, 22 bp, Homo sapiens
aacatgtaaatatcattgtact

SEQ ID NO: 8176787 - DNA, 22 bp, Homo sapiens
aataacttcagttcttacatta

SEQ ID NO: 8176788 - DNA, 22 bp, Homo sapiens
aataacttcagttcttacatta

SEQ ID NO: 8176789 - DNA, 22 bp, Homo sapiens
aataacttcagttcttacatta

SEQ ID NO: 8176790 - DNA, 19 bp, Homo sapiens
aacatggaactggagaggg

SEQ ID NO: 8176791 - DNA, 22 bp, Homo sapiens
aacatgtaaatatcattgtact

SEQ ID NO: 8176792 - DNA, 22 bp, Homo sapiens
aacatgtaaatatcattgtact

SEQ ID NO: 8176793 - DNA, 22 bp, Homo sapiens
aacatgctttgataaataaaag

SEQ ID NO: 8176794 - DNA, 22 bp, Homo sapiens
aacatgctttgataaataaaag

SEQ ID NO: 8176795 - DNA, 22 bp, Homo sapiens
aacatgctttgataaataaaag

SEQ ID NO: 8176796 - DNA, 22 bp, Homo sapiens
aatagttaagcaactttttcca

SEQ ID NO: 8176797 - DNA, 22 bp, Homo sapiens
aaccagaggggccctgcctggg

SEQ ID NO: 8176798 - DNA, 21 bp, Homo sapiens
aaccagagccaggctctcagc

SEQ ID NO: 8176799 - DNA, 22 bp, Homo sapiens
aatagtttgaatttatcagatg

SEQ ID NO: 8176800 - DNA, 22 bp, Homo sapiens
aatagtttgaatttatcagatg

SEQ ID NO: 8176801 - DNA, 22 bp, Homo sapiens
aatagtttgaatttatcagatg

SEQ ID NO: 8176802 - DNA, 22 bp, Homo sapiens
aatataaattcctgggcccagc

SEQ ID NO: 8176803 - DNA, 22 bp, Homo sapiens
aatataaattcctgggcccagc

SEQ ID NO: 8176804 - DNA, 22 bp, Homo sapiens
aatataaattcctgggcccagc

SEQ ID NO: 8176805 - DNA, 22 bp, Homo sapiens
aatataaattcctgggcccagc

SEQ ID NO: 8176806 - DNA, 22 bp, Homo sapiens
aaccacaacactaaatgctggt

SEQ ID NO: 8176807 - DNA, 22 bp, Homo sapiens
aaccacaacactaaatgctggt

SEQ ID NO: 8176808 - DNA, 22 bp, Homo sapiens
aaccacagacccagactagaga

SEQ ID NO: 8176809 - DNA, 22 bp, Homo sapiens
aaccacagacccagactagaga

SEQ ID NO: 8176810 - DNA, 22 bp, Homo sapiens
aaccacagagccccctcagatg

SEQ ID NO: 8176811 - DNA, 22 bp, Homo sapiens
aaccaccattctctcctcttcc

SEQ ID NO: 8176812 - DNA, 22 bp, Homo sapiens
aactgcataatatatcatgcag

SEQ ID NO: 8176813 - DNA, 22 bp, Homo sapiens
aactgcagttaacaagtcttca

SEQ ID NO: 8176814 - DNA, 22 bp, Homo sapiens
aactgcattgtactaaacttgt

SEQ ID NO: 8176815 - DNA, 22 bp, Homo sapiens
aactgcaattacttttgcacta

SEQ ID NO: 8176816 - DNA, 22 bp, Homo sapiens
aactgcaattacttttgcacta

SEQ ID NO: 8176817 - DNA, 22 bp, Homo sapiens
aactgcaattacttttgcacca

SEQ ID NO: 8176818 - DNA, 22 bp, Homo sapiens
aactgcaatcacttttgcacca

SEQ ID NO: 8176819 - DNA, 22 bp, Homo sapiens
aactgcaattacttttgcacca

SEQ ID NO: 8176820 - DNA, 22 bp, Homo sapiens
aactgcaatcacttttgcacca

SEQ ID NO: 8176821 - DNA, 22 bp, Homo sapiens
aactgaaacggtgatcttttaa

SEQ ID NO: 8176822 - DNA, 22 bp, Homo sapiens
aatcattcttatttcacagcaa

SEQ ID NO: 8176823 - DNA, 22 bp, Homo sapiens
aatcattctcatgccagtttcc

SEQ ID NO: 8176824 - DNA, 22 bp, Homo sapiens
aatcatgtttcagatgagtttt

SEQ ID NO: 8176825 - DNA, 22 bp, Homo sapiens
aatcatgtttacgtgacatgtc

SEQ ID NO: 8176826 - DNA, 22 bp, Homo sapiens
aatcattgttgtcgttcctaga

SEQ ID NO: 8176827 - DNA, 22 bp, Homo sapiens
aatcattgttcttcagatttga

SEQ ID NO: 8176828 - DNA, 22 bp, Homo sapiens
aatccaatcctactcagaaagt

SEQ ID NO: 8176829 - DNA, 22 bp, Homo sapiens
aatcattgagacaaattagctt

SEQ ID NO: 8176830 - DNA, 22 bp, Homo sapiens
aatcattgtaaatggttttgtt

SEQ ID NO: 8176831 - DNA, 22 bp, Homo sapiens
aatcattgctcctttctctggt

SEQ ID NO: 8176832 - DNA, 22 bp, Homo sapiens
aatcatcacgaacacaacagcg

SEQ ID NO: 8176833 - DNA, 21 bp, Homo sapiens
aatcatacaaaacatgtcagg

SEQ ID NO: 8176834 - DNA, 21 bp, Homo sapiens
aatcatacaaaacatgtcagg

SEQ ID NO: 8176835 - DNA, 22 bp, Homo sapiens
aatcatcctgaagtcaataaag

SEQ ID NO: 8176836 - DNA, 22 bp, Homo sapiens
aatcatctccgaaaaaagagta

SEQ ID NO: 8176837 - DNA, 22 bp, Homo sapiens
aatcatggcgtgtttagcttaa

SEQ ID NO: 8176838 - DNA, 22 bp, Homo sapiens
aatcatgaaatatcagttcttt

SEQ ID NO: 8176839 - DNA, 22 bp, Homo sapiens
aatcataattttgtgaatgtag

SEQ ID NO: 8176840 - DNA, 22 bp, Homo sapiens
aatcataattttgtgaatgtag

SEQ ID NO: 8176841 - DNA, 22 bp, Homo sapiens
aactacattgtcctttctgaag

SEQ ID NO: 8176842 - DNA, 19 bp, Homo sapiens
aactacagcgcactgtcct

SEQ ID NO: 8176843 - DNA, 22 bp, Homo sapiens
aactacagggggtggcaggcgg

SEQ ID NO: 8176844 - DNA, 22 bp, Homo sapiens
aactacagctcttgtctttctg

SEQ ID NO: 8176845 - DNA, 22 bp, Homo sapiens
aactacagtatgtccaaagaat

SEQ ID NO: 8176846 - DNA, 22 bp, Homo sapiens
aactacagtagtttgcccttct

SEQ ID NO: 8176847 - DNA, 22 bp, Homo sapiens
aactacagtgggcagaggcaat

SEQ ID NO: 8176848 - DNA, 22 bp, Homo sapiens
aactacagtgggcagaggcaat

SEQ ID NO: 8176849 - DNA, 21 bp, Homo sapiens
aactacagttgttccttcatt

SEQ ID NO: 8176850 - DNA, 22 bp, Homo sapiens
aactacagaatcatagaaaata

SEQ ID NO: 8176851 - DNA, 22 bp, Homo sapiens
aactacagcatctatacaaata

SEQ ID NO: 8176852 - DNA, 22 bp, Homo sapiens
aactacagaaaaggtaagctct

SEQ ID NO: 8176853 - DNA, 22 bp, Homo sapiens
aactacaatatgtatgtatgta

SEQ ID NO: 8176854 - DNA, 22 bp, Homo sapiens
aatataatgctgttttatgcca

SEQ ID NO: 8176855 - DNA, 22 bp, Homo sapiens
aatataatgctgttttatgcca

SEQ ID NO: 8176856 - DNA, 22 bp, Homo sapiens
aatataatgctgttttatgcca

SEQ ID NO: 8176857 - DNA, 20 bp, Homo sapiens
aatataattctctgaattta

SEQ ID NO: 8176858 - DNA, 22 bp, Homo sapiens
aatataatgctgttttatgcca

SEQ ID NO: 8176859 - DNA, 22 bp, Homo sapiens
aactgctctgcatgcaatggaa

SEQ ID NO: 8176860 - DNA, 22 bp, Homo sapiens
aactgctcatttgagagtatgc

SEQ ID NO: 8176861 - DNA, 21 bp, Homo sapiens
aactgctggtcttttctgtct

SEQ ID NO: 8176862 - DNA, 22 bp, Homo sapiens
aactgctgtggcctagtactta

SEQ ID NO: 8176863 - DNA, 22 bp, Homo sapiens
aactgcttagtgatggatgacc

SEQ ID NO: 8176864 - DNA, 22 bp, Homo sapiens
aactgcatttaacaaatactct

SEQ ID NO: 8176865 - DNA, 21 bp, Homo sapiens
aactgcttcccatcttagggc

SEQ ID NO: 8176866 - DNA, 22 bp, Homo sapiens
aactgcttccttggcaggcatg

SEQ ID NO: 8176867 - DNA, 19 bp, Homo sapiens
aactgcttctgaaggagcc

SEQ ID NO: 8176868 - DNA, 22 bp, Homo sapiens
aactgcttcttactgctgggca

SEQ ID NO: 8176869 - DNA, 22 bp, Homo sapiens
aactgcttcacttggcatttgg

SEQ ID NO: 8176870 - DNA, 22 bp, Homo sapiens
aactgcttatctttggtagatg

SEQ ID NO: 8176871 - DNA, 22 bp, Homo sapiens
aactgcttcaagtctgtgggga

SEQ ID NO: 8176872 - DNA, 22 bp, Homo sapiens
aactgcttatctttggtagatg

SEQ ID NO: 8176873 - DNA, 22 bp, Homo sapiens
aatgatatagcagacatagcct

SEQ ID NO: 8176874 - DNA, 22 bp, Homo sapiens
aatgatatgcaaattatcatca

SEQ ID NO: 8176875 - DNA, 22 bp, Homo sapiens
aatgatatgcaaattatcatca

SEQ ID NO: 8176876 - DNA, 22 bp, Homo sapiens
aatgatatagcagacatagcct

SEQ ID NO: 8176877 - DNA, 22 bp, Homo sapiens
aatgatatgcaaattatcatca

SEQ ID NO: 8176878 - DNA, 22 bp, Homo sapiens
aatgatcacctggtaaagagag

SEQ ID NO: 8176879 - DNA, 22 bp, Homo sapiens
aatgatatttattgaatagatg

SEQ ID NO: 8176880 - DNA, 22 bp, Homo sapiens
aatgatatttattgaatagatg

SEQ ID NO: 8176881 - DNA, 22 bp, Homo sapiens
aatgatcattataaagtgctct

SEQ ID NO: 8176882 - DNA, 22 bp, Homo sapiens
aacttaaacccactcatgtaga

SEQ ID NO: 8176883 - DNA, 22 bp, Homo sapiens
aacttaaacccactcatgtaga

SEQ ID NO: 8176884 - DNA, 22 bp, Homo sapiens
aacttaaacccactcatgtaga

SEQ ID NO: 8176885 - DNA, 23 bp, Homo sapiens
aacttaatactgggataagatgc

SEQ ID NO: 8176886 - DNA, 22 bp, Homo sapiens
aacttacaaggatgatagctgc

SEQ ID NO: 8176887 - DNA, 22 bp, Homo sapiens
aacttacaaggatgatagctgc

SEQ ID NO: 8176888 - DNA, 22 bp, Homo sapiens
aacttaatgatttcatgcatgt

SEQ ID NO: 8176889 - DNA, 23 bp, Homo sapiens
aacttaatactgggataagatgc

SEQ ID NO: 8176890 - DNA, 22 bp, Homo sapiens
aacttaatccaacacgggcatc

SEQ ID NO: 8176891 - DNA, 22 bp, Homo sapiens
aacttacaatgttagagtctca

SEQ ID NO: 8176892 - DNA, 22 bp, Homo sapiens
aactgtttcagaaatattgttg

SEQ ID NO: 8176893 - DNA, 22 bp, Homo sapiens
aactgtttatgtaagtatgcag

SEQ ID NO: 8176894 - DNA, 22 bp, Homo sapiens
aactgtttggaactcttccaca

SEQ ID NO: 8176895 - DNA, 22 bp, Homo sapiens
aactgtttttcacgtgtctcat

SEQ ID NO: 8176896 - DNA, 22 bp, Homo sapiens
aactgttcttcattttcagtat

SEQ ID NO: 8176897 - DNA, 19 bp, Homo sapiens
aactgtaaagatctgtagc

SEQ ID NO: 8176898 - DNA, 22 bp, Homo sapiens
acagcagctaacccctgggcca

SEQ ID NO: 8176899 - DNA, 22 bp, Homo sapiens
acagcagctaacccctgggcca

SEQ ID NO: 8176900 - DNA, 22 bp, Homo sapiens
aagcatttcaggtagagatatt

SEQ ID NO: 8176901 - DNA, 22 bp, Homo sapiens
aagcatttcaggtagagatatt

SEQ ID NO: 8176902 - DNA, 22 bp, Homo sapiens
aagcatttcaggtagagatatt

SEQ ID NO: 8176903 - DNA, 23 bp, Homo sapiens
aagcatggttcacagttagtact

SEQ ID NO: 8176904 - DNA, 19 bp, Homo sapiens
aagcattagccaaagcatt

SEQ ID NO: 8176905 - DNA, 22 bp, Homo sapiens
aagcatttcaatataatattca

SEQ ID NO: 8176906 - DNA, 22 bp, Homo sapiens
aagcatttatagataagaattt

SEQ ID NO: 8176907 - DNA, 22 bp, Homo sapiens
aagcatttatagataagaattt

SEQ ID NO: 8176908 - DNA, 22 bp, Homo sapiens
aagcattgtaagcagaagatgc

SEQ ID NO: 8176909 - DNA, 17 bp, Homo sapiens
aagcatttaatttgcta

SEQ ID NO: 8176910 - DNA, 22 bp, Homo sapiens
acagcagctgccttcaggctct

SEQ ID NO: 8176911 - DNA, 22 bp, Homo sapiens
acagcagctgccttcaggctct

SEQ ID NO: 8176912 - DNA, 22 bp, Homo sapiens
acagcagctgccttcaggctct

SEQ ID NO: 8176913 - DNA, 22 bp, Homo sapiens
acagcagctgggttcccaccat

SEQ ID NO: 8176914 - DNA, 22 bp, Homo sapiens
acagcagctgggttcccaccat

SEQ ID NO: 8176915 - DNA, 22 bp, Homo sapiens
acagcagctgggttcccaccat

SEQ ID NO: 8176916 - DNA, 22 bp, Homo sapiens
acagcagcttgcgtgtctggtc

SEQ ID NO: 8176917 - DNA, 22 bp, Homo sapiens
acagcagcttgcgtgtctggtc

SEQ ID NO: 8176918 - DNA, 22 bp, Homo sapiens
acagcaggaagctggagggaaa

SEQ ID NO: 8176919 - DNA, 22 bp, Homo sapiens
acagcagcttgcgtgtctggtc

SEQ ID NO: 8176920 - DNA, 22 bp, Homo sapiens
acagcagcttgtctgttcttta

SEQ ID NO: 8176921 - DNA, 22 bp, Homo sapiens
aagccaggagcgaggcctcggc

SEQ ID NO: 8176922 - DNA, 22 bp, Homo sapiens
aagccaggaccaaactcatcct

SEQ ID NO: 8176923 - DNA, 22 bp, Homo sapiens
aagccaggaatggagtcttcgc

SEQ ID NO: 8176924 - DNA, 22 bp, Homo sapiens
aagccaggaagggagctgtccc

SEQ ID NO: 8176925 - DNA, 22 bp, Homo sapiens
aagccaggagcgaggcctcggc

SEQ ID NO: 8176926 - DNA, 19 bp, Homo sapiens
aagccagctgccagctcgg

SEQ ID NO: 8176927 - DNA, 22 bp, Homo sapiens
aagccaggaagagagccttcac

SEQ ID NO: 8176928 - DNA, 22 bp, Homo sapiens
aagccaggaagggagctgtccc

SEQ ID NO: 8176929 - DNA, 22 bp, Homo sapiens
aagccaggaagagagccttcac

SEQ ID NO: 8176930 - DNA, 22 bp, Homo sapiens
aagccaatcgtgtgaacttagt

SEQ ID NO: 8176931 - DNA, 22 bp, Homo sapiens
aagccagcctgtttccttcttc

SEQ ID NO: 8176932 - DNA, 22 bp, Homo sapiens
acagagtagctcaagaagattg

SEQ ID NO: 8176933 - DNA, 22 bp, Homo sapiens
acagagtacattcagagactat

SEQ ID NO: 8176934 - DNA, 22 bp, Homo sapiens
acagaggtttccattgaggttt

SEQ ID NO: 8176935 - DNA, 21 bp, Homo sapiens
acagagtagttgaaacagaga

SEQ ID NO: 8176936 - DNA, 22 bp, Homo sapiens
acagagtaggtgctgtcgactg

SEQ ID NO: 8176937 - DNA, 22 bp, Homo sapiens
acagagtaggtgctcagtaaat

SEQ ID NO: 8176938 - DNA, 22 bp, Homo sapiens
acagagtatctatcaggagtat

SEQ ID NO: 8176939 - DNA, 22 bp, Homo sapiens
acagagtattggaaaggcagtg

SEQ ID NO: 8176940 - DNA, 22 bp, Homo sapiens
acagagtattggaaaggcagtg

SEQ ID NO: 8176941 - DNA, 22 bp, Homo sapiens
acagaggtgtgtgtaggacagt

SEQ ID NO: 8176942 - DNA, 22 bp, Homo sapiens
acagaggtgttccagacctagg

SEQ ID NO: 8176943 - DNA, 22 bp, Homo sapiens
aagcagctgatttcacagctca

SEQ ID NO: 8176944 - DNA, 22 bp, Homo sapiens
aagcagctgatttcacagctca

SEQ ID NO: 8176945 - DNA, 22 bp, Homo sapiens
aagcagctgatttcacagctca

SEQ ID NO: 8176946 - DNA, 22 bp, Homo sapiens
aagcagctgatttcacagctca

SEQ ID NO: 8176947 - DNA, 22 bp, Homo sapiens
aagcagccagccatcatgcccg

SEQ ID NO: 8176948 - DNA, 22 bp, Homo sapiens
aagcagctgaaggattcagggt

SEQ ID NO: 8176949 - DNA, 22 bp, Homo sapiens
aagcagcattgtggtaggggag

SEQ ID NO: 8176950 - DNA, 22 bp, Homo sapiens
aagcagcattgtaaccaatgcc

SEQ ID NO: 8176951 - DNA, 22 bp, Homo sapiens
aagcagccactggccagttata

SEQ ID NO: 8176952 - DNA, 22 bp, Homo sapiens
aagcagccacctcatctccact

SEQ ID NO: 8176953 - DNA, 22 bp, Homo sapiens
aagcagcatgattgtaatacta

SEQ ID NO: 8176954 - DNA, 22 bp, Homo sapiens
aagcagcatcctgggcagacct

SEQ ID NO: 8176955 - DNA, 18 bp, Homo sapiens
acagacaaaatggaaatg

SEQ ID NO: 8176956 - DNA, 18 bp, Homo sapiens
acagacaaaatggaaatg

SEQ ID NO: 8176957 - DNA, 22 bp, Homo sapiens
aagcagaggtagggtgtgcagt

SEQ ID NO: 8176958 - DNA, 22 bp, Homo sapiens
aagcagaggtagggtgtgcagt

SEQ ID NO: 8176959 - DNA, 22 bp, Homo sapiens
aagcagaggtagggtgtgcagt

SEQ ID NO: 8176960 - DNA, 22 bp, Homo sapiens
aagcagcattcagtgaaatgtg

SEQ ID NO: 8176961 - DNA, 22 bp, Homo sapiens
aagcagcattcagtgaaatgtg

SEQ ID NO: 8176962 - DNA, 22 bp, Homo sapiens
aagcagcattgtaaccaatgcc

SEQ ID NO: 8176963 - DNA, 22 bp, Homo sapiens
aagcagcattgtaaccaatgcc

SEQ ID NO: 8176964 - DNA, 22 bp, Homo sapiens
aagcagcatgctatgctggtgg

SEQ ID NO: 8176965 - DNA, 22 bp, Homo sapiens
aagcagcatgattgtaatacta

SEQ ID NO: 8176966 - DNA, 22 bp, Homo sapiens
aagcagcatgctatgctggtgg

SEQ ID NO: 8176967 - DNA, 22 bp, Homo sapiens
aagcagcatgtgggttatcggg

SEQ ID NO: 8176968 - DNA, 22 bp, Homo sapiens
acagaattgaaagtataatctg

SEQ ID NO: 8176969 - DNA, 22 bp, Homo sapiens
acagaatttacacatctctaaa

SEQ ID NO: 8176970 - DNA, 22 bp, Homo sapiens
acagaatttaaagctctagact

SEQ ID NO: 8176971 - DNA, 18 bp, Homo sapiens
acagacaaaatggaaatg

SEQ ID NO: 8176972 - DNA, 20 bp, Homo sapiens
aagaggctgtggatcctact

SEQ ID NO: 8176973 - DNA, 18 bp, Homo sapiens
aagaggctgttctgtggg

SEQ ID NO: 8176974 - DNA, 20 bp, Homo sapiens
aagaggctgtggatcctact

SEQ ID NO: 8176975 - DNA, 22 bp, Homo sapiens
aagaggctggcattgatggtag

SEQ ID NO: 8176976 - DNA, 22 bp, Homo sapiens
aagatgttctattttcactttt

SEQ ID NO: 8176977 - DNA, 22 bp, Homo sapiens
aagaggcttcagatccttcaga

SEQ ID NO: 8176978 - DNA, 22 bp, Homo sapiens
aagaggcttcagatccttcaga

SEQ ID NO: 8176979 - DNA, 22 bp, Homo sapiens
aagaggcttatagtcttcctgt

SEQ ID NO: 8176980 - DNA, 22 bp, Homo sapiens
aagaggcctggaggcagaggtg

SEQ ID NO: 8176981 - DNA, 22 bp, Homo sapiens
aagaggctagccggctcactaa

SEQ ID NO: 8176982 - DNA, 22 bp, Homo sapiens
aagaggctagccggctcactaa

SEQ ID NO: 8176983 - DNA, 22 bp, Homo sapiens
aagaggctgaatgagaaagtac

SEQ ID NO: 8176984 - DNA, 22 bp, Homo sapiens
aagaggctggaggatactgcgc

SEQ ID NO: 8176985 - DNA, 22 bp, Homo sapiens
aagattgacggctttgagtgct

SEQ ID NO: 8176986 - DNA, 22 bp, Homo sapiens
aagatttaccactttattcaag

SEQ ID NO: 8176987 - DNA, 22 bp, Homo sapiens
aagattgttttggatgctaact

SEQ ID NO: 8176988 - DNA, 22 bp, Homo sapiens
aagattgttttgggggaagtgg

SEQ ID NO: 8176989 - DNA, 18 bp, Homo sapiens
aagattctgcttctctct

SEQ ID NO: 8176990 - DNA, 22 bp, Homo sapiens
acacagggggcattctaggagt

SEQ ID NO: 8176991 - DNA, 22 bp, Homo sapiens
acacagggtctagagttaggcc

SEQ ID NO: 8176992 - DNA, 22 bp, Homo sapiens
acacaggtacacatatgtacct

SEQ ID NO: 8176993 - DNA, 22 bp, Homo sapiens
acacaggtaatggttttggaag

SEQ ID NO: 8176994 - DNA, 22 bp, Homo sapiens
acacaggttaaaataattggga

SEQ ID NO: 8176995 - DNA, 22 bp, Homo sapiens
acacaggttaaaataattggga

SEQ ID NO: 8176996 - DNA, 22 bp, Homo sapiens
acacaggggctcggctgggtgc

SEQ ID NO: 8176997 - DNA, 22 bp, Homo sapiens
acacaggggaaagtggagctga

SEQ ID NO: 8176998 - DNA, 22 bp, Homo sapiens
acacagggctgcgcctgacccc

SEQ ID NO: 8176999 - DNA, 22 bp, Homo sapiens
acacaggaactcaagctcgctt

SEQ ID NO: 8177000 - DNA, 22 bp, Homo sapiens
acacaggaactcaagctcgctt

SEQ ID NO: 8177001 - DNA, 22 bp, Homo sapiens
acacaggaactcaagctcgctt

SEQ ID NO: 8177002 - DNA, 20 bp, Homo sapiens
acacagtagcaattagtgca

SEQ ID NO: 8177003 - DNA, 20 bp, Homo sapiens
acacagtagcaattagtgca

SEQ ID NO: 8177004 - DNA, 22 bp, Homo sapiens
acacagtaccccaaggctgggc

SEQ ID NO: 8177005 - DNA, 22 bp, Homo sapiens
acacaggttccatctccacctt

SEQ ID NO: 8177006 - DNA, 22 bp, Homo sapiens
aagcacaggagacgcacagcca

SEQ ID NO: 8177007 - DNA, 22 bp, Homo sapiens
aagcacaggatcttgaggagcg

SEQ ID NO: 8177008 - DNA, 22 bp, Homo sapiens
aagcacaggatcttgaggagcg

SEQ ID NO: 8177009 - DNA, 22 bp, Homo sapiens
aagcacagggactcaggaccgg

SEQ ID NO: 8177010 - DNA, 22 bp, Homo sapiens
aagcacagaaaaggagcatgga

SEQ ID NO: 8177011 - DNA, 22 bp, Homo sapiens
acactggtaggaagagatggct

SEQ ID NO: 8177012 - DNA, 22 bp, Homo sapiens
acactgggttacctgtactatt

SEQ ID NO: 8177013 - DNA, 22 bp, Homo sapiens
acactgggtaacatatctgtta

SEQ ID NO: 8177014 - DNA, 22 bp, Homo sapiens
aagcacagtaaaagcagatttt

SEQ ID NO: 8177015 - DNA, 22 bp, Homo sapiens
aagcacagtgccaagttctatt

SEQ ID NO: 8177016 - DNA, 22 bp, Homo sapiens
aagcacagtgccaagttctatt

SEQ ID NO: 8177017 - DNA, 22 bp, Homo sapiens
aagcacaggggaaataagttgt

SEQ ID NO: 8177018 - DNA, 22 bp, Homo sapiens
aagcacaggttgaggattattc

SEQ ID NO: 8177019 - DNA, 18 bp, Homo sapiens
aagcacaggtgtttcagg

SEQ ID NO: 8177020 - DNA, 22 bp, Homo sapiens
acactggagcttctagcccacg

SEQ ID NO: 8177021 - DNA, 22 bp, Homo sapiens
acactggactcagaggccagaa

SEQ ID NO: 8177022 - DNA, 22 bp, Homo sapiens
acactggaccatttaaacttga

SEQ ID NO: 8177023 - DNA, 22 bp, Homo sapiens
acactggaccatttaaacttga

SEQ ID NO: 8177024 - DNA, 22 bp, Homo sapiens
acactggaccatttaaacttga

SEQ ID NO: 8177025 - DNA, 22 bp, Homo sapiens
acactggatgaagcaagctaaa

SEQ ID NO: 8177026 - DNA, 19 bp, Homo sapiens
acactgggagaagactgct

SEQ ID NO: 8177027 - DNA, 22 bp, Homo sapiens
acactggataccactgttatta

SEQ ID NO: 8177028 - DNA, 22 bp, Homo sapiens
acactggataccactgttatta

SEQ ID NO: 8177029 - DNA, 22 bp, Homo sapiens
acactgcttctctggcagagcc

SEQ ID NO: 8177030 - DNA, 22 bp, Homo sapiens
acactgctaaacagtaaagatg

SEQ ID NO: 8177031 - DNA, 22 bp, Homo sapiens
acactgctcacttcttcccttg

SEQ ID NO: 8177032 - DNA, 21 bp, Homo sapiens
acactgctgtagcatattggg

SEQ ID NO: 8177033 - DNA, 21 bp, Homo sapiens
acactgcaggtgaagtgcact

SEQ ID NO: 8177034 - DNA, 21 bp, Homo sapiens
acactgcaggtgaagtgcact

SEQ ID NO: 8177035 - DNA, 22 bp, Homo sapiens
acactgcatttcaacaaggccc

SEQ ID NO: 8177036 - DNA, 22 bp, Homo sapiens
acactgcatttcaacaaggccc

SEQ ID NO: 8177037 - DNA, 22 bp, Homo sapiens
acactgctaaacagtaaagatg

SEQ ID NO: 8177038 - DNA, 22 bp, Homo sapiens
aagatttcagagtttgggggaa

SEQ ID NO: 8177039 - DNA, 22 bp, Homo sapiens
aagatttcctggatgtaattcc

SEQ ID NO: 8177040 - DNA, 22 bp, Homo sapiens
aagatttccatttctagctcat

SEQ ID NO: 8177041 - DNA, 17 bp, Homo sapiens
aagatttcattagctga

SEQ ID NO: 8177042 - DNA, 22 bp, Homo sapiens
aagatttctgcttttggaggca

SEQ ID NO: 8177043 - DNA, 22 bp, Homo sapiens
aagatttctgctcctgagagaa

SEQ ID NO: 8177044 - DNA, 22 bp, Homo sapiens
aagatttctctcctggaaagca

SEQ ID NO: 8177045 - DNA, 22 bp, Homo sapiens
aagatttccttcagtagagcta

SEQ ID NO: 8177046 - DNA, 22 bp, Homo sapiens
aagatttactagcataatagct

SEQ ID NO: 8177047 - DNA, 22 bp, Homo sapiens
aagatttactttctttgtaata

SEQ ID NO: 8177048 - DNA, 22 bp, Homo sapiens
aagatttactttctttgtaata

SEQ ID NO: 8177049 - DNA, 22 bp, Homo sapiens
aatgttttagattactgctggg

SEQ ID NO: 8177050 - DNA, 22 bp, Homo sapiens
aatgttttatagctcaagcaat

SEQ ID NO: 8177051 - DNA, 22 bp, Homo sapiens
aatgttttacagatcccattag

SEQ ID NO: 8177052 - DNA, 22 bp, Homo sapiens
aagaaatgctgatgttggatgg

SEQ ID NO: 8177053 - DNA, 22 bp, Homo sapiens
aagaaatggaagatccatggtg

SEQ ID NO: 8177054 - DNA, 22 bp, Homo sapiens
aagaaatgcacacaactgctgg

SEQ ID NO: 8177055 - DNA, 22 bp, Homo sapiens
aagaaatgcacacaactgctgg

SEQ ID NO: 8177056 - DNA, 22 bp, Homo sapiens
aagaaatgcacacaactgctgg

SEQ ID NO: 8177057 - DNA, 22 bp, Homo sapiens
aatgttttgcattagttttcta

SEQ ID NO: 8177058 - DNA, 22 bp, Homo sapiens
aagaagcactttcctacatgtt

SEQ ID NO: 8177059 - DNA, 22 bp, Homo sapiens
aatgttttctgactgctaactt

SEQ ID NO: 8177060 - DNA, 22 bp, Homo sapiens
aatgttttctgactgctaactt

SEQ ID NO: 8177061 - DNA, 22 bp, Homo sapiens
aatgttttgcattagttttcta

SEQ ID NO: 8177062 - DNA, 22 bp, Homo sapiens
aatgttttcccagtgcagacga

SEQ ID NO: 8177063 - DNA, 22 bp, Homo sapiens
aatgttttcccagtgcagacga

SEQ ID NO: 8177064 - DNA, 22 bp, Homo sapiens
aatgttttctctgtgaacacat

SEQ ID NO: 8177065 - DNA, 22 bp, Homo sapiens
aatgttttctctgtgaacacat

SEQ ID NO: 8177066 - DNA, 22 bp, Homo sapiens
aatgttttcattatcctaactg

SEQ ID NO: 8177067 - DNA, 22 bp, Homo sapiens
aatgttttcattatcctaactg

SEQ ID NO: 8177068 - DNA, 22 bp, Homo sapiens
aatgttttcattatcctaactg

SEQ ID NO: 8177069 - DNA, 22 bp, Homo sapiens
aatgttttcattatcctaactg

SEQ ID NO: 8177070 - DNA, 22 bp, Homo sapiens
aatgttttatagctcaagcaat

SEQ ID NO: 8177071 - DNA, 22 bp, Homo sapiens
aagaaatacatggtttttgagt

SEQ ID NO: 8177072 - DNA, 22 bp, Homo sapiens
aagaaatacatggtttttgagt

SEQ ID NO: 8177073 - DNA, 22 bp, Homo sapiens
aagaaatacatggtttttgagt

SEQ ID NO: 8177074 - DNA, 22 bp, Homo sapiens
aagaaatacatggtttttgagt

SEQ ID NO: 8177075 - DNA, 22 bp, Homo sapiens
aagaaatattgggccttataaa

SEQ ID NO: 8177076 - DNA, 22 bp, Homo sapiens
aagaaatattgggccttataaa

SEQ ID NO: 8177077 - DNA, 22 bp, Homo sapiens
aagaaatcatatcatttcttgg

SEQ ID NO: 8177078 - DNA, 22 bp, Homo sapiens
aagaaatattgggccttataaa

SEQ ID NO: 8177079 - DNA, 22 bp, Homo sapiens
aacttatacccagggcagaaat

SEQ ID NO: 8177080 - DNA, 22 bp, Homo sapiens
aacttatcagactgatgtatgg

SEQ ID NO: 8177081 - DNA, 22 bp, Homo sapiens
aacttatcagactgatgtatgg

SEQ ID NO: 8177082 - DNA, 22 bp, Homo sapiens
aacttagtttagggtattgatt

SEQ ID NO: 8177083 - DNA, 22 bp, Homo sapiens
aacttattgaacattctcgaat

SEQ ID NO: 8177084 - DNA, 22 bp, Homo sapiens
aacttcacctttttgccacact

SEQ ID NO: 8177085 - DNA, 21 bp, Homo sapiens
aagaaagataattaaggaccc

SEQ ID NO: 8177086 - DNA, 22 bp, Homo sapiens
aacttcatgtaatttaaaacag

SEQ ID NO: 8177087 - DNA, 22 bp, Homo sapiens
aacttcatgtaatttaaaacag

SEQ ID NO: 8177088 - DNA, 22 bp, Homo sapiens
aagaataacacttaggttttgc

SEQ ID NO: 8177089 - DNA, 22 bp, Homo sapiens
aagaataacacttaggttttgc

SEQ ID NO: 8177090 - DNA, 22 bp, Homo sapiens
aagaataaattaagatacttag

SEQ ID NO: 8177091 - DNA, 22 bp, Homo sapiens
aagaataaattaagatacttag

SEQ ID NO: 8177092 - DNA, 22 bp, Homo sapiens
aagaagcagagctgtgggtgtt

SEQ ID NO: 8177093 - DNA, 22 bp, Homo sapiens
aagaataaattaagatacttag

SEQ ID NO: 8177094 - DNA, 22 bp, Homo sapiens
aattggaaaatgctacatatca

SEQ ID NO: 8177095 - DNA, 22 bp, Homo sapiens
aattggttattctgtccttttt

SEQ ID NO: 8177096 - DNA, 22 bp, Homo sapiens
aattggcatagcatacaattca

SEQ ID NO: 8177097 - DNA, 22 bp, Homo sapiens
aattggcagaactttatatatt

SEQ ID NO: 8177098 - DNA, 22 bp, Homo sapiens
aagaatacgtatcaacaatggt

SEQ ID NO: 8177099 - DNA, 22 bp, Homo sapiens
aagaatacgtatcaacaatggt

SEQ ID NO: 8177100 - DNA, 22 bp, Homo sapiens
aagaataagtagatgggagaag

SEQ ID NO: 8177101 - DNA, 22 bp, Homo sapiens
aagaataagtagatgggagaag

SEQ ID NO: 8177102 - DNA, 22 bp, Homo sapiens
aagaatacgtatcaacaatggt

SEQ ID NO: 8177103 - DNA, 22 bp, Homo sapiens
aagaataagtagatgggagaag

SEQ ID NO: 8177104 - DNA, 22 bp, Homo sapiens
aagaataagtagatgggagaag

SEQ ID NO: 8177105 - DNA, 22 bp, Homo sapiens
aattgtcaaaaattgcaattgt

SEQ ID NO: 8177106 - DNA, 22 bp, Homo sapiens
aattgttgagcataaattatcg

SEQ ID NO: 8177107 - DNA, 20 bp, Homo sapiens
aattgttgactccccagaga

SEQ ID NO: 8177108 - DNA, 23 bp, Homo sapiens
aattgtgcttcccaggggctatt

SEQ ID NO: 8177109 - DNA, 22 bp, Homo sapiens
aattgtgctgtgatcaattact

SEQ ID NO: 8177110 - DNA, 22 bp, Homo sapiens
aattgttgggccctaccccaga

SEQ ID NO: 8177111 - DNA, 22 bp, Homo sapiens
aattgttgggtattcctgtgac

SEQ ID NO: 8177112 - DNA, 22 bp, Homo sapiens
aattgttgtacagaataaatga

SEQ ID NO: 8177113 - DNA, 22 bp, Homo sapiens
aattgtgcatttttaaatcacg

SEQ ID NO: 8177114 - DNA, 22 bp, Homo sapiens
aattgtgcccgtgacatttcat

SEQ ID NO: 8177115 - DNA, 22 bp, Homo sapiens
aattgtgatgacagctggtggt

SEQ ID NO: 8177116 - DNA, 22 bp, Homo sapiens
aattgtgctgtaggctcgttaa

SEQ ID NO: 8177117 - DNA, 21 bp, Homo sapiens
aattgtgctattctgctttta

SEQ ID NO: 8177118 - DNA, 22 bp, Homo sapiens
aattgtgctgctataggattaa

SEQ ID NO: 8177119 - DNA, 22 bp, Homo sapiens
aattgtgctatgattatgaaag

SEQ ID NO: 8177120 - DNA, 20 bp, Homo sapiens
aagacaccagtggcagcccc

SEQ ID NO: 8177121 - DNA, 22 bp, Homo sapiens
aatttaagaacatttcaggact

SEQ ID NO: 8177122 - DNA, 22 bp, Homo sapiens
aagacagcagcacctctcgttt

SEQ ID NO: 8177123 - DNA, 22 bp, Homo sapiens
aagacaggaacatagcaaatcc

SEQ ID NO: 8177124 - DNA, 22 bp, Homo sapiens
aagacagtgatctctgagagat

SEQ ID NO: 8177125 - DNA, 22 bp, Homo sapiens
aagacagtgacagtcacaattg

SEQ ID NO: 8177126 - DNA, 22 bp, Homo sapiens
aagacaggaaaagctccaggcc

SEQ ID NO: 8177127 - DNA, 22 bp, Homo sapiens
aagacaggaaaagctccaggcc

SEQ ID NO: 8177128 - DNA, 22 bp, Homo sapiens
aagacaggaaaagctccaggcc

SEQ ID NO: 8177129 - DNA, 22 bp, Homo sapiens
acaaagattcatttgcattatt

SEQ ID NO: 8177130 - DNA, 22 bp, Homo sapiens
aagagagaacacagcttgggca

SEQ ID NO: 8177131 - DNA, 22 bp, Homo sapiens
aagagagaacacagcttgggca

SEQ ID NO: 8177132 - DNA, 22 bp, Homo sapiens
aagagagaacacagcttgggca

SEQ ID NO: 8177133 - DNA, 22 bp, Homo sapiens
acaaagccagattctggagcac

SEQ ID NO: 8177134 - DNA, 22 bp, Homo sapiens
acaaagatgtttaaagcattta

SEQ ID NO: 8177135 - DNA, 22 bp, Homo sapiens
acaaagatgtttaaagcattta

SEQ ID NO: 8177136 - DNA, 22 bp, Homo sapiens
acaaagatgtttaaagcattta

SEQ ID NO: 8177137 - DNA, 20 bp, Homo sapiens
acaaagactggaaaagcaag

SEQ ID NO: 8177138 - DNA, 22 bp, Homo sapiens
aagacattactggaatctgact

SEQ ID NO: 8177139 - DNA, 22 bp, Homo sapiens
aagacattactggaatctgact

SEQ ID NO: 8177140 - DNA, 22 bp, Homo sapiens
acaaagataagtcagaaagtca

SEQ ID NO: 8177141 - DNA, 22 bp, Homo sapiens
acaaagagggaccagtgacttg

SEQ ID NO: 8177142 - DNA, 22 bp, Homo sapiens
acaaagagggaccagtgacttg

SEQ ID NO: 8177143 - DNA, 22 bp, Homo sapiens
aagacatgactgcacagccaaa

SEQ ID NO: 8177144 - DNA, 22 bp, Homo sapiens
aagacataaaacagtcagcgaa

SEQ ID NO: 8177145 - DNA, 22 bp, Homo sapiens
aagacatacagacagtgagcca

SEQ ID NO: 8177146 - DNA, 22 bp, Homo sapiens
acaaggagaagaaattggtcat

SEQ ID NO: 8177147 - DNA, 22 bp, Homo sapiens
acaaggagagcacacatgggga

SEQ ID NO: 8177148 - DNA, 22 bp, Homo sapiens
acaaggattaaatgatatacag

SEQ ID NO: 8177149 - DNA, 22 bp, Homo sapiens
acaaggattaaggtatgcaaca

SEQ ID NO: 8177150 - DNA, 22 bp, Homo sapiens
acaaggatctgtgtaggcaggc

SEQ ID NO: 8177151 - DNA, 22 bp, Homo sapiens
acaaggacatgcaatttggatt

SEQ ID NO: 8177152 - DNA, 22 bp, Homo sapiens
acaaggaccatgaggcagaccc

SEQ ID NO: 8177153 - DNA, 22 bp, Homo sapiens
aagagattggttataagagatt

SEQ ID NO: 8177154 - DNA, 22 bp, Homo sapiens
aagagatgatggcagccagagg

SEQ ID NO: 8177155 - DNA, 22 bp, Homo sapiens
aagagatgctttacatcggatg

SEQ ID NO: 8177156 - DNA, 22 bp, Homo sapiens
aagagattcctcactcagaatg

SEQ ID NO: 8177157 - DNA, 22 bp, Homo sapiens
aagagattcctcactcagaatg

SEQ ID NO: 8177158 - DNA, 22 bp, Homo sapiens
aagagatgttgaagtttattag

SEQ ID NO: 8177159 - DNA, 22 bp, Homo sapiens
aagagaggggttgcatggaaat

SEQ ID NO: 8177160 - DNA, 22 bp, Homo sapiens
aagagaggggttgcatggaaat

SEQ ID NO: 8177161 - DNA, 22 bp, Homo sapiens
aagagaggggttgcatggaaat

SEQ ID NO: 8177162 - DNA, 22 bp, Homo sapiens
aagagaggggttgcatggaaat

SEQ ID NO: 8177163 - DNA, 22 bp, Homo sapiens
aagagaggggttgcatggaaat

SEQ ID NO: 8177164 - DNA, 22 bp, Homo sapiens
aagagagggacttattaaagtc

SEQ ID NO: 8177165 - DNA, 22 bp, Homo sapiens
aagagagggacttattaaagtc

SEQ ID NO: 8177166 - DNA, 22 bp, Homo sapiens
aagagagggatttggtttattg

SEQ ID NO: 8177167 - DNA, 22 bp, Homo sapiens
aagagagggatttggtttattg

SEQ ID NO: 8177168 - DNA, 17 bp, Homo sapiens
aagagaggctgagctgg

SEQ ID NO: 8177169 - DNA, 17 bp, Homo sapiens
aagagaggctgagctgg

SEQ ID NO: 8177170 - DNA, 17 bp, Homo sapiens
aagagaggctgagctgg

SEQ ID NO: 8177171 - DNA, 17 bp, Homo sapiens
aagagaggctgagctgg

SEQ ID NO: 8177172 - DNA, 22 bp, Homo sapiens
aagagaggacatggtgaacctg

SEQ ID NO: 8177173 - DNA, 22 bp, Homo sapiens
aagagaggacatggtgaacctg

SEQ ID NO: 8177174 - DNA, 20 bp, Homo sapiens
aagagctgactcacagtggt

SEQ ID NO: 8177175 - DNA, 20 bp, Homo sapiens
aagagctgactcacagtggt

SEQ ID NO: 8177176 - DNA, 22 bp, Homo sapiens
aagagcagtgttttactcagct

SEQ ID NO: 8177177 - DNA, 22 bp, Homo sapiens
aagagctatgttaaggaagaga

SEQ ID NO: 8177178 - DNA, 19 bp, Homo sapiens
aagagcagggaaagaattg

SEQ ID NO: 8177179 - DNA, 22 bp, Homo sapiens
aagagcagtgttttactcagct

SEQ ID NO: 8177180 - DNA, 20 bp, Homo sapiens
aagagctgactcacagtggt

SEQ ID NO: 8177181 - DNA, 22 bp, Homo sapiens
aagagctgattaagtcatgagg

SEQ ID NO: 8177182 - DNA, 22 bp, Homo sapiens
aagagctgcatctaagccatga

SEQ ID NO: 8177183 - DNA, 22 bp, Homo sapiens
aagagctgcccaaggtgaacag

SEQ ID NO: 8177184 - DNA, 22 bp, Homo sapiens
aagagctgcccaaggtgaacag

SEQ ID NO: 8177185 - DNA, 19 bp, Homo sapiens
acaaggctgggagagcgcc

SEQ ID NO: 8177186 - DNA, 22 bp, Homo sapiens
acaaggctgctgtgattgggaa

SEQ ID NO: 8177187 - DNA, 22 bp, Homo sapiens
acaaggctgtggggagaactga

SEQ ID NO: 8177188 - DNA, 22 bp, Homo sapiens
acaaggctgtgggagaacctct

SEQ ID NO: 8177189 - DNA, 22 bp, Homo sapiens
acaaggctctaatttcattgaa

SEQ ID NO: 8177190 - DNA, 23 bp, Homo sapiens
acaaggcaacatagatcagggca

SEQ ID NO: 8177191 - DNA, 22 bp, Homo sapiens
acaaggcaattcctggtgaatt

SEQ ID NO: 8177192 - DNA, 22 bp, Homo sapiens
acaaggcactttatgaagagga

SEQ ID NO: 8177193 - DNA, 22 bp, Homo sapiens
acaaggcagtacaatgatgaca

SEQ ID NO: 8177194 - DNA, 22 bp, Homo sapiens
acaaggcagtacaatgatgaca

SEQ ID NO: 8177195 - DNA, 22 bp, Homo sapiens
acaaggccaagcattctagcaa

SEQ ID NO: 8177196 - DNA, 22 bp, Homo sapiens
aagagctggctcttgcagcagc

SEQ ID NO: 8177197 - DNA, 22 bp, Homo sapiens
aagagctggctcttgcagcagc

SEQ ID NO: 8177198 - DNA, 22 bp, Homo sapiens
aagagctggctcttgcagcagc

SEQ ID NO: 8177199 - DNA, 22 bp, Homo sapiens
aagagctggtcacaggtccatt

SEQ ID NO: 8177200 - DNA, 22 bp, Homo sapiens
aagagctgtgggtggtagtcct

SEQ ID NO: 8177201 - DNA, 22 bp, Homo sapiens
aagagctgtatgccatatgatt

SEQ ID NO: 8177202 - DNA, 21 bp, Homo sapiens
aagagctgtcaggaaggctgc

SEQ ID NO: 8177203 - DNA, 22 bp, Homo sapiens
aagagctgtatgccatatgatt

SEQ ID NO: 8177204 - DNA, 18 bp, Homo sapiens
aagagcttcgcatataca

SEQ ID NO: 8177205 - DNA, 22 bp, Homo sapiens
aagagctgttgtctgcttactg

SEQ ID NO: 8177206 - DNA, 22 bp, Homo sapiens
aagagctggagtttgcagccct

SEQ ID NO: 8177207 - DNA, 22 bp, Homo sapiens
aagagctggagtttgcagccct

SEQ ID NO: 8177208 - DNA, 22 bp, Homo sapiens
aagagctggagtttgcagccct

SEQ ID NO: 8177209 - DNA, 22 bp, Homo sapiens
aagagctggaagtgaagataac

SEQ ID NO: 8177210 - DNA, 22 bp, Homo sapiens
aagagctggaagtgaagataac

SEQ ID NO: 8177211 - DNA, 22 bp, Homo sapiens
aagagctggagctgctacagga

SEQ ID NO: 8177212 - DNA, 22 bp, Homo sapiens
aagagctggagctgctacagga

SEQ ID NO: 8177213 - DNA, 22 bp, Homo sapiens
aagagctggatgaagaaatcaa

SEQ ID NO: 8177214 - DNA, 21 bp, Homo sapiens
aagagctggatcaaggataag

SEQ ID NO: 8177215 - DNA, 21 bp, Homo sapiens
aagagctggatcaaggataag

SEQ ID NO: 8177216 - DNA, 22 bp, Homo sapiens
aagagctggatggaatctggga

SEQ ID NO: 8177217 - DNA, 22 bp, Homo sapiens
aagagctggcccaatctgagca

SEQ ID NO: 8177218 - DNA, 22 bp, Homo sapiens
aagagctggcccaatctgagca

SEQ ID NO: 8177219 - DNA, 22 bp, Homo sapiens
aagagctggattgtgctgcaga

SEQ ID NO: 8177220 - DNA, 22 bp, Homo sapiens
aaattagaaatactttcaaagc

SEQ ID NO: 8177221 - DNA, 22 bp, Homo sapiens
aaattactttacactttcatct

SEQ ID NO: 8177222 - DNA, 20 bp, Homo sapiens
aaattactgccacacatttc

SEQ ID NO: 8177223 - DNA, 22 bp, Homo sapiens
aaattgtgagactgaaccaaat

SEQ ID NO: 8177224 - DNA, 22 bp, Homo sapiens
aaattagaccagggctcctgga

SEQ ID NO: 8177225 - DNA, 22 bp, Homo sapiens
aaattagaccagggctcctgga

SEQ ID NO: 8177226 - DNA, 22 bp, Homo sapiens
aaattagaaatactttcaaagc

SEQ ID NO: 8177227 - DNA, 22 bp, Homo sapiens
aaattagaagtgctcaggaata

SEQ ID NO: 8177228 - DNA, 22 bp, Homo sapiens
aaattacagatcaccaatgcat

SEQ ID NO: 8177229 - DNA, 22 bp, Homo sapiens
aaattacagatcaccaatgcat

SEQ ID NO: 8177230 - DNA, 22 bp, Homo sapiens
aaattacagccttgggtagctt

SEQ ID NO: 8177231 - DNA, 22 bp, Homo sapiens
aaattacagccttgggtagctt

SEQ ID NO: 8177232 - DNA, 20 bp, Homo sapiens
aaattactgccacacatttc

SEQ ID NO: 8177233 - DNA, 20 bp, Homo sapiens
aaattactgccacacatttc

SEQ ID NO: 8177234 - DNA, 22 bp, Homo sapiens
aaattaagagtaactctgtaga

SEQ ID NO: 8177235 - DNA, 22 bp, Homo sapiens
aaagagttgaggcagttatcca

SEQ ID NO: 8177236 - DNA, 22 bp, Homo sapiens
aaagagtctggcactgtaccag

SEQ ID NO: 8177237 - DNA, 22 bp, Homo sapiens
aaagaggatggagtagtcagct

SEQ ID NO: 8177238 - DNA, 22 bp, Homo sapiens
aaagaggatggagtagtcagct

SEQ ID NO: 8177239 - DNA, 22 bp, Homo sapiens
aaagaggaaccaagagcacgtg

SEQ ID NO: 8177240 - DNA, 22 bp, Homo sapiens
aaagaggcaatcaatgtagcaa

SEQ ID NO: 8177241 - DNA, 22 bp, Homo sapiens
aaagaggctcaaggtgggccag

SEQ ID NO: 8177242 - DNA, 22 bp, Homo sapiens
aaagaggcaggtgttactggaa

SEQ ID NO: 8177243 - DNA, 22 bp, Homo sapiens
aaagagcatggaaagttcagga

SEQ ID NO: 8177244 - DNA, 22 bp, Homo sapiens
aaatgcagcagctaattgaaaa

SEQ ID NO: 8177245 - DNA, 22 bp, Homo sapiens
aaatgcagcagctaattgaaaa

SEQ ID NO: 8177246 - DNA, 22 bp, Homo sapiens
aaatgcagcagctaattgaaaa

SEQ ID NO: 8177247 - DNA, 22 bp, Homo sapiens
aaagagcaccctcaatgtctga

SEQ ID NO: 8177248 - DNA, 22 bp, Homo sapiens
aaagagcaccctcaatgtctga

SEQ ID NO: 8177249 - DNA, 22 bp, Homo sapiens
aaatgcagaatgatttcatcta

SEQ ID NO: 8177250 - DNA, 22 bp, Homo sapiens
aaatgcagaatgatttcatcta

SEQ ID NO: 8177251 - DNA, 22 bp, Homo sapiens
aaatgcagaatctcagacccca

SEQ ID NO: 8177252 - DNA, 22 bp, Homo sapiens
aaagacacaaatgtagaccaaa

SEQ ID NO: 8177253 - DNA, 22 bp, Homo sapiens
aaatgcagatccctgaatctca

SEQ ID NO: 8177254 - DNA, 22 bp, Homo sapiens
aaatgcagatccctgaatctca

SEQ ID NO: 8177255 - DNA, 22 bp, Homo sapiens
aaatgcagatccctgaatctca

SEQ ID NO: 8177256 - DNA, 22 bp, Homo sapiens
aaatgcagattcatgagcccca

SEQ ID NO: 8177257 - DNA, 22 bp, Homo sapiens
aaatgcagattgtcattcagga

SEQ ID NO: 8177258 - DNA, 22 bp, Homo sapiens
aaatgcagattgtcattcagga

SEQ ID NO: 8177259 - DNA, 22 bp, Homo sapiens
aaatgcagattgtcattcagga

SEQ ID NO: 8177260 - DNA, 21 bp, Homo sapiens
aaactgaccttgcctgagaca

SEQ ID NO: 8177261 - DNA, 21 bp, Homo sapiens
aaactgaccttgcctgagaca

SEQ ID NO: 8177262 - DNA, 22 bp, Homo sapiens
aaactgacaatctcagtcctat

SEQ ID NO: 8177263 - DNA, 22 bp, Homo sapiens
aaactgaattcaagtatccagt

SEQ ID NO: 8177264 - DNA, 22 bp, Homo sapiens
aaactgaggcaggggatgatta

SEQ ID NO: 8177265 - DNA, 22 bp, Homo sapiens
aaactgaggagttagactaggg

SEQ ID NO: 8177266 - DNA, 22 bp, Homo sapiens
aaactgaggcccagagaggcag

SEQ ID NO: 8177267 - DNA, 22 bp, Homo sapiens
aaactgaggagttagactaggg

SEQ ID NO: 8177268 - DNA, 22 bp, Homo sapiens
aaactgaggctcccgagggtgt

SEQ ID NO: 8177269 - DNA, 21 bp, Homo sapiens
aaactgaggcttcaagcagtg

SEQ ID NO: 8177270 - DNA, 21 bp, Homo sapiens
aaactgaggcttcaagcagtg

SEQ ID NO: 8177271 - DNA, 22 bp, Homo sapiens
aaactgagaccgaaaggggtag

SEQ ID NO: 8177272 - DNA, 22 bp, Homo sapiens
aaactgaggaacaaggaaggat

SEQ ID NO: 8177273 - DNA, 22 bp, Homo sapiens
aaactgagattgctgctgtctg

SEQ ID NO: 8177274 - DNA, 22 bp, Homo sapiens
aaactgaggaatgacagcatta

SEQ ID NO: 8177275 - DNA, 22 bp, Homo sapiens
aaactgaggagttagactaggg

SEQ ID NO: 8177276 - DNA, 21 bp, Homo sapiens
aaactgaggagatgaggacta

SEQ ID NO: 8177277 - DNA, 17 bp, Homo sapiens
aaactgaaaaattcact

SEQ ID NO: 8177278 - DNA, 17 bp, Homo sapiens
aaactgaaaaattcact

SEQ ID NO: 8177279 - DNA, 22 bp, Homo sapiens
aaactgaaacatcatcatgttg

SEQ ID NO: 8177280 - DNA, 22 bp, Homo sapiens
aaactgaaacatcatcatgttg

SEQ ID NO: 8177281 - DNA, 21 bp, Homo sapiens
aaactgaagagacaggaactt

SEQ ID NO: 8177282 - DNA, 22 bp, Homo sapiens
aaactcttcatatacatatgct

SEQ ID NO: 8177283 - DNA, 22 bp, Homo sapiens
aaactctgttgagataatattt

SEQ ID NO: 8177284 - DNA, 22 bp, Homo sapiens
aaactctgttgagataatattt

SEQ ID NO: 8177285 - DNA, 22 bp, Homo sapiens
aaactctgtatttgctgtgggt

SEQ ID NO: 8177286 - DNA, 22 bp, Homo sapiens
aaactctgccatttttggcctg

SEQ ID NO: 8177287 - DNA, 22 bp, Homo sapiens
aaactctggagatgtttatgca

SEQ ID NO: 8177288 - DNA, 22 bp, Homo sapiens
aaactctgatgcttattgggaa

SEQ ID NO: 8177289 - DNA, 22 bp, Homo sapiens
aaactctgcactgcggtaaggt

SEQ ID NO: 8177290 - DNA, 22 bp, Homo sapiens
aaactctgtagctaaacataat

SEQ ID NO: 8177291 - DNA, 22 bp, Homo sapiens
aaactctgggggtggagcccag

SEQ ID NO: 8177292 - DNA, 22 bp, Homo sapiens
aaactctggattggagtccagc

SEQ ID NO: 8177293 - DNA, 22 bp, Homo sapiens
aaagaatagcctttgtccaaat

SEQ ID NO: 8177294 - DNA, 22 bp, Homo sapiens
aaagaatactccttttgccttg

SEQ ID NO: 8177295 - DNA, 22 bp, Homo sapiens
aaagaatactccttttgccttg

SEQ ID NO: 8177296 - DNA, 22 bp, Homo sapiens
aaagaatagcctttgtccaaat

SEQ ID NO: 8177297 - DNA, 22 bp, Homo sapiens
aaagacacaaatgtagaccaaa

SEQ ID NO: 8177298 - DNA, 22 bp, Homo sapiens
aaagacacaaatgtagaccaaa

SEQ ID NO: 8177299 - DNA, 22 bp, Homo sapiens
aaagaatcgtgtgtagtttgaa

SEQ ID NO: 8177300 - DNA, 21 bp, Homo sapiens
aaagaatcatgggtaatttca

SEQ ID NO: 8177301 - DNA, 22 bp, Homo sapiens
aaagaagtgttgaatttgcaag

SEQ ID NO: 8177302 - DNA, 22 bp, Homo sapiens
aaagaataccctgggtcataaa

SEQ ID NO: 8177303 - DNA, 22 bp, Homo sapiens
aaagaaggtagggctggtgact

SEQ ID NO: 8177304 - DNA, 23 bp, Homo sapiens
aaactgaggcttgatgaggcggt

SEQ ID NO: 8177305 - DNA, 22 bp, Homo sapiens
aaactgaggtgaggccatcgct

SEQ ID NO: 8177306 - DNA, 22 bp, Homo sapiens
aaactgagtacctctgcattca

SEQ ID NO: 8177307 - DNA, 22 bp, Homo sapiens
aaactgagtggcttataaacaa

SEQ ID NO: 8177308 - DNA, 22 bp, Homo sapiens
aaactgagtggcttataaacaa

SEQ ID NO: 8177309 - DNA, 22 bp, Homo sapiens
aaactgagtggcttataaacaa

SEQ ID NO: 8177310 - DNA, 16 bp, Homo sapiens
aaactgagttcagttc

SEQ ID NO: 8177311 - DNA, 22 bp, Homo sapiens
aaactgagttttctgaacccca

SEQ ID NO: 8177312 - DNA, 22 bp, Homo sapiens
aaactgataaaataagtacatt

SEQ ID NO: 8177313 - DNA, 22 bp, Homo sapiens
aaactgataaaataagtacatt

SEQ ID NO: 8177314 - DNA, 21 bp, Homo sapiens
aaagttacagtcagtgggtgc

SEQ ID NO: 8177315 - DNA, 22 bp, Homo sapiens
aaagttacccaatctctatgaa

SEQ ID NO: 8177316 - DNA, 22 bp, Homo sapiens
aaagttagtttcttatatgtct

SEQ ID NO: 8177317 - DNA, 22 bp, Homo sapiens
aaagttaggtgtggatttctca

SEQ ID NO: 8177318 - DNA, 22 bp, Homo sapiens
aaagttagcattctctcttgct

SEQ ID NO: 8177319 - DNA, 22 bp, Homo sapiens
aaagttagacagcatcatttct

SEQ ID NO: 8177320 - DNA, 22 bp, Homo sapiens
aaagttcactgaccagcactgg

SEQ ID NO: 8177321 - DNA, 22 bp, Homo sapiens
aaagttcactgaccagcactgg

SEQ ID NO: 8177322 - DNA, 21 bp, Homo sapiens
aaagttcatgctttaatattc

SEQ ID NO: 8177323 - DNA, 19 bp, Homo sapiens
aaactctgaaggccactgg

SEQ ID NO: 8177324 - DNA, 22 bp, Homo sapiens
aaactctcattttagtgcactg

SEQ ID NO: 8177325 - DNA, 22 bp, Homo sapiens
aaacattgtaattttagcatgg

SEQ ID NO: 8177326 - DNA, 22 bp, Homo sapiens
aaaggtgttgccttggagacct

SEQ ID NO: 8177327 - DNA, 22 bp, Homo sapiens
aaaggtgttctcactgggggtc

SEQ ID NO: 8177328 - DNA, 22 bp, Homo sapiens
aaaggtgttctcactgggggtc

SEQ ID NO: 8177329 - DNA, 22 bp, Homo sapiens
aaaggtcttgtcttgacagagt

SEQ ID NO: 8177330 - DNA, 22 bp, Homo sapiens
aaaggtcttttttctaacacca

SEQ ID NO: 8177331 - DNA, 22 bp, Homo sapiens
aaaggtcttaatgttaacatac

SEQ ID NO: 8177332 - DNA, 22 bp, Homo sapiens
aaacattgtacattctgtagct

SEQ ID NO: 8177333 - DNA, 22 bp, Homo sapiens
aaacccagggttttgtcttccc

SEQ ID NO: 8177334 - DNA, 22 bp, Homo sapiens
aaacccagggttttgtcttccc

SEQ ID NO: 8177335 - DNA, 22 bp, Homo sapiens
aaacctattggcaagaataata

SEQ ID NO: 8177336 - DNA, 19 bp, Homo sapiens
aaacctgttagtagagcac

SEQ ID NO: 8177337 - DNA, 22 bp, Homo sapiens
aaacctttaccagactagcaag

SEQ ID NO: 8177338 - DNA, 22 bp, Homo sapiens
aaaccttttcagctgaatggag

SEQ ID NO: 8177339 - DNA, 22 bp, Homo sapiens
aaacctttaccagactagcaag

SEQ ID NO: 8177340 - DNA, 22 bp, Homo sapiens
aaacctttctgctctcagcgta

SEQ ID NO: 8177341 - DNA, 22 bp, Homo sapiens
aaacctggtggaacggtgaata

SEQ ID NO: 8177342 - DNA, 22 bp, Homo sapiens
aaacctgaagtacgttacataa

SEQ ID NO: 8177343 - DNA, 22 bp, Homo sapiens
aaacagtgactggtacataata

SEQ ID NO: 8177344 - DNA, 22 bp, Homo sapiens
aaacagcttgtaaggtgtaatt

SEQ ID NO: 8177345 - DNA, 22 bp, Homo sapiens
aaacacaagaggcagggtacag

SEQ ID NO: 8177346 - DNA, 22 bp, Homo sapiens
aaacagtgccaggcagatgcca

SEQ ID NO: 8177347 - DNA, 22 bp, Homo sapiens
aaacaatttccacctctcctga

SEQ ID NO: 8177348 - DNA, 22 bp, Homo sapiens
aaacaatgttgtctccaagagg

SEQ ID NO: 8177349 - DNA, 17 bp, Homo sapiens
aaacaatgcagacaagc

SEQ ID NO: 8177350 - DNA, 22 bp, Homo sapiens
aaacaatgtagattaccattta

SEQ ID NO: 8177351 - DNA, 22 bp, Homo sapiens
aaacagtttataacatgatact

SEQ ID NO: 8177352 - DNA, 22 bp, Homo sapiens
aaacagtttcattttcatgacc

SEQ ID NO: 8177353 - DNA, 22 bp, Homo sapiens
aaacagtttataacatgatact

SEQ ID NO: 8177354 - DNA, 22 bp, Homo sapiens
aaacagtttcattttcatgacc

SEQ ID NO: 8177355 - DNA, 22 bp, Homo sapiens
aaacagtttcattttcatgacc

SEQ ID NO: 8177356 - DNA, 22 bp, Homo sapiens
aaacagtttataacatgatact

SEQ ID NO: 8177357 - DNA, 22 bp, Homo sapiens
aaacagttgttatttttatatg

SEQ ID NO: 8177358 - DNA, 22 bp, Homo sapiens
aaacagtgcctggcatggagga

SEQ ID NO: 8177359 - DNA, 22 bp, Homo sapiens
aaacagtgtaggtggccaggca

SEQ ID NO: 8177360 - DNA, 22 bp, Homo sapiens
aaacagtggccaattctggaga

SEQ ID NO: 8177361 - DNA, 22 bp, Homo sapiens
aaacagttacgagcgcagacct

SEQ ID NO: 8177362 - DNA, 22 bp, Homo sapiens
aaacagttaattgctttcagtt

SEQ ID NO: 8177363 - DNA, 22 bp, Homo sapiens
aaacagtgtgtttcagagaggc

SEQ ID NO: 8177364 - DNA, 22 bp, Homo sapiens
aaaggtatgatactgtgacatg

SEQ ID NO: 8177365 - DNA, 22 bp, Homo sapiens
aaaggtagtacttctagaaggg

SEQ ID NO: 8177366 - DNA, 22 bp, Homo sapiens
aaaggtcttaaggttaagcagg

SEQ ID NO: 8177367 - DNA, 22 bp, Homo sapiens
aaacagttttcctagctgtctg

SEQ ID NO: 8177368 - DNA, 22 bp, Homo sapiens
aaagggctgtcaaataagcaac

SEQ ID NO: 8177369 - DNA, 22 bp, Homo sapiens
aaagggctgatgtgacatagct

SEQ ID NO: 8177370 - DNA, 22 bp, Homo sapiens
aaagggtcagattctgctagtg

SEQ ID NO: 8177371 - DNA, 22 bp, Homo sapiens
aaagggtccagatacttggaaa

SEQ ID NO: 8177372 - DNA, 22 bp, Homo sapiens
aaagggttgttgtaaggattat

SEQ ID NO: 8177373 - DNA, 22 bp, Homo sapiens
aaagactaaatgaatgagctca

SEQ ID NO: 8177374 - DNA, 22 bp, Homo sapiens
aaaatcagtacactttattttg

SEQ ID NO: 8177375 - DNA, 22 bp, Homo sapiens
aaaatcagtacactttattttg

SEQ ID NO: 8177376 - DNA, 22 bp, Homo sapiens
aaaatcctctaattctagaata

SEQ ID NO: 8177377 - DNA, 22 bp, Homo sapiens
aaaatcctctaattctagaata

SEQ ID NO: 8177378 - DNA, 22 bp, Homo sapiens
aaaatcctgctgactcgagatg

SEQ ID NO: 8177379 - DNA, 22 bp, Homo sapiens
aaaatcctgctgactcgagatg

SEQ ID NO: 8177380 - DNA, 23 bp, Homo sapiens
aaaatcattaatttaccctgaaa

SEQ ID NO: 8177381 - DNA, 23 bp, Homo sapiens
aaaatcattaatttaccctgaaa

SEQ ID NO: 8177382 - DNA, 23 bp, Homo sapiens
aaaatcattaatttaccctgaaa

SEQ ID NO: 8177383 - DNA, 22 bp, Homo sapiens
aaaatcctctaattctagaata

SEQ ID NO: 8177384 - DNA, 22 bp, Homo sapiens
aaagaccatgtttacagctagg

SEQ ID NO: 8177385 - DNA, 22 bp, Homo sapiens
aaagaccatgtttacagctagg

SEQ ID NO: 8177386 - DNA, 22 bp, Homo sapiens
aaagacattagcttagatgtca

SEQ ID NO: 8177387 - DNA, 22 bp, Homo sapiens
aaagacatggcaagagatgggg

SEQ ID NO: 8177388 - DNA, 22 bp, Homo sapiens
aaacaaggcacaattcaggatt

SEQ ID NO: 8177389 - DNA, 20 bp, Homo sapiens
aaacaaggttgctctgagga

SEQ ID NO: 8177390 - DNA, 22 bp, Homo sapiens
aaacaagcaagcacataatttt

SEQ ID NO: 8177391 - DNA, 22 bp, Homo sapiens
aaacaagcaagcacataatttt

SEQ ID NO: 8177392 - DNA, 22 bp, Homo sapiens
aaacaagagtcttgctccacct

SEQ ID NO: 8177393 - DNA, 22 bp, Homo sapiens
aaaatctaagtagcgagtaagg

SEQ ID NO: 8177394 - DNA, 22 bp, Homo sapiens
aaaatctaagtagcgagtaagg

SEQ ID NO: 8177395 - DNA, 22 bp, Homo sapiens
aaaatctcattatcaggaaggg

SEQ ID NO: 8177396 - DNA, 22 bp, Homo sapiens
aaaatctgcacaggtcagtttt

SEQ ID NO: 8177397 - DNA, 22 bp, Homo sapiens
aaacaagtcactttatcttgaa

SEQ ID NO: 8177398 - DNA, 22 bp, Homo sapiens
aaacaagtcactttatcttgaa

SEQ ID NO: 8177399 - DNA, 22 bp, Homo sapiens
aaacaatccaggaacctgttta

SEQ ID NO: 8177400 - DNA, 22 bp, Homo sapiens
aaaagagagttgccagtctgta

SEQ ID NO: 8177401 - DNA, 22 bp, Homo sapiens
aaaagagagttgccagtctgta

SEQ ID NO: 8177402 - DNA, 22 bp, Homo sapiens
aaaagagagttgccagtctgta

SEQ ID NO: 8177403 - DNA, 22 bp, Homo sapiens
aaacccagggttttgtcttccc

SEQ ID NO: 8177404 - DNA, 18 bp, Homo sapiens
aaacccactcagcgctga

SEQ ID NO: 8177405 - DNA, 22 bp, Homo sapiens
aaacccagagactagaaagacc

SEQ ID NO: 8177406 - DNA, 22 bp, Homo sapiens
aaaagagaaagtggcaggcttt

SEQ ID NO: 8177407 - DNA, 22 bp, Homo sapiens
aaaagagaatcctgtacagaga

SEQ ID NO: 8177408 - DNA, 22 bp, Homo sapiens
aaaagagaatcctgtacagaga

SEQ ID NO: 8177409 - DNA, 22 bp, Homo sapiens
aaaagagaatcctgtacagaga

SEQ ID NO: 8177410 - DNA, 22 bp, Homo sapiens
aaaagagagctgaggagctcca

SEQ ID NO: 8177411 - DNA, 22 bp, Homo sapiens
aaaagagagctgaggagctcca

SEQ ID NO: 8177412 - DNA, 19 bp, Homo sapiens
aaactcatagactcatatt

SEQ ID NO: 8177413 - DNA, 19 bp, Homo sapiens
aaactcatagactcatatt

SEQ ID NO: 8177414 - DNA, 22 bp, Homo sapiens
aaactcagacacagtatctgtt

SEQ ID NO: 8177415 - DNA, 22 bp, Homo sapiens
aaactcagacacagtatctgtt

SEQ ID NO: 8177416 - DNA, 22 bp, Homo sapiens
aaactcaagtctatgaacaagg

SEQ ID NO: 8177417 - DNA, 22 bp, Homo sapiens
aaactcagaaggtacagaaggg

SEQ ID NO: 8177418 - DNA, 22 bp, Homo sapiens
aaactagctcttagtttagagg

SEQ ID NO: 8177419 - DNA, 22 bp, Homo sapiens
aaagacatggaactagagatgg

SEQ ID NO: 8177420 - DNA, 22 bp, Homo sapiens
aaagaagggacagactgcctct

SEQ ID NO: 8177421 - DNA, 22 bp, Homo sapiens
aaaagtatttatggctatgtaa

SEQ ID NO: 8177422 - DNA, 22 bp, Homo sapiens
aaaagtattggccaccatttct

SEQ ID NO: 8177423 - DNA, 22 bp, Homo sapiens
aaaagtatggtggtccttttta

SEQ ID NO: 8177424 - DNA, 22 bp, Homo sapiens
aaaagtactattttaacaaagt

SEQ ID NO: 8177425 - DNA, 22 bp, Homo sapiens
aaaagtactattttaacaaagt

SEQ ID NO: 8177426 - DNA, 22 bp, Homo sapiens
aaaagtatagggtttggagtca

SEQ ID NO: 8177427 - DNA, 22 bp, Homo sapiens
aaaagtactattttaacaaagt

SEQ ID NO: 8177428 - DNA, 22 bp, Homo sapiens
aaaagtactattttaacaaagt

SEQ ID NO: 8177429 - DNA, 20 bp, Homo sapiens
aaactctacctcaatcgtca

SEQ ID NO: 8177430 - DNA, 22 bp, Homo sapiens
aaactctagctactaggataac

SEQ ID NO: 8177431 - DNA, 22 bp, Homo sapiens
aaactctaatcaaatatagcat

SEQ ID NO: 8177432 - DNA, 22 bp, Homo sapiens
aaactcctgcatactcagaagc

SEQ ID NO: 8177433 - DNA, 22 bp, Homo sapiens
aaactcctgggctcaagcagtt

SEQ ID NO: 8177434 - DNA, 22 bp, Homo sapiens
aaaatgaataagttaacccagg

SEQ ID NO: 8177435 - DNA, 22 bp, Homo sapiens
aaaatgaataagttaacccagg

SEQ ID NO: 8177436 - DNA, 22 bp, Homo sapiens
aaaaatagcttctcttgtccct

SEQ ID NO: 8177437 - DNA, 22 bp, Homo sapiens
aaaaatagaaggattgactgag

SEQ ID NO: 8177438 - DNA, 22 bp, Homo sapiens
aaaaatagaaggattgactgag

SEQ ID NO: 8177439 - DNA, 22 bp, Homo sapiens
aaaaatagaaggattgactgag

SEQ ID NO: 8177440 - DNA, 22 bp, Homo sapiens
aaaaatagcttctcttgtccct

SEQ ID NO: 8177441 - DNA, 22 bp, Homo sapiens
aaaaataggtcaaccgtgtatg

SEQ ID NO: 8177442 - DNA, 22 bp, Homo sapiens
aaaaatcacttttataggcagc

SEQ ID NO: 8177443 - DNA, 22 bp, Homo sapiens
aaaaatcacttttataggcagc

SEQ ID NO: 8177444 - DNA, 22 bp, Homo sapiens
aaaaatcacttttataggcagc

SEQ ID NO: 8177445 - DNA, 22 bp, Homo sapiens
aaaaatcacttttataggcagc

SEQ ID NO: 8177446 - DNA, 22 bp, Homo sapiens
aaaaatcacttttataggcagc

SEQ ID NO: 8177447 - DNA, 22 bp, Homo sapiens
aaacacatcattcatgtcgtca

SEQ ID NO: 8177448 - DNA, 22 bp, Homo sapiens
aaacacaggtactgcagaagtg

SEQ ID NO: 8177449 - DNA, 22 bp, Homo sapiens
aaacacaggtactgcagaagtg

SEQ ID NO: 8177450 - DNA, 22 bp, Homo sapiens
aaacacaggtactgcagaagtg

SEQ ID NO: 8177451 - DNA, 22 bp, Homo sapiens
aaacactgtgggacatcttact

SEQ ID NO: 8177452 - DNA, 22 bp, Homo sapiens
aaacacatcattcatgtcgtca

SEQ ID NO: 8177453 - DNA, 22 bp, Homo sapiens
aaacactgtgtcaaactggggc

SEQ ID NO: 8177454 - DNA, 22 bp, Homo sapiens
aaaaatctatgactgcttctcc

SEQ ID NO: 8177455 - DNA, 22 bp, Homo sapiens
aaaaatctatgactgcttctcc

SEQ ID NO: 8177456 - DNA, 22 bp, Homo sapiens
aaaagacatctatttcaggcag

SEQ ID NO: 8177457 - DNA, 22 bp, Homo sapiens
aaaagagaaagtggcaggcttt

SEQ ID NO: 8177458 - DNA, 22 bp, Homo sapiens
aaaagaccacctcctggtcgaa

SEQ ID NO: 8177459 - DNA, 22 bp, Homo sapiens
aaacagagggccactgaggctc

SEQ ID NO: 8177460 - DNA, 22 bp, Homo sapiens
aaacacttcctgtaacatgaca

SEQ ID NO: 8177461 - DNA, 22 bp, Homo sapiens
aaacacttcctgtaacatgaca

SEQ ID NO: 8177462 - DNA, 22 bp, Homo sapiens
aaacactttagaaagggacttg

SEQ ID NO: 8177463 - DNA, 22 bp, Homo sapiens
aaacacttgcaaaatggttcct

SEQ ID NO: 8177464 - DNA, 22 bp, Homo sapiens
aaaatgaataagttaacccagg

SEQ ID NO: 8177465 - DNA, 22 bp, Homo sapiens
aaaatgaagcaaaggcattcag

SEQ ID NO: 8177466 - DNA, 22 bp, Homo sapiens
aaaatgaacagaacaatgggga

SEQ ID NO: 8177467 - DNA, 22 bp, Homo sapiens
aaaatgaacagaacaatgggga

SEQ ID NO: 8177468 - DNA, 22 bp, Homo sapiens
aaaatctggtaatttgaatgtg

SEQ ID NO: 8177469 - DNA, 22 bp, Homo sapiens
aaaatcttgtgacttaggaagg

SEQ ID NO: 8177470 - DNA, 22 bp, Homo sapiens
aaaaacctttcattgcaaatgt

SEQ ID NO: 8177471 - DNA, 22 bp, Homo sapiens
aaaaaccattgtcttcagtctc

SEQ ID NO: 8177472 - DNA, 22 bp, Homo sapiens
aaaaacctcaattacttttgca

SEQ ID NO: 8177473 - DNA, 22 bp, Homo sapiens
aaaaaccattgtcttcagtctc

SEQ ID NO: 8177474 - DNA, 22 bp, Homo sapiens
aaaaactgcaattacttttgtc

SEQ ID NO: 8177475 - DNA, 22 bp, Homo sapiens
aaaatagttaacgttcagagta

SEQ ID NO: 8177476 - DNA, 22 bp, Homo sapiens
aaaatagttaacgttcagagta

SEQ ID NO: 8177477 - DNA, 20 bp, Homo sapiens
aaaaacagtaatgctgaaga

SEQ ID NO: 8177478 - DNA, 22 bp, Homo sapiens
aaaaacagaatgtgtctaactc

SEQ ID NO: 8177479 - DNA, 22 bp, Homo sapiens
aaaaacacaagtggcttggtct

SEQ ID NO: 8177480 - DNA, 22 bp, Homo sapiens
aaaaacacaactgtctttctct

SEQ ID NO: 8177481 - DNA, 22 bp, Homo sapiens
aaaaaattccattctgtgcctt

SEQ ID NO: 8177482 - DNA, 22 bp, Homo sapiens
aaaaaattccattctgtgcctt

SEQ ID NO: 8177483 - DNA, 22 bp, Homo sapiens
aaaaacacaactgtctttctct

SEQ ID NO: 8177484 - DNA, 22 bp, Homo sapiens
aaaaacacaactgtctttctct

SEQ ID NO: 8177485 - DNA, 22 bp, Homo sapiens
aaaaaagattgatggtggatgc

SEQ ID NO: 8177486 - DNA, 23 bp, Homo sapiens
aaaaaaccatgtaggcactcagt

SEQ ID NO: 8177487 - DNA, 22 bp, Homo sapiens
aaaaaattatcatagttcctga

SEQ ID NO: 8177488 - DNA, 22 bp, Homo sapiens
aaaaaattatcatagttcctga

SEQ ID NO: 8177489 - DNA, 22 bp, Homo sapiens
aaaaaattatcatagttcctga

SEQ ID NO: 8177490 - DNA, 22 bp, Homo sapiens
aaaaaatcagatctttggttaa

SEQ ID NO: 8177491 - DNA, 21 bp, Homo sapiens
aaagtgtgtggggaagaagga

SEQ ID NO: 8177492 - DNA, 22 bp, Homo sapiens
aaagtgtggcacaagtcacatc

SEQ ID NO: 8177493 - DNA, 22 bp, Homo sapiens
aaagtgtggagattgaactaaa

SEQ ID NO: 8177494 - DNA, 22 bp, Homo sapiens
aaagtgtaggcttcaaagaggg

SEQ ID NO: 8177495 - DNA, 23 bp, Homo sapiens
aaagtgtagccaggttaagaacc

SEQ ID NO: 8177496 - DNA, 22 bp, Homo sapiens
aaagtgttatgcaaaactctgt

SEQ ID NO: 8177497 - DNA, 22 bp, Homo sapiens
aaagtgttgatatgtgacatcc

SEQ ID NO: 8177498 - DNA, 22 bp, Homo sapiens
aaagtgttgggaagaaagtgca

SEQ ID NO: 8177499 - DNA, 22 bp, Homo sapiens
aaataacagtcagggacaacat

SEQ ID NO: 8177500 - DNA, 22 bp, Homo sapiens
aaagttttattcaagcattagt

SEQ ID NO: 8177501 - DNA, 22 bp, Homo sapiens
aaagttttatatgctgcagcga

SEQ ID NO: 8177502 - DNA, 22 bp, Homo sapiens
aaataattatagcgagtctatc

SEQ ID NO: 8177503 - DNA, 22 bp, Homo sapiens
aaataatcaatttttgtagata

SEQ ID NO: 8177504 - DNA, 22 bp, Homo sapiens
aaataagttagcagattccagt

SEQ ID NO: 8177505 - DNA, 22 bp, Homo sapiens
aaataagttagcagattccagt

SEQ ID NO: 8177506 - DNA, 22 bp, Homo sapiens
aaataagtagtttagtgttgtg

SEQ ID NO: 8177507 - DNA, 22 bp, Homo sapiens
aaataagttaaactagaatgat

SEQ ID NO: 8177508 - DNA, 22 bp, Homo sapiens
aaataagttaaactagaatgat

SEQ ID NO: 8177509 - DNA, 22 bp, Homo sapiens
aaataagcacttaactgtatca

SEQ ID NO: 8177510 - DNA, 22 bp, Homo sapiens
aaataagaggacagatgtttgg

SEQ ID NO: 8177511 - DNA, 22 bp, Homo sapiens
aaataagaaattcttctttgca

SEQ ID NO: 8177512 - DNA, 22 bp, Homo sapiens
aaataacttggtttcatcagag

SEQ ID NO: 8177513 - DNA, 22 bp, Homo sapiens
aaataacttggtttcatcagag

SEQ ID NO: 8177514 - DNA, 22 bp, Homo sapiens
aaataactttctgtgtatagtc

SEQ ID NO: 8177515 - DNA, 22 bp, Homo sapiens
aaatagcaatgtgaaaagagga

SEQ ID NO: 8177516 - DNA, 22 bp, Homo sapiens
aaatagatttcctagcattgga

SEQ ID NO: 8177517 - DNA, 22 bp, Homo sapiens
aaatagcagcctttagttaaca

SEQ ID NO: 8177518 - DNA, 22 bp, Homo sapiens
aaatagcagcctttagttaaca

SEQ ID NO: 8177519 - DNA, 22 bp, Homo sapiens
aaatagcagcctttagttaaca

SEQ ID NO: 8177520 - DNA, 22 bp, Homo sapiens
aaatagcaatgtgaaaagagga

SEQ ID NO: 8177521 - DNA, 22 bp, Homo sapiens
aaatagatttcctagcattgga

SEQ ID NO: 8177522 - DNA, 22 bp, Homo sapiens
aaatagatttcctagcattgga

SEQ ID NO: 8177523 - DNA, 22 bp, Homo sapiens
aaatagattgctgaggcattac

SEQ ID NO: 8177524 - DNA, 22 bp, Homo sapiens
aaatagagctgggttaaacttt

SEQ ID NO: 8177525 - DNA, 22 bp, Homo sapiens
aaataattgagttggtcaatat

SEQ ID NO: 8177526 - DNA, 22 bp, Homo sapiens
aaatacaaaaattagccaggca

SEQ ID NO: 8177527 - DNA, 22 bp, Homo sapiens
aaataattgagttggtcaatat

SEQ ID NO: 8177528 - DNA, 22 bp, Homo sapiens
aaatacaaaaattagccaggca

SEQ ID NO: 8177529 - DNA, 22 bp, Homo sapiens
aaataattgagttggtcaatat

SEQ ID NO: 8177530 - DNA, 22 bp, Homo sapiens
aaataattatagcgagtctatc

SEQ ID NO: 8177531 - DNA, 22 bp, Homo sapiens
aaataattatagcgagtctatc

SEQ ID NO: 8177532 - DNA, 22 bp, Homo sapiens
aaataattatagcgagtctatc

SEQ ID NO: 8177533 - DNA, 22 bp, Homo sapiens
aaataattatagcgagtctatc

SEQ ID NO: 8177534 - DNA, 22 bp, Homo sapiens
aaatactgtagataatagagtt

SEQ ID NO: 8177535 - DNA, 22 bp, Homo sapiens
aaatagacaggcttaaatagga

SEQ ID NO: 8177536 - DNA, 22 bp, Homo sapiens
aaatagacaggcttaaatagga

SEQ ID NO: 8177537 - DNA, 22 bp, Homo sapiens
aaatagacaggcttaaatagga

SEQ ID NO: 8177538 - DNA, 22 bp, Homo sapiens
aaatagacaggcttaaatagga

SEQ ID NO: 8177539 - DNA, 22 bp, Homo sapiens
aaatagacaggcttaaatagga

SEQ ID NO: 8177540 - DNA, 22 bp, Homo sapiens
aaatccatcaaatcttctagaa

SEQ ID NO: 8177541 - DNA, 22 bp, Homo sapiens
aaatccatggtaatctgttaca

SEQ ID NO: 8177542 - DNA, 22 bp, Homo sapiens
aaatcccactcagaaactgcca

SEQ ID NO: 8177543 - DNA, 22 bp, Homo sapiens
aaatcccactcagaaactgcca

SEQ ID NO: 8177544 - DNA, 22 bp, Homo sapiens
aaatcccactcacgagttttgc

SEQ ID NO: 8177545 - DNA, 22 bp, Homo sapiens
aaatcccaatgctagacccggt

SEQ ID NO: 8177546 - DNA, 23 bp, Homo sapiens
aaataggagtatctggatcatga

SEQ ID NO: 8177547 - DNA, 22 bp, Homo sapiens
aaatcagatcttacacaattgt

SEQ ID NO: 8177548 - DNA, 23 bp, Homo sapiens
aaataggagtatctggatcatga

SEQ ID NO: 8177549 - DNA, 23 bp, Homo sapiens
aaataggagtatctggatcatga

SEQ ID NO: 8177550 - DNA, 23 bp, Homo sapiens
aaataggagtatctggatcatga

SEQ ID NO: 8177551 - DNA, 23 bp, Homo sapiens
aaataggagtatctggatcatga

SEQ ID NO: 8177552 - DNA, 22 bp, Homo sapiens
aaataggagcttaagcacttct

SEQ ID NO: 8177553 - DNA, 22 bp, Homo sapiens
aaataggagcttaagcacttct

SEQ ID NO: 8177554 - DNA, 23 bp, Homo sapiens
aaataggagtatctggatcatga

SEQ ID NO: 8177555 - DNA, 23 bp, Homo sapiens
aaataggagtatctggatcatga

SEQ ID NO: 8177556 - DNA, 22 bp, Homo sapiens
aaataggaatgtggtcctggga

SEQ ID NO: 8177557 - DNA, 22 bp, Homo sapiens
aaatagcttttcataattctca

SEQ ID NO: 8177558 - DNA, 22 bp, Homo sapiens
aaatagctacatgatctctagg

SEQ ID NO: 8177559 - DNA, 22 bp, Homo sapiens
aaatagctacatgatctctagg

SEQ ID NO: 8177560 - DNA, 22 bp, Homo sapiens
aaatagcattgtatttagctga

SEQ ID NO: 8177561 - DNA, 22 bp, Homo sapiens
aaatagcataaaataggaagct

SEQ ID NO: 8177562 - DNA, 22 bp, Homo sapiens
aaatagcagcctttagttaaca

SEQ ID NO: 8177563 - DNA, 22 bp, Homo sapiens
aaatagcagcctttagttaaca

SEQ ID NO: 8177564 - DNA, 22 bp, Homo sapiens
aaatagcagctttgacagcaca

SEQ ID NO: 8177565 - DNA, 22 bp, Homo sapiens
aagcatgggaatcccacagggt

SEQ ID NO: 8177566 - DNA, 20 bp, Homo sapiens
aagcatggtcaaaacttatg

SEQ ID NO: 8177567 - DNA, 22 bp, Homo sapiens
aaatgtaagtctttgtttctta

SEQ ID NO: 8177568 - DNA, 22 bp, Homo sapiens
aaatgtacaacatccatatata

SEQ ID NO: 8177569 - DNA, 22 bp, Homo sapiens
aagcatgcaatctgtgataagg

SEQ ID NO: 8177570 - DNA, 22 bp, Homo sapiens
aagcatgcactccaaacagctt

SEQ ID NO: 8177571 - DNA, 22 bp, Homo sapiens
aagcatgagctttcaaaccaga

SEQ ID NO: 8177572 - DNA, 23 bp, Homo sapiens
aagcatcttttcctagctccatc

SEQ ID NO: 8177573 - DNA, 20 bp, Homo sapiens
aagcatctggatgtagcaat

SEQ ID NO: 8177574 - DNA, 22 bp, Homo sapiens
aagcatctataggttctaggag

SEQ ID NO: 8177575 - DNA, 22 bp, Homo sapiens
aagcatctcctcatcatttggg

SEQ ID NO: 8177576 - DNA, 22 bp, Homo sapiens
aagcatctcacctgcccccacg

SEQ ID NO: 8177577 - DNA, 22 bp, Homo sapiens
aagctcttttcaccattaaagt

SEQ ID NO: 8177578 - DNA, 22 bp, Homo sapiens
aaatgtagtatgttgcatgtat

SEQ ID NO: 8177579 - DNA, 22 bp, Homo sapiens
aaatgtagtatgttgcatgtat

SEQ ID NO: 8177580 - DNA, 22 bp, Homo sapiens
aaatgtaccttgatagtttggt

SEQ ID NO: 8177581 - DNA, 22 bp, Homo sapiens
aaatgtacgggagtagaattag

SEQ ID NO: 8177582 - DNA, 22 bp, Homo sapiens
aaatgtacgggagtagaattag

SEQ ID NO: 8177583 - DNA, 22 bp, Homo sapiens
aaatgtattgcataggatattt

SEQ ID NO: 8177584 - DNA, 22 bp, Homo sapiens
aaatgtattgcataggatattt

SEQ ID NO: 8177585 - DNA, 22 bp, Homo sapiens
aaatgtattgcataggatattt

SEQ ID NO: 8177586 - DNA, 22 bp, Homo sapiens
aaatgtatcctacttcctgagt

SEQ ID NO: 8177587 - DNA, 22 bp, Homo sapiens
aaatcctgtccatttaccagat

SEQ ID NO: 8177588 - DNA, 22 bp, Homo sapiens
aaatcctaatgacaagtttagt

SEQ ID NO: 8177589 - DNA, 19 bp, Homo sapiens
aaatcctgaggttcaaaag

SEQ ID NO: 8177590 - DNA, 23 bp, Homo sapiens
aaatcctgcctcttgtatttatc

SEQ ID NO: 8177591 - DNA, 22 bp, Homo sapiens
aaatcctaatgacaagtttagt

SEQ ID NO: 8177592 - DNA, 22 bp, Homo sapiens
aaatcctaatgacaagtttagt

SEQ ID NO: 8177593 - DNA, 22 bp, Homo sapiens
aaatcctaatgacaagtttagt

SEQ ID NO: 8177594 - DNA, 22 bp, Homo sapiens
aaatcctaaggagaatatgatt

SEQ ID NO: 8177595 - DNA, 22 bp, Homo sapiens
aaatcctaaaagtttgacttaa

SEQ ID NO: 8177596 - DNA, 22 bp, Homo sapiens
aaatcctaaaagtttgacttaa

SEQ ID NO: 8177597 - DNA, 22 bp, Homo sapiens
aaatcctaaggagaatatgatt

SEQ ID NO: 8177598 - DNA, 22 bp, Homo sapiens
aaatcccatcggagaggaggat

SEQ ID NO: 8177599 - DNA, 22 bp, Homo sapiens
aaatcccagatagtaatgtatt

SEQ ID NO: 8177600 - DNA, 22 bp, Homo sapiens
aaatcccatcggagaggaggat

SEQ ID NO: 8177601 - DNA, 22 bp, Homo sapiens
aagcacagagatgggcacgcct

SEQ ID NO: 8177602 - DNA, 22 bp, Homo sapiens
aagcacagataaaacaggattc

SEQ ID NO: 8177603 - DNA, 22 bp, Homo sapiens
aagcacagagaggtaaagtaac

SEQ ID NO: 8177604 - DNA, 22 bp, Homo sapiens
aagcacagagaggtaaagtaac

SEQ ID NO: 8177605 - DNA, 22 bp, Homo sapiens
aaatctcaaaggcttagcatct

SEQ ID NO: 8177606 - DNA, 22 bp, Homo sapiens
aagcacagaccagatctccagg

SEQ ID NO: 8177607 - DNA, 22 bp, Homo sapiens
aagcacagactccctctgagtg

SEQ ID NO: 8177608 - DNA, 22 bp, Homo sapiens
aaatgcagtttcctgagaccca

SEQ ID NO: 8177609 - DNA, 22 bp, Homo sapiens
aaatgcagttggtggggatatg

SEQ ID NO: 8177610 - DNA, 22 bp, Homo sapiens
aaatgcagtttcctgagaccca

SEQ ID NO: 8177611 - DNA, 22 bp, Homo sapiens
aaatgcatgagaaagtattctg

SEQ ID NO: 8177612 - DNA, 22 bp, Homo sapiens
aaatgcatgagaaagtattctg

SEQ ID NO: 8177613 - DNA, 20 bp, Homo sapiens
aaatgcagggctgctgcgga

SEQ ID NO: 8177614 - DNA, 20 bp, Homo sapiens
aaatgcagggctgctgcgga

SEQ ID NO: 8177615 - DNA, 22 bp, Homo sapiens
aaatgcaggtagtatttatttt

SEQ ID NO: 8177616 - DNA, 22 bp, Homo sapiens
aaatgcaggtagtatttatttt

SEQ ID NO: 8177617 - DNA, 21 bp, Homo sapiens
aaatgcagtctctgagatctg

SEQ ID NO: 8177618 - DNA, 20 bp, Homo sapiens
aaatgcagttctgccttggc

SEQ ID NO: 8177619 - DNA, 22 bp, Homo sapiens
aaatgcagtggttctacttctc

SEQ ID NO: 8177620 - DNA, 22 bp, Homo sapiens
aaatgcaggttcttgagccaag

SEQ ID NO: 8177621 - DNA, 21 bp, Homo sapiens
aaatgcagtctctgagatctg

SEQ ID NO: 8177622 - DNA, 22 bp, Homo sapiens
aaatgcaggttcttgagccaag

SEQ ID NO: 8177623 - DNA, 22 bp, Homo sapiens
aagcacagatgcaagggggacc

SEQ ID NO: 8177624 - DNA, 22 bp, Homo sapiens
aagcacagattgctgcatccat

SEQ ID NO: 8177625 - DNA, 22 bp, Homo sapiens
aaatgcacaggttttaaatcct

SEQ ID NO: 8177626 - DNA, 22 bp, Homo sapiens
aagcacagctggaacagcagga

SEQ ID NO: 8177627 - DNA, 22 bp, Homo sapiens
aaatgcaggaaattatgctttt

SEQ ID NO: 8177628 - DNA, 22 bp, Homo sapiens
aaatgcaccttgctgtgagact

SEQ ID NO: 8177629 - DNA, 22 bp, Homo sapiens
aaatgcagctgggcatgagagg

SEQ ID NO: 8177630 - DNA, 22 bp, Homo sapiens
aaatgcagctgggcatgagagg

SEQ ID NO: 8177631 - DNA, 22 bp, Homo sapiens
aaatgcagctgggcatgagagg

SEQ ID NO: 8177632 - DNA, 22 bp, Homo sapiens
aacaaacaaacattttgtcatc

SEQ ID NO: 8177633 - DNA, 22 bp, Homo sapiens
aacaaaagccgaagtaggtgtc

SEQ ID NO: 8177634 - DNA, 22 bp, Homo sapiens
aacaaacaaacattttgtcatc

SEQ ID NO: 8177635 - DNA, 22 bp, Homo sapiens
aacaaaacatttgtcttgtttc

SEQ ID NO: 8177636 - DNA, 22 bp, Homo sapiens
aacaaaacatttgtcttgtttc

SEQ ID NO: 8177637 - DNA, 22 bp, Homo sapiens
aacaaaacatttgtcttgtttc

SEQ ID NO: 8177638 - DNA, 22 bp, Homo sapiens
aaagatacttaatagttgtctg

SEQ ID NO: 8177639 - DNA, 22 bp, Homo sapiens
aacaaacaaacattttgtcatc

SEQ ID NO: 8177640 - DNA, 22 bp, Homo sapiens
aaattttctctctaagacttaa

SEQ ID NO: 8177641 - DNA, 22 bp, Homo sapiens
aaattttcagagcactagagaa

SEQ ID NO: 8177642 - DNA, 22 bp, Homo sapiens
aaattttcagagcactagagaa

SEQ ID NO: 8177643 - DNA, 22 bp, Homo sapiens
aaattttgtattctagttctag

SEQ ID NO: 8177644 - DNA, 22 bp, Homo sapiens
aaattttagtaaggaagttgag

SEQ ID NO: 8177645 - DNA, 22 bp, Homo sapiens
aaattgtgagctatagatctag

SEQ ID NO: 8177646 - DNA, 22 bp, Homo sapiens
aaattgtgcatccttggcatat

SEQ ID NO: 8177647 - DNA, 22 bp, Homo sapiens
aaattgtgctttgactcctgcc

SEQ ID NO: 8177648 - DNA, 22 bp, Homo sapiens
aaattgtgctcacactgatatt

SEQ ID NO: 8177649 - DNA, 22 bp, Homo sapiens
aaagccataagcctaatactaa

SEQ ID NO: 8177650 - DNA, 22 bp, Homo sapiens
aaagccatcagtaaaatgattt

SEQ ID NO: 8177651 - DNA, 22 bp, Homo sapiens
aaagccatcagtaaaatgattt

SEQ ID NO: 8177652 - DNA, 22 bp, Homo sapiens
aaagccagttcttttatattgg

SEQ ID NO: 8177653 - DNA, 22 bp, Homo sapiens
aaagccagtttctggaagtacc

SEQ ID NO: 8177654 - DNA, 22 bp, Homo sapiens
aaagccataagcctaatactaa

SEQ ID NO: 8177655 - DNA, 22 bp, Homo sapiens
aaagccagtggtatgagagaaa

SEQ ID NO: 8177656 - DNA, 22 bp, Homo sapiens
aaagccaggttgtgtgcaggaa

SEQ ID NO: 8177657 - DNA, 22 bp, Homo sapiens
aaagccagggtccaggcctgcc

SEQ ID NO: 8177658 - DNA, 22 bp, Homo sapiens
aaagccagggtccaggcctgcc

SEQ ID NO: 8177659 - DNA, 22 bp, Homo sapiens
aaagccaggggagggattccca

SEQ ID NO: 8177660 - DNA, 22 bp, Homo sapiens
aaagccagttcttagagaaagc

SEQ ID NO: 8177661 - DNA, 22 bp, Homo sapiens
aaagccagttcttagagaaagc

SEQ ID NO: 8177662 - DNA, 22 bp, Homo sapiens
aaagccacgtggcctggggagc

SEQ ID NO: 8177663 - DNA, 22 bp, Homo sapiens
aaagatcagaggatagctgagt

SEQ ID NO: 8177664 - DNA, 22 bp, Homo sapiens
aaagatcagaggatagctgagt

SEQ ID NO: 8177665 - DNA, 22 bp, Homo sapiens
aaagatcacgtcccaggactcg

SEQ ID NO: 8177666 - DNA, 22 bp, Homo sapiens
aaagatcacactgtggggcagt

SEQ ID NO: 8177667 - DNA, 20 bp, Homo sapiens
aaagatactttttgtaatgg

SEQ ID NO: 8177668 - DNA, 22 bp, Homo sapiens
aaagatacttaatagttgtctg

SEQ ID NO: 8177669 - DNA, 20 bp, Homo sapiens
aaagatactttttgtaatgg

SEQ ID NO: 8177670 - DNA, 20 bp, Homo sapiens
aaagatactttttgtaatgg

SEQ ID NO: 8177671 - DNA, 22 bp, Homo sapiens
aaagatcaatagataaagctac

SEQ ID NO: 8177672 - DNA, 23 bp, Homo sapiens
aaagatcaaagtggcaggcctgt

SEQ ID NO: 8177673 - DNA, 22 bp, Homo sapiens
aaagatatgtctccaaagagat

SEQ ID NO: 8177674 - DNA, 22 bp, Homo sapiens
aacagcaatagcactattcatt

SEQ ID NO: 8177675 - DNA, 22 bp, Homo sapiens
aacagcaatagcactattcatt

SEQ ID NO: 8177676 - DNA, 22 bp, Homo sapiens
aacagcagaaactgcaagctac

SEQ ID NO: 8177677 - DNA, 22 bp, Homo sapiens
aacagcagaggagcgatggctg

SEQ ID NO: 8177678 - DNA, 22 bp, Homo sapiens
aacagcagcaagtaagcaggtc

SEQ ID NO: 8177679 - DNA, 22 bp, Homo sapiens
aaagccttttctgtttaacaca

SEQ ID NO: 8177680 - DNA, 22 bp, Homo sapiens
aaagctaaggtagcattggaga

SEQ ID NO: 8177681 - DNA, 22 bp, Homo sapiens
aacagcagcatgacagctgggt

SEQ ID NO: 8177682 - DNA, 22 bp, Homo sapiens
aacagcagcaagtaagcaggtc

SEQ ID NO: 8177683 - DNA, 22 bp, Homo sapiens
aaagctcttggattttagactc

SEQ ID NO: 8177684 - DNA, 22 bp, Homo sapiens
aacagatttaagaagccaaggt

SEQ ID NO: 8177685 - DNA, 22 bp, Homo sapiens
aacagattgtaacctgatagcc

SEQ ID NO: 8177686 - DNA, 22 bp, Homo sapiens
aaagccatctgtattaagtgaa

SEQ ID NO: 8177687 - DNA, 22 bp, Homo sapiens
aaagccatgaatgttatagagg

SEQ ID NO: 8177688 - DNA, 22 bp, Homo sapiens
aaagctgctttaaacatctatg

SEQ ID NO: 8177689 - DNA, 22 bp, Homo sapiens
aaagctgctttggtttctggaa

SEQ ID NO: 8177690 - DNA, 22 bp, Homo sapiens
aaagctgctgtgaatggtttgg

SEQ ID NO: 8177691 - DNA, 22 bp, Homo sapiens
aaagctgctgtgaatggtttgg

SEQ ID NO: 8177692 - DNA, 22 bp, Homo sapiens
aaagctgcccagctgcctgttt

SEQ ID NO: 8177693 - DNA, 22 bp, Homo sapiens
aaagctgattgcaggaagagag

SEQ ID NO: 8177694 - DNA, 22 bp, Homo sapiens
aaagctcttttccaagtattga

SEQ ID NO: 8177695 - DNA, 22 bp, Homo sapiens
aaagctttctagctatgttcta

SEQ ID NO: 8177696 - DNA, 22 bp, Homo sapiens
aaagcttttgttttcgtaactg

SEQ ID NO: 8177697 - DNA, 22 bp, Homo sapiens
aaaggaagatgccaggactctg

SEQ ID NO: 8177698 - DNA, 22 bp, Homo sapiens
aaaggttattattactattgtc

SEQ ID NO: 8177699 - DNA, 22 bp, Homo sapiens
aaaggaagatgccaggactctg

SEQ ID NO: 8177700 - DNA, 22 bp, Homo sapiens
aaaggaagatgccaggactctg

SEQ ID NO: 8177701 - DNA, 22 bp, Homo sapiens
aaaggtttccgagctttaattt

SEQ ID NO: 8177702 - DNA, 22 bp, Homo sapiens
aaaggtttgaggtgggaagagg

SEQ ID NO: 8177703 - DNA, 22 bp, Homo sapiens
aaaggtttgcatggaatttacc

SEQ ID NO: 8177704 - DNA, 22 bp, Homo sapiens
aaaggtttgaggtgggaagagg

SEQ ID NO: 8177705 - DNA, 22 bp, Homo sapiens
aaaggtttgcatggaatttacc

SEQ ID NO: 8177706 - DNA, 22 bp, Homo sapiens
aaaggtttgccgacctctgctt

SEQ ID NO: 8177707 - DNA, 22 bp, Homo sapiens
aaaggtttgccgacctctgctt

SEQ ID NO: 8177708 - DNA, 22 bp, Homo sapiens
aaaggttttatgttttccactt

SEQ ID NO: 8177709 - DNA, 22 bp, Homo sapiens
aaaggttttattctgagctctg

SEQ ID NO: 8177710 - DNA, 22 bp, Homo sapiens
aaaggttttcatcacagcaaga

SEQ ID NO: 8177711 - DNA, 22 bp, Homo sapiens
aaaggttttatgttttccactt

SEQ ID NO: 8177712 - DNA, 22 bp, Homo sapiens
aaaggttttattctgagctctg

SEQ ID NO: 8177713 - DNA, 22 bp, Homo sapiens
aaaggtttatttgttgctcaca

SEQ ID NO: 8177714 - DNA, 22 bp, Homo sapiens
aaaggtttatttgttgctcaca

SEQ ID NO: 8177715 - DNA, 22 bp, Homo sapiens
aaaggtttccgagctttaattt

SEQ ID NO: 8177716 - DNA, 22 bp, Homo sapiens
aaaggtttatttaatcagggag

SEQ ID NO: 8177717 - DNA, 22 bp, Homo sapiens
aaaggtttatttaatcagggag

SEQ ID NO: 8177718 - DNA, 22 bp, Homo sapiens
aaaggtttattgattctgctct

SEQ ID NO: 8177719 - DNA, 22 bp, Homo sapiens
aaaggtttattgattctgctct

SEQ ID NO: 8177720 - DNA, 22 bp, Homo sapiens
aaaggtttattgctatggttgt

SEQ ID NO: 8177721 - DNA, 22 bp, Homo sapiens
aaaggtttattgctatggttgt

SEQ ID NO: 8177722 - DNA, 22 bp, Homo sapiens
aaaggttttctagggttgaggg

SEQ ID NO: 8177723 - DNA, 22 bp, Homo sapiens
aaaggttttcatcacagcaaga

SEQ ID NO: 8177724 - DNA, 22 bp, Homo sapiens
aactaaaactggtttgttctct

SEQ ID NO: 8177725 - DNA, 22 bp, Homo sapiens
aactaaaactggtttgttctct

SEQ ID NO: 8177726 - DNA, 18 bp, Homo sapiens
aactaaagatctttaagc

SEQ ID NO: 8177727 - DNA, 22 bp, Homo sapiens
aactaaaactggtttgttctct

SEQ ID NO: 8177728 - DNA, 22 bp, Homo sapiens
aactaaatctggcatttagagc

SEQ ID NO: 8177729 - DNA, 22 bp, Homo sapiens
aactaaatctggcatttagagc

SEQ ID NO: 8177730 - DNA, 22 bp, Homo sapiens
aactaaatctggcatttagagc

SEQ ID NO: 8177731 - DNA, 22 bp, Homo sapiens
aactaaagtaaccaaggatatc

SEQ ID NO: 8177732 - DNA, 18 bp, Homo sapiens
aactaaagatctttaagc

SEQ ID NO: 8177733 - DNA, 22 bp, Homo sapiens
aactaaatctggcatttagagc

SEQ ID NO: 8177734 - DNA, 22 bp, Homo sapiens
aactaaatctggcatttagagc

SEQ ID NO: 8177735 - DNA, 22 bp, Homo sapiens
aactaaatctggcatttagagc

SEQ ID NO: 8177736 - DNA, 22 bp, Homo sapiens
aaagtactttgggctatgtttg

SEQ ID NO: 8177737 - DNA, 22 bp, Homo sapiens
aaagtacccaagaacagagtga

SEQ ID NO: 8177738 - DNA, 22 bp, Homo sapiens
aaagtaattgtggtttctgtca

SEQ ID NO: 8177739 - DNA, 22 bp, Homo sapiens
aaagtacaaggaaaggatctga

SEQ ID NO: 8177740 - DNA, 22 bp, Homo sapiens
aaagtaattgtggtttctgtca

SEQ ID NO: 8177741 - DNA, 22 bp, Homo sapiens
aaagtaattgtggttcttgcca

SEQ ID NO: 8177742 - DNA, 22 bp, Homo sapiens
aactaacagtcattaaaagaac

SEQ ID NO: 8177743 - DNA, 22 bp, Homo sapiens
aactaacagtcattaaaagaac

SEQ ID NO: 8177744 - DNA, 22 bp, Homo sapiens
aactaacagtcattaaaagaac

SEQ ID NO: 8177745 - DNA, 22 bp, Homo sapiens
aaagtcacatagcatcacttct

SEQ ID NO: 8177746 - DNA, 22 bp, Homo sapiens
aaagtgctggtattacaggtgt

SEQ ID NO: 8177747 - DNA, 22 bp, Homo sapiens
aaagtgcttctctttggtgggt

SEQ ID NO: 8177748 - DNA, 23 bp, Homo sapiens
aaagtgcttggcacgacacctgg

SEQ ID NO: 8177749 - DNA, 23 bp, Homo sapiens
aaagtgcttggcacgacacctgg

SEQ ID NO: 8177750 - DNA, 22 bp, Homo sapiens
aaagtgctttaggatatttgga

SEQ ID NO: 8177751 - DNA, 22 bp, Homo sapiens
aaagtgggaacaatggagagtg

SEQ ID NO: 8177752 - DNA, 22 bp, Homo sapiens
aaagtgggaacaatggagagtg

SEQ ID NO: 8177753 - DNA, 22 bp, Homo sapiens
aaagtggggtctagagggcctg

SEQ ID NO: 8177754 - DNA, 22 bp, Homo sapiens
aaagtgggaacaatggagagtg

SEQ ID NO: 8177755 - DNA, 22 bp, Homo sapiens
aaagtggtttttcagactttga

SEQ ID NO: 8177756 - DNA, 22 bp, Homo sapiens
aaagtagcttagttgatatttc

SEQ ID NO: 8177757 - DNA, 22 bp, Homo sapiens
aaagtagtccttggagcgaaat

SEQ ID NO: 8177758 - DNA, 22 bp, Homo sapiens
aaagtatttgtgatttttacca

SEQ ID NO: 8177759 - DNA, 22 bp, Homo sapiens
aaagtatttgtgatttttacca

SEQ ID NO: 8177760 - DNA, 22 bp, Homo sapiens
aaagtatttgtgatttttacca

SEQ ID NO: 8177761 - DNA, 22 bp, Homo sapiens
aaagtattcaaaaatatttggt

SEQ ID NO: 8177762 - DNA, 22 bp, Homo sapiens
aaagtattcaaaaatatttggt

SEQ ID NO: 8177763 - DNA, 22 bp, Homo sapiens
aaagtattcttgactgtttttc

SEQ ID NO: 8177764 - DNA, 22 bp, Homo sapiens
aaagtattcttgactgtttttc

SEQ ID NO: 8177765 - DNA, 22 bp, Homo sapiens
gggctcagcctcctcacttcga

SEQ ID NO: 8177766 - DNA, 22 bp, Homo sapiens
gggctcagcctcctcacttcga

SEQ ID NO: 8177767 - DNA, 22 bp, Homo sapiens
gggctcagcctcctcacttcga

SEQ ID NO: 8177768 - DNA, 21 bp, Homo sapiens
gggctcagcgctcggctcctc

SEQ ID NO: 8177769 - DNA, 22 bp, Homo sapiens
gggctcagcctcctcacttcga

SEQ ID NO: 8177770 - DNA, 22 bp, Homo sapiens
gggctcagccccattgaaccag

SEQ ID NO: 8177771 - DNA, 23 bp, Homo sapiens
gggctcagatttcattctgtgcc

SEQ ID NO: 8177772 - DNA, 23 bp, Homo sapiens
gggctcagatttcattctgtgcc

SEQ ID NO: 8177773 - DNA, 16 bp, Homo sapiens
gggctcagatctttga

SEQ ID NO: 8177774 - DNA, 22 bp, Homo sapiens
gggctcagaggagtggcctggg

SEQ ID NO: 8177775 - DNA, 22 bp, Homo sapiens
gggctcagagcatttgggttgg

SEQ ID NO: 8177776 - DNA, 22 bp, Homo sapiens
gggctcagaggagtggcctggg

SEQ ID NO: 8177777 - DNA, 22 bp, Homo sapiens
gggctcagacatccctcctgga

SEQ ID NO: 8177778 - DNA, 22 bp, Homo sapiens
gggctcagacatccctcctgga

SEQ ID NO: 8177779 - DNA, 22 bp, Homo sapiens
gggctcagagcatttgggttgg

SEQ ID NO: 8177780 - DNA, 22 bp, Homo sapiens
gggctcagctccttccttccta

SEQ ID NO: 8177781 - DNA, 22 bp, Homo sapiens
gggctcagctgggcgtgctggt

SEQ ID NO: 8177782 - DNA, 22 bp, Homo sapiens
gggctcagctccttccttccta

SEQ ID NO: 8177783 - DNA, 22 bp, Homo sapiens
gggctcagctccttccttccta

SEQ ID NO: 8177784 - DNA, 21 bp, Homo sapiens
gggctcagcgctcggctcctc

SEQ ID NO: 8177785 - DNA, 21 bp, Homo sapiens
gggctcagcgctcggctcctc

SEQ ID NO: 8177786 - DNA, 22 bp, Homo sapiens
gggctcagttctgcttcatgct

SEQ ID NO: 8177787 - DNA, 22 bp, Homo sapiens
gggctcagttctgcttcatgct

SEQ ID NO: 8177788 - DNA, 22 bp, Homo sapiens
gggctcaggagtttgaggctgc

SEQ ID NO: 8177789 - DNA, 22 bp, Homo sapiens
gggctcagttctgcttcatgct

SEQ ID NO: 8177790 - DNA, 22 bp, Homo sapiens
gggctctggaaatgggagctcc

SEQ ID NO: 8177791 - DNA, 22 bp, Homo sapiens
gggctctggaaatgggagctcc

SEQ ID NO: 8177792 - DNA, 22 bp, Homo sapiens
gggctctggaaatgggagctcc

SEQ ID NO: 8177793 - DNA, 22 bp, Homo sapiens
gggctctggaaatgggagctcc

SEQ ID NO: 8177794 - DNA, 22 bp, Homo sapiens
gggctctggaaatgggagctcc

SEQ ID NO: 8177795 - DNA, 22 bp, Homo sapiens
gggctctggaaatgggagctcc

SEQ ID NO: 8177796 - DNA, 22 bp, Homo sapiens
gggctctggaaggtgcaccatg

SEQ ID NO: 8177797 - DNA, 22 bp, Homo sapiens
gggctctggacccaggcaagag

SEQ ID NO: 8177798 - DNA, 22 bp, Homo sapiens
gggctctggaaggtgcaccatg

SEQ ID NO: 8177799 - DNA, 22 bp, Homo sapiens
gggctctggacccaggcaagag

SEQ ID NO: 8177800 - DNA, 22 bp, Homo sapiens
gggctctggacccaggcaagag

SEQ ID NO: 8177801 - DNA, 22 bp, Homo sapiens
gggctctggacccaggcaagag

SEQ ID NO: 8177802 - DNA, 22 bp, Homo sapiens
gggctctggacccaggcaagag

SEQ ID NO: 8177803 - DNA, 18 bp, Homo sapiens
gggctctggcatctgggt

SEQ ID NO: 8177804 - DNA, 18 bp, Homo sapiens
gggctctggcatctgggt

SEQ ID NO: 8177805 - DNA, 22 bp, Homo sapiens
gggctctggatggagcctgcag

SEQ ID NO: 8177806 - DNA, 22 bp, Homo sapiens
gggctctggatggagcctgcag

SEQ ID NO: 8177807 - DNA, 22 bp, Homo sapiens
gggctctggatggagcctgcag

SEQ ID NO: 8177808 - DNA, 22 bp, Homo sapiens
gggctctggatggagcctgcag

SEQ ID NO: 8177809 - DNA, 22 bp, Homo sapiens
gggctctggatggagcctgcag

SEQ ID NO: 8177810 - DNA, 22 bp, Homo sapiens
gggctctggagttctagaaaga

SEQ ID NO: 8177811 - DNA, 22 bp, Homo sapiens
gggctctggagttctagaaaga

SEQ ID NO: 8177812 - DNA, 22 bp, Homo sapiens
gggctctggacccaggcaagag

SEQ ID NO: 8177813 - DNA, 22 bp, Homo sapiens
gggctctggagttctagaaaga

SEQ ID NO: 8177814 - DNA, 22 bp, Homo sapiens
gggctctggatggagcctgcag

SEQ ID NO: 8177815 - DNA, 22 bp, Homo sapiens
gggctctggatggagcctgcag

SEQ ID NO: 8177816 - DNA, 22 bp, Homo sapiens
gggctctgaatgagttaccaag

SEQ ID NO: 8177817 - DNA, 22 bp, Homo sapiens
gggctctgaatgagttaccaag

SEQ ID NO: 8177818 - DNA, 22 bp, Homo sapiens
gggctctgactgaatattgaat

SEQ ID NO: 8177819 - DNA, 22 bp, Homo sapiens
gggctctgactgaatattgaat

SEQ ID NO: 8177820 - DNA, 22 bp, Homo sapiens
gggctctggaaatgggagctcc

SEQ ID NO: 8177821 - DNA, 22 bp, Homo sapiens
gggctctgagctctgggaatta

SEQ ID NO: 8177822 - DNA, 22 bp, Homo sapiens
gggctctgagctctgggaatta

SEQ ID NO: 8177823 - DNA, 22 bp, Homo sapiens
gggctctgagctctgggaatta

SEQ ID NO: 8177824 - DNA, 22 bp, Homo sapiens
gggctctgactgaatattgaat

SEQ ID NO: 8177825 - DNA, 22 bp, Homo sapiens
gggctccaactacatcagcctt

SEQ ID NO: 8177826 - DNA, 22 bp, Homo sapiens
gggctctgaatcccaggtctgc

SEQ ID NO: 8177827 - DNA, 22 bp, Homo sapiens
gggctccaacggtgagcatgga

SEQ ID NO: 8177828 - DNA, 22 bp, Homo sapiens
gggctccaacggtgagcatgga

SEQ ID NO: 8177829 - DNA, 22 bp, Homo sapiens
gggctccaaccccagtgaactc

SEQ ID NO: 8177830 - DNA, 22 bp, Homo sapiens
gggctccaaaatcctgtagcct

SEQ ID NO: 8177831 - DNA, 22 bp, Homo sapiens
gggctccaaaatcctgtagcct

SEQ ID NO: 8177832 - DNA, 22 bp, Homo sapiens
gggcaggtggcctcttgtacta

SEQ ID NO: 8177833 - DNA, 22 bp, Homo sapiens
gggcaggtggcagggtctctgg

SEQ ID NO: 8177834 - DNA, 22 bp, Homo sapiens
gggcaggtggcagggtctctgg

SEQ ID NO: 8177835 - DNA, 22 bp, Homo sapiens
gggcaggtggcagggtctctgg

SEQ ID NO: 8177836 - DNA, 22 bp, Homo sapiens
gggcaggtggagggcccagcca

SEQ ID NO: 8177837 - DNA, 22 bp, Homo sapiens
gggcaggtggagggcccagcca

SEQ ID NO: 8177838 - DNA, 22 bp, Homo sapiens
gggcaggtggcaaagccagagg

SEQ ID NO: 8177839 - DNA, 22 bp, Homo sapiens
gggcaggtggcaaagccagagg

SEQ ID NO: 8177840 - DNA, 22 bp, Homo sapiens
gggcaggtgttgtcaatctaat

SEQ ID NO: 8177841 - DNA, 22 bp, Homo sapiens
gggcaggtgtttccaaggtgag

SEQ ID NO: 8177842 - DNA, 22 bp, Homo sapiens
gggcaggtgtttccaaggtgag

SEQ ID NO: 8177843 - DNA, 22 bp, Homo sapiens
gggcaggtgtttccaaggtgag

SEQ ID NO: 8177844 - DNA, 22 bp, Homo sapiens
gggcaggtgtgcagagctgttg

SEQ ID NO: 8177845 - DNA, 22 bp, Homo sapiens
gggcaggtgttgtcaatctaat

SEQ ID NO: 8177846 - DNA, 22 bp, Homo sapiens
gggcaggtggcctcttgtacta

SEQ ID NO: 8177847 - DNA, 22 bp, Homo sapiens
gggcaggtggcctcttgtacta

SEQ ID NO: 8177848 - DNA, 22 bp, Homo sapiens
gggcaggtgtgcagagctgttg

SEQ ID NO: 8177849 - DNA, 22 bp, Homo sapiens
gggccccttgtatctctggctc

SEQ ID NO: 8177850 - DNA, 22 bp, Homo sapiens
gggccccttgtatctctggctc

SEQ ID NO: 8177851 - DNA, 22 bp, Homo sapiens
gggccccttgtatctctggctc

SEQ ID NO: 8177852 - DNA, 22 bp, Homo sapiens
gggccccttgctgctctgctgg

SEQ ID NO: 8177853 - DNA, 22 bp, Homo sapiens
gggccccttgctgctctgctgg

SEQ ID NO: 8177854 - DNA, 22 bp, Homo sapiens
gggccccactggggctgcctgc

SEQ ID NO: 8177855 - DNA, 22 bp, Homo sapiens
gggccccaagaacctcctcctg

SEQ ID NO: 8177856 - DNA, 22 bp, Homo sapiens
gggcccaggcctccttccttcc

SEQ ID NO: 8177857 - DNA, 22 bp, Homo sapiens
gggcccaggcctccttccttcc

SEQ ID NO: 8177858 - DNA, 22 bp, Homo sapiens
gggccccaaaatgccaggctct

SEQ ID NO: 8177859 - DNA, 22 bp, Homo sapiens
gggcccagtaccctctgccaag

SEQ ID NO: 8177860 - DNA, 22 bp, Homo sapiens
gggcccagtaccctctgccaag

SEQ ID NO: 8177861 - DNA, 22 bp, Homo sapiens
gggcccagtaccctctgccaag

SEQ ID NO: 8177862 - DNA, 22 bp, Homo sapiens
gggccctgggattcagagcaag

SEQ ID NO: 8177863 - DNA, 22 bp, Homo sapiens
gggccctgcctaaggaacacac

SEQ ID NO: 8177864 - DNA, 22 bp, Homo sapiens
gggccctgcctaaggaacacac

SEQ ID NO: 8177865 - DNA, 22 bp, Homo sapiens
gggccctgcctaaggaacacac

SEQ ID NO: 8177866 - DNA, 22 bp, Homo sapiens
gggccctggggatgtggacgcg

SEQ ID NO: 8177867 - DNA, 22 bp, Homo sapiens
gggccctgccccgtggctctga

SEQ ID NO: 8177868 - DNA, 22 bp, Homo sapiens
gggccctgccccgtggctctga

SEQ ID NO: 8177869 - DNA, 22 bp, Homo sapiens
gggccctgccccgtggctctga

SEQ ID NO: 8177870 - DNA, 22 bp, Homo sapiens
gggccctgatctgtgagcgcag

SEQ ID NO: 8177871 - DNA, 22 bp, Homo sapiens
gggccctcagtcccaggccttc

SEQ ID NO: 8177872 - DNA, 22 bp, Homo sapiens
gggccctctgcagctgcccagg

SEQ ID NO: 8177873 - DNA, 22 bp, Homo sapiens
gggccgtagaccacgtccgggc

SEQ ID NO: 8177874 - DNA, 22 bp, Homo sapiens
gggccggagctgggtcccgcgc

SEQ ID NO: 8177875 - DNA, 22 bp, Homo sapiens
gggccctggggcctgatttgca

SEQ ID NO: 8177876 - DNA, 22 bp, Homo sapiens
gggccctggggcctgatttgca

SEQ ID NO: 8177877 - DNA, 22 bp, Homo sapiens
gggccctgtgatttcttgagga

SEQ ID NO: 8177878 - DNA, 22 bp, Homo sapiens
gggccctgtgatttcttgagga

SEQ ID NO: 8177879 - DNA, 22 bp, Homo sapiens
gggctatctgctcaccttcctc

SEQ ID NO: 8177880 - DNA, 18 bp, Homo sapiens
gggctcacacaggtcatc

SEQ ID NO: 8177881 - DNA, 22 bp, Homo sapiens
gggctcagacatccctcctgga

SEQ ID NO: 8177882 - DNA, 22 bp, Homo sapiens
gggcctcactatgtggtccagg

SEQ ID NO: 8177883 - DNA, 22 bp, Homo sapiens
gggagctcgtgcgcccaggtgc

SEQ ID NO: 8177884 - DNA, 22 bp, Homo sapiens
gggagcgggactgcgcaggctt

SEQ ID NO: 8177885 - DNA, 22 bp, Homo sapiens
gggagctgaactgctgaagttg

SEQ ID NO: 8177886 - DNA, 22 bp, Homo sapiens
gggagctctccctgaggcctgg

SEQ ID NO: 8177887 - DNA, 22 bp, Homo sapiens
gggagctgaactgctgaagttg

SEQ ID NO: 8177888 - DNA, 22 bp, Homo sapiens
gggagctgaactgctgaagttg

SEQ ID NO: 8177889 - DNA, 22 bp, Homo sapiens
gggagctgaactgctgaagttg

SEQ ID NO: 8177890 - DNA, 22 bp, Homo sapiens
gggagctgaactgctgaagttg

SEQ ID NO: 8177891 - DNA, 22 bp, Homo sapiens
gggagctgaaggagccggcggg

SEQ ID NO: 8177892 - DNA, 22 bp, Homo sapiens
gggagctgaaggagccggcggg

SEQ ID NO: 8177893 - DNA, 22 bp, Homo sapiens
gggagctgaaggagccggcggg

SEQ ID NO: 8177894 - DNA, 22 bp, Homo sapiens
gggagctgaagtaggggtaaat

SEQ ID NO: 8177895 - DNA, 22 bp, Homo sapiens
gggagctgaagtaggggtaaat

SEQ ID NO: 8177896 - DNA, 22 bp, Homo sapiens
gggagctgaatggcaatggaga

SEQ ID NO: 8177897 - DNA, 22 bp, Homo sapiens
gggagtggagagcaatggatga

SEQ ID NO: 8177898 - DNA, 22 bp, Homo sapiens
gggagtggagagcaatggatga

SEQ ID NO: 8177899 - DNA, 22 bp, Homo sapiens
gggagtggagagcaatggatga

SEQ ID NO: 8177900 - DNA, 22 bp, Homo sapiens
gggagtggattatgtggaccca

SEQ ID NO: 8177901 - DNA, 16 bp, Homo sapiens
gggagtgaaggagggt

SEQ ID NO: 8177902 - DNA, 22 bp, Homo sapiens
gggagctgaatggcaatggaga

SEQ ID NO: 8177903 - DNA, 22 bp, Homo sapiens
gggaggttgaggctgcagtgag

SEQ ID NO: 8177904 - DNA, 22 bp, Homo sapiens
gggagctgaatggcaatggaga

SEQ ID NO: 8177905 - DNA, 22 bp, Homo sapiens
gggagtgggtttggcctaggcc

SEQ ID NO: 8177906 - DNA, 22 bp, Homo sapiens
gggagtggggcttaccttgaag

SEQ ID NO: 8177907 - DNA, 22 bp, Homo sapiens
gggagtggggcttaccttgaag

SEQ ID NO: 8177908 - DNA, 22 bp, Homo sapiens
gggagtggggcttaccttgaag

SEQ ID NO: 8177909 - DNA, 22 bp, Homo sapiens
gggagtggggcttaccttgaag

SEQ ID NO: 8177910 - DNA, 22 bp, Homo sapiens
gggagtgggtttggcctaggcc

SEQ ID NO: 8177911 - DNA, 22 bp, Homo sapiens
gggagtgggtttggcctaggcc

SEQ ID NO: 8177912 - DNA, 22 bp, Homo sapiens
gggagtgggtttggcctaggcc

SEQ ID NO: 8177913 - DNA, 22 bp, Homo sapiens
gggagtggtcctttcctatctg

SEQ ID NO: 8177914 - DNA, 22 bp, Homo sapiens
gggagtggtcctttcctatctg

SEQ ID NO: 8177915 - DNA, 22 bp, Homo sapiens
gggagtggtcctttcctatctg

SEQ ID NO: 8177916 - DNA, 20 bp, Homo sapiens
gggagtggtggtagcctgtg

SEQ ID NO: 8177917 - DNA, 20 bp, Homo sapiens
gggagtggtggtagcctgtg

SEQ ID NO: 8177918 - DNA, 20 bp, Homo sapiens
gggagtggtggtagcctgtg

SEQ ID NO: 8177919 - DNA, 20 bp, Homo sapiens
gggagtggtggtagcctgtg

SEQ ID NO: 8177920 - DNA, 22 bp, Homo sapiens
gggagtggttgatggtgaaaat

SEQ ID NO: 8177921 - DNA, 22 bp, Homo sapiens
gggagtggttgatggtgaaaat

SEQ ID NO: 8177922 - DNA, 22 bp, Homo sapiens
gggataggaaacttaggtacac

SEQ ID NO: 8177923 - DNA, 19 bp, Homo sapiens
gggagttgttctgatccta

SEQ ID NO: 8177924 - DNA, 22 bp, Homo sapiens
gggataggaaacttaggtacac

SEQ ID NO: 8177925 - DNA, 22 bp, Homo sapiens
gggataggagattgggagtgtt

SEQ ID NO: 8177926 - DNA, 22 bp, Homo sapiens
gggataggagattgggagtgtt

SEQ ID NO: 8177927 - DNA, 22 bp, Homo sapiens
gggataggagattgggagtgtt

SEQ ID NO: 8177928 - DNA, 22 bp, Homo sapiens
gggataggagattgggagtgtt

SEQ ID NO: 8177929 - DNA, 22 bp, Homo sapiens
gggataggtttggaagaggtgg

SEQ ID NO: 8177930 - DNA, 22 bp, Homo sapiens
gggataggtttggaagaggtgg

SEQ ID NO: 8177931 - DNA, 23 bp, Homo sapiens
gggatatggaccttggaggagtc

SEQ ID NO: 8177932 - DNA, 22 bp, Homo sapiens
gggatcagaaacatagccctga

SEQ ID NO: 8177933 - DNA, 22 bp, Homo sapiens
gggatcagcaagccactgcacc

SEQ ID NO: 8177934 - DNA, 22 bp, Homo sapiens
gggatcagactctgggatgtag

SEQ ID NO: 8177935 - DNA, 22 bp, Homo sapiens
gggatcagattccctgtcccaa

SEQ ID NO: 8177936 - DNA, 22 bp, Homo sapiens
gggatcagactctgggatgtag

SEQ ID NO: 8177937 - DNA, 20 bp, Homo sapiens
gggatcaggaaaggaggcta

SEQ ID NO: 8177938 - DNA, 20 bp, Homo sapiens
gggatcaggaaaggaggcta

SEQ ID NO: 8177939 - DNA, 22 bp, Homo sapiens
gggatcagcaagccactgcacc

SEQ ID NO: 8177940 - DNA, 19 bp, Homo sapiens
gggatcagcccagggctct

SEQ ID NO: 8177941 - DNA, 19 bp, Homo sapiens
gggatcagcccagggctct

SEQ ID NO: 8177942 - DNA, 19 bp, Homo sapiens
gggatcagcccagggctct

SEQ ID NO: 8177943 - DNA, 22 bp, Homo sapiens
gggcaggtgccagctccctgtc

SEQ ID NO: 8177944 - DNA, 22 bp, Homo sapiens
gggcaggtgccagctccctgtc

SEQ ID NO: 8177945 - DNA, 22 bp, Homo sapiens
gggcaggtgccagctccctgtc

SEQ ID NO: 8177946 - DNA, 22 bp, Homo sapiens
gggcaggtgcccagggccagag

SEQ ID NO: 8177947 - DNA, 22 bp, Homo sapiens
gggcaggtgcccagggccagag

SEQ ID NO: 8177948 - DNA, 22 bp, Homo sapiens
gggcaggtgacctcttgtcctg

SEQ ID NO: 8177949 - DNA, 22 bp, Homo sapiens
gggcaggtgattttggctccat

SEQ ID NO: 8177950 - DNA, 22 bp, Homo sapiens
gggcaggtgacctcttgtcctg

SEQ ID NO: 8177951 - DNA, 22 bp, Homo sapiens
gggcaggtgattttggctccat

SEQ ID NO: 8177952 - DNA, 22 bp, Homo sapiens
gggcaggtgattttggctccat

SEQ ID NO: 8177953 - DNA, 15 bp, Homo sapiens
gggcaggtctggggc

SEQ ID NO: 8177954 - DNA, 15 bp, Homo sapiens
gggcaggtctggggc

SEQ ID NO: 8177955 - DNA, 22 bp, Homo sapiens
gggcaggtctgggtcagcctga

SEQ ID NO: 8177956 - DNA, 22 bp, Homo sapiens
gggcaggtctgggtcagcctga

SEQ ID NO: 8177957 - DNA, 21 bp, Homo sapiens
gggcaggtctctgatgtcaac

SEQ ID NO: 8177958 - DNA, 21 bp, Homo sapiens
gggcagaggggcctcctgggt

SEQ ID NO: 8177959 - DNA, 21 bp, Homo sapiens
gggcagaggggcctcctgggt

SEQ ID NO: 8177960 - DNA, 17 bp, Homo sapiens
gggcagggactcctggg

SEQ ID NO: 8177961 - DNA, 17 bp, Homo sapiens
gggcagggactcctggg

SEQ ID NO: 8177962 - DNA, 17 bp, Homo sapiens
gggcagggactcctggg

SEQ ID NO: 8177963 - DNA, 22 bp, Homo sapiens
gggcagaggctctggcccatcc

SEQ ID NO: 8177964 - DNA, 22 bp, Homo sapiens
gggcagaggctctggcccatcc

SEQ ID NO: 8177965 - DNA, 22 bp, Homo sapiens
gggcagaggctctggcccatcc

SEQ ID NO: 8177966 - DNA, 21 bp, Homo sapiens
gggcagaggggcctcctgggt

SEQ ID NO: 8177967 - DNA, 21 bp, Homo sapiens
gggcagaggggcctcctgggt

SEQ ID NO: 8177968 - DNA, 21 bp, Homo sapiens
gggcagaggggcctcctgggt

SEQ ID NO: 8177969 - DNA, 21 bp, Homo sapiens
gggcagaggggcctcctgggt

SEQ ID NO: 8177970 - DNA, 21 bp, Homo sapiens
gggcagaggggcctcctgggt

SEQ ID NO: 8177971 - DNA, 22 bp, Homo sapiens
gggcagagagctggaactcctt

SEQ ID NO: 8177972 - DNA, 22 bp, Homo sapiens
gggcagagagctggaactcctt

SEQ ID NO: 8177973 - DNA, 22 bp, Homo sapiens
gggcagagagctggaactcctt

SEQ ID NO: 8177974 - DNA, 22 bp, Homo sapiens
gggcagagactcagaaacagaa

SEQ ID NO: 8177975 - DNA, 22 bp, Homo sapiens
gggcagagactcagaaacagaa

SEQ ID NO: 8177976 - DNA, 22 bp, Homo sapiens
gggcagagactcagaaacagaa

SEQ ID NO: 8177977 - DNA, 22 bp, Homo sapiens
gggcagagactcagaaacagaa

SEQ ID NO: 8177978 - DNA, 22 bp, Homo sapiens
gggcactgtacactgtgcatgg

SEQ ID NO: 8177979 - DNA, 22 bp, Homo sapiens
gggcactggtgctgccatcttg

SEQ ID NO: 8177980 - DNA, 22 bp, Homo sapiens
gggcactgtgctaggtgctgag

SEQ ID NO: 8177981 - DNA, 22 bp, Homo sapiens
gggcactgtacactgtgcatgg

SEQ ID NO: 8177982 - DNA, 18 bp, Homo sapiens
gggatcaggctgcctagg

SEQ ID NO: 8177983 - DNA, 20 bp, Homo sapiens
gggatcaggaaaggaggcta

SEQ ID NO: 8177984 - DNA, 22 bp, Homo sapiens
gggatcagttaaggagagtttt

SEQ ID NO: 8177985 - DNA, 18 bp, Homo sapiens
gggatcaggctgcctagg

SEQ ID NO: 8177986 - DNA, 22 bp, Homo sapiens
gggcactggtgctgccatcttg

SEQ ID NO: 8177987 - DNA, 22 bp, Homo sapiens
gggcactgggtcttctccacgc

SEQ ID NO: 8177988 - DNA, 22 bp, Homo sapiens
gggatccatccgtgcagcagag

SEQ ID NO: 8177989 - DNA, 20 bp, Homo sapiens
gggcagagccagccagtccc

SEQ ID NO: 8177990 - DNA, 22 bp, Homo sapiens
gggcagaggctctggcccatcc

SEQ ID NO: 8177991 - DNA, 22 bp, Homo sapiens
gggcagaggctctggcccatcc

SEQ ID NO: 8177992 - DNA, 20 bp, Homo sapiens
gggcagagccagccagtccc

SEQ ID NO: 8177993 - DNA, 20 bp, Homo sapiens
gggcagagccagccagtccc

SEQ ID NO: 8177994 - DNA, 20 bp, Homo sapiens
gggcagagccagccagtccc

SEQ ID NO: 8177995 - DNA, 20 bp, Homo sapiens
gggcagagccagccagtccc

SEQ ID NO: 8177996 - DNA, 20 bp, Homo sapiens
gggcagagccagccagtccc

SEQ ID NO: 8177997 - DNA, 20 bp, Homo sapiens
gggcagagccagccagtccc

SEQ ID NO: 8177998 - DNA, 22 bp, Homo sapiens
gggcagagagctggaactcctt

SEQ ID NO: 8177999 - DNA, 22 bp, Homo sapiens
gggcagagagctggaactcctt

SEQ ID NO: 8178000 - DNA, 22 bp, Homo sapiens
gggcagagagctggaactcctt

SEQ ID NO: 8178001 - DNA, 22 bp, Homo sapiens
ggctggagtgggctccagagtt

SEQ ID NO: 8178002 - DNA, 22 bp, Homo sapiens
ggctggagtgggctccagagtt

SEQ ID NO: 8178003 - DNA, 22 bp, Homo sapiens
ggctggagtgggctccagagtt

SEQ ID NO: 8178004 - DNA, 22 bp, Homo sapiens
ggctggatgtactttggggctg

SEQ ID NO: 8178005 - DNA, 22 bp, Homo sapiens
ggctggcagaagtgtgctggct

SEQ ID NO: 8178006 - DNA, 22 bp, Homo sapiens
ggctggagtgggctccagagtt

SEQ ID NO: 8178007 - DNA, 22 bp, Homo sapiens
ggctggagtgggctccagagtt

SEQ ID NO: 8178008 - DNA, 19 bp, Homo sapiens
ggctggagtggccatctgt

SEQ ID NO: 8178009 - DNA, 22 bp, Homo sapiens
ggctggaggtagaagaacactt

SEQ ID NO: 8178010 - DNA, 22 bp, Homo sapiens
ggctggaggtagaagaacactt

SEQ ID NO: 8178011 - DNA, 19 bp, Homo sapiens
ggctggagtggccatctgt

SEQ ID NO: 8178012 - DNA, 19 bp, Homo sapiens
ggctggagtggccatctgt

SEQ ID NO: 8178013 - DNA, 19 bp, Homo sapiens
ggctggagtggccatctgt

SEQ ID NO: 8178014 - DNA, 17 bp, Homo sapiens
ggctggaggggacccgg

SEQ ID NO: 8178015 - DNA, 22 bp, Homo sapiens
ggctggaggtagaagaacactt

SEQ ID NO: 8178016 - DNA, 22 bp, Homo sapiens
ggctggcaggggatgtcagatg

SEQ ID NO: 8178017 - DNA, 22 bp, Homo sapiens
ggctggcaggggatgtcagatg

SEQ ID NO: 8178018 - DNA, 22 bp, Homo sapiens
ggctggcaggggatgtcagatg

SEQ ID NO: 8178019 - DNA, 22 bp, Homo sapiens
ggctggcagtgtgagagaggga

SEQ ID NO: 8178020 - DNA, 22 bp, Homo sapiens
ggctggcaggggatgtcagatg

SEQ ID NO: 8178021 - DNA, 22 bp, Homo sapiens
ggctggcaggggatgtcagatg

SEQ ID NO: 8178022 - DNA, 22 bp, Homo sapiens
ggctggcagtgtgagagaggga

SEQ ID NO: 8178023 - DNA, 22 bp, Homo sapiens
ggctggcagtgtgagagaggga

SEQ ID NO: 8178024 - DNA, 22 bp, Homo sapiens
ggctggcagtgtgagagaggga

SEQ ID NO: 8178025 - DNA, 22 bp, Homo sapiens
ggctggcagtgtgagagaggga

SEQ ID NO: 8178026 - DNA, 22 bp, Homo sapiens
ggctggcagttaatacctgaag

SEQ ID NO: 8178027 - DNA, 22 bp, Homo sapiens
ggctggcattgctctattgcct

SEQ ID NO: 8178028 - DNA, 22 bp, Homo sapiens
ggctggcatccagggaaatcca

SEQ ID NO: 8178029 - DNA, 22 bp, Homo sapiens
ggctggcatttacacaatgcat

SEQ ID NO: 8178030 - DNA, 22 bp, Homo sapiens
ggctggcattgctctattgcct

SEQ ID NO: 8178031 - DNA, 22 bp, Homo sapiens
ggctggcattgctctattgcct

SEQ ID NO: 8178032 - DNA, 22 bp, Homo sapiens
ggctggcagaagtgtgctggct

SEQ ID NO: 8178033 - DNA, 22 bp, Homo sapiens
ggctggcagaggggagtctgtg

SEQ ID NO: 8178034 - DNA, 22 bp, Homo sapiens
ggctggcagaggggagtctgtg

SEQ ID NO: 8178035 - DNA, 22 bp, Homo sapiens
ggctggcagaggggagtctgtg

SEQ ID NO: 8178036 - DNA, 22 bp, Homo sapiens
ggctggcagaggggagtctgtg

SEQ ID NO: 8178037 - DNA, 22 bp, Homo sapiens
ggctggcagaagtgtgctggct

SEQ ID NO: 8178038 - DNA, 22 bp, Homo sapiens
ggctggcagaagtgtgctggct

SEQ ID NO: 8178039 - DNA, 22 bp, Homo sapiens
ggctggcagaagtgtgctggct

SEQ ID NO: 8178040 - DNA, 22 bp, Homo sapiens
ggctggcagaagtgtgctggct

SEQ ID NO: 8178041 - DNA, 22 bp, Homo sapiens
ggctggcagcttcatcccagat

SEQ ID NO: 8178042 - DNA, 22 bp, Homo sapiens
ggctggcagaggggagtctgtg

SEQ ID NO: 8178043 - DNA, 22 bp, Homo sapiens
ggctggcaggactcacacttgg

SEQ ID NO: 8178044 - DNA, 22 bp, Homo sapiens
ggctggcagcttcatcccagat

SEQ ID NO: 8178045 - DNA, 22 bp, Homo sapiens
ggctggcaggcacagtatgcaa

SEQ ID NO: 8178046 - DNA, 22 bp, Homo sapiens
ggctggcaggcacagtatgcaa

SEQ ID NO: 8178047 - DNA, 22 bp, Homo sapiens
ggctggcaggcacagtatgcaa

SEQ ID NO: 8178048 - DNA, 22 bp, Homo sapiens
ggctggaggagaatgggtgtga

SEQ ID NO: 8178049 - DNA, 22 bp, Homo sapiens
ggctggaggagaatgggtgtga

SEQ ID NO: 8178050 - DNA, 22 bp, Homo sapiens
ggctggaggagaatgggtgtga

SEQ ID NO: 8178051 - DNA, 22 bp, Homo sapiens
ggctggaggagaatgggtgtga

SEQ ID NO: 8178052 - DNA, 17 bp, Homo sapiens
ggctggagcagctcccc

SEQ ID NO: 8178053 - DNA, 17 bp, Homo sapiens
ggctggagcagctcccc

SEQ ID NO: 8178054 - DNA, 22 bp, Homo sapiens
ggctggagacaacgtcctgccc

SEQ ID NO: 8178055 - DNA, 22 bp, Homo sapiens
ggctggagatatgtctggaaca

SEQ ID NO: 8178056 - DNA, 22 bp, Homo sapiens
ggctggagatatgtctggaaca

SEQ ID NO: 8178057 - DNA, 22 bp, Homo sapiens
ggctggagacaacgtcctgccc

SEQ ID NO: 8178058 - DNA, 22 bp, Homo sapiens
ggctggagacaacgtcctgccc

SEQ ID NO: 8178059 - DNA, 22 bp, Homo sapiens
ggctgcctggacctcctctttc

SEQ ID NO: 8178060 - DNA, 22 bp, Homo sapiens
ggctgcctgctcctcctgcacg

SEQ ID NO: 8178061 - DNA, 22 bp, Homo sapiens
ggctgcctgaggcagtgagaga

SEQ ID NO: 8178062 - DNA, 22 bp, Homo sapiens
ggctgcctgaactttggggaaa

SEQ ID NO: 8178063 - DNA, 22 bp, Homo sapiens
ggctgcctctggaagctggaga

SEQ ID NO: 8178064 - DNA, 22 bp, Homo sapiens
ggctgcctctggaagctggaga

SEQ ID NO: 8178065 - DNA, 22 bp, Homo sapiens
ggctgcctctgatgtgcagacg

SEQ ID NO: 8178066 - DNA, 22 bp, Homo sapiens
ggctgcctctgatgtgcagacg

SEQ ID NO: 8178067 - DNA, 22 bp, Homo sapiens
ggctgcctgaggctgaggcccg

SEQ ID NO: 8178068 - DNA, 22 bp, Homo sapiens
ggctgcctgccgcccacttggc

SEQ ID NO: 8178069 - DNA, 22 bp, Homo sapiens
ggctgcctgccgcccacttggc

SEQ ID NO: 8178070 - DNA, 22 bp, Homo sapiens
ggctgcctgctcctcctgcacg

SEQ ID NO: 8178071 - DNA, 22 bp, Homo sapiens
ggctgcctgctcaggtgcggcg

SEQ ID NO: 8178072 - DNA, 22 bp, Homo sapiens
ggctgcctgcctccaagccggg

SEQ ID NO: 8178073 - DNA, 22 bp, Homo sapiens
ggctgcagtttgtcttttgctt

SEQ ID NO: 8178074 - DNA, 22 bp, Homo sapiens
ggctgcatgcctcagtgtaaga

SEQ ID NO: 8178075 - DNA, 22 bp, Homo sapiens
ggctgcatgttcagatgacact

SEQ ID NO: 8178076 - DNA, 20 bp, Homo sapiens
ggctgcagtgcacctcatct

SEQ ID NO: 8178077 - DNA, 22 bp, Homo sapiens
ggctgcagttgtgtgaaggccg

SEQ ID NO: 8178078 - DNA, 22 bp, Homo sapiens
ggctgcagttgtgtgaaggccg

SEQ ID NO: 8178079 - DNA, 22 bp, Homo sapiens
ggctgcagttgtgtgaaggccg

SEQ ID NO: 8178080 - DNA, 22 bp, Homo sapiens
ggctgcagttgtgtgaaggccg

SEQ ID NO: 8178081 - DNA, 22 bp, Homo sapiens
ggctgcagttgtgtgaaggccg

SEQ ID NO: 8178082 - DNA, 22 bp, Homo sapiens
ggctgccaggagggaggccagt

SEQ ID NO: 8178083 - DNA, 22 bp, Homo sapiens
ggctgccaggagggaggccagt

SEQ ID NO: 8178084 - DNA, 22 bp, Homo sapiens
ggctgccaggagaagctcagtg

SEQ ID NO: 8178085 - DNA, 22 bp, Homo sapiens
ggctgccagcactggtgtagag

SEQ ID NO: 8178086 - DNA, 22 bp, Homo sapiens
ggctgccaggagaagctcagtg

SEQ ID NO: 8178087 - DNA, 22 bp, Homo sapiens
ggctgccaggagaagctcagtg

SEQ ID NO: 8178088 - DNA, 22 bp, Homo sapiens
ggctgccagcactggtgtagag

SEQ ID NO: 8178089 - DNA, 22 bp, Homo sapiens
ggctgccagcactggtgtagag

SEQ ID NO: 8178090 - DNA, 22 bp, Homo sapiens
ggctgccacgtcgagggtccaa

SEQ ID NO: 8178091 - DNA, 22 bp, Homo sapiens
ggctgccacgtcgagggtccaa

SEQ ID NO: 8178092 - DNA, 22 bp, Homo sapiens
ggctgccacgtcgagggtccaa

SEQ ID NO: 8178093 - DNA, 22 bp, Homo sapiens
ggctgccacgtcgagggtccaa

SEQ ID NO: 8178094 - DNA, 22 bp, Homo sapiens
ggctgccagtgagtgcagaccg

SEQ ID NO: 8178095 - DNA, 22 bp, Homo sapiens
ggctgccagtgagtgcagaccg

SEQ ID NO: 8178096 - DNA, 22 bp, Homo sapiens
ggctgccaggagggaggccagt

SEQ ID NO: 8178097 - DNA, 22 bp, Homo sapiens
ggctgcctccactgcttgtccc

SEQ ID NO: 8178098 - DNA, 22 bp, Homo sapiens
ggctgcctcccaggagaatctg

SEQ ID NO: 8178099 - DNA, 19 bp, Homo sapiens
ggctgcctcctgggagatt

SEQ ID NO: 8178100 - DNA, 22 bp, Homo sapiens
ggctgcctctatttaggatcaa

SEQ ID NO: 8178101 - DNA, 20 bp, Homo sapiens
ggctgcctccttcctttcct

SEQ ID NO: 8178102 - DNA, 22 bp, Homo sapiens
ggctgcctcctgctgggctgga

SEQ ID NO: 8178103 - DNA, 22 bp, Homo sapiens
ggctgcctcctcgagacaggat

SEQ ID NO: 8178104 - DNA, 22 bp, Homo sapiens
ggctgcctcctgctgggctgga

SEQ ID NO: 8178105 - DNA, 22 bp, Homo sapiens
ggctgcctcctgctgggctgga

SEQ ID NO: 8178106 - DNA, 22 bp, Homo sapiens
ggctctgcggcgtgtgcgcagg

SEQ ID NO: 8178107 - DNA, 22 bp, Homo sapiens
ggctctgcgcggtaaagtgact

SEQ ID NO: 8178108 - DNA, 22 bp, Homo sapiens
ggctctgcgcctgcggggactt

SEQ ID NO: 8178109 - DNA, 22 bp, Homo sapiens
ggctctgcgcggtaaagtgact

SEQ ID NO: 8178110 - DNA, 22 bp, Homo sapiens
ggctctgcggcgtgtgcgcagg

SEQ ID NO: 8178111 - DNA, 22 bp, Homo sapiens
ggctctgcggcgtgtgcgcagg

SEQ ID NO: 8178112 - DNA, 22 bp, Homo sapiens
ggctctgcggcgtgtgcgcagg

SEQ ID NO: 8178113 - DNA, 22 bp, Homo sapiens
ggctgcaggcagggtatccact

SEQ ID NO: 8178114 - DNA, 22 bp, Homo sapiens
ggctgcaggcttccctccagca

SEQ ID NO: 8178115 - DNA, 22 bp, Homo sapiens
ggctgcaggcttccctccagca

SEQ ID NO: 8178116 - DNA, 22 bp, Homo sapiens
ggctgcaggcagggtatccact

SEQ ID NO: 8178117 - DNA, 22 bp, Homo sapiens
ggctgcaggcagggtatccact

SEQ ID NO: 8178118 - DNA, 22 bp, Homo sapiens
ggctgcaggcttccctccagca

SEQ ID NO: 8178119 - DNA, 22 bp, Homo sapiens
ggctgcaggcttccctccagca

SEQ ID NO: 8178120 - DNA, 21 bp, Homo sapiens
ggctgcagggagccctggggt

SEQ ID NO: 8178121 - DNA, 21 bp, Homo sapiens
ggctgcagggagccctggggt

SEQ ID NO: 8178122 - DNA, 21 bp, Homo sapiens
ggctgcagggagccctggggt

SEQ ID NO: 8178123 - DNA, 21 bp, Homo sapiens
ggctgcagggagccctggggt

SEQ ID NO: 8178124 - DNA, 21 bp, Homo sapiens
ggctgcagggagccctggggt

SEQ ID NO: 8178125 - DNA, 21 bp, Homo sapiens
ggctgcagggagccctggggt

SEQ ID NO: 8178126 - DNA, 17 bp, Homo sapiens
ggctgcagtccaggagg

SEQ ID NO: 8178127 - DNA, 17 bp, Homo sapiens
ggctgcagtccaggagg

SEQ ID NO: 8178128 - DNA, 20 bp, Homo sapiens
ggctgcagtgcacctcatct

SEQ ID NO: 8178129 - DNA, 20 bp, Homo sapiens
ggctgcagtgcacctcatct

SEQ ID NO: 8178130 - DNA, 20 bp, Homo sapiens
ggctgcagtgcacctcatct

SEQ ID NO: 8178131 - DNA, 17 bp, Homo sapiens
ggctgcagtccaggagg

SEQ ID NO: 8178132 - DNA, 17 bp, Homo sapiens
ggctgcagtccaggagg

SEQ ID NO: 8178133 - DNA, 17 bp, Homo sapiens
ggctgcagtccaggagg

SEQ ID NO: 8178134 - DNA, 17 bp, Homo sapiens
ggctgcagtccaggagg

SEQ ID NO: 8178135 - DNA, 22 bp, Homo sapiens
ggctgcaggttggttggcagct

SEQ ID NO: 8178136 - DNA, 22 bp, Homo sapiens
ggctgcagggcagctggtgtgg

SEQ ID NO: 8178137 - DNA, 22 bp, Homo sapiens
ggctgcagggcagctggtgtgg

SEQ ID NO: 8178138 - DNA, 22 bp, Homo sapiens
ggctgcagggcagctggtgtgg

SEQ ID NO: 8178139 - DNA, 22 bp, Homo sapiens
ggctgcagggcagctggtgtgg

SEQ ID NO: 8178140 - DNA, 22 bp, Homo sapiens
ggctgcaggttggttggcagct

SEQ ID NO: 8178141 - DNA, 22 bp, Homo sapiens
ggctgcaggttggttggcagct

SEQ ID NO: 8178142 - DNA, 22 bp, Homo sapiens
ggctgcaggttggttggcagct

SEQ ID NO: 8178143 - DNA, 22 bp, Homo sapiens
ggctgcaggttggttggcagct

SEQ ID NO: 8178144 - DNA, 22 bp, Homo sapiens
ggctgcaggttggttggcagct

SEQ ID NO: 8178145 - DNA, 22 bp, Homo sapiens
ggctgcaggttggttggcagct

SEQ ID NO: 8178146 - DNA, 23 bp, Homo sapiens
gggagccaggacctcgcgcccca

SEQ ID NO: 8178147 - DNA, 22 bp, Homo sapiens
gggagccagccatccagaacct

SEQ ID NO: 8178148 - DNA, 22 bp, Homo sapiens
gggagccagcctttgcctataa

SEQ ID NO: 8178149 - DNA, 22 bp, Homo sapiens
gggagccatgctggtcttcttt

SEQ ID NO: 8178150 - DNA, 22 bp, Homo sapiens
gggagccagcagggcatggagc

SEQ ID NO: 8178151 - DNA, 22 bp, Homo sapiens
gggagccagcagggcatggagc

SEQ ID NO: 8178152 - DNA, 22 bp, Homo sapiens
gggagccactcagctgagagtt

SEQ ID NO: 8178153 - DNA, 22 bp, Homo sapiens
gggagccacagtttatagtgat

SEQ ID NO: 8178154 - DNA, 22 bp, Homo sapiens
gggaaggccggtccagtcaggt

SEQ ID NO: 8178155 - DNA, 22 bp, Homo sapiens
gggaaggccggtccagtcaggt

SEQ ID NO: 8178156 - DNA, 22 bp, Homo sapiens
gggaaggccggtccagtcaggt

SEQ ID NO: 8178157 - DNA, 22 bp, Homo sapiens
gggaaggccttgtcagcggatt

SEQ ID NO: 8178158 - DNA, 22 bp, Homo sapiens
gggagatgactcagtgacctcg

SEQ ID NO: 8178159 - DNA, 23 bp, Homo sapiens
gggagatgggaaatgaaggctct

SEQ ID NO: 8178160 - DNA, 23 bp, Homo sapiens
gggagatgggaaatgaaggctct

SEQ ID NO: 8178161 - DNA, 23 bp, Homo sapiens
gggagatgggaaatgaaggctct

SEQ ID NO: 8178162 - DNA, 22 bp, Homo sapiens
gggagatggctcagaggccgcg

SEQ ID NO: 8178163 - DNA, 22 bp, Homo sapiens
gggagccacagtagcagctact

SEQ ID NO: 8178164 - DNA, 23 bp, Homo sapiens
gggagatgggaaatgaaggctct

SEQ ID NO: 8178165 - DNA, 22 bp, Homo sapiens
gggagccacagtttatagtgat

SEQ ID NO: 8178166 - DNA, 22 bp, Homo sapiens
gggagccacagtgaggtgcatg

SEQ ID NO: 8178167 - DNA, 22 bp, Homo sapiens
gggaaggcatacctgagggaga

SEQ ID NO: 8178168 - DNA, 22 bp, Homo sapiens
gggaaggcatacctgagggaga

SEQ ID NO: 8178169 - DNA, 22 bp, Homo sapiens
gggaaggcagtgggaggaactg

SEQ ID NO: 8178170 - DNA, 22 bp, Homo sapiens
gggaaggcagtgggaggaactg

SEQ ID NO: 8178171 - DNA, 22 bp, Homo sapiens
gggaaggcagtgggaggaactg

SEQ ID NO: 8178172 - DNA, 22 bp, Homo sapiens
gggaaggcaccatggtgttcca

SEQ ID NO: 8178173 - DNA, 22 bp, Homo sapiens
gggaaggcaggattctctggtg

SEQ ID NO: 8178174 - DNA, 22 bp, Homo sapiens
gggaagccatgctcagaggtac

SEQ ID NO: 8178175 - DNA, 22 bp, Homo sapiens
gggaagcatctgagggtccact

SEQ ID NO: 8178176 - DNA, 22 bp, Homo sapiens
gggaagcatctgagggtccact

SEQ ID NO: 8178177 - DNA, 18 bp, Homo sapiens
gggaagccgggaagccgg

SEQ ID NO: 8178178 - DNA, 22 bp, Homo sapiens
gggaagccatgctcagaggtac

SEQ ID NO: 8178179 - DNA, 22 bp, Homo sapiens
gggaagccctgtgcttgcctgg

SEQ ID NO: 8178180 - DNA, 22 bp, Homo sapiens
gggaagcagcattgtgctggct

SEQ ID NO: 8178181 - DNA, 22 bp, Homo sapiens
gggaagcagatcataccagacc

SEQ ID NO: 8178182 - DNA, 22 bp, Homo sapiens
gggaagatagtgttgagggccc

SEQ ID NO: 8178183 - DNA, 22 bp, Homo sapiens
gggaagagtaactagcccatgt

SEQ ID NO: 8178184 - DNA, 22 bp, Homo sapiens
gggaagagtaactagcccatgt

SEQ ID NO: 8178185 - DNA, 22 bp, Homo sapiens
gggaagagtgtcggttgaagtg

SEQ ID NO: 8178186 - DNA, 22 bp, Homo sapiens
gggaagagtgtcggttgaagtg

SEQ ID NO: 8178187 - DNA, 22 bp, Homo sapiens
ggctgtgcgggcagccgtggga

SEQ ID NO: 8178188 - DNA, 22 bp, Homo sapiens
ggctggccagggccctcgctgg

SEQ ID NO: 8178189 - DNA, 22 bp, Homo sapiens
ggctggccagggccctcgctgg

SEQ ID NO: 8178190 - DNA, 18 bp, Homo sapiens
ggctgtgcgtggaggctg

SEQ ID NO: 8178191 - DNA, 18 bp, Homo sapiens
ggctgtgcgtggaggctg

SEQ ID NO: 8178192 - DNA, 18 bp, Homo sapiens
ggctgtgcgtggaggctg

SEQ ID NO: 8178193 - DNA, 21 bp, Homo sapiens
ggctgtggagccatgactcac

SEQ ID NO: 8178194 - DNA, 22 bp, Homo sapiens
ggctgtggacactgagctcaga

SEQ ID NO: 8178195 - DNA, 22 bp, Homo sapiens
ggctgtggacactgagctcaga

SEQ ID NO: 8178196 - DNA, 22 bp, Homo sapiens
ggctgtggacactgagctcaga

SEQ ID NO: 8178197 - DNA, 22 bp, Homo sapiens
ggctgtgctttgcccaaagggc

SEQ ID NO: 8178198 - DNA, 22 bp, Homo sapiens
ggctgtgctgagggggaagccc

SEQ ID NO: 8178199 - DNA, 22 bp, Homo sapiens
ggctgtgctgagggggaagccc

SEQ ID NO: 8178200 - DNA, 22 bp, Homo sapiens
ggctgtgctgagggggaagccc

SEQ ID NO: 8178201 - DNA, 22 bp, Homo sapiens
ggctgtggcagctggaagtggt

SEQ ID NO: 8178202 - DNA, 22 bp, Homo sapiens
ggctgtggcagctggaagtggt

SEQ ID NO: 8178203 - DNA, 22 bp, Homo sapiens
ggctgtggcagctggaagtggt

SEQ ID NO: 8178204 - DNA, 22 bp, Homo sapiens
ggctgtggcattaggtgaggcc

SEQ ID NO: 8178205 - DNA, 22 bp, Homo sapiens
ggctgtggccagcggggctgag

SEQ ID NO: 8178206 - DNA, 22 bp, Homo sapiens
ggctgtggcattaggtgaggcc

SEQ ID NO: 8178207 - DNA, 22 bp, Homo sapiens
ggctgtggcagctggaagtggt

SEQ ID NO: 8178208 - DNA, 22 bp, Homo sapiens
ggctgtggcagctggaagtggt

SEQ ID NO: 8178209 - DNA, 22 bp, Homo sapiens
ggctgtggcagctggaagtggt

SEQ ID NO: 8178210 - DNA, 21 bp, Homo sapiens
ggctgtggagccatgactcac

SEQ ID NO: 8178211 - DNA, 22 bp, Homo sapiens
ggctgtggagctgcagagttgg

SEQ ID NO: 8178212 - DNA, 22 bp, Homo sapiens
ggctgtggagctgcagagttgg

SEQ ID NO: 8178213 - DNA, 22 bp, Homo sapiens
ggctgtggggccgggtacagtg

SEQ ID NO: 8178214 - DNA, 22 bp, Homo sapiens
ggctgtggggaccaacaggact

SEQ ID NO: 8178215 - DNA, 22 bp, Homo sapiens
ggctgtggggggagcctgcccg

SEQ ID NO: 8178216 - DNA, 22 bp, Homo sapiens
ggctgtggggggagcctgcccg

SEQ ID NO: 8178217 - DNA, 22 bp, Homo sapiens
ggctgtggggggagcctgcccg

SEQ ID NO: 8178218 - DNA, 22 bp, Homo sapiens
ggctgtggccagcggggctgag

SEQ ID NO: 8178219 - DNA, 22 bp, Homo sapiens
ggctgtggccagcggggctgag

SEQ ID NO: 8178220 - DNA, 22 bp, Homo sapiens
ggctgtgggatgcataggagct

SEQ ID NO: 8178221 - DNA, 22 bp, Homo sapiens
ggctgtgggatgcataggagct

SEQ ID NO: 8178222 - DNA, 22 bp, Homo sapiens
ggctgtggtcattaggaggttg

SEQ ID NO: 8178223 - DNA, 22 bp, Homo sapiens
ggctgtggtcattaggaggttg

SEQ ID NO: 8178224 - DNA, 22 bp, Homo sapiens
ggctgtgggtgtgacaggcctc

SEQ ID NO: 8178225 - DNA, 22 bp, Homo sapiens
ggctgtggtctcatctagcctt

SEQ ID NO: 8178226 - DNA, 22 bp, Homo sapiens
ggctgtggtctgggtgctcccc

SEQ ID NO: 8178227 - DNA, 22 bp, Homo sapiens
ggctgtggtctgggtgctcccc

SEQ ID NO: 8178228 - DNA, 22 bp, Homo sapiens
gggaagagggagctggaatgat

SEQ ID NO: 8178229 - DNA, 22 bp, Homo sapiens
gggaagagggagctggaatgat

SEQ ID NO: 8178230 - DNA, 22 bp, Homo sapiens
gggaagagggagctggaatgat

SEQ ID NO: 8178231 - DNA, 22 bp, Homo sapiens
gggaagagggagctggaatgat

SEQ ID NO: 8178232 - DNA, 22 bp, Homo sapiens
gggaagagggagctggaatgat

SEQ ID NO: 8178233 - DNA, 18 bp, Homo sapiens
gggaagaggatctggccc

SEQ ID NO: 8178234 - DNA, 22 bp, Homo sapiens
gggaagagggagctggaatgat

SEQ ID NO: 8178235 - DNA, 19 bp, Homo sapiens
ggcacctttctgctgtgtc

SEQ ID NO: 8178236 - DNA, 22 bp, Homo sapiens
ggcacgtgcctaaggagcaggc

SEQ ID NO: 8178237 - DNA, 22 bp, Homo sapiens
ggcactcaataaatgttgccaa

SEQ ID NO: 8178238 - DNA, 22 bp, Homo sapiens
ggcactgaagtgggtgttgggt

SEQ ID NO: 8178239 - DNA, 22 bp, Homo sapiens
ggcactgaatttcttggcatct

SEQ ID NO: 8178240 - DNA, 23 bp, Homo sapiens
ggcactgaagctacaatggtgag

SEQ ID NO: 8178241 - DNA, 22 bp, Homo sapiens
ggcactgagctgccttggggca

SEQ ID NO: 8178242 - DNA, 22 bp, Homo sapiens
ggcactgacactagcatggcac

SEQ ID NO: 8178243 - DNA, 22 bp, Homo sapiens
ggcactgactgtgcagcgcacc

SEQ ID NO: 8178244 - DNA, 22 bp, Homo sapiens
ggcactgagaacaggctgactt

SEQ ID NO: 8178245 - DNA, 22 bp, Homo sapiens
ggcagaggtgacagtgtctttt

SEQ ID NO: 8178246 - DNA, 22 bp, Homo sapiens
ggcagaggtgacagtgtctttt

SEQ ID NO: 8178247 - DNA, 22 bp, Homo sapiens
ggcagaggtgaagttcacaagg

SEQ ID NO: 8178248 - DNA, 22 bp, Homo sapiens
ggcagaggtgaagttcacaagg

SEQ ID NO: 8178249 - DNA, 22 bp, Homo sapiens
ggcagatggaatgagctgtcta

SEQ ID NO: 8178250 - DNA, 22 bp, Homo sapiens
ggcagatggagaagcagcaggt

SEQ ID NO: 8178251 - DNA, 22 bp, Homo sapiens
ggcagatggagaagcagcaggt

SEQ ID NO: 8178252 - DNA, 22 bp, Homo sapiens
ggcagatggggtgacaagagag

SEQ ID NO: 8178253 - DNA, 22 bp, Homo sapiens
ggcagatgttatatgatctgag

SEQ ID NO: 8178254 - DNA, 22 bp, Homo sapiens
ggcagattcaagggtggagagg

SEQ ID NO: 8178255 - DNA, 22 bp, Homo sapiens
ggcagatgttgcagtgagcaga

SEQ ID NO: 8178256 - DNA, 22 bp, Homo sapiens
ggcagcaaatattgtcagctgt

SEQ ID NO: 8178257 - DNA, 22 bp, Homo sapiens
ggcagcaaatattgtcagctgt

SEQ ID NO: 8178258 - DNA, 18 bp, Homo sapiens
ggcagcaagaagggaggg

SEQ ID NO: 8178259 - DNA, 22 bp, Homo sapiens
ggcagcaactcggagagaagag

SEQ ID NO: 8178260 - DNA, 22 bp, Homo sapiens
ggcagcaactcattattcctgt

SEQ ID NO: 8178261 - DNA, 18 bp, Homo sapiens
ggcagcaagaagggaggg

SEQ ID NO: 8178262 - DNA, 22 bp, Homo sapiens
ggcagcaactcggagagaagag

SEQ ID NO: 8178263 - DNA, 22 bp, Homo sapiens
ggcagcaagagaggttcagctt

SEQ ID NO: 8178264 - DNA, 22 bp, Homo sapiens
ggcagcacgacaggagtggaag

SEQ ID NO: 8178265 - DNA, 21 bp, Homo sapiens
ggcagcactacctgaagcata

SEQ ID NO: 8178266 - DNA, 20 bp, Homo sapiens
ggcagcaattcaccctatcc

SEQ ID NO: 8178267 - DNA, 22 bp, Homo sapiens
ggcagcaagtggtgggagactt

SEQ ID NO: 8178268 - DNA, 22 bp, Homo sapiens
ggcagcaatgctgtgcaggcat

SEQ ID NO: 8178269 - DNA, 22 bp, Homo sapiens
ggcagcagacccctaagtctac

SEQ ID NO: 8178270 - DNA, 22 bp, Homo sapiens
ggcagcagaactggccctgtat

SEQ ID NO: 8178271 - DNA, 22 bp, Homo sapiens
ggcagcactgcagcttgttggg

SEQ ID NO: 8178272 - DNA, 22 bp, Homo sapiens
ggcagcactgcagcttgttggg

SEQ ID NO: 8178273 - DNA, 22 bp, Homo sapiens
ggcagcagaactggccctgtat

SEQ ID NO: 8178274 - DNA, 22 bp, Homo sapiens
ggaggaggggtgactgaatgct

SEQ ID NO: 8178275 - DNA, 22 bp, Homo sapiens
ggaggaggggtgactgaatgct

SEQ ID NO: 8178276 - DNA, 22 bp, Homo sapiens
ggaggaggggtgactgaatgct

SEQ ID NO: 8178277 - DNA, 22 bp, Homo sapiens
ggaggaggggtttacattggaa

SEQ ID NO: 8178278 - DNA, 22 bp, Homo sapiens
ggaggaggggtttacattggaa

SEQ ID NO: 8178279 - DNA, 22 bp, Homo sapiens
ggaggaggggtttacattggaa

SEQ ID NO: 8178280 - DNA, 22 bp, Homo sapiens
ggaggaggtgggttaagttgta

SEQ ID NO: 8178281 - DNA, 22 bp, Homo sapiens
ggaggagtgtggggcactctgc

SEQ ID NO: 8178282 - DNA, 22 bp, Homo sapiens
ggaggagtgtggggcactctgc

SEQ ID NO: 8178283 - DNA, 23 bp, Homo sapiens
ggaggagttcccagccctcctgg

SEQ ID NO: 8178284 - DNA, 22 bp, Homo sapiens
ggaggattagctctgcctgaaa

SEQ ID NO: 8178285 - DNA, 22 bp, Homo sapiens
ggaggatgccaagctgtgcaca

SEQ ID NO: 8178286 - DNA, 22 bp, Homo sapiens
ggaggatgagctacgaggagct

SEQ ID NO: 8178287 - DNA, 22 bp, Homo sapiens
ggaggatttgtcatctgaagat

SEQ ID NO: 8178288 - DNA, 22 bp, Homo sapiens
ggaggcaaagcactttgcttgg

SEQ ID NO: 8178289 - DNA, 23 bp, Homo sapiens
ggaggcacttaggcagagcagag

SEQ ID NO: 8178290 - DNA, 22 bp, Homo sapiens
ggaggcaccctatttgaggcct

SEQ ID NO: 8178291 - DNA, 22 bp, Homo sapiens
ggaggcacacctcagactggga

SEQ ID NO: 8178292 - DNA, 22 bp, Homo sapiens
ggaggcacacctcagactggga

SEQ ID NO: 8178293 - DNA, 22 bp, Homo sapiens
ggaggcaacatgcttgtttcta

SEQ ID NO: 8178294 - DNA, 22 bp, Homo sapiens
ggcacctgtagttattttgttt

SEQ ID NO: 8178295 - DNA, 22 bp, Homo sapiens
ggcacctggtaagtgctcagta

SEQ ID NO: 8178296 - DNA, 22 bp, Homo sapiens
ggcacctggtaagtgctcagta

SEQ ID NO: 8178297 - DNA, 22 bp, Homo sapiens
ggcacctgtctgctcacagtga

SEQ ID NO: 8178298 - DNA, 22 bp, Homo sapiens
ggcacctgtctgctcacagtga

SEQ ID NO: 8178299 - DNA, 22 bp, Homo sapiens
ggcacctttcatcccatctaga

SEQ ID NO: 8178300 - DNA, 19 bp, Homo sapiens
ggcaccttggtcttggact

SEQ ID NO: 8178301 - DNA, 22 bp, Homo sapiens
ggcacctgtgtaagatctggaa

SEQ ID NO: 8178302 - DNA, 22 bp, Homo sapiens
ggcacctggatgtagcagtgaa

SEQ ID NO: 8178303 - DNA, 22 bp, Homo sapiens
ggcacctggatgtagcagtgaa

SEQ ID NO: 8178304 - DNA, 22 bp, Homo sapiens
ggcacctggtaagtgctcagta

SEQ ID NO: 8178305 - DNA, 22 bp, Homo sapiens
ggcacctgctcatctggactca

SEQ ID NO: 8178306 - DNA, 22 bp, Homo sapiens
ggcacctggaggtttactggat

SEQ ID NO: 8178307 - DNA, 22 bp, Homo sapiens
ggcacctggaggtttactggat

SEQ ID NO: 8178308 - DNA, 22 bp, Homo sapiens
ggaggcacttcccgtctcagcc

SEQ ID NO: 8178309 - DNA, 22 bp, Homo sapiens
ggaggcacttcatgctgacccg

SEQ ID NO: 8178310 - DNA, 22 bp, Homo sapiens
ggaggcacttcccgtctcagcc

SEQ ID NO: 8178311 - DNA, 22 bp, Homo sapiens
ggaggcacttcccgtctcagcc

SEQ ID NO: 8178312 - DNA, 22 bp, Homo sapiens
ggaggcagaacttcccgtcagt

SEQ ID NO: 8178313 - DNA, 22 bp, Homo sapiens
ggaggcagaacttcccgtcagt

SEQ ID NO: 8178314 - DNA, 16 bp, Homo sapiens
ggcaccagtgaacaca

SEQ ID NO: 8178315 - DNA, 22 bp, Homo sapiens
ggcaccatcagctgtgcagggg

SEQ ID NO: 8178316 - DNA, 22 bp, Homo sapiens
ggcacccttggggggccacagc

SEQ ID NO: 8178317 - DNA, 18 bp, Homo sapiens
ggcacctctcttgcctta

SEQ ID NO: 8178318 - DNA, 18 bp, Homo sapiens
ggcacctctcttgcctta

SEQ ID NO: 8178319 - DNA, 22 bp, Homo sapiens
ggcaccagggacaatcctcttc

SEQ ID NO: 8178320 - DNA, 22 bp, Homo sapiens
ggcaccagggaaggaaggctgg

SEQ ID NO: 8178321 - DNA, 18 bp, Homo sapiens
ggcagcctacccacttgt

SEQ ID NO: 8178322 - DNA, 18 bp, Homo sapiens
ggcagcctacccacttgt

SEQ ID NO: 8178323 - DNA, 22 bp, Homo sapiens
ggcagccctttctggccagctc

SEQ ID NO: 8178324 - DNA, 22 bp, Homo sapiens
ggcagccctttctggccagctc

SEQ ID NO: 8178325 - DNA, 21 bp, Homo sapiens
ggcagcccgccctctcctggc

SEQ ID NO: 8178326 - DNA, 21 bp, Homo sapiens
ggcagcccgccctctcctggc

SEQ ID NO: 8178327 - DNA, 22 bp, Homo sapiens
ggcagccctgtggagaggccca

SEQ ID NO: 8178328 - DNA, 22 bp, Homo sapiens
ggcagccctgtggagaggccca

SEQ ID NO: 8178329 - DNA, 17 bp, Homo sapiens
ggcagcctcaggcgttt

SEQ ID NO: 8178330 - DNA, 17 bp, Homo sapiens
ggcagcctcaggcgttt

SEQ ID NO: 8178331 - DNA, 22 bp, Homo sapiens
ggcagcctcaggttttctttga

SEQ ID NO: 8178332 - DNA, 22 bp, Homo sapiens
ggcagccatgtcccagggcttc

SEQ ID NO: 8178333 - DNA, 22 bp, Homo sapiens
ggcagccatgtcccagggcttc

SEQ ID NO: 8178334 - DNA, 22 bp, Homo sapiens
ggcagccatgtcccagggcttc

SEQ ID NO: 8178335 - DNA, 22 bp, Homo sapiens
ggcagcccaccagcccacgtct

SEQ ID NO: 8178336 - DNA, 22 bp, Homo sapiens
ggcagccccagaaacagttcag

SEQ ID NO: 8178337 - DNA, 22 bp, Homo sapiens
ggcagccatgtgggcagcgagt

SEQ ID NO: 8178338 - DNA, 22 bp, Homo sapiens
ggcagccccatcagagacgctg

SEQ ID NO: 8178339 - DNA, 21 bp, Homo sapiens
ggcagcctgacccccagagag

SEQ ID NO: 8178340 - DNA, 21 bp, Homo sapiens
ggcagcctctgtggaagggga

SEQ ID NO: 8178341 - DNA, 19 bp, Homo sapiens
ggcagcctgcacgggctgc

SEQ ID NO: 8178342 - DNA, 21 bp, Homo sapiens
ggcagcctgacccccagagag

SEQ ID NO: 8178343 - DNA, 23 bp, Homo sapiens
ggcagcctctgactctgctttgc

SEQ ID NO: 8178344 - DNA, 23 bp, Homo sapiens
ggcagcctctgactctgctttgc

SEQ ID NO: 8178345 - DNA, 18 bp, Homo sapiens
ggcagcctggacatgctc

SEQ ID NO: 8178346 - DNA, 18 bp, Homo sapiens
ggcagcctggacatgctc

SEQ ID NO: 8178347 - DNA, 22 bp, Homo sapiens
ggcagcctggagactttgtgaa

SEQ ID NO: 8178348 - DNA, 22 bp, Homo sapiens
ggcagccttgactagtgactta

SEQ ID NO: 8178349 - DNA, 22 bp, Homo sapiens
ggcagccttgagggaggcctgg

SEQ ID NO: 8178350 - DNA, 22 bp, Homo sapiens
ggcagccttgactagtgactta

SEQ ID NO: 8178351 - DNA, 22 bp, Homo sapiens
ggcaggcttgatatggggggac

SEQ ID NO: 8178352 - DNA, 22 bp, Homo sapiens
ggcaggcttggtggcaccggtt

SEQ ID NO: 8178353 - DNA, 22 bp, Homo sapiens
ggcaggctgttcacctgctttt

SEQ ID NO: 8178354 - DNA, 20 bp, Homo sapiens
ggcaggctttatatggaggg

SEQ ID NO: 8178355 - DNA, 22 bp, Homo sapiens
ggcaggctttcagcatcaagtc

SEQ ID NO: 8178356 - DNA, 22 bp, Homo sapiens
ggcaggctttcagcatcaagtc

SEQ ID NO: 8178357 - DNA, 18 bp, Homo sapiens
ggcagggaaaagataggg

SEQ ID NO: 8178358 - DNA, 22 bp, Homo sapiens
ggcaggctttgagaaagagcat

SEQ ID NO: 8178359 - DNA, 21 bp, Homo sapiens
ggcagcgtgtggacaggaagg

SEQ ID NO: 8178360 - DNA, 22 bp, Homo sapiens
ggcagctattccaagcagcact

SEQ ID NO: 8178361 - DNA, 22 bp, Homo sapiens
ggcagccttgagggaggcctgg

SEQ ID NO: 8178362 - DNA, 22 bp, Homo sapiens
ggcagcgagtcgccaagtctcg

SEQ ID NO: 8178363 - DNA, 22 bp, Homo sapiens
ggcagcgcccgagtccgcagct

SEQ ID NO: 8178364 - DNA, 22 bp, Homo sapiens
ggcagtgcaaggctggcacagt

SEQ ID NO: 8178365 - DNA, 18 bp, Homo sapiens
ggcagtgcagtctcaggg

SEQ ID NO: 8178366 - DNA, 18 bp, Homo sapiens
ggcagtgcagtctcaggg

SEQ ID NO: 8178367 - DNA, 22 bp, Homo sapiens
ggcagtgcaggcccttcagcct

SEQ ID NO: 8178368 - DNA, 22 bp, Homo sapiens
ggcagtgcaaggctggcacagt

SEQ ID NO: 8178369 - DNA, 22 bp, Homo sapiens
ggcagtgcccggtgcctcctct

SEQ ID NO: 8178370 - DNA, 22 bp, Homo sapiens
ggcagtgcccggtgcctcctct

SEQ ID NO: 8178371 - DNA, 22 bp, Homo sapiens
ggcagtgccactaagctctgct

SEQ ID NO: 8178372 - DNA, 22 bp, Homo sapiens
ggcagtgcctgatgctgcagga

SEQ ID NO: 8178373 - DNA, 22 bp, Homo sapiens
ggcagtgcctgatgctgcagga

SEQ ID NO: 8178374 - DNA, 22 bp, Homo sapiens
ggcagtgccactaagctctgct

SEQ ID NO: 8178375 - DNA, 22 bp, Homo sapiens
ggcagtggaggaccctgtgtct

SEQ ID NO: 8178376 - DNA, 22 bp, Homo sapiens
ggcagtggcagagcttggtcta

SEQ ID NO: 8178377 - DNA, 17 bp, Homo sapiens
ggcagtggaggaagaga

SEQ ID NO: 8178378 - DNA, 17 bp, Homo sapiens
ggcagtggaggaagaga

SEQ ID NO: 8178379 - DNA, 22 bp, Homo sapiens
ggcagtgccttagaatctgtgg

SEQ ID NO: 8178380 - DNA, 17 bp, Homo sapiens
ggcagtggaggaagaga

SEQ ID NO: 8178381 - DNA, 22 bp, Homo sapiens
ggcagtgagtcccggagaggcc

SEQ ID NO: 8178382 - DNA, 22 bp, Homo sapiens
ggcagtgagtcccggagaggcc

SEQ ID NO: 8178383 - DNA, 22 bp, Homo sapiens
ggcagtgatgtcaaacagtgaa

SEQ ID NO: 8178384 - DNA, 21 bp, Homo sapiens
ggcagtgatgtgaagtgcatc

SEQ ID NO: 8178385 - DNA, 22 bp, Homo sapiens
ggcagtgatgtcaaacagtgaa

SEQ ID NO: 8178386 - DNA, 21 bp, Homo sapiens
ggcagtgatgtgaagtgcatc

SEQ ID NO: 8178387 - DNA, 22 bp, Homo sapiens
ggcagtgcaaggcagcctggat

SEQ ID NO: 8178388 - DNA, 22 bp, Homo sapiens
ggcagtgcaaggcagcctggat

SEQ ID NO: 8178389 - DNA, 22 bp, Homo sapiens
ggcagtgagctggagggaagga

SEQ ID NO: 8178390 - DNA, 22 bp, Homo sapiens
ggcagtgagctggagggaagga

SEQ ID NO: 8178391 - DNA, 19 bp, Homo sapiens
ggcagtgagaagactcctg

SEQ ID NO: 8178392 - DNA, 22 bp, Homo sapiens
ggcagtgagaggtctcctggtc

SEQ ID NO: 8178393 - DNA, 22 bp, Homo sapiens
ggcaggggtcctggtgttgact

SEQ ID NO: 8178394 - DNA, 22 bp, Homo sapiens
ggcagggcttgtctctgtgatg

SEQ ID NO: 8178395 - DNA, 22 bp, Homo sapiens
ggcagggcttgtctctgtgatg

SEQ ID NO: 8178396 - DNA, 22 bp, Homo sapiens
ggcaggggtcctggtgttgact

SEQ ID NO: 8178397 - DNA, 22 bp, Homo sapiens
ggcagggcttgtctctgtgatg

SEQ ID NO: 8178398 - DNA, 22 bp, Homo sapiens
ggcagggcttgtctctgtgatg

SEQ ID NO: 8178399 - DNA, 22 bp, Homo sapiens
ggcagggccctgattcctgggg

SEQ ID NO: 8178400 - DNA, 22 bp, Homo sapiens
ggcagggccctgattcctgggg

SEQ ID NO: 8178401 - DNA, 22 bp, Homo sapiens
ggcagggccctgattcctgggg

SEQ ID NO: 8178402 - DNA, 20 bp, Homo sapiens
ggcagggcatcaacagctct

SEQ ID NO: 8178403 - DNA, 20 bp, Homo sapiens
ggcagggcatcaacagctct

SEQ ID NO: 8178404 - DNA, 20 bp, Homo sapiens
ggcagggcatcaacagctct

SEQ ID NO: 8178405 - DNA, 20 bp, Homo sapiens
ggcagggcatcaacagctct

SEQ ID NO: 8178406 - DNA, 20 bp, Homo sapiens
ggcagggcatcaacagctct

SEQ ID NO: 8178407 - DNA, 22 bp, Homo sapiens
ggcagggaagctggcatcacgg

SEQ ID NO: 8178408 - DNA, 22 bp, Homo sapiens
ggcagggacaggatagggtttt

SEQ ID NO: 8178409 - DNA, 22 bp, Homo sapiens
ggcagggagagcatgctgataa

SEQ ID NO: 8178410 - DNA, 22 bp, Homo sapiens
ggcagggaaacagctgatccca

SEQ ID NO: 8178411 - DNA, 22 bp, Homo sapiens
ggcagggaaacagctgatccca

SEQ ID NO: 8178412 - DNA, 18 bp, Homo sapiens
ggcagggaaaagataggg

SEQ ID NO: 8178413 - DNA, 22 bp, Homo sapiens
ggcagggaaacagctgatccca

SEQ ID NO: 8178414 - DNA, 22 bp, Homo sapiens
ggcagggaagctggcatcacgg

SEQ ID NO: 8178415 - DNA, 22 bp, Homo sapiens
ggcccaggtccagcgagtacct

SEQ ID NO: 8178416 - DNA, 22 bp, Homo sapiens
ggcccaggtccagcgagtacct

SEQ ID NO: 8178417 - DNA, 20 bp, Homo sapiens
ggcccagtgaaccaggacgg

SEQ ID NO: 8178418 - DNA, 22 bp, Homo sapiens
ggcccagtctggggccctgtga

SEQ ID NO: 8178419 - DNA, 22 bp, Homo sapiens
ggcccatgaccctagccaactg

SEQ ID NO: 8178420 - DNA, 22 bp, Homo sapiens
ggcccagtgttgccagacctga

SEQ ID NO: 8178421 - DNA, 22 bp, Homo sapiens
ggcccatctcttgctctgggtt

SEQ ID NO: 8178422 - DNA, 22 bp, Homo sapiens
ggcccagtgtaccccaggcagt

SEQ ID NO: 8178423 - DNA, 22 bp, Homo sapiens
ggcccagtgtcccggtcgtggc

SEQ ID NO: 8178424 - DNA, 22 bp, Homo sapiens
ggcccagtgtcccggtcgtggc

SEQ ID NO: 8178425 - DNA, 22 bp, Homo sapiens
ggcccagtgtgggtggatgttg

SEQ ID NO: 8178426 - DNA, 22 bp, Homo sapiens
ggcccagtgtgggtggatgttg

SEQ ID NO: 8178427 - DNA, 22 bp, Homo sapiens
ggcccagctgggcggggacacg

SEQ ID NO: 8178428 - DNA, 22 bp, Homo sapiens
ggcccagctgggcggggacacg

SEQ ID NO: 8178429 - DNA, 22 bp, Homo sapiens
ggcccagctgtatattacagtt

SEQ ID NO: 8178430 - DNA, 22 bp, Homo sapiens
ggcccagctttcattccttgct

SEQ ID NO: 8178431 - DNA, 22 bp, Homo sapiens
ggcccagctgtgcttccagccc

SEQ ID NO: 8178432 - DNA, 22 bp, Homo sapiens
ggcccaggctggagtgcagtgg

SEQ ID NO: 8178433 - DNA, 22 bp, Homo sapiens
ggcccaggctggagtgcagtgg

SEQ ID NO: 8178434 - DNA, 22 bp, Homo sapiens
ggcccaggctggagtgcagtgg

SEQ ID NO: 8178435 - DNA, 22 bp, Homo sapiens
ggcccaggctggagtgcagtgg

SEQ ID NO: 8178436 - DNA, 22 bp, Homo sapiens
ggcccaggatgcaagaactgaa

SEQ ID NO: 8178437 - DNA, 22 bp, Homo sapiens
ggcccaggatgcaagaactgaa

SEQ ID NO: 8178438 - DNA, 22 bp, Homo sapiens
ggccagctggagttccgggtgg

SEQ ID NO: 8178439 - DNA, 22 bp, Homo sapiens
ggccagctggagttccgggtgg

SEQ ID NO: 8178440 - DNA, 22 bp, Homo sapiens
ggccagctggatgtgggtgacg

SEQ ID NO: 8178441 - DNA, 22 bp, Homo sapiens
ggccagctggatgtgggtgacg

SEQ ID NO: 8178442 - DNA, 22 bp, Homo sapiens
ggcccagctctattgaattaca

SEQ ID NO: 8178443 - DNA, 22 bp, Homo sapiens
ggcccagctgggcggggacacg

SEQ ID NO: 8178444 - DNA, 22 bp, Homo sapiens
ggccagctgggccaccaggtgc

SEQ ID NO: 8178445 - DNA, 22 bp, Homo sapiens
ggccagctgggccaccaggtgc

SEQ ID NO: 8178446 - DNA, 22 bp, Homo sapiens
ggccagctgggccaccaggtgc

SEQ ID NO: 8178447 - DNA, 22 bp, Homo sapiens
ggccagctgcctgaccttctgt

SEQ ID NO: 8178448 - DNA, 22 bp, Homo sapiens
ggccagctgccaccagccctat

SEQ ID NO: 8178449 - DNA, 20 bp, Homo sapiens
ggccagctggaggcgccggg

SEQ ID NO: 8178450 - DNA, 22 bp, Homo sapiens
ggccagctgctcagtgtctctg

SEQ ID NO: 8178451 - DNA, 20 bp, Homo sapiens
ggccagctgatgcacgatgc

SEQ ID NO: 8178452 - DNA, 22 bp, Homo sapiens
ggccagctgccaccagccctat

SEQ ID NO: 8178453 - DNA, 22 bp, Homo sapiens
ggccagctgccaccagccctat

SEQ ID NO: 8178454 - DNA, 20 bp, Homo sapiens
ggccagctgatgcacgatgc

SEQ ID NO: 8178455 - DNA, 21 bp, Homo sapiens
ggccagctgcatatgtcactg

SEQ ID NO: 8178456 - DNA, 21 bp, Homo sapiens
ggccagcagcgtccactgtgg

SEQ ID NO: 8178457 - DNA, 22 bp, Homo sapiens
ggccagcaggccctgtgatcct

SEQ ID NO: 8178458 - DNA, 22 bp, Homo sapiens
ggccagcaggccctgtgatcct

SEQ ID NO: 8178459 - DNA, 22 bp, Homo sapiens
ggccagcagtcacagggtcaga

SEQ ID NO: 8178460 - DNA, 22 bp, Homo sapiens
ggccagcagtcacagggtcaga

SEQ ID NO: 8178461 - DNA, 22 bp, Homo sapiens
ggccagcatatagagtgaagta

SEQ ID NO: 8178462 - DNA, 19 bp, Homo sapiens
ggccagccacctcgcctgg

SEQ ID NO: 8178463 - DNA, 22 bp, Homo sapiens
ggccagcccagtggtcctctct

SEQ ID NO: 8178464 - DNA, 19 bp, Homo sapiens
ggccagccacctcgcctgg

SEQ ID NO: 8178465 - DNA, 22 bp, Homo sapiens
ggccagctctgcacagcagctg

SEQ ID NO: 8178466 - DNA, 22 bp, Homo sapiens
ggccagctctgcacagcagctg

SEQ ID NO: 8178467 - DNA, 22 bp, Homo sapiens
ggccagctgagctgctgcacag

SEQ ID NO: 8178468 - DNA, 22 bp, Homo sapiens
ggccagagtctatatgcagaca

SEQ ID NO: 8178469 - DNA, 22 bp, Homo sapiens
ggccagagtctatatgcagaca

SEQ ID NO: 8178470 - DNA, 22 bp, Homo sapiens
ggccagagtctatatgcagaca

SEQ ID NO: 8178471 - DNA, 22 bp, Homo sapiens
ggccagagtctatatgcagaca

SEQ ID NO: 8178472 - DNA, 22 bp, Homo sapiens
ggccagagtctatatgcagaca

SEQ ID NO: 8178473 - DNA, 19 bp, Homo sapiens
ggccacctctcttcccagg

SEQ ID NO: 8178474 - DNA, 22 bp, Homo sapiens
ggccacctctgccctactgagt

SEQ ID NO: 8178475 - DNA, 22 bp, Homo sapiens
ggccagagttgatggcatcttg

SEQ ID NO: 8178476 - DNA, 22 bp, Homo sapiens
ggccagcagacctcagggactc

SEQ ID NO: 8178477 - DNA, 22 bp, Homo sapiens
ggccagcagacctcagggactc

SEQ ID NO: 8178478 - DNA, 22 bp, Homo sapiens
ggccacagtgggaaatcctggg

SEQ ID NO: 8178479 - DNA, 21 bp, Homo sapiens
ggccacagttagggctcagga

SEQ ID NO: 8178480 - DNA, 21 bp, Homo sapiens
ggccacagttagggctcagga

SEQ ID NO: 8178481 - DNA, 21 bp, Homo sapiens
ggccacagttagggctcagga

SEQ ID NO: 8178482 - DNA, 21 bp, Homo sapiens
ggccacagttagggctcagga

SEQ ID NO: 8178483 - DNA, 22 bp, Homo sapiens
ggccacagtgggaaatcctggg

SEQ ID NO: 8178484 - DNA, 22 bp, Homo sapiens
ggccacagtgggaaatcctggg

SEQ ID NO: 8178485 - DNA, 22 bp, Homo sapiens
ggccaccagtcctctggcaggg

SEQ ID NO: 8178486 - DNA, 22 bp, Homo sapiens
ggccacattcaaagctgtcctg

SEQ ID NO: 8178487 - DNA, 22 bp, Homo sapiens
ggccacattcaaagctgtcctg

SEQ ID NO: 8178488 - DNA, 22 bp, Homo sapiens
ggccacatgaattcttggacag

SEQ ID NO: 8178489 - DNA, 22 bp, Homo sapiens
ggccacatgaattcttggacag

SEQ ID NO: 8178490 - DNA, 22 bp, Homo sapiens
ggccacatgtggctgctcgtat

SEQ ID NO: 8178491 - DNA, 22 bp, Homo sapiens
ggccacagtctctggaaggatg

SEQ ID NO: 8178492 - DNA, 22 bp, Homo sapiens
ggccacagtctctggaaggatg

SEQ ID NO: 8178493 - DNA, 20 bp, Homo sapiens
ggccacagggtgctggtgga

SEQ ID NO: 8178494 - DNA, 20 bp, Homo sapiens
ggccacagggtgctggtgga

SEQ ID NO: 8178495 - DNA, 20 bp, Homo sapiens
ggccacagggtgctggtgga

SEQ ID NO: 8178496 - DNA, 22 bp, Homo sapiens
ggccacagggctgaacgtggac

SEQ ID NO: 8178497 - DNA, 20 bp, Homo sapiens
ggccacagggtgctggtgga

SEQ ID NO: 8178498 - DNA, 20 bp, Homo sapiens
ggccacagggtgctggtgga

SEQ ID NO: 8178499 - DNA, 22 bp, Homo sapiens
ggccacagcaatgctgtgatgt

SEQ ID NO: 8178500 - DNA, 22 bp, Homo sapiens
ggccacagcaatgctgtgatgt

SEQ ID NO: 8178501 - DNA, 22 bp, Homo sapiens
ggccacagcaatgctgtgatgt

SEQ ID NO: 8178502 - DNA, 22 bp, Homo sapiens
ggccacagcaatgctgtgatgt

SEQ ID NO: 8178503 - DNA, 22 bp, Homo sapiens
ggccacagcagatgcttcagat

SEQ ID NO: 8178504 - DNA, 22 bp, Homo sapiens
ggccacagcagatgcttcagat

SEQ ID NO: 8178505 - DNA, 22 bp, Homo sapiens
ggccacagcagatgcttcagat

SEQ ID NO: 8178506 - DNA, 22 bp, Homo sapiens
ggccacagcaatgctgtgatgt

SEQ ID NO: 8178507 - DNA, 22 bp, Homo sapiens
ggcagtggctcctctctactcc

SEQ ID NO: 8178508 - DNA, 22 bp, Homo sapiens
ggcagtggctgtagtctcttgg

SEQ ID NO: 8178509 - DNA, 22 bp, Homo sapiens
ggcagtgggaaataagtgagaa

SEQ ID NO: 8178510 - DNA, 22 bp, Homo sapiens
ggcagtggctcctctctactcc

SEQ ID NO: 8178511 - DNA, 22 bp, Homo sapiens
ggcagtggctcctctctactcc

SEQ ID NO: 8178512 - DNA, 22 bp, Homo sapiens
ggcagtggcatgtgggtagtgg

SEQ ID NO: 8178513 - DNA, 22 bp, Homo sapiens
ggcagtggcatgtgggtagtgg

SEQ ID NO: 8178514 - DNA, 22 bp, Homo sapiens
ggcagtggcatgtgggtagtgg

SEQ ID NO: 8178515 - DNA, 22 bp, Homo sapiens
ggcagtgggtggatctcaggga

SEQ ID NO: 8178516 - DNA, 22 bp, Homo sapiens
ggcagtgggtggatctcaggga

SEQ ID NO: 8178517 - DNA, 17 bp, Homo sapiens
ggccacagagcttgggg

SEQ ID NO: 8178518 - DNA, 17 bp, Homo sapiens
ggccacagagcttgggg

SEQ ID NO: 8178519 - DNA, 22 bp, Homo sapiens
ggccacagagggcgggatgctg

SEQ ID NO: 8178520 - DNA, 22 bp, Homo sapiens
ggctctgcactcagagtcattc

SEQ ID NO: 8178521 - DNA, 22 bp, Homo sapiens
ggctctgcaaaagtagatactt

SEQ ID NO: 8178522 - DNA, 22 bp, Homo sapiens
ggctctgcaaaagtagatactt

SEQ ID NO: 8178523 - DNA, 22 bp, Homo sapiens
ggctctgaggctatgctttaca

SEQ ID NO: 8178524 - DNA, 22 bp, Homo sapiens
ggctctgagtttagaagggtgg

SEQ ID NO: 8178525 - DNA, 22 bp, Homo sapiens
ggctctgagtttagaagggtgg

SEQ ID NO: 8178526 - DNA, 23 bp, Homo sapiens
ggctctgaggatggagctggtgg

SEQ ID NO: 8178527 - DNA, 22 bp, Homo sapiens
ggctctgaattattcctgagtc

SEQ ID NO: 8178528 - DNA, 22 bp, Homo sapiens
ggctctgacctcccaggcagtt

SEQ ID NO: 8178529 - DNA, 22 bp, Homo sapiens
ggctctgcagagggcccagctt

SEQ ID NO: 8178530 - DNA, 22 bp, Homo sapiens
ggctctgcagagggcccagctt

SEQ ID NO: 8178531 - DNA, 22 bp, Homo sapiens
ggctctgcagagggcccagctt

SEQ ID NO: 8178532 - DNA, 22 bp, Homo sapiens
ggctctgcagcttgctaactgt

SEQ ID NO: 8178533 - DNA, 22 bp, Homo sapiens
ggctctgcagtgacttgagggg

SEQ ID NO: 8178534 - DNA, 22 bp, Homo sapiens
ggctctgcatgcaggttgtcag

SEQ ID NO: 8178535 - DNA, 22 bp, Homo sapiens
ggctctgcagtgacttgagggg

SEQ ID NO: 8178536 - DNA, 22 bp, Homo sapiens
ggctctgcatgtgagtgggtgg

SEQ ID NO: 8178537 - DNA, 22 bp, Homo sapiens
ggctctgcatgtgagtgggtgg

SEQ ID NO: 8178538 - DNA, 22 bp, Homo sapiens
ggctctgcccgcggctgcccac

SEQ ID NO: 8178539 - DNA, 22 bp, Homo sapiens
ggctctgcccgcggctgcccac

SEQ ID NO: 8178540 - DNA, 22 bp, Homo sapiens
ggctctgcccaggtggacagca

SEQ ID NO: 8178541 - DNA, 22 bp, Homo sapiens
ggctctgcccagatgaagagga

SEQ ID NO: 8178542 - DNA, 22 bp, Homo sapiens
ggctctgccatttcctagctgc

SEQ ID NO: 8178543 - DNA, 22 bp, Homo sapiens
ggctctgccatttcctagctgc

SEQ ID NO: 8178544 - DNA, 22 bp, Homo sapiens
ggctctgccacttcttggctgt

SEQ ID NO: 8178545 - DNA, 22 bp, Homo sapiens
ggctctgccacttcttggctgt

SEQ ID NO: 8178546 - DNA, 22 bp, Homo sapiens
ggctctgccacttcttggctgt

SEQ ID NO: 8178547 - DNA, 22 bp, Homo sapiens
ggctctgccgtgtgctcacatg

SEQ ID NO: 8178548 - DNA, 22 bp, Homo sapiens
ggctctgccgtgtgctcacatg

SEQ ID NO: 8178549 - DNA, 22 bp, Homo sapiens
ggctctgcctgcccagcagcac

SEQ ID NO: 8178550 - DNA, 22 bp, Homo sapiens
ggctctgcctctgaccctctgg

SEQ ID NO: 8178551 - DNA, 22 bp, Homo sapiens
ggctctgcgcctgcggggactt

SEQ ID NO: 8178552 - DNA, 22 bp, Homo sapiens
ggctctgcgcctgcggggactt

SEQ ID NO: 8178553 - DNA, 22 bp, Homo sapiens
ggctctgcctgcctgagtgtcc

SEQ ID NO: 8178554 - DNA, 22 bp, Homo sapiens
ggctctgcctgcctgagtgtcc

SEQ ID NO: 8178555 - DNA, 22 bp, Homo sapiens
ggctctgcctgcctgagtgtcc

SEQ ID NO: 8178556 - DNA, 22 bp, Homo sapiens
ggctcactgcaacttccgcctc

SEQ ID NO: 8178557 - DNA, 22 bp, Homo sapiens
ggctcactgcaacttccgcctc

SEQ ID NO: 8178558 - DNA, 23 bp, Homo sapiens
ggctcagaaaaagtcctggcctc

SEQ ID NO: 8178559 - DNA, 22 bp, Homo sapiens
ggctcactttggggtcagctgg

SEQ ID NO: 8178560 - DNA, 22 bp, Homo sapiens
ggctcagaaacctctggtgtct

SEQ ID NO: 8178561 - DNA, 23 bp, Homo sapiens
ggctcagaaaaagtcctggcctc

SEQ ID NO: 8178562 - DNA, 22 bp, Homo sapiens
ggctcagaaactaaaggcgctg

SEQ ID NO: 8178563 - DNA, 22 bp, Homo sapiens
ggctcagaaggccatgctctgc

SEQ ID NO: 8178564 - DNA, 22 bp, Homo sapiens
ggctcagaaactaaaggcgctg

SEQ ID NO: 8178565 - DNA, 22 bp, Homo sapiens
ggctcagaaactaaaggcgctg

SEQ ID NO: 8178566 - DNA, 22 bp, Homo sapiens
ggctcagaaggccatgctctgc

SEQ ID NO: 8178567 - DNA, 22 bp, Homo sapiens
ggctcagaggccagcaggtaga

SEQ ID NO: 8178568 - DNA, 22 bp, Homo sapiens
ggctcagaggccagcaggtaga

SEQ ID NO: 8178569 - DNA, 22 bp, Homo sapiens
ggctcagaggccagcaggtaga

SEQ ID NO: 8178570 - DNA, 22 bp, Homo sapiens
ggctcagaggttgaggccggca

SEQ ID NO: 8178571 - DNA, 22 bp, Homo sapiens
ggctcagaggttgaggccggca

SEQ ID NO: 8178572 - DNA, 22 bp, Homo sapiens
ggctcagaggagctggaacggt

SEQ ID NO: 8178573 - DNA, 22 bp, Homo sapiens
ggctcagaggccagcaggtaga

SEQ ID NO: 8178574 - DNA, 22 bp, Homo sapiens
ggctcagaggagctggaacggt

SEQ ID NO: 8178575 - DNA, 22 bp, Homo sapiens
ggctcagacctcccagctccag

SEQ ID NO: 8178576 - DNA, 22 bp, Homo sapiens
ggctcagacctcccagctccag

SEQ ID NO: 8178577 - DNA, 22 bp, Homo sapiens
ggctcagacctcccagctccag

SEQ ID NO: 8178578 - DNA, 22 bp, Homo sapiens
ggctcagacctcccagctccag

SEQ ID NO: 8178579 - DNA, 22 bp, Homo sapiens
ggctcagactcccaggccctct

SEQ ID NO: 8178580 - DNA, 22 bp, Homo sapiens
ggctcagactcccaggccctct

SEQ ID NO: 8178581 - DNA, 22 bp, Homo sapiens
ggctcagagacctgcgatctga

SEQ ID NO: 8178582 - DNA, 22 bp, Homo sapiens
ggctcagcacagggctggcatc

SEQ ID NO: 8178583 - DNA, 22 bp, Homo sapiens
ggctcagcaatgatgagcccct

SEQ ID NO: 8178584 - DNA, 22 bp, Homo sapiens
ggctcagcaatgatgagcccct

SEQ ID NO: 8178585 - DNA, 22 bp, Homo sapiens
ggctcagcaatgatgagcccct

SEQ ID NO: 8178586 - DNA, 22 bp, Homo sapiens
ggctcagattccgagtggccct

SEQ ID NO: 8178587 - DNA, 22 bp, Homo sapiens
ggctcagcacagggctggcatc

SEQ ID NO: 8178588 - DNA, 22 bp, Homo sapiens
ggctcagcacagggctggcatc

SEQ ID NO: 8178589 - DNA, 22 bp, Homo sapiens
ggctcagattccgagtggccct

SEQ ID NO: 8178590 - DNA, 22 bp, Homo sapiens
ggctcagattccgagtggccct

SEQ ID NO: 8178591 - DNA, 22 bp, Homo sapiens
ggctcagattccgagtggccct

SEQ ID NO: 8178592 - DNA, 22 bp, Homo sapiens
ggctcagagttaggacccatgt

SEQ ID NO: 8178593 - DNA, 22 bp, Homo sapiens
ggctcagaggttgaggccggca

SEQ ID NO: 8178594 - DNA, 22 bp, Homo sapiens
ggctcagaggttgaggccggca

SEQ ID NO: 8178595 - DNA, 22 bp, Homo sapiens
ggctcagatggtttgttctaga

SEQ ID NO: 8178596 - DNA, 22 bp, Homo sapiens
ggctcagagttaggacccatgt

SEQ ID NO: 8178597 - DNA, 17 bp, Homo sapiens
ggctctcttccagactt

SEQ ID NO: 8178598 - DNA, 22 bp, Homo sapiens
ggctctctgaggaaacccttcc

SEQ ID NO: 8178599 - DNA, 22 bp, Homo sapiens
ggctctgaaggagacagctgct

SEQ ID NO: 8178600 - DNA, 22 bp, Homo sapiens
ggctctgaacatggggaggagt

SEQ ID NO: 8178601 - DNA, 19 bp, Homo sapiens
ggcctctgcaggccgcccc

SEQ ID NO: 8178602 - DNA, 22 bp, Homo sapiens
ggcctctgcaactggctgtggc

SEQ ID NO: 8178603 - DNA, 22 bp, Homo sapiens
ggcctctgcaactggctgtggc

SEQ ID NO: 8178604 - DNA, 22 bp, Homo sapiens
ggcctctgcaactggctgtggc

SEQ ID NO: 8178605 - DNA, 22 bp, Homo sapiens
ggcctctgcaactggctgtggc

SEQ ID NO: 8178606 - DNA, 22 bp, Homo sapiens
ggcctctgcaggcctcgacaag

SEQ ID NO: 8178607 - DNA, 22 bp, Homo sapiens
ggcctctgccccagccacacct

SEQ ID NO: 8178608 - DNA, 22 bp, Homo sapiens
ggcctctgccccagccacacct

SEQ ID NO: 8178609 - DNA, 22 bp, Homo sapiens
ggcctctgccccagccacacct

SEQ ID NO: 8178610 - DNA, 22 bp, Homo sapiens
ggcctctgcctcatctgggcac

SEQ ID NO: 8178611 - DNA, 21 bp, Homo sapiens
ggcctctgccttgccccactc

SEQ ID NO: 8178612 - DNA, 21 bp, Homo sapiens
ggcctctgccttgccccactc

SEQ ID NO: 8178613 - DNA, 22 bp, Homo sapiens
ggcctctgccccgcggggctcg

SEQ ID NO: 8178614 - DNA, 22 bp, Homo sapiens
ggcctctgcctcatctgggcac

SEQ ID NO: 8178615 - DNA, 22 bp, Homo sapiens
ggcctctgccctcactcctgtc

SEQ ID NO: 8178616 - DNA, 21 bp, Homo sapiens
ggcctcccggaccgcagcgcc

SEQ ID NO: 8178617 - DNA, 21 bp, Homo sapiens
ggcctcccggaccgcagcgcc

SEQ ID NO: 8178618 - DNA, 22 bp, Homo sapiens
ggcctccatcttatcttactct

SEQ ID NO: 8178619 - DNA, 22 bp, Homo sapiens
ggcctccaggcctactcagggc

SEQ ID NO: 8178620 - DNA, 22 bp, Homo sapiens
ggcctccaggcctactcagggc

SEQ ID NO: 8178621 - DNA, 22 bp, Homo sapiens
ggcctcctcaccctgctcaggc

SEQ ID NO: 8178622 - DNA, 21 bp, Homo sapiens
ggcctcctacagtcatgggcc

SEQ ID NO: 8178623 - DNA, 21 bp, Homo sapiens
ggcctcctacagtcatgggcc

SEQ ID NO: 8178624 - DNA, 21 bp, Homo sapiens
ggcctcctacagtcatgggcc

SEQ ID NO: 8178625 - DNA, 22 bp, Homo sapiens
ggcctctctgagagcagacgtt

SEQ ID NO: 8178626 - DNA, 22 bp, Homo sapiens
ggcctcctcaccctgctcaggc

SEQ ID NO: 8178627 - DNA, 22 bp, Homo sapiens
ggcctcctcaccctgctcaggc

SEQ ID NO: 8178628 - DNA, 22 bp, Homo sapiens
ggcctctctccttggcttgcag

SEQ ID NO: 8178629 - DNA, 22 bp, Homo sapiens
ggcctcctcaccctgctcaggc

SEQ ID NO: 8178630 - DNA, 22 bp, Homo sapiens
ggcctctctggcatggctgccc

SEQ ID NO: 8178631 - DNA, 22 bp, Homo sapiens
ggcctctctggcatggctgccc

SEQ ID NO: 8178632 - DNA, 22 bp, Homo sapiens
ggcctctcttgggacagctgtc

SEQ ID NO: 8178633 - DNA, 22 bp, Homo sapiens
ggcctctcttgggacagctgtc

SEQ ID NO: 8178634 - DNA, 22 bp, Homo sapiens
ggcctctgaggacagccttggc

SEQ ID NO: 8178635 - DNA, 22 bp, Homo sapiens
ggcctctgaggacagccttggc

SEQ ID NO: 8178636 - DNA, 22 bp, Homo sapiens
ggcctctgaggacagccttggc

SEQ ID NO: 8178637 - DNA, 22 bp, Homo sapiens
ggcctctgaggacagccttggc

SEQ ID NO: 8178638 - DNA, 22 bp, Homo sapiens
ggcctctgaggacagccttggc

SEQ ID NO: 8178639 - DNA, 22 bp, Homo sapiens
ggcctctggtcaagacaagcat

SEQ ID NO: 8178640 - DNA, 22 bp, Homo sapiens
ggcctctggtcaagacaagcat

SEQ ID NO: 8178641 - DNA, 22 bp, Homo sapiens
ggcctctggtcaagacaagcat

SEQ ID NO: 8178642 - DNA, 22 bp, Homo sapiens
ggcctctggggtcctgagccca

SEQ ID NO: 8178643 - DNA, 22 bp, Homo sapiens
ggcctctggggtcctgagccca

SEQ ID NO: 8178644 - DNA, 22 bp, Homo sapiens
ggcctctggggtcctgagccca

SEQ ID NO: 8178645 - DNA, 22 bp, Homo sapiens
ggcctctggtgcctgaagcgcc

SEQ ID NO: 8178646 - DNA, 22 bp, Homo sapiens
ggcctctggttcacagggagga

SEQ ID NO: 8178647 - DNA, 18 bp, Homo sapiens
ggcctctggactggcagc

SEQ ID NO: 8178648 - DNA, 22 bp, Homo sapiens
ggcctctggcaggcaggccctc

SEQ ID NO: 8178649 - DNA, 22 bp, Homo sapiens
ggcctctggcaggcaggccctc

SEQ ID NO: 8178650 - DNA, 18 bp, Homo sapiens
ggcctctggactggcagc

SEQ ID NO: 8178651 - DNA, 18 bp, Homo sapiens
ggcctctggactggcagc

SEQ ID NO: 8178652 - DNA, 22 bp, Homo sapiens
ggcctctgcttatgctgatgac

SEQ ID NO: 8178653 - DNA, 22 bp, Homo sapiens
ggcctctgcttatgctgatgac

SEQ ID NO: 8178654 - DNA, 22 bp, Homo sapiens
ggcctctgcttatgctgatgac

SEQ ID NO: 8178655 - DNA, 22 bp, Homo sapiens
ggcctctgcttatgctgatgac

SEQ ID NO: 8178656 - DNA, 22 bp, Homo sapiens
ggctcaccattttcactctctg

SEQ ID NO: 8178657 - DNA, 22 bp, Homo sapiens
ggctcaccatggcctccctgct

SEQ ID NO: 8178658 - DNA, 23 bp, Homo sapiens
ggctcacacggagtgcctccacc

SEQ ID NO: 8178659 - DNA, 22 bp, Homo sapiens
ggctagggaaaatgattggata

SEQ ID NO: 8178660 - DNA, 22 bp, Homo sapiens
ggctagggacacagctctgctc

SEQ ID NO: 8178661 - DNA, 22 bp, Homo sapiens
ggctagggacacagctctgctc

SEQ ID NO: 8178662 - DNA, 22 bp, Homo sapiens
ggctagggacacagctctgctc

SEQ ID NO: 8178663 - DNA, 22 bp, Homo sapiens
ggctagggacacagctctgctc

SEQ ID NO: 8178664 - DNA, 22 bp, Homo sapiens
ggctcacgcaattatcccggcc

SEQ ID NO: 8178665 - DNA, 22 bp, Homo sapiens
ggctcacgcaattatcccggcc

SEQ ID NO: 8178666 - DNA, 22 bp, Homo sapiens
ggctcactgcaacttccgcctc

SEQ ID NO: 8178667 - DNA, 22 bp, Homo sapiens
ggctcactgcaacttccgcctc

SEQ ID NO: 8178668 - DNA, 22 bp, Homo sapiens
ggctcactgcaacctctgcctc

SEQ ID NO: 8178669 - DNA, 22 bp, Homo sapiens
ggctcactgcaacttccgcctc

SEQ ID NO: 8178670 - DNA, 22 bp, Homo sapiens
ggctcactgcaacttccgcctc

SEQ ID NO: 8178671 - DNA, 22 bp, Homo sapiens
ggctcactgcaacttccgcctc

SEQ ID NO: 8178672 - DNA, 22 bp, Homo sapiens
gtataaagtataagcttgtttt

SEQ ID NO: 8178673 - DNA, 19 bp, Homo sapiens
gtataacttacaccagcaa

SEQ ID NO: 8178674 - DNA, 20 bp, Homo sapiens
gtataagatttcacacatta

SEQ ID NO: 8178675 - DNA, 22 bp, Homo sapiens
gtatacaatacacaatgctctg

SEQ ID NO: 8178676 - DNA, 22 bp, Homo sapiens
gtatacaatacacaatgctctg

SEQ ID NO: 8178677 - DNA, 22 bp, Homo sapiens
gtagttctgcagtgtcacctga

SEQ ID NO: 8178678 - DNA, 22 bp, Homo sapiens
gtagttctgcagtgtcacctga

SEQ ID NO: 8178679 - DNA, 22 bp, Homo sapiens
gtagtttaattcctggcctttc

SEQ ID NO: 8178680 - DNA, 22 bp, Homo sapiens
gtagtttacagaagaggagcaa

SEQ ID NO: 8178681 - DNA, 22 bp, Homo sapiens
gtagttctgcagtgtcacctga

SEQ ID NO: 8178682 - DNA, 22 bp, Homo sapiens
gtagttatgtttacatgccatc

SEQ ID NO: 8178683 - DNA, 22 bp, Homo sapiens
gtagtgggtgaggaaggaagga

SEQ ID NO: 8178684 - DNA, 22 bp, Homo sapiens
gtatttttaggtaaggaaagta

SEQ ID NO: 8178685 - DNA, 22 bp, Homo sapiens
gtatttttaggtaaggaaagta

SEQ ID NO: 8178686 - DNA, 22 bp, Homo sapiens
gtatttttaggtaaggaaagta

SEQ ID NO: 8178687 - DNA, 22 bp, Homo sapiens
gtatttttaggtaaggaaagta

SEQ ID NO: 8178688 - DNA, 22 bp, Homo sapiens
gtattttatggcctggggccta

SEQ ID NO: 8178689 - DNA, 22 bp, Homo sapiens
gtattttcaagagcagtagtat

SEQ ID NO: 8178690 - DNA, 22 bp, Homo sapiens
gtattttatggcatgcagtggc

SEQ ID NO: 8178691 - DNA, 22 bp, Homo sapiens
gtattttatggcatgcagtggc

SEQ ID NO: 8178692 - DNA, 22 bp, Homo sapiens
gtatttcctcgcttgtgggatt

SEQ ID NO: 8178693 - DNA, 22 bp, Homo sapiens
gtatttcctcgcttgtgggatt

SEQ ID NO: 8178694 - DNA, 22 bp, Homo sapiens
gtatttcctcgcttgtgggatt

SEQ ID NO: 8178695 - DNA, 22 bp, Homo sapiens
gtatttcctatagtgagggcct

SEQ ID NO: 8178696 - DNA, 22 bp, Homo sapiens
gtatttccctgagttctgtgag

SEQ ID NO: 8178697 - DNA, 22 bp, Homo sapiens
gtatttcctatagtgagggcct

SEQ ID NO: 8178698 - DNA, 22 bp, Homo sapiens
gtatacatacttctagattaaa

SEQ ID NO: 8178699 - DNA, 22 bp, Homo sapiens
gtatttccattagtgtgtgcac

SEQ ID NO: 8178700 - DNA, 22 bp, Homo sapiens
gtatttcccccagactccctgg

SEQ ID NO: 8178701 - DNA, 22 bp, Homo sapiens
gtatttccctgagttctgtgag

SEQ ID NO: 8178702 - DNA, 22 bp, Homo sapiens
gtatttccctgagttctgtgag

SEQ ID NO: 8178703 - DNA, 22 bp, Homo sapiens
gtatttcccccagactccctgg

SEQ ID NO: 8178704 - DNA, 22 bp, Homo sapiens
gtcaaatatatgcaaaactatt

SEQ ID NO: 8178705 - DNA, 22 bp, Homo sapiens
gtcaaatatatgcaaaactatt

SEQ ID NO: 8178706 - DNA, 22 bp, Homo sapiens
gtcaaatattatgcagcttgga

SEQ ID NO: 8178707 - DNA, 22 bp, Homo sapiens
gtcaaatatactaagaggtaaa

SEQ ID NO: 8178708 - DNA, 22 bp, Homo sapiens
gtcaaatatactaagaggtaaa

SEQ ID NO: 8178709 - DNA, 22 bp, Homo sapiens
gtcaaagaaacgcaccttacat

SEQ ID NO: 8178710 - DNA, 22 bp, Homo sapiens
gtcaaagatcctatgagttaaa

SEQ ID NO: 8178711 - DNA, 22 bp, Homo sapiens
gtcaaataattttctcaatagt

SEQ ID NO: 8178712 - DNA, 22 bp, Homo sapiens
gtcaaataattttctcaatagt

SEQ ID NO: 8178713 - DNA, 22 bp, Homo sapiens
gtcaaagaaacgcaccttacat

SEQ ID NO: 8178714 - DNA, 20 bp, Homo sapiens
gtcaaactactggcagtgcc

SEQ ID NO: 8178715 - DNA, 22 bp, Homo sapiens
gtcaaacatagggactttgtgg

SEQ ID NO: 8178716 - DNA, 22 bp, Homo sapiens
gtcaaaaagtagtcatttctgt

SEQ ID NO: 8178717 - DNA, 22 bp, Homo sapiens
gtcaaaaagtagtcatttctgt

SEQ ID NO: 8178718 - DNA, 22 bp, Homo sapiens
gtatttttcattccaagtgaga

SEQ ID NO: 8178719 - DNA, 22 bp, Homo sapiens
gtatttttcattccaagtgaga

SEQ ID NO: 8178720 - DNA, 22 bp, Homo sapiens
gtatttttcattccaagtgaga

SEQ ID NO: 8178721 - DNA, 22 bp, Homo sapiens
gtatttttcattccaagtgaga

SEQ ID NO: 8178722 - DNA, 22 bp, Homo sapiens
gtatttttcagttaggagctta

SEQ ID NO: 8178723 - DNA, 22 bp, Homo sapiens
gtatttttcattccaagtgaga

SEQ ID NO: 8178724 - DNA, 22 bp, Homo sapiens
gtcaaaaagtagtcatttctgt

SEQ ID NO: 8178725 - DNA, 22 bp, Homo sapiens
gtcaaaaagtagtcatttctgt

SEQ ID NO: 8178726 - DNA, 22 bp, Homo sapiens
gtcaaaaagtagtcatttctgt

SEQ ID NO: 8178727 - DNA, 22 bp, Homo sapiens
gtcaaaacaaagttaagaattc

SEQ ID NO: 8178728 - DNA, 22 bp, Homo sapiens
gtcaaaaagtagtcatttctgt

SEQ ID NO: 8178729 - DNA, 22 bp, Homo sapiens
gtatttttaggtaaggaaagta

SEQ ID NO: 8178730 - DNA, 22 bp, Homo sapiens
gtatttttagtagagtcggggt

SEQ ID NO: 8178731 - DNA, 22 bp, Homo sapiens
gtatttttagtagagtcggggt

SEQ ID NO: 8178732 - DNA, 22 bp, Homo sapiens
gtatttttcagttaggagctta

SEQ ID NO: 8178733 - DNA, 22 bp, Homo sapiens
gtatttttcagttaggagctta

SEQ ID NO: 8178734 - DNA, 22 bp, Homo sapiens
gtatttttcagttaggagctta

SEQ ID NO: 8178735 - DNA, 22 bp, Homo sapiens
gtatttttcagttaggagctta

SEQ ID NO: 8178736 - DNA, 22 bp, Homo sapiens
gtatttttagtagagtcggggt

SEQ ID NO: 8178737 - DNA, 22 bp, Homo sapiens
gtacaagtgtatttggcttgat

SEQ ID NO: 8178738 - DNA, 22 bp, Homo sapiens
gtacaagtgctgtgagggaaaa

SEQ ID NO: 8178739 - DNA, 22 bp, Homo sapiens
gtacaagtaagaaaattgccca

SEQ ID NO: 8178740 - DNA, 21 bp, Homo sapiens
gtacaagctcaccaagtggac

SEQ ID NO: 8178741 - DNA, 22 bp, Homo sapiens
gtacaataactagtcttatagt

SEQ ID NO: 8178742 - DNA, 22 bp, Homo sapiens
gtacaagttgcctaccttaagt

SEQ ID NO: 8178743 - DNA, 22 bp, Homo sapiens
gtacaagtgtatttggcttgat

SEQ ID NO: 8178744 - DNA, 22 bp, Homo sapiens
gtacaagttctactctataaat

SEQ ID NO: 8178745 - DNA, 22 bp, Homo sapiens
gtacaagtgtgtgtttgagcag

SEQ ID NO: 8178746 - DNA, 22 bp, Homo sapiens
gtacaagttctactctataaat

SEQ ID NO: 8178747 - DNA, 22 bp, Homo sapiens
gtacaacaggattgatgtacca

SEQ ID NO: 8178748 - DNA, 22 bp, Homo sapiens
gtacaacatgattttactctct

SEQ ID NO: 8178749 - DNA, 22 bp, Homo sapiens
gtacaacatgattttactctct

SEQ ID NO: 8178750 - DNA, 22 bp, Homo sapiens
gtacaacatgattttactctct

SEQ ID NO: 8178751 - DNA, 22 bp, Homo sapiens
gtacaacatgattttactctct

SEQ ID NO: 8178752 - DNA, 22 bp, Homo sapiens
gtacaaattgatacagatttga

SEQ ID NO: 8178753 - DNA, 22 bp, Homo sapiens
gtacaaattttgacatctagga

SEQ ID NO: 8178754 - DNA, 22 bp, Homo sapiens
gtacaaatgtacacttgtataa

SEQ ID NO: 8178755 - DNA, 22 bp, Homo sapiens
gtacaaatgtacacttgtataa

SEQ ID NO: 8178756 - DNA, 22 bp, Homo sapiens
gtacaaatgtacacttgtataa

SEQ ID NO: 8178757 - DNA, 22 bp, Homo sapiens
gtacaaatgaaaatagaccact

SEQ ID NO: 8178758 - DNA, 22 bp, Homo sapiens
gtacaaatgagagttctgtttt

SEQ ID NO: 8178759 - DNA, 22 bp, Homo sapiens
gtacaaatgcaggtttgttaca

SEQ ID NO: 8178760 - DNA, 22 bp, Homo sapiens
gtacaaatgcaggtttgttaca

SEQ ID NO: 8178761 - DNA, 22 bp, Homo sapiens
gtacaaaagttattgcggtttt

SEQ ID NO: 8178762 - DNA, 22 bp, Homo sapiens
gtacaaaagttattgcggtttt

SEQ ID NO: 8178763 - DNA, 22 bp, Homo sapiens
gtaggggtcaggtagggactct

SEQ ID NO: 8178764 - DNA, 22 bp, Homo sapiens
gtagggttggagagcacaacca

SEQ ID NO: 8178765 - DNA, 22 bp, Homo sapiens
gtaggggtcaggtagggactct

SEQ ID NO: 8178766 - DNA, 22 bp, Homo sapiens
gtagggctcagtaaatactttg

SEQ ID NO: 8178767 - DNA, 22 bp, Homo sapiens
gtagggctcagtaaatactttg

SEQ ID NO: 8178768 - DNA, 22 bp, Homo sapiens
gtaggggatggttccctagaaa

SEQ ID NO: 8178769 - DNA, 22 bp, Homo sapiens
gtaggggatggttccctagaaa

SEQ ID NO: 8178770 - DNA, 22 bp, Homo sapiens
gtaggcagataggagtgcagcc

SEQ ID NO: 8178771 - DNA, 22 bp, Homo sapiens
gtaggcagataggagtgcagcc

SEQ ID NO: 8178772 - DNA, 22 bp, Homo sapiens
gtagggcatagagatgttggca

SEQ ID NO: 8178773 - DNA, 22 bp, Homo sapiens
gtaggcagaataattcctcctt

SEQ ID NO: 8178774 - DNA, 22 bp, Homo sapiens
gtacaataactagtcttatagt

SEQ ID NO: 8178775 - DNA, 22 bp, Homo sapiens
gtacaatagcagttttcccttt

SEQ ID NO: 8178776 - DNA, 22 bp, Homo sapiens
gtaggtcagacataagaggaca

SEQ ID NO: 8178777 - DNA, 22 bp, Homo sapiens
gtaggtcagacataagaggaca

SEQ ID NO: 8178778 - DNA, 22 bp, Homo sapiens
gtaggtcagacataagaggaca

SEQ ID NO: 8178779 - DNA, 22 bp, Homo sapiens
gtaggggtgctgagatctggaa

SEQ ID NO: 8178780 - DNA, 22 bp, Homo sapiens
gtagggttggagagcacaacca

SEQ ID NO: 8178781 - DNA, 22 bp, Homo sapiens
gtaggtgagtgatgctcagatt

SEQ ID NO: 8178782 - DNA, 22 bp, Homo sapiens
gtaggtgagtgatgctcagatt

SEQ ID NO: 8178783 - DNA, 22 bp, Homo sapiens
gtagtcccagctaccccggagg

SEQ ID NO: 8178784 - DNA, 22 bp, Homo sapiens
gtagtataaatgggaaatacat

SEQ ID NO: 8178785 - DNA, 22 bp, Homo sapiens
gtagtatgaacatgtaggtaga

SEQ ID NO: 8178786 - DNA, 22 bp, Homo sapiens
gtcagaaaaagcaaggctgggc

SEQ ID NO: 8178787 - DNA, 22 bp, Homo sapiens
gtcagaaaaagcaaggctgggc

SEQ ID NO: 8178788 - DNA, 17 bp, Homo sapiens
gtcactttgtttaaagg

SEQ ID NO: 8178789 - DNA, 22 bp, Homo sapiens
gtcactttggcctctacagcca

SEQ ID NO: 8178790 - DNA, 22 bp, Homo sapiens
gtcacttttaagggccttttct

SEQ ID NO: 8178791 - DNA, 17 bp, Homo sapiens
gtcactttgtttaaagg

SEQ ID NO: 8178792 - DNA, 22 bp, Homo sapiens
gtcagaaaccagtcaaacaaga

SEQ ID NO: 8178793 - DNA, 22 bp, Homo sapiens
gtcagaagcatttgtggctgaa

SEQ ID NO: 8178794 - DNA, 22 bp, Homo sapiens
gtcagaagcatttgtggctgaa

SEQ ID NO: 8178795 - DNA, 22 bp, Homo sapiens
gtcactttacactcctactaaa

SEQ ID NO: 8178796 - DNA, 22 bp, Homo sapiens
gtcactttaaagggttaacagg

SEQ ID NO: 8178797 - DNA, 22 bp, Homo sapiens
gtcactgtttcctattatattt

SEQ ID NO: 8178798 - DNA, 22 bp, Homo sapiens
gtcactttattaattttggtga

SEQ ID NO: 8178799 - DNA, 22 bp, Homo sapiens
gtcactttacactcctactaaa

SEQ ID NO: 8178800 - DNA, 22 bp, Homo sapiens
gtcactttgaagctgtttttag

SEQ ID NO: 8178801 - DNA, 22 bp, Homo sapiens
gtcactttctgtgagatgtagt

SEQ ID NO: 8178802 - DNA, 22 bp, Homo sapiens
gtcactttcacactttattgct

SEQ ID NO: 8178803 - DNA, 17 bp, Homo sapiens
gtcactgtctaatgaag

SEQ ID NO: 8178804 - DNA, 22 bp, Homo sapiens
gtcactgtatccaggttccagc

SEQ ID NO: 8178805 - DNA, 22 bp, Homo sapiens
gtcactgtatccaggttccagc

SEQ ID NO: 8178806 - DNA, 22 bp, Homo sapiens
gtcactgtatccaggttccagc

SEQ ID NO: 8178807 - DNA, 22 bp, Homo sapiens
gtcactgtatccaggttccagc

SEQ ID NO: 8178808 - DNA, 22 bp, Homo sapiens
gtcactggggccacatgcagaa

SEQ ID NO: 8178809 - DNA, 22 bp, Homo sapiens
gtcactggggccacatgcagaa

SEQ ID NO: 8178810 - DNA, 22 bp, Homo sapiens
gtcactgcctcttaactttttc

SEQ ID NO: 8178811 - DNA, 22 bp, Homo sapiens
gtcactggaattacaggcatgc

SEQ ID NO: 8178812 - DNA, 18 bp, Homo sapiens
gtcacctggatcagatta

SEQ ID NO: 8178813 - DNA, 22 bp, Homo sapiens
gtcaccttgaacaggctactca

SEQ ID NO: 8178814 - DNA, 18 bp, Homo sapiens
gtcactagttcaaacttc

SEQ ID NO: 8178815 - DNA, 22 bp, Homo sapiens
gtcactcaggctggagttcagt

SEQ ID NO: 8178816 - DNA, 22 bp, Homo sapiens
gtcactcttccccatagcctac

SEQ ID NO: 8178817 - DNA, 22 bp, Homo sapiens
gtcacccactccctgctgctgt

SEQ ID NO: 8178818 - DNA, 22 bp, Homo sapiens
gtcacctcgctgtcttcctgag

SEQ ID NO: 8178819 - DNA, 22 bp, Homo sapiens
gtcacctctcatcacatgctac

SEQ ID NO: 8178820 - DNA, 22 bp, Homo sapiens
gtcacctcgctgtcttcctgag

SEQ ID NO: 8178821 - DNA, 22 bp, Homo sapiens
gtcacctctcatcacatgctac

SEQ ID NO: 8178822 - DNA, 22 bp, Homo sapiens
gtccagctccagggaggcaggc

SEQ ID NO: 8178823 - DNA, 22 bp, Homo sapiens
gtccagctctcagatggctgca

SEQ ID NO: 8178824 - DNA, 19 bp, Homo sapiens
gtccagcctttgggtctta

SEQ ID NO: 8178825 - DNA, 22 bp, Homo sapiens
gtccagctgcagctgggcagaa

SEQ ID NO: 8178826 - DNA, 22 bp, Homo sapiens
gtccagctgcagctgggcagaa

SEQ ID NO: 8178827 - DNA, 22 bp, Homo sapiens
gtccagctgcagctgggcagaa

SEQ ID NO: 8178828 - DNA, 22 bp, Homo sapiens
gtccagctgggccagggcactc

SEQ ID NO: 8178829 - DNA, 22 bp, Homo sapiens
gtccagctctgagaagaaacat

SEQ ID NO: 8178830 - DNA, 22 bp, Homo sapiens
gtccagctctcagatggctgca

SEQ ID NO: 8178831 - DNA, 22 bp, Homo sapiens
gtccagctgatcttgacccagc

SEQ ID NO: 8178832 - DNA, 22 bp, Homo sapiens
gtccagctctgagaagaaacat

SEQ ID NO: 8178833 - DNA, 22 bp, Homo sapiens
gtccagccctctgcctccaggt

SEQ ID NO: 8178834 - DNA, 22 bp, Homo sapiens
gtccagcccgggctccgccagc

SEQ ID NO: 8178835 - DNA, 22 bp, Homo sapiens
gtcagagcactgagttgtgggc

SEQ ID NO: 8178836 - DNA, 22 bp, Homo sapiens
gtcagagcccccagcggcgcgg

SEQ ID NO: 8178837 - DNA, 22 bp, Homo sapiens
gtcagagctggaggcaagttct

SEQ ID NO: 8178838 - DNA, 22 bp, Homo sapiens
gtcagagcccttccctgatttt

SEQ ID NO: 8178839 - DNA, 22 bp, Homo sapiens
gtcagagctgtgcaaggctgag

SEQ ID NO: 8178840 - DNA, 22 bp, Homo sapiens
gtccagagaagggaggggactc

SEQ ID NO: 8178841 - DNA, 22 bp, Homo sapiens
gtccagagagatcttctgatag

SEQ ID NO: 8178842 - DNA, 22 bp, Homo sapiens
gtccagagaagtcattacttca

SEQ ID NO: 8178843 - DNA, 22 bp, Homo sapiens
gtcagaggaggctgagtaggaa

SEQ ID NO: 8178844 - DNA, 22 bp, Homo sapiens
gtccagaattactactgtttga

SEQ ID NO: 8178845 - DNA, 22 bp, Homo sapiens
gtcctctgtagggctgggccac

SEQ ID NO: 8178846 - DNA, 22 bp, Homo sapiens
gtcctctgtagggctgggccac

SEQ ID NO: 8178847 - DNA, 22 bp, Homo sapiens
gtcctctgtagggctgggccac

SEQ ID NO: 8178848 - DNA, 22 bp, Homo sapiens
gtcctctgtagggctgggccac

SEQ ID NO: 8178849 - DNA, 22 bp, Homo sapiens
gtcctctggtgaaagcattccc

SEQ ID NO: 8178850 - DNA, 22 bp, Homo sapiens
gtcctctgggctttgagcagtc

SEQ ID NO: 8178851 - DNA, 22 bp, Homo sapiens
gtcctctgggctttgagcagtc

SEQ ID NO: 8178852 - DNA, 22 bp, Homo sapiens
gtcctggaatcctagaacagtg

SEQ ID NO: 8178853 - DNA, 22 bp, Homo sapiens
gtcctggaatcctagaacagtg

SEQ ID NO: 8178854 - DNA, 22 bp, Homo sapiens
gtcctggagtggcatggcatgg

SEQ ID NO: 8178855 - DNA, 22 bp, Homo sapiens
gtcctggagtggcatggcatgg

SEQ ID NO: 8178856 - DNA, 22 bp, Homo sapiens
gtcctgctaccatgctgtgtga

SEQ ID NO: 8178857 - DNA, 22 bp, Homo sapiens
gtcctctgtgtaggctgcagac

SEQ ID NO: 8178858 - DNA, 22 bp, Homo sapiens
gtcctggcctctgggggtatgg

SEQ ID NO: 8178859 - DNA, 22 bp, Homo sapiens
gtcctggcctctgggggtatgg

SEQ ID NO: 8178860 - DNA, 22 bp, Homo sapiens
gtcctggcccaggagtacacat

SEQ ID NO: 8178861 - DNA, 19 bp, Homo sapiens
gtcctggcgccgccacacc

SEQ ID NO: 8178862 - DNA, 22 bp, Homo sapiens
gtcctggcccaggagtacacat

SEQ ID NO: 8178863 - DNA, 22 bp, Homo sapiens
gtcctggcccaggagtacacat

SEQ ID NO: 8178864 - DNA, 22 bp, Homo sapiens
gtcctggctggttctgtggggc

SEQ ID NO: 8178865 - DNA, 22 bp, Homo sapiens
gtcctggctggttctgtggggc

SEQ ID NO: 8178866 - DNA, 22 bp, Homo sapiens
gtcctggctagtcgtccgcgac

SEQ ID NO: 8178867 - DNA, 22 bp, Homo sapiens
gtcctggcccactggcaggctg

SEQ ID NO: 8178868 - DNA, 22 bp, Homo sapiens
gtcctggcccactggcaggctg

SEQ ID NO: 8178869 - DNA, 22 bp, Homo sapiens
gtcctggcccactggcaggctg

SEQ ID NO: 8178870 - DNA, 22 bp, Homo sapiens
gtcctggcccactggcaggctg

SEQ ID NO: 8178871 - DNA, 22 bp, Homo sapiens
gtcctggcccactggcaggctg

SEQ ID NO: 8178872 - DNA, 22 bp, Homo sapiens
gtcctggcacctcactggctac

SEQ ID NO: 8178873 - DNA, 22 bp, Homo sapiens
gtcctggcacctcactggctac

SEQ ID NO: 8178874 - DNA, 22 bp, Homo sapiens
gtcctggattgaacataggcag

SEQ ID NO: 8178875 - DNA, 22 bp, Homo sapiens
gtcctggattgaacataggcag

SEQ ID NO: 8178876 - DNA, 22 bp, Homo sapiens
gtcctggattgaacataggcag

SEQ ID NO: 8178877 - DNA, 22 bp, Homo sapiens
gtcgtggtcagacaccagaaaa

SEQ ID NO: 8178878 - DNA, 22 bp, Homo sapiens
gtcgtggagctcacagtgtgcc

SEQ ID NO: 8178879 - DNA, 22 bp, Homo sapiens
gtcgtggagctcacagtgtgcc

SEQ ID NO: 8178880 - DNA, 22 bp, Homo sapiens
gtcgggtagtgctggaaggatt

SEQ ID NO: 8178881 - DNA, 22 bp, Homo sapiens
gtcctggcttagttcgctgtaa

SEQ ID NO: 8178882 - DNA, 22 bp, Homo sapiens
gtcctggctgtgtttggtttct

SEQ ID NO: 8178883 - DNA, 22 bp, Homo sapiens
gtcctggctgtcttatgttgaa

SEQ ID NO: 8178884 - DNA, 22 bp, Homo sapiens
gtcctgggaactggacagctaa

SEQ ID NO: 8178885 - DNA, 22 bp, Homo sapiens
gtcctgggaactggacagctaa

SEQ ID NO: 8178886 - DNA, 22 bp, Homo sapiens
gtcctgggaactggacagctaa

SEQ ID NO: 8178887 - DNA, 22 bp, Homo sapiens
gtcctgggaactggacagctaa

SEQ ID NO: 8178888 - DNA, 22 bp, Homo sapiens
gtccaggcacctcccttgtgct

SEQ ID NO: 8178889 - DNA, 19 bp, Homo sapiens
gtccaggcattgggttggt

SEQ ID NO: 8178890 - DNA, 22 bp, Homo sapiens
gtccaggctcaaaaggttgtta

SEQ ID NO: 8178891 - DNA, 22 bp, Homo sapiens
gtccaggctgacccctagagga

SEQ ID NO: 8178892 - DNA, 22 bp, Homo sapiens
gtccaggctgacccctagagga

SEQ ID NO: 8178893 - DNA, 22 bp, Homo sapiens
gtccaggcctgcctctgaggag

SEQ ID NO: 8178894 - DNA, 22 bp, Homo sapiens
gtccaggccccagggattcttg

SEQ ID NO: 8178895 - DNA, 22 bp, Homo sapiens
gtccaggcctgcctctgaggag

SEQ ID NO: 8178896 - DNA, 22 bp, Homo sapiens
gtccaggccccagggattcttg

SEQ ID NO: 8178897 - DNA, 22 bp, Homo sapiens
gtccaggccatggtggacacag

SEQ ID NO: 8178898 - DNA, 22 bp, Homo sapiens
gtccaggccatggtggacacag

SEQ ID NO: 8178899 - DNA, 22 bp, Homo sapiens
gtccaggccatggtggacacag

SEQ ID NO: 8178900 - DNA, 22 bp, Homo sapiens
gtccaggctgacccctagagga

SEQ ID NO: 8178901 - DNA, 22 bp, Homo sapiens
gtccaggctgacccctagagga

SEQ ID NO: 8178902 - DNA, 22 bp, Homo sapiens
gtccaggctgcccagggtcctg

SEQ ID NO: 8178903 - DNA, 22 bp, Homo sapiens
gtccaggctgcccagggtcctg

SEQ ID NO: 8178904 - DNA, 22 bp, Homo sapiens
gtcctctggcctttcccaggac

SEQ ID NO: 8178905 - DNA, 22 bp, Homo sapiens
gtcctctggcctttcccaggac

SEQ ID NO: 8178906 - DNA, 22 bp, Homo sapiens
gtcctctgggcagctgccccac

SEQ ID NO: 8178907 - DNA, 22 bp, Homo sapiens
gtcctctgggcagctgccccac

SEQ ID NO: 8178908 - DNA, 22 bp, Homo sapiens
gtcctctgggagccttgagcct

SEQ ID NO: 8178909 - DNA, 22 bp, Homo sapiens
gtcctctgggagccttgagcct

SEQ ID NO: 8178910 - DNA, 22 bp, Homo sapiens
gtgagccattctactcctaacc

SEQ ID NO: 8178911 - DNA, 22 bp, Homo sapiens
gtgagctgtctgagtctcttgg

SEQ ID NO: 8178912 - DNA, 22 bp, Homo sapiens
gtgagctggaatagtggagaaa

SEQ ID NO: 8178913 - DNA, 22 bp, Homo sapiens
gtgagccaataccatgctgttc

SEQ ID NO: 8178914 - DNA, 22 bp, Homo sapiens
gtgagccagttcgactgtttct

SEQ ID NO: 8178915 - DNA, 22 bp, Homo sapiens
gtgagccattctactcctaacc

SEQ ID NO: 8178916 - DNA, 22 bp, Homo sapiens
gtgagccagttcgactgtttct

SEQ ID NO: 8178917 - DNA, 22 bp, Homo sapiens
gtgagcagtggccagggtccta

SEQ ID NO: 8178918 - DNA, 22 bp, Homo sapiens
gtgagcagtggccagggtccta

SEQ ID NO: 8178919 - DNA, 22 bp, Homo sapiens
gtgaggaagtgtttgtcaaatt

SEQ ID NO: 8178920 - DNA, 22 bp, Homo sapiens
gtgagctttgtggtaatgaagt

SEQ ID NO: 8178921 - DNA, 22 bp, Homo sapiens
gtgagctgttggagtggcagag

SEQ ID NO: 8178922 - DNA, 22 bp, Homo sapiens
gtgaggagggctggtcccaggc

SEQ ID NO: 8178923 - DNA, 22 bp, Homo sapiens
gtgaggagtctgaagcacataa

SEQ ID NO: 8178924 - DNA, 22 bp, Homo sapiens
gtgaggagggctggtcccaggc

SEQ ID NO: 8178925 - DNA, 22 bp, Homo sapiens
gtgaggagctgacactggggtg

SEQ ID NO: 8178926 - DNA, 22 bp, Homo sapiens
gtgaggagctgacactggggtg

SEQ ID NO: 8178927 - DNA, 22 bp, Homo sapiens
gtgaggagctctttgactcacg

SEQ ID NO: 8178928 - DNA, 22 bp, Homo sapiens
gtgaggagctctttgactcacg

SEQ ID NO: 8178929 - DNA, 22 bp, Homo sapiens
gtgaaaaatgatttgttaactg

SEQ ID NO: 8178930 - DNA, 22 bp, Homo sapiens
gtgaaaaatgatttgttaactg

SEQ ID NO: 8178931 - DNA, 22 bp, Homo sapiens
gtgagcagtggccagggtccta

SEQ ID NO: 8178932 - DNA, 22 bp, Homo sapiens
gtgagcagggcaggactgggga

SEQ ID NO: 8178933 - DNA, 22 bp, Homo sapiens
gtgaaaaatcatcatgacttga

SEQ ID NO: 8178934 - DNA, 22 bp, Homo sapiens
gtgaaaaatcatcatgacttga

SEQ ID NO: 8178935 - DNA, 22 bp, Homo sapiens
gtgaaaaatcatcatgacttga

SEQ ID NO: 8178936 - DNA, 22 bp, Homo sapiens
gtctttatttgagattgtcatt

SEQ ID NO: 8178937 - DNA, 22 bp, Homo sapiens
gtctttcatggatattcagttt

SEQ ID NO: 8178938 - DNA, 22 bp, Homo sapiens
gtctttcactgcggtttacatg

SEQ ID NO: 8178939 - DNA, 22 bp, Homo sapiens
gtctttcactgcggtttacatg

SEQ ID NO: 8178940 - DNA, 22 bp, Homo sapiens
gtctttctatgatgaactgttg

SEQ ID NO: 8178941 - DNA, 22 bp, Homo sapiens
gtctttctatgatgaactgttg

SEQ ID NO: 8178942 - DNA, 22 bp, Homo sapiens
gtctttcatggatattcagttt

SEQ ID NO: 8178943 - DNA, 21 bp, Homo sapiens
gtctttctacctctatgtggc

SEQ ID NO: 8178944 - DNA, 21 bp, Homo sapiens
gtctttctacctctatgtggc

SEQ ID NO: 8178945 - DNA, 22 bp, Homo sapiens
gtctttctatgcatagagcaga

SEQ ID NO: 8178946 - DNA, 22 bp, Homo sapiens
gtctttctatgcatagagcaga

SEQ ID NO: 8178947 - DNA, 22 bp, Homo sapiens
gtctttctatgcatagagcaga

SEQ ID NO: 8178948 - DNA, 21 bp, Homo sapiens
gtcttttaagtgaagagaggc

SEQ ID NO: 8178949 - DNA, 21 bp, Homo sapiens
gtcttttaagtgaagagaggc

SEQ ID NO: 8178950 - DNA, 22 bp, Homo sapiens
gtctaagtgggtggcactgaca

SEQ ID NO: 8178951 - DNA, 22 bp, Homo sapiens
gtctacaaagcatataaaagag

SEQ ID NO: 8178952 - DNA, 22 bp, Homo sapiens
gtctacatgtgttcttaagaga

SEQ ID NO: 8178953 - DNA, 22 bp, Homo sapiens
gtctactttttaatcttggcag

SEQ ID NO: 8178954 - DNA, 22 bp, Homo sapiens
gtctagaattgcttggcagatg

SEQ ID NO: 8178955 - DNA, 22 bp, Homo sapiens
gtctatgtaaacgtctacatta

SEQ ID NO: 8178956 - DNA, 22 bp, Homo sapiens
gtctatgtaaacgtctacatta

SEQ ID NO: 8178957 - DNA, 22 bp, Homo sapiens
gtctatgatattttgttatagc

SEQ ID NO: 8178958 - DNA, 22 bp, Homo sapiens
gtctataagcaggggaaaactt

SEQ ID NO: 8178959 - DNA, 22 bp, Homo sapiens
gtctagagaggaaggaagtgtg

SEQ ID NO: 8178960 - DNA, 22 bp, Homo sapiens
gtctatttgggatcatgatatg

SEQ ID NO: 8178961 - DNA, 22 bp, Homo sapiens
gtctatgtaaacgtctacatta

SEQ ID NO: 8178962 - DNA, 22 bp, Homo sapiens
gtctatgtgtaatagcatgtgt

SEQ ID NO: 8178963 - DNA, 22 bp, Homo sapiens
gtctccagaggttacatcctgt

SEQ ID NO: 8178964 - DNA, 22 bp, Homo sapiens
gtctccagaggttacatcctgt

SEQ ID NO: 8178965 - DNA, 22 bp, Homo sapiens
gtctccagatatcctacacaac

SEQ ID NO: 8178966 - DNA, 22 bp, Homo sapiens
gtctccagttacagcagccagg

SEQ ID NO: 8178967 - DNA, 22 bp, Homo sapiens
gtcttgcacttacctaagaact

SEQ ID NO: 8178968 - DNA, 19 bp, Homo sapiens
gtcttggctctcaaccatc

SEQ ID NO: 8178969 - DNA, 22 bp, Homo sapiens
gtcttggcatattttcaccaag

SEQ ID NO: 8178970 - DNA, 22 bp, Homo sapiens
gtctccagggctgctggcgcct

SEQ ID NO: 8178971 - DNA, 22 bp, Homo sapiens
gtctccagtgttcaggtgactg

SEQ ID NO: 8178972 - DNA, 22 bp, Homo sapiens
gtctccagtgttcaggtgactg

SEQ ID NO: 8178973 - DNA, 20 bp, Homo sapiens
gtctttatgttttatgacct

SEQ ID NO: 8178974 - DNA, 22 bp, Homo sapiens
gtctttatggtatgaaaactga

SEQ ID NO: 8178975 - DNA, 22 bp, Homo sapiens
gtctttatatttactaaagaat

SEQ ID NO: 8178976 - DNA, 22 bp, Homo sapiens
gtctttatatttactaaagaat

SEQ ID NO: 8178977 - DNA, 22 bp, Homo sapiens
gtcttgtttgggatgtggatgg

SEQ ID NO: 8178978 - DNA, 22 bp, Homo sapiens
gtcttgttaagattttggaata

SEQ ID NO: 8178979 - DNA, 22 bp, Homo sapiens
gtcttgtcccagctctgccact

SEQ ID NO: 8178980 - DNA, 22 bp, Homo sapiens
gtcttgttggagttcttgcagc

SEQ ID NO: 8178981 - DNA, 22 bp, Homo sapiens
gtcttgtttgggatgtggatgg

SEQ ID NO: 8178982 - DNA, 22 bp, Homo sapiens
gtcttgtcagtgttggcagctt

SEQ ID NO: 8178983 - DNA, 22 bp, Homo sapiens
gtgaggatacttaagagaacac

SEQ ID NO: 8178984 - DNA, 22 bp, Homo sapiens
gtgaggagtctgaagcacataa

SEQ ID NO: 8178985 - DNA, 22 bp, Homo sapiens
gtgaggcaagggcatactaggc

SEQ ID NO: 8178986 - DNA, 22 bp, Homo sapiens
gtgaggatgcagatgagggcct

SEQ ID NO: 8178987 - DNA, 22 bp, Homo sapiens
gtgaggcaagggcatactaggc

SEQ ID NO: 8178988 - DNA, 22 bp, Homo sapiens
gtgaggcagaagttccctttta

SEQ ID NO: 8178989 - DNA, 22 bp, Homo sapiens
gtgaggcagagatgccaaaact

SEQ ID NO: 8178990 - DNA, 22 bp, Homo sapiens
gtgaggcaagggcatactaggc

SEQ ID NO: 8178991 - DNA, 22 bp, Homo sapiens
gtgaggcagaagttccctttta

SEQ ID NO: 8178992 - DNA, 22 bp, Homo sapiens
gtgcagcaaactagtgcgaggg

SEQ ID NO: 8178993 - DNA, 22 bp, Homo sapiens
gtgaggcaggcattctcctttc

SEQ ID NO: 8178994 - DNA, 22 bp, Homo sapiens
gtgaggcagggaaagaggataa

SEQ ID NO: 8178995 - DNA, 22 bp, Homo sapiens
gtgaggcaggcattctcctttc

SEQ ID NO: 8178996 - DNA, 22 bp, Homo sapiens
gtgaggcagcaggagcctctgt

SEQ ID NO: 8178997 - DNA, 22 bp, Homo sapiens
gtgaggcagagatgccaaaact

SEQ ID NO: 8178998 - DNA, 22 bp, Homo sapiens
gtgaggcagcaggagcctctgt

SEQ ID NO: 8178999 - DNA, 22 bp, Homo sapiens
gtgaggcagcaggagcctctgt

SEQ ID NO: 8179000 - DNA, 22 bp, Homo sapiens
gtgaggcagcaggagcctctgt

SEQ ID NO: 8179001 - DNA, 22 bp, Homo sapiens
gtgcaggcattgggctagccat

SEQ ID NO: 8179002 - DNA, 22 bp, Homo sapiens
gtgcaggcattgggctagccat

SEQ ID NO: 8179003 - DNA, 22 bp, Homo sapiens
gtgcaggcaaaagggccaggcc

SEQ ID NO: 8179004 - DNA, 22 bp, Homo sapiens
gtgcaggcaaaagggccaggcc

SEQ ID NO: 8179005 - DNA, 22 bp, Homo sapiens
gtgcagggagcccagaaggtcc

SEQ ID NO: 8179006 - DNA, 22 bp, Homo sapiens
gtgcagggagcccagaaggtcc

SEQ ID NO: 8179007 - DNA, 22 bp, Homo sapiens
gtgcaggagtaggagagggctt

SEQ ID NO: 8179008 - DNA, 22 bp, Homo sapiens
gtgcaggagtaggagagggctt

SEQ ID NO: 8179009 - DNA, 22 bp, Homo sapiens
gtgcaggatgttgggaatcagg

SEQ ID NO: 8179010 - DNA, 22 bp, Homo sapiens
gtgcaggaggtaacatagcaaa

SEQ ID NO: 8179011 - DNA, 22 bp, Homo sapiens
gtgcaggaggtaacatagcaaa

SEQ ID NO: 8179012 - DNA, 17 bp, Homo sapiens
gtgcagggatgaaggat

SEQ ID NO: 8179013 - DNA, 17 bp, Homo sapiens
gtgcagggatgaaggat

SEQ ID NO: 8179014 - DNA, 17 bp, Homo sapiens
gtgcagggatgaaggat

SEQ ID NO: 8179015 - DNA, 17 bp, Homo sapiens
gtgcagggatgaaggat

SEQ ID NO: 8179016 - DNA, 22 bp, Homo sapiens
gtgcagggcagccgaatgggct

SEQ ID NO: 8179017 - DNA, 22 bp, Homo sapiens
gtgcagggcagccgaatgggct

SEQ ID NO: 8179018 - DNA, 22 bp, Homo sapiens
gtgcagggcagccgaatgggct

SEQ ID NO: 8179019 - DNA, 22 bp, Homo sapiens
gtgcagggcagccgaatgggct

SEQ ID NO: 8179020 - DNA, 22 bp, Homo sapiens
gtgcaggggatcaggttgcagc

SEQ ID NO: 8179021 - DNA, 22 bp, Homo sapiens
gtgcaggggatcaggttgcagc

SEQ ID NO: 8179022 - DNA, 22 bp, Homo sapiens
gtgcagggctggcaccggaggc

SEQ ID NO: 8179023 - DNA, 22 bp, Homo sapiens
gtgcagggctggcaccggaggc

SEQ ID NO: 8179024 - DNA, 22 bp, Homo sapiens
gtgcagggctggcaccggaggc

SEQ ID NO: 8179025 - DNA, 22 bp, Homo sapiens
gtgcagggctggcaccggaggc

SEQ ID NO: 8179026 - DNA, 22 bp, Homo sapiens
gtgcagggcagccgaatgggct

SEQ ID NO: 8179027 - DNA, 22 bp, Homo sapiens
gtgcagggcaggtgtccttcca

SEQ ID NO: 8179028 - DNA, 22 bp, Homo sapiens
gtgcagggcaggtgtccttcca

SEQ ID NO: 8179029 - DNA, 22 bp, Homo sapiens
gtgcagggtagcgacggcagga

SEQ ID NO: 8179030 - DNA, 22 bp, Homo sapiens
gtgcagggtagcgacggcagga

SEQ ID NO: 8179031 - DNA, 22 bp, Homo sapiens
gtgcagggtagcgacggcagga

SEQ ID NO: 8179032 - DNA, 22 bp, Homo sapiens
gtgcagggtagcgacggcagga

SEQ ID NO: 8179033 - DNA, 22 bp, Homo sapiens
gtgcagggtagcgacggcagga

SEQ ID NO: 8179034 - DNA, 22 bp, Homo sapiens
gtgcagggtagcgacggcagga

SEQ ID NO: 8179035 - DNA, 22 bp, Homo sapiens
gtgcagggtagcgacggcagga

SEQ ID NO: 8179036 - DNA, 22 bp, Homo sapiens
gtgcaggggcctccccttgctg

SEQ ID NO: 8179037 - DNA, 22 bp, Homo sapiens
gtgcaggggcctccccttgctg

SEQ ID NO: 8179038 - DNA, 22 bp, Homo sapiens
gtgcaggggcctccccttgctg

SEQ ID NO: 8179039 - DNA, 22 bp, Homo sapiens
gtgcagggtagcgacggcagga

SEQ ID NO: 8179040 - DNA, 22 bp, Homo sapiens
gtgcaggggatcaggttgcagc

SEQ ID NO: 8179041 - DNA, 22 bp, Homo sapiens
gtgcaggggatcaggttgcagc

SEQ ID NO: 8179042 - DNA, 22 bp, Homo sapiens
gtgcaggggatcaggttgcagc

SEQ ID NO: 8179043 - DNA, 22 bp, Homo sapiens
gtgccagagatgacaggcctgc

SEQ ID NO: 8179044 - DNA, 22 bp, Homo sapiens
gtgccagagatgacaggcctgc

SEQ ID NO: 8179045 - DNA, 22 bp, Homo sapiens
gtgccagcagttatggtgattt

SEQ ID NO: 8179046 - DNA, 22 bp, Homo sapiens
gtgccagcagttatggtgattt

SEQ ID NO: 8179047 - DNA, 22 bp, Homo sapiens
gtgctgcctgccagcttctggg

SEQ ID NO: 8179048 - DNA, 22 bp, Homo sapiens
gtgctgctcaagggacaggaca

SEQ ID NO: 8179049 - DNA, 22 bp, Homo sapiens
gtgctgctgccagcaggatcct

SEQ ID NO: 8179050 - DNA, 22 bp, Homo sapiens
gtgctgctcacatctggaggta

SEQ ID NO: 8179051 - DNA, 22 bp, Homo sapiens
gtgctgcctgccagcttctggg

SEQ ID NO: 8179052 - DNA, 22 bp, Homo sapiens
gtgctgcctccatatccgtcag

SEQ ID NO: 8179053 - DNA, 22 bp, Homo sapiens
gtgctgccggcatagcagtgaa

SEQ ID NO: 8179054 - DNA, 22 bp, Homo sapiens
gtgctgccagacagtgagaggg

SEQ ID NO: 8179055 - DNA, 22 bp, Homo sapiens
gtgctgcatgacttgctcctga

SEQ ID NO: 8179056 - DNA, 20 bp, Homo sapiens
gtgctggagttaggaaaggt

SEQ ID NO: 8179057 - DNA, 22 bp, Homo sapiens
gtgctggaccctggaaggtggt

SEQ ID NO: 8179058 - DNA, 22 bp, Homo sapiens
gtgctgcttgggggcagagcag

SEQ ID NO: 8179059 - DNA, 22 bp, Homo sapiens
gtgctggccctgtcctcgagct

SEQ ID NO: 8179060 - DNA, 22 bp, Homo sapiens
gtgctggcacccctctccagtt

SEQ ID NO: 8179061 - DNA, 22 bp, Homo sapiens
gtgctggccctgtcctcgagct

SEQ ID NO: 8179062 - DNA, 22 bp, Homo sapiens
gtgctggccctgtcctcgagct

SEQ ID NO: 8179063 - DNA, 22 bp, Homo sapiens
gtgctggccctgtcctcgagct

SEQ ID NO: 8179064 - DNA, 20 bp, Homo sapiens
gtgctgagtgtctaactcct

SEQ ID NO: 8179065 - DNA, 22 bp, Homo sapiens
gtgctgagtgcagagtgcagag

SEQ ID NO: 8179066 - DNA, 22 bp, Homo sapiens
gtgctgcagagtctcgtgccgc

SEQ ID NO: 8179067 - DNA, 22 bp, Homo sapiens
gtgctgcagggcctcctgcacc

SEQ ID NO: 8179068 - DNA, 23 bp, Homo sapiens
gtgctgcaaaatcggccactgca

SEQ ID NO: 8179069 - DNA, 22 bp, Homo sapiens
gtgcccaggcccaaggcaccac

SEQ ID NO: 8179070 - DNA, 22 bp, Homo sapiens
gtgcccaggcccaaggcaccac

SEQ ID NO: 8179071 - DNA, 22 bp, Homo sapiens
gtgcccaggcccaaggcaccac

SEQ ID NO: 8179072 - DNA, 22 bp, Homo sapiens
gtgctgaatccactcttaggaa

SEQ ID NO: 8179073 - DNA, 18 bp, Homo sapiens
gtgctgaataactacttt

SEQ ID NO: 8179074 - DNA, 22 bp, Homo sapiens
gtgctgaataacagtagaaatt

SEQ ID NO: 8179075 - DNA, 22 bp, Homo sapiens
gtgctgacaggagcctggcggt

SEQ ID NO: 8179076 - DNA, 22 bp, Homo sapiens
gtgctgaattgtgctctttaca

SEQ ID NO: 8179077 - DNA, 22 bp, Homo sapiens
gtgctgaatttgagaaactctg

SEQ ID NO: 8179078 - DNA, 22 bp, Homo sapiens
gtgctgaattggagatgctcct

SEQ ID NO: 8179079 - DNA, 22 bp, Homo sapiens
gtgctgaattggagatgctcct

SEQ ID NO: 8179080 - DNA, 22 bp, Homo sapiens
gtgccaggcccagggagcgggg

SEQ ID NO: 8179081 - DNA, 22 bp, Homo sapiens
gtgccaggcccagggagcgggg

SEQ ID NO: 8179082 - DNA, 22 bp, Homo sapiens
gtgccaggcccagggagcgggg

SEQ ID NO: 8179083 - DNA, 20 bp, Homo sapiens
gtgccaggcaagacaggtgg

SEQ ID NO: 8179084 - DNA, 22 bp, Homo sapiens
gtgccagggagtggaggagctt

SEQ ID NO: 8179085 - DNA, 22 bp, Homo sapiens
gtgccagggagtggaggagctt

SEQ ID NO: 8179086 - DNA, 22 bp, Homo sapiens
gtgccaggcccagggagcgggg

SEQ ID NO: 8179087 - DNA, 22 bp, Homo sapiens
gtgccagggagtggaggagctt

SEQ ID NO: 8179088 - DNA, 22 bp, Homo sapiens
gtgccagggagtggaggagctt

SEQ ID NO: 8179089 - DNA, 22 bp, Homo sapiens
gtgccagggagtggaggagctt

SEQ ID NO: 8179090 - DNA, 22 bp, Homo sapiens
gtgccagggagtggaggagctt

SEQ ID NO: 8179091 - DNA, 22 bp, Homo sapiens
gtgccagggagtggaggagctt

SEQ ID NO: 8179092 - DNA, 18 bp, Homo sapiens
gtgccaggaggcgcagcc

SEQ ID NO: 8179093 - DNA, 18 bp, Homo sapiens
gtgccaggaggcgcagcc

SEQ ID NO: 8179094 - DNA, 18 bp, Homo sapiens
gtgccaggaggcgcagcc

SEQ ID NO: 8179095 - DNA, 20 bp, Homo sapiens
gtgccaggcaagacaggtgg

SEQ ID NO: 8179096 - DNA, 18 bp, Homo sapiens
gtgccaggaggcgcagcc

SEQ ID NO: 8179097 - DNA, 18 bp, Homo sapiens
gtgccaggaggcgcagcc

SEQ ID NO: 8179098 - DNA, 18 bp, Homo sapiens
gtgccaggaggcgcagcc

SEQ ID NO: 8179099 - DNA, 22 bp, Homo sapiens
gtgccagcctggtgcgcctggg

SEQ ID NO: 8179100 - DNA, 22 bp, Homo sapiens
gtgccagccgcaccccaggaga

SEQ ID NO: 8179101 - DNA, 22 bp, Homo sapiens
gtgccagcctggtgcgcctggg

SEQ ID NO: 8179102 - DNA, 22 bp, Homo sapiens
gtgccagggggcactgaacaga

SEQ ID NO: 8179103 - DNA, 22 bp, Homo sapiens
gtgccagggagtggaggagctt

SEQ ID NO: 8179104 - DNA, 22 bp, Homo sapiens
gtgccagggggcactgaacaga

SEQ ID NO: 8179105 - DNA, 22 bp, Homo sapiens
gtgccaggtgctaagctgtgct

SEQ ID NO: 8179106 - DNA, 22 bp, Homo sapiens
gtgccaggtgctaagctgtgct

SEQ ID NO: 8179107 - DNA, 22 bp, Homo sapiens
gtgccagtctctgagttaggac

SEQ ID NO: 8179108 - DNA, 22 bp, Homo sapiens
gtgcccagctccacctcacaga

SEQ ID NO: 8179109 - DNA, 22 bp, Homo sapiens
gtgcccagcagcagcgtccccg

SEQ ID NO: 8179110 - DNA, 22 bp, Homo sapiens
ggttaggatcagatcctggagg

SEQ ID NO: 8179111 - DNA, 23 bp, Homo sapiens
ggttagggaatgatctcaggcat

SEQ ID NO: 8179112 - DNA, 23 bp, Homo sapiens
ggtggtgctcatatctcaggcct

SEQ ID NO: 8179113 - DNA, 22 bp, Homo sapiens
ggtggtgactgtcctagggatg

SEQ ID NO: 8179114 - DNA, 22 bp, Homo sapiens
ggtggtctgcgcagcccagggt

SEQ ID NO: 8179115 - DNA, 22 bp, Homo sapiens
ggtggtctgtttattgaaggtt

SEQ ID NO: 8179116 - DNA, 22 bp, Homo sapiens
ggtggtgaagacaagtggaagt

SEQ ID NO: 8179117 - DNA, 22 bp, Homo sapiens
ggtggtggagccagctgggagt

SEQ ID NO: 8179118 - DNA, 22 bp, Homo sapiens
ggtggtggagccagctgggagt

SEQ ID NO: 8179119 - DNA, 22 bp, Homo sapiens
ggtggtggagccagctgggagt

SEQ ID NO: 8179120 - DNA, 22 bp, Homo sapiens
ggtggtggagccagctgggagt

SEQ ID NO: 8179121 - DNA, 22 bp, Homo sapiens
ggtggtgggagagctttctgga

SEQ ID NO: 8179122 - DNA, 17 bp, Homo sapiens
ggtgtttaagtgccagc

SEQ ID NO: 8179123 - DNA, 23 bp, Homo sapiens
ggtgtttaattacagactgagag

SEQ ID NO: 8179124 - DNA, 22 bp, Homo sapiens
ggtgtttagacagggcccctct

SEQ ID NO: 8179125 - DNA, 22 bp, Homo sapiens
ggtgtttagggaggggttataa

SEQ ID NO: 8179126 - DNA, 22 bp, Homo sapiens
ggttgtagttggaggttgtata

SEQ ID NO: 8179127 - DNA, 17 bp, Homo sapiens
ggtttaatccttacctg

SEQ ID NO: 8179128 - DNA, 22 bp, Homo sapiens
ggtttaaaagccatgcatgggg

SEQ ID NO: 8179129 - DNA, 22 bp, Homo sapiens
ggttgttgtgaaggtgaagaga

SEQ ID NO: 8179130 - DNA, 22 bp, Homo sapiens
ggttgtagttggaggttgtata

SEQ ID NO: 8179131 - DNA, 21 bp, Homo sapiens
ggttggtgtgtccagtggcca

SEQ ID NO: 8179132 - DNA, 21 bp, Homo sapiens
ggttggtgtgtccagtggcca

SEQ ID NO: 8179133 - DNA, 22 bp, Homo sapiens
gtaatgtgtgtgtcttctctag

SEQ ID NO: 8179134 - DNA, 22 bp, Homo sapiens
ggtttaatggagatatttcaga

SEQ ID NO: 8179135 - DNA, 22 bp, Homo sapiens
ggtttaatgggtgaaggcatga

SEQ ID NO: 8179136 - DNA, 22 bp, Homo sapiens
gtaattctgtgtgaatctatta

SEQ ID NO: 8179137 - DNA, 22 bp, Homo sapiens
gtaattgaacattaagttgaag

SEQ ID NO: 8179138 - DNA, 22 bp, Homo sapiens
gtacaaaagttattgcggtttt

SEQ ID NO: 8179139 - DNA, 22 bp, Homo sapiens
gtacaaaagttattgcggtttt

SEQ ID NO: 8179140 - DNA, 22 bp, Homo sapiens
ggttcagggatgtgggtgatgc

SEQ ID NO: 8179141 - DNA, 22 bp, Homo sapiens
ggttcagggctaccagtgggtg

SEQ ID NO: 8179142 - DNA, 22 bp, Homo sapiens
ggttcagagcctgcccagtata

SEQ ID NO: 8179143 - DNA, 22 bp, Homo sapiens
ggttcattctgaagtcttcagc

SEQ ID NO: 8179144 - DNA, 22 bp, Homo sapiens
ggttggaggtgggaatagctag

SEQ ID NO: 8179145 - DNA, 22 bp, Homo sapiens
ggttggctactggagacctatg

SEQ ID NO: 8179146 - DNA, 22 bp, Homo sapiens
ggttccacctggcgaggggtat

SEQ ID NO: 8179147 - DNA, 22 bp, Homo sapiens
ggttggggcgagctggaggccc

SEQ ID NO: 8179148 - DNA, 22 bp, Homo sapiens
ggttggggcgagctggaggccc

SEQ ID NO: 8179149 - DNA, 22 bp, Homo sapiens
ggttggggcgagctggaggccc

SEQ ID NO: 8179150 - DNA, 22 bp, Homo sapiens
ggttggggcgagctggaggccc

SEQ ID NO: 8179151 - DNA, 22 bp, Homo sapiens
ggttggtaactccctgtgcagt

SEQ ID NO: 8179152 - DNA, 21 bp, Homo sapiens
ggttggtgtgtccagtggcca

SEQ ID NO: 8179153 - DNA, 22 bp, Homo sapiens
ggtggggagtcaggcattcttg

SEQ ID NO: 8179154 - DNA, 22 bp, Homo sapiens
ggtggggagtcaggcattcttg

SEQ ID NO: 8179155 - DNA, 22 bp, Homo sapiens
ggtgggcaggtcactctgcctc

SEQ ID NO: 8179156 - DNA, 22 bp, Homo sapiens
ggtgggccaggaaggccgccag

SEQ ID NO: 8179157 - DNA, 22 bp, Homo sapiens
ggtggggcccaggcatctgatg

SEQ ID NO: 8179158 - DNA, 22 bp, Homo sapiens
ggtggggccagggctccaacct

SEQ ID NO: 8179159 - DNA, 22 bp, Homo sapiens
ggtggggattcctgatcactgt

SEQ ID NO: 8179160 - DNA, 22 bp, Homo sapiens
ggtggggccctggcactggtat

SEQ ID NO: 8179161 - DNA, 22 bp, Homo sapiens
ggtgggtgcagggggcttctta

SEQ ID NO: 8179162 - DNA, 22 bp, Homo sapiens
ggtgggtgagccctgggagctg

SEQ ID NO: 8179163 - DNA, 22 bp, Homo sapiens
ggtgggtgagccctgggagctg

SEQ ID NO: 8179164 - DNA, 22 bp, Homo sapiens
ggtgggtgagccctgggagctg

SEQ ID NO: 8179165 - DNA, 22 bp, Homo sapiens
ggtgggtgagccctgggagctg

SEQ ID NO: 8179166 - DNA, 22 bp, Homo sapiens
ggtgggtgagccctgggagctg

SEQ ID NO: 8179167 - DNA, 22 bp, Homo sapiens
ggtggggcctgctccagcggcc

SEQ ID NO: 8179168 - DNA, 22 bp, Homo sapiens
ggtggggcctgctccagcggcc

SEQ ID NO: 8179169 - DNA, 22 bp, Homo sapiens
ggtggggctaggacctcaggat

SEQ ID NO: 8179170 - DNA, 22 bp, Homo sapiens
ggtggggcctgctccagcggcc

SEQ ID NO: 8179171 - DNA, 22 bp, Homo sapiens
ggtggagctggaccaggagagg

SEQ ID NO: 8179172 - DNA, 22 bp, Homo sapiens
ggtggagctggaccaggagagg

SEQ ID NO: 8179173 - DNA, 22 bp, Homo sapiens
ggtggactcaaaatgtgcttga

SEQ ID NO: 8179174 - DNA, 22 bp, Homo sapiens
ggtggactgtgttggagttgac

SEQ ID NO: 8179175 - DNA, 22 bp, Homo sapiens
ggtggcacactggggagctcgg

SEQ ID NO: 8179176 - DNA, 22 bp, Homo sapiens
ggtggcaagggcagccagtaac

SEQ ID NO: 8179177 - DNA, 22 bp, Homo sapiens
ggtggcacactggggagctcgg

SEQ ID NO: 8179178 - DNA, 22 bp, Homo sapiens
ggtggcaccttaccctgcgcag

SEQ ID NO: 8179179 - DNA, 22 bp, Homo sapiens
ggtggagtaattcgcagaggtt

SEQ ID NO: 8179180 - DNA, 22 bp, Homo sapiens
ggtggatagctcagctccacgt

SEQ ID NO: 8179181 - DNA, 22 bp, Homo sapiens
ggtggcagaataattgaaggtc

SEQ ID NO: 8179182 - DNA, 22 bp, Homo sapiens
ggtggcagaataattgaaggtc

SEQ ID NO: 8179183 - DNA, 22 bp, Homo sapiens
ggtggcagagacataggacata

SEQ ID NO: 8179184 - DNA, 22 bp, Homo sapiens
ggtggcaccttaccctgcgcag

SEQ ID NO: 8179185 - DNA, 22 bp, Homo sapiens
ggtggcaccttgatcttggact

SEQ ID NO: 8179186 - DNA, 19 bp, Homo sapiens
ggtggcagaacgtgggtcc

SEQ ID NO: 8179187 - DNA, 22 bp, Homo sapiens
ggtggcactcattatcaggtgc

SEQ ID NO: 8179188 - DNA, 19 bp, Homo sapiens
ggtggcagaacgtgggtcc

SEQ ID NO: 8179189 - DNA, 19 bp, Homo sapiens
ggtggcagaacgtgggtcc

SEQ ID NO: 8179190 - DNA, 19 bp, Homo sapiens
ggtggcagaacgtgggtcc

SEQ ID NO: 8179191 - DNA, 22 bp, Homo sapiens
ggtgggcaggcgaggcccaggt

SEQ ID NO: 8179192 - DNA, 22 bp, Homo sapiens
ggtgggcaggcgaggcccaggt

SEQ ID NO: 8179193 - DNA, 22 bp, Homo sapiens
ggtggcagagaggaggtagttt

SEQ ID NO: 8179194 - DNA, 22 bp, Homo sapiens
ggtggcagagacataggacata

SEQ ID NO: 8179195 - DNA, 22 bp, Homo sapiens
ggtggcagagaggaggtagttt

SEQ ID NO: 8179196 - DNA, 22 bp, Homo sapiens
ggtgaggcccagtgatctgtgt

SEQ ID NO: 8179197 - DNA, 22 bp, Homo sapiens
ggtgaggcctgtacaaagctgc

SEQ ID NO: 8179198 - DNA, 22 bp, Homo sapiens
ggtgaggctaagtgacacaggg

SEQ ID NO: 8179199 - DNA, 22 bp, Homo sapiens
ggtgagggacatcactcagcca

SEQ ID NO: 8179200 - DNA, 22 bp, Homo sapiens
ggtgaggcgtccccaccatggg

SEQ ID NO: 8179201 - DNA, 22 bp, Homo sapiens
ggtgaggctaagtgacacaggg

SEQ ID NO: 8179202 - DNA, 18 bp, Homo sapiens
ggtgagggagctggaagc

SEQ ID NO: 8179203 - DNA, 18 bp, Homo sapiens
ggtgagggagctggaagc

SEQ ID NO: 8179204 - DNA, 18 bp, Homo sapiens
ggtgagggagctggaagc

SEQ ID NO: 8179205 - DNA, 22 bp, Homo sapiens
ggtgagggacatcactcagcca

SEQ ID NO: 8179206 - DNA, 18 bp, Homo sapiens
ggtgagggagctggaagc

SEQ ID NO: 8179207 - DNA, 18 bp, Homo sapiens
ggtgagggagctggaagc

SEQ ID NO: 8179208 - DNA, 18 bp, Homo sapiens
ggtgagggagctggaagc

SEQ ID NO: 8179209 - DNA, 18 bp, Homo sapiens
ggtgagggagctggaagc

SEQ ID NO: 8179210 - DNA, 22 bp, Homo sapiens
ggtgctctggtcatggtggagt

SEQ ID NO: 8179211 - DNA, 21 bp, Homo sapiens
ggtgctcgctgatgaggagtg

SEQ ID NO: 8179212 - DNA, 22 bp, Homo sapiens
ggtgctgtggcagctcctcctc

SEQ ID NO: 8179213 - DNA, 22 bp, Homo sapiens
ggtgctctttctcagacaagat

SEQ ID NO: 8179214 - DNA, 22 bp, Homo sapiens
ggtgctgaaggactataacggt

SEQ ID NO: 8179215 - DNA, 21 bp, Homo sapiens
ggtgctcctccatgctgctct

SEQ ID NO: 8179216 - DNA, 22 bp, Homo sapiens
ggtgctcaaggtgacaggacat

SEQ ID NO: 8179217 - DNA, 22 bp, Homo sapiens
ggtgagggagtggaacgaggtg

SEQ ID NO: 8179218 - DNA, 22 bp, Homo sapiens
ggtggacaaatgaatgactgaa

SEQ ID NO: 8179219 - DNA, 22 bp, Homo sapiens
ggtggacaaatgaatgactgaa

SEQ ID NO: 8179220 - DNA, 22 bp, Homo sapiens
ggtggacaaatgaatgactgaa

SEQ ID NO: 8179221 - DNA, 17 bp, Homo sapiens
ggtggaagtttctagtt

SEQ ID NO: 8179222 - DNA, 22 bp, Homo sapiens
ggtggacagtgttagctctggg

SEQ ID NO: 8179223 - DNA, 22 bp, Homo sapiens
ggtggacagtgttagctctggg

SEQ ID NO: 8179224 - DNA, 22 bp, Homo sapiens
ggtggacagtgttagctctggg

SEQ ID NO: 8179225 - DNA, 22 bp, Homo sapiens
ggtggaaggcctggaaggaggc

SEQ ID NO: 8179226 - DNA, 22 bp, Homo sapiens
ggtggaaggcagcagtctcagg

SEQ ID NO: 8179227 - DNA, 22 bp, Homo sapiens
ggtggaaggcctggaaggaggc

SEQ ID NO: 8179228 - DNA, 22 bp, Homo sapiens
ggtggaaggcctggaaggaggc

SEQ ID NO: 8179229 - DNA, 22 bp, Homo sapiens
ggtggaaggcctggaaggaggc

SEQ ID NO: 8179230 - DNA, 22 bp, Homo sapiens
ggtgacagcgggtcaagaggag

SEQ ID NO: 8179231 - DNA, 22 bp, Homo sapiens
ggtgacagcgggtcaagaggag

SEQ ID NO: 8179232 - DNA, 22 bp, Homo sapiens
ggtgacagcgggtcaagaggag

SEQ ID NO: 8179233 - DNA, 22 bp, Homo sapiens
ggtgacagccgcttggcgctag

SEQ ID NO: 8179234 - DNA, 22 bp, Homo sapiens
ggtgagcaaagcttcatctgta

SEQ ID NO: 8179235 - DNA, 22 bp, Homo sapiens
ggtccctgctgaagccttggtg

SEQ ID NO: 8179236 - DNA, 22 bp, Homo sapiens
ggtccctggaaggccaagcttg

SEQ ID NO: 8179237 - DNA, 22 bp, Homo sapiens
ggtccctggaaggccaagcttg

SEQ ID NO: 8179238 - DNA, 22 bp, Homo sapiens
ggtccctggaaggcactagtga

SEQ ID NO: 8179239 - DNA, 22 bp, Homo sapiens
ggtccctgcctgaggctggcct

SEQ ID NO: 8179240 - DNA, 22 bp, Homo sapiens
ggtccctgctgaagccttggtg

SEQ ID NO: 8179241 - DNA, 22 bp, Homo sapiens
ggtccctgctgaagccttggtg

SEQ ID NO: 8179242 - DNA, 22 bp, Homo sapiens
ggtgacagccgcttgccctgta

SEQ ID NO: 8179243 - DNA, 22 bp, Homo sapiens
ggtgacagccgcttgccctgta

SEQ ID NO: 8179244 - DNA, 21 bp, Homo sapiens
ggtgacacgtggccccgctct

SEQ ID NO: 8179245 - DNA, 22 bp, Homo sapiens
ggtccctggaaggccaagcttg

SEQ ID NO: 8179246 - DNA, 22 bp, Homo sapiens
ggtgaggaaagatggtgacagt

SEQ ID NO: 8179247 - DNA, 22 bp, Homo sapiens
ggtgagcttgctgctagaggct

SEQ ID NO: 8179248 - DNA, 22 bp, Homo sapiens
ggtgaggaaagatggtgacagt

SEQ ID NO: 8179249 - DNA, 22 bp, Homo sapiens
ggtgaggaaagatggtgacagt

SEQ ID NO: 8179250 - DNA, 22 bp, Homo sapiens
ggtgaggaaagatggtgacagt

SEQ ID NO: 8179251 - DNA, 22 bp, Homo sapiens
ggtgagctggtctggggctgct

SEQ ID NO: 8179252 - DNA, 22 bp, Homo sapiens
ggtgagcctggagtcttgctgg

SEQ ID NO: 8179253 - DNA, 22 bp, Homo sapiens
ggtgagccgaaaagggtcataa

SEQ ID NO: 8179254 - DNA, 19 bp, Homo sapiens
ggtgagccctcgcctgcct

SEQ ID NO: 8179255 - DNA, 22 bp, Homo sapiens
ggtgaggaattggggactgacc

SEQ ID NO: 8179256 - DNA, 22 bp, Homo sapiens
ggtgaggaaagatggtgacagt

SEQ ID NO: 8179257 - DNA, 22 bp, Homo sapiens
ggtgaggaaagatggtgacagt

SEQ ID NO: 8179258 - DNA, 22 bp, Homo sapiens
ggtgaggaattggggactgacc

SEQ ID NO: 8179259 - DNA, 22 bp, Homo sapiens
ggtgaggaattggggactgacc

SEQ ID NO: 8179260 - DNA, 22 bp, Homo sapiens
ggtgaggcaggtggctgctgag

SEQ ID NO: 8179261 - DNA, 22 bp, Homo sapiens
ggtgaggaattggggactgacc

SEQ ID NO: 8179262 - DNA, 22 bp, Homo sapiens
ggtccctgaagatgcctgagga

SEQ ID NO: 8179263 - DNA, 23 bp, Homo sapiens
ggtccctgacagcgggcaagttg

SEQ ID NO: 8179264 - DNA, 22 bp, Homo sapiens
ggtccctgcccaaagcccttgg

SEQ ID NO: 8179265 - DNA, 22 bp, Homo sapiens
ggtccctgcccaaagcccttgg

SEQ ID NO: 8179266 - DNA, 20 bp, Homo sapiens
ggtccctgccctctgtcatc

SEQ ID NO: 8179267 - DNA, 22 bp, Homo sapiens
ggtccctgccctacattttctt

SEQ ID NO: 8179268 - DNA, 22 bp, Homo sapiens
ggtccctgccctaaaactcgtc

SEQ ID NO: 8179269 - DNA, 22 bp, Homo sapiens
ggtccctgcccacctgggagct

SEQ ID NO: 8179270 - DNA, 20 bp, Homo sapiens
ggtccctgccctctgtcatc

SEQ ID NO: 8179271 - DNA, 22 bp, Homo sapiens
ggtccctgcctgaggctggcct

SEQ ID NO: 8179272 - DNA, 22 bp, Homo sapiens
ggtccctgaagatgcctgagga

SEQ ID NO: 8179273 - DNA, 22 bp, Homo sapiens
ggtccctgaagatgcctgagga

SEQ ID NO: 8179274 - DNA, 22 bp, Homo sapiens
ggtccctgaagaggcctggggt

SEQ ID NO: 8179275 - DNA, 22 bp, Homo sapiens
ggtccccgtggaggctggagcg

SEQ ID NO: 8179276 - DNA, 22 bp, Homo sapiens
ggtccccgtggaggctggagcg

SEQ ID NO: 8179277 - DNA, 22 bp, Homo sapiens
ggtcccaggttgacagggagac

SEQ ID NO: 8179278 - DNA, 23 bp, Homo sapiens
ggtcccagtggagaggcctcacc

SEQ ID NO: 8179279 - DNA, 22 bp, Homo sapiens
ggtcccagtcctctccctgcta

SEQ ID NO: 8179280 - DNA, 22 bp, Homo sapiens
ggtcccaggctgcgggctggtg

SEQ ID NO: 8179281 - DNA, 22 bp, Homo sapiens
ggtcccaggttgacagggagac

SEQ ID NO: 8179282 - DNA, 23 bp, Homo sapiens
ggtcccagtggagaggcctcacc

SEQ ID NO: 8179283 - DNA, 22 bp, Homo sapiens
ggtcccagttgcccaggtcagg

SEQ ID NO: 8179284 - DNA, 22 bp, Homo sapiens
ggtcccagttgcccaggtcagg

SEQ ID NO: 8179285 - DNA, 23 bp, Homo sapiens
ggtcccagtggagaggcctcacc

SEQ ID NO: 8179286 - DNA, 22 bp, Homo sapiens
gggtgtccacaaaatggctttg

SEQ ID NO: 8179287 - DNA, 22 bp, Homo sapiens
gggtgtagaaagaaccctctgg

SEQ ID NO: 8179288 - DNA, 22 bp, Homo sapiens
gggttgaggcggatgtcggcgg

SEQ ID NO: 8179289 - DNA, 22 bp, Homo sapiens
gggtgtccttctgtggactctg

SEQ ID NO: 8179290 - DNA, 22 bp, Homo sapiens
gggtgtcctgtgccaagctggg

SEQ ID NO: 8179291 - DNA, 22 bp, Homo sapiens
gggtgtccagggcgtgtctgga

SEQ ID NO: 8179292 - DNA, 22 bp, Homo sapiens
gggtgtcctgtgccaagctggg

SEQ ID NO: 8179293 - DNA, 22 bp, Homo sapiens
gggttggcagcaccagaggagg

SEQ ID NO: 8179294 - DNA, 22 bp, Homo sapiens
gggttggcatcagggttctgtg

SEQ ID NO: 8179295 - DNA, 22 bp, Homo sapiens
gggttgggactgtcatctggag

SEQ ID NO: 8179296 - DNA, 22 bp, Homo sapiens
gggttggattacttagggagaa

SEQ ID NO: 8179297 - DNA, 22 bp, Homo sapiens
gggttggattacttagggagaa

SEQ ID NO: 8179298 - DNA, 22 bp, Homo sapiens
gggttggatcctggtggctgcc

SEQ ID NO: 8179299 - DNA, 22 bp, Homo sapiens
gggttggatcctggtggctgcc

SEQ ID NO: 8179300 - DNA, 22 bp, Homo sapiens
gggttggatcctggtggctgcc

SEQ ID NO: 8179301 - DNA, 22 bp, Homo sapiens
ggtaaaaatcacaaatacttta

SEQ ID NO: 8179302 - DNA, 22 bp, Homo sapiens
ggtcccagctgctcaagaggct

SEQ ID NO: 8179303 - DNA, 19 bp, Homo sapiens
gggttgtgtggaaggtatc

SEQ ID NO: 8179304 - DNA, 22 bp, Homo sapiens
gggttgtgggatagagaaggag

SEQ ID NO: 8179305 - DNA, 22 bp, Homo sapiens
gggttgtgggatagagaaggag

SEQ ID NO: 8179306 - DNA, 19 bp, Homo sapiens
gggttgtgtggaaggtatc

SEQ ID NO: 8179307 - DNA, 22 bp, Homo sapiens
gggttttatggttcacttgcaa

SEQ ID NO: 8179308 - DNA, 22 bp, Homo sapiens
gggttgtcaatcaaaagaaaac

SEQ ID NO: 8179309 - DNA, 22 bp, Homo sapiens
gggttggggcccagcagtctgc

SEQ ID NO: 8179310 - DNA, 22 bp, Homo sapiens
ggtcccagctggtcactgtcag

SEQ ID NO: 8179311 - DNA, 22 bp, Homo sapiens
ggtcccagctggtcactgtcag

SEQ ID NO: 8179312 - DNA, 22 bp, Homo sapiens
ggtcccagctgctcaagaggct

SEQ ID NO: 8179313 - DNA, 22 bp, Homo sapiens
ggtcccaggaatctgtgttcta

SEQ ID NO: 8179314 - DNA, 22 bp, Homo sapiens
ggtcccaggaagtgcggcggcg

SEQ ID NO: 8179315 - DNA, 22 bp, Homo sapiens
ggtcccaggagaataggtgcaa

SEQ ID NO: 8179316 - DNA, 22 bp, Homo sapiens
ggtcccaggagaataggtgcaa

SEQ ID NO: 8179317 - DNA, 22 bp, Homo sapiens
ggtcccaggctccctcttgtcc

SEQ ID NO: 8179318 - DNA, 22 bp, Homo sapiens
ggtcccaggattggttgcgcag

SEQ ID NO: 8179319 - DNA, 22 bp, Homo sapiens
gggcttcagttctgaccatctt

SEQ ID NO: 8179320 - DNA, 22 bp, Homo sapiens
gggcttcagttctgaccatctt

SEQ ID NO: 8179321 - DNA, 23 bp, Homo sapiens
gggcttcattttaattcagctgc

SEQ ID NO: 8179322 - DNA, 22 bp, Homo sapiens
gggcttctaagtgaaagtgtaa

SEQ ID NO: 8179323 - DNA, 22 bp, Homo sapiens
gggcttctattcaagtctgttt

SEQ ID NO: 8179324 - DNA, 22 bp, Homo sapiens
gggcttctagaccagcagtgag

SEQ ID NO: 8179325 - DNA, 22 bp, Homo sapiens
gggcttctagaatttctgatat

SEQ ID NO: 8179326 - DNA, 22 bp, Homo sapiens
gggcttctagaatttctgatat

SEQ ID NO: 8179327 - DNA, 22 bp, Homo sapiens
gggcttctacttgcaaaggata

SEQ ID NO: 8179328 - DNA, 22 bp, Homo sapiens
gggcttcagggtacttcctcct

SEQ ID NO: 8179329 - DNA, 22 bp, Homo sapiens
gggcttcaaaattggcactctt

SEQ ID NO: 8179330 - DNA, 22 bp, Homo sapiens
gggcttcaatagcagaggcgtg

SEQ ID NO: 8179331 - DNA, 22 bp, Homo sapiens
gggcttctctttagtgagctga

SEQ ID NO: 8179332 - DNA, 22 bp, Homo sapiens
gggcttctctttagtgagctga

SEQ ID NO: 8179333 - DNA, 22 bp, Homo sapiens
gggcttctctttagtgagctga

SEQ ID NO: 8179334 - DNA, 22 bp, Homo sapiens
gggcttctgctcttttggtgct

SEQ ID NO: 8179335 - DNA, 22 bp, Homo sapiens
gggcttctgggcaccactccct

SEQ ID NO: 8179336 - DNA, 22 bp, Homo sapiens
gggcttctggctactgtatgag

SEQ ID NO: 8179337 - DNA, 22 bp, Homo sapiens
gggcttctgggcaccactccct

SEQ ID NO: 8179338 - DNA, 22 bp, Homo sapiens
gggcttctggtcattcctcatc

SEQ ID NO: 8179339 - DNA, 22 bp, Homo sapiens
gggcttctggtcattcctcatc

SEQ ID NO: 8179340 - DNA, 22 bp, Homo sapiens
gggcttctgggcaccactccct

SEQ ID NO: 8179341 - DNA, 22 bp, Homo sapiens
gggcttctccctaaggactctg

SEQ ID NO: 8179342 - DNA, 22 bp, Homo sapiens
gggcttctctcaggggcatgag

SEQ ID NO: 8179343 - DNA, 22 bp, Homo sapiens
gggcttctctcagaaactatca

SEQ ID NO: 8179344 - DNA, 22 bp, Homo sapiens
gggcttctccctaaggactctg

SEQ ID NO: 8179345 - DNA, 22 bp, Homo sapiens
gggcttctattctggcacaaga

SEQ ID NO: 8179346 - DNA, 22 bp, Homo sapiens
gggcttctctgggagtcctggt

SEQ ID NO: 8179347 - DNA, 22 bp, Homo sapiens
gggcttctctgggagtcctggt

SEQ ID NO: 8179348 - DNA, 22 bp, Homo sapiens
gggcttctctgggagtcctggt

SEQ ID NO: 8179349 - DNA, 22 bp, Homo sapiens
gggcttctctcaggggcatgag

SEQ ID NO: 8179350 - DNA, 22 bp, Homo sapiens
gggcttctctcaggggcatgag

SEQ ID NO: 8179351 - DNA, 22 bp, Homo sapiens
gggcttctctgatcaatatttc

SEQ ID NO: 8179352 - DNA, 22 bp, Homo sapiens
gggcttctctcaggggcatgag

SEQ ID NO: 8179353 - DNA, 22 bp, Homo sapiens
gggctctggggtgccctggcat

SEQ ID NO: 8179354 - DNA, 22 bp, Homo sapiens
gggctctggggtgccctggcat

SEQ ID NO: 8179355 - DNA, 22 bp, Homo sapiens
gggctctggggtgccctggcat

SEQ ID NO: 8179356 - DNA, 22 bp, Homo sapiens
gggctctggggtgccctggcat

SEQ ID NO: 8179357 - DNA, 22 bp, Homo sapiens
gggctctggggtgccctggcat

SEQ ID NO: 8179358 - DNA, 22 bp, Homo sapiens
gggctctggggtgccctggcat

SEQ ID NO: 8179359 - DNA, 22 bp, Homo sapiens
gggctctggggtgccctggcat

SEQ ID NO: 8179360 - DNA, 22 bp, Homo sapiens
gggctctggggtcagacagcct

SEQ ID NO: 8179361 - DNA, 22 bp, Homo sapiens
gggctctggggtcagacagcct

SEQ ID NO: 8179362 - DNA, 22 bp, Homo sapiens
gggctggtctggcttagtcagg

SEQ ID NO: 8179363 - DNA, 22 bp, Homo sapiens
gggctggtgaggctgccctgca

SEQ ID NO: 8179364 - DNA, 22 bp, Homo sapiens
gggctggtgaggctgccctgca

SEQ ID NO: 8179365 - DNA, 22 bp, Homo sapiens
gggctgtgtgcccacttcccat

SEQ ID NO: 8179366 - DNA, 22 bp, Homo sapiens
gggctgtgtgcccacttcccat

SEQ ID NO: 8179367 - DNA, 18 bp, Homo sapiens
gggctgtgttcatgccca

SEQ ID NO: 8179368 - DNA, 22 bp, Homo sapiens
gggctctgggatgctcttagag

SEQ ID NO: 8179369 - DNA, 19 bp, Homo sapiens
gggctctggcctcagtggg

SEQ ID NO: 8179370 - DNA, 19 bp, Homo sapiens
gggctctggcctcagtggg

SEQ ID NO: 8179371 - DNA, 19 bp, Homo sapiens
gggctctggcctcagtggg

SEQ ID NO: 8179372 - DNA, 19 bp, Homo sapiens
gggctctggcctcagtggg

SEQ ID NO: 8179373 - DNA, 20 bp, Homo sapiens
gggctctggccaatgctttg

SEQ ID NO: 8179374 - DNA, 20 bp, Homo sapiens
gggctctggccaatgctttg

SEQ ID NO: 8179375 - DNA, 19 bp, Homo sapiens
gggctctggcctcagtggg

SEQ ID NO: 8179376 - DNA, 19 bp, Homo sapiens
gggctctggcctcagtggg

SEQ ID NO: 8179377 - DNA, 18 bp, Homo sapiens
gggctctggcatctgggt

SEQ ID NO: 8179378 - DNA, 18 bp, Homo sapiens
gggctctggcatctgggt

SEQ ID NO: 8179379 - DNA, 18 bp, Homo sapiens
gggctctggcatctgggt

SEQ ID NO: 8179380 - DNA, 22 bp, Homo sapiens
gggctctgggattcagagcaag

SEQ ID NO: 8179381 - DNA, 22 bp, Homo sapiens
gggctctgggatgctcttagag

SEQ ID NO: 8179382 - DNA, 22 bp, Homo sapiens
gggctctgggatgctcttagag

SEQ ID NO: 8179383 - DNA, 22 bp, Homo sapiens
gggctctgggatgctcttagag

SEQ ID NO: 8179384 - DNA, 22 bp, Homo sapiens
gggctctgggattcagagcaag

SEQ ID NO: 8179385 - DNA, 22 bp, Homo sapiens
gggctctgggattcagagcaag

SEQ ID NO: 8179386 - DNA, 22 bp, Homo sapiens
gggctctgggattcagagcaag

SEQ ID NO: 8179387 - DNA, 22 bp, Homo sapiens
gggctctgggattcagagcaag

SEQ ID NO: 8179388 - DNA, 22 bp, Homo sapiens
gggctctgggattcagagcaag

SEQ ID NO: 8179389 - DNA, 22 bp, Homo sapiens
gggctctgggattcagagcaag

SEQ ID NO: 8179390 - DNA, 22 bp, Homo sapiens
gggctctggggtcagacagcct

SEQ ID NO: 8179391 - DNA, 22 bp, Homo sapiens
gggctctggggaggacccttca

SEQ ID NO: 8179392 - DNA, 22 bp, Homo sapiens
gggctctggggaggacccttca

SEQ ID NO: 8179393 - DNA, 22 bp, Homo sapiens
ggggagttaaaatgtgctgcaa

SEQ ID NO: 8179394 - DNA, 22 bp, Homo sapiens
ggggagtgttttcatgggcttg

SEQ ID NO: 8179395 - DNA, 22 bp, Homo sapiens
ggggagtgttttcatgggcttg

SEQ ID NO: 8179396 - DNA, 22 bp, Homo sapiens
ggggagtggttgcctgtgatcc

SEQ ID NO: 8179397 - DNA, 22 bp, Homo sapiens
ggggagtggttgcctgtgatcc

SEQ ID NO: 8179398 - DNA, 22 bp, Homo sapiens
ggggagtgttttcatgggcttg

SEQ ID NO: 8179399 - DNA, 19 bp, Homo sapiens
ggggaggtattgttttcat

SEQ ID NO: 8179400 - DNA, 22 bp, Homo sapiens
ggggagtgacgcagggccatag

SEQ ID NO: 8179401 - DNA, 22 bp, Homo sapiens
ggggagttcatgcatttgtgga

SEQ ID NO: 8179402 - DNA, 21 bp, Homo sapiens
ggggatgcgaccacaggctcc

SEQ ID NO: 8179403 - DNA, 21 bp, Homo sapiens
ggggatgcgaccacaggctcc

SEQ ID NO: 8179404 - DNA, 22 bp, Homo sapiens
ggggcagggaggttatcgccga

SEQ ID NO: 8179405 - DNA, 22 bp, Homo sapiens
ggggcaggaggtgttctctttt

SEQ ID NO: 8179406 - DNA, 22 bp, Homo sapiens
ggggcagggaggttatcgccga

SEQ ID NO: 8179407 - DNA, 22 bp, Homo sapiens
ggggcagggaggttatcgccga

SEQ ID NO: 8179408 - DNA, 22 bp, Homo sapiens
ggggccagatatcactaaggtt

SEQ ID NO: 8179409 - DNA, 22 bp, Homo sapiens
ggggccagatatcactaaggtt

SEQ ID NO: 8179410 - DNA, 22 bp, Homo sapiens
ggggcattgtgtctgggttcct

SEQ ID NO: 8179411 - DNA, 22 bp, Homo sapiens
ggggcattgtgtctgggttcct

SEQ ID NO: 8179412 - DNA, 22 bp, Homo sapiens
ggggccagagaggacccaggtg

SEQ ID NO: 8179413 - DNA, 22 bp, Homo sapiens
ggggccagagaggacccaggtg

SEQ ID NO: 8179414 - DNA, 22 bp, Homo sapiens
ggggcagtgaggtggcagcccg

SEQ ID NO: 8179415 - DNA, 22 bp, Homo sapiens
ggggcagtgaggtggcagcccg

SEQ ID NO: 8179416 - DNA, 20 bp, Homo sapiens
ggggcaggtttttatggcta

SEQ ID NO: 8179417 - DNA, 20 bp, Homo sapiens
ggggcaggtttttatggcta

SEQ ID NO: 8179418 - DNA, 20 bp, Homo sapiens
ggggcaggtttttatggcta

SEQ ID NO: 8179419 - DNA, 22 bp, Homo sapiens
ggggaggctgatgtgggcaaag

SEQ ID NO: 8179420 - DNA, 22 bp, Homo sapiens
ggggaggctgatgtgggcaaag

SEQ ID NO: 8179421 - DNA, 22 bp, Homo sapiens
ggggaggccagtggaccgtccc

SEQ ID NO: 8179422 - DNA, 22 bp, Homo sapiens
ggggaggccagtggaccgtccc

SEQ ID NO: 8179423 - DNA, 22 bp, Homo sapiens
ggggaggcaagatgaagtgagg

SEQ ID NO: 8179424 - DNA, 22 bp, Homo sapiens
ggggaggcaagatgaagtgagg

SEQ ID NO: 8179425 - DNA, 22 bp, Homo sapiens
ggggaggcaagatgaagtgagg

SEQ ID NO: 8179426 - DNA, 22 bp, Homo sapiens
ggggaggagccatgtaactagt

SEQ ID NO: 8179427 - DNA, 22 bp, Homo sapiens
ggggaggacctttccaaggctt

SEQ ID NO: 8179428 - DNA, 22 bp, Homo sapiens
ggggaggacctttccaaggctt

SEQ ID NO: 8179429 - DNA, 22 bp, Homo sapiens
ggggaggacctttccaaggctt

SEQ ID NO: 8179430 - DNA, 22 bp, Homo sapiens
ggggaggagccatgtaactagt

SEQ ID NO: 8179431 - DNA, 22 bp, Homo sapiens
ggggaggagccatgtaactagt

SEQ ID NO: 8179432 - DNA, 22 bp, Homo sapiens
ggggaggagtgtacaggtttat

SEQ ID NO: 8179433 - DNA, 22 bp, Homo sapiens
ggggaggaagctggaacacggg

SEQ ID NO: 8179434 - DNA, 22 bp, Homo sapiens
ggggaggaagctggaacacggg

SEQ ID NO: 8179435 - DNA, 22 bp, Homo sapiens
ggggaggaagctggaacacggg

SEQ ID NO: 8179436 - DNA, 22 bp, Homo sapiens
ggggaggaagctggaacacggg

SEQ ID NO: 8179437 - DNA, 22 bp, Homo sapiens
ggggaggaagctggaacacggg

SEQ ID NO: 8179438 - DNA, 22 bp, Homo sapiens
ggggaggaagctggaacacggg

SEQ ID NO: 8179439 - DNA, 22 bp, Homo sapiens
ggggaggaagctggaacacggg

SEQ ID NO: 8179440 - DNA, 22 bp, Homo sapiens
gggcttctgtacctacctggaa

SEQ ID NO: 8179441 - DNA, 22 bp, Homo sapiens
gggcttctgtacctacctggaa

SEQ ID NO: 8179442 - DNA, 22 bp, Homo sapiens
gggcttctgttcctttcacttg

SEQ ID NO: 8179443 - DNA, 22 bp, Homo sapiens
gggcttctgttcctttcacttg

SEQ ID NO: 8179444 - DNA, 22 bp, Homo sapiens
ggggagaattacatggcgtgga

SEQ ID NO: 8179445 - DNA, 19 bp, Homo sapiens
ggggtggctggggctccag

SEQ ID NO: 8179446 - DNA, 22 bp, Homo sapiens
ggggtgggagtgccatccttga

SEQ ID NO: 8179447 - DNA, 19 bp, Homo sapiens
ggggtggctggggctccag

SEQ ID NO: 8179448 - DNA, 22 bp, Homo sapiens
ggggtggctggcacctcctggt

SEQ ID NO: 8179449 - DNA, 22 bp, Homo sapiens
ggggtggctggcacctcctggt

SEQ ID NO: 8179450 - DNA, 22 bp, Homo sapiens
ggggtggctggcacctcctggt

SEQ ID NO: 8179451 - DNA, 22 bp, Homo sapiens
ggggtggctggcacctcctggt

SEQ ID NO: 8179452 - DNA, 19 bp, Homo sapiens
ggggtggctggggctccag

SEQ ID NO: 8179453 - DNA, 22 bp, Homo sapiens
ggggtggctggcacctcctggt

SEQ ID NO: 8179454 - DNA, 19 bp, Homo sapiens
ggggtggctggggctccag

SEQ ID NO: 8179455 - DNA, 22 bp, Homo sapiens
ggggtggcctgtaggcagcatg

SEQ ID NO: 8179456 - DNA, 22 bp, Homo sapiens
ggggtggcctgtaggcagcatg

SEQ ID NO: 8179457 - DNA, 22 bp, Homo sapiens
ggggtggcctgtaggcagcatg

SEQ ID NO: 8179458 - DNA, 22 bp, Homo sapiens
ggggtggccctaccctctggaa

SEQ ID NO: 8179459 - DNA, 22 bp, Homo sapiens
ggggtggccctaccctctggaa

SEQ ID NO: 8179460 - DNA, 22 bp, Homo sapiens
ggggtggccctaccctctggaa

SEQ ID NO: 8179461 - DNA, 22 bp, Homo sapiens
ggggtggatttcaggcggtgtc

SEQ ID NO: 8179462 - DNA, 22 bp, Homo sapiens
ggggtggatttcaggcggtgtc

SEQ ID NO: 8179463 - DNA, 22 bp, Homo sapiens
ggggtggatttcaggcggtgtc

SEQ ID NO: 8179464 - DNA, 22 bp, Homo sapiens
ggggtggccaaggactctgacc

SEQ ID NO: 8179465 - DNA, 22 bp, Homo sapiens
ggggtggccaaggactctgacc

SEQ ID NO: 8179466 - DNA, 22 bp, Homo sapiens
ggggtggccaaggactctgacc

SEQ ID NO: 8179467 - DNA, 22 bp, Homo sapiens
ggggtggccaaggactctgacc

SEQ ID NO: 8179468 - DNA, 22 bp, Homo sapiens
ggggtggccaaggactctgacc

SEQ ID NO: 8179469 - DNA, 22 bp, Homo sapiens
ggggtggatttcaggcggtgtc

SEQ ID NO: 8179470 - DNA, 22 bp, Homo sapiens
ggggtggattcctacaggtcca

SEQ ID NO: 8179471 - DNA, 22 bp, Homo sapiens
ggggtggattcctacaggtcca

SEQ ID NO: 8179472 - DNA, 22 bp, Homo sapiens
ggggtggattcctacaggtcca

SEQ ID NO: 8179473 - DNA, 22 bp, Homo sapiens
ggggtggattcctacaggtcca

SEQ ID NO: 8179474 - DNA, 22 bp, Homo sapiens
ggggtgctagagtggggccact

SEQ ID NO: 8179475 - DNA, 22 bp, Homo sapiens
ggggtgctagagtggggccact

SEQ ID NO: 8179476 - DNA, 22 bp, Homo sapiens
ggggtgctgaagatgtcatggt

SEQ ID NO: 8179477 - DNA, 19 bp, Homo sapiens
ggggtgctagggagggatc

SEQ ID NO: 8179478 - DNA, 22 bp, Homo sapiens
ggggtggagatggtggcccttt

SEQ ID NO: 8179479 - DNA, 22 bp, Homo sapiens
ggggtggagatggtggcccttt

SEQ ID NO: 8179480 - DNA, 22 bp, Homo sapiens
ggggtgctgaagatgtcatggt

SEQ ID NO: 8179481 - DNA, 22 bp, Homo sapiens
ggggtggagatggtggcccttt

SEQ ID NO: 8179482 - DNA, 22 bp, Homo sapiens
ggggtggagctaaatgtctact

SEQ ID NO: 8179483 - DNA, 22 bp, Homo sapiens
ggggtggagctaaatgtctact

SEQ ID NO: 8179484 - DNA, 22 bp, Homo sapiens
ggggtggatcaggcaggcccag

SEQ ID NO: 8179485 - DNA, 22 bp, Homo sapiens
ggggtggagctaaatgtctact

SEQ ID NO: 8179486 - DNA, 22 bp, Homo sapiens
ggggccagatatcactaaggtt

SEQ ID NO: 8179487 - DNA, 22 bp, Homo sapiens
ggggccagcaatgttgaggaat

SEQ ID NO: 8179488 - DNA, 22 bp, Homo sapiens
ggggccagcaatgttgaggaat

SEQ ID NO: 8179489 - DNA, 22 bp, Homo sapiens
ggggccagcttcgcgtgctctt

SEQ ID NO: 8179490 - DNA, 22 bp, Homo sapiens
ggggccagcactgtgcctttgt

SEQ ID NO: 8179491 - DNA, 22 bp, Homo sapiens
ggggccagcaatgttgaggaat

SEQ ID NO: 8179492 - DNA, 22 bp, Homo sapiens
ggggccagtaggagtgatgtac

SEQ ID NO: 8179493 - DNA, 22 bp, Homo sapiens
ggggccagtaggagtgatgtac

SEQ ID NO: 8179494 - DNA, 22 bp, Homo sapiens
ggggccaggtccagcttccaaa

SEQ ID NO: 8179495 - DNA, 22 bp, Homo sapiens
ggggccaggtccagcttccaaa

SEQ ID NO: 8179496 - DNA, 22 bp, Homo sapiens
ggggtagggtgattgtgaagta

SEQ ID NO: 8179497 - DNA, 22 bp, Homo sapiens
ggggtgagtgctcagccccgga

SEQ ID NO: 8179498 - DNA, 22 bp, Homo sapiens
ggggtgagttagcgtcggcttg

SEQ ID NO: 8179499 - DNA, 22 bp, Homo sapiens
ggggtgagttagcgtcggcttg

SEQ ID NO: 8179500 - DNA, 22 bp, Homo sapiens
ggggcccttgtggctgcaggcc

SEQ ID NO: 8179501 - DNA, 22 bp, Homo sapiens
ggggtaggcaggtgatctgatc

SEQ ID NO: 8179502 - DNA, 22 bp, Homo sapiens
ggggtaggcaggtgatctgatc

SEQ ID NO: 8179503 - DNA, 22 bp, Homo sapiens
ggggtagggcgattgctgcttt

SEQ ID NO: 8179504 - DNA, 22 bp, Homo sapiens
ggggtagggcgattgctgcttt

SEQ ID NO: 8179505 - DNA, 22 bp, Homo sapiens
ggggtagggcgattgctgcttt

SEQ ID NO: 8179506 - DNA, 22 bp, Homo sapiens
ggggtagggcgattgctgcttt

SEQ ID NO: 8179507 - DNA, 22 bp, Homo sapiens
ggggcccttgtggctgcaggcc

SEQ ID NO: 8179508 - DNA, 22 bp, Homo sapiens
ggggcccttgtggctgcaggcc

SEQ ID NO: 8179509 - DNA, 22 bp, Homo sapiens
ggggcccttgtggctgcaggcc

SEQ ID NO: 8179510 - DNA, 22 bp, Homo sapiens
ggggcccctcggacacgtgcgg

SEQ ID NO: 8179511 - DNA, 22 bp, Homo sapiens
gggtggtggcggaggctccagg

SEQ ID NO: 8179512 - DNA, 22 bp, Homo sapiens
gggtggtgtattagagctgcag

SEQ ID NO: 8179513 - DNA, 22 bp, Homo sapiens
gggtggtgtattagagctgcag

SEQ ID NO: 8179514 - DNA, 22 bp, Homo sapiens
gggtggtgtattagagctgcag

SEQ ID NO: 8179515 - DNA, 22 bp, Homo sapiens
gggtggtgtattagagctgcag

SEQ ID NO: 8179516 - DNA, 19 bp, Homo sapiens
gggtggtccaactttcagg

SEQ ID NO: 8179517 - DNA, 21 bp, Homo sapiens
gggtggtctagctcaggaact

SEQ ID NO: 8179518 - DNA, 21 bp, Homo sapiens
gggtggtctgctgaagaggga

SEQ ID NO: 8179519 - DNA, 22 bp, Homo sapiens
gggtggtgagatgtagctgatg

SEQ ID NO: 8179520 - DNA, 22 bp, Homo sapiens
gggtggtctggcaggctggaaa

SEQ ID NO: 8179521 - DNA, 22 bp, Homo sapiens
gggtggtctggcaggctggaaa

SEQ ID NO: 8179522 - DNA, 16 bp, Homo sapiens
gggtggtcttggagac

SEQ ID NO: 8179523 - DNA, 22 bp, Homo sapiens
gggtggtggccagcagtgggca

SEQ ID NO: 8179524 - DNA, 22 bp, Homo sapiens
gggtggtgagatgtagctgatg

SEQ ID NO: 8179525 - DNA, 22 bp, Homo sapiens
gggtggtgagatgtagctgatg

SEQ ID NO: 8179526 - DNA, 21 bp, Homo sapiens
gggtggggttccagccttttc

SEQ ID NO: 8179527 - DNA, 21 bp, Homo sapiens
gggtggggttccagccttttc

SEQ ID NO: 8179528 - DNA, 22 bp, Homo sapiens
gggtggtcatctgaaggtctgg

SEQ ID NO: 8179529 - DNA, 22 bp, Homo sapiens
gggtggagccagttgactctgt

SEQ ID NO: 8179530 - DNA, 22 bp, Homo sapiens
gggtggagccagttgactctgt

SEQ ID NO: 8179531 - DNA, 22 bp, Homo sapiens
gggtggaattgttggcatcgga

SEQ ID NO: 8179532 - DNA, 22 bp, Homo sapiens
gggtggagaggctaagtccagt

SEQ ID NO: 8179533 - DNA, 22 bp, Homo sapiens
gggtggagaggctaagtccagt

SEQ ID NO: 8179534 - DNA, 22 bp, Homo sapiens
gggtgctttggctcacgcctgt

SEQ ID NO: 8179535 - DNA, 22 bp, Homo sapiens
gggtggaagccagagaggtcat

SEQ ID NO: 8179536 - DNA, 22 bp, Homo sapiens
gggtggaagccagagaggtcat

SEQ ID NO: 8179537 - DNA, 22 bp, Homo sapiens
gggtggaagccagagaggtcat

SEQ ID NO: 8179538 - DNA, 21 bp, Homo sapiens
gggtgctgtggtcatgcagga

SEQ ID NO: 8179539 - DNA, 21 bp, Homo sapiens
gggtgctgtggtcatgcagga

SEQ ID NO: 8179540 - DNA, 21 bp, Homo sapiens
gggtgctgtggtcatgcagga

SEQ ID NO: 8179541 - DNA, 18 bp, Homo sapiens
gggtgctggggccccttg

SEQ ID NO: 8179542 - DNA, 22 bp, Homo sapiens
gggtgctgggaggctgacatct

SEQ ID NO: 8179543 - DNA, 22 bp, Homo sapiens
gggtgctgggaggctgacatct

SEQ ID NO: 8179544 - DNA, 22 bp, Homo sapiens
gggtgcaggcagcccaggcagg

SEQ ID NO: 8179545 - DNA, 22 bp, Homo sapiens
gggtgcaggcagcccaggcagg

SEQ ID NO: 8179546 - DNA, 22 bp, Homo sapiens
gggtgcaggcagcccaggcagg

SEQ ID NO: 8179547 - DNA, 18 bp, Homo sapiens
gggtgcaggcactgactg

SEQ ID NO: 8179548 - DNA, 22 bp, Homo sapiens
gggtgcaggcagcccaggcagg

SEQ ID NO: 8179549 - DNA, 22 bp, Homo sapiens
gggtgcaggcagcccaggcagg

SEQ ID NO: 8179550 - DNA, 22 bp, Homo sapiens
gggtgcaggcagcccaggcagg

SEQ ID NO: 8179551 - DNA, 18 bp, Homo sapiens
gggtgcaggcactgactg

SEQ ID NO: 8179552 - DNA, 18 bp, Homo sapiens
gggtgcaggcactgactg

SEQ ID NO: 8179553 - DNA, 18 bp, Homo sapiens
gggtgcaggcactgactg

SEQ ID NO: 8179554 - DNA, 22 bp, Homo sapiens
gggtgcagctttgaaagcatgt

SEQ ID NO: 8179555 - DNA, 22 bp, Homo sapiens
gggtgcagcagagctcctctgt

SEQ ID NO: 8179556 - DNA, 22 bp, Homo sapiens
gggtgcaaacccgttctgcacc

SEQ ID NO: 8179557 - DNA, 22 bp, Homo sapiens
gggtgcaagccaaagaagactg

SEQ ID NO: 8179558 - DNA, 22 bp, Homo sapiens
gggtgcaagcaagtggcacaga

SEQ ID NO: 8179559 - DNA, 22 bp, Homo sapiens
gggtgcaactaagaagaggtga

SEQ ID NO: 8179560 - DNA, 22 bp, Homo sapiens
gggtgcagcagagctcctctgt

SEQ ID NO: 8179561 - DNA, 22 bp, Homo sapiens
gggtgagggatgagccttcttc

SEQ ID NO: 8179562 - DNA, 22 bp, Homo sapiens
gggtgagggatgagccttcttc

SEQ ID NO: 8179563 - DNA, 22 bp, Homo sapiens
gggtgagggatgagccttcttc

SEQ ID NO: 8179564 - DNA, 22 bp, Homo sapiens
gggtgaggccttgctgccatca

SEQ ID NO: 8179565 - DNA, 22 bp, Homo sapiens
gggtgaggccttgctgccatca

SEQ ID NO: 8179566 - DNA, 22 bp, Homo sapiens
gggtgaggccttgctgccatca

SEQ ID NO: 8179567 - DNA, 20 bp, Homo sapiens
gggtgaggatggagaatttg

SEQ ID NO: 8179568 - DNA, 22 bp, Homo sapiens
gggtgaggcccatttgaggcca

SEQ ID NO: 8179569 - DNA, 20 bp, Homo sapiens
gggtgaggatggagaatttg

SEQ ID NO: 8179570 - DNA, 22 bp, Homo sapiens
gggtgaggccttgctgccatca

SEQ ID NO: 8179571 - DNA, 22 bp, Homo sapiens
gggtgaggcccatttgaggcca

SEQ ID NO: 8179572 - DNA, 22 bp, Homo sapiens
gggtgaggcccatttgaggcca

SEQ ID NO: 8179573 - DNA, 20 bp, Homo sapiens
gctcagggaattcaggaagc

SEQ ID NO: 8179574 - DNA, 20 bp, Homo sapiens
gctcagggaattcaggaagc

SEQ ID NO: 8179575 - DNA, 22 bp, Homo sapiens
gctcagggagagagggcagccg

SEQ ID NO: 8179576 - DNA, 22 bp, Homo sapiens
gctcagggaaggccacgtgaga

SEQ ID NO: 8179577 - DNA, 21 bp, Homo sapiens
gctatacagaatggccagagg

SEQ ID NO: 8179578 - DNA, 22 bp, Homo sapiens
gctcagggaatgagaagatgtt

SEQ ID NO: 8179579 - DNA, 22 bp, Homo sapiens
gctcagggaaggccacgtgaga

SEQ ID NO: 8179580 - DNA, 22 bp, Homo sapiens
gctagtttcttgaatactctaa

SEQ ID NO: 8179581 - DNA, 22 bp, Homo sapiens
gctagtgcagggaaatctttgg

SEQ ID NO: 8179582 - DNA, 22 bp, Homo sapiens
gctatacacatttcttggtagt

SEQ ID NO: 8179583 - DNA, 22 bp, Homo sapiens
gctatacaagtgtagaatagag

SEQ ID NO: 8179584 - DNA, 22 bp, Homo sapiens
gctagtttcttgttggcagaga

SEQ ID NO: 8179585 - DNA, 22 bp, Homo sapiens
gctaggtgcagcagacagctta

SEQ ID NO: 8179586 - DNA, 23 bp, Homo sapiens
gctaggtgcttccacacgtgctg

SEQ ID NO: 8179587 - DNA, 22 bp, Homo sapiens
gctaggtgcagcagacagctta

SEQ ID NO: 8179588 - DNA, 22 bp, Homo sapiens
gctaggttggggaagttctcct

SEQ ID NO: 8179589 - DNA, 22 bp, Homo sapiens
gctaggttggggaagttctcct

SEQ ID NO: 8179590 - DNA, 22 bp, Homo sapiens
gctaggttggggaagttctcct

SEQ ID NO: 8179591 - DNA, 22 bp, Homo sapiens
gctaggtgcagcagacagctta

SEQ ID NO: 8179592 - DNA, 22 bp, Homo sapiens
gctcagggcctggctgcggact

SEQ ID NO: 8179593 - DNA, 22 bp, Homo sapiens
gctcagggccatggaccagcag

SEQ ID NO: 8179594 - DNA, 22 bp, Homo sapiens
gctcagggcgcgagggacgtgg

SEQ ID NO: 8179595 - DNA, 20 bp, Homo sapiens
gctcagggcctgggtctgga

SEQ ID NO: 8179596 - DNA, 22 bp, Homo sapiens
gctcagggagagagggcagccg

SEQ ID NO: 8179597 - DNA, 22 bp, Homo sapiens
gctcagggagagagggcagccg

SEQ ID NO: 8179598 - DNA, 22 bp, Homo sapiens
gctcagggagagagggcagccg

SEQ ID NO: 8179599 - DNA, 22 bp, Homo sapiens
gctcagggagtttcacagtgta

SEQ ID NO: 8179600 - DNA, 22 bp, Homo sapiens
gctcagggccatggaccagcag

SEQ ID NO: 8179601 - DNA, 22 bp, Homo sapiens
gctcagggccatggaccagcag

SEQ ID NO: 8179602 - DNA, 22 bp, Homo sapiens
gctcagggccatggaccagcag

SEQ ID NO: 8179603 - DNA, 22 bp, Homo sapiens
gctcagtttttagtttgtgaga

SEQ ID NO: 8179604 - DNA, 22 bp, Homo sapiens
gctcagttatccgtgtgtgact

SEQ ID NO: 8179605 - DNA, 22 bp, Homo sapiens
gctcagttatccgtgtgtgact

SEQ ID NO: 8179606 - DNA, 18 bp, Homo sapiens
gctcagtgtgttaacact

SEQ ID NO: 8179607 - DNA, 22 bp, Homo sapiens
gctcagtgtggtcctcagatgt

SEQ ID NO: 8179608 - DNA, 22 bp, Homo sapiens
gctcagtgtgcacgagtactct

SEQ ID NO: 8179609 - DNA, 22 bp, Homo sapiens
gctcccagcaattgaggcagcc

SEQ ID NO: 8179610 - DNA, 22 bp, Homo sapiens
gctcccagcaattgaggcagcc

SEQ ID NO: 8179611 - DNA, 22 bp, Homo sapiens
gctcccagcaattgaggcagcc

SEQ ID NO: 8179612 - DNA, 22 bp, Homo sapiens
gctcccagatttcagccttgtg

SEQ ID NO: 8179613 - DNA, 22 bp, Homo sapiens
gctcccagatttcagccttgtg

SEQ ID NO: 8179614 - DNA, 22 bp, Homo sapiens
gctcccagcaattgaggcagcc

SEQ ID NO: 8179615 - DNA, 22 bp, Homo sapiens
gctcccagcaattgaggcagcc

SEQ ID NO: 8179616 - DNA, 23 bp, Homo sapiens
gctcatcaggcttagagtcaagg

SEQ ID NO: 8179617 - DNA, 22 bp, Homo sapiens
gctcatccagcaagccagggcc

SEQ ID NO: 8179618 - DNA, 22 bp, Homo sapiens
gctcccagactgaccagaggtg

SEQ ID NO: 8179619 - DNA, 18 bp, Homo sapiens
gctcatcccacaatcagg

SEQ ID NO: 8179620 - DNA, 22 bp, Homo sapiens
gctcccagactgaccagaggtg

SEQ ID NO: 8179621 - DNA, 22 bp, Homo sapiens
gctcccagactgaccagaggtg

SEQ ID NO: 8179622 - DNA, 22 bp, Homo sapiens
gctcccagatttcagccttgtg

SEQ ID NO: 8179623 - DNA, 22 bp, Homo sapiens
gctcccagactgaccagaggtg

SEQ ID NO: 8179624 - DNA, 22 bp, Homo sapiens
gctagaaatcgacttcagaatt

SEQ ID NO: 8179625 - DNA, 22 bp, Homo sapiens
gctagcctcccttttccatggt

SEQ ID NO: 8179626 - DNA, 22 bp, Homo sapiens
gctagcctgcagtggctatggt

SEQ ID NO: 8179627 - DNA, 22 bp, Homo sapiens
gctagctgggtttcactgtgga

SEQ ID NO: 8179628 - DNA, 22 bp, Homo sapiens
gctaggaagaagggtgcttgaa

SEQ ID NO: 8179629 - DNA, 22 bp, Homo sapiens
gctaggaagaagggtgcttgaa

SEQ ID NO: 8179630 - DNA, 22 bp, Homo sapiens
gctaggaacatttatatacaaa

SEQ ID NO: 8179631 - DNA, 22 bp, Homo sapiens
gctaggagattgagctctgaag

SEQ ID NO: 8179632 - DNA, 17 bp, Homo sapiens
gctaggagagggaggag

SEQ ID NO: 8179633 - DNA, 22 bp, Homo sapiens
gctaggctcggaagcagcaggg

SEQ ID NO: 8179634 - DNA, 22 bp, Homo sapiens
gctaggctcggaagcagcaggg

SEQ ID NO: 8179635 - DNA, 22 bp, Homo sapiens
gctaggctcttccatcagggca

SEQ ID NO: 8179636 - DNA, 22 bp, Homo sapiens
gctaggctcggaagcagcaggg

SEQ ID NO: 8179637 - DNA, 22 bp, Homo sapiens
gctaggctgaatatggtgctta

SEQ ID NO: 8179638 - DNA, 22 bp, Homo sapiens
gctaggctgaatatggtgctta

SEQ ID NO: 8179639 - DNA, 20 bp, Homo sapiens
gctaggctggtgattgtcaa

SEQ ID NO: 8179640 - DNA, 20 bp, Homo sapiens
gctaggctgtgtcctgccca

SEQ ID NO: 8179641 - DNA, 22 bp, Homo sapiens
gctaggctgtgtttcagaccct

SEQ ID NO: 8179642 - DNA, 22 bp, Homo sapiens
gctagggtggctaataggagag

SEQ ID NO: 8179643 - DNA, 18 bp, Homo sapiens
gctagggcatgcatggtg

SEQ ID NO: 8179644 - DNA, 18 bp, Homo sapiens
gctagggcatgcatggtg

SEQ ID NO: 8179645 - DNA, 18 bp, Homo sapiens
gctagggcatgcatggtg

SEQ ID NO: 8179646 - DNA, 22 bp, Homo sapiens
gctagggctcttgtccttgctc

SEQ ID NO: 8179647 - DNA, 22 bp, Homo sapiens
gctagggcgggagtgctggaga

SEQ ID NO: 8179648 - DNA, 22 bp, Homo sapiens
gctagggcgggagtgctggaga

SEQ ID NO: 8179649 - DNA, 22 bp, Homo sapiens
gctagggaacctcttctgagga

SEQ ID NO: 8179650 - DNA, 22 bp, Homo sapiens
gctagggactagggaaggagca

SEQ ID NO: 8179651 - DNA, 22 bp, Homo sapiens
gctagggagacttgtgtcatca

SEQ ID NO: 8179652 - DNA, 16 bp, Homo sapiens
gcctggcaccgtcggc

SEQ ID NO: 8179653 - DNA, 16 bp, Homo sapiens
gcctggcaccgtcggc

SEQ ID NO: 8179654 - DNA, 20 bp, Homo sapiens
gcctggcacccggggctggc

SEQ ID NO: 8179655 - DNA, 20 bp, Homo sapiens
gcctggcacccggggctggc

SEQ ID NO: 8179656 - DNA, 20 bp, Homo sapiens
gcctggcacccggggctggc

SEQ ID NO: 8179657 - DNA, 20 bp, Homo sapiens
gcctggcacccggggctggc

SEQ ID NO: 8179658 - DNA, 20 bp, Homo sapiens
gcctggcacccggggctggc

SEQ ID NO: 8179659 - DNA, 22 bp, Homo sapiens
gcctggcaccacagcctttcag

SEQ ID NO: 8179660 - DNA, 22 bp, Homo sapiens
gcctggagttcagccaagtccc

SEQ ID NO: 8179661 - DNA, 22 bp, Homo sapiens
gcctggagttcagccaagtccc

SEQ ID NO: 8179662 - DNA, 22 bp, Homo sapiens
gcctggagttcagccaagtccc

SEQ ID NO: 8179663 - DNA, 22 bp, Homo sapiens
gcctggagttcagccaagtccc

SEQ ID NO: 8179664 - DNA, 22 bp, Homo sapiens
gcctggagttcagccaagtccc

SEQ ID NO: 8179665 - DNA, 22 bp, Homo sapiens
gcctggagttcagccaagtccc

SEQ ID NO: 8179666 - DNA, 22 bp, Homo sapiens
gcctggagtggtcctgctgccc

SEQ ID NO: 8179667 - DNA, 22 bp, Homo sapiens
gcctggagtggtcctgctgccc

SEQ ID NO: 8179668 - DNA, 22 bp, Homo sapiens
gcctggagtggtcctgctgccc

SEQ ID NO: 8179669 - DNA, 22 bp, Homo sapiens
gcctggagtggtcctgctgccc

SEQ ID NO: 8179670 - DNA, 16 bp, Homo sapiens
gcctggagtggcaggg

SEQ ID NO: 8179671 - DNA, 22 bp, Homo sapiens
gcctggagtggtcctgctgccc

SEQ ID NO: 8179672 - DNA, 22 bp, Homo sapiens
gcctggagtggtcctgctgccc

SEQ ID NO: 8179673 - DNA, 22 bp, Homo sapiens
gcctggagtggtcctgctgccc

SEQ ID NO: 8179674 - DNA, 22 bp, Homo sapiens
gcctggagtggtcctgctgccc

SEQ ID NO: 8179675 - DNA, 22 bp, Homo sapiens
gcctggagtgttggtatttctc

SEQ ID NO: 8179676 - DNA, 20 bp, Homo sapiens
gcctggagttagttttcctt

SEQ ID NO: 8179677 - DNA, 20 bp, Homo sapiens
gcctggagttagttttcctt

SEQ ID NO: 8179678 - DNA, 22 bp, Homo sapiens
gcctggagtggtcctgctgccc

SEQ ID NO: 8179679 - DNA, 22 bp, Homo sapiens
gcctggagtgttggtatttctc

SEQ ID NO: 8179680 - DNA, 22 bp, Homo sapiens
gcctggcaggaatctcagtgct

SEQ ID NO: 8179681 - DNA, 22 bp, Homo sapiens
gcctggcaggcctcatgagggg

SEQ ID NO: 8179682 - DNA, 22 bp, Homo sapiens
gcctggcaggcctcatgagggg

SEQ ID NO: 8179683 - DNA, 22 bp, Homo sapiens
gcctggcaggcctcatgagggg

SEQ ID NO: 8179684 - DNA, 22 bp, Homo sapiens
gcctggcagcctccaaccttca

SEQ ID NO: 8179685 - DNA, 22 bp, Homo sapiens
gcctggcaggaatctcagtgct

SEQ ID NO: 8179686 - DNA, 22 bp, Homo sapiens
gcctggcagcccctagacattt

SEQ ID NO: 8179687 - DNA, 22 bp, Homo sapiens
gcctggcagcccctagacattt

SEQ ID NO: 8179688 - DNA, 22 bp, Homo sapiens
gcctggcagcctccaaccttca

SEQ ID NO: 8179689 - DNA, 22 bp, Homo sapiens
gcctggcaggcctcatgagggg

SEQ ID NO: 8179690 - DNA, 22 bp, Homo sapiens
gctactttgcagctagctagga

SEQ ID NO: 8179691 - DNA, 22 bp, Homo sapiens
gctagaaaatgaaagataattt

SEQ ID NO: 8179692 - DNA, 22 bp, Homo sapiens
gctagaaactgtttaatctctt

SEQ ID NO: 8179693 - DNA, 22 bp, Homo sapiens
gcctggcagattgacatagcca

SEQ ID NO: 8179694 - DNA, 22 bp, Homo sapiens
gcctggcagattgacatagcca

SEQ ID NO: 8179695 - DNA, 22 bp, Homo sapiens
gcctggcagattgacatagcca

SEQ ID NO: 8179696 - DNA, 22 bp, Homo sapiens
gcctggcactcactgaagaggc

SEQ ID NO: 8179697 - DNA, 22 bp, Homo sapiens
gcctggcactgggctcctggcc

SEQ ID NO: 8179698 - DNA, 22 bp, Homo sapiens
gcctggcactgggctcctggcc

SEQ ID NO: 8179699 - DNA, 22 bp, Homo sapiens
gcctggcactcaatcatctgct

SEQ ID NO: 8179700 - DNA, 22 bp, Homo sapiens
gcctggcactcaatcatctgct

SEQ ID NO: 8179701 - DNA, 22 bp, Homo sapiens
gcctggcacgggctcggcccac

SEQ ID NO: 8179702 - DNA, 22 bp, Homo sapiens
gcctggcacgggctcggcccac

SEQ ID NO: 8179703 - DNA, 22 bp, Homo sapiens
gcctggcactcactgaagaggc

SEQ ID NO: 8179704 - DNA, 22 bp, Homo sapiens
gcctggcactcactgaagaggc

SEQ ID NO: 8179705 - DNA, 22 bp, Homo sapiens
gctctggttctcttagagtagt

SEQ ID NO: 8179706 - DNA, 22 bp, Homo sapiens
gctctggtttcctgttcactca

SEQ ID NO: 8179707 - DNA, 22 bp, Homo sapiens
gctctggttttagcctttcagg

SEQ ID NO: 8179708 - DNA, 22 bp, Homo sapiens
gctctgtagtatttagtaaata

SEQ ID NO: 8179709 - DNA, 21 bp, Homo sapiens
gctctgtacgttggtgccttc

SEQ ID NO: 8179710 - DNA, 22 bp, Homo sapiens
gctctgggtagccactgcctgg

SEQ ID NO: 8179711 - DNA, 22 bp, Homo sapiens
gctctgggtagccactgcctgg

SEQ ID NO: 8179712 - DNA, 22 bp, Homo sapiens
gctctgggtagccactgcctgg

SEQ ID NO: 8179713 - DNA, 22 bp, Homo sapiens
gctctcttgacagcttgctgtt

SEQ ID NO: 8179714 - DNA, 22 bp, Homo sapiens
gctctcttgacagcttgctgtt

SEQ ID NO: 8179715 - DNA, 22 bp, Homo sapiens
gctctctgttattaagatcttt

SEQ ID NO: 8179716 - DNA, 22 bp, Homo sapiens
gctctctgtcgttatgcttcat

SEQ ID NO: 8179717 - DNA, 22 bp, Homo sapiens
gctctctgtcgttatgcttcat

SEQ ID NO: 8179718 - DNA, 22 bp, Homo sapiens
gctctctgtcgttatgcttcat

SEQ ID NO: 8179719 - DNA, 22 bp, Homo sapiens
gctctcttggtggctgtcctgg

SEQ ID NO: 8179720 - DNA, 22 bp, Homo sapiens
gctctcttgacagcttgctgtt

SEQ ID NO: 8179721 - DNA, 22 bp, Homo sapiens
gctctcttggtggctgtcctgg

SEQ ID NO: 8179722 - DNA, 22 bp, Homo sapiens
gctctggggttggaaagtgatc

SEQ ID NO: 8179723 - DNA, 22 bp, Homo sapiens
gctctctggctagtccatcggg

SEQ ID NO: 8179724 - DNA, 22 bp, Homo sapiens
gctctctgggtgtgtctagata

SEQ ID NO: 8179725 - DNA, 22 bp, Homo sapiens
gctctctggttccagtcaggaa

SEQ ID NO: 8179726 - DNA, 22 bp, Homo sapiens
gctctctggaggccatggacag

SEQ ID NO: 8179727 - DNA, 22 bp, Homo sapiens
gctctctggaaggtatcattat

SEQ ID NO: 8179728 - DNA, 22 bp, Homo sapiens
gctctctgcctttctcaatgac

SEQ ID NO: 8179729 - DNA, 22 bp, Homo sapiens
gctctctgcctttctcaatgac

SEQ ID NO: 8179730 - DNA, 22 bp, Homo sapiens
gctctctgcctttctcaatgac

SEQ ID NO: 8179731 - DNA, 22 bp, Homo sapiens
gctctctgccatatgaggatac

SEQ ID NO: 8179732 - DNA, 22 bp, Homo sapiens
gctctctgccatatgaggatac

SEQ ID NO: 8179733 - DNA, 22 bp, Homo sapiens
gctctgtgctagaactaagaat

SEQ ID NO: 8179734 - DNA, 22 bp, Homo sapiens
gctctgtgctactttgaactct

SEQ ID NO: 8179735 - DNA, 22 bp, Homo sapiens
gctctgtgccagggctgggcca

SEQ ID NO: 8179736 - DNA, 22 bp, Homo sapiens
gctctgtgccagggctgggcca

SEQ ID NO: 8179737 - DNA, 22 bp, Homo sapiens
gctctgtgcccctgccgtggac

SEQ ID NO: 8179738 - DNA, 22 bp, Homo sapiens
gctctgtgcccctgccgtggac

SEQ ID NO: 8179739 - DNA, 20 bp, Homo sapiens
gctctgtgctggcggaggct

SEQ ID NO: 8179740 - DNA, 22 bp, Homo sapiens
gctctgtggcaggaggtcttgt

SEQ ID NO: 8179741 - DNA, 22 bp, Homo sapiens
gctctgtggcaggaggtcttgt

SEQ ID NO: 8179742 - DNA, 22 bp, Homo sapiens
gctctgtggcattcatgggcag

SEQ ID NO: 8179743 - DNA, 22 bp, Homo sapiens
gctctgtgccacatgcagtgtt

SEQ ID NO: 8179744 - DNA, 22 bp, Homo sapiens
gctctgtgcagttcagggacac

SEQ ID NO: 8179745 - DNA, 22 bp, Homo sapiens
gctctgtgccacatgcagtgtt

SEQ ID NO: 8179746 - DNA, 22 bp, Homo sapiens
gctctgtgccacatgcagtgtt

SEQ ID NO: 8179747 - DNA, 19 bp, Homo sapiens
gctctgtgatgctgagggg

SEQ ID NO: 8179748 - DNA, 19 bp, Homo sapiens
gctctgtgatgctgagggg

SEQ ID NO: 8179749 - DNA, 19 bp, Homo sapiens
gctctgtgatgctgagggg

SEQ ID NO: 8179750 - DNA, 22 bp, Homo sapiens
gctctgtgcaaatagcacccct

SEQ ID NO: 8179751 - DNA, 21 bp, Homo sapiens
gctctgtgaaatttcaccagg

SEQ ID NO: 8179752 - DNA, 21 bp, Homo sapiens
gctctgtgaaatttcaccagg

SEQ ID NO: 8179753 - DNA, 22 bp, Homo sapiens
gctctgtcttcagcacacagta

SEQ ID NO: 8179754 - DNA, 22 bp, Homo sapiens
gctctgtgaagggtgttgctca

SEQ ID NO: 8179755 - DNA, 19 bp, Homo sapiens
gctctgtgatgctgagggg

SEQ ID NO: 8179756 - DNA, 19 bp, Homo sapiens
gctctgtgatgctgagggg

SEQ ID NO: 8179757 - DNA, 22 bp, Homo sapiens
gctctgtgagtattggccctgg

SEQ ID NO: 8179758 - DNA, 22 bp, Homo sapiens
gctctgtgagtattggccctgg

SEQ ID NO: 8179759 - DNA, 22 bp, Homo sapiens
gctctgtgagccacttgatgta

SEQ ID NO: 8179760 - DNA, 22 bp, Homo sapiens
gctctgtatgtagttcttgctt

SEQ ID NO: 8179761 - DNA, 22 bp, Homo sapiens
gctctgtcaacagctagctgtg

SEQ ID NO: 8179762 - DNA, 22 bp, Homo sapiens
gctctgtcaacagctagctgtg

SEQ ID NO: 8179763 - DNA, 22 bp, Homo sapiens
gctctgtcattttgcagacact

SEQ ID NO: 8179764 - DNA, 22 bp, Homo sapiens
gctctgtccagcgtgcacagaa

SEQ ID NO: 8179765 - DNA, 22 bp, Homo sapiens
gctctgtcttcagcacacagta

SEQ ID NO: 8179766 - DNA, 22 bp, Homo sapiens
gctctccaggtctcatgcactg

SEQ ID NO: 8179767 - DNA, 22 bp, Homo sapiens
gctctcccgcagcctggtgggc

SEQ ID NO: 8179768 - DNA, 22 bp, Homo sapiens
gctccctctgctcaggcacttg

SEQ ID NO: 8179769 - DNA, 22 bp, Homo sapiens
gctccctctgctcaggcacttg

SEQ ID NO: 8179770 - DNA, 22 bp, Homo sapiens
gctctccaggggctcccaggat

SEQ ID NO: 8179771 - DNA, 22 bp, Homo sapiens
gctctctgcagcctccttggag

SEQ ID NO: 8179772 - DNA, 22 bp, Homo sapiens
gctctctgcagcctccttggag

SEQ ID NO: 8179773 - DNA, 22 bp, Homo sapiens
gctctctgcagcctccttggag

SEQ ID NO: 8179774 - DNA, 21 bp, Homo sapiens
gctctctgcatggtggctcag

SEQ ID NO: 8179775 - DNA, 21 bp, Homo sapiens
gctctctgcatggtggctcag

SEQ ID NO: 8179776 - DNA, 21 bp, Homo sapiens
gctctctgcatggtggctcag

SEQ ID NO: 8179777 - DNA, 22 bp, Homo sapiens
gctctctgaggtgctggcagag

SEQ ID NO: 8179778 - DNA, 22 bp, Homo sapiens
gctctctgcaagtcagcagcct

SEQ ID NO: 8179779 - DNA, 22 bp, Homo sapiens
gctctctgcaagtcagcagcct

SEQ ID NO: 8179780 - DNA, 22 bp, Homo sapiens
gctctctccctaggcaagtgag

SEQ ID NO: 8179781 - DNA, 22 bp, Homo sapiens
gctctctcgtgaacaggtggtt

SEQ ID NO: 8179782 - DNA, 22 bp, Homo sapiens
gctctctcgtgaacaggtggtt

SEQ ID NO: 8179783 - DNA, 22 bp, Homo sapiens
gctctctccctaggcaagtgag

SEQ ID NO: 8179784 - DNA, 22 bp, Homo sapiens
gctctctccctaggcaagtgag

SEQ ID NO: 8179785 - DNA, 22 bp, Homo sapiens
gctctctcttggggattcagca

SEQ ID NO: 8179786 - DNA, 22 bp, Homo sapiens
gctctctcttggggattcagca

SEQ ID NO: 8179787 - DNA, 22 bp, Homo sapiens
gctctctcgtgaacaggtggtt

SEQ ID NO: 8179788 - DNA, 22 bp, Homo sapiens
gctctctcgtgaacaggtggtt

SEQ ID NO: 8179789 - DNA, 22 bp, Homo sapiens
gctctctgaggtgctggcagag

SEQ ID NO: 8179790 - DNA, 22 bp, Homo sapiens
gctctctgaggtgctggcagag

SEQ ID NO: 8179791 - DNA, 22 bp, Homo sapiens
gctcccaggaagagaagggcca

SEQ ID NO: 8179792 - DNA, 22 bp, Homo sapiens
gctcccaggatgaggagccagg

SEQ ID NO: 8179793 - DNA, 22 bp, Homo sapiens
gctcccagctggagcctcaaca

SEQ ID NO: 8179794 - DNA, 20 bp, Homo sapiens
gctcccagcctgcagtcccc

SEQ ID NO: 8179795 - DNA, 20 bp, Homo sapiens
gctcccagcctgcagtcccc

SEQ ID NO: 8179796 - DNA, 22 bp, Homo sapiens
gctcccagcattgcttcccagg

SEQ ID NO: 8179797 - DNA, 22 bp, Homo sapiens
gctcccagcattgcttcccagg

SEQ ID NO: 8179798 - DNA, 22 bp, Homo sapiens
gctcccagcattgcttcccagg

SEQ ID NO: 8179799 - DNA, 20 bp, Homo sapiens
gctcccagcctgcagtcccc

SEQ ID NO: 8179800 - DNA, 20 bp, Homo sapiens
gctcccagcctgcagtcccc

SEQ ID NO: 8179801 - DNA, 22 bp, Homo sapiens
gctccccttggtcctcctggga

SEQ ID NO: 8179802 - DNA, 22 bp, Homo sapiens
gctccccattgatctgcaggct

SEQ ID NO: 8179803 - DNA, 22 bp, Homo sapiens
gctccccattgatctgcaggct

SEQ ID NO: 8179804 - DNA, 22 bp, Homo sapiens
gctccccattgatctgcaggct

SEQ ID NO: 8179805 - DNA, 22 bp, Homo sapiens
gctccccattgatctgcaggct

SEQ ID NO: 8179806 - DNA, 22 bp, Homo sapiens
gctccccattgatctgcaggct

SEQ ID NO: 8179807 - DNA, 22 bp, Homo sapiens
gctccccattgatctgcaggct

SEQ ID NO: 8179808 - DNA, 22 bp, Homo sapiens
gctccccaggctggtcccctcg

SEQ ID NO: 8179809 - DNA, 22 bp, Homo sapiens
gctcccaggatgaggagccagg

SEQ ID NO: 8179810 - DNA, 22 bp, Homo sapiens
gctcccaggatgaggagccagg

SEQ ID NO: 8179811 - DNA, 22 bp, Homo sapiens
gctccctcccaccagcctgcag

SEQ ID NO: 8179812 - DNA, 22 bp, Homo sapiens
gctccctccatgaggcagaccg

SEQ ID NO: 8179813 - DNA, 22 bp, Homo sapiens
gctccctccatgaggcagaccg

SEQ ID NO: 8179814 - DNA, 22 bp, Homo sapiens
gctccctcatctgtgctgtttt

SEQ ID NO: 8179815 - DNA, 22 bp, Homo sapiens
gctccctatttggccttctctg

SEQ ID NO: 8179816 - DNA, 22 bp, Homo sapiens
gctccctaatttgttaatgctg

SEQ ID NO: 8179817 - DNA, 22 bp, Homo sapiens
gctccctcatctgtgctgtttt

SEQ ID NO: 8179818 - DNA, 22 bp, Homo sapiens
gctgcaggggggtctggacttg

SEQ ID NO: 8179819 - DNA, 22 bp, Homo sapiens
gctgcaggggggtctggacttg

SEQ ID NO: 8179820 - DNA, 22 bp, Homo sapiens
gctgcctccaatctgtgccccg

SEQ ID NO: 8179821 - DNA, 22 bp, Homo sapiens
gctgcaggggggtctggacttg

SEQ ID NO: 8179822 - DNA, 22 bp, Homo sapiens
gctgcaggggggtctggacttg

SEQ ID NO: 8179823 - DNA, 22 bp, Homo sapiens
gctgcagggctctcacaggggg

SEQ ID NO: 8179824 - DNA, 22 bp, Homo sapiens
gctgcagggctctcacaggggg

SEQ ID NO: 8179825 - DNA, 22 bp, Homo sapiens
gctgcagggctctcacaggggg

SEQ ID NO: 8179826 - DNA, 21 bp, Homo sapiens
gctgcagggcccagggcaccc

SEQ ID NO: 8179827 - DNA, 21 bp, Homo sapiens
gctgcagggcccagggcaccc

SEQ ID NO: 8179828 - DNA, 21 bp, Homo sapiens
gctgcagggcccagggcaccc

SEQ ID NO: 8179829 - DNA, 21 bp, Homo sapiens
gctgcagggcccagggcaccc

SEQ ID NO: 8179830 - DNA, 21 bp, Homo sapiens
gctgcagggcccagggcaccc

SEQ ID NO: 8179831 - DNA, 22 bp, Homo sapiens
gctgcagggagctggaaggctc

SEQ ID NO: 8179832 - DNA, 22 bp, Homo sapiens
gctgcagggagctggaaggctc

SEQ ID NO: 8179833 - DNA, 22 bp, Homo sapiens
gctgcagggagctggaaggctc

SEQ ID NO: 8179834 - DNA, 22 bp, Homo sapiens
gctgcagggagctggaaggctc

SEQ ID NO: 8179835 - DNA, 22 bp, Homo sapiens
gctgcagggagctggaaggctc

SEQ ID NO: 8179836 - DNA, 22 bp, Homo sapiens
gctgcagggaatgtatggattt

SEQ ID NO: 8179837 - DNA, 22 bp, Homo sapiens
gctgcaggctgtggcaggggag

SEQ ID NO: 8179838 - DNA, 22 bp, Homo sapiens
gctgcaggctgtggcaggggag

SEQ ID NO: 8179839 - DNA, 22 bp, Homo sapiens
gctgcagggagctggaaggctc

SEQ ID NO: 8179840 - DNA, 22 bp, Homo sapiens
gctgcagggaatgtatggattt

SEQ ID NO: 8179841 - DNA, 22 bp, Homo sapiens
gctgcagggagctggaaggctc

SEQ ID NO: 8179842 - DNA, 22 bp, Homo sapiens
gctgcagggagctggaaggctc

SEQ ID NO: 8179843 - DNA, 22 bp, Homo sapiens
gctgcaggcggccgtggtggcg

SEQ ID NO: 8179844 - DNA, 22 bp, Homo sapiens
gctgcaggcggccgtggtggcg

SEQ ID NO: 8179845 - DNA, 22 bp, Homo sapiens
gctgcaggcggccgtggtggcg

SEQ ID NO: 8179846 - DNA, 22 bp, Homo sapiens
gctgcaggctgtggcaggggag

SEQ ID NO: 8179847 - DNA, 22 bp, Homo sapiens
gctgcaggctgtggcaggggag

SEQ ID NO: 8179848 - DNA, 22 bp, Homo sapiens
gctgcaggctctgcaggaattg

SEQ ID NO: 8179849 - DNA, 22 bp, Homo sapiens
gctgcaggctctgcaggaattg

SEQ ID NO: 8179850 - DNA, 22 bp, Homo sapiens
gctgcaggctctgcaggaattg

SEQ ID NO: 8179851 - DNA, 22 bp, Homo sapiens
gctgcctcccagagccctgcag

SEQ ID NO: 8179852 - DNA, 22 bp, Homo sapiens
gctgcctcccagagccctgcag

SEQ ID NO: 8179853 - DNA, 22 bp, Homo sapiens
gctgcctcccagagccctgcag

SEQ ID NO: 8179854 - DNA, 22 bp, Homo sapiens
gctgcctcccagagccctgcag

SEQ ID NO: 8179855 - DNA, 22 bp, Homo sapiens
gctgcctccactggctcccagt

SEQ ID NO: 8179856 - DNA, 22 bp, Homo sapiens
gctgcctccactggctcccagt

SEQ ID NO: 8179857 - DNA, 22 bp, Homo sapiens
gctgcctccactggctcccagt

SEQ ID NO: 8179858 - DNA, 22 bp, Homo sapiens
gctgcctccactggctcccagt

SEQ ID NO: 8179859 - DNA, 22 bp, Homo sapiens
gctgcctccactggctcccagt

SEQ ID NO: 8179860 - DNA, 22 bp, Homo sapiens
gctgcctccgccggctccacag

SEQ ID NO: 8179861 - DNA, 22 bp, Homo sapiens
gctgcctccgccggctccacag

SEQ ID NO: 8179862 - DNA, 22 bp, Homo sapiens
gctgcctccgccggctccacag

SEQ ID NO: 8179863 - DNA, 22 bp, Homo sapiens
gctgcctccgccggctccacag

SEQ ID NO: 8179864 - DNA, 22 bp, Homo sapiens
gctgcctcccccatggctggaa

SEQ ID NO: 8179865 - DNA, 22 bp, Homo sapiens
gctgcctccgccggctccacag

SEQ ID NO: 8179866 - DNA, 22 bp, Homo sapiens
gctgcctcccccatggctggaa

SEQ ID NO: 8179867 - DNA, 22 bp, Homo sapiens
gctgcctctcctgagttgacag

SEQ ID NO: 8179868 - DNA, 22 bp, Homo sapiens
gctgcctctgcacagctcactc

SEQ ID NO: 8179869 - DNA, 22 bp, Homo sapiens
gctgcctctgcacagctcactc

SEQ ID NO: 8179870 - DNA, 22 bp, Homo sapiens
gctgcctctgcgactctgggcg

SEQ ID NO: 8179871 - DNA, 22 bp, Homo sapiens
gctgcctctgcgactctgggcg

SEQ ID NO: 8179872 - DNA, 22 bp, Homo sapiens
gctgcctcctgaaagcgctctg

SEQ ID NO: 8179873 - DNA, 23 bp, Homo sapiens
gctgcctcctacaaaagcccagc

SEQ ID NO: 8179874 - DNA, 22 bp, Homo sapiens
gctgcctcctgaaagcgctctg

SEQ ID NO: 8179875 - DNA, 22 bp, Homo sapiens
gctgcctctcctgagttgacag

SEQ ID NO: 8179876 - DNA, 22 bp, Homo sapiens
gctgcctcctgaaagcgctctg

SEQ ID NO: 8179877 - DNA, 22 bp, Homo sapiens
gctgcctcctgagatttgggca

SEQ ID NO: 8179878 - DNA, 22 bp, Homo sapiens
gctctgtggcattcatgggcag

SEQ ID NO: 8179879 - DNA, 22 bp, Homo sapiens
gctctgtggtggggcagagttt

SEQ ID NO: 8179880 - DNA, 22 bp, Homo sapiens
gctctgtggtggggcagagttt

SEQ ID NO: 8179881 - DNA, 20 bp, Homo sapiens
gctctgtggtttgagtctcc

SEQ ID NO: 8179882 - DNA, 22 bp, Homo sapiens
gctctgtggtggggcagagttt

SEQ ID NO: 8179883 - DNA, 20 bp, Homo sapiens
gctctgtggtttgagtctcc

SEQ ID NO: 8179884 - DNA, 22 bp, Homo sapiens
gctctgtgtatgtggcaggtgc

SEQ ID NO: 8179885 - DNA, 22 bp, Homo sapiens
gctctgtgtatgtggcaggtgc

SEQ ID NO: 8179886 - DNA, 22 bp, Homo sapiens
gctctgtgtaaatgtagggtcc

SEQ ID NO: 8179887 - DNA, 22 bp, Homo sapiens
gctctgtgtaaatgtagggtcc

SEQ ID NO: 8179888 - DNA, 22 bp, Homo sapiens
gctgagggtaacacttcgggat

SEQ ID NO: 8179889 - DNA, 23 bp, Homo sapiens
gctgaggtacatttacaggaaga

SEQ ID NO: 8179890 - DNA, 22 bp, Homo sapiens
gctctgtgtccacagctggaaa

SEQ ID NO: 8179891 - DNA, 22 bp, Homo sapiens
gctctgtgtccacagctggaaa

SEQ ID NO: 8179892 - DNA, 20 bp, Homo sapiens
gctgaggggtctatggcata

SEQ ID NO: 8179893 - DNA, 20 bp, Homo sapiens
gctgaggggtctatggcata

SEQ ID NO: 8179894 - DNA, 20 bp, Homo sapiens
gctgaggggtctatggcata

SEQ ID NO: 8179895 - DNA, 22 bp, Homo sapiens
gctgagggggaaggaaagctga

SEQ ID NO: 8179896 - DNA, 22 bp, Homo sapiens
gctgaggtttcaggagtggcag

SEQ ID NO: 8179897 - DNA, 22 bp, Homo sapiens
gctgaggtgtcaccttgctggg

SEQ ID NO: 8179898 - DNA, 22 bp, Homo sapiens
gctgaggtgtcaccttgctggg

SEQ ID NO: 8179899 - DNA, 22 bp, Homo sapiens
gctgaggtgtcaccttgctggg

SEQ ID NO: 8179900 - DNA, 18 bp, Homo sapiens
gctgaggtggtgtcagag

SEQ ID NO: 8179901 - DNA, 22 bp, Homo sapiens
gctgaggtggctgccttagtaa

SEQ ID NO: 8179902 - DNA, 22 bp, Homo sapiens
gctgaggtggtgatggttcatc

SEQ ID NO: 8179903 - DNA, 22 bp, Homo sapiens
gctgaggtggctgccttagtaa

SEQ ID NO: 8179904 - DNA, 22 bp, Homo sapiens
gctgaggtggctgccttagtaa

SEQ ID NO: 8179905 - DNA, 22 bp, Homo sapiens
gctgaggtggtgatggttcatc

SEQ ID NO: 8179906 - DNA, 18 bp, Homo sapiens
gctgaggtggtgtcagag

SEQ ID NO: 8179907 - DNA, 20 bp, Homo sapiens
gctgaggtttcttcctatat

SEQ ID NO: 8179908 - DNA, 22 bp, Homo sapiens
gctgaggtttcaggagtggcag

SEQ ID NO: 8179909 - DNA, 22 bp, Homo sapiens
gctgaggtttcaggagtggcag

SEQ ID NO: 8179910 - DNA, 22 bp, Homo sapiens
gctgaggttttctgcctgctca

SEQ ID NO: 8179911 - DNA, 22 bp, Homo sapiens
gctgaggtttcaggagtggcag

SEQ ID NO: 8179912 - DNA, 20 bp, Homo sapiens
gctgaggtttcttcctatat

SEQ ID NO: 8179913 - DNA, 22 bp, Homo sapiens
gctgaggtttcaggagtggcag

SEQ ID NO: 8179914 - DNA, 22 bp, Homo sapiens
gctgagtcttgagcactgagca

SEQ ID NO: 8179915 - DNA, 22 bp, Homo sapiens
gctgagtcttgagcactgagca

SEQ ID NO: 8179916 - DNA, 22 bp, Homo sapiens
gctgagtcttgagcactgagca

SEQ ID NO: 8179917 - DNA, 22 bp, Homo sapiens
gctgagtcagattgcagtcttg

SEQ ID NO: 8179918 - DNA, 22 bp, Homo sapiens
gctgaggttttctgcctgctca

SEQ ID NO: 8179919 - DNA, 22 bp, Homo sapiens
gctgagtcagattgcagtcttg

SEQ ID NO: 8179920 - DNA, 22 bp, Homo sapiens
gctgagtgaggtccagagcttg

SEQ ID NO: 8179921 - DNA, 22 bp, Homo sapiens
gctgagtgaggtccagagcttg

SEQ ID NO: 8179922 - DNA, 22 bp, Homo sapiens
gctgagtgattcatacgctgct

SEQ ID NO: 8179923 - DNA, 22 bp, Homo sapiens
gctgagtgattcatacgctgct

SEQ ID NO: 8179924 - DNA, 17 bp, Homo sapiens
gctgagtgcagggagtc

SEQ ID NO: 8179925 - DNA, 22 bp, Homo sapiens
gctgagtgattgatattttagt

SEQ ID NO: 8179926 - DNA, 22 bp, Homo sapiens
gctgagtgaggaaaaggttata

SEQ ID NO: 8179927 - DNA, 22 bp, Homo sapiens
gctgagtgaaagtttgctgtgt

SEQ ID NO: 8179928 - DNA, 22 bp, Homo sapiens
gctgagtgaaagtttgctgtgt

SEQ ID NO: 8179929 - DNA, 22 bp, Homo sapiens
gctgagtgaaagtttgctgtgt

SEQ ID NO: 8179930 - DNA, 22 bp, Homo sapiens
gctgagtcttgcctgtgctgtc

SEQ ID NO: 8179931 - DNA, 22 bp, Homo sapiens
gctgagtgaggtccagagcttg

SEQ ID NO: 8179932 - DNA, 22 bp, Homo sapiens
gctgagtgaggctgtcaaaatg

SEQ ID NO: 8179933 - DNA, 22 bp, Homo sapiens
gctgagtgaggaaaaggttata

SEQ ID NO: 8179934 - DNA, 22 bp, Homo sapiens
gctgagttgaaagcagaggata

SEQ ID NO: 8179935 - DNA, 22 bp, Homo sapiens
gctgagtgtaatgatggcagag

SEQ ID NO: 8179936 - DNA, 22 bp, Homo sapiens
gctgagttgaaagcagaggata

SEQ ID NO: 8179937 - DNA, 22 bp, Homo sapiens
gctgagtgtaatgatggcagag

SEQ ID NO: 8179938 - DNA, 22 bp, Homo sapiens
gctgagttgaaagcagaggata

SEQ ID NO: 8179939 - DNA, 22 bp, Homo sapiens
gctgagtgtaatgatggcagag

SEQ ID NO: 8179940 - DNA, 22 bp, Homo sapiens
gctgagtgtaatgatggcagag

SEQ ID NO: 8179941 - DNA, 22 bp, Homo sapiens
gctgagtgtaatgatggcagag

SEQ ID NO: 8179942 - DNA, 22 bp, Homo sapiens
gctgagtggagcagtcagcgct

SEQ ID NO: 8179943 - DNA, 22 bp, Homo sapiens
gctgagtggagcagtcagcgct

SEQ ID NO: 8179944 - DNA, 17 bp, Homo sapiens
gctgagtgcagggagtc

SEQ ID NO: 8179945 - DNA, 17 bp, Homo sapiens
gctgagtgcagggagtc

SEQ ID NO: 8179946 - DNA, 17 bp, Homo sapiens
gctgagtgcagggagtc

SEQ ID NO: 8179947 - DNA, 22 bp, Homo sapiens
gctgagtgattgatattttagt

SEQ ID NO: 8179948 - DNA, 22 bp, Homo sapiens
gctgcaggcattttcctgggca

SEQ ID NO: 8179949 - DNA, 22 bp, Homo sapiens
gctgcaggcattttcctgggca

SEQ ID NO: 8179950 - DNA, 22 bp, Homo sapiens
gctgcaggcattttcctgggca

SEQ ID NO: 8179951 - DNA, 22 bp, Homo sapiens
gctgcaggcagaatctcccaat

SEQ ID NO: 8179952 - DNA, 22 bp, Homo sapiens
gctgcaggcagaatctcccaat

SEQ ID NO: 8179953 - DNA, 22 bp, Homo sapiens
gctgatagactgaatgttggga

SEQ ID NO: 8179954 - DNA, 22 bp, Homo sapiens
gctgataagagggcaatgagtg

SEQ ID NO: 8179955 - DNA, 23 bp, Homo sapiens
gctgataatgcattctgtttaat

SEQ ID NO: 8179956 - DNA, 22 bp, Homo sapiens
gctgataaatagttgatgtacc

SEQ ID NO: 8179957 - DNA, 22 bp, Homo sapiens
gctgataaattacccagcatct

SEQ ID NO: 8179958 - DNA, 22 bp, Homo sapiens
gctgataagaagacccatcctg

SEQ ID NO: 8179959 - DNA, 22 bp, Homo sapiens
gctgataaatagttgatgtacc

SEQ ID NO: 8179960 - DNA, 18 bp, Homo sapiens
gctgcaggcgcctgcggt

SEQ ID NO: 8179961 - DNA, 18 bp, Homo sapiens
gctgcaggccctccgagg

SEQ ID NO: 8179962 - DNA, 22 bp, Homo sapiens
gctgcaggcattttcctgggca

SEQ ID NO: 8179963 - DNA, 22 bp, Homo sapiens
gctgcaggcattttcctgggca

SEQ ID NO: 8179964 - DNA, 22 bp, Homo sapiens
gctgcaggcgcctgcggtctct

SEQ ID NO: 8179965 - DNA, 22 bp, Homo sapiens
gctgcaggcgcctgcggtctct

SEQ ID NO: 8179966 - DNA, 18 bp, Homo sapiens
gctgcaggcgcctgcggt

SEQ ID NO: 8179967 - DNA, 18 bp, Homo sapiens
gctgcaggcgcctgcggt

SEQ ID NO: 8179968 - DNA, 18 bp, Homo sapiens
gctgcaggcgcctgcggt

SEQ ID NO: 8179969 - DNA, 22 bp, Homo sapiens
gctggaggtttcacctgagttt

SEQ ID NO: 8179970 - DNA, 22 bp, Homo sapiens
gctggaggtggtgagaaaaggt

SEQ ID NO: 8179971 - DNA, 22 bp, Homo sapiens
gctggaggtagggaggtcctgt

SEQ ID NO: 8179972 - DNA, 22 bp, Homo sapiens
gctggaggtagggaggtcctgt

SEQ ID NO: 8179973 - DNA, 22 bp, Homo sapiens
gctggaggtagggaggtcctgt

SEQ ID NO: 8179974 - DNA, 22 bp, Homo sapiens
gctggaggtttcacctgagttt

SEQ ID NO: 8179975 - DNA, 22 bp, Homo sapiens
gctggaggtttcacctgagttt

SEQ ID NO: 8179976 - DNA, 22 bp, Homo sapiens
gctggagtaggaccatgcttga

SEQ ID NO: 8179977 - DNA, 22 bp, Homo sapiens
gctggagtacatctttggcggc

SEQ ID NO: 8179978 - DNA, 22 bp, Homo sapiens
gctggagtaggaccatgcttga

SEQ ID NO: 8179979 - DNA, 22 bp, Homo sapiens
gctggagtacatctttggcggc

SEQ ID NO: 8179980 - DNA, 22 bp, Homo sapiens
gctggagtaggaccatgcttga

SEQ ID NO: 8179981 - DNA, 22 bp, Homo sapiens
gctggagtatctggggaaggag

SEQ ID NO: 8179982 - DNA, 19 bp, Homo sapiens
gctggagtcacttttgaga

SEQ ID NO: 8179983 - DNA, 22 bp, Homo sapiens
gctggagtatctggggaaggag

SEQ ID NO: 8179984 - DNA, 22 bp, Homo sapiens
gctggagtatctggggaaggag

SEQ ID NO: 8179985 - DNA, 22 bp, Homo sapiens
gctggagtccagtggcatgatc

SEQ ID NO: 8179986 - DNA, 22 bp, Homo sapiens
gctggagtccagtggcatgatc

SEQ ID NO: 8179987 - DNA, 22 bp, Homo sapiens
gctggagtccagtggcatgatc

SEQ ID NO: 8179988 - DNA, 19 bp, Homo sapiens
gctggagtcacttttgaga

SEQ ID NO: 8179989 - DNA, 22 bp, Homo sapiens
gctggagtcttgaaagtggact

SEQ ID NO: 8179990 - DNA, 22 bp, Homo sapiens
gctggagtctggaggtgtgcca

SEQ ID NO: 8179991 - DNA, 22 bp, Homo sapiens
gctggagtgagggaccatattt

SEQ ID NO: 8179992 - DNA, 22 bp, Homo sapiens
gctggagtcttgaaagtggact

SEQ ID NO: 8179993 - DNA, 22 bp, Homo sapiens
gctggagtgatgcctgtgtctc

SEQ ID NO: 8179994 - DNA, 22 bp, Homo sapiens
gctggagtgatgcctgtgtctc

SEQ ID NO: 8179995 - DNA, 22 bp, Homo sapiens
gctggagtgatgcctgtgtctc

SEQ ID NO: 8179996 - DNA, 22 bp, Homo sapiens
gctggagtgatgcctgtgtctc

SEQ ID NO: 8179997 - DNA, 22 bp, Homo sapiens
gctggagtgagtatgtgtagtc

SEQ ID NO: 8179998 - DNA, 22 bp, Homo sapiens
gctggagtgagtatgtgtagtc

SEQ ID NO: 8179999 - DNA, 22 bp, Homo sapiens
gctggagtctacattcaagaat

SEQ ID NO: 8180000 - DNA, 22 bp, Homo sapiens
gctggagtctggaggtgtgcca

SEQ ID NO: 8180001 - DNA, 22 bp, Homo sapiens
gctggagtctggaggtgtgcca

SEQ ID NO: 8180002 - DNA, 22 bp, Homo sapiens
gctggagtccagtggtatgatc

SEQ ID NO: 8180003 - DNA, 22 bp, Homo sapiens
gctggagtccagtggtatgatc

SEQ ID NO: 8180004 - DNA, 16 bp, Homo sapiens
gctggagtcctggagc

SEQ ID NO: 8180005 - DNA, 16 bp, Homo sapiens
gctggagtcctggagc

SEQ ID NO: 8180006 - DNA, 22 bp, Homo sapiens
gctggagtccctgcctttcctt

SEQ ID NO: 8180007 - DNA, 22 bp, Homo sapiens
gctggagtccctgcctttcctt

SEQ ID NO: 8180008 - DNA, 22 bp, Homo sapiens
gctggagtgctggagtgcagtg

SEQ ID NO: 8180009 - DNA, 22 bp, Homo sapiens
gctggagttagaactagcctgg

SEQ ID NO: 8180010 - DNA, 22 bp, Homo sapiens
gctggagttagaactagcctgg

SEQ ID NO: 8180011 - DNA, 22 bp, Homo sapiens
gctggagttagaactagcctgg

SEQ ID NO: 8180012 - DNA, 22 bp, Homo sapiens
gctggagttaggtgggcttgaa

SEQ ID NO: 8180013 - DNA, 22 bp, Homo sapiens
gctggagttaggtgggcttgaa

SEQ ID NO: 8180014 - DNA, 22 bp, Homo sapiens
gctggagtgctgaggtgcagtg

SEQ ID NO: 8180015 - DNA, 22 bp, Homo sapiens
gctggagtgcagttgcacagtc

SEQ ID NO: 8180016 - DNA, 22 bp, Homo sapiens
gctggcaggtccaagatagagc

SEQ ID NO: 8180017 - DNA, 22 bp, Homo sapiens
gctggcaggtccaagatagagc

SEQ ID NO: 8180018 - DNA, 22 bp, Homo sapiens
gctggcaggtccaagatagagc

SEQ ID NO: 8180019 - DNA, 22 bp, Homo sapiens
gctggcaggtccaagatagagc

SEQ ID NO: 8180020 - DNA, 22 bp, Homo sapiens
gctggcaggtccaagatagagc

SEQ ID NO: 8180021 - DNA, 22 bp, Homo sapiens
gctggcaggtaaagccccgggg

SEQ ID NO: 8180022 - DNA, 22 bp, Homo sapiens
gctggcaggtaaagccccgggg

SEQ ID NO: 8180023 - DNA, 22 bp, Homo sapiens
gctggcaggtaaagccccgggg

SEQ ID NO: 8180024 - DNA, 22 bp, Homo sapiens
gctggcaggtaaagccccgggg

SEQ ID NO: 8180025 - DNA, 22 bp, Homo sapiens
gctggcaggtaaagccccgggg

SEQ ID NO: 8180026 - DNA, 22 bp, Homo sapiens
gctggcagggttctcactgaaa

SEQ ID NO: 8180027 - DNA, 22 bp, Homo sapiens
gctggcagggttctcactgaaa

SEQ ID NO: 8180028 - DNA, 22 bp, Homo sapiens
gctggcaggtaaagccccgggg

SEQ ID NO: 8180029 - DNA, 22 bp, Homo sapiens
gctggagttggcaaggcatgta

SEQ ID NO: 8180030 - DNA, 22 bp, Homo sapiens
gctggagttaggtgggcttgaa

SEQ ID NO: 8180031 - DNA, 22 bp, Homo sapiens
gctggagttggcaaggcatgta

SEQ ID NO: 8180032 - DNA, 22 bp, Homo sapiens
gctggagttgtgggtttactaa

SEQ ID NO: 8180033 - DNA, 22 bp, Homo sapiens
gctggagttggcaaggcatgta

SEQ ID NO: 8180034 - DNA, 22 bp, Homo sapiens
gctggagttgtgggtttactaa

SEQ ID NO: 8180035 - DNA, 22 bp, Homo sapiens
gctggcagggtggttgagagag

SEQ ID NO: 8180036 - DNA, 22 bp, Homo sapiens
gctggcagggtggttgagagag

SEQ ID NO: 8180037 - DNA, 22 bp, Homo sapiens
gctggcagggttctcactgaaa

SEQ ID NO: 8180038 - DNA, 22 bp, Homo sapiens
gctggcagggtggttgagagag

SEQ ID NO: 8180039 - DNA, 19 bp, Homo sapiens
gctggatggatcctggagt

SEQ ID NO: 8180040 - DNA, 22 bp, Homo sapiens
gctggcagtgtattgttagctg

SEQ ID NO: 8180041 - DNA, 22 bp, Homo sapiens
gctggcagtgtattgttagctg

SEQ ID NO: 8180042 - DNA, 22 bp, Homo sapiens
gctggcagtcccatcagctggg

SEQ ID NO: 8180043 - DNA, 22 bp, Homo sapiens
gctggcagtcccatcagctggg

SEQ ID NO: 8180044 - DNA, 22 bp, Homo sapiens
gctggcagtcccatcagctggg

SEQ ID NO: 8180045 - DNA, 22 bp, Homo sapiens
gctggcagtcccatcagctggg

SEQ ID NO: 8180046 - DNA, 22 bp, Homo sapiens
gctggcagtcccatcagctggg

SEQ ID NO: 8180047 - DNA, 22 bp, Homo sapiens
gctggcagtaaagggtttggca

SEQ ID NO: 8180048 - DNA, 22 bp, Homo sapiens
gctggcagtcccatcagctggg

SEQ ID NO: 8180049 - DNA, 22 bp, Homo sapiens
gctggcagtaaagggtttggca

SEQ ID NO: 8180050 - DNA, 22 bp, Homo sapiens
gctggcagtaaagggtttggca

SEQ ID NO: 8180051 - DNA, 22 bp, Homo sapiens
gctggcagtaaagggtttggca

SEQ ID NO: 8180052 - DNA, 22 bp, Homo sapiens
gctggcagtaaagggtttggca

SEQ ID NO: 8180053 - DNA, 22 bp, Homo sapiens
gctggcagtgtgaatgacaagc

SEQ ID NO: 8180054 - DNA, 22 bp, Homo sapiens
gctggcagtgtgaatgacaagc

SEQ ID NO: 8180055 - DNA, 22 bp, Homo sapiens
gctggcagtttcctcaccgagg

SEQ ID NO: 8180056 - DNA, 22 bp, Homo sapiens
gctggcagtttcctcaccgagg

SEQ ID NO: 8180057 - DNA, 22 bp, Homo sapiens
gctggcagtttcctcaccgagg

SEQ ID NO: 8180058 - DNA, 22 bp, Homo sapiens
gctggccaaagtgtacctggag

SEQ ID NO: 8180059 - DNA, 22 bp, Homo sapiens
gctggccaaagtgtacctggag

SEQ ID NO: 8180060 - DNA, 22 bp, Homo sapiens
gctggcatcactggcttcggtg

SEQ ID NO: 8180061 - DNA, 22 bp, Homo sapiens
gctggcatggagactctgggtc

SEQ ID NO: 8180062 - DNA, 22 bp, Homo sapiens
gctgctggaacaaatcacccca

SEQ ID NO: 8180063 - DNA, 22 bp, Homo sapiens
gctgctggaacaaatcacccca

SEQ ID NO: 8180064 - DNA, 22 bp, Homo sapiens
gctgctggaacaaatcacccca

SEQ ID NO: 8180065 - DNA, 19 bp, Homo sapiens
gctgctggctctggctgga

SEQ ID NO: 8180066 - DNA, 22 bp, Homo sapiens
gctgctggcgctgggcgtccgg

SEQ ID NO: 8180067 - DNA, 22 bp, Homo sapiens
gctgctggcgctgggcgtccgg

SEQ ID NO: 8180068 - DNA, 22 bp, Homo sapiens
gctgctggaagcatgcgatgaa

SEQ ID NO: 8180069 - DNA, 22 bp, Homo sapiens
gctgctggaagcatgcgatgaa

SEQ ID NO: 8180070 - DNA, 22 bp, Homo sapiens
gctgctggaagcatgcgatgaa

SEQ ID NO: 8180071 - DNA, 23 bp, Homo sapiens
gctgcctctgttggtcttcagtt

SEQ ID NO: 8180072 - DNA, 23 bp, Homo sapiens
gctgcctctgttggtcttcagtt

SEQ ID NO: 8180073 - DNA, 22 bp, Homo sapiens
gctgcctctgtagctttggacc

SEQ ID NO: 8180074 - DNA, 22 bp, Homo sapiens
gctgcctctgtagctttggacc

SEQ ID NO: 8180075 - DNA, 22 bp, Homo sapiens
gctgcctctgtagctttggacc

SEQ ID NO: 8180076 - DNA, 22 bp, Homo sapiens
gctgcctctgtagctttggacc

SEQ ID NO: 8180077 - DNA, 23 bp, Homo sapiens
gctgcctctgttggtcttcagtt

SEQ ID NO: 8180078 - DNA, 22 bp, Homo sapiens
gctgcctgaaatgttgcctagc

SEQ ID NO: 8180079 - DNA, 22 bp, Homo sapiens
gctgctgggaatgaacagtgtt

SEQ ID NO: 8180080 - DNA, 22 bp, Homo sapiens
gctgctgggagggatcgtaaat

SEQ ID NO: 8180081 - DNA, 22 bp, Homo sapiens
gctgctgggaatgaacagtgtt

SEQ ID NO: 8180082 - DNA, 22 bp, Homo sapiens
gctgctgggaatgaacagtgtt

SEQ ID NO: 8180083 - DNA, 19 bp, Homo sapiens
gctgctggctctggctgga

SEQ ID NO: 8180084 - DNA, 22 bp, Homo sapiens
gctgctggcttcctgctgtttt

SEQ ID NO: 8180085 - DNA, 19 bp, Homo sapiens
gctgctggctctggctgga

SEQ ID NO: 8180086 - DNA, 19 bp, Homo sapiens
gctgctggctctggctgga

SEQ ID NO: 8180087 - DNA, 22 bp, Homo sapiens
gctgctgggcaccccctgagct

SEQ ID NO: 8180088 - DNA, 22 bp, Homo sapiens
gctgctgggatcctgggtctca

SEQ ID NO: 8180089 - DNA, 22 bp, Homo sapiens
gctgctgggatcctgggtctca

SEQ ID NO: 8180090 - DNA, 22 bp, Homo sapiens
gctgctggggtcacatggtaag

SEQ ID NO: 8180091 - DNA, 22 bp, Homo sapiens
gctgctggggtcacatggtaag

SEQ ID NO: 8180092 - DNA, 22 bp, Homo sapiens
gctgctggggtcacatggtaag

SEQ ID NO: 8180093 - DNA, 22 bp, Homo sapiens
gctgctggggccttccctcggg

SEQ ID NO: 8180094 - DNA, 22 bp, Homo sapiens
gctgctggggtcacatggtaag

SEQ ID NO: 8180095 - DNA, 22 bp, Homo sapiens
gctggaggggtaataggatggg

SEQ ID NO: 8180096 - DNA, 22 bp, Homo sapiens
gctggaggggtaataggatggg

SEQ ID NO: 8180097 - DNA, 22 bp, Homo sapiens
gctggaggggtaataggatggg

SEQ ID NO: 8180098 - DNA, 22 bp, Homo sapiens
gctggaggggtaataggatggg

SEQ ID NO: 8180099 - DNA, 22 bp, Homo sapiens
gctggaggggtaataggatggg

SEQ ID NO: 8180100 - DNA, 22 bp, Homo sapiens
gctggaggggtaataggatggg

SEQ ID NO: 8180101 - DNA, 22 bp, Homo sapiens
gctggagcttgagaggacaggg

SEQ ID NO: 8180102 - DNA, 22 bp, Homo sapiens
gctggagcttgagaggacaggg

SEQ ID NO: 8180103 - DNA, 22 bp, Homo sapiens
gctggagcttgagaggacaggg

SEQ ID NO: 8180104 - DNA, 22 bp, Homo sapiens
gctggagcttgagaggacaggg

SEQ ID NO: 8180105 - DNA, 22 bp, Homo sapiens
gctggagctgcagcctgggcct

SEQ ID NO: 8180106 - DNA, 22 bp, Homo sapiens
gctggagctgcagcctgggcct

SEQ ID NO: 8180107 - DNA, 22 bp, Homo sapiens
gctgctgtctcatgcgatgcgg

SEQ ID NO: 8180108 - DNA, 22 bp, Homo sapiens
gctgctgtctcatgcgatgcgg

SEQ ID NO: 8180109 - DNA, 22 bp, Homo sapiens
gctgctgtccttcaagtctgcg

SEQ ID NO: 8180110 - DNA, 22 bp, Homo sapiens
gctgctgtccttagggagttct

SEQ ID NO: 8180111 - DNA, 22 bp, Homo sapiens
gctgctgtccttagggagttct

SEQ ID NO: 8180112 - DNA, 22 bp, Homo sapiens
gctgctgtcagtggtggcagtt

SEQ ID NO: 8180113 - DNA, 22 bp, Homo sapiens
gctgctgtcagtggtggcagtt

SEQ ID NO: 8180114 - DNA, 22 bp, Homo sapiens
gctgctgtcagtggtggcagtt

SEQ ID NO: 8180115 - DNA, 22 bp, Homo sapiens
gctgctgtcagtctgaatctga

SEQ ID NO: 8180116 - DNA, 22 bp, Homo sapiens
gctgctgtcagtggtggcagtt

SEQ ID NO: 8180117 - DNA, 22 bp, Homo sapiens
gctgctgtcagtggtggcagtt

SEQ ID NO: 8180118 - DNA, 22 bp, Homo sapiens
gctgctggtcctcagagctcat

SEQ ID NO: 8180119 - DNA, 22 bp, Homo sapiens
gctgctggtcctcagagctcat

SEQ ID NO: 8180120 - DNA, 22 bp, Homo sapiens
gctgctggtcctcagagctcat

SEQ ID NO: 8180121 - DNA, 22 bp, Homo sapiens
gctgctggggtggagaaacgct

SEQ ID NO: 8180122 - DNA, 22 bp, Homo sapiens
gctgctggtcctcagagctcat

SEQ ID NO: 8180123 - DNA, 22 bp, Homo sapiens
gctgctgggtccctctgtgcca

SEQ ID NO: 8180124 - DNA, 22 bp, Homo sapiens
gctgctgggtccctctgtgcca

SEQ ID NO: 8180125 - DNA, 18 bp, Homo sapiens
gctgctggtggagggagc

SEQ ID NO: 8180126 - DNA, 18 bp, Homo sapiens
gctgctggtggagggagc

SEQ ID NO: 8180127 - DNA, 18 bp, Homo sapiens
gctgctggtggagggagc

SEQ ID NO: 8180128 - DNA, 22 bp, Homo sapiens
gctgctgtaatgtgttaagtca

SEQ ID NO: 8180129 - DNA, 22 bp, Homo sapiens
gctgctgtacttggggggtgct

SEQ ID NO: 8180130 - DNA, 22 bp, Homo sapiens
gctgctgtaatgtgttaagtca

SEQ ID NO: 8180131 - DNA, 22 bp, Homo sapiens
gctgctgtaacactaagtgcag

SEQ ID NO: 8180132 - DNA, 22 bp, Homo sapiens
gctgctgtcacggtgctaaggg

SEQ ID NO: 8180133 - DNA, 22 bp, Homo sapiens
gctgctgtcagcaggccttgtt

SEQ ID NO: 8180134 - DNA, 22 bp, Homo sapiens
gctgctgtcagcaggccttgtt

SEQ ID NO: 8180135 - DNA, 22 bp, Homo sapiens
gctgctgtcacggtgctaaggg

SEQ ID NO: 8180136 - DNA, 22 bp, Homo sapiens
gctgctgtcacccacatctgtc

SEQ ID NO: 8180137 - DNA, 22 bp, Homo sapiens
gctgctgtacttggggggtgct

SEQ ID NO: 8180138 - DNA, 22 bp, Homo sapiens
gcttggcagggcctgctggagc

SEQ ID NO: 8180139 - DNA, 22 bp, Homo sapiens
gcttggcagcaacaggcatccc

SEQ ID NO: 8180140 - DNA, 22 bp, Homo sapiens
gcttggggtcatgaggctgctg

SEQ ID NO: 8180141 - DNA, 20 bp, Homo sapiens
gcttggcaggttttgttgcc

SEQ ID NO: 8180142 - DNA, 22 bp, Homo sapiens
gcttggtttggcaaaggaagga

SEQ ID NO: 8180143 - DNA, 22 bp, Homo sapiens
gcttaaattgtttgtggatagt

SEQ ID NO: 8180144 - DNA, 22 bp, Homo sapiens
gcttaaatcccaatgctagacc

SEQ ID NO: 8180145 - DNA, 22 bp, Homo sapiens
gcttggagatgggggatgagcc

SEQ ID NO: 8180146 - DNA, 22 bp, Homo sapiens
gcttggaagtaggattgggaga

SEQ ID NO: 8180147 - DNA, 22 bp, Homo sapiens
gcttggagtagaatgcattctt

SEQ ID NO: 8180148 - DNA, 22 bp, Homo sapiens
gcttgtttgtgatttctccaga

SEQ ID NO: 8180149 - DNA, 22 bp, Homo sapiens
gcttgtttctatttatcaagta

SEQ ID NO: 8180150 - DNA, 22 bp, Homo sapiens
gcttgtcattactggtttctcg

SEQ ID NO: 8180151 - DNA, 22 bp, Homo sapiens
gcttgtctgctgagccacctgt

SEQ ID NO: 8180152 - DNA, 22 bp, Homo sapiens
gctttaatgaagtcacgcaaag

SEQ ID NO: 8180153 - DNA, 22 bp, Homo sapiens
gctttacacagatgaatatttc

SEQ ID NO: 8180154 - DNA, 22 bp, Homo sapiens
gctttacatgtttccctttaag

SEQ ID NO: 8180155 - DNA, 22 bp, Homo sapiens
gctttacatgagatgaggacaa

SEQ ID NO: 8180156 - DNA, 22 bp, Homo sapiens
gctttacataaacatttattat

SEQ ID NO: 8180157 - DNA, 22 bp, Homo sapiens
gctttacaacaaattgaatatg

SEQ ID NO: 8180158 - DNA, 22 bp, Homo sapiens
gctttaatgcaatttcacctca

SEQ ID NO: 8180159 - DNA, 22 bp, Homo sapiens
gctttaatgcttcgtggggcca

SEQ ID NO: 8180160 - DNA, 22 bp, Homo sapiens
gctgtgtttgacagtagcagac

SEQ ID NO: 8180161 - DNA, 22 bp, Homo sapiens
gctgtgttggtgaagctgtagc

SEQ ID NO: 8180162 - DNA, 22 bp, Homo sapiens
gctgtgttttatgttaggttaa

SEQ ID NO: 8180163 - DNA, 22 bp, Homo sapiens
gctgtgtgttcaataatgtgat

SEQ ID NO: 8180164 - DNA, 22 bp, Homo sapiens
gctgtgtgttcaataatgtgat

SEQ ID NO: 8180165 - DNA, 22 bp, Homo sapiens
gctgtgtgttcaataatgtgat

SEQ ID NO: 8180166 - DNA, 22 bp, Homo sapiens
gctgtgtgctgggcatggcact

SEQ ID NO: 8180167 - DNA, 22 bp, Homo sapiens
gctgtgtgctgggcatggcact

SEQ ID NO: 8180168 - DNA, 22 bp, Homo sapiens
gctgtgtgctgggcatggcact

SEQ ID NO: 8180169 - DNA, 22 bp, Homo sapiens
gctgtgtggctgtgccgtcacg

SEQ ID NO: 8180170 - DNA, 22 bp, Homo sapiens
gctgtgtgctctggtctttctt

SEQ ID NO: 8180171 - DNA, 22 bp, Homo sapiens
gctgtgtgctgggcatggcact

SEQ ID NO: 8180172 - DNA, 22 bp, Homo sapiens
gctgtgtgctcacgtagtggaa

SEQ ID NO: 8180173 - DNA, 22 bp, Homo sapiens
gctgtttctttggcaaactgat

SEQ ID NO: 8180174 - DNA, 22 bp, Homo sapiens
gctgtttctgagtagctaggct

SEQ ID NO: 8180175 - DNA, 22 bp, Homo sapiens
gctgtttccagacaatgtcttt

SEQ ID NO: 8180176 - DNA, 22 bp, Homo sapiens
gctgtttccccttcacagtggc

SEQ ID NO: 8180177 - DNA, 18 bp, Homo sapiens
gctttttagtgcatcttc

SEQ ID NO: 8180178 - DNA, 22 bp, Homo sapiens
gcttttcttcagcagcctgatg

SEQ ID NO: 8180179 - DNA, 22 bp, Homo sapiens
gcttttttaggtaagacccagg

SEQ ID NO: 8180180 - DNA, 22 bp, Homo sapiens
gcttttttgctattgaagtggt

SEQ ID NO: 8180181 - DNA, 22 bp, Homo sapiens
gcttttttgggatgcctgcctt

SEQ ID NO: 8180182 - DNA, 22 bp, Homo sapiens
gctttttcaaatgaaagctggt

SEQ ID NO: 8180183 - DNA, 19 bp, Homo sapiens
gcttttattgctcaggtgc

SEQ ID NO: 8180184 - DNA, 22 bp, Homo sapiens
gcttttattgtctttacgacga

SEQ ID NO: 8180185 - DNA, 22 bp, Homo sapiens
gcttttatgcacataagggtca

SEQ ID NO: 8180186 - DNA, 22 bp, Homo sapiens
gcttttatttcttcacaaaagt

SEQ ID NO: 8180187 - DNA, 22 bp, Homo sapiens
gcttttatttcttcacaaaagt

SEQ ID NO: 8180188 - DNA, 22 bp, Homo sapiens
gcttttatttcttcacaaaagt

SEQ ID NO: 8180189 - DNA, 22 bp, Homo sapiens
gcttttctagctagaacatccg

SEQ ID NO: 8180190 - DNA, 22 bp, Homo sapiens
gcttttctccttagtgtccctg

SEQ ID NO: 8180191 - DNA, 22 bp, Homo sapiens
gcttttctccttagtgtccctg

SEQ ID NO: 8180192 - DNA, 19 bp, Homo sapiens
gcttttctccttcaagcca

SEQ ID NO: 8180193 - DNA, 22 bp, Homo sapiens
gcttttctagctagaacatccg

SEQ ID NO: 8180194 - DNA, 22 bp, Homo sapiens
gcttttctataagaactttcaa

SEQ ID NO: 8180195 - DNA, 22 bp, Homo sapiens
gcttttctataagaactttcaa

SEQ ID NO: 8180196 - DNA, 22 bp, Homo sapiens
gctttatccgcttgacccttac

SEQ ID NO: 8180197 - DNA, 21 bp, Homo sapiens
gctttagatttagtgagccag

SEQ ID NO: 8180198 - DNA, 22 bp, Homo sapiens
gctttagatagatttagtcttt

SEQ ID NO: 8180199 - DNA, 22 bp, Homo sapiens
gctttagatctgactttctgtg

SEQ ID NO: 8180200 - DNA, 22 bp, Homo sapiens
gctttagatactcccaatgtcc

SEQ ID NO: 8180201 - DNA, 22 bp, Homo sapiens
gctttagagcccagcttggtgg

SEQ ID NO: 8180202 - DNA, 22 bp, Homo sapiens
gctttagaaatatcactgtgga

SEQ ID NO: 8180203 - DNA, 22 bp, Homo sapiens
gctttagaaatgagtaaattag

SEQ ID NO: 8180204 - DNA, 22 bp, Homo sapiens
gctttagagaagaaaggttgct

SEQ ID NO: 8180205 - DNA, 22 bp, Homo sapiens
gctttagacataaagttcttca

SEQ ID NO: 8180206 - DNA, 22 bp, Homo sapiens
gctttagaaatgtaggagatac

SEQ ID NO: 8180207 - DNA, 22 bp, Homo sapiens
gctttagaagacactctgtttt

SEQ ID NO: 8180208 - DNA, 22 bp, Homo sapiens
gctttggtcaggtgtccagccc

SEQ ID NO: 8180209 - DNA, 22 bp, Homo sapiens
gctttggtacctcctgctgatc

SEQ ID NO: 8180210 - DNA, 22 bp, Homo sapiens
gctttggtgatacttgctggct

SEQ ID NO: 8180211 - DNA, 22 bp, Homo sapiens
gctttgtgaattattactcaca

SEQ ID NO: 8180212 - DNA, 22 bp, Homo sapiens
gctttatgctacgatttctagt

SEQ ID NO: 8180213 - DNA, 22 bp, Homo sapiens
gctttatggattgtaaactgca

SEQ ID NO: 8180214 - DNA, 22 bp, Homo sapiens
gctttatgagtgaggcaggata

SEQ ID NO: 8180215 - DNA, 22 bp, Homo sapiens
gctttatgcaaacctggtactt

SEQ ID NO: 8180216 - DNA, 22 bp, Homo sapiens
gctttatccgcttgacccttac

SEQ ID NO: 8180217 - DNA, 22 bp, Homo sapiens
gctttatgggccatgcggtgtc

SEQ ID NO: 8180218 - DNA, 22 bp, Homo sapiens
gctttggatgtgtgcctgaggt

SEQ ID NO: 8180219 - DNA, 20 bp, Homo sapiens
gctgtcccaggccaaagggc

SEQ ID NO: 8180220 - DNA, 20 bp, Homo sapiens
gctgtcccaggccaaagggc

SEQ ID NO: 8180221 - DNA, 22 bp, Homo sapiens
gctgtccatgtctggcctcagt

SEQ ID NO: 8180222 - DNA, 22 bp, Homo sapiens
gctgtccatgtctggcctcagt

SEQ ID NO: 8180223 - DNA, 22 bp, Homo sapiens
gctgtccatccacttcccagcg

SEQ ID NO: 8180224 - DNA, 22 bp, Homo sapiens
gctgtcccgaacccctggtaat

SEQ ID NO: 8180225 - DNA, 22 bp, Homo sapiens
gctgtcccgaacccctggtaat

SEQ ID NO: 8180226 - DNA, 22 bp, Homo sapiens
gctgtcccgaacccctggtaat

SEQ ID NO: 8180227 - DNA, 22 bp, Homo sapiens
gctgtcccatggttgcaagatg

SEQ ID NO: 8180228 - DNA, 23 bp, Homo sapiens
gctgtccccatgctccatccctg

SEQ ID NO: 8180229 - DNA, 22 bp, Homo sapiens
gctgtccagagcatgggagcaa

SEQ ID NO: 8180230 - DNA, 22 bp, Homo sapiens
gctgtccacggggttggtagag

SEQ ID NO: 8180231 - DNA, 22 bp, Homo sapiens
gctgtcagttttacccacagac

SEQ ID NO: 8180232 - DNA, 22 bp, Homo sapiens
gctgtcatagagtgggtgggcc

SEQ ID NO: 8180233 - DNA, 22 bp, Homo sapiens
gctgtccaggagtgcagagatt

SEQ ID NO: 8180234 - DNA, 22 bp, Homo sapiens
gctgtccagagcatgggagcaa

SEQ ID NO: 8180235 - DNA, 22 bp, Homo sapiens
gctgtcccgctgacttccagct

SEQ ID NO: 8180236 - DNA, 22 bp, Homo sapiens
gctgtcccgctgacttccagct

SEQ ID NO: 8180237 - DNA, 22 bp, Homo sapiens
gctgtcctcttggactcagggc

SEQ ID NO: 8180238 - DNA, 22 bp, Homo sapiens
gctgtcctctgatctctggagg

SEQ ID NO: 8180239 - DNA, 22 bp, Homo sapiens
gctgtctcatacaaggccctgc

SEQ ID NO: 8180240 - DNA, 22 bp, Homo sapiens
gctgtcctgggaacaggcacta

SEQ ID NO: 8180241 - DNA, 22 bp, Homo sapiens
gctgtcctggggagggagaatg

SEQ ID NO: 8180242 - DNA, 22 bp, Homo sapiens
gctgtctgggttgagggccctg

SEQ ID NO: 8180243 - DNA, 22 bp, Homo sapiens
gctgtctgtggtgtcagctgac

SEQ ID NO: 8180244 - DNA, 22 bp, Homo sapiens
gctgtctggcatggcgtggctg

SEQ ID NO: 8180245 - DNA, 22 bp, Homo sapiens
gctgtctgggatgtcactgctg

SEQ ID NO: 8180246 - DNA, 22 bp, Homo sapiens
gctgtctgggaggcctccactt

SEQ ID NO: 8180247 - DNA, 22 bp, Homo sapiens
gctgtctgctgtgcactgagca

SEQ ID NO: 8180248 - DNA, 22 bp, Homo sapiens
gctgtgtgacctgggcaagtct

SEQ ID NO: 8180249 - DNA, 19 bp, Homo sapiens
gctgtgtgaccttgggcaa

SEQ ID NO: 8180250 - DNA, 19 bp, Homo sapiens
gctgtgtgaccttgggcaa

SEQ ID NO: 8180251 - DNA, 19 bp, Homo sapiens
gctgtgtgaccttgggcaa

SEQ ID NO: 8180252 - DNA, 22 bp, Homo sapiens
gctgtgtgactgagagcctggc

SEQ ID NO: 8180253 - DNA, 22 bp, Homo sapiens
gctgtgtgactgagagcctggc

SEQ ID NO: 8180254 - DNA, 22 bp, Homo sapiens
gctgtgtgctcacgtagtggaa

SEQ ID NO: 8180255 - DNA, 22 bp, Homo sapiens
gctgtgtgctcacgtagtggaa

SEQ ID NO: 8180256 - DNA, 22 bp, Homo sapiens
gctgtgtgctcacgtagtggaa

SEQ ID NO: 8180257 - DNA, 22 bp, Homo sapiens
gctgtgtgctaggatatgtttt

SEQ ID NO: 8180258 - DNA, 22 bp, Homo sapiens
gctgtgtgccaggggaaggctg

SEQ ID NO: 8180259 - DNA, 22 bp, Homo sapiens
gctgtgtgccaggggaaggctg

SEQ ID NO: 8180260 - DNA, 22 bp, Homo sapiens
gctgtgtgccaggggaaggctg

SEQ ID NO: 8180261 - DNA, 22 bp, Homo sapiens
gctgtgtgactgagagcctggc

SEQ ID NO: 8180262 - DNA, 18 bp, Homo sapiens
gctgtgtgcacctgataa

SEQ ID NO: 8180263 - DNA, 22 bp, Homo sapiens
gctgtcacaaatatttctcagc

SEQ ID NO: 8180264 - DNA, 22 bp, Homo sapiens
gctgtattggaacacatccatg

SEQ ID NO: 8180265 - DNA, 22 bp, Homo sapiens
gctgtatttaacaactggctca

SEQ ID NO: 8180266 - DNA, 22 bp, Homo sapiens
gctgtattcctgcactgtatag

SEQ ID NO: 8180267 - DNA, 22 bp, Homo sapiens
gctgtagatggactggcatcca

SEQ ID NO: 8180268 - DNA, 22 bp, Homo sapiens
gctgtagggctgagctggaccg

SEQ ID NO: 8180269 - DNA, 22 bp, Homo sapiens
gctgtaggtaaggatggcaaag

SEQ ID NO: 8180270 - DNA, 17 bp, Homo sapiens
gctgtagtttgataaga

SEQ ID NO: 8180271 - DNA, 22 bp, Homo sapiens
gctgtagtgaatggccgcgttc

SEQ ID NO: 8180272 - DNA, 22 bp, Homo sapiens
gctgtagtgaatggccgcgttc

SEQ ID NO: 8180273 - DNA, 22 bp, Homo sapiens
gctgtcagtgaggtgagacatg

SEQ ID NO: 8180274 - DNA, 23 bp, Homo sapiens
gctgtcagttgtttttgtctcta

SEQ ID NO: 8180275 - DNA, 22 bp, Homo sapiens
gctgtcaggaacatgccttggt

SEQ ID NO: 8180276 - DNA, 22 bp, Homo sapiens
gctgtcaggccatgtgggcctt

SEQ ID NO: 8180277 - DNA, 22 bp, Homo sapiens
gctgtcagaaggtgaagggtaa

SEQ ID NO: 8180278 - DNA, 22 bp, Homo sapiens
gctgtcagcgcccaaggagctc

SEQ ID NO: 8180279 - DNA, 22 bp, Homo sapiens
gctgtcagaaggtgaagggtaa

SEQ ID NO: 8180280 - DNA, 22 bp, Homo sapiens
gctgtcagaaggtgaagggtaa

SEQ ID NO: 8180281 - DNA, 22 bp, Homo sapiens
gctgtcactctccggccttccc

SEQ ID NO: 8180282 - DNA, 22 bp, Homo sapiens
gctgtcactcaccaggcctgca

SEQ ID NO: 8180283 - DNA, 22 bp, Homo sapiens
gctgtcaccaaagcaggcactg

SEQ ID NO: 8180284 - DNA, 22 bp, Homo sapiens
gctgtcaccaaagcaggcactg

SEQ ID NO: 8180285 - DNA, 22 bp, Homo sapiens
gctgtcacatttggagcactgg

SEQ ID NO: 8180286 - DNA, 22 bp, Homo sapiens
gctgtcacatttggagcactgg

SEQ ID NO: 8180287 - DNA, 22 bp, Homo sapiens
gctgtcacacatgggatctcag

SEQ ID NO: 8180288 - DNA, 22 bp, Homo sapiens
gctgtcacatcaaggcactaaa

SEQ ID NO: 8180289 - DNA, 22 bp, Homo sapiens
gctgtcacatcaaggcactaaa

SEQ ID NO: 8180290 - DNA, 22 bp, Homo sapiens
gctgtcacaaattgggttcttt

SEQ ID NO: 8180291 - DNA, 22 bp, Homo sapiens
gctgtcacaagcatctggggca

SEQ ID NO: 8180292 - DNA, 22 bp, Homo sapiens
gctgtcacacatggccccagct

SEQ ID NO: 8180293 - DNA, 22 bp, Homo sapiens
gctgtcacacatgggatctcag

SEQ ID NO: 8180294 - DNA, 19 bp, Homo sapiens
gctggccacgccccagttg

SEQ ID NO: 8180295 - DNA, 19 bp, Homo sapiens
gctggccacgccccagttg

SEQ ID NO: 8180296 - DNA, 22 bp, Homo sapiens
gctggccacattgtgccgtcct

SEQ ID NO: 8180297 - DNA, 22 bp, Homo sapiens
gctggccacattgtgccgtcct

SEQ ID NO: 8180298 - DNA, 22 bp, Homo sapiens
gctggccacattgtgccgtcct

SEQ ID NO: 8180299 - DNA, 22 bp, Homo sapiens
gctggccaggaagagtctcaga

SEQ ID NO: 8180300 - DNA, 22 bp, Homo sapiens
gctggccagccctcttcctcca

SEQ ID NO: 8180301 - DNA, 22 bp, Homo sapiens
gctggccaggaagagtctcaga

SEQ ID NO: 8180302 - DNA, 22 bp, Homo sapiens
gctggccaggaagagtctcaga

SEQ ID NO: 8180303 - DNA, 22 bp, Homo sapiens
gctggccagccctcttcctcca

SEQ ID NO: 8180304 - DNA, 22 bp, Homo sapiens
gctggccacagatccccaggga

SEQ ID NO: 8180305 - DNA, 22 bp, Homo sapiens
gctggccacagatccccaggga

SEQ ID NO: 8180306 - DNA, 22 bp, Homo sapiens
gctggccacactgctgatggag

SEQ ID NO: 8180307 - DNA, 22 bp, Homo sapiens
gctggccacagatccccaggga

SEQ ID NO: 8180308 - DNA, 22 bp, Homo sapiens
gctggccacagatccccaggga

SEQ ID NO: 8180309 - DNA, 22 bp, Homo sapiens
gctggccacactgctgatggag

SEQ ID NO: 8180310 - DNA, 22 bp, Homo sapiens
gctggccacactgctgatggag

SEQ ID NO: 8180311 - DNA, 22 bp, Homo sapiens
gctggccacactgctgatggag

SEQ ID NO: 8180312 - DNA, 22 bp, Homo sapiens
gctggccaggaagagtctcaga

SEQ ID NO: 8180313 - DNA, 22 bp, Homo sapiens
gctggtcagagagaaaggaggc

SEQ ID NO: 8180314 - DNA, 22 bp, Homo sapiens
gctggccaggaagagtctcaga

SEQ ID NO: 8180315 - DNA, 22 bp, Homo sapiens
gctggtccattggcactgctca

SEQ ID NO: 8180316 - DNA, 22 bp, Homo sapiens
gctgtacattctgcacaggccc

SEQ ID NO: 8180317 - DNA, 22 bp, Homo sapiens
ggactgctgtggacagagtcat

SEQ ID NO: 8180318 - DNA, 23 bp, Homo sapiens
ggactgcaatggcgccgtctcag

SEQ ID NO: 8180319 - DNA, 22 bp, Homo sapiens
ggactggccggcgctgaggccc

SEQ ID NO: 8180320 - DNA, 22 bp, Homo sapiens
ggactggccggcgctgaggccc

SEQ ID NO: 8180321 - DNA, 22 bp, Homo sapiens
ggactgggtcactaagatagta

SEQ ID NO: 8180322 - DNA, 22 bp, Homo sapiens
ggactgggaatcagggagatgc

SEQ ID NO: 8180323 - DNA, 22 bp, Homo sapiens
ggactgggaatcagggagatgc

SEQ ID NO: 8180324 - DNA, 22 bp, Homo sapiens
ggacttgctaaggtggctgaac

SEQ ID NO: 8180325 - DNA, 22 bp, Homo sapiens
ggacttgctaaggtggctgaac

SEQ ID NO: 8180326 - DNA, 22 bp, Homo sapiens
ggactttaggaagggccaagtg

SEQ ID NO: 8180327 - DNA, 17 bp, Homo sapiens
ggactttaggttcttcc

SEQ ID NO: 8180328 - DNA, 22 bp, Homo sapiens
ggacttgggctggtctgtttct

SEQ ID NO: 8180329 - DNA, 22 bp, Homo sapiens
ggactttaattctttcctaagc

SEQ ID NO: 8180330 - DNA, 22 bp, Homo sapiens
ggactttaaaaagatgaccttt

SEQ ID NO: 8180331 - DNA, 22 bp, Homo sapiens
ggagaaagctgtagtggaatgt

SEQ ID NO: 8180332 - DNA, 22 bp, Homo sapiens
ggacaggcgcagggccaaggaa

SEQ ID NO: 8180333 - DNA, 22 bp, Homo sapiens
ggacaggcctggcacagtactg

SEQ ID NO: 8180334 - DNA, 22 bp, Homo sapiens
ggacaggctgcatctgagcatg

SEQ ID NO: 8180335 - DNA, 22 bp, Homo sapiens
ggacaggcccggggagcctgga

SEQ ID NO: 8180336 - DNA, 22 bp, Homo sapiens
ggacaggccctctggtcagctt

SEQ ID NO: 8180337 - DNA, 22 bp, Homo sapiens
ggacaggccgcctcggtggggg

SEQ ID NO: 8180338 - DNA, 22 bp, Homo sapiens
ggacagggatcattatctgagc

SEQ ID NO: 8180339 - DNA, 23 bp, Homo sapiens
ggacagggccctgccctatggcc

SEQ ID NO: 8180340 - DNA, 23 bp, Homo sapiens
ggacagggccctgccctatggcc

SEQ ID NO: 8180341 - DNA, 23 bp, Homo sapiens
ggacagggccctgccctatggcc

SEQ ID NO: 8180342 - DNA, 23 bp, Homo sapiens
ggacagggccctgccctatggcc

SEQ ID NO: 8180343 - DNA, 22 bp, Homo sapiens
ggacagggctcttggcactcct

SEQ ID NO: 8180344 - DNA, 22 bp, Homo sapiens
ggacagggctcttggcactcct

SEQ ID NO: 8180345 - DNA, 22 bp, Homo sapiens
ggacagggctcttggcactcct

SEQ ID NO: 8180346 - DNA, 22 bp, Homo sapiens
ggacagggctcttggcactcct

SEQ ID NO: 8180347 - DNA, 22 bp, Homo sapiens
ggacaggggcgtggggattgtt

SEQ ID NO: 8180348 - DNA, 22 bp, Homo sapiens
ggacaggggcgtggggattgtt

SEQ ID NO: 8180349 - DNA, 19 bp, Homo sapiens
ggacagggggagcttttat

SEQ ID NO: 8180350 - DNA, 22 bp, Homo sapiens
ggaaggcagaggtgtcgtgggg

SEQ ID NO: 8180351 - DNA, 22 bp, Homo sapiens
ggaaggcagaggtgtcgtgggg

SEQ ID NO: 8180352 - DNA, 19 bp, Homo sapiens
ggaaggccacggcaggctt

SEQ ID NO: 8180353 - DNA, 22 bp, Homo sapiens
ggaaggcagtgaaggggctgat

SEQ ID NO: 8180354 - DNA, 22 bp, Homo sapiens
ggaaggctttgtagaagtgcca

SEQ ID NO: 8180355 - DNA, 22 bp, Homo sapiens
ggaaggctttctgttctgtgac

SEQ ID NO: 8180356 - DNA, 22 bp, Homo sapiens
ggaaggctttctgttctgtgac

SEQ ID NO: 8180357 - DNA, 22 bp, Homo sapiens
ggaaggctgtgccagaagaact

SEQ ID NO: 8180358 - DNA, 22 bp, Homo sapiens
ggacaggagtgaggcgggttcc

SEQ ID NO: 8180359 - DNA, 18 bp, Homo sapiens
ggacaggagacatgggtg

SEQ ID NO: 8180360 - DNA, 18 bp, Homo sapiens
ggacaggagacatgggtg

SEQ ID NO: 8180361 - DNA, 18 bp, Homo sapiens
ggacaggagacatgggtg

SEQ ID NO: 8180362 - DNA, 22 bp, Homo sapiens
ggacagagggttgacagagtat

SEQ ID NO: 8180363 - DNA, 22 bp, Homo sapiens
ggacaggataagagacactgcc

SEQ ID NO: 8180364 - DNA, 22 bp, Homo sapiens
ggacaggataagagacactgcc

SEQ ID NO: 8180365 - DNA, 22 bp, Homo sapiens
ggacagagggttgacagagtat

SEQ ID NO: 8180366 - DNA, 22 bp, Homo sapiens
ggacagagggttgacagagtat

SEQ ID NO: 8180367 - DNA, 22 bp, Homo sapiens
ggaagggaaaattcattcggct

SEQ ID NO: 8180368 - DNA, 22 bp, Homo sapiens
ggaaggctttgtagaagtgcca

SEQ ID NO: 8180369 - DNA, 22 bp, Homo sapiens
ggaaggaggggcaaagcagttc

SEQ ID NO: 8180370 - DNA, 22 bp, Homo sapiens
ggaaggaggggcaaagcagttc

SEQ ID NO: 8180371 - DNA, 22 bp, Homo sapiens
ggaaggaggggcaaagcagttc

SEQ ID NO: 8180372 - DNA, 22 bp, Homo sapiens
ggaaggaggggcaaagcagttc

SEQ ID NO: 8180373 - DNA, 22 bp, Homo sapiens
ggaaggaggatgctctggcctt

SEQ ID NO: 8180374 - DNA, 22 bp, Homo sapiens
ggaaggaggatgctctggcctt

SEQ ID NO: 8180375 - DNA, 22 bp, Homo sapiens
ggaaggaggatgctctggcctt

SEQ ID NO: 8180376 - DNA, 22 bp, Homo sapiens
ggaaggaggggcaaagcagttc

SEQ ID NO: 8180377 - DNA, 22 bp, Homo sapiens
ggaaggaggggcaaagcagttc

SEQ ID NO: 8180378 - DNA, 22 bp, Homo sapiens
ggaaggaggggcaaagcagttc

SEQ ID NO: 8180379 - DNA, 18 bp, Homo sapiens
ggaaggagtggaccccag

SEQ ID NO: 8180380 - DNA, 18 bp, Homo sapiens
ggaaggagtggaccccag

SEQ ID NO: 8180381 - DNA, 19 bp, Homo sapiens
ggaaggcagaggggctgtg

SEQ ID NO: 8180382 - DNA, 19 bp, Homo sapiens
ggaaggagagaaatgcatg

SEQ ID NO: 8180383 - DNA, 22 bp, Homo sapiens
ggaaggagcatttgccagttta

SEQ ID NO: 8180384 - DNA, 22 bp, Homo sapiens
ggaaggagcatttgccagttta

SEQ ID NO: 8180385 - DNA, 22 bp, Homo sapiens
ggaaaaacagtctttattattt

SEQ ID NO: 8180386 - DNA, 22 bp, Homo sapiens
ggagccagggaagctgcttcct

SEQ ID NO: 8180387 - DNA, 22 bp, Homo sapiens
ggagccagggaagctgcttcct

SEQ ID NO: 8180388 - DNA, 22 bp, Homo sapiens
ggagccaggggaccttcacaga

SEQ ID NO: 8180389 - DNA, 22 bp, Homo sapiens
ggagccaggggaccttcacaga

SEQ ID NO: 8180390 - DNA, 22 bp, Homo sapiens
ggagccagtatttagtggtctt

SEQ ID NO: 8180391 - DNA, 17 bp, Homo sapiens
ggagccaggagcccacc

SEQ ID NO: 8180392 - DNA, 22 bp, Homo sapiens
ggagccaggcaatctgtacttt

SEQ ID NO: 8180393 - DNA, 22 bp, Homo sapiens
ggagccaggcaatctgtacttt

SEQ ID NO: 8180394 - DNA, 22 bp, Homo sapiens
ggagccaggcaatctgtacttt

SEQ ID NO: 8180395 - DNA, 22 bp, Homo sapiens
ggagccaggcatatcggggcac

SEQ ID NO: 8180396 - DNA, 22 bp, Homo sapiens
ggagaagcagcttcttgatgaa

SEQ ID NO: 8180397 - DNA, 22 bp, Homo sapiens
ggagaagattggaattaagcac

SEQ ID NO: 8180398 - DNA, 22 bp, Homo sapiens
ggagaagcagcttcttgatgaa

SEQ ID NO: 8180399 - DNA, 22 bp, Homo sapiens
ggagaagaggagctggaagcct

SEQ ID NO: 8180400 - DNA, 22 bp, Homo sapiens
ggagaagaggagctggaagcct

SEQ ID NO: 8180401 - DNA, 22 bp, Homo sapiens
ggagaagaggagctggaagcct

SEQ ID NO: 8180402 - DNA, 22 bp, Homo sapiens
ggagaagaggagctggaagcct

SEQ ID NO: 8180403 - DNA, 22 bp, Homo sapiens
ggagaagaggagctggaagcct

SEQ ID NO: 8180404 - DNA, 22 bp, Homo sapiens
ggagaaagtacagcaggcaaca

SEQ ID NO: 8180405 - DNA, 22 bp, Homo sapiens
ggagaaagtacagcaggcaaca

SEQ ID NO: 8180406 - DNA, 22 bp, Homo sapiens
ggagaaagggactgatctgctc

SEQ ID NO: 8180407 - DNA, 22 bp, Homo sapiens
ggagaacaggcaagcatctggc

SEQ ID NO: 8180408 - DNA, 22 bp, Homo sapiens
ggagaacaaatatctggcttct

SEQ ID NO: 8180409 - DNA, 22 bp, Homo sapiens
ggagaacatatctcccacattg

SEQ ID NO: 8180410 - DNA, 22 bp, Homo sapiens
ggagccctcaccggcgagtgcc

SEQ ID NO: 8180411 - DNA, 22 bp, Homo sapiens
ggagcctggagtttctgatggg

SEQ ID NO: 8180412 - DNA, 22 bp, Homo sapiens
ggagcctggcaatgctgcgtcc

SEQ ID NO: 8180413 - DNA, 22 bp, Homo sapiens
ggagcctggagtttctgatggg

SEQ ID NO: 8180414 - DNA, 22 bp, Homo sapiens
ggagccctcaccggcgagtgcc

SEQ ID NO: 8180415 - DNA, 22 bp, Homo sapiens
ggagcctggcaatgctgcgtcc

SEQ ID NO: 8180416 - DNA, 23 bp, Homo sapiens
ggagcctggcatatgagacgcat

SEQ ID NO: 8180417 - DNA, 19 bp, Homo sapiens
ggagcctggcaggggcgtg

SEQ ID NO: 8180418 - DNA, 22 bp, Homo sapiens
ggagcctggcccggcccttggc

SEQ ID NO: 8180419 - DNA, 23 bp, Homo sapiens
ggagcctggcatatgagacgcat

SEQ ID NO: 8180420 - DNA, 23 bp, Homo sapiens
ggagcctggcatatgagacgcat

SEQ ID NO: 8180421 - DNA, 18 bp, Homo sapiens
ggagcccagaggtgagtt

SEQ ID NO: 8180422 - DNA, 18 bp, Homo sapiens
ggagcccagaggacagga

SEQ ID NO: 8180423 - DNA, 18 bp, Homo sapiens
ggagcccacggcgtccca

SEQ ID NO: 8180424 - DNA, 22 bp, Homo sapiens
ggagccagtttagacctcagtt

SEQ ID NO: 8180425 - DNA, 18 bp, Homo sapiens
ggagccagtctgtctctg

SEQ ID NO: 8180426 - DNA, 18 bp, Homo sapiens
ggagccagtctgtctctg

SEQ ID NO: 8180427 - DNA, 22 bp, Homo sapiens
ggaggaggggcgctttgtctat

SEQ ID NO: 8180428 - DNA, 22 bp, Homo sapiens
ggaggaggggcgctttgtctat

SEQ ID NO: 8180429 - DNA, 22 bp, Homo sapiens
ggaggaggggtgactgaatgct

SEQ ID NO: 8180430 - DNA, 22 bp, Homo sapiens
ggaggaggggtgactgaatgct

SEQ ID NO: 8180431 - DNA, 22 bp, Homo sapiens
ggaggaggggtgactgaatgct

SEQ ID NO: 8180432 - DNA, 22 bp, Homo sapiens
ggaggaggggtgactgaatgct

SEQ ID NO: 8180433 - DNA, 22 bp, Homo sapiens
ggagctgttgcgcatgcgctcg

SEQ ID NO: 8180434 - DNA, 19 bp, Homo sapiens
ggagcttggtggctgtggc

SEQ ID NO: 8180435 - DNA, 19 bp, Homo sapiens
ggagcttggtggctgtggc

SEQ ID NO: 8180436 - DNA, 19 bp, Homo sapiens
ggagcttggtggctgtggc

SEQ ID NO: 8180437 - DNA, 19 bp, Homo sapiens
ggagcttggtggctgtggc

SEQ ID NO: 8180438 - DNA, 22 bp, Homo sapiens
ggaggaggcggcagaagttcct

SEQ ID NO: 8180439 - DNA, 21 bp, Homo sapiens
ggaggaaaaaggaatgacttg

SEQ ID NO: 8180440 - DNA, 21 bp, Homo sapiens
ggaggaaaaaggaatgacttg

SEQ ID NO: 8180441 - DNA, 21 bp, Homo sapiens
ggagctggggagctggcccca

SEQ ID NO: 8180442 - DNA, 22 bp, Homo sapiens
ggagctggggttggcatcttcc

SEQ ID NO: 8180443 - DNA, 22 bp, Homo sapiens
ggagctggggttggcatcttcc

SEQ ID NO: 8180444 - DNA, 22 bp, Homo sapiens
ggagctggggttggcatcttcc

SEQ ID NO: 8180445 - DNA, 22 bp, Homo sapiens
ggagctgtaacgagccattgct

SEQ ID NO: 8180446 - DNA, 22 bp, Homo sapiens
ggagctggggttggcatcttcc

SEQ ID NO: 8180447 - DNA, 22 bp, Homo sapiens
ggagctggtcagccttgagcat

SEQ ID NO: 8180448 - DNA, 22 bp, Homo sapiens
ggagctggtcagccttgagcat

SEQ ID NO: 8180449 - DNA, 22 bp, Homo sapiens
ggagctgtgggacgctgtccca

SEQ ID NO: 8180450 - DNA, 22 bp, Homo sapiens
ggagctgtgggacgctgtccca

SEQ ID NO: 8180451 - DNA, 22 bp, Homo sapiens
ggagctgtgttatccattccca

SEQ ID NO: 8180452 - DNA, 22 bp, Homo sapiens
ggagctgtctgtagggcacagg

SEQ ID NO: 8180453 - DNA, 20 bp, Homo sapiens
ggagctgccctgggctggag

SEQ ID NO: 8180454 - DNA, 22 bp, Homo sapiens
ggagctgcatttagggagcctt

SEQ ID NO: 8180455 - DNA, 20 bp, Homo sapiens
ggagctgccctgggctggag

SEQ ID NO: 8180456 - DNA, 22 bp, Homo sapiens
ggagctggctacagagaactcc

SEQ ID NO: 8180457 - DNA, 22 bp, Homo sapiens
ggagctggctacagagaactcc

SEQ ID NO: 8180458 - DNA, 22 bp, Homo sapiens
ggagctggccgcctatgtgcag

SEQ ID NO: 8180459 - DNA, 22 bp, Homo sapiens
ggagctgctcagagccagtccc

SEQ ID NO: 8180460 - DNA, 22 bp, Homo sapiens
ggagcctggcctggctctgtgt

SEQ ID NO: 8180461 - DNA, 22 bp, Homo sapiens
ggagcctgggcattagtaattt

SEQ ID NO: 8180462 - DNA, 22 bp, Homo sapiens
ggagcctggtatagtgttgcat

SEQ ID NO: 8180463 - DNA, 22 bp, Homo sapiens
ggagcctggtcaggttggctcc

SEQ ID NO: 8180464 - DNA, 22 bp, Homo sapiens
ggagcctggtatagtgttgcat

SEQ ID NO: 8180465 - DNA, 22 bp, Homo sapiens
ggagcctggtatagtgttgcat

SEQ ID NO: 8180466 - DNA, 22 bp, Homo sapiens
ggagcctggtatagtgttgcat

SEQ ID NO: 8180467 - DNA, 22 bp, Homo sapiens
ggagctgcatttagggagcctt

SEQ ID NO: 8180468 - DNA, 22 bp, Homo sapiens
ggagctgcatttagggagcctt

SEQ ID NO: 8180469 - DNA, 21 bp, Homo sapiens
ggagctgcaggagccgaaggc

SEQ ID NO: 8180470 - DNA, 22 bp, Homo sapiens
ggagcctggtcaggttggctcc

SEQ ID NO: 8180471 - DNA, 21 bp, Homo sapiens
ggagctgcaggagccgaaggc

SEQ ID NO: 8180472 - DNA, 22 bp, Homo sapiens
ggagctgggaactatgtagtat

SEQ ID NO: 8180473 - DNA, 22 bp, Homo sapiens
ggagctgggaattggatcatct

SEQ ID NO: 8180474 - DNA, 22 bp, Homo sapiens
ggagctgggaattggatcatct

SEQ ID NO: 8180475 - DNA, 22 bp, Homo sapiens
ggagctgggaattggatcatct

SEQ ID NO: 8180476 - DNA, 22 bp, Homo sapiens
ggagctgggaattggatcatct

SEQ ID NO: 8180477 - DNA, 22 bp, Homo sapiens
ggagctgggaccctgtcatctg

SEQ ID NO: 8180478 - DNA, 22 bp, Homo sapiens
ggagctgggaccctgtcatctg

SEQ ID NO: 8180479 - DNA, 22 bp, Homo sapiens
ggagctgggaccctgtcatctg

SEQ ID NO: 8180480 - DNA, 18 bp, Homo sapiens
ggagctgggccccactcc

SEQ ID NO: 8180481 - DNA, 22 bp, Homo sapiens
ggagctgggaccctgtcatctg

SEQ ID NO: 8180482 - DNA, 18 bp, Homo sapiens
ggagctgggccccactcc

SEQ ID NO: 8180483 - DNA, 18 bp, Homo sapiens
ggagctgggcctggttcc

SEQ ID NO: 8180484 - DNA, 21 bp, Homo sapiens
ggagctggggagctggcccca

SEQ ID NO: 8180485 - DNA, 18 bp, Homo sapiens
ggagctgggcctggttcc

SEQ ID NO: 8180486 - DNA, 21 bp, Homo sapiens
ggagctggggagctggcccca

SEQ ID NO: 8180487 - DNA, 21 bp, Homo sapiens
ggagctggggagctggcccca

SEQ ID NO: 8180488 - DNA, 21 bp, Homo sapiens
ggagctggggagctggcccca

SEQ ID NO: 8180489 - DNA, 22 bp, Homo sapiens
gcagcaagtctagtttgtaggc

SEQ ID NO: 8180490 - DNA, 22 bp, Homo sapiens
gcagcaaggatgaagcacttgg

SEQ ID NO: 8180491 - DNA, 22 bp, Homo sapiens
gcagcaaggatgaagcacttgg

SEQ ID NO: 8180492 - DNA, 22 bp, Homo sapiens
gcagcaagaggtttctgttgac

SEQ ID NO: 8180493 - DNA, 22 bp, Homo sapiens
gcagcacatataaacaaagaga

SEQ ID NO: 8180494 - DNA, 22 bp, Homo sapiens
gcagcaatcttcacagtgtcat

SEQ ID NO: 8180495 - DNA, 22 bp, Homo sapiens
gcagcacaaagtccccagggac

SEQ ID NO: 8180496 - DNA, 22 bp, Homo sapiens
gcagcactaatgggccccagaa

SEQ ID NO: 8180497 - DNA, 22 bp, Homo sapiens
gcagcaccaaccagggcctgtt

SEQ ID NO: 8180498 - DNA, 22 bp, Homo sapiens
gcagcagatgtgggcccagagc

SEQ ID NO: 8180499 - DNA, 22 bp, Homo sapiens
gcagcagaaggccaaggggagc

SEQ ID NO: 8180500 - DNA, 22 bp, Homo sapiens
gcagcagcaagaaggttggact

SEQ ID NO: 8180501 - DNA, 22 bp, Homo sapiens
gcagcagatgtgggcccagagc

SEQ ID NO: 8180502 - DNA, 22 bp, Homo sapiens
gcagcagcagcaattttctgtc

SEQ ID NO: 8180503 - DNA, 22 bp, Homo sapiens
gcagcagcagcaattttctgtc

SEQ ID NO: 8180504 - DNA, 22 bp, Homo sapiens
gcagcagcaggcgctcggccgt

SEQ ID NO: 8180505 - DNA, 22 bp, Homo sapiens
gcagcagccactattctggcat

SEQ ID NO: 8180506 - DNA, 22 bp, Homo sapiens
gcagcagcaggcgctcggccgt

SEQ ID NO: 8180507 - DNA, 22 bp, Homo sapiens
gcagcagcagggagtctgactt

SEQ ID NO: 8180508 - DNA, 22 bp, Homo sapiens
gcagcagcagggagtctgactt

SEQ ID NO: 8180509 - DNA, 22 bp, Homo sapiens
gcagcagcaggcgctcggccgt

SEQ ID NO: 8180510 - DNA, 22 bp, Homo sapiens
gcagccaccctcaaggctgaat

SEQ ID NO: 8180511 - DNA, 21 bp, Homo sapiens
gcagccacagccaccaagcta

SEQ ID NO: 8180512 - DNA, 22 bp, Homo sapiens
gcagccacagaggagggatgca

SEQ ID NO: 8180513 - DNA, 22 bp, Homo sapiens
gcagcagcccagggctctcaga

SEQ ID NO: 8180514 - DNA, 22 bp, Homo sapiens
gcagcagcccagggctctcaga

SEQ ID NO: 8180515 - DNA, 22 bp, Homo sapiens
gcagcagcccagggctctcaga

SEQ ID NO: 8180516 - DNA, 22 bp, Homo sapiens
gcagcagccactattctggcat

SEQ ID NO: 8180517 - DNA, 22 bp, Homo sapiens
gcagccagaagactcagaacaa

SEQ ID NO: 8180518 - DNA, 22 bp, Homo sapiens
gcagccagaagactcagaacaa

SEQ ID NO: 8180519 - DNA, 22 bp, Homo sapiens
gcagccactagttttcctgttt

SEQ ID NO: 8180520 - DNA, 22 bp, Homo sapiens
gcagccaccctcaaggctgaat

SEQ ID NO: 8180521 - DNA, 22 bp, Homo sapiens
gcagccagcccctctgacctct

SEQ ID NO: 8180522 - DNA, 22 bp, Homo sapiens
gcagccagcccctctgacctct

SEQ ID NO: 8180523 - DNA, 22 bp, Homo sapiens
gcagccagcaggaagcgggaga

SEQ ID NO: 8180524 - DNA, 22 bp, Homo sapiens
gcagccagcaggaagcgggaga

SEQ ID NO: 8180525 - DNA, 22 bp, Homo sapiens
gcagccagcccctctgacctct

SEQ ID NO: 8180526 - DNA, 21 bp, Homo sapiens
gcagccagacgggattcagtt

SEQ ID NO: 8180527 - DNA, 21 bp, Homo sapiens
gcagccagacgggattcagtt

SEQ ID NO: 8180528 - DNA, 22 bp, Homo sapiens
gcagccagagggggtgtgatca

SEQ ID NO: 8180529 - DNA, 22 bp, Homo sapiens
gcagccagagggggtgtgatca

SEQ ID NO: 8180530 - DNA, 22 bp, Homo sapiens
gcagccaggaaagctggaccct

SEQ ID NO: 8180531 - DNA, 22 bp, Homo sapiens
gcagccaggaaagctggaccct

SEQ ID NO: 8180532 - DNA, 22 bp, Homo sapiens
gcagccagccctagtcccactt

SEQ ID NO: 8180533 - DNA, 21 bp, Homo sapiens
gcagccagccgagaccatgcc

SEQ ID NO: 8180534 - DNA, 21 bp, Homo sapiens
gcagccagccgagaccatgcc

SEQ ID NO: 8180535 - DNA, 21 bp, Homo sapiens
gcagccagccgagaccatgcc

SEQ ID NO: 8180536 - DNA, 22 bp, Homo sapiens
gcagctggctctgggaaaaact

SEQ ID NO: 8180537 - DNA, 22 bp, Homo sapiens
gcagctggctcagagaggtggg

SEQ ID NO: 8180538 - DNA, 22 bp, Homo sapiens
gcagctggctcagagaggtggg

SEQ ID NO: 8180539 - DNA, 22 bp, Homo sapiens
gcagctgggacactgaggccag

SEQ ID NO: 8180540 - DNA, 22 bp, Homo sapiens
gcagctgggacactgaggccag

SEQ ID NO: 8180541 - DNA, 22 bp, Homo sapiens
gcagctgggacactgaggccag

SEQ ID NO: 8180542 - DNA, 22 bp, Homo sapiens
gcagcccacagctggaggccta

SEQ ID NO: 8180543 - DNA, 22 bp, Homo sapiens
gcagcccacagctggaggccta

SEQ ID NO: 8180544 - DNA, 22 bp, Homo sapiens
gcagcccacaccactctgctca

SEQ ID NO: 8180545 - DNA, 22 bp, Homo sapiens
gcagctggccctgacacgcaga

SEQ ID NO: 8180546 - DNA, 22 bp, Homo sapiens
gcagcccaatggactgagacag

SEQ ID NO: 8180547 - DNA, 22 bp, Homo sapiens
gcagcccaatggactgagacag

SEQ ID NO: 8180548 - DNA, 22 bp, Homo sapiens
gcagcccaatggactgagacag

SEQ ID NO: 8180549 - DNA, 17 bp, Homo sapiens
gcagccagtgcagcagg

SEQ ID NO: 8180550 - DNA, 17 bp, Homo sapiens
gcagccagtgcagcagg

SEQ ID NO: 8180551 - DNA, 22 bp, Homo sapiens
gcagccagtatcctctgagatt

SEQ ID NO: 8180552 - DNA, 22 bp, Homo sapiens
gcagccaggaagcccaggacac

SEQ ID NO: 8180553 - DNA, 22 bp, Homo sapiens
gcagccaggaagcccaggacac

SEQ ID NO: 8180554 - DNA, 22 bp, Homo sapiens
gcagcccaagcctgagcatcct

SEQ ID NO: 8180555 - DNA, 22 bp, Homo sapiens
gcagccagtgggatgagaaaga

SEQ ID NO: 8180556 - DNA, 22 bp, Homo sapiens
gcagcccaaaaaagaggtagat

SEQ ID NO: 8180557 - DNA, 22 bp, Homo sapiens
gcagctggggaggtcgtgggga

SEQ ID NO: 8180558 - DNA, 22 bp, Homo sapiens
gcagctgggccccagcctctcc

SEQ ID NO: 8180559 - DNA, 22 bp, Homo sapiens
gcagctggggaggtcgtgggga

SEQ ID NO: 8180560 - DNA, 22 bp, Homo sapiens
gcagctggggaggtcgtgggga

SEQ ID NO: 8180561 - DNA, 22 bp, Homo sapiens
gcagctggggaggtcgtgggga

SEQ ID NO: 8180562 - DNA, 22 bp, Homo sapiens
gcagctggggaggtcgtgggga

SEQ ID NO: 8180563 - DNA, 22 bp, Homo sapiens
gcagctgggccccagcctctcc

SEQ ID NO: 8180564 - DNA, 22 bp, Homo sapiens
gcagctgggccccagcctctcc

SEQ ID NO: 8180565 - DNA, 22 bp, Homo sapiens
gcagctgggccccagcctctcc

SEQ ID NO: 8180566 - DNA, 22 bp, Homo sapiens
gcagctgggacactgaggccag

SEQ ID NO: 8180567 - DNA, 22 bp, Homo sapiens
gcagctgggacactgaggccag

SEQ ID NO: 8180568 - DNA, 22 bp, Homo sapiens
gcagctgggacactgaggccag

SEQ ID NO: 8180569 - DNA, 22 bp, Homo sapiens
gcagctgggtctgtgtgggctg

SEQ ID NO: 8180570 - DNA, 22 bp, Homo sapiens
gcagctgggtctgtgtgggctg

SEQ ID NO: 8180571 - DNA, 21 bp, Homo sapiens
gcagctggtctcagagcttgc

SEQ ID NO: 8180572 - DNA, 22 bp, Homo sapiens
gcagctgggtctgtgtgggctg

SEQ ID NO: 8180573 - DNA, 22 bp, Homo sapiens
gcagctggggccacacttaggc

SEQ ID NO: 8180574 - DNA, 22 bp, Homo sapiens
gcagctggggccacacttaggc

SEQ ID NO: 8180575 - DNA, 22 bp, Homo sapiens
gcagctggggccacacttaggc

SEQ ID NO: 8180576 - DNA, 22 bp, Homo sapiens
gcagctggggccacacttaggc

SEQ ID NO: 8180577 - DNA, 22 bp, Homo sapiens
gcagctggtctggcctagagta

SEQ ID NO: 8180578 - DNA, 21 bp, Homo sapiens
gcagctggtctcagagcttgc

SEQ ID NO: 8180579 - DNA, 21 bp, Homo sapiens
gcagctggtctcagagcttgc

SEQ ID NO: 8180580 - DNA, 22 bp, Homo sapiens
gcagctggtgcaaatgtcactc

SEQ ID NO: 8180581 - DNA, 22 bp, Homo sapiens
gcagctggtgcaaatgtcactc

SEQ ID NO: 8180582 - DNA, 22 bp, Homo sapiens
gcagctggtgcaaatgtcactc

SEQ ID NO: 8180583 - DNA, 22 bp, Homo sapiens
gcagctggtctggcctagagta

SEQ ID NO: 8180584 - DNA, 23 bp, Homo sapiens
gcagctggttagaagggaaggag

SEQ ID NO: 8180585 - DNA, 23 bp, Homo sapiens
gcagctggttagaagggaaggag

SEQ ID NO: 8180586 - DNA, 23 bp, Homo sapiens
gcagctggttagaagggaaggag

SEQ ID NO: 8180587 - DNA, 23 bp, Homo sapiens
gcagctggttagaagggaaggag

SEQ ID NO: 8180588 - DNA, 22 bp, Homo sapiens
gcagctggttaatgggagaatt

SEQ ID NO: 8180589 - DNA, 22 bp, Homo sapiens
gcagctggttaatgggagaatt

SEQ ID NO: 8180590 - DNA, 22 bp, Homo sapiens
gcagctggtgcaaatgtcactc

SEQ ID NO: 8180591 - DNA, 22 bp, Homo sapiens
gcaggtcccagaaagttaattc

SEQ ID NO: 8180592 - DNA, 20 bp, Homo sapiens
gcaggtccctggcatgcaga

SEQ ID NO: 8180593 - DNA, 22 bp, Homo sapiens
gcaggtctagaagctgcctctg

SEQ ID NO: 8180594 - DNA, 22 bp, Homo sapiens
gcaggtctagaagctgcctctg

SEQ ID NO: 8180595 - DNA, 19 bp, Homo sapiens
gcaggtcattaggctaggt

SEQ ID NO: 8180596 - DNA, 19 bp, Homo sapiens
gcaggtcattaggctaggt

SEQ ID NO: 8180597 - DNA, 19 bp, Homo sapiens
gcaggtcattaggctaggt

SEQ ID NO: 8180598 - DNA, 22 bp, Homo sapiens
gcaggtccagtcaccagagaga

SEQ ID NO: 8180599 - DNA, 19 bp, Homo sapiens
gcaggtcattaggctaggt

SEQ ID NO: 8180600 - DNA, 19 bp, Homo sapiens
gcagggtgttgactgtccc

SEQ ID NO: 8180601 - DNA, 21 bp, Homo sapiens
gcagggtttgtgctgtgagtt

SEQ ID NO: 8180602 - DNA, 22 bp, Homo sapiens
gcaggtagcattttttgacaaa

SEQ ID NO: 8180603 - DNA, 22 bp, Homo sapiens
gcaggtacccttgtccatgaca

SEQ ID NO: 8180604 - DNA, 19 bp, Homo sapiens
gcaggtagagacagcagcc

SEQ ID NO: 8180605 - DNA, 22 bp, Homo sapiens
gcaggtgaatgatggactagga

SEQ ID NO: 8180606 - DNA, 22 bp, Homo sapiens
gcaggtgaatgatggactagga

SEQ ID NO: 8180607 - DNA, 22 bp, Homo sapiens
gcaggtgaatgatggactagga

SEQ ID NO: 8180608 - DNA, 22 bp, Homo sapiens
gcaggtgaatgatggactagga

SEQ ID NO: 8180609 - DNA, 22 bp, Homo sapiens
gcaggtgaatgatggactagga

SEQ ID NO: 8180610 - DNA, 22 bp, Homo sapiens
gcaggtgaatgatggactagga

SEQ ID NO: 8180611 - DNA, 22 bp, Homo sapiens
gcaggtgatgtgatgtgagcat

SEQ ID NO: 8180612 - DNA, 22 bp, Homo sapiens
gcaggtgatgtgatgtgagcat

SEQ ID NO: 8180613 - DNA, 22 bp, Homo sapiens
gcaggtgatgtgatgtgagcat

SEQ ID NO: 8180614 - DNA, 19 bp, Homo sapiens
gcaggtgagccgtggctcc

SEQ ID NO: 8180615 - DNA, 19 bp, Homo sapiens
gcaggtgagccgtggctcc

SEQ ID NO: 8180616 - DNA, 22 bp, Homo sapiens
gcaggtgatgtgatgtgagcat

SEQ ID NO: 8180617 - DNA, 22 bp, Homo sapiens
gcaggtctggagggcactgggg

SEQ ID NO: 8180618 - DNA, 22 bp, Homo sapiens
gcaggtctggcatagagcctgc

SEQ ID NO: 8180619 - DNA, 22 bp, Homo sapiens
gcaggtgaaagtgagtagtgag

SEQ ID NO: 8180620 - DNA, 22 bp, Homo sapiens
gcaggtgaaagtgagtagtgag

SEQ ID NO: 8180621 - DNA, 22 bp, Homo sapiens
gcaggtgaaagtgagtagtgag

SEQ ID NO: 8180622 - DNA, 22 bp, Homo sapiens
gcaggtctatcaggctgcaggt

SEQ ID NO: 8180623 - DNA, 22 bp, Homo sapiens
gcaggtctcaatctgagcaggc

SEQ ID NO: 8180624 - DNA, 22 bp, Homo sapiens
gcaggtctcaatctgagcaggc

SEQ ID NO: 8180625 - DNA, 22 bp, Homo sapiens
gcagggccagtgcagagaggaa

SEQ ID NO: 8180626 - DNA, 22 bp, Homo sapiens
gcagggccaggtacaagaagca

SEQ ID NO: 8180627 - DNA, 22 bp, Homo sapiens
gcagggccaggtacaagaagca

SEQ ID NO: 8180628 - DNA, 22 bp, Homo sapiens
gcagggccagtgcagagaggaa

SEQ ID NO: 8180629 - DNA, 22 bp, Homo sapiens
gcagggccagtgcagagaggaa

SEQ ID NO: 8180630 - DNA, 22 bp, Homo sapiens
gcagggccagtgcagagaggaa

SEQ ID NO: 8180631 - DNA, 19 bp, Homo sapiens
gcagggtggcagagctctt

SEQ ID NO: 8180632 - DNA, 22 bp, Homo sapiens
gcagggtgtgtctcatacagtt

SEQ ID NO: 8180633 - DNA, 19 bp, Homo sapiens
gcagggtgttgactgtccc

SEQ ID NO: 8180634 - DNA, 22 bp, Homo sapiens
gcagggtgtgtctcatacagtt

SEQ ID NO: 8180635 - DNA, 22 bp, Homo sapiens
gcagggtgtgtctcatacagtt

SEQ ID NO: 8180636 - DNA, 22 bp, Homo sapiens
gcagggtgtgtctcatacagtt

SEQ ID NO: 8180637 - DNA, 22 bp, Homo sapiens
gcagggccagggctcaggctgt

SEQ ID NO: 8180638 - DNA, 22 bp, Homo sapiens
gcagggccagggctcaggctgt

SEQ ID NO: 8180639 - DNA, 22 bp, Homo sapiens
gcagggcatgggccctgtctgc

SEQ ID NO: 8180640 - DNA, 22 bp, Homo sapiens
gcagggcatgggccctgtctgc

SEQ ID NO: 8180641 - DNA, 22 bp, Homo sapiens
gcagggcatgggccctgtctgc

SEQ ID NO: 8180642 - DNA, 22 bp, Homo sapiens
gcagggcatgggccctgtctgc

SEQ ID NO: 8180643 - DNA, 22 bp, Homo sapiens
gcagggcagtaagagctagagt

SEQ ID NO: 8180644 - DNA, 22 bp, Homo sapiens
gcagggcagtaagagctagagt

SEQ ID NO: 8180645 - DNA, 22 bp, Homo sapiens
gcagggcagtaagagctagagt

SEQ ID NO: 8180646 - DNA, 22 bp, Homo sapiens
gcagggcagggcaagaactggg

SEQ ID NO: 8180647 - DNA, 22 bp, Homo sapiens
gcagggcagggcaagaactggg

SEQ ID NO: 8180648 - DNA, 22 bp, Homo sapiens
gcagggcaggatttgaacccag

SEQ ID NO: 8180649 - DNA, 22 bp, Homo sapiens
gcagggcaggatttgaacccag

SEQ ID NO: 8180650 - DNA, 22 bp, Homo sapiens
gcagggcagggcaagaactggg

SEQ ID NO: 8180651 - DNA, 22 bp, Homo sapiens
gcagggcaggatttgaacccag

SEQ ID NO: 8180652 - DNA, 22 bp, Homo sapiens
gcaggcctctaattcaccgcag

SEQ ID NO: 8180653 - DNA, 22 bp, Homo sapiens
gcaggcctcccctgctggagct

SEQ ID NO: 8180654 - DNA, 22 bp, Homo sapiens
gcaggcctcccctgctggagct

SEQ ID NO: 8180655 - DNA, 22 bp, Homo sapiens
gcaggcctcccctgctggagct

SEQ ID NO: 8180656 - DNA, 18 bp, Homo sapiens
gcaggcctagaacttggt

SEQ ID NO: 8180657 - DNA, 22 bp, Homo sapiens
gcaggcccttagccttggtggg

SEQ ID NO: 8180658 - DNA, 22 bp, Homo sapiens
gcaggcctaagagaaggcattg

SEQ ID NO: 8180659 - DNA, 22 bp, Homo sapiens
gcaggcccttagccttggtggg

SEQ ID NO: 8180660 - DNA, 22 bp, Homo sapiens
gcaggcctaagagaaggcattg

SEQ ID NO: 8180661 - DNA, 19 bp, Homo sapiens
gcaggcccagtcgggctgg

SEQ ID NO: 8180662 - DNA, 20 bp, Homo sapiens
gcaggccctctctctagtct

SEQ ID NO: 8180663 - DNA, 22 bp, Homo sapiens
gcaggccctcctctagcaaggc

SEQ ID NO: 8180664 - DNA, 22 bp, Homo sapiens
gcaggccctcctctagcaaggc

SEQ ID NO: 8180665 - DNA, 18 bp, Homo sapiens
gcaggccctgtttctggg

SEQ ID NO: 8180666 - DNA, 20 bp, Homo sapiens
gcaggccctctctctagtct

SEQ ID NO: 8180667 - DNA, 20 bp, Homo sapiens
gcaggccctctctctagtct

SEQ ID NO: 8180668 - DNA, 22 bp, Homo sapiens
gcaggcccttagccttggtggg

SEQ ID NO: 8180669 - DNA, 22 bp, Homo sapiens
gcaggcccttagccttggtggg

SEQ ID NO: 8180670 - DNA, 22 bp, Homo sapiens
gcagggcagctcactgtggttc

SEQ ID NO: 8180671 - DNA, 22 bp, Homo sapiens
gcagggcagctcactgtggttc

SEQ ID NO: 8180672 - DNA, 22 bp, Homo sapiens
gcagggcagctgaagctaggtg

SEQ ID NO: 8180673 - DNA, 22 bp, Homo sapiens
gcagggcagccacaggccccct

SEQ ID NO: 8180674 - DNA, 22 bp, Homo sapiens
gcagggcagctcactgtggttc

SEQ ID NO: 8180675 - DNA, 22 bp, Homo sapiens
gcagggcagctcactgtggttc

SEQ ID NO: 8180676 - DNA, 22 bp, Homo sapiens
gcagggcagctcactgtggttc

SEQ ID NO: 8180677 - DNA, 22 bp, Homo sapiens
gcagggcagctgaagctaggtg

SEQ ID NO: 8180678 - DNA, 22 bp, Homo sapiens
gcagggcagctgaagctaggtg

SEQ ID NO: 8180679 - DNA, 22 bp, Homo sapiens
gcagggcagcttagtccctgtc

SEQ ID NO: 8180680 - DNA, 22 bp, Homo sapiens
gcagggcagcttagtccctgtc

SEQ ID NO: 8180681 - DNA, 22 bp, Homo sapiens
gcagggcagcttagtccctgtc

SEQ ID NO: 8180682 - DNA, 22 bp, Homo sapiens
gcagggcagcttagtccctgtc

SEQ ID NO: 8180683 - DNA, 22 bp, Homo sapiens
gcagggcagcttagtccctgtc

SEQ ID NO: 8180684 - DNA, 22 bp, Homo sapiens
gcagggcagcttagtccctgtc

SEQ ID NO: 8180685 - DNA, 22 bp, Homo sapiens
gcaggccacagtggagtctctg

SEQ ID NO: 8180686 - DNA, 22 bp, Homo sapiens
gcaggccactgtctcctctggg

SEQ ID NO: 8180687 - DNA, 22 bp, Homo sapiens
gcaggccacagtggagtctctg

SEQ ID NO: 8180688 - DNA, 22 bp, Homo sapiens
gcaggccactgtctcctctggg

SEQ ID NO: 8180689 - DNA, 22 bp, Homo sapiens
gcaggccagctgtgcagatggg

SEQ ID NO: 8180690 - DNA, 22 bp, Homo sapiens
gcaggccagctgtgcagatggg

SEQ ID NO: 8180691 - DNA, 22 bp, Homo sapiens
gcaggccagctgtgcagatggg

SEQ ID NO: 8180692 - DNA, 22 bp, Homo sapiens
gcaggccagctgtgcagatggg

SEQ ID NO: 8180693 - DNA, 22 bp, Homo sapiens
gcaggccagctgtgcagatggg

SEQ ID NO: 8180694 - DNA, 22 bp, Homo sapiens
gcaggccagctgtgcagatggg

SEQ ID NO: 8180695 - DNA, 22 bp, Homo sapiens
gcaggccattcaggagatgtgc

SEQ ID NO: 8180696 - DNA, 22 bp, Homo sapiens
gcaggccattcaggagatgtgc

SEQ ID NO: 8180697 - DNA, 22 bp, Homo sapiens
gcaggcccagagtcgctggcct

SEQ ID NO: 8180698 - DNA, 22 bp, Homo sapiens
gcaggcccagagtcgctggcct

SEQ ID NO: 8180699 - DNA, 22 bp, Homo sapiens
gcaggcccagagtcgctggcct

SEQ ID NO: 8180700 - DNA, 22 bp, Homo sapiens
gcaggcccagagtcgctggcct

SEQ ID NO: 8180701 - DNA, 22 bp, Homo sapiens
gcaggccaggctaggggctgtc

SEQ ID NO: 8180702 - DNA, 22 bp, Homo sapiens
gcaggccattcaggagatgtgc

SEQ ID NO: 8180703 - DNA, 22 bp, Homo sapiens
gcaggccaggctaggggctgtc

SEQ ID NO: 8180704 - DNA, 19 bp, Homo sapiens
gcaggccaggaggcggagg

SEQ ID NO: 8180705 - DNA, 22 bp, Homo sapiens
gcaggccaggctaggggctgtc

SEQ ID NO: 8180706 - DNA, 19 bp, Homo sapiens
gcaggccaggaggcggagg

SEQ ID NO: 8180707 - DNA, 22 bp, Homo sapiens
gcagctgtaaagcagaaatagt

SEQ ID NO: 8180708 - DNA, 23 bp, Homo sapiens
gcagctggttagaagggaaggag

SEQ ID NO: 8180709 - DNA, 22 bp, Homo sapiens
gcagctgtactggcagcattgt

SEQ ID NO: 8180710 - DNA, 22 bp, Homo sapiens
gcaggcagttgcagttttctag

SEQ ID NO: 8180711 - DNA, 22 bp, Homo sapiens
gcaggcatctctgtagccaggg

SEQ ID NO: 8180712 - DNA, 22 bp, Homo sapiens
gcaggcatctctgtagccaggg

SEQ ID NO: 8180713 - DNA, 22 bp, Homo sapiens
gcaggcatggtcgctgccaggt

SEQ ID NO: 8180714 - DNA, 22 bp, Homo sapiens
gcaggcatggtcgctgccaggt

SEQ ID NO: 8180715 - DNA, 22 bp, Homo sapiens
gcaggcagtttgcttttccctc

SEQ ID NO: 8180716 - DNA, 22 bp, Homo sapiens
gcaggcagtttgcttttccctc

SEQ ID NO: 8180717 - DNA, 22 bp, Homo sapiens
gcaggcagtttgcttttccctc

SEQ ID NO: 8180718 - DNA, 22 bp, Homo sapiens
gcaggccaagccctcgcagaga

SEQ ID NO: 8180719 - DNA, 22 bp, Homo sapiens
gcaggcattagcccccatggct

SEQ ID NO: 8180720 - DNA, 22 bp, Homo sapiens
gcaggcatggtcgctgccaggt

SEQ ID NO: 8180721 - DNA, 22 bp, Homo sapiens
gcaggccacagtggagtctctg

SEQ ID NO: 8180722 - DNA, 22 bp, Homo sapiens
gcaggccaagccctcgcagaga

SEQ ID NO: 8180723 - DNA, 22 bp, Homo sapiens
gcacatgttgctagttacttgc

SEQ ID NO: 8180724 - DNA, 17 bp, Homo sapiens
gcacatgtgttctttta

SEQ ID NO: 8180725 - DNA, 22 bp, Homo sapiens
gcacatgtcttattcactgtta

SEQ ID NO: 8180726 - DNA, 22 bp, Homo sapiens
gcacatgtgagagtagaggcct

SEQ ID NO: 8180727 - DNA, 22 bp, Homo sapiens
gcacatggacaatggaggtgca

SEQ ID NO: 8180728 - DNA, 18 bp, Homo sapiens
gcacatgtaagagtaaag

SEQ ID NO: 8180729 - DNA, 22 bp, Homo sapiens
gcacatggtaggcatttgatgt

SEQ ID NO: 8180730 - DNA, 22 bp, Homo sapiens
gcacatggtaggcatttgatgt

SEQ ID NO: 8180731 - DNA, 22 bp, Homo sapiens
gcacatggcggccagcaggtga

SEQ ID NO: 8180732 - DNA, 22 bp, Homo sapiens
gcacatgccccattcttgtcac

SEQ ID NO: 8180733 - DNA, 22 bp, Homo sapiens
gcacatgcatgcatattcctgg

SEQ ID NO: 8180734 - DNA, 22 bp, Homo sapiens
gcacatgcagactcattatcta

SEQ ID NO: 8180735 - DNA, 22 bp, Homo sapiens
gcacagatggtactagcttggt

SEQ ID NO: 8180736 - DNA, 22 bp, Homo sapiens
gcacagatggtactagcttggt

SEQ ID NO: 8180737 - DNA, 22 bp, Homo sapiens
gcacagagtgggtgagatgtgg

SEQ ID NO: 8180738 - DNA, 22 bp, Homo sapiens
gcacagagtgggtgagatgtgg

SEQ ID NO: 8180739 - DNA, 22 bp, Homo sapiens
gcacagagtcactagctaagca

SEQ ID NO: 8180740 - DNA, 22 bp, Homo sapiens
gcacagagtcactagctaagca

SEQ ID NO: 8180741 - DNA, 22 bp, Homo sapiens
gcacagagtcactagctaagca

SEQ ID NO: 8180742 - DNA, 22 bp, Homo sapiens
gcacagagtcactagctaagca

SEQ ID NO: 8180743 - DNA, 22 bp, Homo sapiens
gcacagaggtggaggacaaata

SEQ ID NO: 8180744 - DNA, 22 bp, Homo sapiens
gcacagaggtggaggacaaata

SEQ ID NO: 8180745 - DNA, 22 bp, Homo sapiens
gcacagcagacttggtggggct

SEQ ID NO: 8180746 - DNA, 22 bp, Homo sapiens
gcacagcacagcaacatgtttt

SEQ ID NO: 8180747 - DNA, 20 bp, Homo sapiens
gcacatgcaacttttattta

SEQ ID NO: 8180748 - DNA, 20 bp, Homo sapiens
gcacatgcaacttttattta

SEQ ID NO: 8180749 - DNA, 22 bp, Homo sapiens
gcacagcagctgctcagttgct

SEQ ID NO: 8180750 - DNA, 22 bp, Homo sapiens
gcacagcagctgctcagttgct

SEQ ID NO: 8180751 - DNA, 22 bp, Homo sapiens
gcacagagacagtcctgagatc

SEQ ID NO: 8180752 - DNA, 22 bp, Homo sapiens
gcacagagacagtcctgagatc

SEQ ID NO: 8180753 - DNA, 22 bp, Homo sapiens
gcacagagacagtcctgagatc

SEQ ID NO: 8180754 - DNA, 20 bp, Homo sapiens
gcacagagatgagcaaagta

SEQ ID NO: 8180755 - DNA, 22 bp, Homo sapiens
gcacagagagtcccgggtgccc

SEQ ID NO: 8180756 - DNA, 22 bp, Homo sapiens
gcacagagagggaaggtaactt

SEQ ID NO: 8180757 - DNA, 22 bp, Homo sapiens
gcacagagagggaaggtaactt

SEQ ID NO: 8180758 - DNA, 22 bp, Homo sapiens
gcacagagagggaaggtaactt

SEQ ID NO: 8180759 - DNA, 22 bp, Homo sapiens
gcacagaggtggaggacaaata

SEQ ID NO: 8180760 - DNA, 22 bp, Homo sapiens
gcacagagggcagtgagcctct

SEQ ID NO: 8180761 - DNA, 22 bp, Homo sapiens
gcaatacagttgaagagattga

SEQ ID NO: 8180762 - DNA, 22 bp, Homo sapiens
gcaatagattatgatctacagt

SEQ ID NO: 8180763 - DNA, 22 bp, Homo sapiens
gcaatagagcagctaatggaaa

SEQ ID NO: 8180764 - DNA, 22 bp, Homo sapiens
gcacagaaccagacatgaggca

SEQ ID NO: 8180765 - DNA, 22 bp, Homo sapiens
gcacagaataacactctgggct

SEQ ID NO: 8180766 - DNA, 22 bp, Homo sapiens
gcacagaagtaaaatacaagtc

SEQ ID NO: 8180767 - DNA, 22 bp, Homo sapiens
gagtattttcaaattcagcaga

SEQ ID NO: 8180768 - DNA, 22 bp, Homo sapiens
gagtattttcaaattcagcaga

SEQ ID NO: 8180769 - DNA, 22 bp, Homo sapiens
gagtcaacaagtcagatctcac

SEQ ID NO: 8180770 - DNA, 22 bp, Homo sapiens
gcaaggaagagcaggtggtgct

SEQ ID NO: 8180771 - DNA, 22 bp, Homo sapiens
gagtcacaaaagatgcccaggg

SEQ ID NO: 8180772 - DNA, 22 bp, Homo sapiens
gagtcacaaaagatgcccaggg

SEQ ID NO: 8180773 - DNA, 22 bp, Homo sapiens
gcaaggagactgtagggccaag

SEQ ID NO: 8180774 - DNA, 21 bp, Homo sapiens
gcaaggcaatgccatgatttc

SEQ ID NO: 8180775 - DNA, 22 bp, Homo sapiens
gagtagggtttccaggttagag

SEQ ID NO: 8180776 - DNA, 22 bp, Homo sapiens
gagtagggatgctggtgactcc

SEQ ID NO: 8180777 - DNA, 22 bp, Homo sapiens
gagtagggatgctggtgactcc

SEQ ID NO: 8180778 - DNA, 22 bp, Homo sapiens
gagtataatgattttcattcac

SEQ ID NO: 8180779 - DNA, 22 bp, Homo sapiens
gagtataagtaatttcaagcaa

SEQ ID NO: 8180780 - DNA, 22 bp, Homo sapiens
gagtataagctttttcacttca

SEQ ID NO: 8180781 - DNA, 22 bp, Homo sapiens
gagtatttatatgtaagtacct

SEQ ID NO: 8180782 - DNA, 20 bp, Homo sapiens
gagtatgtaggatggtatca

SEQ ID NO: 8180783 - DNA, 22 bp, Homo sapiens
gagtagggatgctggtgactcc

SEQ ID NO: 8180784 - DNA, 22 bp, Homo sapiens
gagtagcattctagagtatgct

SEQ ID NO: 8180785 - DNA, 22 bp, Homo sapiens
gagtagcattctagagtatgct

SEQ ID NO: 8180786 - DNA, 22 bp, Homo sapiens
gagtagaaagtaaagtacgaat

SEQ ID NO: 8180787 - DNA, 22 bp, Homo sapiens
gagtagaactggttatctaata

SEQ ID NO: 8180788 - DNA, 22 bp, Homo sapiens
gagtagaactagaattcttcaa

SEQ ID NO: 8180789 - DNA, 22 bp, Homo sapiens
gagtagaactagaattcttcaa

SEQ ID NO: 8180790 - DNA, 22 bp, Homo sapiens
gagtagaaggaagttatctacc

SEQ ID NO: 8180791 - DNA, 22 bp, Homo sapiens
gagtagaactggttatctaata

SEQ ID NO: 8180792 - DNA, 22 bp, Homo sapiens
gagtagacattaaattacactg

SEQ ID NO: 8180793 - DNA, 22 bp, Homo sapiens
gcaaggctcccgcagcccaggg

SEQ ID NO: 8180794 - DNA, 22 bp, Homo sapiens
gcaataaaatgtaatgattggg

SEQ ID NO: 8180795 - DNA, 22 bp, Homo sapiens
gcaataaagattttactgtcag

SEQ ID NO: 8180796 - DNA, 22 bp, Homo sapiens
gcaataaagtagcagctcatca

SEQ ID NO: 8180797 - DNA, 22 bp, Homo sapiens
gcaataaataacatggaagaca

SEQ ID NO: 8180798 - DNA, 22 bp, Homo sapiens
gcaataaataacatggaagaca

SEQ ID NO: 8180799 - DNA, 22 bp, Homo sapiens
gcaatacagtaagagtactgta

SEQ ID NO: 8180800 - DNA, 22 bp, Homo sapiens
gcaatacagtaggtttattggt

SEQ ID NO: 8180801 - DNA, 22 bp, Homo sapiens
gcaataaataacatggaagaca

SEQ ID NO: 8180802 - DNA, 18 bp, Homo sapiens
gcaaggctcaggccaggc

SEQ ID NO: 8180803 - DNA, 22 bp, Homo sapiens
gcaaggctcacattgaactgaa

SEQ ID NO: 8180804 - DNA, 22 bp, Homo sapiens
gcaaggctcacattgaactgaa

SEQ ID NO: 8180805 - DNA, 17 bp, Homo sapiens
gcaaggcctgtttgttc

SEQ ID NO: 8180806 - DNA, 18 bp, Homo sapiens
gcaaggctcaggccaggc

SEQ ID NO: 8180807 - DNA, 18 bp, Homo sapiens
gcaaggctcaggccaggc

SEQ ID NO: 8180808 - DNA, 18 bp, Homo sapiens
gcaaggctcaggccaggc

SEQ ID NO: 8180809 - DNA, 22 bp, Homo sapiens
gcaaggcctgaggtgggtgctc

SEQ ID NO: 8180810 - DNA, 22 bp, Homo sapiens
gcaaggcctgaggtgggtgctc

SEQ ID NO: 8180811 - DNA, 21 bp, Homo sapiens
gcaaggcctatcatggcagct

SEQ ID NO: 8180812 - DNA, 21 bp, Homo sapiens
gcaaggcctatcatggcagct

SEQ ID NO: 8180813 - DNA, 19 bp, Homo sapiens
gcaaggccagcttgatgtg

SEQ ID NO: 8180814 - DNA, 22 bp, Homo sapiens
gcaaggcagtcctggggccctg

SEQ ID NO: 8180815 - DNA, 22 bp, Homo sapiens
gcaaggcagcgcggagtagcta

SEQ ID NO: 8180816 - DNA, 22 bp, Homo sapiens
gcaaggcagcgcggagtagcta

SEQ ID NO: 8180817 - DNA, 20 bp, Homo sapiens
gcaaggcacagtgaggaggg

SEQ ID NO: 8180818 - DNA, 20 bp, Homo sapiens
gcaaggcacagtgaggaggg

SEQ ID NO: 8180819 - DNA, 22 bp, Homo sapiens
gcagaaggcctcttggttaata

SEQ ID NO: 8180820 - DNA, 22 bp, Homo sapiens
gcagaagggaataaggagcttt

SEQ ID NO: 8180821 - DNA, 22 bp, Homo sapiens
gcagaagggaataaggagcttt

SEQ ID NO: 8180822 - DNA, 22 bp, Homo sapiens
gcagacacagggaaggcaagga

SEQ ID NO: 8180823 - DNA, 22 bp, Homo sapiens
gcagacaatttattagcagatt

SEQ ID NO: 8180824 - DNA, 18 bp, Homo sapiens
gcagacactcgtggaggg

SEQ ID NO: 8180825 - DNA, 22 bp, Homo sapiens
gcagacaccttgtaggtgtgta

SEQ ID NO: 8180826 - DNA, 22 bp, Homo sapiens
gcagacagaagctaagtagaca

SEQ ID NO: 8180827 - DNA, 22 bp, Homo sapiens
gcagacagactgcagtgatttt

SEQ ID NO: 8180828 - DNA, 22 bp, Homo sapiens
gcagacagactgcagtgatttt

SEQ ID NO: 8180829 - DNA, 23 bp, Homo sapiens
gcagacagagcagactaagacaa

SEQ ID NO: 8180830 - DNA, 23 bp, Homo sapiens
gcagacagagcagactaagacaa

SEQ ID NO: 8180831 - DNA, 23 bp, Homo sapiens
gcagacagagcagactaagacaa

SEQ ID NO: 8180832 - DNA, 22 bp, Homo sapiens
gcagacagatgagggtgctggg

SEQ ID NO: 8180833 - DNA, 22 bp, Homo sapiens
gcagacagatgagggtgctggg

SEQ ID NO: 8180834 - DNA, 22 bp, Homo sapiens
gcagacagatgagggtgctggg

SEQ ID NO: 8180835 - DNA, 22 bp, Homo sapiens
gcagacagatgagggtgctggg

SEQ ID NO: 8180836 - DNA, 22 bp, Homo sapiens
gcagacagatgagggtgctggg

SEQ ID NO: 8180837 - DNA, 22 bp, Homo sapiens
gcagacagcatgttgggctatt

SEQ ID NO: 8180838 - DNA, 22 bp, Homo sapiens
gcagacagcatgttgggctatt

SEQ ID NO: 8180839 - DNA, 22 bp, Homo sapiens
gcagacagcatgttgggctatt

SEQ ID NO: 8180840 - DNA, 22 bp, Homo sapiens
gcagacagcatgttgggctatt

SEQ ID NO: 8180841 - DNA, 22 bp, Homo sapiens
gcagacagcatgttgggctatt

SEQ ID NO: 8180842 - DNA, 22 bp, Homo sapiens
gcagacagcatgttgggctatt

SEQ ID NO: 8180843 - DNA, 22 bp, Homo sapiens
gcagacaggcccagtggaggga

SEQ ID NO: 8180844 - DNA, 22 bp, Homo sapiens
gcagacaggcccagtggaggga

SEQ ID NO: 8180845 - DNA, 22 bp, Homo sapiens
gcagacaggcccagtggaggga

SEQ ID NO: 8180846 - DNA, 22 bp, Homo sapiens
gcagacagccagactgcactgg

SEQ ID NO: 8180847 - DNA, 22 bp, Homo sapiens
gcagacagccagactgcactgg

SEQ ID NO: 8180848 - DNA, 22 bp, Homo sapiens
gcagacaggattgggttaatag

SEQ ID NO: 8180849 - DNA, 22 bp, Homo sapiens
gcagacagccagactgcactgg

SEQ ID NO: 8180850 - DNA, 22 bp, Homo sapiens
gcagacagccagactgcactgg

SEQ ID NO: 8180851 - DNA, 22 bp, Homo sapiens
gcagaaggatccgcaggtgcaa

SEQ ID NO: 8180852 - DNA, 22 bp, Homo sapiens
gcagaaggatccgcaggtgcaa

SEQ ID NO: 8180853 - DNA, 22 bp, Homo sapiens
gcagaaggatccgcaggtgcaa

SEQ ID NO: 8180854 - DNA, 22 bp, Homo sapiens
gcagaaggatccgcaggtgcaa

SEQ ID NO: 8180855 - DNA, 21 bp, Homo sapiens
gcacccagccggttctcccag

SEQ ID NO: 8180856 - DNA, 22 bp, Homo sapiens
gcacccagaggtcagcagtgct

SEQ ID NO: 8180857 - DNA, 22 bp, Homo sapiens
gcacccagaggtcagcagtgct

SEQ ID NO: 8180858 - DNA, 22 bp, Homo sapiens
gcacccagaggtcagcagtgct

SEQ ID NO: 8180859 - DNA, 22 bp, Homo sapiens
gcacccagccagcatctcagag

SEQ ID NO: 8180860 - DNA, 22 bp, Homo sapiens
gcaccactaagagcagggaccg

SEQ ID NO: 8180861 - DNA, 22 bp, Homo sapiens
gcaccagctgcagggtggctga

SEQ ID NO: 8180862 - DNA, 22 bp, Homo sapiens
gcaccaggaggcccttctcatc

SEQ ID NO: 8180863 - DNA, 22 bp, Homo sapiens
gcacccagaggtcagcagtgct

SEQ ID NO: 8180864 - DNA, 22 bp, Homo sapiens
gcaccagctgccttctgtgccc

SEQ ID NO: 8180865 - DNA, 22 bp, Homo sapiens
gcaccagcctgagcctcttgca

SEQ ID NO: 8180866 - DNA, 22 bp, Homo sapiens
gcaccagctgccttctgtgccc

SEQ ID NO: 8180867 - DNA, 22 bp, Homo sapiens
gcagagtgaggaagagcttcca

SEQ ID NO: 8180868 - DNA, 22 bp, Homo sapiens
gcagagtgaagggagaggtgtg

SEQ ID NO: 8180869 - DNA, 22 bp, Homo sapiens
gcagagtgaagggagaggtgtg

SEQ ID NO: 8180870 - DNA, 22 bp, Homo sapiens
gcagagtgagccgaggctgctc

SEQ ID NO: 8180871 - DNA, 22 bp, Homo sapiens
gcagagtgagatatgaacccag

SEQ ID NO: 8180872 - DNA, 22 bp, Homo sapiens
gcagagtgagatatgaacccag

SEQ ID NO: 8180873 - DNA, 22 bp, Homo sapiens
gcagagtgatggaatgtgggtg

SEQ ID NO: 8180874 - DNA, 22 bp, Homo sapiens
gcagagtgatggaatgtgggtg

SEQ ID NO: 8180875 - DNA, 22 bp, Homo sapiens
gcagagtgccgagatggaagcg

SEQ ID NO: 8180876 - DNA, 22 bp, Homo sapiens
gcagagtgccgagatggaagcg

SEQ ID NO: 8180877 - DNA, 22 bp, Homo sapiens
gcagagtgctgtcgtacgcccc

SEQ ID NO: 8180878 - DNA, 18 bp, Homo sapiens
gcagagtgcgtctctgtg

SEQ ID NO: 8180879 - DNA, 18 bp, Homo sapiens
gcagagtgcgtctctgtg

SEQ ID NO: 8180880 - DNA, 18 bp, Homo sapiens
gcagagtgcgtctctgtg

SEQ ID NO: 8180881 - DNA, 22 bp, Homo sapiens
gcagcaagaggtgccatcttga

SEQ ID NO: 8180882 - DNA, 22 bp, Homo sapiens
gcagcaagaggtgccatcttga

SEQ ID NO: 8180883 - DNA, 22 bp, Homo sapiens
gcagcaagaataatttgggtag

SEQ ID NO: 8180884 - DNA, 18 bp, Homo sapiens
gcagcaaagggcccgggg

SEQ ID NO: 8180885 - DNA, 22 bp, Homo sapiens
gcagcaacgcggccctactgct

SEQ ID NO: 8180886 - DNA, 19 bp, Homo sapiens
gcagagtggggtggagggt

SEQ ID NO: 8180887 - DNA, 19 bp, Homo sapiens
gcagagtggggtggagggt

SEQ ID NO: 8180888 - DNA, 19 bp, Homo sapiens
gcagagtggggtggagggt

SEQ ID NO: 8180889 - DNA, 22 bp, Homo sapiens
gcagagtgggagcccagggctg

SEQ ID NO: 8180890 - DNA, 22 bp, Homo sapiens
gcagatgttgttgctgggagtt

SEQ ID NO: 8180891 - DNA, 22 bp, Homo sapiens
gcagatgttgatgcaagaagag

SEQ ID NO: 8180892 - DNA, 22 bp, Homo sapiens
gcagatgttgtgaggctggtaa

SEQ ID NO: 8180893 - DNA, 22 bp, Homo sapiens
gcagaggtgtcaccttccagga

SEQ ID NO: 8180894 - DNA, 22 bp, Homo sapiens
gcagaggtgctcagtggcagaa

SEQ ID NO: 8180895 - DNA, 22 bp, Homo sapiens
gcagaggtgctcagtggcagaa

SEQ ID NO: 8180896 - DNA, 22 bp, Homo sapiens
gcagaggtgctcagtggcagaa

SEQ ID NO: 8180897 - DNA, 22 bp, Homo sapiens
gcagaggtggcatctgggctct

SEQ ID NO: 8180898 - DNA, 22 bp, Homo sapiens
gcagaggtggcatctgggctct

SEQ ID NO: 8180899 - DNA, 22 bp, Homo sapiens
gcagacaggggcttaggaaagg

SEQ ID NO: 8180900 - DNA, 22 bp, Homo sapiens
gcagacagggctacagaggtac

SEQ ID NO: 8180901 - DNA, 22 bp, Homo sapiens
gcagacagggctacagaggtac

SEQ ID NO: 8180902 - DNA, 22 bp, Homo sapiens
gcagacagggctacagaggtac

SEQ ID NO: 8180903 - DNA, 22 bp, Homo sapiens
gcagacagggctacagaggtac

SEQ ID NO: 8180904 - DNA, 22 bp, Homo sapiens
gcagacaggcccagtggaggga

SEQ ID NO: 8180905 - DNA, 22 bp, Homo sapiens
gcagaggttggattggtgactt

SEQ ID NO: 8180906 - DNA, 19 bp, Homo sapiens
gcagagtcaagagctgctg

SEQ ID NO: 8180907 - DNA, 23 bp, Homo sapiens
gcagaggtttttcagtatggttt

SEQ ID NO: 8180908 - DNA, 22 bp, Homo sapiens
gcagagtcagcctccgagacag

SEQ ID NO: 8180909 - DNA, 23 bp, Homo sapiens
gcagagtcaagtagtcatgagtg

SEQ ID NO: 8180910 - DNA, 19 bp, Homo sapiens
gcagagtcaagagctgctg

SEQ ID NO: 8180911 - DNA, 19 bp, Homo sapiens
gcagagtcaagagctgctg

SEQ ID NO: 8180912 - DNA, 22 bp, Homo sapiens
gcagagtgaagcagtatggaaa

SEQ ID NO: 8180913 - DNA, 22 bp, Homo sapiens
gcagagtgaagcagtatggaaa

SEQ ID NO: 8180914 - DNA, 22 bp, Homo sapiens
gcagagtctgggctacctcttg

SEQ ID NO: 8180915 - DNA, 22 bp, Homo sapiens
gcagagtctggtaggtgctggt

SEQ ID NO: 8180916 - DNA, 22 bp, Homo sapiens
gcagagtctggtaggtgctggt

SEQ ID NO: 8180917 - DNA, 22 bp, Homo sapiens
gcagagtcaggtccaaggactg

SEQ ID NO: 8180918 - DNA, 22 bp, Homo sapiens
gcagagtcaggtccaaggactg

SEQ ID NO: 8180919 - DNA, 22 bp, Homo sapiens
gcagagtcaggattccatccca

SEQ ID NO: 8180920 - DNA, 22 bp, Homo sapiens
gcagagtcattatttatgcaat

SEQ ID NO: 8180921 - DNA, 22 bp, Homo sapiens
gcagagtctgggcagcctccat

SEQ ID NO: 8180922 - DNA, 22 bp, Homo sapiens
gcagagtcccagcaggtggtgg

SEQ ID NO: 8180923 - DNA, 22 bp, Homo sapiens
gcagagtcccagcaggtggtgg

SEQ ID NO: 8180924 - DNA, 22 bp, Homo sapiens
gcagagtcccagcaggtggtgg

SEQ ID NO: 8180925 - DNA, 22 bp, Homo sapiens
gcctcaggtaaaacttgagttt

SEQ ID NO: 8180926 - DNA, 22 bp, Homo sapiens
gcctcaggtaaaacttgagttt

SEQ ID NO: 8180927 - DNA, 22 bp, Homo sapiens
gcctcaggtgcatctctcattc

SEQ ID NO: 8180928 - DNA, 22 bp, Homo sapiens
gcctcaggtgcatctctcattc

SEQ ID NO: 8180929 - DNA, 22 bp, Homo sapiens
gcctcaggtaaaacttgagttt

SEQ ID NO: 8180930 - DNA, 22 bp, Homo sapiens
gcctcaggtaaaacttgagttt

SEQ ID NO: 8180931 - DNA, 20 bp, Homo sapiens
gccctggacgtggcctcggc

SEQ ID NO: 8180932 - DNA, 22 bp, Homo sapiens
gcctcagggggagaggccagct

SEQ ID NO: 8180933 - DNA, 22 bp, Homo sapiens
gcctcagggggagaggccagct

SEQ ID NO: 8180934 - DNA, 22 bp, Homo sapiens
gccctgcttctggcatgcagaa

SEQ ID NO: 8180935 - DNA, 22 bp, Homo sapiens
gccctgcttggtcatggccttc

SEQ ID NO: 8180936 - DNA, 22 bp, Homo sapiens
gccctgcttggtcatggccttc

SEQ ID NO: 8180937 - DNA, 22 bp, Homo sapiens
gccctggaaaggaacctgggct

SEQ ID NO: 8180938 - DNA, 22 bp, Homo sapiens
gccctggaatctctccatggga

SEQ ID NO: 8180939 - DNA, 20 bp, Homo sapiens
gccctggacgtggcctcggc

SEQ ID NO: 8180940 - DNA, 22 bp, Homo sapiens
gcctcaggtgcatctctcattc

SEQ ID NO: 8180941 - DNA, 22 bp, Homo sapiens
gcctcaggtgcatctctcattc

SEQ ID NO: 8180942 - DNA, 22 bp, Homo sapiens
gcctcagttgatctgtgtgagc

SEQ ID NO: 8180943 - DNA, 20 bp, Homo sapiens
gcctccacactcacccctta

SEQ ID NO: 8180944 - DNA, 20 bp, Homo sapiens
gcctccaccccaggcttcag

SEQ ID NO: 8180945 - DNA, 18 bp, Homo sapiens
gcctccaccatggagggt

SEQ ID NO: 8180946 - DNA, 20 bp, Homo sapiens
gcctccacactcacccctta

SEQ ID NO: 8180947 - DNA, 23 bp, Homo sapiens
gcctccaaacctctaggctggtg

SEQ ID NO: 8180948 - DNA, 19 bp, Homo sapiens
gcctcatttccacctcccc

SEQ ID NO: 8180949 - DNA, 22 bp, Homo sapiens
gccctgctggggcacagcaaga

SEQ ID NO: 8180950 - DNA, 23 bp, Homo sapiens
gccctgctgggacctcctgctac

SEQ ID NO: 8180951 - DNA, 22 bp, Homo sapiens
gccctgctggggcacagcaaga

SEQ ID NO: 8180952 - DNA, 22 bp, Homo sapiens
gccctgctgtcttcagagtata

SEQ ID NO: 8180953 - DNA, 22 bp, Homo sapiens
gccctgctgtcttcagagtata

SEQ ID NO: 8180954 - DNA, 22 bp, Homo sapiens
gccctgcttctggcatgcagaa

SEQ ID NO: 8180955 - DNA, 22 bp, Homo sapiens
gccctgcttctggcatgcagaa

SEQ ID NO: 8180956 - DNA, 22 bp, Homo sapiens
gccctgcttctggcatgcagaa

SEQ ID NO: 8180957 - DNA, 22 bp, Homo sapiens
gccctgctgtttagagagctac

SEQ ID NO: 8180958 - DNA, 22 bp, Homo sapiens
gccctgctgtttagagagctac

SEQ ID NO: 8180959 - DNA, 22 bp, Homo sapiens
gccctgctgtttagagagctac

SEQ ID NO: 8180960 - DNA, 22 bp, Homo sapiens
gccctgctgcgcagcacgcatg

SEQ ID NO: 8180961 - DNA, 23 bp, Homo sapiens
gccctgctgggacctcctgctac

SEQ ID NO: 8180962 - DNA, 23 bp, Homo sapiens
gccctgctgggacctcctgctac

SEQ ID NO: 8180963 - DNA, 22 bp, Homo sapiens
gccctgctgctggcagaggcgc

SEQ ID NO: 8180964 - DNA, 22 bp, Homo sapiens
gccctgctcttttgcccaccca

SEQ ID NO: 8180965 - DNA, 22 bp, Homo sapiens
gccctgctgagtccggctcaga

SEQ ID NO: 8180966 - DNA, 22 bp, Homo sapiens
gccctgctgagtccggctcaga

SEQ ID NO: 8180967 - DNA, 22 bp, Homo sapiens
gccctgctgcgcagcacgcatg

SEQ ID NO: 8180968 - DNA, 22 bp, Homo sapiens
gccctgctctgttggtcacctg

SEQ ID NO: 8180969 - DNA, 22 bp, Homo sapiens
gccctgctctggtctctgcccg

SEQ ID NO: 8180970 - DNA, 22 bp, Homo sapiens
gccctgctctggtctctgcccg

SEQ ID NO: 8180971 - DNA, 22 bp, Homo sapiens
gccctgctctggtctctgcccg

SEQ ID NO: 8180972 - DNA, 23 bp, Homo sapiens
gccctgctcctggctgggaggga

SEQ ID NO: 8180973 - DNA, 23 bp, Homo sapiens
gccctgctcctggctgggaggga

SEQ ID NO: 8180974 - DNA, 22 bp, Homo sapiens
gccctgctcctccgtcccacga

SEQ ID NO: 8180975 - DNA, 22 bp, Homo sapiens
gccctgctcatttcacgtgttt

SEQ ID NO: 8180976 - DNA, 22 bp, Homo sapiens
gccctgctccaggagaataccc

SEQ ID NO: 8180977 - DNA, 22 bp, Homo sapiens
gccctgcgccgtcccgctggtg

SEQ ID NO: 8180978 - DNA, 22 bp, Homo sapiens
gccctgctaatttcgtactttt

SEQ ID NO: 8180979 - DNA, 23 bp, Homo sapiens
gccctgctactcacaagctgtgt

SEQ ID NO: 8180980 - DNA, 22 bp, Homo sapiens
gccctgctcatttcacgtgttt

SEQ ID NO: 8180981 - DNA, 22 bp, Homo sapiens
gccctgctcatttcacgtgttt

SEQ ID NO: 8180982 - DNA, 23 bp, Homo sapiens
gccctgctactcacaagctgtgt

SEQ ID NO: 8180983 - DNA, 17 bp, Homo sapiens
gccctgcctgctgccct

SEQ ID NO: 8180984 - DNA, 22 bp, Homo sapiens
gccctgcctgtctgctgggagg

SEQ ID NO: 8180985 - DNA, 22 bp, Homo sapiens
gcccacacaccagctcaggagg

SEQ ID NO: 8180986 - DNA, 22 bp, Homo sapiens
gcccaatattgtgtgctacctt

SEQ ID NO: 8180987 - DNA, 22 bp, Homo sapiens
gcccaatagtggggatatacct

SEQ ID NO: 8180988 - DNA, 22 bp, Homo sapiens
gcccaatagagaaatagtgaaa

SEQ ID NO: 8180989 - DNA, 22 bp, Homo sapiens
gcccaaggtcccatggcagcac

SEQ ID NO: 8180990 - DNA, 20 bp, Homo sapiens
gcccaaggtccagaaggggg

SEQ ID NO: 8180991 - DNA, 22 bp, Homo sapiens
gccccaggggaggtgccctgca

SEQ ID NO: 8180992 - DNA, 22 bp, Homo sapiens
gccccaggggaggtgccctgca

SEQ ID NO: 8180993 - DNA, 22 bp, Homo sapiens
gcccacaggggacctggtggct

SEQ ID NO: 8180994 - DNA, 22 bp, Homo sapiens
gcccacaggggacctggtggct

SEQ ID NO: 8180995 - DNA, 22 bp, Homo sapiens
gcccacagctcgttcctctcct

SEQ ID NO: 8180996 - DNA, 22 bp, Homo sapiens
gcccacagctcgttcctctcct

SEQ ID NO: 8180997 - DNA, 22 bp, Homo sapiens
gcccacagaggcaccaccaggc

SEQ ID NO: 8180998 - DNA, 22 bp, Homo sapiens
gcccacagctcgttcctctcct

SEQ ID NO: 8180999 - DNA, 22 bp, Homo sapiens
gcccctggctggccagctcctc

SEQ ID NO: 8181000 - DNA, 22 bp, Homo sapiens
gcccctggctggccagctcctc

SEQ ID NO: 8181001 - DNA, 22 bp, Homo sapiens
gcccctggctggccagctcctc

SEQ ID NO: 8181002 - DNA, 22 bp, Homo sapiens
gcccctggctggccagctcctc

SEQ ID NO: 8181003 - DNA, 22 bp, Homo sapiens
gcccctctccttgtgcacctgc

SEQ ID NO: 8181004 - DNA, 22 bp, Homo sapiens
gcccctctccttgtgcacctgc

SEQ ID NO: 8181005 - DNA, 22 bp, Homo sapiens
gcccctctccttgtgcacctgc

SEQ ID NO: 8181006 - DNA, 22 bp, Homo sapiens
gcccctctccttgtgcacctgc

SEQ ID NO: 8181007 - DNA, 22 bp, Homo sapiens
gcccctctcccttgaggcaggc

SEQ ID NO: 8181008 - DNA, 22 bp, Homo sapiens
gcccctcccagtcaggagcact

SEQ ID NO: 8181009 - DNA, 22 bp, Homo sapiens
gcccctccatccatcaccgggg

SEQ ID NO: 8181010 - DNA, 22 bp, Homo sapiens
gcccctccatccatcaccgggg

SEQ ID NO: 8181011 - DNA, 22 bp, Homo sapiens
gcccctccgggcgcgtcatagc

SEQ ID NO: 8181012 - DNA, 22 bp, Homo sapiens
gccccaggttgcctgtcccagg

SEQ ID NO: 8181013 - DNA, 22 bp, Homo sapiens
gccccaggttgcctgtcccagg

SEQ ID NO: 8181014 - DNA, 22 bp, Homo sapiens
gccccaggttgcctgtcccagg

SEQ ID NO: 8181015 - DNA, 22 bp, Homo sapiens
gccccaggtggtaaacctaaga

SEQ ID NO: 8181016 - DNA, 22 bp, Homo sapiens
gccccaggtggtaaacctaaga

SEQ ID NO: 8181017 - DNA, 22 bp, Homo sapiens
gccctaggcctgtttgtccata

SEQ ID NO: 8181018 - DNA, 21 bp, Homo sapiens
gccctaggctacctggagcgc

SEQ ID NO: 8181019 - DNA, 22 bp, Homo sapiens
gccctaggcttttgtgactgcc

SEQ ID NO: 8181020 - DNA, 22 bp, Homo sapiens
gccctcagaggacagctgactt

SEQ ID NO: 8181021 - DNA, 22 bp, Homo sapiens
gccctcagaatgggctctaatc

SEQ ID NO: 8181022 - DNA, 22 bp, Homo sapiens
gccctagggggaaccgaggact

SEQ ID NO: 8181023 - DNA, 22 bp, Homo sapiens
gccctcagaggacagctgactt

SEQ ID NO: 8181024 - DNA, 19 bp, Homo sapiens
gccctgagtaagctaggag

SEQ ID NO: 8181025 - DNA, 22 bp, Homo sapiens
gccctcagagttccccacagtg

SEQ ID NO: 8181026 - DNA, 22 bp, Homo sapiens
gccctgagttgagccttccaaa

SEQ ID NO: 8181027 - DNA, 22 bp, Homo sapiens
gccctacctcagtccagatctg

SEQ ID NO: 8181028 - DNA, 22 bp, Homo sapiens
gccctagcccgggccacctgtt

SEQ ID NO: 8181029 - DNA, 22 bp, Homo sapiens
gccctagcgccagctcagcacc

SEQ ID NO: 8181030 - DNA, 22 bp, Homo sapiens
gcccgcgccagcctctccatct

SEQ ID NO: 8181031 - DNA, 22 bp, Homo sapiens
gcccgcgccagcctctccatct

SEQ ID NO: 8181032 - DNA, 22 bp, Homo sapiens
gcccgcgccagcctctccatct

SEQ ID NO: 8181033 - DNA, 22 bp, Homo sapiens
gcccgcgccagcctctccatct

SEQ ID NO: 8181034 - DNA, 22 bp, Homo sapiens
gcccctgggagcagagccacca

SEQ ID NO: 8181035 - DNA, 22 bp, Homo sapiens
gcccctgggagcagagccacca

SEQ ID NO: 8181036 - DNA, 22 bp, Homo sapiens
gccccttccatcatgtgaggac

SEQ ID NO: 8181037 - DNA, 22 bp, Homo sapiens
gccccttcgtggaagtgcattc

SEQ ID NO: 8181038 - DNA, 22 bp, Homo sapiens
gcccgcagagatctttaacaaa

SEQ ID NO: 8181039 - DNA, 22 bp, Homo sapiens
gccccttgtctccaggccccaa

SEQ ID NO: 8181040 - DNA, 22 bp, Homo sapiens
gccccttgggaattcctccact

SEQ ID NO: 8181041 - DNA, 22 bp, Homo sapiens
gcctggagtgcagtggcgtgat

SEQ ID NO: 8181042 - DNA, 22 bp, Homo sapiens
gcctggagtggacttggcccct

SEQ ID NO: 8181043 - DNA, 22 bp, Homo sapiens
gcctggagtgcagtggcgtgat

SEQ ID NO: 8181044 - DNA, 22 bp, Homo sapiens
gcctggagtgcagtggcgtgat

SEQ ID NO: 8181045 - DNA, 22 bp, Homo sapiens
gcctggagtgcagtggcgtgat

SEQ ID NO: 8181046 - DNA, 22 bp, Homo sapiens
gcctggagtgcagtggcgtgat

SEQ ID NO: 8181047 - DNA, 22 bp, Homo sapiens
gcctggagtgcagtggcgtgat

SEQ ID NO: 8181048 - DNA, 22 bp, Homo sapiens
gcctggagtggacttggcccct

SEQ ID NO: 8181049 - DNA, 22 bp, Homo sapiens
gcctggagtggacttggcccct

SEQ ID NO: 8181050 - DNA, 16 bp, Homo sapiens
gcctggagtggcaggg

SEQ ID NO: 8181051 - DNA, 16 bp, Homo sapiens
gcctggagtggcaggg

SEQ ID NO: 8181052 - DNA, 16 bp, Homo sapiens
gcctggagtggcaggg

SEQ ID NO: 8181053 - DNA, 16 bp, Homo sapiens
gcctggagtggcaggg

SEQ ID NO: 8181054 - DNA, 22 bp, Homo sapiens
gcctggagcccagtgtggggct

SEQ ID NO: 8181055 - DNA, 22 bp, Homo sapiens
gcctggagcccagtgtggggct

SEQ ID NO: 8181056 - DNA, 22 bp, Homo sapiens
gcctggagcccagtgtggggct

SEQ ID NO: 8181057 - DNA, 22 bp, Homo sapiens
gcctggagcccagtgtggggct

SEQ ID NO: 8181058 - DNA, 22 bp, Homo sapiens
gcctggagcccagtgtggggct

SEQ ID NO: 8181059 - DNA, 22 bp, Homo sapiens
gcctggagtgcagtggcgtgat

SEQ ID NO: 8181060 - DNA, 22 bp, Homo sapiens
gcctggagtagcatggcaagcc

SEQ ID NO: 8181061 - DNA, 22 bp, Homo sapiens
gcctggagtagcatggcaagcc

SEQ ID NO: 8181062 - DNA, 22 bp, Homo sapiens
gcctggagtagcatggcaagcc

SEQ ID NO: 8181063 - DNA, 22 bp, Homo sapiens
gcctggagtagcatggcaagcc

SEQ ID NO: 8181064 - DNA, 22 bp, Homo sapiens
gcctggagtagcatggcaagcc

SEQ ID NO: 8181065 - DNA, 22 bp, Homo sapiens
gcctggagaggaagccggtgga

SEQ ID NO: 8181066 - DNA, 22 bp, Homo sapiens
gcctggagcagacgtgtcccgg

SEQ ID NO: 8181067 - DNA, 22 bp, Homo sapiens
gcctggagcagacgtgtcccgg

SEQ ID NO: 8181068 - DNA, 22 bp, Homo sapiens
gcctggagcagacgtgtcccgg

SEQ ID NO: 8181069 - DNA, 22 bp, Homo sapiens
gcctggagcagacgtgtcccgg

SEQ ID NO: 8181070 - DNA, 22 bp, Homo sapiens
gcctggagaggaagccggtgga

SEQ ID NO: 8181071 - DNA, 22 bp, Homo sapiens
gcctggagaggaagccggtgga

SEQ ID NO: 8181072 - DNA, 22 bp, Homo sapiens
gcctggagaggaagccggtgga

SEQ ID NO: 8181073 - DNA, 22 bp, Homo sapiens
gcctggagaggaagccggtgga

SEQ ID NO: 8181074 - DNA, 22 bp, Homo sapiens
gcctggagaggaagccggtgga

SEQ ID NO: 8181075 - DNA, 22 bp, Homo sapiens
gcctggagaggaagccggtgga

SEQ ID NO: 8181076 - DNA, 22 bp, Homo sapiens
gcctggagacctgctcctctac

SEQ ID NO: 8181077 - DNA, 22 bp, Homo sapiens
gcctggagacctgctcctctac

SEQ ID NO: 8181078 - DNA, 22 bp, Homo sapiens
gcctggagacctgctcctctac

SEQ ID NO: 8181079 - DNA, 22 bp, Homo sapiens
gcctggagacagcagaggcggc

SEQ ID NO: 8181080 - DNA, 22 bp, Homo sapiens
gcctggagacagcagaggcggc

SEQ ID NO: 8181081 - DNA, 22 bp, Homo sapiens
gcctggagacagcagaggcggc

SEQ ID NO: 8181082 - DNA, 22 bp, Homo sapiens
gcctggagagcactgtgcgctt

SEQ ID NO: 8181083 - DNA, 22 bp, Homo sapiens
gcctggagagcactgtgcgctt

SEQ ID NO: 8181084 - DNA, 22 bp, Homo sapiens
gcctggagagcactgtgcgctt

SEQ ID NO: 8181085 - DNA, 22 bp, Homo sapiens
gcctggagagcactgtgcgctt

SEQ ID NO: 8181086 - DNA, 22 bp, Homo sapiens
gcctggagagcactgtgcgctt

SEQ ID NO: 8181087 - DNA, 22 bp, Homo sapiens
gcctggagacctgctcctctac

SEQ ID NO: 8181088 - DNA, 22 bp, Homo sapiens
gcctggagacctgctcctctac

SEQ ID NO: 8181089 - DNA, 22 bp, Homo sapiens
gcctgcagggtgatgggctgcc

SEQ ID NO: 8181090 - DNA, 22 bp, Homo sapiens
gcctgcagggtgatgggctgcc

SEQ ID NO: 8181091 - DNA, 22 bp, Homo sapiens
gcctgcagggtgatgggctgcc

SEQ ID NO: 8181092 - DNA, 22 bp, Homo sapiens
gcctgcagggtgatgggctgcc

SEQ ID NO: 8181093 - DNA, 22 bp, Homo sapiens
gcctgcagggtgatgggctgcc

SEQ ID NO: 8181094 - DNA, 20 bp, Homo sapiens
gcctgcaggttggatgggat

SEQ ID NO: 8181095 - DNA, 22 bp, Homo sapiens
gcctgcagtgagtgcagaaggt

SEQ ID NO: 8181096 - DNA, 22 bp, Homo sapiens
gcctgcagtgagtgcagaaggt

SEQ ID NO: 8181097 - DNA, 22 bp, Homo sapiens
gcctgcagttctgtgctaggca

SEQ ID NO: 8181098 - DNA, 22 bp, Homo sapiens
gcctgcagttctgtgctaggca

SEQ ID NO: 8181099 - DNA, 23 bp, Homo sapiens
gcctggagaaaagctgcagttca

SEQ ID NO: 8181100 - DNA, 23 bp, Homo sapiens
gcctggagaaaagctgcagttca

SEQ ID NO: 8181101 - DNA, 23 bp, Homo sapiens
gcctggagaaaagctgcagttca

SEQ ID NO: 8181102 - DNA, 23 bp, Homo sapiens
gcctggagaaaagctgcagttca

SEQ ID NO: 8181103 - DNA, 23 bp, Homo sapiens
gcctggagaaaagctgcagttca

SEQ ID NO: 8181104 - DNA, 22 bp, Homo sapiens
gcctggagaagatggaactagc

SEQ ID NO: 8181105 - DNA, 22 bp, Homo sapiens
gcctggagaagatggaactagc

SEQ ID NO: 8181106 - DNA, 22 bp, Homo sapiens
gcctggagaattaaaaggaagg

SEQ ID NO: 8181107 - DNA, 22 bp, Homo sapiens
gcctggagaagatggaactagc

SEQ ID NO: 8181108 - DNA, 22 bp, Homo sapiens
gcctggagaaaggaaggtggga

SEQ ID NO: 8181109 - DNA, 22 bp, Homo sapiens
gcctggagaaaggaaggtggga

SEQ ID NO: 8181110 - DNA, 22 bp, Homo sapiens
gcctggagaaaggaaggtggga

SEQ ID NO: 8181111 - DNA, 22 bp, Homo sapiens
gcctggagaaaggaaggtggga

SEQ ID NO: 8181112 - DNA, 22 bp, Homo sapiens
gcctggagaaaggaaggtggga

SEQ ID NO: 8181113 - DNA, 22 bp, Homo sapiens
gcctggagaaaggaaggtggga

SEQ ID NO: 8181114 - DNA, 22 bp, Homo sapiens
gcctggagacagcagaggcggc

SEQ ID NO: 8181115 - DNA, 22 bp, Homo sapiens
gcctggagacaaggacaaaggg

SEQ ID NO: 8181116 - DNA, 22 bp, Homo sapiens
gcctggagacaaggacaaaggg

SEQ ID NO: 8181117 - DNA, 22 bp, Homo sapiens
gcctggagacagcagaggcggc

SEQ ID NO: 8181118 - DNA, 22 bp, Homo sapiens
gcctggagacaaggacaaaggg

SEQ ID NO: 8181119 - DNA, 22 bp, Homo sapiens
gcctggagacaaggacaaaggg

SEQ ID NO: 8181120 - DNA, 22 bp, Homo sapiens
gcctggagacaaggacaaaggg

SEQ ID NO: 8181121 - DNA, 22 bp, Homo sapiens
gcctggagaattaaaaggaagg

SEQ ID NO: 8181122 - DNA, 22 bp, Homo sapiens
gcctggagaattaaaaggaagg

SEQ ID NO: 8181123 - DNA, 22 bp, Homo sapiens
gcctggagaattaaaaggaagg

SEQ ID NO: 8181124 - DNA, 20 bp, Homo sapiens
gcctgcagagaaggtcagag

SEQ ID NO: 8181125 - DNA, 22 bp, Homo sapiens
gcctgcagaactgtgaggcaat

SEQ ID NO: 8181126 - DNA, 21 bp, Homo sapiens
gcctgcagaccccaccaggct

SEQ ID NO: 8181127 - DNA, 20 bp, Homo sapiens
gcctgcagagaaggtcagag

SEQ ID NO: 8181128 - DNA, 22 bp, Homo sapiens
gcctgcagaggtgctgctagct

SEQ ID NO: 8181129 - DNA, 22 bp, Homo sapiens
gcctgcagaggtgctgctagct

SEQ ID NO: 8181130 - DNA, 22 bp, Homo sapiens
gcctgcagaggtgctgctagct

SEQ ID NO: 8181131 - DNA, 20 bp, Homo sapiens
gcctgatggacatttcagtt

SEQ ID NO: 8181132 - DNA, 22 bp, Homo sapiens
gcctgcaaacaaggacttctga

SEQ ID NO: 8181133 - DNA, 22 bp, Homo sapiens
gcctgcacccacaggcatggcc

SEQ ID NO: 8181134 - DNA, 21 bp, Homo sapiens
gcctgcacacagtaggtgcac

SEQ ID NO: 8181135 - DNA, 21 bp, Homo sapiens
gcctgcacacagtaggtgcac

SEQ ID NO: 8181136 - DNA, 19 bp, Homo sapiens
gcctgcagaaaaggcaggg

SEQ ID NO: 8181137 - DNA, 19 bp, Homo sapiens
gcctgcagaaaaggcaggg

SEQ ID NO: 8181138 - DNA, 22 bp, Homo sapiens
gcctgcactcaaacactctctt

SEQ ID NO: 8181139 - DNA, 22 bp, Homo sapiens
gcctgcagaactgtgaggcaat

SEQ ID NO: 8181140 - DNA, 18 bp, Homo sapiens
gcctgcaggcacgggggt

SEQ ID NO: 8181141 - DNA, 22 bp, Homo sapiens
gcctgcagcctcagagaatttt

SEQ ID NO: 8181142 - DNA, 22 bp, Homo sapiens
gcctgcagggcctgggcctacc

SEQ ID NO: 8181143 - DNA, 22 bp, Homo sapiens
gcctgcagggcctgggcctacc

SEQ ID NO: 8181144 - DNA, 22 bp, Homo sapiens
gcctgcagggcccttgtgggtc

SEQ ID NO: 8181145 - DNA, 17 bp, Homo sapiens
gcctgcaggcccgcaga

SEQ ID NO: 8181146 - DNA, 22 bp, Homo sapiens
gcctgcagatatataggatggt

SEQ ID NO: 8181147 - DNA, 22 bp, Homo sapiens
gcctgcagatatataggatggt

SEQ ID NO: 8181148 - DNA, 22 bp, Homo sapiens
gcctgcagcccctctgcagtag

SEQ ID NO: 8181149 - DNA, 22 bp, Homo sapiens
gcctgcagcccctctgcagtag

SEQ ID NO: 8181150 - DNA, 22 bp, Homo sapiens
gcctgcagcctcaagggctgag

SEQ ID NO: 8181151 - DNA, 22 bp, Homo sapiens
gcctgcagcctcaagggctgag

SEQ ID NO: 8181152 - DNA, 22 bp, Homo sapiens
gcctgagggctcctagcaggct

SEQ ID NO: 8181153 - DNA, 22 bp, Homo sapiens
gcctgaggaattgagggggtaa

SEQ ID NO: 8181154 - DNA, 22 bp, Homo sapiens
gcctgagggctcctagcaggct

SEQ ID NO: 8181155 - DNA, 22 bp, Homo sapiens
gcctgagggctcctagcaggct

SEQ ID NO: 8181156 - DNA, 22 bp, Homo sapiens
gcctgagtcaagatgtggcacc

SEQ ID NO: 8181157 - DNA, 22 bp, Homo sapiens
gcctgagtaaatatgcggcagg

SEQ ID NO: 8181158 - DNA, 22 bp, Homo sapiens
gcctccctgttcttccacaata

SEQ ID NO: 8181159 - DNA, 22 bp, Homo sapiens
gcctccctgtttcctgctccaa

SEQ ID NO: 8181160 - DNA, 18 bp, Homo sapiens
gcctccctggctacactt

SEQ ID NO: 8181161 - DNA, 18 bp, Homo sapiens
gcctccctggctacactt

SEQ ID NO: 8181162 - DNA, 22 bp, Homo sapiens
gcctccactgatcagacttgac

SEQ ID NO: 8181163 - DNA, 22 bp, Homo sapiens
gcctccactgatcagacttgac

SEQ ID NO: 8181164 - DNA, 22 bp, Homo sapiens
gcctccccaggggtgtcatgag

SEQ ID NO: 8181165 - DNA, 22 bp, Homo sapiens
gcctccccaggggtgtcatgag

SEQ ID NO: 8181166 - DNA, 22 bp, Homo sapiens
gcctccacttctttagtatgac

SEQ ID NO: 8181167 - DNA, 22 bp, Homo sapiens
gcctccaccgaacgctctcttg

SEQ ID NO: 8181168 - DNA, 22 bp, Homo sapiens
gcctccaccgaacgctctcttg

SEQ ID NO: 8181169 - DNA, 22 bp, Homo sapiens
gcctccacccctggggagtgga

SEQ ID NO: 8181170 - DNA, 22 bp, Homo sapiens
gcctccctccaccactgcaggt

SEQ ID NO: 8181171 - DNA, 22 bp, Homo sapiens
gcctccctggcccacagcagcg

SEQ ID NO: 8181172 - DNA, 22 bp, Homo sapiens
gccaggctaagaaaggtgtgat

SEQ ID NO: 8181173 - DNA, 22 bp, Homo sapiens
gccaggctaagaaaggtgtgat

SEQ ID NO: 8181174 - DNA, 22 bp, Homo sapiens
gccaggctaagaaaggtgtgat

SEQ ID NO: 8181175 - DNA, 22 bp, Homo sapiens
gccaggctcagcagtcaacctg

SEQ ID NO: 8181176 - DNA, 22 bp, Homo sapiens
gccaggctcagcagtcaacctg

SEQ ID NO: 8181177 - DNA, 22 bp, Homo sapiens
gccaggctcagcagtcaacctg

SEQ ID NO: 8181178 - DNA, 22 bp, Homo sapiens
gccaggctcagtagcgattcct

SEQ ID NO: 8181179 - DNA, 22 bp, Homo sapiens
gccaggctcagtagcgattcct

SEQ ID NO: 8181180 - DNA, 22 bp, Homo sapiens
gccaggcattattccgatccct

SEQ ID NO: 8181181 - DNA, 22 bp, Homo sapiens
gccaggcgggtctcaaactcct

SEQ ID NO: 8181182 - DNA, 22 bp, Homo sapiens
gccaggcattattccgatccct

SEQ ID NO: 8181183 - DNA, 22 bp, Homo sapiens
gccaggcattattccgatccct

SEQ ID NO: 8181184 - DNA, 22 bp, Homo sapiens
gccaggctaagaaaggtgtgat

SEQ ID NO: 8181185 - DNA, 22 bp, Homo sapiens
gccaggctaagaaaggtgtgat

SEQ ID NO: 8181186 - DNA, 22 bp, Homo sapiens
gccaggctaagaaaggtgtgat

SEQ ID NO: 8181187 - DNA, 22 bp, Homo sapiens
gccaggctaagaaaggtgtgat

SEQ ID NO: 8181188 - DNA, 22 bp, Homo sapiens
gccaggcgggtctcaaactcct

SEQ ID NO: 8181189 - DNA, 22 bp, Homo sapiens
gccaggcgggtctcaaactcct

SEQ ID NO: 8181190 - DNA, 22 bp, Homo sapiens
gccaggctccaggccctcctga

SEQ ID NO: 8181191 - DNA, 19 bp, Homo sapiens
gccaggctccatagccggc

SEQ ID NO: 8181192 - DNA, 19 bp, Homo sapiens
gccaggctccatagccggc

SEQ ID NO: 8181193 - DNA, 19 bp, Homo sapiens
gccaggctccatagccggc

SEQ ID NO: 8181194 - DNA, 19 bp, Homo sapiens
gccaggctccatagccggc

SEQ ID NO: 8181195 - DNA, 22 bp, Homo sapiens
gccaggctccaggccctcctga

SEQ ID NO: 8181196 - DNA, 22 bp, Homo sapiens
gccaggctccaggccctcctga

SEQ ID NO: 8181197 - DNA, 22 bp, Homo sapiens
gccaggctccaggccctcctga

SEQ ID NO: 8181198 - DNA, 22 bp, Homo sapiens
gccaggctccaggccctcctga

SEQ ID NO: 8181199 - DNA, 22 bp, Homo sapiens
gccaggctccccggatccctgg

SEQ ID NO: 8181200 - DNA, 22 bp, Homo sapiens
gccaggctccccggatccctgg

SEQ ID NO: 8181201 - DNA, 22 bp, Homo sapiens
gccaggctccccggatccctgg

SEQ ID NO: 8181202 - DNA, 22 bp, Homo sapiens
gccaggctccccggatccctgg

SEQ ID NO: 8181203 - DNA, 23 bp, Homo sapiens
gccaggctccggtctgtggccac

SEQ ID NO: 8181204 - DNA, 23 bp, Homo sapiens
gccaggctccggtctgtggccac

SEQ ID NO: 8181205 - DNA, 22 bp, Homo sapiens
gccaggctccccggatccctgg

SEQ ID NO: 8181206 - DNA, 23 bp, Homo sapiens
gccaggctccggtctgtggccac

SEQ ID NO: 8181207 - DNA, 23 bp, Homo sapiens
gccaggctccggtctgtggccac

SEQ ID NO: 8181208 - DNA, 22 bp, Homo sapiens
gccaggctctcagtgactgccc

SEQ ID NO: 8181209 - DNA, 22 bp, Homo sapiens
gccaggctctcagtgactgccc

SEQ ID NO: 8181210 - DNA, 21 bp, Homo sapiens
gccatttcacacagacatttg

SEQ ID NO: 8181211 - DNA, 22 bp, Homo sapiens
gcccaaagagctttgatctcag

SEQ ID NO: 8181212 - DNA, 22 bp, Homo sapiens
gcccaaagagctttgatctcag

SEQ ID NO: 8181213 - DNA, 22 bp, Homo sapiens
gccattttgaaaaccgttgcta

SEQ ID NO: 8181214 - DNA, 22 bp, Homo sapiens
gccattttctgtcttgtttatt

SEQ ID NO: 8181215 - DNA, 22 bp, Homo sapiens
gcccaaagtcactcagctagga

SEQ ID NO: 8181216 - DNA, 22 bp, Homo sapiens
gcccaaagtcactcagctagga

SEQ ID NO: 8181217 - DNA, 22 bp, Homo sapiens
gcccaaagccagtgtgctctcc

SEQ ID NO: 8181218 - DNA, 22 bp, Homo sapiens
gcccaaagccagtgtgctctcc

SEQ ID NO: 8181219 - DNA, 22 bp, Homo sapiens
gcccaagacatttagtaaagag

SEQ ID NO: 8181220 - DNA, 22 bp, Homo sapiens
gcccaagaatatttcccaagtt

SEQ ID NO: 8181221 - DNA, 22 bp, Homo sapiens
gcccaagagagcgaaggttggc

SEQ ID NO: 8181222 - DNA, 22 bp, Homo sapiens
gcccaagatctggagctgcagg

SEQ ID NO: 8181223 - DNA, 20 bp, Homo sapiens
gcccaagcgccggccgcaga

SEQ ID NO: 8181224 - DNA, 22 bp, Homo sapiens
gcccaagccgccttccagagac

SEQ ID NO: 8181225 - DNA, 22 bp, Homo sapiens
gcccaagatcagtggggcagat

SEQ ID NO: 8181226 - DNA, 22 bp, Homo sapiens
gcccaaggtatatcagagacag

SEQ ID NO: 8181227 - DNA, 22 bp, Homo sapiens
gccagctgtaggtggtgggttg

SEQ ID NO: 8181228 - DNA, 22 bp, Homo sapiens
gccagctgtaggtggtgggttg

SEQ ID NO: 8181229 - DNA, 22 bp, Homo sapiens
gccagctgtaggtggtgggttg

SEQ ID NO: 8181230 - DNA, 22 bp, Homo sapiens
gccagctgtctaagagagtaaa

SEQ ID NO: 8181231 - DNA, 22 bp, Homo sapiens
gccagctgtatctttggccagc

SEQ ID NO: 8181232 - DNA, 20 bp, Homo sapiens
gccagctggtcccaattatg

SEQ ID NO: 8181233 - DNA, 22 bp, Homo sapiens
gccagctgtaagcagtgattct

SEQ ID NO: 8181234 - DNA, 22 bp, Homo sapiens
gccagctgtaagcagtgattct

SEQ ID NO: 8181235 - DNA, 22 bp, Homo sapiens
gccagctgtaagcagtgattct

SEQ ID NO: 8181236 - DNA, 22 bp, Homo sapiens
gccagctgtaagctggggtgat

SEQ ID NO: 8181237 - DNA, 22 bp, Homo sapiens
gccagctgtaagctggggtgat

SEQ ID NO: 8181238 - DNA, 22 bp, Homo sapiens
gccagctgtaagctggggtgat

SEQ ID NO: 8181239 - DNA, 22 bp, Homo sapiens
gccagctgaggccgtgcaggct

SEQ ID NO: 8181240 - DNA, 22 bp, Homo sapiens
gccagctgggccttagggctgg

SEQ ID NO: 8181241 - DNA, 22 bp, Homo sapiens
gccagctgggccttagggctgg

SEQ ID NO: 8181242 - DNA, 21 bp, Homo sapiens
gccagctgggtcttgcaggag

SEQ ID NO: 8181243 - DNA, 21 bp, Homo sapiens
gccagctgggtcttgcaggag

SEQ ID NO: 8181244 - DNA, 22 bp, Homo sapiens
gccagctggtaggcacctagcc

SEQ ID NO: 8181245 - DNA, 22 bp, Homo sapiens
gccagctggtaggcacctagcc

SEQ ID NO: 8181246 - DNA, 22 bp, Homo sapiens
gccagaaggggtggatccaggc

SEQ ID NO: 8181247 - DNA, 22 bp, Homo sapiens
gccagaagactggagtcagctg

SEQ ID NO: 8181248 - DNA, 22 bp, Homo sapiens
gccacttctgcctggcagggcc

SEQ ID NO: 8181249 - DNA, 16 bp, Homo sapiens
gccacttattgattga

SEQ ID NO: 8181250 - DNA, 22 bp, Homo sapiens
gccacttatattcccactgtgc

SEQ ID NO: 8181251 - DNA, 22 bp, Homo sapiens
gccactttgatgatataaaaac

SEQ ID NO: 8181252 - DNA, 22 bp, Homo sapiens
gccagaaacatacacatcactt

SEQ ID NO: 8181253 - DNA, 22 bp, Homo sapiens
gccagacactcccctgggcagg

SEQ ID NO: 8181254 - DNA, 22 bp, Homo sapiens
gccagctgaggccgtgcaggct

SEQ ID NO: 8181255 - DNA, 22 bp, Homo sapiens
gccagctgaggccgtgcaggct

SEQ ID NO: 8181256 - DNA, 22 bp, Homo sapiens
gccagctgaggccgtgcaggct

SEQ ID NO: 8181257 - DNA, 22 bp, Homo sapiens
gccagctgaggccgtgcaggct

SEQ ID NO: 8181258 - DNA, 22 bp, Homo sapiens
gccagctgaggccgtgcaggct

SEQ ID NO: 8181259 - DNA, 22 bp, Homo sapiens
gccagctgagaaatcattgata

SEQ ID NO: 8181260 - DNA, 22 bp, Homo sapiens
gccaggcatgtcctctgcagaa

SEQ ID NO: 8181261 - DNA, 22 bp, Homo sapiens
gccaggcatgtcctctgcagaa

SEQ ID NO: 8181262 - DNA, 22 bp, Homo sapiens
gccaggaatcactgctgagtaa

SEQ ID NO: 8181263 - DNA, 22 bp, Homo sapiens
gccaggaacacaatgccaagct

SEQ ID NO: 8181264 - DNA, 22 bp, Homo sapiens
gccaggaaagggaattccctga

SEQ ID NO: 8181265 - DNA, 22 bp, Homo sapiens
gccaggaagcagttagatgggt

SEQ ID NO: 8181266 - DNA, 22 bp, Homo sapiens
gccaggaaaagaagctggtgct

SEQ ID NO: 8181267 - DNA, 22 bp, Homo sapiens
gccaggaaagccactggcatac

SEQ ID NO: 8181268 - DNA, 22 bp, Homo sapiens
gccaggaaaaacgtggtgggag

SEQ ID NO: 8181269 - DNA, 22 bp, Homo sapiens
gccaggaaaaagggtggccaat

SEQ ID NO: 8181270 - DNA, 22 bp, Homo sapiens
gccaggaaaaaccggccctgct

SEQ ID NO: 8181271 - DNA, 22 bp, Homo sapiens
gccagctgtttcagagcccagt

SEQ ID NO: 8181272 - DNA, 22 bp, Homo sapiens
gccagctgtttcagagcccagt

SEQ ID NO: 8181273 - DNA, 22 bp, Homo sapiens
gccagctgtttcagagcccagt

SEQ ID NO: 8181274 - DNA, 22 bp, Homo sapiens
gccagctgttcagacattcttt

SEQ ID NO: 8181275 - DNA, 22 bp, Homo sapiens
gccagctgtctaagagagtaaa

SEQ ID NO: 8181276 - DNA, 22 bp, Homo sapiens
gccagctgtgcttttcctaaaa

SEQ ID NO: 8181277 - DNA, 22 bp, Homo sapiens
gccagcttggccagtggccagt

SEQ ID NO: 8181278 - DNA, 22 bp, Homo sapiens
gccagcttccatggccacgtca

SEQ ID NO: 8181279 - DNA, 22 bp, Homo sapiens
gccagcttccatggccacgtca

SEQ ID NO: 8181280 - DNA, 22 bp, Homo sapiens
gccagcttggcatgtgaggagt

SEQ ID NO: 8181281 - DNA, 17 bp, Homo sapiens
gccagcttgagggccat

SEQ ID NO: 8181282 - DNA, 22 bp, Homo sapiens
gcagttggcagggagcccagat

SEQ ID NO: 8181283 - DNA, 22 bp, Homo sapiens
gcagttggcagggagcccagat

SEQ ID NO: 8181284 - DNA, 22 bp, Homo sapiens
gcagttatgtgaatcatgtgac

SEQ ID NO: 8181285 - DNA, 22 bp, Homo sapiens
gcagtgtttgtgttctcacatg

SEQ ID NO: 8181286 - DNA, 22 bp, Homo sapiens
gcagtgtttttcaatgcttcca

SEQ ID NO: 8181287 - DNA, 22 bp, Homo sapiens
gcagtgttttacagaccagcat

SEQ ID NO: 8181288 - DNA, 22 bp, Homo sapiens
gcaggtgattcaccctgggcct

SEQ ID NO: 8181289 - DNA, 22 bp, Homo sapiens
gcaggtgattcaccctgggcct

SEQ ID NO: 8181290 - DNA, 22 bp, Homo sapiens
gcaggtgattcaccctgggcct

SEQ ID NO: 8181291 - DNA, 18 bp, Homo sapiens
gcaggtgccactgctgtt

SEQ ID NO: 8181292 - DNA, 18 bp, Homo sapiens
gcaggtgccactgctgtt

SEQ ID NO: 8181293 - DNA, 18 bp, Homo sapiens
gcaggtgccactgctgtt

SEQ ID NO: 8181294 - DNA, 22 bp, Homo sapiens
gcaggtggaagcagcagactca

SEQ ID NO: 8181295 - DNA, 22 bp, Homo sapiens
gcaggtggaagcagcagactca

SEQ ID NO: 8181296 - DNA, 22 bp, Homo sapiens
gcaggtggaagcagcagactca

SEQ ID NO: 8181297 - DNA, 22 bp, Homo sapiens
gcagtgttggcaggatggggct

SEQ ID NO: 8181298 - DNA, 22 bp, Homo sapiens
gcagtgttggtttgctctgcag

SEQ ID NO: 8181299 - DNA, 22 bp, Homo sapiens
gcagtgttgtgatccaggtctt

SEQ ID NO: 8181300 - DNA, 22 bp, Homo sapiens
gcagtgttgttaaaagattaga

SEQ ID NO: 8181301 - DNA, 22 bp, Homo sapiens
gcagtgtttacatattagaaac

SEQ ID NO: 8181302 - DNA, 22 bp, Homo sapiens
gcagtgtttcaaatcaaaggca

SEQ ID NO: 8181303 - DNA, 22 bp, Homo sapiens
gcagtgtttggatccatagcga

SEQ ID NO: 8181304 - DNA, 23 bp, Homo sapiens
gcagtgtttgcttcatcttatcc

SEQ ID NO: 8181305 - DNA, 22 bp, Homo sapiens
gcagtgtttcagtgctttttct

SEQ ID NO: 8181306 - DNA, 22 bp, Homo sapiens
gcagtgtttcccagagatggaa

SEQ ID NO: 8181307 - DNA, 22 bp, Homo sapiens
gcagtttgtttgtggacacctt

SEQ ID NO: 8181308 - DNA, 22 bp, Homo sapiens
gcagtttgctggactaatgaag

SEQ ID NO: 8181309 - DNA, 22 bp, Homo sapiens
gcagttttagagctttaagatg

SEQ ID NO: 8181310 - DNA, 19 bp, Homo sapiens
gcataaaatgtcaatgtgt

SEQ ID NO: 8181311 - DNA, 22 bp, Homo sapiens
gcagttttattatgatggaaat

SEQ ID NO: 8181312 - DNA, 22 bp, Homo sapiens
gcagtttagtagatgacattat

SEQ ID NO: 8181313 - DNA, 22 bp, Homo sapiens
gcagtttctgaatttatccaag

SEQ ID NO: 8181314 - DNA, 22 bp, Homo sapiens
gcagtttgaaagtatgagtcca

SEQ ID NO: 8181315 - DNA, 22 bp, Homo sapiens
gcattacagcagttcaacttgg

SEQ ID NO: 8181316 - DNA, 22 bp, Homo sapiens
gcattagaaactattgctgcaa

SEQ ID NO: 8181317 - DNA, 22 bp, Homo sapiens
gcattagacccaaggtattttg

SEQ ID NO: 8181318 - DNA, 19 bp, Homo sapiens
gcataaaatgtcaatgtgt

SEQ ID NO: 8181319 - DNA, 22 bp, Homo sapiens
gcattctttgaatgcttctaat

SEQ ID NO: 8181320 - DNA, 20 bp, Homo sapiens
gcattgagtatagacagatg

SEQ ID NO: 8181321 - DNA, 22 bp, Homo sapiens
gcattcttcgaagtaagtagtg

SEQ ID NO: 8181322 - DNA, 22 bp, Homo sapiens
gccacctggacagctgtgccct

SEQ ID NO: 8181323 - DNA, 22 bp, Homo sapiens
gccacctgccaacttgctggaa

SEQ ID NO: 8181324 - DNA, 22 bp, Homo sapiens
gccacctgtttcgcttgcccag

SEQ ID NO: 8181325 - DNA, 22 bp, Homo sapiens
gccacttactaacctcctatcc

SEQ ID NO: 8181326 - DNA, 22 bp, Homo sapiens
gccacctctctcttgactcgag

SEQ ID NO: 8181327 - DNA, 22 bp, Homo sapiens
gccacctctttgtctctgccgc

SEQ ID NO: 8181328 - DNA, 22 bp, Homo sapiens
gccacctctagcaaagctcagc

SEQ ID NO: 8181329 - DNA, 22 bp, Homo sapiens
gccacctcggctttctctgctc

SEQ ID NO: 8181330 - DNA, 21 bp, Homo sapiens
gccacctcaatcttctagcgc

SEQ ID NO: 8181331 - DNA, 22 bp, Homo sapiens
gccacccttgcgtcactgacat

SEQ ID NO: 8181332 - DNA, 22 bp, Homo sapiens
gccacccttatcccatgcttct

SEQ ID NO: 8181333 - DNA, 22 bp, Homo sapiens
gccaccctggacgcactgttcg

SEQ ID NO: 8181334 - DNA, 22 bp, Homo sapiens
gccacctccttattccacctgt

SEQ ID NO: 8181335 - DNA, 22 bp, Homo sapiens
gccacctcccaggacgaggctg

SEQ ID NO: 8181336 - DNA, 22 bp, Homo sapiens
gccacctcccaggacgaggctg

SEQ ID NO: 8181337 - DNA, 22 bp, Homo sapiens
gcatttcatgccgtggaagtcc

SEQ ID NO: 8181338 - DNA, 18 bp, Homo sapiens
gccaccctcctcgtctcc

SEQ ID NO: 8181339 - DNA, 18 bp, Homo sapiens
gccaccctcctcgtctcc

SEQ ID NO: 8181340 - DNA, 22 bp, Homo sapiens
gccaccctggaccaccctgggc

SEQ ID NO: 8181341 - DNA, 22 bp, Homo sapiens
gccaccctgcaaatgcccagga

SEQ ID NO: 8181342 - DNA, 22 bp, Homo sapiens
gcatttatttctttactgcatc

SEQ ID NO: 8181343 - DNA, 22 bp, Homo sapiens
gcatttcaaaattccaggcaag

SEQ ID NO: 8181344 - DNA, 22 bp, Homo sapiens
gcatttatttctttactgcatc

SEQ ID NO: 8181345 - DNA, 22 bp, Homo sapiens
gcatttatttctttactgcatc

SEQ ID NO: 8181346 - DNA, 22 bp, Homo sapiens
gcatttatttctttactgcatc

SEQ ID NO: 8181347 - DNA, 22 bp, Homo sapiens
gcatttattatctgccaggcac

SEQ ID NO: 8181348 - DNA, 22 bp, Homo sapiens
gcatttattatctgccaggcac

SEQ ID NO: 8181349 - DNA, 18 bp, Homo sapiens
gcatttatgcggggctac

SEQ ID NO: 8181350 - DNA, 22 bp, Homo sapiens
gcatttattatctgccaggcac

SEQ ID NO: 8181351 - DNA, 18 bp, Homo sapiens
gcatttatgcggggctac

SEQ ID NO: 8181352 - DNA, 18 bp, Homo sapiens
gcatttatgcggggctac

SEQ ID NO: 8181353 - DNA, 22 bp, Homo sapiens
gcatttatattctgttcggata

SEQ ID NO: 8181354 - DNA, 22 bp, Homo sapiens
gcatttatattctgttcggata

SEQ ID NO: 8181355 - DNA, 22 bp, Homo sapiens
gcatttatattctgttcggata

SEQ ID NO: 8181356 - DNA, 22 bp, Homo sapiens
gcatttaaatttgaacttcaga

SEQ ID NO: 8181357 - DNA, 22 bp, Homo sapiens
gcattgtttcagtccactgtag

SEQ ID NO: 8181358 - DNA, 20 bp, Homo sapiens
gcattgttgtagtagattgt

SEQ ID NO: 8181359 - DNA, 22 bp, Homo sapiens
gcattgtttaagtgggtggggt

SEQ ID NO: 8181360 - DNA, 21 bp, Homo sapiens
gcattgttggctgctgctagg

SEQ ID NO: 8181361 - DNA, 22 bp, Homo sapiens
gcattgttagtctatgcagata

SEQ ID NO: 8181362 - DNA, 22 bp, Homo sapiens
gcattgttgaaaggaatgggct

SEQ ID NO: 8181363 - DNA, 23 bp, Homo sapiens
gcattgtctccccacttctgggc

SEQ ID NO: 8181364 - DNA, 22 bp, Homo sapiens
gcattgttagtctatgcagata

SEQ ID NO: 8181365 - DNA, 22 bp, Homo sapiens
gcattgatctgtatgcattaag

SEQ ID NO: 8181366 - DNA, 22 bp, Homo sapiens
gcattgatctttattctgcttt

SEQ ID NO: 8181367 - DNA, 22 bp, Homo sapiens
gcattgattctgaagtgaaatg

SEQ ID NO: 8181368 - DNA, 22 bp, Homo sapiens
gcattgcaaaaagcagcttgat

SEQ ID NO: 8181369 - DNA, 22 bp, Homo sapiens
gcattgcaactgacagatcatt

SEQ ID NO: 8181370 - DNA, 22 bp, Homo sapiens
gcattggttaagagctttgggg

SEQ ID NO: 8181371 - DNA, 22 bp, Homo sapiens
gcattgcaggtgtacccagtta

SEQ ID NO: 8181372 - DNA, 23 bp, Homo sapiens
gcattgtagaatgtttagcagca

SEQ ID NO: 8181373 - DNA, 22 bp, Homo sapiens
gcattggttcaaggttgtgcag

SEQ ID NO: 8181374 - DNA, 22 bp, Homo sapiens
gcattggtttacacagggtgaa

SEQ ID NO: 8181375 - DNA, 22 bp, Homo sapiens
tccatgtgttttcctgtccaca

SEQ ID NO: 8181376 - DNA, 22 bp, Homo sapiens
tccatgtgttttcctgtccaca

SEQ ID NO: 8181377 - DNA, 22 bp, Homo sapiens
tccattatacttctgattcaaa

SEQ ID NO: 8181378 - DNA, 22 bp, Homo sapiens
tccatggagatggatgactgta

SEQ ID NO: 8181379 - DNA, 22 bp, Homo sapiens
tccatggagtttttatttggta

SEQ ID NO: 8181380 - DNA, 22 bp, Homo sapiens
tccatggagatggatgactgta

SEQ ID NO: 8181381 - DNA, 22 bp, Homo sapiens
tccatgggaagattttgagtgg

SEQ ID NO: 8181382 - DNA, 22 bp, Homo sapiens
tccatgggtagccctggttgag

SEQ ID NO: 8181383 - DNA, 22 bp, Homo sapiens
tccatgtgacggtggcagtttt

SEQ ID NO: 8181384 - DNA, 22 bp, Homo sapiens
tccatgtggcaataggagacag

SEQ ID NO: 8181385 - DNA, 22 bp, Homo sapiens
tccatgtgcttcctcaggggaa

SEQ ID NO: 8181386 - DNA, 22 bp, Homo sapiens
tccattctttttacctctcaga

SEQ ID NO: 8181387 - DNA, 18 bp, Homo sapiens
tccattgttctactgtga

SEQ ID NO: 8181388 - DNA, 22 bp, Homo sapiens
tcccaaaggtccgagcgggaat

SEQ ID NO: 8181389 - DNA, 22 bp, Homo sapiens
tcccaaagctactcttctgact

SEQ ID NO: 8181390 - DNA, 22 bp, Homo sapiens
tcccaaagctactcttctgact

SEQ ID NO: 8181391 - DNA, 22 bp, Homo sapiens
tccattctatgcttacatttat

SEQ ID NO: 8181392 - DNA, 22 bp, Homo sapiens
tccattcttttgctgtcttcct

SEQ ID NO: 8181393 - DNA, 22 bp, Homo sapiens
tccattcttttgctgtcttcct

SEQ ID NO: 8181394 - DNA, 22 bp, Homo sapiens
tccattctttttacctctcaga

SEQ ID NO: 8181395 - DNA, 22 bp, Homo sapiens
tccattctttttacctctcaga

SEQ ID NO: 8181396 - DNA, 22 bp, Homo sapiens
tccattcaggccagtgcaaagt

SEQ ID NO: 8181397 - DNA, 22 bp, Homo sapiens
tccattcagaaatctggctaca

SEQ ID NO: 8181398 - DNA, 22 bp, Homo sapiens
tccattatacttctgattcaaa

SEQ ID NO: 8181399 - DNA, 22 bp, Homo sapiens
tccattcagaaatctggctaca

SEQ ID NO: 8181400 - DNA, 21 bp, Homo sapiens
tcccaagaatatgcataagtt

SEQ ID NO: 8181401 - DNA, 22 bp, Homo sapiens
tcccaaatataatgcaagagac

SEQ ID NO: 8181402 - DNA, 22 bp, Homo sapiens
tcccaagactatgttctgtgtg

SEQ ID NO: 8181403 - DNA, 22 bp, Homo sapiens
tcccaagagacagaatggtatc

SEQ ID NO: 8181404 - DNA, 22 bp, Homo sapiens
tcccaagagctactcaatggaa

SEQ ID NO: 8181405 - DNA, 22 bp, Homo sapiens
tcccaaagtcaagctgtgtctt

SEQ ID NO: 8181406 - DNA, 22 bp, Homo sapiens
tcccaaagtcaagctgtgtctt

SEQ ID NO: 8181407 - DNA, 22 bp, Homo sapiens
tcccaaagtattagcatttcaa

SEQ ID NO: 8181408 - DNA, 22 bp, Homo sapiens
tcccaaagtattagcatttcaa

SEQ ID NO: 8181409 - DNA, 22 bp, Homo sapiens
tcccaaagtattagcatttcaa

SEQ ID NO: 8181410 - DNA, 22 bp, Homo sapiens
tcccaagatacgctgtaagaag

SEQ ID NO: 8181411 - DNA, 22 bp, Homo sapiens
tcccaagaggggttattatgcc

SEQ ID NO: 8181412 - DNA, 22 bp, Homo sapiens
tcccaagagctctgggataagg

SEQ ID NO: 8181413 - DNA, 22 bp, Homo sapiens
tcccaagagctctgggataagg

SEQ ID NO: 8181414 - DNA, 22 bp, Homo sapiens
tcccaagattattgagggaggg

SEQ ID NO: 8181415 - DNA, 22 bp, Homo sapiens
tcccaagattattgagggaggg

SEQ ID NO: 8181416 - DNA, 22 bp, Homo sapiens
tcccagagaagagctggatgga

SEQ ID NO: 8181417 - DNA, 22 bp, Homo sapiens
tcccagagaagagctggatgga

SEQ ID NO: 8181418 - DNA, 19 bp, Homo sapiens
tcccaagatttctgtatca

SEQ ID NO: 8181419 - DNA, 22 bp, Homo sapiens
tcccagagatttcctctccttc

SEQ ID NO: 8181420 - DNA, 22 bp, Homo sapiens
tcccagagatttcctctccttc

SEQ ID NO: 8181421 - DNA, 22 bp, Homo sapiens
tcccagagacagagcctcctcc

SEQ ID NO: 8181422 - DNA, 22 bp, Homo sapiens
tcccagagacatcatttctccg

SEQ ID NO: 8181423 - DNA, 22 bp, Homo sapiens
tcccagagcagtactccaggag

SEQ ID NO: 8181424 - DNA, 22 bp, Homo sapiens
tcccagagcagtactccaggag

SEQ ID NO: 8181425 - DNA, 22 bp, Homo sapiens
tcccagagcagatgtgctaaag

SEQ ID NO: 8181426 - DNA, 22 bp, Homo sapiens
tcccagagccaagctatggatg

SEQ ID NO: 8181427 - DNA, 22 bp, Homo sapiens
tcccagagcagtactccaggag

SEQ ID NO: 8181428 - DNA, 22 bp, Homo sapiens
tcccagcctcctgacagttttg

SEQ ID NO: 8181429 - DNA, 22 bp, Homo sapiens
tcccagccggtgcctgggtccc

SEQ ID NO: 8181430 - DNA, 23 bp, Homo sapiens
tcccagcctcttctcttgcatac

SEQ ID NO: 8181431 - DNA, 23 bp, Homo sapiens
tcccagcctcttctcttgcatac

SEQ ID NO: 8181432 - DNA, 22 bp, Homo sapiens
tcccagcattaatgcctgtcag

SEQ ID NO: 8181433 - DNA, 22 bp, Homo sapiens
tcccagcattaatgcctgtcag

SEQ ID NO: 8181434 - DNA, 22 bp, Homo sapiens
tcccagccacaggtgtagccct

SEQ ID NO: 8181435 - DNA, 22 bp, Homo sapiens
tcccagcattaatgcctgtcag

SEQ ID NO: 8181436 - DNA, 22 bp, Homo sapiens
tcccagccacaggtgtagccct

SEQ ID NO: 8181437 - DNA, 22 bp, Homo sapiens
tcccagccggtgcctgggtccc

SEQ ID NO: 8181438 - DNA, 22 bp, Homo sapiens
tcccagccggtgcctgggtccc

SEQ ID NO: 8181439 - DNA, 22 bp, Homo sapiens
tcccagaggctccagtctctat

SEQ ID NO: 8181440 - DNA, 22 bp, Homo sapiens
tcccagaggtctctgctggttc

SEQ ID NO: 8181441 - DNA, 22 bp, Homo sapiens
tcccagaggttgagtcacttat

SEQ ID NO: 8181442 - DNA, 22 bp, Homo sapiens
tcccagaggttgagtcacttat

SEQ ID NO: 8181443 - DNA, 22 bp, Homo sapiens
tcccagagtattagcaattgct

SEQ ID NO: 8181444 - DNA, 22 bp, Homo sapiens
tcccagcctttctttctccagc

SEQ ID NO: 8181445 - DNA, 22 bp, Homo sapiens
tcccagccttccttgtggtgaa

SEQ ID NO: 8181446 - DNA, 22 bp, Homo sapiens
tcccagccttccttgtggtgaa

SEQ ID NO: 8181447 - DNA, 22 bp, Homo sapiens
tcccaggccacacttggggaac

SEQ ID NO: 8181448 - DNA, 22 bp, Homo sapiens
tcccaggcaggtgacaggggga

SEQ ID NO: 8181449 - DNA, 22 bp, Homo sapiens
tcccaggcaggtgacaggggga

SEQ ID NO: 8181450 - DNA, 22 bp, Homo sapiens
tcccagcctttctttctccagc

SEQ ID NO: 8181451 - DNA, 16 bp, Homo sapiens
tcccaggccaggtgga

SEQ ID NO: 8181452 - DNA, 22 bp, Homo sapiens
tcccaggccataaaactcagag

SEQ ID NO: 8181453 - DNA, 16 bp, Homo sapiens
tcccaggccaggtgga

SEQ ID NO: 8181454 - DNA, 22 bp, Homo sapiens
tcccaggccataaaactcagag

SEQ ID NO: 8181455 - DNA, 22 bp, Homo sapiens
tcccaggccataaaactcagag

SEQ ID NO: 8181456 - DNA, 22 bp, Homo sapiens
tcccaggcgcctggtggggagc

SEQ ID NO: 8181457 - DNA, 22 bp, Homo sapiens
tcccaggccataaaactcagag

SEQ ID NO: 8181458 - DNA, 22 bp, Homo sapiens
tcccaggccataaaactcagag

SEQ ID NO: 8181459 - DNA, 22 bp, Homo sapiens
tcccaggcgcctggtggggagc

SEQ ID NO: 8181460 - DNA, 22 bp, Homo sapiens
tcccaggcgcctggtggggagc

SEQ ID NO: 8181461 - DNA, 22 bp, Homo sapiens
tcccaggcgcctggtggggagc

SEQ ID NO: 8181462 - DNA, 22 bp, Homo sapiens
tcccagccttccagtctggttt

SEQ ID NO: 8181463 - DNA, 22 bp, Homo sapiens
tcccagccttccagtctggttt

SEQ ID NO: 8181464 - DNA, 22 bp, Homo sapiens
tcccagccttatctcccctggc

SEQ ID NO: 8181465 - DNA, 22 bp, Homo sapiens
tcccagccttatctcccctggc

SEQ ID NO: 8181466 - DNA, 22 bp, Homo sapiens
tcccagccttatctcccctggc

SEQ ID NO: 8181467 - DNA, 22 bp, Homo sapiens
tcccagcctggaccctgccagt

SEQ ID NO: 8181468 - DNA, 22 bp, Homo sapiens
tcccagcctgacagtgcatcaa

SEQ ID NO: 8181469 - DNA, 22 bp, Homo sapiens
tcccagcctgacagtgcatcaa

SEQ ID NO: 8181470 - DNA, 22 bp, Homo sapiens
tcccagcctgacagtgcatcaa

SEQ ID NO: 8181471 - DNA, 18 bp, Homo sapiens
tccaggcctgaagtgtcc

SEQ ID NO: 8181472 - DNA, 18 bp, Homo sapiens
tccaggcctgaagtgtcc

SEQ ID NO: 8181473 - DNA, 18 bp, Homo sapiens
tccaggcctgaagtgtcc

SEQ ID NO: 8181474 - DNA, 22 bp, Homo sapiens
tccaggcctgcaatgacaaagc

SEQ ID NO: 8181475 - DNA, 22 bp, Homo sapiens
tccaggcctgcaatgacaaagc

SEQ ID NO: 8181476 - DNA, 22 bp, Homo sapiens
tccaggcctgactataaatgta

SEQ ID NO: 8181477 - DNA, 22 bp, Homo sapiens
tccaggcctgactataaatgta

SEQ ID NO: 8181478 - DNA, 22 bp, Homo sapiens
tccaggcctgcaatgacaaagc

SEQ ID NO: 8181479 - DNA, 22 bp, Homo sapiens
tccaggcctgcctggtgtttgc

SEQ ID NO: 8181480 - DNA, 22 bp, Homo sapiens
tccaggcctctagcccctatct

SEQ ID NO: 8181481 - DNA, 22 bp, Homo sapiens
tccaggcctctagcccctatct

SEQ ID NO: 8181482 - DNA, 22 bp, Homo sapiens
tccaggcctctagccctctctt

SEQ ID NO: 8181483 - DNA, 22 bp, Homo sapiens
tccaggcctctagccctctctt

SEQ ID NO: 8181484 - DNA, 22 bp, Homo sapiens
tccaggctacttggattcctgg

SEQ ID NO: 8181485 - DNA, 22 bp, Homo sapiens
tccaggctaattttgcattgtt

SEQ ID NO: 8181486 - DNA, 22 bp, Homo sapiens
tccaggctaattttgcattgtt

SEQ ID NO: 8181487 - DNA, 22 bp, Homo sapiens
tccaggctaattttgcattgtt

SEQ ID NO: 8181488 - DNA, 22 bp, Homo sapiens
tccaggcctttgcacatgttgt

SEQ ID NO: 8181489 - DNA, 22 bp, Homo sapiens
tccaggcctttgcacatgttgt

SEQ ID NO: 8181490 - DNA, 22 bp, Homo sapiens
tccaggcctttgcacatgttgt

SEQ ID NO: 8181491 - DNA, 20 bp, Homo sapiens
tccaggccttgttctcagat

SEQ ID NO: 8181492 - DNA, 20 bp, Homo sapiens
tccaggccttgttctcagat

SEQ ID NO: 8181493 - DNA, 20 bp, Homo sapiens
tccaggccttgttctcagat

SEQ ID NO: 8181494 - DNA, 22 bp, Homo sapiens
tccaggccttgacaggtcagtt

SEQ ID NO: 8181495 - DNA, 22 bp, Homo sapiens
tccaggccttgacaggtcagtt

SEQ ID NO: 8181496 - DNA, 22 bp, Homo sapiens
tccaggccttgacaggtcagtt

SEQ ID NO: 8181497 - DNA, 22 bp, Homo sapiens
tccaggcctggctccattcagt

SEQ ID NO: 8181498 - DNA, 22 bp, Homo sapiens
tccaggcctgcctggtgtttgc

SEQ ID NO: 8181499 - DNA, 22 bp, Homo sapiens
tccaggcctggctccattcagt

SEQ ID NO: 8181500 - DNA, 22 bp, Homo sapiens
tccaggctggcctcgcgtgaca

SEQ ID NO: 8181501 - DNA, 22 bp, Homo sapiens
tccaggctggctcttcaaaatt

SEQ ID NO: 8181502 - DNA, 22 bp, Homo sapiens
tccaggctggctcttcaaaatt

SEQ ID NO: 8181503 - DNA, 22 bp, Homo sapiens
tccaggctggctcttcaaaatt

SEQ ID NO: 8181504 - DNA, 22 bp, Homo sapiens
tccaggctggcctcgcgtgaca

SEQ ID NO: 8181505 - DNA, 22 bp, Homo sapiens
tccaggctggcctcgcgtgaca

SEQ ID NO: 8181506 - DNA, 22 bp, Homo sapiens
tccaggctggcctcgcgtgaca

SEQ ID NO: 8181507 - DNA, 22 bp, Homo sapiens
tccaggctggagtgcagtggcg

SEQ ID NO: 8181508 - DNA, 18 bp, Homo sapiens
tccaggctggattgatga

SEQ ID NO: 8181509 - DNA, 18 bp, Homo sapiens
tccaggctggattgatga

SEQ ID NO: 8181510 - DNA, 22 bp, Homo sapiens
tccaggctggagtgcagtggca

SEQ ID NO: 8181511 - DNA, 22 bp, Homo sapiens
tccaggctggagtgcagtggca

SEQ ID NO: 8181512 - DNA, 22 bp, Homo sapiens
tccaggctggagtgcagtggca

SEQ ID NO: 8181513 - DNA, 22 bp, Homo sapiens
tccaggctggagtgcagtggca

SEQ ID NO: 8181514 - DNA, 22 bp, Homo sapiens
tccaggctggagtgcagtggcg

SEQ ID NO: 8181515 - DNA, 22 bp, Homo sapiens
tccaggctggagtgcagtggcg

SEQ ID NO: 8181516 - DNA, 22 bp, Homo sapiens
tccaggctggagtgcagtggcg

SEQ ID NO: 8181517 - DNA, 22 bp, Homo sapiens
tccaggctagaagtcacaggcc

SEQ ID NO: 8181518 - DNA, 22 bp, Homo sapiens
tccaggctagaagtcacaggcc

SEQ ID NO: 8181519 - DNA, 22 bp, Homo sapiens
tccaggctacttggattcctgg

SEQ ID NO: 8181520 - DNA, 22 bp, Homo sapiens
tccaggctagaagtcacaggcc

SEQ ID NO: 8181521 - DNA, 22 bp, Homo sapiens
tccaggctagagtgcagtggcc

SEQ ID NO: 8181522 - DNA, 22 bp, Homo sapiens
tccaggctagagtgcagtggcc

SEQ ID NO: 8181523 - DNA, 22 bp, Homo sapiens
tccaggctagaagtcacaggcc

SEQ ID NO: 8181524 - DNA, 22 bp, Homo sapiens
tccaggctagaagtcacaggcc

SEQ ID NO: 8181525 - DNA, 22 bp, Homo sapiens
tccaggctagagtgcagtggcc

SEQ ID NO: 8181526 - DNA, 21 bp, Homo sapiens
tccaggctggaaggggcgttg

SEQ ID NO: 8181527 - DNA, 22 bp, Homo sapiens
tccaggctggacatgaggcggg

SEQ ID NO: 8181528 - DNA, 22 bp, Homo sapiens
tccaggctggacatgaggcggg

SEQ ID NO: 8181529 - DNA, 22 bp, Homo sapiens
tccaggctagagtgcagtggcc

SEQ ID NO: 8181530 - DNA, 22 bp, Homo sapiens
tccaggctagcctggtagagaa

SEQ ID NO: 8181531 - DNA, 22 bp, Homo sapiens
tccaggctagcctggtagagaa

SEQ ID NO: 8181532 - DNA, 23 bp, Homo sapiens
tccaggctgggacttcaactggc

SEQ ID NO: 8181533 - DNA, 23 bp, Homo sapiens
tccaggctgggacttcaactggc

SEQ ID NO: 8181534 - DNA, 22 bp, Homo sapiens
tccaggctgggctgaagggtgc

SEQ ID NO: 8181535 - DNA, 22 bp, Homo sapiens
tccaggctttttcatgctgtct

SEQ ID NO: 8181536 - DNA, 22 bp, Homo sapiens
tccagggaagagcagaggctac

SEQ ID NO: 8181537 - DNA, 21 bp, Homo sapiens
tccagggaacttctcaggaat

SEQ ID NO: 8181538 - DNA, 21 bp, Homo sapiens
tccagggaacttctcaggaat

SEQ ID NO: 8181539 - DNA, 22 bp, Homo sapiens
tccagggaaggtgtgaggctgg

SEQ ID NO: 8181540 - DNA, 22 bp, Homo sapiens
tccagggaaggtgtgaggctgg

SEQ ID NO: 8181541 - DNA, 22 bp, Homo sapiens
tccagggaaggtgtgaggctgg

SEQ ID NO: 8181542 - DNA, 22 bp, Homo sapiens
tccagggaagagcagaggctac

SEQ ID NO: 8181543 - DNA, 22 bp, Homo sapiens
tccagggaaggtgtgaggctgg

SEQ ID NO: 8181544 - DNA, 22 bp, Homo sapiens
tccagggctgacttgggagagg

SEQ ID NO: 8181545 - DNA, 22 bp, Homo sapiens
tccagggctgacttgggagagg

SEQ ID NO: 8181546 - DNA, 22 bp, Homo sapiens
tccagggctgacttgggagagg

SEQ ID NO: 8181547 - DNA, 22 bp, Homo sapiens
tccagggctgacttgggagagg

SEQ ID NO: 8181548 - DNA, 22 bp, Homo sapiens
tccagggacacagagtccttct

SEQ ID NO: 8181549 - DNA, 22 bp, Homo sapiens
tccagggctccccaacatccag

SEQ ID NO: 8181550 - DNA, 22 bp, Homo sapiens
tccagggacagcgctggagcta

SEQ ID NO: 8181551 - DNA, 22 bp, Homo sapiens
tccagggctgggttggctcagc

SEQ ID NO: 8181552 - DNA, 22 bp, Homo sapiens
tccagggctgggttggctcagc

SEQ ID NO: 8181553 - DNA, 22 bp, Homo sapiens
tccagggctgggttggctcagc

SEQ ID NO: 8181554 - DNA, 23 bp, Homo sapiens
tccagggctggccagacctcggt

SEQ ID NO: 8181555 - DNA, 18 bp, Homo sapiens
tccagggcttcctcctct

SEQ ID NO: 8181556 - DNA, 22 bp, Homo sapiens
tccagggctgggttggctcagc

SEQ ID NO: 8181557 - DNA, 22 bp, Homo sapiens
tccagggctgggttggctcagc

SEQ ID NO: 8181558 - DNA, 22 bp, Homo sapiens
tccagggctgggttggctcagc

SEQ ID NO: 8181559 - DNA, 22 bp, Homo sapiens
tccagggctgggttggctcagc

SEQ ID NO: 8181560 - DNA, 21 bp, Homo sapiens
tccagggctttgattctctca

SEQ ID NO: 8181561 - DNA, 22 bp, Homo sapiens
tccaggtctaatttgtccttga

SEQ ID NO: 8181562 - DNA, 19 bp, Homo sapiens
tccagggctttatggcttt

SEQ ID NO: 8181563 - DNA, 21 bp, Homo sapiens
tccagggctttgattctctca

SEQ ID NO: 8181564 - DNA, 19 bp, Homo sapiens
tccagggctttatggcttt

SEQ ID NO: 8181565 - DNA, 19 bp, Homo sapiens
tccagggctttatggcttt

SEQ ID NO: 8181566 - DNA, 18 bp, Homo sapiens
tccagggcttcctcctct

SEQ ID NO: 8181567 - DNA, 22 bp, Homo sapiens
tccagggcttgacagggtgcct

SEQ ID NO: 8181568 - DNA, 22 bp, Homo sapiens
tccagggcttggctgggacggt

SEQ ID NO: 8181569 - DNA, 22 bp, Homo sapiens
tccagggcttggctgggacggt

SEQ ID NO: 8181570 - DNA, 22 bp, Homo sapiens
tccagggcttgacagggtgcct

SEQ ID NO: 8181571 - DNA, 22 bp, Homo sapiens
tccagggcttgacagggtgcct

SEQ ID NO: 8181572 - DNA, 22 bp, Homo sapiens
tccatggagatggatgactgta

SEQ ID NO: 8181573 - DNA, 22 bp, Homo sapiens
tccaggtttcgctacaggagag

SEQ ID NO: 8181574 - DNA, 22 bp, Homo sapiens
tccagtagaattttattcaaca

SEQ ID NO: 8181575 - DNA, 22 bp, Homo sapiens
tccaggttttctgaaggcagga

SEQ ID NO: 8181576 - DNA, 22 bp, Homo sapiens
tccaggtgagtgcaggtgcaga

SEQ ID NO: 8181577 - DNA, 22 bp, Homo sapiens
tccaggtgagtgcaggtgcaga

SEQ ID NO: 8181578 - DNA, 22 bp, Homo sapiens
tccaggtgacagagacaggata

SEQ ID NO: 8181579 - DNA, 22 bp, Homo sapiens
tccaggtcttcctattccaggt

SEQ ID NO: 8181580 - DNA, 22 bp, Homo sapiens
tccaggtgccggggactgaggc

SEQ ID NO: 8181581 - DNA, 19 bp, Homo sapiens
tccaggtggagagacaccc

SEQ ID NO: 8181582 - DNA, 22 bp, Homo sapiens
tccaggtgccggggactgaggc

SEQ ID NO: 8181583 - DNA, 22 bp, Homo sapiens
tccaggtgagtgcaggtgcaga

SEQ ID NO: 8181584 - DNA, 19 bp, Homo sapiens
tccaggtggagagacaccc

SEQ ID NO: 8181585 - DNA, 22 bp, Homo sapiens
tccaggtgggctgcacccaggc

SEQ ID NO: 8181586 - DNA, 22 bp, Homo sapiens
tccaggtgtatttactgaagta

SEQ ID NO: 8181587 - DNA, 22 bp, Homo sapiens
tccctggcagctaagggtggtc

SEQ ID NO: 8181588 - DNA, 20 bp, Homo sapiens
tccctggaggtggtggcatc

SEQ ID NO: 8181589 - DNA, 22 bp, Homo sapiens
tccctggcacaagaaggctgtc

SEQ ID NO: 8181590 - DNA, 22 bp, Homo sapiens
tccctgcctctcagacttcctt

SEQ ID NO: 8181591 - DNA, 22 bp, Homo sapiens
tccctgcctctcagacttcctt

SEQ ID NO: 8181592 - DNA, 22 bp, Homo sapiens
tccctggaacagagagacaacg

SEQ ID NO: 8181593 - DNA, 22 bp, Homo sapiens
tccctggacaacagacttcact

SEQ ID NO: 8181594 - DNA, 22 bp, Homo sapiens
tccctgggaacaaaggatgaga

SEQ ID NO: 8181595 - DNA, 22 bp, Homo sapiens
tccctgggaacaaaggatgaga

SEQ ID NO: 8181596 - DNA, 22 bp, Homo sapiens
tccctgggaaatgtcagtttca

SEQ ID NO: 8181597 - DNA, 22 bp, Homo sapiens
tccctggctgtgttcaggtgcg

SEQ ID NO: 8181598 - DNA, 22 bp, Homo sapiens
tccctgggaaatgtcagtttca

SEQ ID NO: 8181599 - DNA, 22 bp, Homo sapiens
tccctgggaattaatatttgga

SEQ ID NO: 8181600 - DNA, 22 bp, Homo sapiens
tccctgggaccggcagctcaca

SEQ ID NO: 8181601 - DNA, 22 bp, Homo sapiens
tccctgggaccggcagctcaca

SEQ ID NO: 8181602 - DNA, 22 bp, Homo sapiens
tccctggctgggggctgccttg

SEQ ID NO: 8181603 - DNA, 19 bp, Homo sapiens
tccctggcgcctctcgggc

SEQ ID NO: 8181604 - DNA, 23 bp, Homo sapiens
tccctggccgcaatggccgcctt

SEQ ID NO: 8181605 - DNA, 19 bp, Homo sapiens
tccctggcgcctctcgggc

SEQ ID NO: 8181606 - DNA, 22 bp, Homo sapiens
tccctggccattcctctaggcc

SEQ ID NO: 8181607 - DNA, 22 bp, Homo sapiens
tccctggccattcctctaggcc

SEQ ID NO: 8181608 - DNA, 22 bp, Homo sapiens
tccctggccattcctctaggcc

SEQ ID NO: 8181609 - DNA, 22 bp, Homo sapiens
tccctggccattcctctaggcc

SEQ ID NO: 8181610 - DNA, 18 bp, Homo sapiens
tccctgggatataattac

SEQ ID NO: 8181611 - DNA, 18 bp, Homo sapiens
tccctgggatataattac

SEQ ID NO: 8181612 - DNA, 22 bp, Homo sapiens
tccctgggcaagtttactcttc

SEQ ID NO: 8181613 - DNA, 22 bp, Homo sapiens
tcctaaaggctgcttttatatt

SEQ ID NO: 8181614 - DNA, 20 bp, Homo sapiens
tcctaaagtcattgaatttc

SEQ ID NO: 8181615 - DNA, 22 bp, Homo sapiens
tccgtggggcctgtggcttccg

SEQ ID NO: 8181616 - DNA, 22 bp, Homo sapiens
tccgtggagattttgtgcaggg

SEQ ID NO: 8181617 - DNA, 22 bp, Homo sapiens
tccctgggacggccttttggag

SEQ ID NO: 8181618 - DNA, 22 bp, Homo sapiens
tccctgggaccggcagctcaca

SEQ ID NO: 8181619 - DNA, 22 bp, Homo sapiens
tccctgggactcagacatggaa

SEQ ID NO: 8181620 - DNA, 22 bp, Homo sapiens
tccctgggactcagacatggaa

SEQ ID NO: 8181621 - DNA, 15 bp, Homo sapiens
tccctgggagatggt

SEQ ID NO: 8181622 - DNA, 16 bp, Homo sapiens
tccctgggagtggtgg

SEQ ID NO: 8181623 - DNA, 22 bp, Homo sapiens
tccctgggagatgatgatgagg

SEQ ID NO: 8181624 - DNA, 22 bp, Homo sapiens
tccctgggactcagacatggaa

SEQ ID NO: 8181625 - DNA, 22 bp, Homo sapiens
tcctagaatgcacctctgctgt

SEQ ID NO: 8181626 - DNA, 22 bp, Homo sapiens
tcctagaatctttgtaagattg

SEQ ID NO: 8181627 - DNA, 22 bp, Homo sapiens
tcctagaatagtgtgtctggag

SEQ ID NO: 8181628 - DNA, 22 bp, Homo sapiens
tcctagaatctttgtaagattg

SEQ ID NO: 8181629 - DNA, 22 bp, Homo sapiens
tcctagaataatctttgactgc

SEQ ID NO: 8181630 - DNA, 19 bp, Homo sapiens
tcctagcacctggcacata

SEQ ID NO: 8181631 - DNA, 22 bp, Homo sapiens
tcctaggcagttggtgctccat

SEQ ID NO: 8181632 - DNA, 22 bp, Homo sapiens
tcctagggttggagacagtgac

SEQ ID NO: 8181633 - DNA, 22 bp, Homo sapiens
tcctagggattcaacactgaac

SEQ ID NO: 8181634 - DNA, 22 bp, Homo sapiens
tcctaggcctggcctggtggat

SEQ ID NO: 8181635 - DNA, 22 bp, Homo sapiens
tcctaggcctggcctggtggat

SEQ ID NO: 8181636 - DNA, 22 bp, Homo sapiens
tcctaggcccagcctgagctgt

SEQ ID NO: 8181637 - DNA, 22 bp, Homo sapiens
tcctcacacccataccactgac

SEQ ID NO: 8181638 - DNA, 22 bp, Homo sapiens
tcctcacacccataccactgac

SEQ ID NO: 8181639 - DNA, 22 bp, Homo sapiens
tcctcacaagcatcctgtctca

SEQ ID NO: 8181640 - DNA, 22 bp, Homo sapiens
tcctcacaagcatcctgtctca

SEQ ID NO: 8181641 - DNA, 22 bp, Homo sapiens
tcctcacactatagatgaggat

SEQ ID NO: 8181642 - DNA, 22 bp, Homo sapiens
tcctcacagctggttcattcag

SEQ ID NO: 8181643 - DNA, 22 bp, Homo sapiens
tcctcacagcatgaccaggcag

SEQ ID NO: 8181644 - DNA, 22 bp, Homo sapiens
tcctcacagatgggtgcatagc

SEQ ID NO: 8181645 - DNA, 22 bp, Homo sapiens
tcctcacagagtggcaggcaat

SEQ ID NO: 8181646 - DNA, 22 bp, Homo sapiens
tcctcacaagcaagcacaggta

SEQ ID NO: 8181647 - DNA, 22 bp, Homo sapiens
tcctagttctggttctgtcact

SEQ ID NO: 8181648 - DNA, 22 bp, Homo sapiens
tcctagttctctgccagtcgct

SEQ ID NO: 8181649 - DNA, 22 bp, Homo sapiens
tcctagttctctgccagtcgct

SEQ ID NO: 8181650 - DNA, 22 bp, Homo sapiens
tcctagttctctgccagtcgct

SEQ ID NO: 8181651 - DNA, 22 bp, Homo sapiens
tcctagttctctgccagtcgct

SEQ ID NO: 8181652 - DNA, 22 bp, Homo sapiens
tcctcacagtcaacactttgag

SEQ ID NO: 8181653 - DNA, 22 bp, Homo sapiens
tcctcacagtcaacactttgag

SEQ ID NO: 8181654 - DNA, 22 bp, Homo sapiens
tcctcacatggtgagccacaca

SEQ ID NO: 8181655 - DNA, 22 bp, Homo sapiens
tcctcacagggcaggaaggagg

SEQ ID NO: 8181656 - DNA, 22 bp, Homo sapiens
tcctcactttgtagccatcctt

SEQ ID NO: 8181657 - DNA, 22 bp, Homo sapiens
tcctcactttgtagccatcctt

SEQ ID NO: 8181658 - DNA, 22 bp, Homo sapiens
tcctcactttgtagccatcctt

SEQ ID NO: 8181659 - DNA, 22 bp, Homo sapiens
tcctcagaaacccctgtgaggt

SEQ ID NO: 8181660 - DNA, 22 bp, Homo sapiens
tcctcagaaacccctgtgaggt

SEQ ID NO: 8181661 - DNA, 22 bp, Homo sapiens
tcctcactgcagtgctccgagc

SEQ ID NO: 8181662 - DNA, 22 bp, Homo sapiens
tcctcactgcagtgctccgagc

SEQ ID NO: 8181663 - DNA, 22 bp, Homo sapiens
tcctcactgcagtgctccgagc

SEQ ID NO: 8181664 - DNA, 22 bp, Homo sapiens
tcctcacatggtgagccacaca

SEQ ID NO: 8181665 - DNA, 20 bp, Homo sapiens
tcctcagaagacatttgggg

SEQ ID NO: 8181666 - DNA, 20 bp, Homo sapiens
tcctcagaagacatttgggg

SEQ ID NO: 8181667 - DNA, 22 bp, Homo sapiens
tcctcagaaacccctgtgaggt

SEQ ID NO: 8181668 - DNA, 22 bp, Homo sapiens
tcctcagaagaacccctagatt

SEQ ID NO: 8181669 - DNA, 22 bp, Homo sapiens
tcctcagaaacccctgtgaggt

SEQ ID NO: 8181670 - DNA, 22 bp, Homo sapiens
tcctcagaatcacctggcagct

SEQ ID NO: 8181671 - DNA, 22 bp, Homo sapiens
tcctcagaatcacctggcagct

SEQ ID NO: 8181672 - DNA, 22 bp, Homo sapiens
tcctcagaatcacctggcagct

SEQ ID NO: 8181673 - DNA, 22 bp, Homo sapiens
tcctcagaatggatggcagggg

SEQ ID NO: 8181674 - DNA, 22 bp, Homo sapiens
tcctcagaatccaaactgcagt

SEQ ID NO: 8181675 - DNA, 22 bp, Homo sapiens
tcctcagcaaacacttcactct

SEQ ID NO: 8181676 - DNA, 22 bp, Homo sapiens
tcctcagatgctcttggacgcc

SEQ ID NO: 8181677 - DNA, 22 bp, Homo sapiens
tcctcagcaaacacttcactct

SEQ ID NO: 8181678 - DNA, 22 bp, Homo sapiens
tcctcagatgctcttggacgcc

SEQ ID NO: 8181679 - DNA, 23 bp, Homo sapiens
tcctcagcatgttttgtcatgta

SEQ ID NO: 8181680 - DNA, 23 bp, Homo sapiens
tcctcagcatgttttgtcatgta

SEQ ID NO: 8181681 - DNA, 22 bp, Homo sapiens
tcctcagcattagcacagacat

SEQ ID NO: 8181682 - DNA, 22 bp, Homo sapiens
tcctcagacttccctttgtgta

SEQ ID NO: 8181683 - DNA, 22 bp, Homo sapiens
tcctcagacttccctttgtgta

SEQ ID NO: 8181684 - DNA, 22 bp, Homo sapiens
tcctcagagatgggcatctaag

SEQ ID NO: 8181685 - DNA, 22 bp, Homo sapiens
tcctcagacaccctgctggctt

SEQ ID NO: 8181686 - DNA, 22 bp, Homo sapiens
tcctcagagatgggcatctaag

SEQ ID NO: 8181687 - DNA, 22 bp, Homo sapiens
tcctcagacaccctgctggctt

SEQ ID NO: 8181688 - DNA, 22 bp, Homo sapiens
tcctcagacaccctgctggctt

SEQ ID NO: 8181689 - DNA, 22 bp, Homo sapiens
tcctcagacaccctgctggctt

SEQ ID NO: 8181690 - DNA, 22 bp, Homo sapiens
tcctcagacttccctttgtgta

SEQ ID NO: 8181691 - DNA, 22 bp, Homo sapiens
tcctcagatacctggcagatca

SEQ ID NO: 8181692 - DNA, 22 bp, Homo sapiens
tcctcagatataaatgagggtg

SEQ ID NO: 8181693 - DNA, 22 bp, Homo sapiens
tcctcagatacctggcagatca

SEQ ID NO: 8181694 - DNA, 22 bp, Homo sapiens
tcctcagagcagccctccgcat

SEQ ID NO: 8181695 - DNA, 22 bp, Homo sapiens
tcctcagagcatagcgctgtct

SEQ ID NO: 8181696 - DNA, 19 bp, Homo sapiens
tcctcaggggctcacagac

SEQ ID NO: 8181697 - DNA, 22 bp, Homo sapiens
tcctcagggcggcctccgtctt

SEQ ID NO: 8181698 - DNA, 22 bp, Homo sapiens
tccctcagatgagctcctagca

SEQ ID NO: 8181699 - DNA, 22 bp, Homo sapiens
tccctcagatgagctcctagca

SEQ ID NO: 8181700 - DNA, 22 bp, Homo sapiens
tccctcagatgagctcctagca

SEQ ID NO: 8181701 - DNA, 22 bp, Homo sapiens
tccctcagagggcaagcgcaga

SEQ ID NO: 8181702 - DNA, 22 bp, Homo sapiens
tccctcagagaccgtggtgcag

SEQ ID NO: 8181703 - DNA, 21 bp, Homo sapiens
tccctcagacagggtgcctat

SEQ ID NO: 8181704 - DNA, 22 bp, Homo sapiens
tccctcagacagatgtgttcct

SEQ ID NO: 8181705 - DNA, 22 bp, Homo sapiens
tccctcagatgagctcctagca

SEQ ID NO: 8181706 - DNA, 22 bp, Homo sapiens
tccctcagattggcaattagat

SEQ ID NO: 8181707 - DNA, 20 bp, Homo sapiens
tccctcagcacttctacctc

SEQ ID NO: 8181708 - DNA, 20 bp, Homo sapiens
tccctcagcacttctacctc

SEQ ID NO: 8181709 - DNA, 22 bp, Homo sapiens
tccctcagcaggaatgtggcag

SEQ ID NO: 8181710 - DNA, 22 bp, Homo sapiens
tccctcagcaggaatgtggcag

SEQ ID NO: 8181711 - DNA, 22 bp, Homo sapiens
tccctcagcaggaactggcctg

SEQ ID NO: 8181712 - DNA, 22 bp, Homo sapiens
tccctcagcaggaactggcctg

SEQ ID NO: 8181713 - DNA, 22 bp, Homo sapiens
tcccctggcacctagtcctact

SEQ ID NO: 8181714 - DNA, 22 bp, Homo sapiens
tcccagggactggatgatgcag

SEQ ID NO: 8181715 - DNA, 18 bp, Homo sapiens
tccccttccaggaagtca

SEQ ID NO: 8181716 - DNA, 18 bp, Homo sapiens
tccccttccaggaagtca

SEQ ID NO: 8181717 - DNA, 22 bp, Homo sapiens
tcccagggactggatgatgcag

SEQ ID NO: 8181718 - DNA, 22 bp, Homo sapiens
tcccagggactctctgccttcc

SEQ ID NO: 8181719 - DNA, 22 bp, Homo sapiens
tcccagggactctctgccttcc

SEQ ID NO: 8181720 - DNA, 22 bp, Homo sapiens
tcccagggacccagcctgatac

SEQ ID NO: 8181721 - DNA, 22 bp, Homo sapiens
tcccagggacccagcctgatac

SEQ ID NO: 8181722 - DNA, 22 bp, Homo sapiens
tcccagggacccagcctgatac

SEQ ID NO: 8181723 - DNA, 22 bp, Homo sapiens
tcccgcatgccgccggtgaaca

SEQ ID NO: 8181724 - DNA, 22 bp, Homo sapiens
tcccgcatgccgccggtgaaca

SEQ ID NO: 8181725 - DNA, 22 bp, Homo sapiens
tcccgcatgccgccggtgaaca

SEQ ID NO: 8181726 - DNA, 22 bp, Homo sapiens
tcccctttgtcttcctgtgggt

SEQ ID NO: 8181727 - DNA, 22 bp, Homo sapiens
tcccgcccttgtacttgccgag

SEQ ID NO: 8181728 - DNA, 22 bp, Homo sapiens
tcccgcttcttccgaatcgcga

SEQ ID NO: 8181729 - DNA, 22 bp, Homo sapiens
tcccgataggcagggctctggc

SEQ ID NO: 8181730 - DNA, 18 bp, Homo sapiens
tccctcagaattatagaa

SEQ ID NO: 8181731 - DNA, 22 bp, Homo sapiens
tccctcagacagatgtgttcct

SEQ ID NO: 8181732 - DNA, 21 bp, Homo sapiens
tccctcagaaggtagccaagc

SEQ ID NO: 8181733 - DNA, 21 bp, Homo sapiens
tccctcagaagctcttggtca

SEQ ID NO: 8181734 - DNA, 22 bp, Homo sapiens
tcccaggctggggccaggtgac

SEQ ID NO: 8181735 - DNA, 20 bp, Homo sapiens
tcccaggctgggctccagct

SEQ ID NO: 8181736 - DNA, 22 bp, Homo sapiens
tcccaggctggggccaggtgac

SEQ ID NO: 8181737 - DNA, 22 bp, Homo sapiens
tcccaggctggggccaggtgac

SEQ ID NO: 8181738 - DNA, 22 bp, Homo sapiens
tcccaggctggggccaggtgac

SEQ ID NO: 8181739 - DNA, 20 bp, Homo sapiens
tcccaggctgggctccagct

SEQ ID NO: 8181740 - DNA, 20 bp, Homo sapiens
tcccaggctgggctccagct

SEQ ID NO: 8181741 - DNA, 20 bp, Homo sapiens
tcccaggctgggctccagct

SEQ ID NO: 8181742 - DNA, 20 bp, Homo sapiens
tcccaggctgggctccagct

SEQ ID NO: 8181743 - DNA, 23 bp, Homo sapiens
tcccagggaaggtgagcgaggct

SEQ ID NO: 8181744 - DNA, 22 bp, Homo sapiens
tcccagggacaccaagctgttt

SEQ ID NO: 8181745 - DNA, 22 bp, Homo sapiens
tcccagggacaccaagctgttt

SEQ ID NO: 8181746 - DNA, 22 bp, Homo sapiens
tcccaggctgggggcctgaagt

SEQ ID NO: 8181747 - DNA, 22 bp, Homo sapiens
tcccaggctgggggcctgaagt

SEQ ID NO: 8181748 - DNA, 22 bp, Homo sapiens
tcccaggctaccagtgaggtca

SEQ ID NO: 8181749 - DNA, 22 bp, Homo sapiens
tcccaggctaccagtgaggtca

SEQ ID NO: 8181750 - DNA, 22 bp, Homo sapiens
tcccaggctaccagtgaggtca

SEQ ID NO: 8181751 - DNA, 22 bp, Homo sapiens
tcccaggctaggcctctgcgtt

SEQ ID NO: 8181752 - DNA, 22 bp, Homo sapiens
tcccaggctaggcctctgcgtt

SEQ ID NO: 8181753 - DNA, 22 bp, Homo sapiens
tcccaggctaggcctctgcgtt

SEQ ID NO: 8181754 - DNA, 20 bp, Homo sapiens
tcccaggctccaccctagac

SEQ ID NO: 8181755 - DNA, 20 bp, Homo sapiens
tcccaggctgggctccagct

SEQ ID NO: 8181756 - DNA, 22 bp, Homo sapiens
tcccaggctggcaggcagcagt

SEQ ID NO: 8181757 - DNA, 22 bp, Homo sapiens
tcccaggctggcaggcagcagt

SEQ ID NO: 8181758 - DNA, 22 bp, Homo sapiens
tcccaggctggcaggcagcagt

SEQ ID NO: 8181759 - DNA, 22 bp, Homo sapiens
tcccaggctggcaggcagcagt

SEQ ID NO: 8181760 - DNA, 22 bp, Homo sapiens
tcccaggctggcaggcagcagt

SEQ ID NO: 8181761 - DNA, 22 bp, Homo sapiens
tcccaggctcttcaaggaagac

SEQ ID NO: 8181762 - DNA, 22 bp, Homo sapiens
tcccaggctcttcaaggaagac

SEQ ID NO: 8181763 - DNA, 22 bp, Homo sapiens
tcccaggctcttcaaggaagac

SEQ ID NO: 8181764 - DNA, 20 bp, Homo sapiens
tcccaggctccaccctagac

SEQ ID NO: 8181765 - DNA, 20 bp, Homo sapiens
tcccaggctccaccctagac

SEQ ID NO: 8181766 - DNA, 22 bp, Homo sapiens
tccctgcctcctggcagtgcca

SEQ ID NO: 8181767 - DNA, 22 bp, Homo sapiens
tccctgcctcctggcagtgcca

SEQ ID NO: 8181768 - DNA, 22 bp, Homo sapiens
tccctgccctgccttcatggtt

SEQ ID NO: 8181769 - DNA, 22 bp, Homo sapiens
tccctgagaaagcccaggaggt

SEQ ID NO: 8181770 - DNA, 22 bp, Homo sapiens
tccctgagactctggagtgtaa

SEQ ID NO: 8181771 - DNA, 22 bp, Homo sapiens
tccctgagagcactggggagcc

SEQ ID NO: 8181772 - DNA, 22 bp, Homo sapiens
tccctctgtgttgggcatgcct

SEQ ID NO: 8181773 - DNA, 22 bp, Homo sapiens
tccctctgtggttggttctgtc

SEQ ID NO: 8181774 - DNA, 22 bp, Homo sapiens
tccctctgttctgttccaagtg

SEQ ID NO: 8181775 - DNA, 22 bp, Homo sapiens
tccctctgtgttgggcatgcct

SEQ ID NO: 8181776 - DNA, 22 bp, Homo sapiens
tccctctgtgttgggcatgcct

SEQ ID NO: 8181777 - DNA, 22 bp, Homo sapiens
tccctgaaccactagtgatgag

SEQ ID NO: 8181778 - DNA, 22 bp, Homo sapiens
tccctctggtcctcggtggaga

SEQ ID NO: 8181779 - DNA, 22 bp, Homo sapiens
tccctctggtctggacgccata

SEQ ID NO: 8181780 - DNA, 22 bp, Homo sapiens
tccctctgggctggagcagggt

SEQ ID NO: 8181781 - DNA, 22 bp, Homo sapiens
tccctctgggctggagcagggt

SEQ ID NO: 8181782 - DNA, 22 bp, Homo sapiens
tccctctgggctggagcagggt

SEQ ID NO: 8181783 - DNA, 22 bp, Homo sapiens
tccctctgggctccagcacgga

SEQ ID NO: 8181784 - DNA, 22 bp, Homo sapiens
tccctctggaggctctagggga

SEQ ID NO: 8181785 - DNA, 22 bp, Homo sapiens
tccctctgctagtgcttgagct

SEQ ID NO: 8181786 - DNA, 20 bp, Homo sapiens
tccctcctgcagatagagaa

SEQ ID NO: 8181787 - DNA, 18 bp, Homo sapiens
tccctccctgctgtggcc

SEQ ID NO: 8181788 - DNA, 19 bp, Homo sapiens
tccctccctgtaatctcac

SEQ ID NO: 8181789 - DNA, 19 bp, Homo sapiens
tccctccctgtaatctcac

SEQ ID NO: 8181790 - DNA, 18 bp, Homo sapiens
tccctccctgctgtggcc

SEQ ID NO: 8181791 - DNA, 20 bp, Homo sapiens
tccctccctccagctctggg

SEQ ID NO: 8181792 - DNA, 20 bp, Homo sapiens
tccctccctccagctctggg

SEQ ID NO: 8181793 - DNA, 20 bp, Homo sapiens
tccctcagtttccagccctg

SEQ ID NO: 8181794 - DNA, 22 bp, Homo sapiens
tccctccacacctgctggtacc

SEQ ID NO: 8181795 - DNA, 22 bp, Homo sapiens
tccctccagaatggtgaggaag

SEQ ID NO: 8181796 - DNA, 19 bp, Homo sapiens
tccctcagtctgccaggcc

SEQ ID NO: 8181797 - DNA, 20 bp, Homo sapiens
tccctcagtcctggctttgt

SEQ ID NO: 8181798 - DNA, 19 bp, Homo sapiens
tccctcagtctgccaggcc

SEQ ID NO: 8181799 - DNA, 22 bp, Homo sapiens
tccctccaggcagctgggtact

SEQ ID NO: 8181800 - DNA, 22 bp, Homo sapiens
tccctccataacagaggtgagc

SEQ ID NO: 8181801 - DNA, 22 bp, Homo sapiens
tccctccccacttctgagcttt

SEQ ID NO: 8181802 - DNA, 20 bp, Homo sapiens
tccctccctccagctctggg

SEQ ID NO: 8181803 - DNA, 22 bp, Homo sapiens
tccctccccacttctgagcttt

SEQ ID NO: 8181804 - DNA, 22 bp, Homo sapiens
tccctccccacttctgagcttt

SEQ ID NO: 8181805 - DNA, 22 bp, Homo sapiens
tccctcagcttgtctccatgca

SEQ ID NO: 8181806 - DNA, 22 bp, Homo sapiens
tccctcagcttgtctccatgca

SEQ ID NO: 8181807 - DNA, 23 bp, Homo sapiens
tccctcaggccttatctccatct

SEQ ID NO: 8181808 - DNA, 22 bp, Homo sapiens
tccctcaggacccaacttgtaa

SEQ ID NO: 8181809 - DNA, 22 bp, Homo sapiens
tccctcagcttgtctccatgca

SEQ ID NO: 8181810 - DNA, 22 bp, Homo sapiens
tccctcagcttgtctccatgca

SEQ ID NO: 8181811 - DNA, 22 bp, Homo sapiens
tccctcagctcatatttatgcc

SEQ ID NO: 8181812 - DNA, 15 bp, Homo sapiens
tccctcagctaaaga

SEQ ID NO: 8181813 - DNA, 22 bp, Homo sapiens
tccctcagcttgtctccatgca

SEQ ID NO: 8181814 - DNA, 22 bp, Homo sapiens
tccctcagtccctggacaggca

SEQ ID NO: 8181815 - DNA, 22 bp, Homo sapiens
tccctcaggtggttcttgtttc

SEQ ID NO: 8181816 - DNA, 23 bp, Homo sapiens
tccctcaggccttatctccatct

SEQ ID NO: 8181817 - DNA, 22 bp, Homo sapiens
tccctcagggtgcagttgcttt

SEQ ID NO: 8181818 - DNA, 20 bp, Homo sapiens
tccctcaggtcattgggctg

SEQ ID NO: 8181819 - DNA, 22 bp, Homo sapiens
tccctcaggtggttcttgtttc

SEQ ID NO: 8181820 - DNA, 22 bp, Homo sapiens
tcctgcagctgcagacctgggg

SEQ ID NO: 8181821 - DNA, 22 bp, Homo sapiens
tcctgcagctgcagacctgggg

SEQ ID NO: 8181822 - DNA, 22 bp, Homo sapiens
tcctgcagctgaagctcatgtg

SEQ ID NO: 8181823 - DNA, 22 bp, Homo sapiens
tcctgcagccttgggctggagc

SEQ ID NO: 8181824 - DNA, 22 bp, Homo sapiens
tcctgcagctctgagaagcatc

SEQ ID NO: 8181825 - DNA, 22 bp, Homo sapiens
tcctgcagccttgggctggagc

SEQ ID NO: 8181826 - DNA, 22 bp, Homo sapiens
tcctgcagctctgagaagcatc

SEQ ID NO: 8181827 - DNA, 22 bp, Homo sapiens
tcctgcagctgaagctcatgtg

SEQ ID NO: 8181828 - DNA, 22 bp, Homo sapiens
tcctgcaggccagaggggtgag

SEQ ID NO: 8181829 - DNA, 21 bp, Homo sapiens
tcctgcaggaggcctgagagg

SEQ ID NO: 8181830 - DNA, 22 bp, Homo sapiens
tcctgcagctgcagacctgggg

SEQ ID NO: 8181831 - DNA, 22 bp, Homo sapiens
tcctgcaggccagaggggtgag

SEQ ID NO: 8181832 - DNA, 21 bp, Homo sapiens
tcctgcaggaggcctgagagg

SEQ ID NO: 8181833 - DNA, 19 bp, Homo sapiens
tcctgcaggtggcttgcag

SEQ ID NO: 8181834 - DNA, 20 bp, Homo sapiens
tcctgcagtcgctagcgccc

SEQ ID NO: 8181835 - DNA, 19 bp, Homo sapiens
tcctgcaggtggcttgcag

SEQ ID NO: 8181836 - DNA, 22 bp, Homo sapiens
tcctgcaggggctgaggaacca

SEQ ID NO: 8181837 - DNA, 22 bp, Homo sapiens
tcctgcaggggctgaggaacca

SEQ ID NO: 8181838 - DNA, 19 bp, Homo sapiens
tcctgcaggtggcttgcag

SEQ ID NO: 8181839 - DNA, 21 bp, Homo sapiens
tcctgcagggcagcagagtgg

SEQ ID NO: 8181840 - DNA, 22 bp, Homo sapiens
tcctgcaggcttgagtcctcag

SEQ ID NO: 8181841 - DNA, 22 bp, Homo sapiens
tcctgcagtctgcactctgcct

SEQ ID NO: 8181842 - DNA, 20 bp, Homo sapiens
tcctgcagtcgctagcgccc

SEQ ID NO: 8181843 - DNA, 20 bp, Homo sapiens
tcctgcagtcgctagcgccc

SEQ ID NO: 8181844 - DNA, 22 bp, Homo sapiens
tcctgcagtctgcactctgcct

SEQ ID NO: 8181845 - DNA, 22 bp, Homo sapiens
tcctgcagtctgcactctgcct

SEQ ID NO: 8181846 - DNA, 22 bp, Homo sapiens
tcctgcagtctgcactctgcct

SEQ ID NO: 8181847 - DNA, 22 bp, Homo sapiens
tcctgccgtcctccggggcctc

SEQ ID NO: 8181848 - DNA, 22 bp, Homo sapiens
tcctgccctcgggggtgttcca

SEQ ID NO: 8181849 - DNA, 22 bp, Homo sapiens
tcctgcccagagctctccactc

SEQ ID NO: 8181850 - DNA, 22 bp, Homo sapiens
tcctgcagagccgccctcaggt

SEQ ID NO: 8181851 - DNA, 22 bp, Homo sapiens
tcctgcagagccgccctcaggt

SEQ ID NO: 8181852 - DNA, 22 bp, Homo sapiens
tcctgcagagccgccctcaggt

SEQ ID NO: 8181853 - DNA, 22 bp, Homo sapiens
tcctgcagagacagaggcctca

SEQ ID NO: 8181854 - DNA, 23 bp, Homo sapiens
tcctgcagataagctggttgaca

SEQ ID NO: 8181855 - DNA, 23 bp, Homo sapiens
tcctgcagataagctggttgaca

SEQ ID NO: 8181856 - DNA, 22 bp, Homo sapiens
tcctgcagagtcccactgattt

SEQ ID NO: 8181857 - DNA, 22 bp, Homo sapiens
tcctgcagccactgcaggcaga

SEQ ID NO: 8181858 - DNA, 22 bp, Homo sapiens
tcctgcagccactgcaggcaga

SEQ ID NO: 8181859 - DNA, 22 bp, Homo sapiens
tcctgcagccattagaggtcaa

SEQ ID NO: 8181860 - DNA, 22 bp, Homo sapiens
tcctgcagccttgggctggagc

SEQ ID NO: 8181861 - DNA, 22 bp, Homo sapiens
tcctgcagccactgcaggcaga

SEQ ID NO: 8181862 - DNA, 22 bp, Homo sapiens
tcctgcagcatccgtcgtctgt

SEQ ID NO: 8181863 - DNA, 22 bp, Homo sapiens
tcctgcagacctcagtcaggtc

SEQ ID NO: 8181864 - DNA, 19 bp, Homo sapiens
tcctgcagaccagacctgt

SEQ ID NO: 8181865 - DNA, 22 bp, Homo sapiens
tcctgcagacctcagtcaggtc

SEQ ID NO: 8181866 - DNA, 22 bp, Homo sapiens
tcctgcagacctcagtcaggtc

SEQ ID NO: 8181867 - DNA, 22 bp, Homo sapiens
tcctgcagagacagaggcctca

SEQ ID NO: 8181868 - DNA, 22 bp, Homo sapiens
tcctgcagacctcagtcaggtc

SEQ ID NO: 8181869 - DNA, 22 bp, Homo sapiens
tcctgcagagacagaggcctca

SEQ ID NO: 8181870 - DNA, 22 bp, Homo sapiens
tcctgcagagacagaggcctca

SEQ ID NO: 8181871 - DNA, 22 bp, Homo sapiens
tcctgcagagacagaggcctca

SEQ ID NO: 8181872 - DNA, 22 bp, Homo sapiens
tcctgcagagacagaggcctca

SEQ ID NO: 8181873 - DNA, 22 bp, Homo sapiens
tcctgattaggtttccatagct

SEQ ID NO: 8181874 - DNA, 22 bp, Homo sapiens
tcctgattaggtttccatagct

SEQ ID NO: 8181875 - DNA, 22 bp, Homo sapiens
tcctgcacaccttgagcttgga

SEQ ID NO: 8181876 - DNA, 22 bp, Homo sapiens
tcctgcacactgatgagatcac

SEQ ID NO: 8181877 - DNA, 22 bp, Homo sapiens
tcctgcacagcctaagtagaaa

SEQ ID NO: 8181878 - DNA, 21 bp, Homo sapiens
tcctgcaccctccctgtggct

SEQ ID NO: 8181879 - DNA, 21 bp, Homo sapiens
tcctgcaccctccctgtggct

SEQ ID NO: 8181880 - DNA, 21 bp, Homo sapiens
tcctgcagaatgccttcctac

SEQ ID NO: 8181881 - DNA, 22 bp, Homo sapiens
tcctgcagacatttacaccttt

SEQ ID NO: 8181882 - DNA, 22 bp, Homo sapiens
tcctgcagacatttacaccttt

SEQ ID NO: 8181883 - DNA, 19 bp, Homo sapiens
tcctgcagaccagacctgt

SEQ ID NO: 8181884 - DNA, 22 bp, Homo sapiens
tcctgcagacatttacaccttt

SEQ ID NO: 8181885 - DNA, 19 bp, Homo sapiens
tcctgcagaccagacctgt

SEQ ID NO: 8181886 - DNA, 22 bp, Homo sapiens
tcctgcctctccatgctaacta

SEQ ID NO: 8181887 - DNA, 22 bp, Homo sapiens
tcctgcctctccatgctaacta

SEQ ID NO: 8181888 - DNA, 22 bp, Homo sapiens
tcctgcctctccatgctaacta

SEQ ID NO: 8181889 - DNA, 22 bp, Homo sapiens
tcctgcctcttgccttcttcac

SEQ ID NO: 8181890 - DNA, 22 bp, Homo sapiens
tcctgcctcttttcttattcca

SEQ ID NO: 8181891 - DNA, 22 bp, Homo sapiens
tcctgcctcttttcttattcca

SEQ ID NO: 8181892 - DNA, 22 bp, Homo sapiens
tcctgcctcttgccttcttcac

SEQ ID NO: 8181893 - DNA, 22 bp, Homo sapiens
tcctgcctcttgccttcttcac

SEQ ID NO: 8181894 - DNA, 22 bp, Homo sapiens
tcctgcctcttgccttcttcac

SEQ ID NO: 8181895 - DNA, 22 bp, Homo sapiens
tcctgcctcttttcttattcca

SEQ ID NO: 8181896 - DNA, 22 bp, Homo sapiens
tcctgcctcttttcttattcca

SEQ ID NO: 8181897 - DNA, 22 bp, Homo sapiens
tcctgcctgcaatcccagcact

SEQ ID NO: 8181898 - DNA, 22 bp, Homo sapiens
tcctgcctgagcgtggaggagg

SEQ ID NO: 8181899 - DNA, 22 bp, Homo sapiens
tcctgcctgagcgtggaggagg

SEQ ID NO: 8181900 - DNA, 22 bp, Homo sapiens
tcctgcctgcaatcccagcact

SEQ ID NO: 8181901 - DNA, 22 bp, Homo sapiens
tcctgcctgcaatcccagcact

SEQ ID NO: 8181902 - DNA, 22 bp, Homo sapiens
tcctgcctcaggctctggagta

SEQ ID NO: 8181903 - DNA, 22 bp, Homo sapiens
tcctgcctcaggctctggagta

SEQ ID NO: 8181904 - DNA, 22 bp, Homo sapiens
tcctgcctcacagttgaagttt

SEQ ID NO: 8181905 - DNA, 22 bp, Homo sapiens
tcctgcctcacagttgaagttt

SEQ ID NO: 8181906 - DNA, 22 bp, Homo sapiens
tcctgcctcaggctctggagta

SEQ ID NO: 8181907 - DNA, 22 bp, Homo sapiens
tcctgcctaccttgcggaggtg

SEQ ID NO: 8181908 - DNA, 22 bp, Homo sapiens
tcctgcctaccttgcggaggtg

SEQ ID NO: 8181909 - DNA, 22 bp, Homo sapiens
tcctgcctaccttgcggaggtg

SEQ ID NO: 8181910 - DNA, 22 bp, Homo sapiens
tcctgcctagcaggtgacctat

SEQ ID NO: 8181911 - DNA, 22 bp, Homo sapiens
tcctgcctagcaggtgacctat

SEQ ID NO: 8181912 - DNA, 22 bp, Homo sapiens
tcctgcctagcaggtgacctat

SEQ ID NO: 8181913 - DNA, 22 bp, Homo sapiens
tcctgcctagcaggtgacctat

SEQ ID NO: 8181914 - DNA, 22 bp, Homo sapiens
tcctgcctagcaggtgacctat

SEQ ID NO: 8181915 - DNA, 22 bp, Homo sapiens
tcctgcctcacagttgaagttt

SEQ ID NO: 8181916 - DNA, 22 bp, Homo sapiens
tcctgaaattctggttgtcact

SEQ ID NO: 8181917 - DNA, 22 bp, Homo sapiens
tcctgaaatgtgcacatgacat

SEQ ID NO: 8181918 - DNA, 22 bp, Homo sapiens
tcctgaaaataatttcacaaga

SEQ ID NO: 8181919 - DNA, 22 bp, Homo sapiens
tcctgaaatgtgcacatgacat

SEQ ID NO: 8181920 - DNA, 22 bp, Homo sapiens
tcctgaaaaattacatgttcag

SEQ ID NO: 8181921 - DNA, 19 bp, Homo sapiens
tcctgaaaacttctggaat

SEQ ID NO: 8181922 - DNA, 19 bp, Homo sapiens
tcctgaaaacttctggaat

SEQ ID NO: 8181923 - DNA, 19 bp, Homo sapiens
tcctgaaaacttctggaat

SEQ ID NO: 8181924 - DNA, 22 bp, Homo sapiens
tcctgaagaggttgtctttata

SEQ ID NO: 8181925 - DNA, 22 bp, Homo sapiens
tcctgaagcagttagcatgagc

SEQ ID NO: 8181926 - DNA, 22 bp, Homo sapiens
tcctgaagaacgaagtcatgta

SEQ ID NO: 8181927 - DNA, 22 bp, Homo sapiens
tcctgaacattatgcaagcttc

SEQ ID NO: 8181928 - DNA, 22 bp, Homo sapiens
tcctgagagcagagtccaggtg

SEQ ID NO: 8181929 - DNA, 22 bp, Homo sapiens
tcctgagagcagagtccaggtg

SEQ ID NO: 8181930 - DNA, 22 bp, Homo sapiens
tcctgagacatctctgctggtc

SEQ ID NO: 8181931 - DNA, 20 bp, Homo sapiens
tcctgagacctgggaaggtt

SEQ ID NO: 8181932 - DNA, 20 bp, Homo sapiens
tcctgagacctgggaaggtt

SEQ ID NO: 8181933 - DNA, 22 bp, Homo sapiens
tcctgagagcagctgctttgga

SEQ ID NO: 8181934 - DNA, 22 bp, Homo sapiens
tcctgagagcagctgctttgga

SEQ ID NO: 8181935 - DNA, 22 bp, Homo sapiens
tcctgagagcagctgctttgga

SEQ ID NO: 8181936 - DNA, 20 bp, Homo sapiens
tcctgagaggctcttggaga

SEQ ID NO: 8181937 - DNA, 20 bp, Homo sapiens
tcctgagaggctcttggaga

SEQ ID NO: 8181938 - DNA, 22 bp, Homo sapiens
tcctgagagccttggcttcaga

SEQ ID NO: 8181939 - DNA, 22 bp, Homo sapiens
tcctgagagccttggcttcaga

SEQ ID NO: 8181940 - DNA, 22 bp, Homo sapiens
tcctgagaatagagttgcatgt

SEQ ID NO: 8181941 - DNA, 22 bp, Homo sapiens
tcctgaaggcctgagttccacc

SEQ ID NO: 8181942 - DNA, 22 bp, Homo sapiens
tcctgagaaggcacagcttgca

SEQ ID NO: 8181943 - DNA, 22 bp, Homo sapiens
tcctgaaggcctgagttccacc

SEQ ID NO: 8181944 - DNA, 22 bp, Homo sapiens
tcctgagaaggcacagcttgca

SEQ ID NO: 8181945 - DNA, 22 bp, Homo sapiens
tcctgagaatagagttgcatgt

SEQ ID NO: 8181946 - DNA, 22 bp, Homo sapiens
tcctgagacatctctgctggtc

SEQ ID NO: 8181947 - DNA, 22 bp, Homo sapiens
tcctgaagcctgagtgatgact

SEQ ID NO: 8181948 - DNA, 22 bp, Homo sapiens
tcctgaaggcagatggggatca

SEQ ID NO: 8181949 - DNA, 22 bp, Homo sapiens
tcctcttctgtggattccctga

SEQ ID NO: 8181950 - DNA, 22 bp, Homo sapiens
tcctgaaaaattacatgttcag

SEQ ID NO: 8181951 - DNA, 22 bp, Homo sapiens
tcctcttctaagctcattcagg

SEQ ID NO: 8181952 - DNA, 22 bp, Homo sapiens
tcctcttctgcctatatctgcc

SEQ ID NO: 8181953 - DNA, 22 bp, Homo sapiens
tcctcttcagagggacctcggg

SEQ ID NO: 8181954 - DNA, 22 bp, Homo sapiens
tcctcttcaaaatagctctgaa

SEQ ID NO: 8181955 - DNA, 22 bp, Homo sapiens
tcctcttcaaaatagctctgaa

SEQ ID NO: 8181956 - DNA, 22 bp, Homo sapiens
tcctcttcaaaaggatttcctt

SEQ ID NO: 8181957 - DNA, 22 bp, Homo sapiens
tcctcttcaaaaggatttcctt

SEQ ID NO: 8181958 - DNA, 22 bp, Homo sapiens
tcctctggttatacttgcaccc

SEQ ID NO: 8181959 - DNA, 22 bp, Homo sapiens
tcctctggttatacttgcaccc

SEQ ID NO: 8181960 - DNA, 19 bp, Homo sapiens
tcctctggtaccacccttg

SEQ ID NO: 8181961 - DNA, 22 bp, Homo sapiens
tcctctggggcgtggtcctgga

SEQ ID NO: 8181962 - DNA, 22 bp, Homo sapiens
tcctctggggtcagggcactac

SEQ ID NO: 8181963 - DNA, 22 bp, Homo sapiens
tcctctggggtcagggcactac

SEQ ID NO: 8181964 - DNA, 22 bp, Homo sapiens
tcctctggtcttcggtgtggac

SEQ ID NO: 8181965 - DNA, 22 bp, Homo sapiens
tcctctggtcctgcagcagatc

SEQ ID NO: 8181966 - DNA, 22 bp, Homo sapiens
tcctctggtacttaaagtgctt

SEQ ID NO: 8181967 - DNA, 22 bp, Homo sapiens
tcctctggggcgtggtcctgga

SEQ ID NO: 8181968 - DNA, 22 bp, Homo sapiens
tcctctgggctccctgcaacag

SEQ ID NO: 8181969 - DNA, 22 bp, Homo sapiens
tcctctgggctccctgcaacag

SEQ ID NO: 8181970 - DNA, 22 bp, Homo sapiens
tcctctggggcgtggtcctgga

SEQ ID NO: 8181971 - DNA, 22 bp, Homo sapiens
tcctgaggaaagttcatgaatg

SEQ ID NO: 8181972 - DNA, 22 bp, Homo sapiens
tcctgagctgacacttggggag

SEQ ID NO: 8181973 - DNA, 22 bp, Homo sapiens
tcctgagctcccatgaacaggc

SEQ ID NO: 8181974 - DNA, 22 bp, Homo sapiens
tcctgagctcccatgaacaggc

SEQ ID NO: 8181975 - DNA, 22 bp, Homo sapiens
tcctgaggaccctgtcaggggc

SEQ ID NO: 8181976 - DNA, 22 bp, Homo sapiens
tcctgaggaatgtgaagagaac

SEQ ID NO: 8181977 - DNA, 22 bp, Homo sapiens
tcctgaggactaacaggaagga

SEQ ID NO: 8181978 - DNA, 22 bp, Homo sapiens
tcctgatggcctctggctccag

SEQ ID NO: 8181979 - DNA, 22 bp, Homo sapiens
tcctgagttgcatagtgaagat

SEQ ID NO: 8181980 - DNA, 22 bp, Homo sapiens
tcctgagtgagagctgggaggt

SEQ ID NO: 8181981 - DNA, 21 bp, Homo sapiens
tcctgagtgtgcccaggctct

SEQ ID NO: 8181982 - DNA, 22 bp, Homo sapiens
tcctgagtggttgttttcttcc

SEQ ID NO: 8181983 - DNA, 20 bp, Homo sapiens
tcctgagtgcagttggcttg

SEQ ID NO: 8181984 - DNA, 22 bp, Homo sapiens
tcctgaggctcactttgaatgt

SEQ ID NO: 8181985 - DNA, 22 bp, Homo sapiens
tcctgaggctaaagtgcagtgg

SEQ ID NO: 8181986 - DNA, 22 bp, Homo sapiens
tcctgaggttttaaaactattc

SEQ ID NO: 8181987 - DNA, 22 bp, Homo sapiens
tcctgaggcctctgtgatgtga

SEQ ID NO: 8181988 - DNA, 22 bp, Homo sapiens
tcctgaggcctctgtgatgtga

SEQ ID NO: 8181989 - DNA, 22 bp, Homo sapiens
tcctgaggccctgttagggtct

SEQ ID NO: 8181990 - DNA, 22 bp, Homo sapiens
tcctgagataaatctcatgtga

SEQ ID NO: 8181991 - DNA, 22 bp, Homo sapiens
tcctgagataggagttgaaggc

SEQ ID NO: 8181992 - DNA, 22 bp, Homo sapiens
tcctgagataggagttgaaggc

SEQ ID NO: 8181993 - DNA, 22 bp, Homo sapiens
tcctgagagtcaagaatgcagg

SEQ ID NO: 8181994 - DNA, 22 bp, Homo sapiens
tcctgagaggtgtgaggtgcag

SEQ ID NO: 8181995 - DNA, 22 bp, Homo sapiens
tcctgagaggggtgggtttccc

SEQ ID NO: 8181996 - DNA, 23 bp, Homo sapiens
tcctgagatgagacagtgctgcc

SEQ ID NO: 8181997 - DNA, 23 bp, Homo sapiens
tcctgagatgagacagtgctgcc

SEQ ID NO: 8181998 - DNA, 23 bp, Homo sapiens
tcctgagatgagacagtgctgcc

SEQ ID NO: 8181999 - DNA, 23 bp, Homo sapiens
tcctgagatgagacagtgctgcc

SEQ ID NO: 8182000 - DNA, 23 bp, Homo sapiens
tcctgagatgagacagtgctgcc

SEQ ID NO: 8182001 - DNA, 22 bp, Homo sapiens
tcctgagatgagacagtgctgc

SEQ ID NO: 8182002 - DNA, 22 bp, Homo sapiens
tcctgagatgagacagtgctgc

SEQ ID NO: 8182003 - DNA, 22 bp, Homo sapiens
tcctgagatgagacagtgctgc

SEQ ID NO: 8182004 - DNA, 22 bp, Homo sapiens
tcctgagatgagacagtgctgc

SEQ ID NO: 8182005 - DNA, 22 bp, Homo sapiens
tcctgagatgagacagtgctgc

SEQ ID NO: 8182006 - DNA, 22 bp, Homo sapiens
tcctgagatccttttagggatc

SEQ ID NO: 8182007 - DNA, 20 bp, Homo sapiens
tcctgagatttaaggggttc

SEQ ID NO: 8182008 - DNA, 22 bp, Homo sapiens
tcctgagattctgcatttctaa

SEQ ID NO: 8182009 - DNA, 22 bp, Homo sapiens
tcctgagattctgcatttctaa

SEQ ID NO: 8182010 - DNA, 22 bp, Homo sapiens
tcctgagatgtggagctccatg

SEQ ID NO: 8182011 - DNA, 22 bp, Homo sapiens
tcctgagatgtggagctccatg

SEQ ID NO: 8182012 - DNA, 22 bp, Homo sapiens
tcctgagattctgcatttctaa

SEQ ID NO: 8182013 - DNA, 22 bp, Homo sapiens
tcctgagatgtggagctccatg

SEQ ID NO: 8182014 - DNA, 22 bp, Homo sapiens
tcctgagcacagagacaaggaa

SEQ ID NO: 8182015 - DNA, 22 bp, Homo sapiens
tcctgagcaacacagctaagtg

SEQ ID NO: 8182016 - DNA, 20 bp, Homo sapiens
tcctgagatttaaggggttc

SEQ ID NO: 8182017 - DNA, 20 bp, Homo sapiens
tcctgagatttaaggggttc

SEQ ID NO: 8182018 - DNA, 22 bp, Homo sapiens
tcctgagccctactctagacga

SEQ ID NO: 8182019 - DNA, 22 bp, Homo sapiens
tcctgagccctactctagacga

SEQ ID NO: 8182020 - DNA, 22 bp, Homo sapiens
tcctgagcacctatgccatggc

SEQ ID NO: 8182021 - DNA, 20 bp, Homo sapiens
tcctgagcctccaccatgtc

SEQ ID NO: 8182022 - DNA, 22 bp, Homo sapiens
tcctgagctacagtagtatgat

SEQ ID NO: 8182023 - DNA, 20 bp, Homo sapiens
tcctgagcctccaccatgtc

SEQ ID NO: 8182024 - DNA, 22 bp, Homo sapiens
tcctgagccctggggtcagtgt

SEQ ID NO: 8182025 - DNA, 22 bp, Homo sapiens
tcagatgctagggctgagctat

SEQ ID NO: 8182026 - DNA, 22 bp, Homo sapiens
tcagatttactgcagagcagat

SEQ ID NO: 8182027 - DNA, 22 bp, Homo sapiens
tcagatttactgcagagcagat

SEQ ID NO: 8182028 - DNA, 18 bp, Homo sapiens
tcagatttaactgtatcc

SEQ ID NO: 8182029 - DNA, 20 bp, Homo sapiens
tcagattaaatgttctgtct

SEQ ID NO: 8182030 - DNA, 18 bp, Homo sapiens
tcagatttaactgtatcc

SEQ ID NO: 8182031 - DNA, 22 bp, Homo sapiens
tcagattctggatagatcttca

SEQ ID NO: 8182032 - DNA, 22 bp, Homo sapiens
tcagattttccacagactggaa

SEQ ID NO: 8182033 - DNA, 22 bp, Homo sapiens
tcagattttgcacgaggttttg

SEQ ID NO: 8182034 - DNA, 20 bp, Homo sapiens
tcagatttttctaactttga

SEQ ID NO: 8182035 - DNA, 20 bp, Homo sapiens
tcagattttgggtcactgat

SEQ ID NO: 8182036 - DNA, 22 bp, Homo sapiens
tcagattttgcacgaggttttg

SEQ ID NO: 8182037 - DNA, 22 bp, Homo sapiens
tcagatttgaatattcctttcg

SEQ ID NO: 8182038 - DNA, 22 bp, Homo sapiens
tcagatttgatgtggttttcta

SEQ ID NO: 8182039 - DNA, 22 bp, Homo sapiens
tcagatttggacacaggaactt

SEQ ID NO: 8182040 - DNA, 22 bp, Homo sapiens
tcagattttattttcctgttac

SEQ ID NO: 8182041 - DNA, 22 bp, Homo sapiens
tcagatttgtcctactaggcac

SEQ ID NO: 8182042 - DNA, 22 bp, Homo sapiens
tcagattttattttcctgttac

SEQ ID NO: 8182043 - DNA, 22 bp, Homo sapiens
tcagatttctagcgtttggcca

SEQ ID NO: 8182044 - DNA, 22 bp, Homo sapiens
tcagatttccttgcagtttgga

SEQ ID NO: 8182045 - DNA, 22 bp, Homo sapiens
tcagatttcttcttgcaacggc

SEQ ID NO: 8182046 - DNA, 22 bp, Homo sapiens
tcagatttcctgttgaagaagt

SEQ ID NO: 8182047 - DNA, 22 bp, Homo sapiens
tcagatttcctgttgaagaagt

SEQ ID NO: 8182048 - DNA, 22 bp, Homo sapiens
tcagatttctagcgtttggcca

SEQ ID NO: 8182049 - DNA, 22 bp, Homo sapiens
tcagatttatgaatatactatg

SEQ ID NO: 8182050 - DNA, 22 bp, Homo sapiens
tcagatttagggtgattacctt

SEQ ID NO: 8182051 - DNA, 22 bp, Homo sapiens
tcagatttatgaatatactatg

SEQ ID NO: 8182052 - DNA, 22 bp, Homo sapiens
tcagatttatgaatatactatg

SEQ ID NO: 8182053 - DNA, 22 bp, Homo sapiens
tcagatttcctgttgaagaagt

SEQ ID NO: 8182054 - DNA, 22 bp, Homo sapiens
tcagatttcagctaaagggatg

SEQ ID NO: 8182055 - DNA, 22 bp, Homo sapiens
tcagatttatgtggctaggctc

SEQ ID NO: 8182056 - DNA, 22 bp, Homo sapiens
tcagagtgtgacttggtcatga

SEQ ID NO: 8182057 - DNA, 21 bp, Homo sapiens
tcagagtgtgttacagcaagc

SEQ ID NO: 8182058 - DNA, 22 bp, Homo sapiens
tcagacagaggagctcgtgcag

SEQ ID NO: 8182059 - DNA, 22 bp, Homo sapiens
tcagacagagaagtacaatgag

SEQ ID NO: 8182060 - DNA, 22 bp, Homo sapiens
tcagacagattttgacacttgc

SEQ ID NO: 8182061 - DNA, 22 bp, Homo sapiens
tcagacagaaggactatttgaa

SEQ ID NO: 8182062 - DNA, 22 bp, Homo sapiens
tcagacagaaagatgagtatgg

SEQ ID NO: 8182063 - DNA, 22 bp, Homo sapiens
tcagacagagaagtacaatgag

SEQ ID NO: 8182064 - DNA, 22 bp, Homo sapiens
tcagacagagaagtacaatgag

SEQ ID NO: 8182065 - DNA, 23 bp, Homo sapiens
tcagaattccagtttctttgaag

SEQ ID NO: 8182066 - DNA, 22 bp, Homo sapiens
tcagaattggaacgtgaagatt

SEQ ID NO: 8182067 - DNA, 22 bp, Homo sapiens
tcagaattgattttcaaaacag

SEQ ID NO: 8182068 - DNA, 22 bp, Homo sapiens
tcagaattggacaatagaagca

SEQ ID NO: 8182069 - DNA, 22 bp, Homo sapiens
tcagaattgtggagaaagggga

SEQ ID NO: 8182070 - DNA, 22 bp, Homo sapiens
tcagaatttaaaatgtgtagat

SEQ ID NO: 8182071 - DNA, 17 bp, Homo sapiens
tcagcaaagacaaagga

SEQ ID NO: 8182072 - DNA, 22 bp, Homo sapiens
tcagatttttgagatgtctgtt

SEQ ID NO: 8182073 - DNA, 20 bp, Homo sapiens
tcagatttttctaactttga

SEQ ID NO: 8182074 - DNA, 22 bp, Homo sapiens
tcagatttttgagatgtctgtt

SEQ ID NO: 8182075 - DNA, 22 bp, Homo sapiens
tcagcaactctcattccgcttt

SEQ ID NO: 8182076 - DNA, 22 bp, Homo sapiens
tcagcaagaagctgtgggcttc

SEQ ID NO: 8182077 - DNA, 22 bp, Homo sapiens
tcagcaactatttatcaaattc

SEQ ID NO: 8182078 - DNA, 22 bp, Homo sapiens
tcagcaagaagtcatttgtagc

SEQ ID NO: 8182079 - DNA, 22 bp, Homo sapiens
tcagcaggcaggaggcatgcca

SEQ ID NO: 8182080 - DNA, 22 bp, Homo sapiens
tcagcaggcaggaggcatgcca

SEQ ID NO: 8182081 - DNA, 22 bp, Homo sapiens
tcagcaggcagaaatctgcaga

SEQ ID NO: 8182082 - DNA, 22 bp, Homo sapiens
tcagcaggctctggttgaccat

SEQ ID NO: 8182083 - DNA, 22 bp, Homo sapiens
tcagcaggctctggttgaccat

SEQ ID NO: 8182084 - DNA, 22 bp, Homo sapiens
tcagcaggcggttccttgtggg

SEQ ID NO: 8182085 - DNA, 22 bp, Homo sapiens
tcagcaggcggttccttgtggg

SEQ ID NO: 8182086 - DNA, 22 bp, Homo sapiens
tcagcaggctgtcagcaggggc

SEQ ID NO: 8182087 - DNA, 22 bp, Homo sapiens
tcagcaggctgtcagcaggggc

SEQ ID NO: 8182088 - DNA, 22 bp, Homo sapiens
tcagcaggctgtcagcaggggc

SEQ ID NO: 8182089 - DNA, 22 bp, Homo sapiens
tcagcaggcccatcctccaggc

SEQ ID NO: 8182090 - DNA, 22 bp, Homo sapiens
tcagcaggcccatcctccaggc

SEQ ID NO: 8182091 - DNA, 22 bp, Homo sapiens
tcagcaggcccatcctccaggc

SEQ ID NO: 8182092 - DNA, 22 bp, Homo sapiens
tcagcaggcagtgggtcacaat

SEQ ID NO: 8182093 - DNA, 22 bp, Homo sapiens
tcagcaggcagtgggtcacaat

SEQ ID NO: 8182094 - DNA, 22 bp, Homo sapiens
tcagcaggcaggaggcatgcca

SEQ ID NO: 8182095 - DNA, 22 bp, Homo sapiens
tcagcagggctgggagctgtga

SEQ ID NO: 8182096 - DNA, 22 bp, Homo sapiens
tcagcagggctgtggtgtggct

SEQ ID NO: 8182097 - DNA, 22 bp, Homo sapiens
tcagcagggctgtggtgtggct

SEQ ID NO: 8182098 - DNA, 22 bp, Homo sapiens
tcagcagggctgtggtgtggct

SEQ ID NO: 8182099 - DNA, 22 bp, Homo sapiens
tcagcagggctgggagctgtga

SEQ ID NO: 8182100 - DNA, 22 bp, Homo sapiens
tcagcagggctgggagctgtga

SEQ ID NO: 8182101 - DNA, 22 bp, Homo sapiens
tcagcagggcctccttgtgcag

SEQ ID NO: 8182102 - DNA, 22 bp, Homo sapiens
tcagcagtgtcagttcccagag

SEQ ID NO: 8182103 - DNA, 22 bp, Homo sapiens
tcagcaggggccgttgggtgga

SEQ ID NO: 8182104 - DNA, 17 bp, Homo sapiens
tcagcaggggccaagct

SEQ ID NO: 8182105 - DNA, 17 bp, Homo sapiens
tcagcaggggccaagct

SEQ ID NO: 8182106 - DNA, 17 bp, Homo sapiens
tcagcaggggccaagct

SEQ ID NO: 8182107 - DNA, 17 bp, Homo sapiens
tcagcaggggccaagct

SEQ ID NO: 8182108 - DNA, 22 bp, Homo sapiens
tcagcagggcatactgagccta

SEQ ID NO: 8182109 - DNA, 22 bp, Homo sapiens
tcagcagggaggctctgtgccc

SEQ ID NO: 8182110 - DNA, 22 bp, Homo sapiens
tcagcagggaggctctgtgccc

SEQ ID NO: 8182111 - DNA, 22 bp, Homo sapiens
tcagcagggaggctctgtgccc

SEQ ID NO: 8182112 - DNA, 22 bp, Homo sapiens
tcagcagggaggctctgtgccc

SEQ ID NO: 8182113 - DNA, 22 bp, Homo sapiens
tcagcagggagaggagaatgca

SEQ ID NO: 8182114 - DNA, 22 bp, Homo sapiens
tcagcagggagaggagaatgca

SEQ ID NO: 8182115 - DNA, 22 bp, Homo sapiens
tcagcaggctgtcagcaggggc

SEQ ID NO: 8182116 - DNA, 22 bp, Homo sapiens
tcagcagggagaggagaatgca

SEQ ID NO: 8182117 - DNA, 22 bp, Homo sapiens
tcagcagggagaggagaatgca

SEQ ID NO: 8182118 - DNA, 22 bp, Homo sapiens
tcagcagggcatactgagccta

SEQ ID NO: 8182119 - DNA, 22 bp, Homo sapiens
tcagcagggcatactgagccta

SEQ ID NO: 8182120 - DNA, 22 bp, Homo sapiens
tcagcagggcctccttgtgcag

SEQ ID NO: 8182121 - DNA, 22 bp, Homo sapiens
tcagcagggcctccttgtgcag

SEQ ID NO: 8182122 - DNA, 22 bp, Homo sapiens
tcagcagggccatgctctctct

SEQ ID NO: 8182123 - DNA, 22 bp, Homo sapiens
tcagcagggccatgctctctct

SEQ ID NO: 8182124 - DNA, 22 bp, Homo sapiens
tcagcagggccatgctctctct

SEQ ID NO: 8182125 - DNA, 22 bp, Homo sapiens
tcagcagggccatgctctctct

SEQ ID NO: 8182126 - DNA, 22 bp, Homo sapiens
tcaggaattttgttctgtatcc

SEQ ID NO: 8182127 - DNA, 22 bp, Homo sapiens
tcaggacaacaagacttgttta

SEQ ID NO: 8182128 - DNA, 22 bp, Homo sapiens
tcaggaagtataatcagattca

SEQ ID NO: 8182129 - DNA, 22 bp, Homo sapiens
tcaggaattttgttctgtatcc

SEQ ID NO: 8182130 - DNA, 22 bp, Homo sapiens
tcaggaagtataatcagattca

SEQ ID NO: 8182131 - DNA, 22 bp, Homo sapiens
tcaggaagtataatcagattca

SEQ ID NO: 8182132 - DNA, 22 bp, Homo sapiens
tcaggaagggtggtccacaggg

SEQ ID NO: 8182133 - DNA, 22 bp, Homo sapiens
tcaggaagggtggtccacaggg

SEQ ID NO: 8182134 - DNA, 22 bp, Homo sapiens
tcaggaagggctcagtctgtgc

SEQ ID NO: 8182135 - DNA, 22 bp, Homo sapiens
tcagctggtgagtggatagaca

SEQ ID NO: 8182136 - DNA, 22 bp, Homo sapiens
tcagctggtgccactcagtcaa

SEQ ID NO: 8182137 - DNA, 22 bp, Homo sapiens
tcagctggtgtttcttctcctt

SEQ ID NO: 8182138 - DNA, 22 bp, Homo sapiens
tcagctggtgtttcttctcctt

SEQ ID NO: 8182139 - DNA, 18 bp, Homo sapiens
tcagctggggctgcagcc

SEQ ID NO: 8182140 - DNA, 22 bp, Homo sapiens
tcagctgggtgagtgttctgca

SEQ ID NO: 8182141 - DNA, 18 bp, Homo sapiens
tcagctgggtttctgggt

SEQ ID NO: 8182142 - DNA, 22 bp, Homo sapiens
tcagctggtgaatggactcatc

SEQ ID NO: 8182143 - DNA, 18 bp, Homo sapiens
tcagctgggtttctgggt

SEQ ID NO: 8182144 - DNA, 22 bp, Homo sapiens
tcagctggtgaatggactcatc

SEQ ID NO: 8182145 - DNA, 18 bp, Homo sapiens
tcagctggggctgcagcc

SEQ ID NO: 8182146 - DNA, 18 bp, Homo sapiens
tcagctggggctgcagcc

SEQ ID NO: 8182147 - DNA, 18 bp, Homo sapiens
tcagctggggctgcagcc

SEQ ID NO: 8182148 - DNA, 22 bp, Homo sapiens
tcagctgggaagttctcgcttg

SEQ ID NO: 8182149 - DNA, 22 bp, Homo sapiens
tcagctggggccccctctgtcc

SEQ ID NO: 8182150 - DNA, 22 bp, Homo sapiens
tcagctggcaggttctgggaag

SEQ ID NO: 8182151 - DNA, 22 bp, Homo sapiens
tcagctggcaggttctgggaag

SEQ ID NO: 8182152 - DNA, 22 bp, Homo sapiens
tcagctggcatcggctcaccca

SEQ ID NO: 8182153 - DNA, 22 bp, Homo sapiens
tcagctggcatcggctcaccca

SEQ ID NO: 8182154 - DNA, 22 bp, Homo sapiens
tcagctggcatcggctcaccca

SEQ ID NO: 8182155 - DNA, 22 bp, Homo sapiens
tcagctggcagttcagaggctg

SEQ ID NO: 8182156 - DNA, 22 bp, Homo sapiens
tcagctggcagttcagaggctg

SEQ ID NO: 8182157 - DNA, 22 bp, Homo sapiens
tcagctggcagttcagaggctg

SEQ ID NO: 8182158 - DNA, 22 bp, Homo sapiens
tcagctggatgtggaagtgcta

SEQ ID NO: 8182159 - DNA, 22 bp, Homo sapiens
tcagctggatgtggaagtgcta

SEQ ID NO: 8182160 - DNA, 19 bp, Homo sapiens
tcagctggcaggcctcctc

SEQ ID NO: 8182161 - DNA, 22 bp, Homo sapiens
tcagctggagatccttgttgtg

SEQ ID NO: 8182162 - DNA, 22 bp, Homo sapiens
tcagctggagatgagaaccgaa

SEQ ID NO: 8182163 - DNA, 22 bp, Homo sapiens
tcagctggagatgagaaccgaa

SEQ ID NO: 8182164 - DNA, 22 bp, Homo sapiens
tcagctggaagatggtgcagaa

SEQ ID NO: 8182165 - DNA, 22 bp, Homo sapiens
tcagctggagactgctcaatga

SEQ ID NO: 8182166 - DNA, 23 bp, Homo sapiens
tcagctgcttcctcctgcctgcc

SEQ ID NO: 8182167 - DNA, 23 bp, Homo sapiens
tcagctgcttcctcctgcctgcc

SEQ ID NO: 8182168 - DNA, 22 bp, Homo sapiens
tcaggacagccagggtgcagac

SEQ ID NO: 8182169 - DNA, 22 bp, Homo sapiens
tcaggacagccagggtgcagac

SEQ ID NO: 8182170 - DNA, 22 bp, Homo sapiens
tcaggagacaaagggtgcggag

SEQ ID NO: 8182171 - DNA, 22 bp, Homo sapiens
tcaggagaatcagggctgtcct

SEQ ID NO: 8182172 - DNA, 22 bp, Homo sapiens
tcaggagactggcagtgcccac

SEQ ID NO: 8182173 - DNA, 22 bp, Homo sapiens
tcaggagactggcagtgcccac

SEQ ID NO: 8182174 - DNA, 22 bp, Homo sapiens
tcaggagactggcagtgcccac

SEQ ID NO: 8182175 - DNA, 22 bp, Homo sapiens
tcaggagactggcagtgcccac

SEQ ID NO: 8182176 - DNA, 22 bp, Homo sapiens
tcaggagacattcttaaagtag

SEQ ID NO: 8182177 - DNA, 22 bp, Homo sapiens
tcaggagacattcttaaagtag

SEQ ID NO: 8182178 - DNA, 18 bp, Homo sapiens
tcaggagacacagacgca

SEQ ID NO: 8182179 - DNA, 22 bp, Homo sapiens
tcaggagaaggcaatgtggaaa

SEQ ID NO: 8182180 - DNA, 22 bp, Homo sapiens
tcaggagaaggcaatgtggaaa

SEQ ID NO: 8182181 - DNA, 22 bp, Homo sapiens
tcaggagaacttccttctaccc

SEQ ID NO: 8182182 - DNA, 22 bp, Homo sapiens
tcaggagaacttccttctaccc

SEQ ID NO: 8182183 - DNA, 22 bp, Homo sapiens
tcaggagaaaatatcaggaagt

SEQ ID NO: 8182184 - DNA, 22 bp, Homo sapiens
tcagcattttttgggtgtaact

SEQ ID NO: 8182185 - DNA, 22 bp, Homo sapiens
tcagcattgtggcagagaatgg

SEQ ID NO: 8182186 - DNA, 22 bp, Homo sapiens
tcagcatttcagaagtggcata

SEQ ID NO: 8182187 - DNA, 22 bp, Homo sapiens
tcagccagaggcttcttggttt

SEQ ID NO: 8182188 - DNA, 22 bp, Homo sapiens
tcagccagaggcttcttggttt

SEQ ID NO: 8182189 - DNA, 22 bp, Homo sapiens
tcagccagaaagtgattttcag

SEQ ID NO: 8182190 - DNA, 22 bp, Homo sapiens
tcagccagagggggcaaaggaa

SEQ ID NO: 8182191 - DNA, 22 bp, Homo sapiens
tcagccagaggtggatgagtca

SEQ ID NO: 8182192 - DNA, 22 bp, Homo sapiens
tcagccagccagctacaggctt

SEQ ID NO: 8182193 - DNA, 22 bp, Homo sapiens
tcagccagccagctacaggctt

SEQ ID NO: 8182194 - DNA, 22 bp, Homo sapiens
tcagccagccagctacaggctt

SEQ ID NO: 8182195 - DNA, 22 bp, Homo sapiens
tcagccagcattacccctgact

SEQ ID NO: 8182196 - DNA, 22 bp, Homo sapiens
tcagccagagggggcaaaggaa

SEQ ID NO: 8182197 - DNA, 22 bp, Homo sapiens
tcagccagcatcagctaagtgc

SEQ ID NO: 8182198 - DNA, 22 bp, Homo sapiens
tcagccagcatcagctaagtgc

SEQ ID NO: 8182199 - DNA, 22 bp, Homo sapiens
tcagccagcatcagctaagtgc

SEQ ID NO: 8182200 - DNA, 22 bp, Homo sapiens
tcagcatctcaaccttctctac

SEQ ID NO: 8182201 - DNA, 21 bp, Homo sapiens
tcagcatcctgagctgtcctc

SEQ ID NO: 8182202 - DNA, 22 bp, Homo sapiens
tcagcatgtacttctcctccat

SEQ ID NO: 8182203 - DNA, 20 bp, Homo sapiens
tcagcatgttctcctccggt

SEQ ID NO: 8182204 - DNA, 20 bp, Homo sapiens
tcagcatgctcctcagacat

SEQ ID NO: 8182205 - DNA, 20 bp, Homo sapiens
tcagcatgctcctcagacat

SEQ ID NO: 8182206 - DNA, 22 bp, Homo sapiens
tcagcatgtacttctcctccat

SEQ ID NO: 8182207 - DNA, 22 bp, Homo sapiens
tcagcatgttcttaggtcacag

SEQ ID NO: 8182208 - DNA, 22 bp, Homo sapiens
tcagcatgttcttaggtcacag

SEQ ID NO: 8182209 - DNA, 22 bp, Homo sapiens
tcagcatgttcttaggtcacag

SEQ ID NO: 8182210 - DNA, 22 bp, Homo sapiens
tcagcattcctgaagacaagca

SEQ ID NO: 8182211 - DNA, 17 bp, Homo sapiens
tcagcatacacagagaa

SEQ ID NO: 8182212 - DNA, 22 bp, Homo sapiens
tcagctgccccatgtgttcact

SEQ ID NO: 8182213 - DNA, 22 bp, Homo sapiens
tcagctgccccatgtgttcact

SEQ ID NO: 8182214 - DNA, 22 bp, Homo sapiens
tcagctgccccgggcactgccc

SEQ ID NO: 8182215 - DNA, 22 bp, Homo sapiens
tcagctgcctctccctggaaga

SEQ ID NO: 8182216 - DNA, 22 bp, Homo sapiens
tcagctgccccgggcactgccc

SEQ ID NO: 8182217 - DNA, 22 bp, Homo sapiens
tcagctgcctttcccatgctag

SEQ ID NO: 8182218 - DNA, 22 bp, Homo sapiens
tcagctgctcaaatttatgtca

SEQ ID NO: 8182219 - DNA, 22 bp, Homo sapiens
tcagctgcgacaggggcctgag

SEQ ID NO: 8182220 - DNA, 22 bp, Homo sapiens
tcagctgctcaaatttatgtca

SEQ ID NO: 8182221 - DNA, 22 bp, Homo sapiens
tcagctgctctgttgagctgaa

SEQ ID NO: 8182222 - DNA, 22 bp, Homo sapiens
tcagctgctctgttgagctgaa

SEQ ID NO: 8182223 - DNA, 22 bp, Homo sapiens
tcagctgctctgttgagctgaa

SEQ ID NO: 8182224 - DNA, 23 bp, Homo sapiens
tcagctgcttcctcctgcctgcc

SEQ ID NO: 8182225 - DNA, 22 bp, Homo sapiens
tcagctctgcctgtggaggcac

SEQ ID NO: 8182226 - DNA, 22 bp, Homo sapiens
tcagccaggccaggcattcaca

SEQ ID NO: 8182227 - DNA, 22 bp, Homo sapiens
tcagctctgcctgtggaggcac

SEQ ID NO: 8182228 - DNA, 19 bp, Homo sapiens
tcagctctggggtcagtgg

SEQ ID NO: 8182229 - DNA, 22 bp, Homo sapiens
tcagccaggccaccttcagctt

SEQ ID NO: 8182230 - DNA, 22 bp, Homo sapiens
tcagccaggccaccttcagctt

SEQ ID NO: 8182231 - DNA, 22 bp, Homo sapiens
tcagccaggccaccttcagctt

SEQ ID NO: 8182232 - DNA, 22 bp, Homo sapiens
tcagccaggcagccccctggtc

SEQ ID NO: 8182233 - DNA, 20 bp, Homo sapiens
tcagccagctaacatgggga

SEQ ID NO: 8182234 - DNA, 20 bp, Homo sapiens
tcagccagctaacatgggga

SEQ ID NO: 8182235 - DNA, 20 bp, Homo sapiens
tcagccagctaacatgggga

SEQ ID NO: 8182236 - DNA, 22 bp, Homo sapiens
tcagccagctcttggactctga

SEQ ID NO: 8182237 - DNA, 22 bp, Homo sapiens
tcagccagctcttggactctga

SEQ ID NO: 8182238 - DNA, 22 bp, Homo sapiens
tcagccaggcacaatggcagct

SEQ ID NO: 8182239 - DNA, 22 bp, Homo sapiens
tcagccagctcttggactctga

SEQ ID NO: 8182240 - DNA, 22 bp, Homo sapiens
tcagccagctgtgtgcttctgc

SEQ ID NO: 8182241 - DNA, 22 bp, Homo sapiens
tcagccagctgtgtgcttctgc

SEQ ID NO: 8182242 - DNA, 22 bp, Homo sapiens
tcagaacaattcctttataaca

SEQ ID NO: 8182243 - DNA, 22 bp, Homo sapiens
tcagaacagaagaaggaacacg

SEQ ID NO: 8182244 - DNA, 22 bp, Homo sapiens
tcagaacagcacagggtgattt

SEQ ID NO: 8182245 - DNA, 22 bp, Homo sapiens
tcagaacagaagctggctataa

SEQ ID NO: 8182246 - DNA, 22 bp, Homo sapiens
tcagaacagaagctggctataa

SEQ ID NO: 8182247 - DNA, 22 bp, Homo sapiens
tcagaaaggttgagtcatgtgc

SEQ ID NO: 8182248 - DNA, 22 bp, Homo sapiens
tcagaaaggttctatgttttac

SEQ ID NO: 8182249 - DNA, 22 bp, Homo sapiens
tcagaaaggccacatggtgcag

SEQ ID NO: 8182250 - DNA, 22 bp, Homo sapiens
tcagaaaggagttagaggtctc

SEQ ID NO: 8182251 - DNA, 22 bp, Homo sapiens
tcagaaaggagttagaggtctc

SEQ ID NO: 8182252 - DNA, 22 bp, Homo sapiens
tcagaaaggccacatggtgcag

SEQ ID NO: 8182253 - DNA, 22 bp, Homo sapiens
tcagaaaggagttagaggtctc

SEQ ID NO: 8182254 - DNA, 22 bp, Homo sapiens
tcagaaaggagttagaggtctc

SEQ ID NO: 8182255 - DNA, 22 bp, Homo sapiens
tcagaaagctatatggtgtgtc

SEQ ID NO: 8182256 - DNA, 22 bp, Homo sapiens
tcagaaagctatatggtgtgtc

SEQ ID NO: 8182257 - DNA, 22 bp, Homo sapiens
tcagaaagctatatggtgtgtc

SEQ ID NO: 8182258 - DNA, 22 bp, Homo sapiens
tcagaaagacgaaacagatggg

SEQ ID NO: 8182259 - DNA, 22 bp, Homo sapiens
tcagaaagacgaaacagatggg

SEQ ID NO: 8182260 - DNA, 22 bp, Homo sapiens
tcagaaagacgaaacagatggg

SEQ ID NO: 8182261 - DNA, 22 bp, Homo sapiens
tcagaaagcttagtgtcttgca

SEQ ID NO: 8182262 - DNA, 22 bp, Homo sapiens
tcagaaagcttttacttaaaca

SEQ ID NO: 8182263 - DNA, 22 bp, Homo sapiens
tcagaaagcttttacttaaaca

SEQ ID NO: 8182264 - DNA, 22 bp, Homo sapiens
tcagaaagctgattcttgatac

SEQ ID NO: 8182265 - DNA, 22 bp, Homo sapiens
tcagaaagcttagtgtcttgca

SEQ ID NO: 8182266 - DNA, 22 bp, Homo sapiens
tcagaaacagaaactaagaacc

SEQ ID NO: 8182267 - DNA, 22 bp, Homo sapiens
tcagaaaccagctctctcaatt

SEQ ID NO: 8182268 - DNA, 22 bp, Homo sapiens
tcagaaacactcttcttctgtc

SEQ ID NO: 8182269 - DNA, 22 bp, Homo sapiens
tcagaaaatgaaatggactctc

SEQ ID NO: 8182270 - DNA, 22 bp, Homo sapiens
tcagaaagaacacaggcagtag

SEQ ID NO: 8182271 - DNA, 22 bp, Homo sapiens
tcagaaagaacacaggcagtag

SEQ ID NO: 8182272 - DNA, 22 bp, Homo sapiens
tcagaaagaacacaggcagtag

SEQ ID NO: 8182273 - DNA, 22 bp, Homo sapiens
tcagaaagaacacaggcagtag

SEQ ID NO: 8182274 - DNA, 22 bp, Homo sapiens
tcagaacaggactggctgccat

SEQ ID NO: 8182275 - DNA, 22 bp, Homo sapiens
tcagaacaggttgtactatgtc

SEQ ID NO: 8182276 - DNA, 22 bp, Homo sapiens
tcagaacaggttgtactatgtc

SEQ ID NO: 8182277 - DNA, 22 bp, Homo sapiens
tcagaacaggttgtactatgtc

SEQ ID NO: 8182278 - DNA, 22 bp, Homo sapiens
tcagaacagcagggtgtggctg

SEQ ID NO: 8182279 - DNA, 22 bp, Homo sapiens
tcagaacagcgagaatattcac

SEQ ID NO: 8182280 - DNA, 22 bp, Homo sapiens
tcagaacagcgagaatattcac

SEQ ID NO: 8182281 - DNA, 22 bp, Homo sapiens
tcagaagccaccttttgttggg

SEQ ID NO: 8182282 - DNA, 20 bp, Homo sapiens
tcagaacagtagaggagcta

SEQ ID NO: 8182283 - DNA, 22 bp, Homo sapiens
tcagaagccgggcaggttttgg

SEQ ID NO: 8182284 - DNA, 22 bp, Homo sapiens
tcagaagccggaagtgctcctc

SEQ ID NO: 8182285 - DNA, 22 bp, Homo sapiens
tcagaagccggaagtgctcctc

SEQ ID NO: 8182286 - DNA, 22 bp, Homo sapiens
tcagaagccttgattatctaga

SEQ ID NO: 8182287 - DNA, 20 bp, Homo sapiens
tcagaagtttcctggagcat

SEQ ID NO: 8182288 - DNA, 22 bp, Homo sapiens
tcagaatatgctaatgacattt

SEQ ID NO: 8182289 - DNA, 22 bp, Homo sapiens
tcagaatatattcatgttgtca

SEQ ID NO: 8182290 - DNA, 22 bp, Homo sapiens
tcagaatatattcatgttgtca

SEQ ID NO: 8182291 - DNA, 22 bp, Homo sapiens
tcagaataagttatgaaatgaa

SEQ ID NO: 8182292 - DNA, 22 bp, Homo sapiens
tcagaataagttatgaaatgaa

SEQ ID NO: 8182293 - DNA, 23 bp, Homo sapiens
tcagaataataacctagtaactg

SEQ ID NO: 8182294 - DNA, 22 bp, Homo sapiens
tcagaatatgctaatgacattt

SEQ ID NO: 8182295 - DNA, 22 bp, Homo sapiens
tcactgcaacctccacctcccg

SEQ ID NO: 8182296 - DNA, 22 bp, Homo sapiens
tcactgcaacctccacctcccg

SEQ ID NO: 8182297 - DNA, 22 bp, Homo sapiens
tcactgcaacctccacctcccg

SEQ ID NO: 8182298 - DNA, 22 bp, Homo sapiens
tcactgcaacctccacctcccg

SEQ ID NO: 8182299 - DNA, 22 bp, Homo sapiens
tcactgcaacctccacctcccg

SEQ ID NO: 8182300 - DNA, 22 bp, Homo sapiens
tcactgcaacctccacctcccg

SEQ ID NO: 8182301 - DNA, 22 bp, Homo sapiens
tcactgcaacctccacctcccg

SEQ ID NO: 8182302 - DNA, 22 bp, Homo sapiens
tcactgcaacctccacctcccg

SEQ ID NO: 8182303 - DNA, 22 bp, Homo sapiens
tcacattttatctattttaagt

SEQ ID NO: 8182304 - DNA, 22 bp, Homo sapiens
tcacattttatctattttaagt

SEQ ID NO: 8182305 - DNA, 22 bp, Homo sapiens
tcacattttatatctctggttt

SEQ ID NO: 8182306 - DNA, 22 bp, Homo sapiens
tcactgattatgaaaatgaagg

SEQ ID NO: 8182307 - DNA, 22 bp, Homo sapiens
tcactgattatgaaaatgaagg

SEQ ID NO: 8182308 - DNA, 22 bp, Homo sapiens
tcactgatttgcccttatcctg

SEQ ID NO: 8182309 - DNA, 22 bp, Homo sapiens
tcactgcaacctccacctcccg

SEQ ID NO: 8182310 - DNA, 22 bp, Homo sapiens
tcacatttgcaattgcattgtt

SEQ ID NO: 8182311 - DNA, 22 bp, Homo sapiens
tcacatttgcaattgcattgtt

SEQ ID NO: 8182312 - DNA, 22 bp, Homo sapiens
tcacatttgcaattgcattgtt

SEQ ID NO: 8182313 - DNA, 22 bp, Homo sapiens
tcacatttgctatcccactcct

SEQ ID NO: 8182314 - DNA, 22 bp, Homo sapiens
tcacatttggagaaagcctgcc

SEQ ID NO: 8182315 - DNA, 22 bp, Homo sapiens
tcacatttgtgttttattagag

SEQ ID NO: 8182316 - DNA, 22 bp, Homo sapiens
tcacatttgtgttttattagag

SEQ ID NO: 8182317 - DNA, 22 bp, Homo sapiens
tcacattttagtaccatgattt

SEQ ID NO: 8182318 - DNA, 22 bp, Homo sapiens
tcacattttagtaccatgattt

SEQ ID NO: 8182319 - DNA, 22 bp, Homo sapiens
tcacattttatatctctggttt

SEQ ID NO: 8182320 - DNA, 22 bp, Homo sapiens
tcacatttgttcctctgcactt

SEQ ID NO: 8182321 - DNA, 22 bp, Homo sapiens
tcacatttgttcctctgcactt

SEQ ID NO: 8182322 - DNA, 22 bp, Homo sapiens
tcacatttgttcttgaatctaa

SEQ ID NO: 8182323 - DNA, 22 bp, Homo sapiens
tcacatttgttcctctgcactt

SEQ ID NO: 8182324 - DNA, 22 bp, Homo sapiens
tcacatttgttcttgaatctaa

SEQ ID NO: 8182325 - DNA, 22 bp, Homo sapiens
tcactgcaacctccacctcctg

SEQ ID NO: 8182326 - DNA, 22 bp, Homo sapiens
tcactgcaacctccacctcctg

SEQ ID NO: 8182327 - DNA, 22 bp, Homo sapiens
tcactgcaacctccacctcctg

SEQ ID NO: 8182328 - DNA, 22 bp, Homo sapiens
tcactgcaacctccacctcctg

SEQ ID NO: 8182329 - DNA, 22 bp, Homo sapiens
tcactgcaacctccacctcctg

SEQ ID NO: 8182330 - DNA, 22 bp, Homo sapiens
tcactgcaacctccacctcctg

SEQ ID NO: 8182331 - DNA, 22 bp, Homo sapiens
tcactgcaacctccacctcctg

SEQ ID NO: 8182332 - DNA, 22 bp, Homo sapiens
tcactgcgcttcagcctgggtg

SEQ ID NO: 8182333 - DNA, 22 bp, Homo sapiens
tcactgcgcttcagcctgggtg

SEQ ID NO: 8182334 - DNA, 22 bp, Homo sapiens
tcactgcaacctccacctcctg

SEQ ID NO: 8182335 - DNA, 22 bp, Homo sapiens
tcactgcaacctccacctcccg

SEQ ID NO: 8182336 - DNA, 22 bp, Homo sapiens
tcactgcaacctccacctcccg

SEQ ID NO: 8182337 - DNA, 22 bp, Homo sapiens
tcactgcaacctccacctcccg

SEQ ID NO: 8182338 - DNA, 22 bp, Homo sapiens
tcactgcaacctccacctcctg

SEQ ID NO: 8182339 - DNA, 22 bp, Homo sapiens
tcactgctcgataacatgatta

SEQ ID NO: 8182340 - DNA, 22 bp, Homo sapiens
tcactgctcagtctgtactaca

SEQ ID NO: 8182341 - DNA, 22 bp, Homo sapiens
tcactgctcagtctgtactaca

SEQ ID NO: 8182342 - DNA, 22 bp, Homo sapiens
tcactgctctccaatgtggagt

SEQ ID NO: 8182343 - DNA, 22 bp, Homo sapiens
tcactgctctctaagcatcgcc

SEQ ID NO: 8182344 - DNA, 23 bp, Homo sapiens
tcactgctactcagcctgagatt

SEQ ID NO: 8182345 - DNA, 22 bp, Homo sapiens
tcactgcaacctccacctcctg

SEQ ID NO: 8182346 - DNA, 23 bp, Homo sapiens
tcactgctactcagcctgagatt

SEQ ID NO: 8182347 - DNA, 23 bp, Homo sapiens
tcactgctactcagcctgagatt

SEQ ID NO: 8182348 - DNA, 22 bp, Homo sapiens
tcactgctatattggatactga

SEQ ID NO: 8182349 - DNA, 22 bp, Homo sapiens
tcactgctatattggatactga

SEQ ID NO: 8182350 - DNA, 22 bp, Homo sapiens
tcagaaaatgaaatggactctc

SEQ ID NO: 8182351 - DNA, 22 bp, Homo sapiens
tcactgcttaactcaagatctc

SEQ ID NO: 8182352 - DNA, 22 bp, Homo sapiens
tcactgcttcttggagaatgtc

SEQ ID NO: 8182353 - DNA, 22 bp, Homo sapiens
tcactgctctgaaagtacaggg

SEQ ID NO: 8182354 - DNA, 22 bp, Homo sapiens
tcactgctgctgccatgatgga

SEQ ID NO: 8182355 - DNA, 22 bp, Homo sapiens
tcactgcttaactcaagatctc

SEQ ID NO: 8182356 - DNA, 22 bp, Homo sapiens
tcactgctctccaatgtggagt

SEQ ID NO: 8182357 - DNA, 22 bp, Homo sapiens
tcactgctctctaagcatcgcc

SEQ ID NO: 8182358 - DNA, 22 bp, Homo sapiens
tcactgctctgaaagtacaggg

SEQ ID NO: 8182359 - DNA, 22 bp, Homo sapiens
tcactgctctgaaagtacaggg

SEQ ID NO: 8182360 - DNA, 22 bp, Homo sapiens
tcaacacttgctggtttcctct

SEQ ID NO: 8182361 - DNA, 22 bp, Homo sapiens
tcaacacttttgtctttgtccc

SEQ ID NO: 8182362 - DNA, 23 bp, Homo sapiens
tcaacagagcagagggaggcttt

SEQ ID NO: 8182363 - DNA, 22 bp, Homo sapiens
tcaacagaagtgatagctatta

SEQ ID NO: 8182364 - DNA, 22 bp, Homo sapiens
tcaaatgcacctctcatttgtt

SEQ ID NO: 8182365 - DNA, 22 bp, Homo sapiens
tcaaatgagtgactcacacagg

SEQ ID NO: 8182366 - DNA, 22 bp, Homo sapiens
tcaaatgaggctgatgaatgtg

SEQ ID NO: 8182367 - DNA, 22 bp, Homo sapiens
tcaaatgaggctgatgaatgtg

SEQ ID NO: 8182368 - DNA, 22 bp, Homo sapiens
tcaacaataggatatagcaggt

SEQ ID NO: 8182369 - DNA, 22 bp, Homo sapiens
tcaacaatgggtctgtaatgga

SEQ ID NO: 8182370 - DNA, 22 bp, Homo sapiens
tcaacactatccaggcaatctt

SEQ ID NO: 8182371 - DNA, 22 bp, Homo sapiens
tcacagtgagaaatttgttggc

SEQ ID NO: 8182372 - DNA, 22 bp, Homo sapiens
tcacagtgagaaatttgttggc

SEQ ID NO: 8182373 - DNA, 22 bp, Homo sapiens
tcacagtgacttacagagattg

SEQ ID NO: 8182374 - DNA, 22 bp, Homo sapiens
tcacagtgacttacagagattg

SEQ ID NO: 8182375 - DNA, 22 bp, Homo sapiens
tcacagtgacttacagagattg

SEQ ID NO: 8182376 - DNA, 22 bp, Homo sapiens
tcacagtgacagccaatgtttt

SEQ ID NO: 8182377 - DNA, 22 bp, Homo sapiens
tcacagtgacagccaatgtttt

SEQ ID NO: 8182378 - DNA, 22 bp, Homo sapiens
tcacagtgacagccaatgtttt

SEQ ID NO: 8182379 - DNA, 22 bp, Homo sapiens
tcacagtattcatgaacatgga

SEQ ID NO: 8182380 - DNA, 22 bp, Homo sapiens
tcaagaagataatgtctagggt

SEQ ID NO: 8182381 - DNA, 22 bp, Homo sapiens
tcaactcacaagaatgagcaag

SEQ ID NO: 8182382 - DNA, 23 bp, Homo sapiens
tcaactgctctgggaaggtcccc

SEQ ID NO: 8182383 - DNA, 22 bp, Homo sapiens
tcaactgcaagtttgcttagtt

SEQ ID NO: 8182384 - DNA, 22 bp, Homo sapiens
tcaactgcaagtttgcttagtt

SEQ ID NO: 8182385 - DNA, 22 bp, Homo sapiens
tcaacgcatgctccaagaaaga

SEQ ID NO: 8182386 - DNA, 22 bp, Homo sapiens
tcaacgtttgttaaatgagtat

SEQ ID NO: 8182387 - DNA, 21 bp, Homo sapiens
tcaacccttgcgtcaccaagc

SEQ ID NO: 8182388 - DNA, 22 bp, Homo sapiens
tcaaccctgttttctttgcaat

SEQ ID NO: 8182389 - DNA, 22 bp, Homo sapiens
tcaacccttgtgcaacagtgat

SEQ ID NO: 8182390 - DNA, 22 bp, Homo sapiens
tcaacccttcctccatatttcc

SEQ ID NO: 8182391 - DNA, 19 bp, Homo sapiens
tcaaccctctttgcctagc

SEQ ID NO: 8182392 - DNA, 22 bp, Homo sapiens
tcaagaaactgtgctacagagt

SEQ ID NO: 8182393 - DNA, 22 bp, Homo sapiens
tcaagaaactgtgctacagagt

SEQ ID NO: 8182394 - DNA, 22 bp, Homo sapiens
tcaagaaactgtgctacagagt

SEQ ID NO: 8182395 - DNA, 22 bp, Homo sapiens
tcaactttagtgtagctattta

SEQ ID NO: 8182396 - DNA, 23 bp, Homo sapiens
tcacatttaacccctcagacctc

SEQ ID NO: 8182397 - DNA, 22 bp, Homo sapiens
tcacatttaaacaggaggatta

SEQ ID NO: 8182398 - DNA, 22 bp, Homo sapiens
tcacatttatttcaaagttact

SEQ ID NO: 8182399 - DNA, 22 bp, Homo sapiens
tcacatttatttcaaagttact

SEQ ID NO: 8182400 - DNA, 22 bp, Homo sapiens
tcacatttatactccatttgca

SEQ ID NO: 8182401 - DNA, 21 bp, Homo sapiens
tcacatgcttattcctggaat

SEQ ID NO: 8182402 - DNA, 21 bp, Homo sapiens
tcacatgcttattcctggaat

SEQ ID NO: 8182403 - DNA, 22 bp, Homo sapiens
tcacatgctgtgggatctgtat

SEQ ID NO: 8182404 - DNA, 22 bp, Homo sapiens
tcacatgctactgagccagacc

SEQ ID NO: 8182405 - DNA, 22 bp, Homo sapiens
tcacatttgataatgcccattg

SEQ ID NO: 8182406 - DNA, 22 bp, Homo sapiens
tcacatttctttatgtagtctt

SEQ ID NO: 8182407 - DNA, 22 bp, Homo sapiens
tcacatttctttatgtagtctt

SEQ ID NO: 8182408 - DNA, 21 bp, Homo sapiens
tcacatttctcatgggtaaat

SEQ ID NO: 8182409 - DNA, 22 bp, Homo sapiens
tcacatttctgattataccaaa

SEQ ID NO: 8182410 - DNA, 21 bp, Homo sapiens
tcacatttctcatgggtaaat

SEQ ID NO: 8182411 - DNA, 22 bp, Homo sapiens
tcacatttctcagcactgatga

SEQ ID NO: 8182412 - DNA, 22 bp, Homo sapiens
tcacatttctcagcactgatga

SEQ ID NO: 8182413 - DNA, 22 bp, Homo sapiens
tcacatttctcagcactgatga

SEQ ID NO: 8182414 - DNA, 22 bp, Homo sapiens
tcacatttcgcatcagtccgat

SEQ ID NO: 8182415 - DNA, 22 bp, Homo sapiens
tcacatttcacatgggaggagg

SEQ ID NO: 8182416 - DNA, 22 bp, Homo sapiens
tcacatttcgcatcagtccgat

SEQ ID NO: 8182417 - DNA, 22 bp, Homo sapiens
tcacatttcaagtgctcaaaag

SEQ ID NO: 8182418 - DNA, 22 bp, Homo sapiens
tcacagttttagctgttaaata

SEQ ID NO: 8182419 - DNA, 23 bp, Homo sapiens
tcacataatccttcatccacagg

SEQ ID NO: 8182420 - DNA, 22 bp, Homo sapiens
tcacagtgtgaaggtcagtcac

SEQ ID NO: 8182421 - DNA, 22 bp, Homo sapiens
tcacagtgtgaaggtcagtcac

SEQ ID NO: 8182422 - DNA, 22 bp, Homo sapiens
tcacagtgtcgtccttgggtgt

SEQ ID NO: 8182423 - DNA, 22 bp, Homo sapiens
tcacagtgtcgtccttgggtgt

SEQ ID NO: 8182424 - DNA, 22 bp, Homo sapiens
tcacagtttcttttctgataaa

SEQ ID NO: 8182425 - DNA, 22 bp, Homo sapiens
tcacagttttagaaaatagata

SEQ ID NO: 8182426 - DNA, 22 bp, Homo sapiens
tcacagtgagccatgtcagaga

SEQ ID NO: 8182427 - DNA, 22 bp, Homo sapiens
tcacagtgaggagttacagttt

SEQ ID NO: 8182428 - DNA, 22 bp, Homo sapiens
tcacagtgataactaagtcctg

SEQ ID NO: 8182429 - DNA, 22 bp, Homo sapiens
tcacagtgaggcagttcttgta

SEQ ID NO: 8182430 - DNA, 22 bp, Homo sapiens
tcacagtgataactaagtcctg

SEQ ID NO: 8182431 - DNA, 22 bp, Homo sapiens
tcacagtgatgacgtgggagca

SEQ ID NO: 8182432 - DNA, 22 bp, Homo sapiens
tcacagtgcacagcaggcgtgg

SEQ ID NO: 8182433 - DNA, 22 bp, Homo sapiens
tcacagtgctctgggtggcaga

SEQ ID NO: 8182434 - DNA, 22 bp, Homo sapiens
tcacagtgggacttttatcgct

SEQ ID NO: 8182435 - DNA, 22 bp, Homo sapiens
tcacagtggagccaccaaggta

SEQ ID NO: 8182436 - DNA, 22 bp, Homo sapiens
tcacagtgcacccctcacaggg

SEQ ID NO: 8182437 - DNA, 22 bp, Homo sapiens
tcacagtgcacccctcacaggg

SEQ ID NO: 8182438 - DNA, 19 bp, Homo sapiens
tcacagtgcagaaccctcc

SEQ ID NO: 8182439 - DNA, 19 bp, Homo sapiens
tcacagtgcagaaccctcc

SEQ ID NO: 8182440 - DNA, 22 bp, Homo sapiens
tcacagtgctctgggtggcaga

SEQ ID NO: 8182441 - DNA, 22 bp, Homo sapiens
tcacagtgcaggatcagttaat

SEQ ID NO: 8182442 - DNA, 22 bp, Homo sapiens
tcatagaaatggaaagtatatt

SEQ ID NO: 8182443 - DNA, 22 bp, Homo sapiens
tcatagaatgagttaatgaact

SEQ ID NO: 8182444 - DNA, 22 bp, Homo sapiens
tcatctgaaattgtatatgtag

SEQ ID NO: 8182445 - DNA, 22 bp, Homo sapiens
tcatctgaccactttatctctc

SEQ ID NO: 8182446 - DNA, 22 bp, Homo sapiens
tcataaatgcagtgtcataaat

SEQ ID NO: 8182447 - DNA, 22 bp, Homo sapiens
tcataaatgcagtgtcataaat

SEQ ID NO: 8182448 - DNA, 22 bp, Homo sapiens
tcataaatgcagtgtcataaat

SEQ ID NO: 8182449 - DNA, 22 bp, Homo sapiens
tcataaattagctgtctttgaa

SEQ ID NO: 8182450 - DNA, 22 bp, Homo sapiens
tcataaattgattatgtgcttt

SEQ ID NO: 8182451 - DNA, 22 bp, Homo sapiens
tcataaattgattatgtgcttt

SEQ ID NO: 8182452 - DNA, 22 bp, Homo sapiens
tcataaattgattatgtgcttt

SEQ ID NO: 8182453 - DNA, 22 bp, Homo sapiens
tcataaattgattatgtgcttt

SEQ ID NO: 8182454 - DNA, 22 bp, Homo sapiens
tcataaattatctatttggcta

SEQ ID NO: 8182455 - DNA, 22 bp, Homo sapiens
tcataaattctggtgctgtgag

SEQ ID NO: 8182456 - DNA, 22 bp, Homo sapiens
tcatacatcttgtatatctatc

SEQ ID NO: 8182457 - DNA, 22 bp, Homo sapiens
tcatacattcagcagatatttg

SEQ ID NO: 8182458 - DNA, 22 bp, Homo sapiens
tcataaattgggttggctgggt

SEQ ID NO: 8182459 - DNA, 22 bp, Homo sapiens
tcatgaaaatagatcagaaatt

SEQ ID NO: 8182460 - DNA, 22 bp, Homo sapiens
tcatgcagagccagtcaggata

SEQ ID NO: 8182461 - DNA, 22 bp, Homo sapiens
tcatctttcctcaaaagatcca

SEQ ID NO: 8182462 - DNA, 22 bp, Homo sapiens
tcatgaaaatagatcagaaatt

SEQ ID NO: 8182463 - DNA, 22 bp, Homo sapiens
tcatgaaaaattttccatgtca

SEQ ID NO: 8182464 - DNA, 22 bp, Homo sapiens
tcatgaaaaattttccatgtca

SEQ ID NO: 8182465 - DNA, 22 bp, Homo sapiens
tcatctttaccccttgcttcaa

SEQ ID NO: 8182466 - DNA, 22 bp, Homo sapiens
tcatctttaccccttgcttcaa

SEQ ID NO: 8182467 - DNA, 22 bp, Homo sapiens
tcatctgtcatccacaaagctg

SEQ ID NO: 8182468 - DNA, 21 bp, Homo sapiens
tcatctggtctggggcctgct

SEQ ID NO: 8182469 - DNA, 22 bp, Homo sapiens
tcatctgggagcttgttagaaa

SEQ ID NO: 8182470 - DNA, 22 bp, Homo sapiens
tcatctgaccccatctattctc

SEQ ID NO: 8182471 - DNA, 22 bp, Homo sapiens
tcatctgaggtttgaggcagtt

SEQ ID NO: 8182472 - DNA, 22 bp, Homo sapiens
tcatctgaggtttgaggcagtt

SEQ ID NO: 8182473 - DNA, 22 bp, Homo sapiens
tcatctgaggcaccagagcata

SEQ ID NO: 8182474 - DNA, 23 bp, Homo sapiens
tcatcttcctcatttctccaggg

SEQ ID NO: 8182475 - DNA, 22 bp, Homo sapiens
tcatcttcctcatttctccagg

SEQ ID NO: 8182476 - DNA, 22 bp, Homo sapiens
tcatcttcctcatttctccagg

SEQ ID NO: 8182477 - DNA, 23 bp, Homo sapiens
tcatcttcctcatttctccaggg

SEQ ID NO: 8182478 - DNA, 23 bp, Homo sapiens
tcatcttcctcatttctccaggg

SEQ ID NO: 8182479 - DNA, 22 bp, Homo sapiens
tcatcttgctgccattgcttta

SEQ ID NO: 8182480 - DNA, 22 bp, Homo sapiens
tcatctgttcatacacatgcgt

SEQ ID NO: 8182481 - DNA, 22 bp, Homo sapiens
tcagtgttcttatttaattagg

SEQ ID NO: 8182482 - DNA, 22 bp, Homo sapiens
tcagtgttctggatttggggca

SEQ ID NO: 8182483 - DNA, 22 bp, Homo sapiens
tcagtctcatcaactctattcc

SEQ ID NO: 8182484 - DNA, 22 bp, Homo sapiens
tcagtgttggcattcagaaatg

SEQ ID NO: 8182485 - DNA, 22 bp, Homo sapiens
tcagtgttggagataattgcac

SEQ ID NO: 8182486 - DNA, 22 bp, Homo sapiens
tcagtgttgaattttttgcaaa

SEQ ID NO: 8182487 - DNA, 22 bp, Homo sapiens
tcagtgtttattcaatgttatt

SEQ ID NO: 8182488 - DNA, 22 bp, Homo sapiens
tcagtgtttaccgtatgttgtt

SEQ ID NO: 8182489 - DNA, 22 bp, Homo sapiens
tcagtgtttcagtttggaaatg

SEQ ID NO: 8182490 - DNA, 22 bp, Homo sapiens
tcagtgtttattgcggtgtgta

SEQ ID NO: 8182491 - DNA, 22 bp, Homo sapiens
tcagtgttggtcaagaatcagt

SEQ ID NO: 8182492 - DNA, 22 bp, Homo sapiens
tcagtgttggctacatctgcct

SEQ ID NO: 8182493 - DNA, 22 bp, Homo sapiens
tcagtgtttacatgcatccttg

SEQ ID NO: 8182494 - DNA, 22 bp, Homo sapiens
tcagtgttggtcaagaatcagt

SEQ ID NO: 8182495 - DNA, 22 bp, Homo sapiens
tcagtgttgtgcacatacaaaa

SEQ ID NO: 8182496 - DNA, 22 bp, Homo sapiens
tcagtatctactatcttgatga

SEQ ID NO: 8182497 - DNA, 22 bp, Homo sapiens
tcagtattcctggaaatacaag

SEQ ID NO: 8182498 - DNA, 22 bp, Homo sapiens
tcagtcctacacgctcagggac

SEQ ID NO: 8182499 - DNA, 22 bp, Homo sapiens
tcagtcctacacgctcagggac

SEQ ID NO: 8182500 - DNA, 18 bp, Homo sapiens
tcagtcctccatagagct

SEQ ID NO: 8182501 - DNA, 18 bp, Homo sapiens
tcagtcctccatagagct

SEQ ID NO: 8182502 - DNA, 22 bp, Homo sapiens
tcagtcctcctctcatagagag

SEQ ID NO: 8182503 - DNA, 22 bp, Homo sapiens
tcagtcctcctctcatagagag

SEQ ID NO: 8182504 - DNA, 22 bp, Homo sapiens
tcagtcctccacacaggcaccc

SEQ ID NO: 8182505 - DNA, 22 bp, Homo sapiens
tcagtcctccacacaggcaccc

SEQ ID NO: 8182506 - DNA, 22 bp, Homo sapiens
tcagtcctccacacaggcaccc

SEQ ID NO: 8182507 - DNA, 19 bp, Homo sapiens
tcagtctaggaatgagcta

SEQ ID NO: 8182508 - DNA, 22 bp, Homo sapiens
tcagtcgtgtagaagttgatcc

SEQ ID NO: 8182509 - DNA, 22 bp, Homo sapiens
tcagtcctgggccggcatcctc

SEQ ID NO: 8182510 - DNA, 22 bp, Homo sapiens
tcagtcctgatgacaggcccaa

SEQ ID NO: 8182511 - DNA, 22 bp, Homo sapiens
tcagtcctgggccggcatcctc

SEQ ID NO: 8182512 - DNA, 23 bp, Homo sapiens
tcataaatattagcacagtagga

SEQ ID NO: 8182513 - DNA, 23 bp, Homo sapiens
tcataaatattagcacagtagga

SEQ ID NO: 8182514 - DNA, 23 bp, Homo sapiens
tcataaatattagcacagtagga

SEQ ID NO: 8182515 - DNA, 22 bp, Homo sapiens
tcataaatatttgtgggggctt

SEQ ID NO: 8182516 - DNA, 22 bp, Homo sapiens
tcataaatcatactccatttgc

SEQ ID NO: 8182517 - DNA, 22 bp, Homo sapiens
tcataaatcatactccatttgc

SEQ ID NO: 8182518 - DNA, 22 bp, Homo sapiens
tcataaatcatactccatttgc

SEQ ID NO: 8182519 - DNA, 22 bp, Homo sapiens
tcataaagttatcaccaaatcc

SEQ ID NO: 8182520 - DNA, 22 bp, Homo sapiens
tcataaagttatcaccaaatcc

SEQ ID NO: 8182521 - DNA, 22 bp, Homo sapiens
tcataaagttacccaaatttta

SEQ ID NO: 8182522 - DNA, 22 bp, Homo sapiens
tcataaagcttgcctgcagtgt

SEQ ID NO: 8182523 - DNA, 22 bp, Homo sapiens
tcagttaatggattctgtcaga

SEQ ID NO: 8182524 - DNA, 22 bp, Homo sapiens
tcagtgtttcctagagcatata

SEQ ID NO: 8182525 - DNA, 22 bp, Homo sapiens
tcagtgtttcctgtggtacagc

SEQ ID NO: 8182526 - DNA, 22 bp, Homo sapiens
tcagtgtttggtttcagaattg

SEQ ID NO: 8182527 - DNA, 22 bp, Homo sapiens
tcagtgtttgaacccagggtta

SEQ ID NO: 8182528 - DNA, 22 bp, Homo sapiens
tcagtgttttaactgtctttta

SEQ ID NO: 8182529 - DNA, 22 bp, Homo sapiens
tcagtgtttgtggcaaatgtta

SEQ ID NO: 8182530 - DNA, 22 bp, Homo sapiens
tcagtgttttccagggtctact

SEQ ID NO: 8182531 - DNA, 22 bp, Homo sapiens
tcagtgttttaactgtctttta

SEQ ID NO: 8182532 - DNA, 22 bp, Homo sapiens
tcagtgtttttaaagcaatata

SEQ ID NO: 8182533 - DNA, 22 bp, Homo sapiens
tcagtaaatgagcaaaaatttc

SEQ ID NO: 8182534 - DNA, 22 bp, Homo sapiens
tcagtaaatgagcaaaaatttc

SEQ ID NO: 8182535 - DNA, 22 bp, Homo sapiens
tcagtaaatgcctttctgtgaa

SEQ ID NO: 8182536 - DNA, 19 bp, Homo sapiens
tcagtaacttttaagagga

SEQ ID NO: 8182537 - DNA, 22 bp, Homo sapiens
tcagtaaatggttgctgttatt

SEQ ID NO: 8182538 - DNA, 22 bp, Homo sapiens
tcagtaaatgaatgaatatatg

SEQ ID NO: 8182539 - DNA, 22 bp, Homo sapiens
tcagtatccacaaatgctcaaa

SEQ ID NO: 8182540 - DNA, 22 bp, Homo sapiens
tcagtacaaaggtgctctcaag

SEQ ID NO: 8182541 - DNA, 22 bp, Homo sapiens
tcagtaatattctttaaaatac

SEQ ID NO: 8182542 - DNA, 22 bp, Homo sapiens
tcagtacacttcagtatttgtg

SEQ ID NO: 8182543 - DNA, 23 bp, Homo sapiens
tcagtaccacagctgcatgacct

SEQ ID NO: 8182544 - DNA, 22 bp, Homo sapiens
tcagtagcagaaagcaatgagt

SEQ ID NO: 8182545 - DNA, 22 bp, Homo sapiens
tcagtagcagaaagcaatgagt

SEQ ID NO: 8182546 - DNA, 22 bp, Homo sapiens
tcagggctccggaagtggcctc

SEQ ID NO: 8182547 - DNA, 22 bp, Homo sapiens
tcagggctcagtgggataggtc

SEQ ID NO: 8182548 - DNA, 22 bp, Homo sapiens
tcagggctcagcatctggcatt

SEQ ID NO: 8182549 - DNA, 22 bp, Homo sapiens
tcagggctcagcatctggcatt

SEQ ID NO: 8182550 - DNA, 22 bp, Homo sapiens
tcagggctgcagaagaggcagg

SEQ ID NO: 8182551 - DNA, 22 bp, Homo sapiens
tcagggctgcagaagaggcagg

SEQ ID NO: 8182552 - DNA, 22 bp, Homo sapiens
tcagggctgcagaagaggcagg

SEQ ID NO: 8182553 - DNA, 22 bp, Homo sapiens
tcagggctgcagaagaggcagg

SEQ ID NO: 8182554 - DNA, 22 bp, Homo sapiens
tcagggctgcatacaggagata

SEQ ID NO: 8182555 - DNA, 22 bp, Homo sapiens
tcagggctgcatacaggagata

SEQ ID NO: 8182556 - DNA, 22 bp, Homo sapiens
tcagggctgcatacaggagata

SEQ ID NO: 8182557 - DNA, 22 bp, Homo sapiens
tcagggctgccgggcagaccgt

SEQ ID NO: 8182558 - DNA, 22 bp, Homo sapiens
tcagggcatggctgcacttggc

SEQ ID NO: 8182559 - DNA, 22 bp, Homo sapiens
tcagggccctggacaaccctcc

SEQ ID NO: 8182560 - DNA, 22 bp, Homo sapiens
tcagggcatctcttaagtggtg

SEQ ID NO: 8182561 - DNA, 19 bp, Homo sapiens
tcagggccgcagagggtac

SEQ ID NO: 8182562 - DNA, 22 bp, Homo sapiens
tcagggccggggctgtggcgag

SEQ ID NO: 8182563 - DNA, 22 bp, Homo sapiens
tcagggcatactcttcaaggtc

SEQ ID NO: 8182564 - DNA, 21 bp, Homo sapiens
tcagggcagtgggaggttcct

SEQ ID NO: 8182565 - DNA, 22 bp, Homo sapiens
tcagggcatactcttcaaggtc

SEQ ID NO: 8182566 - DNA, 22 bp, Homo sapiens
tcagggcatcatcatgaatata

SEQ ID NO: 8182567 - DNA, 22 bp, Homo sapiens
tcagggcatactcttcaaggtc

SEQ ID NO: 8182568 - DNA, 22 bp, Homo sapiens
tcagggcatccattgcctgttg

SEQ ID NO: 8182569 - DNA, 22 bp, Homo sapiens
tcagggcatctcttaagtggtg

SEQ ID NO: 8182570 - DNA, 22 bp, Homo sapiens
tcagggcatcatcatgaatata

SEQ ID NO: 8182571 - DNA, 22 bp, Homo sapiens
tcagggcatccattgcctgttg

SEQ ID NO: 8182572 - DNA, 22 bp, Homo sapiens
tcagggcatcatcatgaatata

SEQ ID NO: 8182573 - DNA, 22 bp, Homo sapiens
tcaggagagagttgggtaggct

SEQ ID NO: 8182574 - DNA, 22 bp, Homo sapiens
tcaggagagaaagaatacaatt

SEQ ID NO: 8182575 - DNA, 22 bp, Homo sapiens
tcaggagagagaaattggggct

SEQ ID NO: 8182576 - DNA, 22 bp, Homo sapiens
tcaggagagaaagaatacaatt

SEQ ID NO: 8182577 - DNA, 22 bp, Homo sapiens
tcaggagagaaagaatacaatt

SEQ ID NO: 8182578 - DNA, 22 bp, Homo sapiens
tcaggagacttatgtcacagtg

SEQ ID NO: 8182579 - DNA, 21 bp, Homo sapiens
tcaggagagcccatctacaaa

SEQ ID NO: 8182580 - DNA, 21 bp, Homo sapiens
tcaggagagcccatctacaaa

SEQ ID NO: 8182581 - DNA, 21 bp, Homo sapiens
tcaggagagcccatctacaaa

SEQ ID NO: 8182582 - DNA, 21 bp, Homo sapiens
tcaggagagcccatctacaaa

SEQ ID NO: 8182583 - DNA, 17 bp, Homo sapiens
tcaggctgggtgcagtg

SEQ ID NO: 8182584 - DNA, 17 bp, Homo sapiens
tcaggctgggtgcagtg

SEQ ID NO: 8182585 - DNA, 17 bp, Homo sapiens
tcaggctgggtgcagtg

SEQ ID NO: 8182586 - DNA, 17 bp, Homo sapiens
tcaggctgggtgcagtg

SEQ ID NO: 8182587 - DNA, 22 bp, Homo sapiens
tcaggctggtggtcagatggct

SEQ ID NO: 8182588 - DNA, 22 bp, Homo sapiens
tcaggctggtggtcagatggct

SEQ ID NO: 8182589 - DNA, 22 bp, Homo sapiens
tcaggctggtggtcagatggct

SEQ ID NO: 8182590 - DNA, 22 bp, Homo sapiens
tcaggctggtggtcagatggct

SEQ ID NO: 8182591 - DNA, 22 bp, Homo sapiens
tcaggctgtaaatggtgtgggt

SEQ ID NO: 8182592 - DNA, 22 bp, Homo sapiens
tcaggctgtaaatggtgtgggt

SEQ ID NO: 8182593 - DNA, 22 bp, Homo sapiens
tcaggctgtagggcccctggag

SEQ ID NO: 8182594 - DNA, 22 bp, Homo sapiens
tcaggctgtagggcccctggag

SEQ ID NO: 8182595 - DNA, 22 bp, Homo sapiens
tcaggctgtaaatggtgtgggt

SEQ ID NO: 8182596 - DNA, 22 bp, Homo sapiens
tcaggctgtaaatggtgtgggt

SEQ ID NO: 8182597 - DNA, 22 bp, Homo sapiens
tcaggctggtccccacagtgga

SEQ ID NO: 8182598 - DNA, 22 bp, Homo sapiens
tcaggctggtccccacagtgga

SEQ ID NO: 8182599 - DNA, 22 bp, Homo sapiens
tcaggctggtccccacagtgga

SEQ ID NO: 8182600 - DNA, 22 bp, Homo sapiens
tcaggctggtccccacagtgga

SEQ ID NO: 8182601 - DNA, 20 bp, Homo sapiens
tcaggctggtgggctttccc

SEQ ID NO: 8182602 - DNA, 22 bp, Homo sapiens
tcaggctggtccccacagtgga

SEQ ID NO: 8182603 - DNA, 20 bp, Homo sapiens
tcaggctggtgggctttccc

SEQ ID NO: 8182604 - DNA, 20 bp, Homo sapiens
tcaggctggtgggctttccc

SEQ ID NO: 8182605 - DNA, 22 bp, Homo sapiens
tcaggctgttcctgtccaaaat

SEQ ID NO: 8182606 - DNA, 22 bp, Homo sapiens
tcaggctgttcctgtccaaaat

SEQ ID NO: 8182607 - DNA, 22 bp, Homo sapiens
tcaggctgtagggcccctggag

SEQ ID NO: 8182608 - DNA, 22 bp, Homo sapiens
tcaggctgtatatcttgcactc

SEQ ID NO: 8182609 - DNA, 22 bp, Homo sapiens
tcaggctgtatatcttgcactc

SEQ ID NO: 8182610 - DNA, 22 bp, Homo sapiens
tcaggctgtatatcttgcactc

SEQ ID NO: 8182611 - DNA, 22 bp, Homo sapiens
tcaggctgtatatcttgcactc

SEQ ID NO: 8182612 - DNA, 22 bp, Homo sapiens
tcaggctgttagccacctcctc

SEQ ID NO: 8182613 - DNA, 22 bp, Homo sapiens
tcaggctgttagccacctcctc

SEQ ID NO: 8182614 - DNA, 22 bp, Homo sapiens
tcaggcttccaggctctgctga

SEQ ID NO: 8182615 - DNA, 22 bp, Homo sapiens
tcaggcttccaggctctgctga

SEQ ID NO: 8182616 - DNA, 22 bp, Homo sapiens
tcaggcttcttctgagcaggga

SEQ ID NO: 8182617 - DNA, 22 bp, Homo sapiens
tcaggcttgaggtctgtatgtg

SEQ ID NO: 8182618 - DNA, 22 bp, Homo sapiens
tcaggcttgcgatggaagtcac

SEQ ID NO: 8182619 - DNA, 22 bp, Homo sapiens
tcaggcttgcgatggaagtcac

SEQ ID NO: 8182620 - DNA, 22 bp, Homo sapiens
tcaggcttgaggtctgtatgtg

SEQ ID NO: 8182621 - DNA, 22 bp, Homo sapiens
tcaggcttcttctgagcaggga

SEQ ID NO: 8182622 - DNA, 22 bp, Homo sapiens
tcaggcttgtctctagagcaat

SEQ ID NO: 8182623 - DNA, 22 bp, Homo sapiens
tcaggcttggtgctccagtgcc

SEQ ID NO: 8182624 - DNA, 22 bp, Homo sapiens
tcaggcttggtgctccagtgcc

SEQ ID NO: 8182625 - DNA, 22 bp, Homo sapiens
tcaggcttgggaggcccagggc

SEQ ID NO: 8182626 - DNA, 22 bp, Homo sapiens
tcaggcttgggaggcccagggc

SEQ ID NO: 8182627 - DNA, 22 bp, Homo sapiens
tcaggcttgggaggcccagggc

SEQ ID NO: 8182628 - DNA, 22 bp, Homo sapiens
tcaggctttccgaagcgcgcgg

SEQ ID NO: 8182629 - DNA, 22 bp, Homo sapiens
tcaggcttgtctctagagcaat

SEQ ID NO: 8182630 - DNA, 22 bp, Homo sapiens
tcaggcttgtctctagagcaat

SEQ ID NO: 8182631 - DNA, 22 bp, Homo sapiens
tcaggctttgaagtctagctgg

SEQ ID NO: 8182632 - DNA, 18 bp, Homo sapiens
tcaggctttgagagaatc

SEQ ID NO: 8182633 - DNA, 22 bp, Homo sapiens
tcagggcaggacagtgtaggcc

SEQ ID NO: 8182634 - DNA, 21 bp, Homo sapiens
tcagggcagctgctcttcaga

SEQ ID NO: 8182635 - DNA, 22 bp, Homo sapiens
tcagggcaggacagtgtaggcc

SEQ ID NO: 8182636 - DNA, 22 bp, Homo sapiens
tcagggcaggcgagcagctgct

SEQ ID NO: 8182637 - DNA, 22 bp, Homo sapiens
tcaggcttttcctgcctcctac

SEQ ID NO: 8182638 - DNA, 22 bp, Homo sapiens
tcaggcttttcctgcctcctac

SEQ ID NO: 8182639 - DNA, 22 bp, Homo sapiens
tcaggcttttcttccctcagtg

SEQ ID NO: 8182640 - DNA, 18 bp, Homo sapiens
tcaggctttgagagaatc

SEQ ID NO: 8182641 - DNA, 22 bp, Homo sapiens
tcaggctttgggaatgccactt

SEQ ID NO: 8182642 - DNA, 22 bp, Homo sapiens
tcaggctttgggtcaggctctg

SEQ ID NO: 8182643 - DNA, 22 bp, Homo sapiens
tcaggctttgggtcaggctctg

SEQ ID NO: 8182644 - DNA, 22 bp, Homo sapiens
tcaggctttgggaatgccactt

SEQ ID NO: 8182645 - DNA, 22 bp, Homo sapiens
tcagggcaggttaacttgggtg

SEQ ID NO: 8182646 - DNA, 22 bp, Homo sapiens
tcagggcaggcgagcagctgct

SEQ ID NO: 8182647 - DNA, 22 bp, Homo sapiens
tcagggcaggcgagcagctgct

SEQ ID NO: 8182648 - DNA, 21 bp, Homo sapiens
tcagggcagtgggaggttcct

SEQ ID NO: 8182649 - DNA, 19 bp, Homo sapiens
tcagggcagtccggtcccc

SEQ ID NO: 8182650 - DNA, 22 bp, Homo sapiens
tcagggcaggttaacttgggtg

SEQ ID NO: 8182651 - DNA, 19 bp, Homo sapiens
tcagggcagtccggtcccc

SEQ ID NO: 8182652 - DNA, 18 bp, Homo sapiens
tccaaaatcatgtatttt

SEQ ID NO: 8182653 - DNA, 22 bp, Homo sapiens
tccaaacaccctccatgctgca

SEQ ID NO: 8182654 - DNA, 22 bp, Homo sapiens
tccaaagaacctggctactgtc

SEQ ID NO: 8182655 - DNA, 22 bp, Homo sapiens
tccaaagaacctggctactgtc

SEQ ID NO: 8182656 - DNA, 22 bp, Homo sapiens
tccaaagaacctggctactgtc

SEQ ID NO: 8182657 - DNA, 22 bp, Homo sapiens
tccaaagaacattgctgagacc

SEQ ID NO: 8182658 - DNA, 22 bp, Homo sapiens
tccaaagaatagaggtgacatt

SEQ ID NO: 8182659 - DNA, 22 bp, Homo sapiens
tccaaagacttgctgtatgtaa

SEQ ID NO: 8182660 - DNA, 22 bp, Homo sapiens
tccaaagagcttaggagagaaa

SEQ ID NO: 8182661 - DNA, 22 bp, Homo sapiens
tccaaagagcttaggagagaaa

SEQ ID NO: 8182662 - DNA, 22 bp, Homo sapiens
tccaaagcatctgagtgtgcat

SEQ ID NO: 8182663 - DNA, 22 bp, Homo sapiens
tccaaagcatctgagtgtgcat

SEQ ID NO: 8182664 - DNA, 22 bp, Homo sapiens
tccaaagccgactgacatctga

SEQ ID NO: 8182665 - DNA, 22 bp, Homo sapiens
tccaaatataggatgtgatata

SEQ ID NO: 8182666 - DNA, 22 bp, Homo sapiens
tccaaatataggatgtgatata

SEQ ID NO: 8182667 - DNA, 22 bp, Homo sapiens
tccaaatatagatgagttgtaa

SEQ ID NO: 8182668 - DNA, 22 bp, Homo sapiens
tccaaatatagatgagttgtaa

SEQ ID NO: 8182669 - DNA, 22 bp, Homo sapiens
tccaaatatacagaatctcctc

SEQ ID NO: 8182670 - DNA, 22 bp, Homo sapiens
tccaaatatacagaatctcctc

SEQ ID NO: 8182671 - DNA, 22 bp, Homo sapiens
tccaaatagttctggaagactg

SEQ ID NO: 8182672 - DNA, 23 bp, Homo sapiens
tccaaatacctgtcaccttgtct

SEQ ID NO: 8182673 - DNA, 23 bp, Homo sapiens
tccaaatacctgtcaccttgtct

SEQ ID NO: 8182674 - DNA, 22 bp, Homo sapiens
tccaaatagctggatgatggtg

SEQ ID NO: 8182675 - DNA, 22 bp, Homo sapiens
tccaaataccagatgggctaat

SEQ ID NO: 8182676 - DNA, 22 bp, Homo sapiens
tccaaatacatttactgtattt

SEQ ID NO: 8182677 - DNA, 22 bp, Homo sapiens
tccaaaggaagaggctgtcagt

SEQ ID NO: 8182678 - DNA, 22 bp, Homo sapiens
tccaaaggacatttctgcttct

SEQ ID NO: 8182679 - DNA, 22 bp, Homo sapiens
tccaaatacatttactgtattt

SEQ ID NO: 8182680 - DNA, 22 bp, Homo sapiens
tcatttgtctggcacagggaat

SEQ ID NO: 8182681 - DNA, 22 bp, Homo sapiens
tcatttgtgcaatgtagatgaa

SEQ ID NO: 8182682 - DNA, 22 bp, Homo sapiens
tcatttttagcgcgcaaaagtt

SEQ ID NO: 8182683 - DNA, 22 bp, Homo sapiens
tcatttttagcgcgcaaaagtt

SEQ ID NO: 8182684 - DNA, 22 bp, Homo sapiens
tcatttttagcgcgcaaaagtt

SEQ ID NO: 8182685 - DNA, 22 bp, Homo sapiens
tcatttgttcatctgctcttct

SEQ ID NO: 8182686 - DNA, 21 bp, Homo sapiens
tcatttttattgctaccttgc

SEQ ID NO: 8182687 - DNA, 21 bp, Homo sapiens
tcatttttattgctaccttgc

SEQ ID NO: 8182688 - DNA, 22 bp, Homo sapiens
tcatttttttccggtaggaata

SEQ ID NO: 8182689 - DNA, 22 bp, Homo sapiens
tcatttttttccggtaggaata

SEQ ID NO: 8182690 - DNA, 22 bp, Homo sapiens
tccaaaacagaactctgtgaat

SEQ ID NO: 8182691 - DNA, 22 bp, Homo sapiens
tcatttttctcttacacgtaga

SEQ ID NO: 8182692 - DNA, 22 bp, Homo sapiens
tcatttttgaccatgggtagga

SEQ ID NO: 8182693 - DNA, 22 bp, Homo sapiens
tcatttttgtctccggtttgtg

SEQ ID NO: 8182694 - DNA, 21 bp, Homo sapiens
tccaacatgcctgatggtgcc

SEQ ID NO: 8182695 - DNA, 22 bp, Homo sapiens
tccaaattctatgttctttcca

SEQ ID NO: 8182696 - DNA, 22 bp, Homo sapiens
tccaaattgacagtagtgatta

SEQ ID NO: 8182697 - DNA, 22 bp, Homo sapiens
tccaagaagctcagcaaacatc

SEQ ID NO: 8182698 - DNA, 22 bp, Homo sapiens
tccaagaagagcctttctcctc

SEQ ID NO: 8182699 - DNA, 22 bp, Homo sapiens
tccaactttctcctccggcttg

SEQ ID NO: 8182700 - DNA, 22 bp, Homo sapiens
tccaaatatcttggtggttagg

SEQ ID NO: 8182701 - DNA, 22 bp, Homo sapiens
tccaaatatattcacgtcctag

SEQ ID NO: 8182702 - DNA, 22 bp, Homo sapiens
tccaaatattatgattatagga

SEQ ID NO: 8182703 - DNA, 22 bp, Homo sapiens
tccaaatattatgattatagga

SEQ ID NO: 8182704 - DNA, 22 bp, Homo sapiens
tccaaatattcatctacttctg

SEQ ID NO: 8182705 - DNA, 22 bp, Homo sapiens
tccaaatattcggtctttctga

SEQ ID NO: 8182706 - DNA, 22 bp, Homo sapiens
tccaagaagcttacaatctaat

SEQ ID NO: 8182707 - DNA, 22 bp, Homo sapiens
tccaagaagcttacaatctaat

SEQ ID NO: 8182708 - DNA, 22 bp, Homo sapiens
tccaagaagctcagcaaacatc

SEQ ID NO: 8182709 - DNA, 21 bp, Homo sapiens
tccaagctcaactcccttcct

SEQ ID NO: 8182710 - DNA, 22 bp, Homo sapiens
tccaagctttccatgccctcac

SEQ ID NO: 8182711 - DNA, 22 bp, Homo sapiens
tccaagcttgctttagccacag

SEQ ID NO: 8182712 - DNA, 22 bp, Homo sapiens
tccaaggaagtcatttaaactg

SEQ ID NO: 8182713 - DNA, 22 bp, Homo sapiens
tccaaggactaaattctagatt

SEQ ID NO: 8182714 - DNA, 22 bp, Homo sapiens
tccaaggacattgttctagttg

SEQ ID NO: 8182715 - DNA, 22 bp, Homo sapiens
tccaaggaagtttgcactattg

SEQ ID NO: 8182716 - DNA, 22 bp, Homo sapiens
tccaaggaggctttgacgtcca

SEQ ID NO: 8182717 - DNA, 22 bp, Homo sapiens
tccaaggaggagctggagattg

SEQ ID NO: 8182718 - DNA, 22 bp, Homo sapiens
tccaaggagcagatccagagga

SEQ ID NO: 8182719 - DNA, 22 bp, Homo sapiens
tccaaggagtcttaagttacat

SEQ ID NO: 8182720 - DNA, 23 bp, Homo sapiens
tccaattcaattgggtcaggaag

SEQ ID NO: 8182721 - DNA, 20 bp, Homo sapiens
tccaattaaaaattgtatgc

SEQ ID NO: 8182722 - DNA, 20 bp, Homo sapiens
tccaattaaaaattgtatgc

SEQ ID NO: 8182723 - DNA, 22 bp, Homo sapiens
tccaataaaactcttgaattaa

SEQ ID NO: 8182724 - DNA, 20 bp, Homo sapiens
tccaagttataaagtgccaa

SEQ ID NO: 8182725 - DNA, 22 bp, Homo sapiens
tccaataaagagaggaatgtct

SEQ ID NO: 8182726 - DNA, 22 bp, Homo sapiens
tccaataacatctaaaaactta

SEQ ID NO: 8182727 - DNA, 22 bp, Homo sapiens
tccaataaccacaatcagatag

SEQ ID NO: 8182728 - DNA, 22 bp, Homo sapiens
tccaagggttcatgtgcattca

SEQ ID NO: 8182729 - DNA, 21 bp, Homo sapiens
tccaagtctggggcatgtgtg

SEQ ID NO: 8182730 - DNA, 22 bp, Homo sapiens
tccaagggctttggcgtgaagt

SEQ ID NO: 8182731 - DNA, 22 bp, Homo sapiens
tccaagggctttggcgtgaagt

SEQ ID NO: 8182732 - DNA, 22 bp, Homo sapiens
tccaagggctcatggacacttt

SEQ ID NO: 8182733 - DNA, 23 bp, Homo sapiens
tccaagggctacaaacacagacc

SEQ ID NO: 8182734 - DNA, 22 bp, Homo sapiens
tccaagggcagccatagaactt

SEQ ID NO: 8182735 - DNA, 22 bp, Homo sapiens
tccaagggcaacaatggaacac

SEQ ID NO: 8182736 - DNA, 22 bp, Homo sapiens
tccaagggcagcagccatagcc

SEQ ID NO: 8182737 - DNA, 22 bp, Homo sapiens
tccaagggaatgtgggcaatgc

SEQ ID NO: 8182738 - DNA, 22 bp, Homo sapiens
tccaagggaatgtgggcaatgc

SEQ ID NO: 8182739 - DNA, 22 bp, Homo sapiens
tcattgtttctgcttttcatga

SEQ ID NO: 8182740 - DNA, 22 bp, Homo sapiens
tcattgttttgattccttcatg

SEQ ID NO: 8182741 - DNA, 22 bp, Homo sapiens
tcatttaataatttttgagtag

SEQ ID NO: 8182742 - DNA, 22 bp, Homo sapiens
tcattgttgacataccaagagc

SEQ ID NO: 8182743 - DNA, 21 bp, Homo sapiens
tcattgttgcatggtaggggg

SEQ ID NO: 8182744 - DNA, 19 bp, Homo sapiens
tcattgttggtttgtcggg

SEQ ID NO: 8182745 - DNA, 19 bp, Homo sapiens
tcattgttggtttgtcggg

SEQ ID NO: 8182746 - DNA, 22 bp, Homo sapiens
tcattgttgcgttaatgtcttc

SEQ ID NO: 8182747 - DNA, 22 bp, Homo sapiens
tcatttacaggtgaagcaacta

SEQ ID NO: 8182748 - DNA, 22 bp, Homo sapiens
tcatttacaggtgaagcaacta

SEQ ID NO: 8182749 - DNA, 22 bp, Homo sapiens
tcatttaataatttttgagtag

SEQ ID NO: 8182750 - DNA, 22 bp, Homo sapiens
tcatttataaggatgcaattaa

SEQ ID NO: 8182751 - DNA, 22 bp, Homo sapiens
tcatttataaggatgcaattaa

SEQ ID NO: 8182752 - DNA, 22 bp, Homo sapiens
tcatttataaggatgcaattaa

SEQ ID NO: 8182753 - DNA, 22 bp, Homo sapiens
tcatttataaggatgcaattaa

SEQ ID NO: 8182754 - DNA, 22 bp, Homo sapiens
tcatttataaggatgcaattaa

SEQ ID NO: 8182755 - DNA, 22 bp, Homo sapiens
tcatttataaggatgcaattaa

SEQ ID NO: 8182756 - DNA, 22 bp, Homo sapiens
tcatttatagaagtgggcagta

SEQ ID NO: 8182757 - DNA, 22 bp, Homo sapiens
tcatttatagaagtgggcagta

SEQ ID NO: 8182758 - DNA, 22 bp, Homo sapiens
tcatttatagctaaccttgaat

SEQ ID NO: 8182759 - DNA, 22 bp, Homo sapiens
tcatttatattgtattctgtag

SEQ ID NO: 8182760 - DNA, 22 bp, Homo sapiens
tcatttatagctaaccttgaat

SEQ ID NO: 8182761 - DNA, 22 bp, Homo sapiens
tcatttatagctaaccttgaat

SEQ ID NO: 8182762 - DNA, 22 bp, Homo sapiens
tcatttatagctaaccttgaat

SEQ ID NO: 8182763 - DNA, 22 bp, Homo sapiens
tcatttacttctatgacaacat

SEQ ID NO: 8182764 - DNA, 22 bp, Homo sapiens
tcatttactgtaggcaaaaatt

SEQ ID NO: 8182765 - DNA, 22 bp, Homo sapiens
tcatttacttggttttaatctt

SEQ ID NO: 8182766 - DNA, 22 bp, Homo sapiens
tcatttagttctttcatgtcca

SEQ ID NO: 8182767 - DNA, 22 bp, Homo sapiens
tcatttactgtaggagtgaacc

SEQ ID NO: 8182768 - DNA, 22 bp, Homo sapiens
tcatttacgcgcctccttcctt

SEQ ID NO: 8182769 - DNA, 22 bp, Homo sapiens
tcatttacgcgcctccttcctt

SEQ ID NO: 8182770 - DNA, 22 bp, Homo sapiens
tcatttacatgtctttctctga

SEQ ID NO: 8182771 - DNA, 22 bp, Homo sapiens
tcattgccatggcatttgcaga

SEQ ID NO: 8182772 - DNA, 22 bp, Homo sapiens
tcattgctctaggttccttgga

SEQ ID NO: 8182773 - DNA, 21 bp, Homo sapiens
tcattggtcattaagctctgt

SEQ ID NO: 8182774 - DNA, 22 bp, Homo sapiens
tcattggttgtcacacagggag

SEQ ID NO: 8182775 - DNA, 21 bp, Homo sapiens
tcattggtaagttttgtttgc

SEQ ID NO: 8182776 - DNA, 22 bp, Homo sapiens
tcattggtaattatttttgaca

SEQ ID NO: 8182777 - DNA, 22 bp, Homo sapiens
tcattgttaactcccagattca

SEQ ID NO: 8182778 - DNA, 22 bp, Homo sapiens
tcattgttaactcccagattca

SEQ ID NO: 8182779 - DNA, 23 bp, Homo sapiens
tcattgtgactgtgccacataac

SEQ ID NO: 8182780 - DNA, 22 bp, Homo sapiens
tcattgtattcagaactgaaga

SEQ ID NO: 8182781 - DNA, 22 bp, Homo sapiens
tcattgttaattcctgccggcc

SEQ ID NO: 8182782 - DNA, 22 bp, Homo sapiens
tcattgttaattgtatgatctg

SEQ ID NO: 8182783 - DNA, 22 bp, Homo sapiens
tcattgttactgtttagttgcc

SEQ ID NO: 8182784 - DNA, 22 bp, Homo sapiens
tcattgttactgtttagttgcc

SEQ ID NO: 8182785 - DNA, 22 bp, Homo sapiens
tcattgttcctatttggcaaga

SEQ ID NO: 8182786 - DNA, 22 bp, Homo sapiens
tcattgttatgttttgctgtct

SEQ ID NO: 8182787 - DNA, 22 bp, Homo sapiens
tcattgttatgttttgctgtct

SEQ ID NO: 8182788 - DNA, 22 bp, Homo sapiens
tcattgttatgttttgctgtct

SEQ ID NO: 8182789 - DNA, 22 bp, Homo sapiens
tcatgcatctgggctggctggt

SEQ ID NO: 8182790 - DNA, 22 bp, Homo sapiens
tcatgcatcaatttctctttag

SEQ ID NO: 8182791 - DNA, 22 bp, Homo sapiens
tcatgcataatggtgacaacct

SEQ ID NO: 8182792 - DNA, 22 bp, Homo sapiens
tcatgcagtttgaagttcaggg

SEQ ID NO: 8182793 - DNA, 22 bp, Homo sapiens
tcatgcagttactgttatgcaa

SEQ ID NO: 8182794 - DNA, 22 bp, Homo sapiens
tcatgcagtttcttatctgcca

SEQ ID NO: 8182795 - DNA, 21 bp, Homo sapiens
tcatgcaggcagagtttggta

SEQ ID NO: 8182796 - DNA, 20 bp, Homo sapiens
tcatgcaggtgttctaggtt

SEQ ID NO: 8182797 - DNA, 22 bp, Homo sapiens
tcatttcagtggcacagaagat

SEQ ID NO: 8182798 - DNA, 23 bp, Homo sapiens
tcatttcatccagccttgagagt

SEQ ID NO: 8182799 - DNA, 23 bp, Homo sapiens
tcatttcatccagccttgagagt

SEQ ID NO: 8182800 - DNA, 22 bp, Homo sapiens
tcatttcagtcctctgtgtgag

SEQ ID NO: 8182801 - DNA, 22 bp, Homo sapiens
tcatttcagtcctctgtgtgag

SEQ ID NO: 8182802 - DNA, 17 bp, Homo sapiens
tcatttcagtaaatcca

SEQ ID NO: 8182803 - DNA, 22 bp, Homo sapiens
tcatttctatctatgcagcttc

SEQ ID NO: 8182804 - DNA, 22 bp, Homo sapiens
tcatttccctcctacaaagagg

SEQ ID NO: 8182805 - DNA, 17 bp, Homo sapiens
tcatttctaggcactcc

SEQ ID NO: 8182806 - DNA, 22 bp, Homo sapiens
tcatttcctcaaattcaaggtt

SEQ ID NO: 8182807 - DNA, 22 bp, Homo sapiens
tcatttcatgtctcaggcactg

SEQ ID NO: 8182808 - DNA, 22 bp, Homo sapiens
tcatttcagatgcatttagaat

SEQ ID NO: 8182809 - DNA, 22 bp, Homo sapiens
tcatttcagatgcatttagaat

SEQ ID NO: 8182810 - DNA, 22 bp, Homo sapiens
tcatttcacttctctagggaga

SEQ ID NO: 8182811 - DNA, 22 bp, Homo sapiens
tcatttcacttctctagggaga

SEQ ID NO: 8182812 - DNA, 23 bp, Homo sapiens
tcatttcaggttgcatggtacca

SEQ ID NO: 8182813 - DNA, 23 bp, Homo sapiens
tcatttcaggttgcatggtacca

SEQ ID NO: 8182814 - DNA, 22 bp, Homo sapiens
tcatttcacttctctagggaga

SEQ ID NO: 8182815 - DNA, 22 bp, Homo sapiens
tcatttatcatttgtgctgtag

SEQ ID NO: 8182816 - DNA, 22 bp, Homo sapiens
tcatttatcatttgtgctgtag

SEQ ID NO: 8182817 - DNA, 22 bp, Homo sapiens
tcatttcaatgatactactaag

SEQ ID NO: 8182818 - DNA, 22 bp, Homo sapiens
tcatttcaatgatactactaag

SEQ ID NO: 8182819 - DNA, 22 bp, Homo sapiens
tcatttatattgtattctgtag

SEQ ID NO: 8182820 - DNA, 22 bp, Homo sapiens
tcatttatattgtattctgtag

SEQ ID NO: 8182821 - DNA, 22 bp, Homo sapiens
tcatttatattgtattctgtag

SEQ ID NO: 8182822 - DNA, 22 bp, Homo sapiens
tcatttctctgagtctgataat

SEQ ID NO: 8182823 - DNA, 22 bp, Homo sapiens
tcatttctctgagtctgataat

SEQ ID NO: 8182824 - DNA, 22 bp, Homo sapiens
tcatttctctgagtctgataat

SEQ ID NO: 8182825 - DNA, 22 bp, Homo sapiens
tcatttctgagccttccatgat

SEQ ID NO: 8182826 - DNA, 22 bp, Homo sapiens
tcatttctgttgtgcatcactg

SEQ ID NO: 8182827 - DNA, 22 bp, Homo sapiens
tcatttcttaactagagtgaac

SEQ ID NO: 8182828 - DNA, 22 bp, Homo sapiens
tcatttcttaactagagtgaac

SEQ ID NO: 8182829 - DNA, 20 bp, Homo sapiens
tcatttcttggggttccaag

SEQ ID NO: 8182830 - DNA, 22 bp, Homo sapiens
tcatttggagccttcctgtttt

SEQ ID NO: 8182831 - DNA, 22 bp, Homo sapiens
tcatttctcctaagtgaaatat

SEQ ID NO: 8182832 - DNA, 21 bp, Homo sapiens
tcatttctctatgtatttcac

SEQ ID NO: 8182833 - DNA, 21 bp, Homo sapiens
tcatttctctatgtatttcac

SEQ ID NO: 8182834 - DNA, 22 bp, Homo sapiens
tcatttctcctaagtgaaatat

SEQ ID NO: 8182835 - DNA, 22 bp, Homo sapiens
tcatttctcctaagtgaaatat

SEQ ID NO: 8182836 - DNA, 22 bp, Homo sapiens
tcatttctcctaagtgaaatat

SEQ ID NO: 8182837 - DNA, 22 bp, Homo sapiens
tcatttctctgagtctgataat

SEQ ID NO: 8182838 - DNA, 22 bp, Homo sapiens
tcatttctctgagtctgataat

SEQ ID NO: 8182839 - DNA, 22 bp, Homo sapiens
tcatttctctgagtctgataat

SEQ ID NO: 8182840 - DNA, 22 bp, Homo sapiens
tcatttctcccggccaaaaact

SEQ ID NO: 8182841 - DNA, 22 bp, Homo sapiens
tcatttctcccggccaaaaact

SEQ ID NO: 8182842 - DNA, 22 bp, Homo sapiens
tcatttctattgctactgtctg

SEQ ID NO: 8182843 - DNA, 22 bp, Homo sapiens
tcatttctccgacctgctgtcc

SEQ ID NO: 8182844 - DNA, 22 bp, Homo sapiens
tcatttctccgacctgctgtcc

SEQ ID NO: 8182845 - DNA, 22 bp, Homo sapiens
tcatttctccgacctgctgtcc

SEQ ID NO: 8182846 - DNA, 22 bp, Homo sapiens
tcatttctcccggccaaaaact

SEQ ID NO: 8182847 - DNA, 22 bp, Homo sapiens
tcatttctccgacctgctgtcc

SEQ ID NO: 8182848 - DNA, 22 bp, Homo sapiens
gtttctttctattgactgaaca

SEQ ID NO: 8182849 - DNA, 22 bp, Homo sapiens
gtttctttctattgactgaaca

SEQ ID NO: 8182850 - DNA, 22 bp, Homo sapiens
gtttctttctattgactgaaca

SEQ ID NO: 8182851 - DNA, 22 bp, Homo sapiens
gtttcagaaatgttctcctgct

SEQ ID NO: 8182852 - DNA, 22 bp, Homo sapiens
gtttcttttgtgatcaccaacc

SEQ ID NO: 8182853 - DNA, 22 bp, Homo sapiens
gtttcttttgtgatcaccaacc

SEQ ID NO: 8182854 - DNA, 22 bp, Homo sapiens
gtttcttttaaaatatgtagac

SEQ ID NO: 8182855 - DNA, 22 bp, Homo sapiens
gtttcttttaaaatatgtagac

SEQ ID NO: 8182856 - DNA, 22 bp, Homo sapiens
gtttcttttaaaatatgtagac

SEQ ID NO: 8182857 - DNA, 22 bp, Homo sapiens
gtttcttttaaaatatgtagac

SEQ ID NO: 8182858 - DNA, 22 bp, Homo sapiens
gtttcacagatggggagacacg

SEQ ID NO: 8182859 - DNA, 22 bp, Homo sapiens
gtttcaagtagctgctgattat

SEQ ID NO: 8182860 - DNA, 22 bp, Homo sapiens
gtttcaagagtggctcaaaact

SEQ ID NO: 8182861 - DNA, 22 bp, Homo sapiens
gtttcaagggaactgttttggt

SEQ ID NO: 8182862 - DNA, 22 bp, Homo sapiens
gtttcaaataggtttcagcaaa

SEQ ID NO: 8182863 - DNA, 22 bp, Homo sapiens
gtttcacagggccatggaggaa

SEQ ID NO: 8182864 - DNA, 22 bp, Homo sapiens
gtttcacagatggtgttcatat

SEQ ID NO: 8182865 - DNA, 22 bp, Homo sapiens
gtttgtcccacttctggcagaa

SEQ ID NO: 8182866 - DNA, 22 bp, Homo sapiens
gtttgtcatttgtacttctagc

SEQ ID NO: 8182867 - DNA, 22 bp, Homo sapiens
gtttgtgtaacatgatgatgat

SEQ ID NO: 8182868 - DNA, 22 bp, Homo sapiens
gtttgtcaatgacttaggcgtt

SEQ ID NO: 8182869 - DNA, 20 bp, Homo sapiens
gttttaaggcacaggccttt

SEQ ID NO: 8182870 - DNA, 20 bp, Homo sapiens
gttttaaggcacaggccttt

SEQ ID NO: 8182871 - DNA, 22 bp, Homo sapiens
gtttgattcaagaacaaagagt

SEQ ID NO: 8182872 - DNA, 22 bp, Homo sapiens
gtttgcatatttgcacaggaat

SEQ ID NO: 8182873 - DNA, 22 bp, Homo sapiens
gtttgaaagaccaattagattt

SEQ ID NO: 8182874 - DNA, 22 bp, Homo sapiens
gtttgaaagaccaattagattt

SEQ ID NO: 8182875 - DNA, 22 bp, Homo sapiens
gtttgaaagtggcaagtccttg

SEQ ID NO: 8182876 - DNA, 22 bp, Homo sapiens
gtttgaaagtggcaagtccttg

SEQ ID NO: 8182877 - DNA, 22 bp, Homo sapiens
gtttgaatgcagtatgcatttt

SEQ ID NO: 8182878 - DNA, 22 bp, Homo sapiens
gtttgaaatgtctgcaagggaa

SEQ ID NO: 8182879 - DNA, 19 bp, Homo sapiens
gttcttttcacctctgtgc

SEQ ID NO: 8182880 - DNA, 22 bp, Homo sapiens
gttgaaaatacagattcctagg

SEQ ID NO: 8182881 - DNA, 22 bp, Homo sapiens
gttgaaaatacagattcctagg

SEQ ID NO: 8182882 - DNA, 22 bp, Homo sapiens
gttcttttggtagagtgtgcat

SEQ ID NO: 8182883 - DNA, 22 bp, Homo sapiens
gttcttttggtagagtgtgcat

SEQ ID NO: 8182884 - DNA, 22 bp, Homo sapiens
gttctttgactccaagaaagta

SEQ ID NO: 8182885 - DNA, 19 bp, Homo sapiens
gttctttcatagtaagagc

SEQ ID NO: 8182886 - DNA, 22 bp, Homo sapiens
gttcttggaccagcagcattga

SEQ ID NO: 8182887 - DNA, 21 bp, Homo sapiens
gttcttgcaggatttccttcc

SEQ ID NO: 8182888 - DNA, 22 bp, Homo sapiens
gttcttgccagcatcctcaggt

SEQ ID NO: 8182889 - DNA, 22 bp, Homo sapiens
gttctttaagtggagaaggaaa

SEQ ID NO: 8182890 - DNA, 22 bp, Homo sapiens
gttctttaaactgctgctctgt

SEQ ID NO: 8182891 - DNA, 21 bp, Homo sapiens
gttcttgcaggatttccttcc

SEQ ID NO: 8182892 - DNA, 22 bp, Homo sapiens
gttgaaatttgtgataatttag

SEQ ID NO: 8182893 - DNA, 22 bp, Homo sapiens
gttgaacatgtgagtctcagga

SEQ ID NO: 8182894 - DNA, 22 bp, Homo sapiens
gttgaaatgagggattaatcag

SEQ ID NO: 8182895 - DNA, 22 bp, Homo sapiens
gttgaaatcctaaccccctagt

SEQ ID NO: 8182896 - DNA, 22 bp, Homo sapiens
gttgaaatcctaaccccctagt

SEQ ID NO: 8182897 - DNA, 22 bp, Homo sapiens
gttgaaagtagatgctatttgg

SEQ ID NO: 8182898 - DNA, 22 bp, Homo sapiens
gttgaaaatgactttataccat

SEQ ID NO: 8182899 - DNA, 22 bp, Homo sapiens
gttgaaagatgtcttggttccc

SEQ ID NO: 8182900 - DNA, 22 bp, Homo sapiens
gttgaactatgttttatctgac

SEQ ID NO: 8182901 - DNA, 23 bp, Homo sapiens
gttgaagtggtcggggaggcaga

SEQ ID NO: 8182902 - DNA, 22 bp, Homo sapiens
gttgaagtttatatgagtgctt

SEQ ID NO: 8182903 - DNA, 22 bp, Homo sapiens
gttgaataattcatagaagcta

SEQ ID NO: 8182904 - DNA, 22 bp, Homo sapiens
gtttatcagagagcagaggtgg

SEQ ID NO: 8182905 - DNA, 22 bp, Homo sapiens
gtttatctagtgaagtgaagaa

SEQ ID NO: 8182906 - DNA, 22 bp, Homo sapiens
gtttatctgcactctcttgtag

SEQ ID NO: 8182907 - DNA, 22 bp, Homo sapiens
gtttatgaaatttcaggcattt

SEQ ID NO: 8182908 - DNA, 22 bp, Homo sapiens
gttgagctctccagcttcattt

SEQ ID NO: 8182909 - DNA, 22 bp, Homo sapiens
gtttatgaggaaaagttatgat

SEQ ID NO: 8182910 - DNA, 22 bp, Homo sapiens
gtttatgaattgcattcccttt

SEQ ID NO: 8182911 - DNA, 22 bp, Homo sapiens
gtttatgaatgttactatagag

SEQ ID NO: 8182912 - DNA, 22 bp, Homo sapiens
gtttatgaggaaaagttatgat

SEQ ID NO: 8182913 - DNA, 22 bp, Homo sapiens
gtttatgagttacgtaggggtt

SEQ ID NO: 8182914 - DNA, 22 bp, Homo sapiens
gtttatgaatgtgtcagacata

SEQ ID NO: 8182915 - DNA, 22 bp, Homo sapiens
gtttatgaatgtgtcagacata

SEQ ID NO: 8182916 - DNA, 21 bp, Homo sapiens
gtttatgaatcttgtcctgct

SEQ ID NO: 8182917 - DNA, 22 bp, Homo sapiens
gtttatgaatgtgtcagacata

SEQ ID NO: 8182918 - DNA, 22 bp, Homo sapiens
gtttatgaatgttactatagag

SEQ ID NO: 8182919 - DNA, 22 bp, Homo sapiens
gtttatgaatgttactatagag

SEQ ID NO: 8182920 - DNA, 22 bp, Homo sapiens
gtttatgaatgttactatagag

SEQ ID NO: 8182921 - DNA, 22 bp, Homo sapiens
gtttatgaatgtgtcagacata

SEQ ID NO: 8182922 - DNA, 22 bp, Homo sapiens
gtttattatacaacaaaagcta

SEQ ID NO: 8182923 - DNA, 22 bp, Homo sapiens
gtttattatacaacaaaagcta

SEQ ID NO: 8182924 - DNA, 22 bp, Homo sapiens
gtttattagagttttctgtctg

SEQ ID NO: 8182925 - DNA, 22 bp, Homo sapiens
gtttattagagttttctgtctg

SEQ ID NO: 8182926 - DNA, 22 bp, Homo sapiens
gtttattagagttttctgtctg

SEQ ID NO: 8182927 - DNA, 22 bp, Homo sapiens
gtttattagagttttctgtctg

SEQ ID NO: 8182928 - DNA, 22 bp, Homo sapiens
gtttattaactgtcaagtgatt

SEQ ID NO: 8182929 - DNA, 22 bp, Homo sapiens
gtttattaactgtcaagtgatt

SEQ ID NO: 8182930 - DNA, 22 bp, Homo sapiens
gtttattaactgtcaagtgatt

SEQ ID NO: 8182931 - DNA, 22 bp, Homo sapiens
gtttattaactgtcaagtgatt

SEQ ID NO: 8182932 - DNA, 22 bp, Homo sapiens
gttcttcatcttaaccatctgt

SEQ ID NO: 8182933 - DNA, 22 bp, Homo sapiens
gttcttcatcattaacactctg

SEQ ID NO: 8182934 - DNA, 22 bp, Homo sapiens
gttcttcagtaaaattaaatgt

SEQ ID NO: 8182935 - DNA, 22 bp, Homo sapiens
gttcttcagtcacatcacagaa

SEQ ID NO: 8182936 - DNA, 22 bp, Homo sapiens
gttcttcagttcaggctgttca

SEQ ID NO: 8182937 - DNA, 22 bp, Homo sapiens
gttattttaacttctcagtaat

SEQ ID NO: 8182938 - DNA, 22 bp, Homo sapiens
gttctggaaagcaagaaagagt

SEQ ID NO: 8182939 - DNA, 21 bp, Homo sapiens
gttctggaggctgcaagtcca

SEQ ID NO: 8182940 - DNA, 22 bp, Homo sapiens
gttctggagtggtgccaggcct

SEQ ID NO: 8182941 - DNA, 22 bp, Homo sapiens
gttctggagtggtgccaggcct

SEQ ID NO: 8182942 - DNA, 22 bp, Homo sapiens
gttctggaagcttttgagcaac

SEQ ID NO: 8182943 - DNA, 22 bp, Homo sapiens
gttctggaagcttttgagcaac

SEQ ID NO: 8182944 - DNA, 21 bp, Homo sapiens
gttctggagcctggaagtcca

SEQ ID NO: 8182945 - DNA, 22 bp, Homo sapiens
gttctggaattgtctgaaatcc

SEQ ID NO: 8182946 - DNA, 22 bp, Homo sapiens
gttctggaggagagcctggtgt

SEQ ID NO: 8182947 - DNA, 21 bp, Homo sapiens
gttattggttacactgcactt

SEQ ID NO: 8182948 - DNA, 20 bp, Homo sapiens
gttattggtcatttttgcca

SEQ ID NO: 8182949 - DNA, 22 bp, Homo sapiens
gttattgggtgcctcaggccct

SEQ ID NO: 8182950 - DNA, 22 bp, Homo sapiens
gttattggaaagcctggagggc

SEQ ID NO: 8182951 - DNA, 22 bp, Homo sapiens
gttattggcagcatttcagagt

SEQ ID NO: 8182952 - DNA, 20 bp, Homo sapiens
gttattggaaatattgtgtg

SEQ ID NO: 8182953 - DNA, 22 bp, Homo sapiens
gttattgtccagcacagttggg

SEQ ID NO: 8182954 - DNA, 22 bp, Homo sapiens
gttattgtccatttatttagca

SEQ ID NO: 8182955 - DNA, 22 bp, Homo sapiens
gttatttaactttgtagcatgg

SEQ ID NO: 8182956 - DNA, 22 bp, Homo sapiens
gttatttaactttgtagcatgg

SEQ ID NO: 8182957 - DNA, 22 bp, Homo sapiens
gttatttataaggtgtaactcc

SEQ ID NO: 8182958 - DNA, 22 bp, Homo sapiens
gttatttataaggtgtaactcc

SEQ ID NO: 8182959 - DNA, 22 bp, Homo sapiens
gttatttcagccacagagtgca

SEQ ID NO: 8182960 - DNA, 22 bp, Homo sapiens
gttatttcagccacagagtgca

SEQ ID NO: 8182961 - DNA, 22 bp, Homo sapiens
gttatttaactttgtagcatgg

SEQ ID NO: 8182962 - DNA, 22 bp, Homo sapiens
gttatttaactttgtagcatgg

SEQ ID NO: 8182963 - DNA, 22 bp, Homo sapiens
gttatttaactttgtagcatgg

SEQ ID NO: 8182964 - DNA, 22 bp, Homo sapiens
gttatgaagtcattcacaaata

SEQ ID NO: 8182965 - DNA, 22 bp, Homo sapiens
gttatgaaataaatatagatca

SEQ ID NO: 8182966 - DNA, 22 bp, Homo sapiens
gttatgaaataaatatagatca

SEQ ID NO: 8182967 - DNA, 22 bp, Homo sapiens
gttatgtatgagggaatgatta

SEQ ID NO: 8182968 - DNA, 22 bp, Homo sapiens
gttatcttccctttgatgattt

SEQ ID NO: 8182969 - DNA, 22 bp, Homo sapiens
gttatcttagggtacaaaggac

SEQ ID NO: 8182970 - DNA, 22 bp, Homo sapiens
gttatcttctatttctcatact

SEQ ID NO: 8182971 - DNA, 22 bp, Homo sapiens
gttatattgccaagtatattgt

SEQ ID NO: 8182972 - DNA, 22 bp, Homo sapiens
gttatattgccaagtatattgt

SEQ ID NO: 8182973 - DNA, 22 bp, Homo sapiens
gttatattggcagaagagaaga

SEQ ID NO: 8182974 - DNA, 22 bp, Homo sapiens
gttatattggcagaagagaaga

SEQ ID NO: 8182975 - DNA, 22 bp, Homo sapiens
gttataaatgactgcaaaagtt

SEQ ID NO: 8182976 - DNA, 22 bp, Homo sapiens
gttataaatgactgcaaaagtt

SEQ ID NO: 8182977 - DNA, 22 bp, Homo sapiens
gttataaatacctaataggatt

SEQ ID NO: 8182978 - DNA, 22 bp, Homo sapiens
gttatataattcctgtggtagt

SEQ ID NO: 8182979 - DNA, 22 bp, Homo sapiens
gttatattcaaaatgaggctgt

SEQ ID NO: 8182980 - DNA, 22 bp, Homo sapiens
gtgttattagagcattaatttt

SEQ ID NO: 8182981 - DNA, 22 bp, Homo sapiens
gtgctgggattacaggtgtgag

SEQ ID NO: 8182982 - DNA, 22 bp, Homo sapiens
gtgctggctggggcatcaggca

SEQ ID NO: 8182983 - DNA, 22 bp, Homo sapiens
gtgctggctggggcatcaggca

SEQ ID NO: 8182984 - DNA, 22 bp, Homo sapiens
gtgctggctggggcatcaggca

SEQ ID NO: 8182985 - DNA, 21 bp, Homo sapiens
gtgctgggacacagccaggct

SEQ ID NO: 8182986 - DNA, 21 bp, Homo sapiens
gtgctgggacacagccaggct

SEQ ID NO: 8182987 - DNA, 21 bp, Homo sapiens
gtgctgggacacagccaggct

SEQ ID NO: 8182988 - DNA, 22 bp, Homo sapiens
gtgctggcctcagagggtcatg

SEQ ID NO: 8182989 - DNA, 17 bp, Homo sapiens
gtgctggcctggggctc

SEQ ID NO: 8182990 - DNA, 17 bp, Homo sapiens
gtgctggcctggggctc

SEQ ID NO: 8182991 - DNA, 17 bp, Homo sapiens
gtgctggcctggggctc

SEQ ID NO: 8182992 - DNA, 17 bp, Homo sapiens
gtgctggcctggggctc

SEQ ID NO: 8182993 - DNA, 22 bp, Homo sapiens
gtgctggcctcagagggtcatg

SEQ ID NO: 8182994 - DNA, 22 bp, Homo sapiens
gtgctggcctcagagggtcatg

SEQ ID NO: 8182995 - DNA, 22 bp, Homo sapiens
gtgctggctggacatggagcac

SEQ ID NO: 8182996 - DNA, 22 bp, Homo sapiens
gtgctggctggacatggagcac

SEQ ID NO: 8182997 - DNA, 22 bp, Homo sapiens
gtgctggctggacatggagcac

SEQ ID NO: 8182998 - DNA, 22 bp, Homo sapiens
gtgctggctgccaggaggctgc

SEQ ID NO: 8182999 - DNA, 22 bp, Homo sapiens
gtgctggctgccaggaggctgc

SEQ ID NO: 8183000 - DNA, 22 bp, Homo sapiens
gtgtttaacatctggtttatac

SEQ ID NO: 8183001 - DNA, 22 bp, Homo sapiens
gtgttgatgacattttagaaac

SEQ ID NO: 8183002 - DNA, 23 bp, Homo sapiens
gtgttggcagcagtgctctgggg

SEQ ID NO: 8183003 - DNA, 22 bp, Homo sapiens
gtgttctttatttagtgatgct

SEQ ID NO: 8183004 - DNA, 22 bp, Homo sapiens
gtgttcatgccccagtgcagga

SEQ ID NO: 8183005 - DNA, 23 bp, Homo sapiens
gtgttcatcccagtctgtgcaat

SEQ ID NO: 8183006 - DNA, 22 bp, Homo sapiens
gtgttcatcccaatgctgatag

SEQ ID NO: 8183007 - DNA, 22 bp, Homo sapiens
gtgttctgggatgattgtagtg

SEQ ID NO: 8183008 - DNA, 22 bp, Homo sapiens
gtgttctgcagaccagcatcat

SEQ ID NO: 8183009 - DNA, 22 bp, Homo sapiens
gtgttcatggatgtcaatttga

SEQ ID NO: 8183010 - DNA, 22 bp, Homo sapiens
gtgttcattgtatggaatgggt

SEQ ID NO: 8183011 - DNA, 22 bp, Homo sapiens
gttaacattcaattaaacagtc

SEQ ID NO: 8183012 - DNA, 22 bp, Homo sapiens
gttataaatacctaataggatt

SEQ ID NO: 8183013 - DNA, 23 bp, Homo sapiens
gttaacatggtccatggaagagc

SEQ ID NO: 8183014 - DNA, 22 bp, Homo sapiens
gttaacataggcttaggggttt

SEQ ID NO: 8183015 - DNA, 22 bp, Homo sapiens
gttaaataacctcatgtccgtt

SEQ ID NO: 8183016 - DNA, 22 bp, Homo sapiens
gttaaataacctcatgtccgtt

SEQ ID NO: 8183017 - DNA, 22 bp, Homo sapiens
gttaaatgcagattctgactca

SEQ ID NO: 8183018 - DNA, 22 bp, Homo sapiens
gttaaatgcactattgaaagct

SEQ ID NO: 8183019 - DNA, 22 bp, Homo sapiens
gttaaattcgatgatggataaa

SEQ ID NO: 8183020 - DNA, 22 bp, Homo sapiens
gttaaatgcattttccaagcac

SEQ ID NO: 8183021 - DNA, 22 bp, Homo sapiens
gttaaattcgatgatggataaa

SEQ ID NO: 8183022 - DNA, 22 bp, Homo sapiens
gttaaataacctcatgtccgtt

SEQ ID NO: 8183023 - DNA, 22 bp, Homo sapiens
gttaaataacctcatgtccgtt

SEQ ID NO: 8183024 - DNA, 22 bp, Homo sapiens
gtgtttcttgcactccccggac

SEQ ID NO: 8183025 - DNA, 22 bp, Homo sapiens
gtgtttaataggtagctgaatc

SEQ ID NO: 8183026 - DNA, 22 bp, Homo sapiens
gtgtttaatgcagatgtgggtg

SEQ ID NO: 8183027 - DNA, 22 bp, Homo sapiens
gtgtttaataggtagctgaatc

SEQ ID NO: 8183028 - DNA, 22 bp, Homo sapiens
gtgtttacagataaagtgagct

SEQ ID NO: 8183029 - DNA, 19 bp, Homo sapiens
gtgtttactgtgtgcagaa

SEQ ID NO: 8183030 - DNA, 22 bp, Homo sapiens
taaaagtggataagctgtagga

SEQ ID NO: 8183031 - DNA, 22 bp, Homo sapiens
taaagacactggttttaatcat

SEQ ID NO: 8183032 - DNA, 23 bp, Homo sapiens
taaagacagccttcaggattctg

SEQ ID NO: 8183033 - DNA, 22 bp, Homo sapiens
taaagacatgcaaagtctaatt

SEQ ID NO: 8183034 - DNA, 22 bp, Homo sapiens
taaagacatgcaaagtctaatt

SEQ ID NO: 8183035 - DNA, 20 bp, Homo sapiens
taaagacataagctactatc

SEQ ID NO: 8183036 - DNA, 20 bp, Homo sapiens
taaagacataagctactatc

SEQ ID NO: 8183037 - DNA, 22 bp, Homo sapiens
taaaagtaggaatgaaacgcat

SEQ ID NO: 8183038 - DNA, 22 bp, Homo sapiens
taaaaggcacttggatgctgag

SEQ ID NO: 8183039 - DNA, 22 bp, Homo sapiens
taaaagtaggaatgaaacgcat

SEQ ID NO: 8183040 - DNA, 22 bp, Homo sapiens
taaaaggcaatactagatgagt

SEQ ID NO: 8183041 - DNA, 22 bp, Homo sapiens
taaaaggattagcaggatgggc

SEQ ID NO: 8183042 - DNA, 22 bp, Homo sapiens
taaaaggattagcaggatgggc

SEQ ID NO: 8183043 - DNA, 22 bp, Homo sapiens
taaaaggaggttgaagctgtca

SEQ ID NO: 8183044 - DNA, 21 bp, Homo sapiens
taaaagatgacaagacagctc

SEQ ID NO: 8183045 - DNA, 22 bp, Homo sapiens
taaaagattttataggaacaag

SEQ ID NO: 8183046 - DNA, 21 bp, Homo sapiens
taaaagatgacaagacagctc

SEQ ID NO: 8183047 - DNA, 22 bp, Homo sapiens
taaaagacatataactgtagga

SEQ ID NO: 8183048 - DNA, 22 bp, Homo sapiens
taaaagaccacaaggtggtaat

SEQ ID NO: 8183049 - DNA, 22 bp, Homo sapiens
taaaagagaatggataacagag

SEQ ID NO: 8183050 - DNA, 21 bp, Homo sapiens
gttttaagggagaaaacctag

SEQ ID NO: 8183051 - DNA, 21 bp, Homo sapiens
gttttaagggagaaaacctag

SEQ ID NO: 8183052 - DNA, 22 bp, Homo sapiens
gttttacaaatgacggcattca

SEQ ID NO: 8183053 - DNA, 22 bp, Homo sapiens
taaaactgaatacatactgagg

SEQ ID NO: 8183054 - DNA, 22 bp, Homo sapiens
taaaacttaactatccagatta

SEQ ID NO: 8183055 - DNA, 22 bp, Homo sapiens
taaaacttctcatttttatggt

SEQ ID NO: 8183056 - DNA, 22 bp, Homo sapiens
taaaacttctcatttttatggt

SEQ ID NO: 8183057 - DNA, 22 bp, Homo sapiens
taaaacttctcatttttatggt

SEQ ID NO: 8183058 - DNA, 22 bp, Homo sapiens
taaaactttgaaggtgctcagt

SEQ ID NO: 8183059 - DNA, 22 bp, Homo sapiens
taaagataagacatcaactgag

SEQ ID NO: 8183060 - DNA, 22 bp, Homo sapiens
taaagagcgatatgctttaaag

SEQ ID NO: 8183061 - DNA, 22 bp, Homo sapiens
taaagagccattgtatggtttt

SEQ ID NO: 8183062 - DNA, 22 bp, Homo sapiens
taaagacatggtgtaggtgaac

SEQ ID NO: 8183063 - DNA, 22 bp, Homo sapiens
taaagacatggtgtaggtgaac

SEQ ID NO: 8183064 - DNA, 22 bp, Homo sapiens
taaagagcacgcttttctctct

SEQ ID NO: 8183065 - DNA, 22 bp, Homo sapiens
taaagaccaaacacagtgcaga

SEQ ID NO: 8183066 - DNA, 22 bp, Homo sapiens
taaagcaaaaatgaactgccat

SEQ ID NO: 8183067 - DNA, 22 bp, Homo sapiens
taaagcaaggcaaattgttggt

SEQ ID NO: 8183068 - DNA, 22 bp, Homo sapiens
taaagcaaggcaaattgttggt

SEQ ID NO: 8183069 - DNA, 22 bp, Homo sapiens
taaagcaattactcagtggctt

SEQ ID NO: 8183070 - DNA, 22 bp, Homo sapiens
taaagcaatgaaagttttgcag

SEQ ID NO: 8183071 - DNA, 22 bp, Homo sapiens
taaatgatttatgtatgtgaaa

SEQ ID NO: 8183072 - DNA, 22 bp, Homo sapiens
taaatgatttatgtatgtgaaa

SEQ ID NO: 8183073 - DNA, 22 bp, Homo sapiens
taaatgatttatgtatgtgaaa

SEQ ID NO: 8183074 - DNA, 22 bp, Homo sapiens
taaatgatttatgtatgtgaaa

SEQ ID NO: 8183075 - DNA, 22 bp, Homo sapiens
taaatgcaagggaaaggcaaga

SEQ ID NO: 8183076 - DNA, 22 bp, Homo sapiens
taaatgataataatgctagtgt

SEQ ID NO: 8183077 - DNA, 22 bp, Homo sapiens
taaatgataataatgctagtgt

SEQ ID NO: 8183078 - DNA, 22 bp, Homo sapiens
taaagcagcgtgggtggggcag

SEQ ID NO: 8183079 - DNA, 22 bp, Homo sapiens
taaatgatttatgtatgtgaaa

SEQ ID NO: 8183080 - DNA, 22 bp, Homo sapiens
taaatgataataatgctagtgt

SEQ ID NO: 8183081 - DNA, 20 bp, Homo sapiens
taaagcagccgtggagggta

SEQ ID NO: 8183082 - DNA, 22 bp, Homo sapiens
taaagcaccatttgtttatcca

SEQ ID NO: 8183083 - DNA, 22 bp, Homo sapiens
taaagcacatatcttacaataa

SEQ ID NO: 8183084 - DNA, 22 bp, Homo sapiens
taaagcacatatcttacaataa

SEQ ID NO: 8183085 - DNA, 22 bp, Homo sapiens
taaatgcagtacaaattgttct

SEQ ID NO: 8183086 - DNA, 22 bp, Homo sapiens
taaatgcagcagtttctgttct

SEQ ID NO: 8183087 - DNA, 18 bp, Homo sapiens
taaatgcatgttaataac

SEQ ID NO: 8183088 - DNA, 18 bp, Homo sapiens
taaatgcatgttaataac

SEQ ID NO: 8183089 - DNA, 20 bp, Homo sapiens
taaatgcatgaatgtaaggc

SEQ ID NO: 8183090 - DNA, 20 bp, Homo sapiens
taaatgcatgaatgtaaggc

SEQ ID NO: 8183091 - DNA, 22 bp, Homo sapiens
taaatgttgtaagtacatctaa

SEQ ID NO: 8183092 - DNA, 22 bp, Homo sapiens
taaatgttgtaagtacatctaa

SEQ ID NO: 8183093 - DNA, 22 bp, Homo sapiens
taacagctggcgttataggaat

SEQ ID NO: 8183094 - DNA, 20 bp, Homo sapiens
taacaggaagcattatttta

SEQ ID NO: 8183095 - DNA, 22 bp, Homo sapiens
taacagcatttgaatgagtaac

SEQ ID NO: 8183096 - DNA, 22 bp, Homo sapiens
taacagctctgtgtggctgtaa

SEQ ID NO: 8183097 - DNA, 22 bp, Homo sapiens
taaatgttatgcccatcatcca

SEQ ID NO: 8183098 - DNA, 22 bp, Homo sapiens
taaatgttatgcccatcatcca

SEQ ID NO: 8183099 - DNA, 22 bp, Homo sapiens
taaatgctccatacatacacca

SEQ ID NO: 8183100 - DNA, 22 bp, Homo sapiens
taaatgttactttcctttcaca

SEQ ID NO: 8183101 - DNA, 22 bp, Homo sapiens
taaatgtgttgtggatgaagtt

SEQ ID NO: 8183102 - DNA, 18 bp, Homo sapiens
taaatgcatgttaataac

SEQ ID NO: 8183103 - DNA, 22 bp, Homo sapiens
taaatgccattcgtttcataca

SEQ ID NO: 8183104 - DNA, 22 bp, Homo sapiens
taaatgccattcgtttcataca

SEQ ID NO: 8183105 - DNA, 22 bp, Homo sapiens
taaatgtggagactcaggagtc

SEQ ID NO: 8183106 - DNA, 22 bp, Homo sapiens
taacagtattgaagataaacta

SEQ ID NO: 8183107 - DNA, 22 bp, Homo sapiens
taacagtatccccatttgcaag

SEQ ID NO: 8183108 - DNA, 22 bp, Homo sapiens
taacagtgtggacttgagatct

SEQ ID NO: 8183109 - DNA, 22 bp, Homo sapiens
taacagtaaagtaagttagctt

SEQ ID NO: 8183110 - DNA, 20 bp, Homo sapiens
taacagtaagtgatgttaca

SEQ ID NO: 8183111 - DNA, 22 bp, Homo sapiens
taacagtacatccttttctctt

SEQ ID NO: 8183112 - DNA, 22 bp, Homo sapiens
taacagtacatccttttctctt

SEQ ID NO: 8183113 - DNA, 22 bp, Homo sapiens
taacagtatagcctaacatttc

SEQ ID NO: 8183114 - DNA, 22 bp, Homo sapiens
taacatctttagcagctcgaac

SEQ ID NO: 8183115 - DNA, 22 bp, Homo sapiens
taacatgagagctaagacatta

SEQ ID NO: 8183116 - DNA, 22 bp, Homo sapiens
taagacttccaggaaaaggtgg

SEQ ID NO: 8183117 - DNA, 22 bp, Homo sapiens
taagagattctaaagctactgg

SEQ ID NO: 8183118 - DNA, 22 bp, Homo sapiens
taagagatgcttttctaaataa

SEQ ID NO: 8183119 - DNA, 22 bp, Homo sapiens
taagagatggttatcaaaagca

SEQ ID NO: 8183120 - DNA, 22 bp, Homo sapiens
taagagcctgtgctttgagttc

SEQ ID NO: 8183121 - DNA, 22 bp, Homo sapiens
taagagcattgtaaaataatct

SEQ ID NO: 8183122 - DNA, 22 bp, Homo sapiens
taagagcagaggttgaataaat

SEQ ID NO: 8183123 - DNA, 22 bp, Homo sapiens
taagaggatatttggccagaag

SEQ ID NO: 8183124 - DNA, 22 bp, Homo sapiens
taagagctcccttctccttgca

SEQ ID NO: 8183125 - DNA, 22 bp, Homo sapiens
taagcatggtggtaaaagaggt

SEQ ID NO: 8183126 - DNA, 22 bp, Homo sapiens
taagcatattccagtcatgtcc

SEQ ID NO: 8183127 - DNA, 22 bp, Homo sapiens
taagcatattccagtcatgtcc

SEQ ID NO: 8183128 - DNA, 21 bp, Homo sapiens
taagcatatcagatagactct

SEQ ID NO: 8183129 - DNA, 22 bp, Homo sapiens
taagaggatatttggccagaag

SEQ ID NO: 8183130 - DNA, 22 bp, Homo sapiens
taagaggcaaaagatactcaga

SEQ ID NO: 8183131 - DNA, 21 bp, Homo sapiens
taagcatatcagatagactct

SEQ ID NO: 8183132 - DNA, 20 bp, Homo sapiens
taagcatagttgtcagggtc

SEQ ID NO: 8183133 - DNA, 22 bp, Homo sapiens
taagacatgtccaggctgtgag

SEQ ID NO: 8183134 - DNA, 22 bp, Homo sapiens
taagaccaatcctgtgtacctc

SEQ ID NO: 8183135 - DNA, 22 bp, Homo sapiens
taagaccagtatgcattttcac

SEQ ID NO: 8183136 - DNA, 22 bp, Homo sapiens
taagaccatacatttccacaga

SEQ ID NO: 8183137 - DNA, 22 bp, Homo sapiens
taagaccaaagttctgtaggga

SEQ ID NO: 8183138 - DNA, 22 bp, Homo sapiens
taagacttaggtcgagtttggc

SEQ ID NO: 8183139 - DNA, 22 bp, Homo sapiens
taagactagttgaatggttttc

SEQ ID NO: 8183140 - DNA, 21 bp, Homo sapiens
taagacagtatgaatactttc

SEQ ID NO: 8183141 - DNA, 22 bp, Homo sapiens
taagacaggtagtaagaacatt

SEQ ID NO: 8183142 - DNA, 22 bp, Homo sapiens
taagacatgagactcagccagt

SEQ ID NO: 8183143 - DNA, 22 bp, Homo sapiens
taagacatcctggatgttcaaa

SEQ ID NO: 8183144 - DNA, 22 bp, Homo sapiens
taagacatcctggatgttcaaa

SEQ ID NO: 8183145 - DNA, 22 bp, Homo sapiens
taagacatcattaaacagcaat

SEQ ID NO: 8183146 - DNA, 22 bp, Homo sapiens
taacatgcagagtttagctttt

SEQ ID NO: 8183147 - DNA, 22 bp, Homo sapiens
taacatgatttgctatttagat

SEQ ID NO: 8183148 - DNA, 22 bp, Homo sapiens
taacatgctaggaagagtgatt

SEQ ID NO: 8183149 - DNA, 22 bp, Homo sapiens
taacatgctaatttgcagatag

SEQ ID NO: 8183150 - DNA, 22 bp, Homo sapiens
taacatgcattgacaaatattt

SEQ ID NO: 8183151 - DNA, 18 bp, Homo sapiens
taacatgttttcattaag

SEQ ID NO: 8183152 - DNA, 22 bp, Homo sapiens
taagacagggagggctctcagc

SEQ ID NO: 8183153 - DNA, 22 bp, Homo sapiens
taagacaattcttcagtcacaa

SEQ ID NO: 8183154 - DNA, 22 bp, Homo sapiens
taagacaagcctcgcatttgta

SEQ ID NO: 8183155 - DNA, 22 bp, Homo sapiens
taagacaaatactatttcaaga

SEQ ID NO: 8183156 - DNA, 22 bp, Homo sapiens
tacacataggtctgaataaaaa

SEQ ID NO: 8183157 - DNA, 22 bp, Homo sapiens
tacacataggagggtaataaaa

SEQ ID NO: 8183158 - DNA, 22 bp, Homo sapiens
tacacataggagggtaataaaa

SEQ ID NO: 8183159 - DNA, 22 bp, Homo sapiens
tacacatacattgcttacaagg

SEQ ID NO: 8183160 - DNA, 22 bp, Homo sapiens
tacacataggagggtaataaaa

SEQ ID NO: 8183161 - DNA, 20 bp, Homo sapiens
tacagaatgcaataaaatgg

SEQ ID NO: 8183162 - DNA, 22 bp, Homo sapiens
tacagaatctatgcttcacagt

SEQ ID NO: 8183163 - DNA, 22 bp, Homo sapiens
tacagacaaagagcatgcggta

SEQ ID NO: 8183164 - DNA, 22 bp, Homo sapiens
tacagacagacttcccaccctc

SEQ ID NO: 8183165 - DNA, 22 bp, Homo sapiens
tacagacaaagtgctatagggt

SEQ ID NO: 8183166 - DNA, 22 bp, Homo sapiens
tacagacagtttttcagatatt

SEQ ID NO: 8183167 - DNA, 22 bp, Homo sapiens
tacagaatgtgtatcattacca

SEQ ID NO: 8183168 - DNA, 21 bp, Homo sapiens
tacagaatgcgcttcagtctg

SEQ ID NO: 8183169 - DNA, 20 bp, Homo sapiens
tacagaatgcaataaaatgg

SEQ ID NO: 8183170 - DNA, 22 bp, Homo sapiens
tacacagaaattgtgtagggat

SEQ ID NO: 8183171 - DNA, 22 bp, Homo sapiens
tacacagaacctggtgtacagt

SEQ ID NO: 8183172 - DNA, 22 bp, Homo sapiens
tacacagaacctggtgtacagt

SEQ ID NO: 8183173 - DNA, 22 bp, Homo sapiens
tacacagaacctggtgtacagt

SEQ ID NO: 8183174 - DNA, 22 bp, Homo sapiens
tacacagaacctggtgtacagt

SEQ ID NO: 8183175 - DNA, 22 bp, Homo sapiens
tacacagtatatgggatcacag

SEQ ID NO: 8183176 - DNA, 22 bp, Homo sapiens
tacacagtaaatggtaaataca

SEQ ID NO: 8183177 - DNA, 22 bp, Homo sapiens
tacacatacattgcttacaagg

SEQ ID NO: 8183178 - DNA, 22 bp, Homo sapiens
tacacatacaccaatgtggtca

SEQ ID NO: 8183179 - DNA, 22 bp, Homo sapiens
tacacatacattgcttacaagg

SEQ ID NO: 8183180 - DNA, 22 bp, Homo sapiens
tacacatacattgcttacaagg

SEQ ID NO: 8183181 - DNA, 22 bp, Homo sapiens
tacacataaaatgctcatggta

SEQ ID NO: 8183182 - DNA, 22 bp, Homo sapiens
tacacagttttgctcccatgat

SEQ ID NO: 8183183 - DNA, 22 bp, Homo sapiens
tacacacatgcatttgccttat

SEQ ID NO: 8183184 - DNA, 22 bp, Homo sapiens
tacacacatgcatttgccttat

SEQ ID NO: 8183185 - DNA, 22 bp, Homo sapiens
tacacacatgcatttgccttat

SEQ ID NO: 8183186 - DNA, 22 bp, Homo sapiens
tacacacatgcatttgccttat

SEQ ID NO: 8183187 - DNA, 22 bp, Homo sapiens
tacacacatgcatttgccttat

SEQ ID NO: 8183188 - DNA, 22 bp, Homo sapiens
tacacacatgcatttgccttat

SEQ ID NO: 8183189 - DNA, 22 bp, Homo sapiens
tacacacagaggccatgggatt

SEQ ID NO: 8183190 - DNA, 22 bp, Homo sapiens
tacacacagaggccatgggatt

SEQ ID NO: 8183191 - DNA, 22 bp, Homo sapiens
tacacacagaggccatgggatt

SEQ ID NO: 8183192 - DNA, 22 bp, Homo sapiens
tacacacagaggccatgggatt

SEQ ID NO: 8183193 - DNA, 22 bp, Homo sapiens
tacacacagaggccatgggatt

SEQ ID NO: 8183194 - DNA, 22 bp, Homo sapiens
tacacacagaggccatgggatt

SEQ ID NO: 8183195 - DNA, 22 bp, Homo sapiens
tacacaattctggatgcatgtc

SEQ ID NO: 8183196 - DNA, 22 bp, Homo sapiens
tacacaattctggatgcatgtc

SEQ ID NO: 8183197 - DNA, 22 bp, Homo sapiens
tacacaattagttgcaaagtga

SEQ ID NO: 8183198 - DNA, 22 bp, Homo sapiens
tacacaatgacttaagatgtca

SEQ ID NO: 8183199 - DNA, 22 bp, Homo sapiens
tacacaattagttgcaaagtga

SEQ ID NO: 8183200 - DNA, 22 bp, Homo sapiens
tacacaatgacttaagatgtca

SEQ ID NO: 8183201 - DNA, 22 bp, Homo sapiens
tacacaatctgtttttccattt

SEQ ID NO: 8183202 - DNA, 22 bp, Homo sapiens
tacacaatctgtttttccattt

SEQ ID NO: 8183203 - DNA, 22 bp, Homo sapiens
tacacaatctgtttttccattt

SEQ ID NO: 8183204 - DNA, 22 bp, Homo sapiens
tacacaatgacttaagatgtca

SEQ ID NO: 8183205 - DNA, 22 bp, Homo sapiens
tacacaatgacttaagatgtca

SEQ ID NO: 8183206 - DNA, 22 bp, Homo sapiens
tacaagctcacaaatttttaag

SEQ ID NO: 8183207 - DNA, 22 bp, Homo sapiens
tacaagctcacaaatttttaag

SEQ ID NO: 8183208 - DNA, 22 bp, Homo sapiens
tacaagctcacaaatttttaag

SEQ ID NO: 8183209 - DNA, 22 bp, Homo sapiens
tacaagattaaaacttatacca

SEQ ID NO: 8183210 - DNA, 22 bp, Homo sapiens
tacaagattaaaacttatacca

SEQ ID NO: 8183211 - DNA, 22 bp, Homo sapiens
tacacaactgacaaccattctg

SEQ ID NO: 8183212 - DNA, 22 bp, Homo sapiens
tacacaatctgtttttccattt

SEQ ID NO: 8183213 - DNA, 22 bp, Homo sapiens
tacaagaggtatatagaaacag

SEQ ID NO: 8183214 - DNA, 22 bp, Homo sapiens
tacaagagtgagattatcatgt

SEQ ID NO: 8183215 - DNA, 22 bp, Homo sapiens
tacaagaggtatatagaaacag

SEQ ID NO: 8183216 - DNA, 22 bp, Homo sapiens
tacaagagtgagattatcatgt

SEQ ID NO: 8183217 - DNA, 21 bp, Homo sapiens
tacaagatagaggtaatatat

SEQ ID NO: 8183218 - DNA, 21 bp, Homo sapiens
tacaagatagaggtaatatat

SEQ ID NO: 8183219 - DNA, 22 bp, Homo sapiens
tacaagatgtactaaaaattat

SEQ ID NO: 8183220 - DNA, 22 bp, Homo sapiens
tacaagaatgtcttaaaagctc

SEQ ID NO: 8183221 - DNA, 22 bp, Homo sapiens
tacaagagaactaatgtaagtc

SEQ ID NO: 8183222 - DNA, 22 bp, Homo sapiens
tacaagaaatttctgcatatat

SEQ ID NO: 8183223 - DNA, 22 bp, Homo sapiens
tacaagaaatttctgcatatat

SEQ ID NO: 8183224 - DNA, 22 bp, Homo sapiens
tacaacttccagctttcagccc

SEQ ID NO: 8183225 - DNA, 22 bp, Homo sapiens
tacaagaaactacatgaatgca

SEQ ID NO: 8183226 - DNA, 22 bp, Homo sapiens
tacaaccatagacatatactag

SEQ ID NO: 8183227 - DNA, 22 bp, Homo sapiens
tacaactgcacatctgaatcac

SEQ ID NO: 8183228 - DNA, 22 bp, Homo sapiens
tacaaccatagacatatactag

SEQ ID NO: 8183229 - DNA, 22 bp, Homo sapiens
taatttcaaatttcttagcgtg

SEQ ID NO: 8183230 - DNA, 22 bp, Homo sapiens
taatttcaagtttagggctcta

SEQ ID NO: 8183231 - DNA, 22 bp, Homo sapiens
tacaacatgtggtcctttatga

SEQ ID NO: 8183232 - DNA, 21 bp, Homo sapiens
taatttattcagcacagtgtt

SEQ ID NO: 8183233 - DNA, 22 bp, Homo sapiens
taatttatggtatgtgtgtaat

SEQ ID NO: 8183234 - DNA, 22 bp, Homo sapiens
taattattctagtcacatagca

SEQ ID NO: 8183235 - DNA, 22 bp, Homo sapiens
taattattctagtcacatagca

SEQ ID NO: 8183236 - DNA, 22 bp, Homo sapiens
taattattatgacaacaattgc

SEQ ID NO: 8183237 - DNA, 22 bp, Homo sapiens
taattattatgacaacaattgc

SEQ ID NO: 8183238 - DNA, 22 bp, Homo sapiens
taattattatgacaacaattgc

SEQ ID NO: 8183239 - DNA, 22 bp, Homo sapiens
taatcttagcaacctccagtgt

SEQ ID NO: 8183240 - DNA, 18 bp, Homo sapiens
taatcttacagacaggat

SEQ ID NO: 8183241 - DNA, 22 bp, Homo sapiens
taatcttagacatgtatttttc

SEQ ID NO: 8183242 - DNA, 22 bp, Homo sapiens
taatcttagacatgtatttttc

SEQ ID NO: 8183243 - DNA, 19 bp, Homo sapiens
taatcttattgggcagatt

SEQ ID NO: 8183244 - DNA, 22 bp, Homo sapiens
taatctgtgtaccttcatcgga

SEQ ID NO: 8183245 - DNA, 22 bp, Homo sapiens
taatatatttctgctaagctca

SEQ ID NO: 8183246 - DNA, 22 bp, Homo sapiens
taatatatttctgctaagctca

SEQ ID NO: 8183247 - DNA, 22 bp, Homo sapiens
taatatatttctgctaagctca

SEQ ID NO: 8183248 - DNA, 22 bp, Homo sapiens
taatatatttctgctaagctca

SEQ ID NO: 8183249 - DNA, 22 bp, Homo sapiens
taatatatttctgctaagctca

SEQ ID NO: 8183250 - DNA, 22 bp, Homo sapiens
taatatatttctgctaagctca

SEQ ID NO: 8183251 - DNA, 22 bp, Homo sapiens
taatatctacttcatagagttt

SEQ ID NO: 8183252 - DNA, 22 bp, Homo sapiens
taatctctttatgagaagaagg

SEQ ID NO: 8183253 - DNA, 22 bp, Homo sapiens
taatcctgtcttgaccatcagg

SEQ ID NO: 8183254 - DNA, 22 bp, Homo sapiens
taattgcagggagcctgggggc

SEQ ID NO: 8183255 - DNA, 22 bp, Homo sapiens
taattgcagaactttgggaggc

SEQ ID NO: 8183256 - DNA, 22 bp, Homo sapiens
taattgcagggtgtcagaatac

SEQ ID NO: 8183257 - DNA, 22 bp, Homo sapiens
taattgctgtatagattgtcat

SEQ ID NO: 8183258 - DNA, 22 bp, Homo sapiens
taatttacttgcaaataacaat

SEQ ID NO: 8183259 - DNA, 22 bp, Homo sapiens
taattgctatttaatgtggtga

SEQ ID NO: 8183260 - DNA, 22 bp, Homo sapiens
taattgctgaactactatccct

SEQ ID NO: 8183261 - DNA, 22 bp, Homo sapiens
taatttatgatgcaaagaaaag

SEQ ID NO: 8183262 - DNA, 22 bp, Homo sapiens
taatttatatggaattgttgct

SEQ ID NO: 8183263 - DNA, 22 bp, Homo sapiens
taatttatatggaattgttgct

SEQ ID NO: 8183264 - DNA, 22 bp, Homo sapiens
taatttagtccaatgtgaatat

SEQ ID NO: 8183265 - DNA, 22 bp, Homo sapiens
taatttatagaatttcttggat

SEQ ID NO: 8183266 - DNA, 22 bp, Homo sapiens
taatttacttgcaaataacaat

SEQ ID NO: 8183267 - DNA, 22 bp, Homo sapiens
taatttatatggaattgttgct

SEQ ID NO: 8183268 - DNA, 22 bp, Homo sapiens
taatttatagaatttcttggat

SEQ ID NO: 8183269 - DNA, 22 bp, Homo sapiens
taattatttgaagacattagag

SEQ ID NO: 8183270 - DNA, 22 bp, Homo sapiens
taattcaggtagaacttaccag

SEQ ID NO: 8183271 - DNA, 22 bp, Homo sapiens
taattcagggccagaatcccca

SEQ ID NO: 8183272 - DNA, 22 bp, Homo sapiens
taattcagtcattaatcttagc

SEQ ID NO: 8183273 - DNA, 22 bp, Homo sapiens
taattattgtctgaagagttat

SEQ ID NO: 8183274 - DNA, 22 bp, Homo sapiens
taattattgtctgaagagttat

SEQ ID NO: 8183275 - DNA, 22 bp, Homo sapiens
taattatttgaagacattagag

SEQ ID NO: 8183276 - DNA, 22 bp, Homo sapiens
taattcatgggcccagtgatat

SEQ ID NO: 8183277 - DNA, 22 bp, Homo sapiens
taattcagtgttcacttggaca

SEQ ID NO: 8183278 - DNA, 22 bp, Homo sapiens
taattcatgggcccagtgatat

SEQ ID NO: 8183279 - DNA, 22 bp, Homo sapiens
taattcctagaaattattctca

SEQ ID NO: 8183280 - DNA, 22 bp, Homo sapiens
taattcttcaggccttttgtct

SEQ ID NO: 8183281 - DNA, 22 bp, Homo sapiens
taattcttgttcagaggtagta

SEQ ID NO: 8183282 - DNA, 22 bp, Homo sapiens
taattcttcaggccttttgtct

SEQ ID NO: 8183283 - DNA, 22 bp, Homo sapiens
taattctgacaacagtggcgtt

SEQ ID NO: 8183284 - DNA, 22 bp, Homo sapiens
taattcttcaggccttttgtct

SEQ ID NO: 8183285 - DNA, 21 bp, Homo sapiens
taagccaccatgtgaaaccag

SEQ ID NO: 8183286 - DNA, 22 bp, Homo sapiens
taagcattaactctgctgcaag

SEQ ID NO: 8183287 - DNA, 22 bp, Homo sapiens
taagcattaactctgctgcaag

SEQ ID NO: 8183288 - DNA, 22 bp, Homo sapiens
taagccactagtctgttatgaa

SEQ ID NO: 8183289 - DNA, 21 bp, Homo sapiens
taagccaccatgtgaaaccag

SEQ ID NO: 8183290 - DNA, 22 bp, Homo sapiens
taagccactgagatttggggtt

SEQ ID NO: 8183291 - DNA, 22 bp, Homo sapiens
taagcctgcatgaaccatgaga

SEQ ID NO: 8183292 - DNA, 22 bp, Homo sapiens
taagcgtcctgtaaatgttagt

SEQ ID NO: 8183293 - DNA, 22 bp, Homo sapiens
taagcctgcatgaaccatgaga

SEQ ID NO: 8183294 - DNA, 22 bp, Homo sapiens
taagcctgcatgaaccatgaga

SEQ ID NO: 8183295 - DNA, 22 bp, Homo sapiens
taaggaaggggaaagacatgtc

SEQ ID NO: 8183296 - DNA, 18 bp, Homo sapiens
taaggaagggggtgaaga

SEQ ID NO: 8183297 - DNA, 22 bp, Homo sapiens
taaggaagtcacaagaatcgct

SEQ ID NO: 8183298 - DNA, 22 bp, Homo sapiens
taaggaaacaacttgtattttt

SEQ ID NO: 8183299 - DNA, 22 bp, Homo sapiens
taatatatacctttgttaggaa

SEQ ID NO: 8183300 - DNA, 22 bp, Homo sapiens
taatatatacctttgttaggaa

SEQ ID NO: 8183301 - DNA, 22 bp, Homo sapiens
taatatatacctttgttaggaa

SEQ ID NO: 8183302 - DNA, 22 bp, Homo sapiens
taatatatacctttgttaggaa

SEQ ID NO: 8183303 - DNA, 22 bp, Homo sapiens
taatatatacctttgttaggaa

SEQ ID NO: 8183304 - DNA, 22 bp, Homo sapiens
taatatacttcccatagtttga

SEQ ID NO: 8183305 - DNA, 22 bp, Homo sapiens
taatatacttcccatagtttga

SEQ ID NO: 8183306 - DNA, 22 bp, Homo sapiens
taatatacttcccatagtttga

SEQ ID NO: 8183307 - DNA, 21 bp, Homo sapiens
taatataggttcacaactagt

SEQ ID NO: 8183308 - DNA, 22 bp, Homo sapiens
taatatatacctttgttaggaa

SEQ ID NO: 8183309 - DNA, 22 bp, Homo sapiens
taatatacttcccatagtttga

SEQ ID NO: 8183310 - DNA, 22 bp, Homo sapiens
taatatacttcccatagtttga

SEQ ID NO: 8183311 - DNA, 22 bp, Homo sapiens
taatataccaaactgtaatttt

SEQ ID NO: 8183312 - DNA, 22 bp, Homo sapiens
taatataccaaactgtaatttt

SEQ ID NO: 8183313 - DNA, 22 bp, Homo sapiens
taatataccaaactgtaatttt

SEQ ID NO: 8183314 - DNA, 19 bp, Homo sapiens
taatatacagacccatctg

SEQ ID NO: 8183315 - DNA, 22 bp, Homo sapiens
taaggacaatcaggttagtagc

SEQ ID NO: 8183316 - DNA, 22 bp, Homo sapiens
taaggacagcagctacttttcc

SEQ ID NO: 8183317 - DNA, 22 bp, Homo sapiens
taaggagagaatttagaggttt

SEQ ID NO: 8183318 - DNA, 22 bp, Homo sapiens
tacatgaagttgtctaaactgg

SEQ ID NO: 8183319 - DNA, 22 bp, Homo sapiens
tacatgaagaaaattaagcagt

SEQ ID NO: 8183320 - DNA, 22 bp, Homo sapiens
tacatgaagatgaatgtatggc

SEQ ID NO: 8183321 - DNA, 22 bp, Homo sapiens
tacatgaacctttatgtgtgat

SEQ ID NO: 8183322 - DNA, 22 bp, Homo sapiens
tacagtgtctggatatcaaagg

SEQ ID NO: 8183323 - DNA, 22 bp, Homo sapiens
tacagtgtgaataagcaggcat

SEQ ID NO: 8183324 - DNA, 22 bp, Homo sapiens
tacagtgtgacatttctacaaa

SEQ ID NO: 8183325 - DNA, 22 bp, Homo sapiens
tacagtgtgacatttctacaaa

SEQ ID NO: 8183326 - DNA, 22 bp, Homo sapiens
tacagtgtttcccccaggatag

SEQ ID NO: 8183327 - DNA, 22 bp, Homo sapiens
tacagtgtttcccccaggatag

SEQ ID NO: 8183328 - DNA, 22 bp, Homo sapiens
tacatgcacatgaacatgtgtg

SEQ ID NO: 8183329 - DNA, 22 bp, Homo sapiens
tacatgcatgtcacagaatgaa

SEQ ID NO: 8183330 - DNA, 22 bp, Homo sapiens
tacatgcaattaagagggtgaa

SEQ ID NO: 8183331 - DNA, 22 bp, Homo sapiens
tacatgcaatgaggattctagt

SEQ ID NO: 8183332 - DNA, 23 bp, Homo sapiens
tacatgctataatttcaccctca

SEQ ID NO: 8183333 - DNA, 22 bp, Homo sapiens
tacatgctcagtaactttcagt

SEQ ID NO: 8183334 - DNA, 23 bp, Homo sapiens
tacatgctataatttcaccctca

SEQ ID NO: 8183335 - DNA, 22 bp, Homo sapiens
tacatgctccactttctcctgt

SEQ ID NO: 8183336 - DNA, 22 bp, Homo sapiens
tacatgctccttatgagaatct

SEQ ID NO: 8183337 - DNA, 22 bp, Homo sapiens
tacatgcttaaaatgcaatgtt

SEQ ID NO: 8183338 - DNA, 22 bp, Homo sapiens
tacatgctggtgactgtagaca

SEQ ID NO: 8183339 - DNA, 22 bp, Homo sapiens
tacatgctcttcaaggactcat

SEQ ID NO: 8183340 - DNA, 19 bp, Homo sapiens
tacatgctcttggttcagg

SEQ ID NO: 8183341 - DNA, 22 bp, Homo sapiens
tacatgcttctatatgtgaagt

SEQ ID NO: 8183342 - DNA, 22 bp, Homo sapiens
tacatgcttccaactgccccat

SEQ ID NO: 8183343 - DNA, 22 bp, Homo sapiens
tacatggatgttatccttactg

SEQ ID NO: 8183344 - DNA, 22 bp, Homo sapiens
tacatgtaagacatgagactct

SEQ ID NO: 8183345 - DNA, 22 bp, Homo sapiens
tacatgtaattttcatagtaag

SEQ ID NO: 8183346 - DNA, 22 bp, Homo sapiens
tacatgtaagacatgagactct

SEQ ID NO: 8183347 - DNA, 22 bp, Homo sapiens
taccaagtgtattatgctttgt

SEQ ID NO: 8183348 - DNA, 22 bp, Homo sapiens
taccaagtgataataggaaagc

SEQ ID NO: 8183349 - DNA, 22 bp, Homo sapiens
taccaagtcatctattcccatg

SEQ ID NO: 8183350 - DNA, 22 bp, Homo sapiens
tacatgtaggtgacattttaat

SEQ ID NO: 8183351 - DNA, 22 bp, Homo sapiens
tacatgtaattttcatagtaag

SEQ ID NO: 8183352 - DNA, 22 bp, Homo sapiens
tacatgtacatgcataggtaga

SEQ ID NO: 8183353 - DNA, 22 bp, Homo sapiens
tacatgtacatgcataggtaga

SEQ ID NO: 8183354 - DNA, 22 bp, Homo sapiens
tacatgtacatgcataggtaga

SEQ ID NO: 8183355 - DNA, 22 bp, Homo sapiens
tacatgtatgtgttaatatctg

SEQ ID NO: 8183356 - DNA, 22 bp, Homo sapiens
tacatgtatgtgttaatatctg

SEQ ID NO: 8183357 - DNA, 22 bp, Homo sapiens
tacagagatgccgaagagtgaa

SEQ ID NO: 8183358 - DNA, 22 bp, Homo sapiens
tacagagatgccgaagagtgaa

SEQ ID NO: 8183359 - DNA, 22 bp, Homo sapiens
tacagacattcaattttgaccc

SEQ ID NO: 8183360 - DNA, 22 bp, Homo sapiens
tacagagatactctagatcaaa

SEQ ID NO: 8183361 - DNA, 22 bp, Homo sapiens
tacagacagtttttcagatatt

SEQ ID NO: 8183362 - DNA, 20 bp, Homo sapiens
tacagacatgacaataatgg

SEQ ID NO: 8183363 - DNA, 22 bp, Homo sapiens
tacagagagtacagcatccaca

SEQ ID NO: 8183364 - DNA, 22 bp, Homo sapiens
tacagagatttattgctaaggc

SEQ ID NO: 8183365 - DNA, 22 bp, Homo sapiens
tacagagatgtgaaaagctcta

SEQ ID NO: 8183366 - DNA, 22 bp, Homo sapiens
tacagagatttattgctaaggc

SEQ ID NO: 8183367 - DNA, 22 bp, Homo sapiens
tacagagatgtgaaaagctcta

SEQ ID NO: 8183368 - DNA, 22 bp, Homo sapiens
tacagtatcttctggcaagcat

SEQ ID NO: 8183369 - DNA, 22 bp, Homo sapiens
tacagtatggaaaatgtatagt

SEQ ID NO: 8183370 - DNA, 22 bp, Homo sapiens
tacagtagtatcttcatttgtt

SEQ ID NO: 8183371 - DNA, 22 bp, Homo sapiens
tacagtaggattttcagggtct

SEQ ID NO: 8183372 - DNA, 22 bp, Homo sapiens
tacagtagctgaggttctcagg

SEQ ID NO: 8183373 - DNA, 22 bp, Homo sapiens
tacagagtaatttgcatgggga

SEQ ID NO: 8183374 - DNA, 22 bp, Homo sapiens
tacagtggaaaactcagtgtgt

SEQ ID NO: 8183375 - DNA, 22 bp, Homo sapiens
tacagtgcttggtatctagtaa

SEQ ID NO: 8183376 - DNA, 22 bp, Homo sapiens
tacagtggggagctcaggagag

SEQ ID NO: 8183377 - DNA, 20 bp, Homo sapiens
tacagtgtatgtatttaggc

SEQ ID NO: 8183378 - DNA, 22 bp, Homo sapiens
tacagtgtctgcaactgcacac

SEQ ID NO: 8183379 - DNA, 22 bp, Homo sapiens
tacagtgtccctttttcagaca

SEQ ID NO: 8183380 - DNA, 22 bp, Homo sapiens
tacagtgtatgtatttgtaggt

SEQ ID NO: 8183381 - DNA, 22 bp, Homo sapiens
tacagtgtccctttttcagaca

SEQ ID NO: 8183382 - DNA, 20 bp, Homo sapiens
tacagtgtatgtatttaggc

SEQ ID NO: 8183383 - DNA, 22 bp, Homo sapiens
tacagtgcaatgtgatgtagat

SEQ ID NO: 8183384 - DNA, 22 bp, Homo sapiens
tacagtgagtggcagagccaga

SEQ ID NO: 8183385 - DNA, 22 bp, Homo sapiens
tacagtgcatagaggcatgata

SEQ ID NO: 8183386 - DNA, 22 bp, Homo sapiens
tacagtgcttggtatctagtaa

SEQ ID NO: 8183387 - DNA, 19 bp, Homo sapiens
tacagtgaaccaggaggag

SEQ ID NO: 8183388 - DNA, 22 bp, Homo sapiens
tacagtctctttgagtgattgt

SEQ ID NO: 8183389 - DNA, 22 bp, Homo sapiens
tacagtgaatgaatggctgtgc

SEQ ID NO: 8183390 - DNA, 22 bp, Homo sapiens
tacagtgaccctatttccaaat

SEQ ID NO: 8183391 - DNA, 22 bp, Homo sapiens
tacagtgacctagaataaatac

SEQ ID NO: 8183392 - DNA, 22 bp, Homo sapiens
tacagtgaccctatttccaaat

SEQ ID NO: 8183393 - DNA, 21 bp, Homo sapiens
tacagtgaggtgttaggatgt

SEQ ID NO: 8183394 - DNA, 22 bp, Homo sapiens
tacagtgagtggcagagccaga

SEQ ID NO: 8183395 - DNA, 22 bp, Homo sapiens
tacagtgagtggcagagccaga

SEQ ID NO: 8183396 - DNA, 22 bp, Homo sapiens
tacagtgaggtggtttccttta

SEQ ID NO: 8183397 - DNA, 22 bp, Homo sapiens
tacagtgagactggctcaggga

SEQ ID NO: 8183398 - DNA, 22 bp, Homo sapiens
tacagtctctttgagtgattgt

SEQ ID NO: 8183399 - DNA, 22 bp, Homo sapiens
tacagtctttggaaagagatag

SEQ ID NO: 8183400 - DNA, 20 bp, Homo sapiens
tacagtcagggcacaggcag

SEQ ID NO: 8183401 - DNA, 20 bp, Homo sapiens
tacagtcagggcacaggcag

SEQ ID NO: 8183402 - DNA, 22 bp, Homo sapiens
tacagtatttgaagaatatgag

SEQ ID NO: 8183403 - DNA, 22 bp, Homo sapiens
tacagtcaatactaggaccata

SEQ ID NO: 8183404 - DNA, 22 bp, Homo sapiens
tactgttttctttatagtacag

SEQ ID NO: 8183405 - DNA, 22 bp, Homo sapiens
tactgtttttaaaattgcatcc

SEQ ID NO: 8183406 - DNA, 22 bp, Homo sapiens
tacttacactgaagcaaagata

SEQ ID NO: 8183407 - DNA, 22 bp, Homo sapiens
tacttacactgaagcaaagata

SEQ ID NO: 8183408 - DNA, 22 bp, Homo sapiens
tacttacagaaggaagcaattg

SEQ ID NO: 8183409 - DNA, 22 bp, Homo sapiens
tacttacagaaggaagcaattg

SEQ ID NO: 8183410 - DNA, 22 bp, Homo sapiens
tacttacagagcttataagtta

SEQ ID NO: 8183411 - DNA, 22 bp, Homo sapiens
tacttacagttgatcgatgtat

SEQ ID NO: 8183412 - DNA, 22 bp, Homo sapiens
tacttacataaaaactgaatgt

SEQ ID NO: 8183413 - DNA, 22 bp, Homo sapiens
tacttacagttgatcgatgtat

SEQ ID NO: 8183414 - DNA, 22 bp, Homo sapiens
tacttacatgaattcaagagca

SEQ ID NO: 8183415 - DNA, 22 bp, Homo sapiens
tacttacatgaattcaagagca

SEQ ID NO: 8183416 - DNA, 22 bp, Homo sapiens
tacttacataaaaactgaatgt

SEQ ID NO: 8183417 - DNA, 22 bp, Homo sapiens
tacttaaaactgatagaatctc

SEQ ID NO: 8183418 - DNA, 22 bp, Homo sapiens
tacttaaaactgatagaatctc

SEQ ID NO: 8183419 - DNA, 22 bp, Homo sapiens
tacttaaaactgatagaatctc

SEQ ID NO: 8183420 - DNA, 22 bp, Homo sapiens
tacttaaataattgctgctatt

SEQ ID NO: 8183421 - DNA, 22 bp, Homo sapiens
tacttacacagctgtagaaggt

SEQ ID NO: 8183422 - DNA, 22 bp, Homo sapiens
tacttacacagctgtagaaggt

SEQ ID NO: 8183423 - DNA, 22 bp, Homo sapiens
tactctggaaaacagaaagttg

SEQ ID NO: 8183424 - DNA, 22 bp, Homo sapiens
tactctggagttgagatgcgag

SEQ ID NO: 8183425 - DNA, 22 bp, Homo sapiens
tactctggctgaggtttggatc

SEQ ID NO: 8183426 - DNA, 22 bp, Homo sapiens
tactctggccttcctgatttct

SEQ ID NO: 8183427 - DNA, 22 bp, Homo sapiens
tactctaacatttgttagatgt

SEQ ID NO: 8183428 - DNA, 22 bp, Homo sapiens
tactctcagggttagtacagga

SEQ ID NO: 8183429 - DNA, 22 bp, Homo sapiens
tactcctgctgatcctgccagc

SEQ ID NO: 8183430 - DNA, 22 bp, Homo sapiens
tactctaaaaagaagcagatct

SEQ ID NO: 8183431 - DNA, 22 bp, Homo sapiens
tactccaggactccatttgaaa

SEQ ID NO: 8183432 - DNA, 22 bp, Homo sapiens
tactgaaaaagaatccagacct

SEQ ID NO: 8183433 - DNA, 22 bp, Homo sapiens
tactctggttctacctccctgt

SEQ ID NO: 8183434 - DNA, 22 bp, Homo sapiens
tactcttttagccccacagaga

SEQ ID NO: 8183435 - DNA, 22 bp, Homo sapiens
tactctggtgttagtctttgca

SEQ ID NO: 8183436 - DNA, 22 bp, Homo sapiens
tactctgggtgatggttaaaag

SEQ ID NO: 8183437 - DNA, 22 bp, Homo sapiens
tactgaaactcttgtaaatatc

SEQ ID NO: 8183438 - DNA, 22 bp, Homo sapiens
tactgaaagaatacataatttc

SEQ ID NO: 8183439 - DNA, 22 bp, Homo sapiens
tactgtactgcagttctgcaaa

SEQ ID NO: 8183440 - DNA, 22 bp, Homo sapiens
tactgtactcaacatgtgagtt

SEQ ID NO: 8183441 - DNA, 22 bp, Homo sapiens
tactgaaacttttcttcaactg

SEQ ID NO: 8183442 - DNA, 22 bp, Homo sapiens
tactgtacattccgtttgttgc

SEQ ID NO: 8183443 - DNA, 22 bp, Homo sapiens
tactgtaatgagattagcttcc

SEQ ID NO: 8183444 - DNA, 22 bp, Homo sapiens
tactgaaagaatacataatttc

SEQ ID NO: 8183445 - DNA, 22 bp, Homo sapiens
tactgtactgtcttttttgctg

SEQ ID NO: 8183446 - DNA, 22 bp, Homo sapiens
tactgtgtgattccatttacgt

SEQ ID NO: 8183447 - DNA, 22 bp, Homo sapiens
tactgtgtgcccagccgagctg

SEQ ID NO: 8183448 - DNA, 22 bp, Homo sapiens
taccaggaatggggtcaccgtc

SEQ ID NO: 8183449 - DNA, 22 bp, Homo sapiens
taccaggaatgttttcaccact

SEQ ID NO: 8183450 - DNA, 22 bp, Homo sapiens
taccaggaatgttttcaccact

SEQ ID NO: 8183451 - DNA, 22 bp, Homo sapiens
taccaggaattattttacattt

SEQ ID NO: 8183452 - DNA, 22 bp, Homo sapiens
taccaggaattattttacattt

SEQ ID NO: 8183453 - DNA, 22 bp, Homo sapiens
taccagcatcacagcatgttgg

SEQ ID NO: 8183454 - DNA, 22 bp, Homo sapiens
taccacagacagatttcagtaa

SEQ ID NO: 8183455 - DNA, 22 bp, Homo sapiens
taccactgataccttggagttc

SEQ ID NO: 8183456 - DNA, 22 bp, Homo sapiens
taccagcaatgctagtcaactc

SEQ ID NO: 8183457 - DNA, 22 bp, Homo sapiens
taccattgtaccaaggtaattt

SEQ ID NO: 8183458 - DNA, 22 bp, Homo sapiens
taccatgatgtttgagttacta

SEQ ID NO: 8183459 - DNA, 22 bp, Homo sapiens
taccagggaacagggatattaa

SEQ ID NO: 8183460 - DNA, 22 bp, Homo sapiens
taccagggaacagggatattaa

SEQ ID NO: 8183461 - DNA, 22 bp, Homo sapiens
taccagggaacagggatattaa

SEQ ID NO: 8183462 - DNA, 22 bp, Homo sapiens
taccatgatcaggctcatcctt

SEQ ID NO: 8183463 - DNA, 22 bp, Homo sapiens
tactacaaggccgaagctctca

SEQ ID NO: 8183464 - DNA, 23 bp, Homo sapiens
tactacagggtcttgctatgaat

SEQ ID NO: 8183465 - DNA, 22 bp, Homo sapiens
tactactttcattcatctgact

SEQ ID NO: 8183466 - DNA, 22 bp, Homo sapiens
tactacattaataaaacattca

SEQ ID NO: 8183467 - DNA, 22 bp, Homo sapiens
tactacattaataaaacattca

SEQ ID NO: 8183468 - DNA, 22 bp, Homo sapiens
tactacatacagaatttagaga

SEQ ID NO: 8183469 - DNA, 22 bp, Homo sapiens
tactacatacagaatttagaga

SEQ ID NO: 8183470 - DNA, 23 bp, Homo sapiens
tactacagggtcttgctatgaat

SEQ ID NO: 8183471 - DNA, 21 bp, Homo sapiens
tactacagtctctttatcagt

SEQ ID NO: 8183472 - DNA, 22 bp, Homo sapiens
tactacagtatgtgtgttatac

SEQ ID NO: 8183473 - DNA, 22 bp, Homo sapiens
tactatactctccattttatag

SEQ ID NO: 8183474 - DNA, 23 bp, Homo sapiens
tactataacgctgtgtcagctcc

SEQ ID NO: 8183475 - DNA, 22 bp, Homo sapiens
tactataaagtcttaatgagtc

SEQ ID NO: 8183476 - DNA, 22 bp, Homo sapiens
tactatctggccctttacagaa

SEQ ID NO: 8183477 - DNA, 22 bp, Homo sapiens
tactatactctccattttatag

SEQ ID NO: 8183478 - DNA, 22 bp, Homo sapiens
tactataccatgtaagatatga

SEQ ID NO: 8183479 - DNA, 17 bp, Homo sapiens
tactatgagaaagtagg

SEQ ID NO: 8183480 - DNA, 22 bp, Homo sapiens
tactatgtgaaaatactatagt

SEQ ID NO: 8183481 - DNA, 23 bp, Homo sapiens
tactatggttattatccctctcc

SEQ ID NO: 8183482 - DNA, 21 bp, Homo sapiens
tactatgtagtgattgcagga

SEQ ID NO: 8183483 - DNA, 21 bp, Homo sapiens
tactatgtagtgattgcagga

SEQ ID NO: 8183484 - DNA, 22 bp, Homo sapiens
tactagtttctaccttacagaa

SEQ ID NO: 8183485 - DNA, 22 bp, Homo sapiens
tactagttctcatatgaaataa

SEQ ID NO: 8183486 - DNA, 22 bp, Homo sapiens
tactagttctcatatgaaataa

SEQ ID NO: 8183487 - DNA, 22 bp, Homo sapiens
tactagaagctgtaatttttca

SEQ ID NO: 8183488 - DNA, 22 bp, Homo sapiens
tagtttaaaagttagggatgat

SEQ ID NO: 8183489 - DNA, 22 bp, Homo sapiens
tagtttaatggtcaactaatga

SEQ ID NO: 8183490 - DNA, 22 bp, Homo sapiens
tagtttaatggtcaactaatga

SEQ ID NO: 8183491 - DNA, 22 bp, Homo sapiens
tagtttaatggtcaactaatga

SEQ ID NO: 8183492 - DNA, 22 bp, Homo sapiens
tagttcttcatgaattcagctt

SEQ ID NO: 8183493 - DNA, 22 bp, Homo sapiens
tagttctgtaacatttcaaggg

SEQ ID NO: 8183494 - DNA, 22 bp, Homo sapiens
tagttgaaagggattattgtgg

SEQ ID NO: 8183495 - DNA, 22 bp, Homo sapiens
tagtttactcatctataaaatg

SEQ ID NO: 8183496 - DNA, 22 bp, Homo sapiens
tagtttaccaaattgatcttcc

SEQ ID NO: 8183497 - DNA, 22 bp, Homo sapiens
tagtttaccaaattgatcttcc

SEQ ID NO: 8183498 - DNA, 22 bp, Homo sapiens
tagtttaccaaattgatcttcc

SEQ ID NO: 8183499 - DNA, 22 bp, Homo sapiens
tagtttaccaaattgatcttcc

SEQ ID NO: 8183500 - DNA, 22 bp, Homo sapiens
tagtttaatggtcaactaatga

SEQ ID NO: 8183501 - DNA, 22 bp, Homo sapiens
tagtttactgttcactttgccc

SEQ ID NO: 8183502 - DNA, 23 bp, Homo sapiens
tagttattttctctgtaatttgc

SEQ ID NO: 8183503 - DNA, 21 bp, Homo sapiens
tagttcaagttctttcagttc

SEQ ID NO: 8183504 - DNA, 22 bp, Homo sapiens
tagttctacagatggtttgtaa

SEQ ID NO: 8183505 - DNA, 23 bp, Homo sapiens
tagttacattattgtcagagctg

SEQ ID NO: 8183506 - DNA, 22 bp, Homo sapiens
tagttagagatgaattttgtct

SEQ ID NO: 8183507 - DNA, 22 bp, Homo sapiens
tagttatatccagtctttaaaa

SEQ ID NO: 8183508 - DNA, 22 bp, Homo sapiens
tagttatatccagtctttaaaa

SEQ ID NO: 8183509 - DNA, 22 bp, Homo sapiens
tagttacagcaggcaggatata

SEQ ID NO: 8183510 - DNA, 22 bp, Homo sapiens
tagttacagtgcatagcaagat

SEQ ID NO: 8183511 - DNA, 22 bp, Homo sapiens
tagttacagtgcatagcaagat

SEQ ID NO: 8183512 - DNA, 22 bp, Homo sapiens
tagttacagtgcatagcaagat

SEQ ID NO: 8183513 - DNA, 22 bp, Homo sapiens
tagttacataaagtggactgtt

SEQ ID NO: 8183514 - DNA, 22 bp, Homo sapiens
tagttacataaagtggactgtt

SEQ ID NO: 8183515 - DNA, 22 bp, Homo sapiens
tagttttttcaacaaatggtgc

SEQ ID NO: 8183516 - DNA, 22 bp, Homo sapiens
tagtttttaagtgtacaatttc

SEQ ID NO: 8183517 - DNA, 22 bp, Homo sapiens
tagttttatgaattggtataat

SEQ ID NO: 8183518 - DNA, 22 bp, Homo sapiens
tagtttttaagtgtacaatttc

SEQ ID NO: 8183519 - DNA, 22 bp, Homo sapiens
tagtttttaagtgtacaatttc

SEQ ID NO: 8183520 - DNA, 22 bp, Homo sapiens
tagttttataatgttaacatct

SEQ ID NO: 8183521 - DNA, 22 bp, Homo sapiens
tagttttataatgttaacatct

SEQ ID NO: 8183522 - DNA, 21 bp, Homo sapiens
tagtttctacccagttaatgg

SEQ ID NO: 8183523 - DNA, 22 bp, Homo sapiens
tagtttctaaagcttcctaggt

SEQ ID NO: 8183524 - DNA, 22 bp, Homo sapiens
tagtttcatctccaccctgccc

SEQ ID NO: 8183525 - DNA, 22 bp, Homo sapiens
tagtttcagattgctttcatat

SEQ ID NO: 8183526 - DNA, 22 bp, Homo sapiens
tagtttatgctgctgcagtgag

SEQ ID NO: 8183527 - DNA, 22 bp, Homo sapiens
tagtttatgctgctgcagtgag

SEQ ID NO: 8183528 - DNA, 22 bp, Homo sapiens
tagtttatgctgctgcagtgag

SEQ ID NO: 8183529 - DNA, 22 bp, Homo sapiens
tagtttatagttagcgagcacg

SEQ ID NO: 8183530 - DNA, 22 bp, Homo sapiens
tagtttatagttagcgagcacg

SEQ ID NO: 8183531 - DNA, 22 bp, Homo sapiens
tagtttatgattttttggaagg

SEQ ID NO: 8183532 - DNA, 22 bp, Homo sapiens
tagtttatgattttttggaagg

SEQ ID NO: 8183533 - DNA, 22 bp, Homo sapiens
tagtttatgattttttggaagg

SEQ ID NO: 8183534 - DNA, 22 bp, Homo sapiens
tagtttatgctgctgcagtgag

SEQ ID NO: 8183535 - DNA, 22 bp, Homo sapiens
tagtttaggtcgtacaagcaaa

SEQ ID NO: 8183536 - DNA, 22 bp, Homo sapiens
tagtttaggatcttttttgtgc

SEQ ID NO: 8183537 - DNA, 22 bp, Homo sapiens
tagtttatagttagcgagcacg

SEQ ID NO: 8183538 - DNA, 22 bp, Homo sapiens
tagtttatagttagcgagcacg

SEQ ID NO: 8183539 - DNA, 22 bp, Homo sapiens
tagtgctatagaagtgcttgcg

SEQ ID NO: 8183540 - DNA, 22 bp, Homo sapiens
tagtgcttaataaatttcagaa

SEQ ID NO: 8183541 - DNA, 22 bp, Homo sapiens
tagtgcttaacacaaagtgatt

SEQ ID NO: 8183542 - DNA, 22 bp, Homo sapiens
tagtgccctcccctttgggata

SEQ ID NO: 8183543 - DNA, 22 bp, Homo sapiens
tagtgccattcaagaggtagtt

SEQ ID NO: 8183544 - DNA, 22 bp, Homo sapiens
tagtgccatgcgaggggtggga

SEQ ID NO: 8183545 - DNA, 22 bp, Homo sapiens
tagtgccatcttgagctgcttt

SEQ ID NO: 8183546 - DNA, 22 bp, Homo sapiens
tagtggagaagtggagtctgtg

SEQ ID NO: 8183547 - DNA, 18 bp, Homo sapiens
tagtggaactgctctggg

SEQ ID NO: 8183548 - DNA, 18 bp, Homo sapiens
tagtggaactgctctggg

SEQ ID NO: 8183549 - DNA, 22 bp, Homo sapiens
tagtgctttggagctttctcct

SEQ ID NO: 8183550 - DNA, 22 bp, Homo sapiens
tagtgctttaagtttacagaga

SEQ ID NO: 8183551 - DNA, 22 bp, Homo sapiens
tagtgctttaggcctgagtgtc

SEQ ID NO: 8183552 - DNA, 22 bp, Homo sapiens
tagtgctttattgttcctgaaa

SEQ ID NO: 8183553 - DNA, 22 bp, Homo sapiens
tagtgcttgagtctctccgtac

SEQ ID NO: 8183554 - DNA, 22 bp, Homo sapiens
tagtgcttggccctaccagata

SEQ ID NO: 8183555 - DNA, 22 bp, Homo sapiens
tagtgctttaagtttacagaga

SEQ ID NO: 8183556 - DNA, 22 bp, Homo sapiens
tagtgcttaataaatttcagaa

SEQ ID NO: 8183557 - DNA, 22 bp, Homo sapiens
tagtgcttgagtctctccgtac

SEQ ID NO: 8183558 - DNA, 22 bp, Homo sapiens
tagtggagaggatgtggagaaa

SEQ ID NO: 8183559 - DNA, 22 bp, Homo sapiens
tagtggagaggatgtggagaaa

SEQ ID NO: 8183560 - DNA, 22 bp, Homo sapiens
tagtggaggggatgcaaagctt

SEQ ID NO: 8183561 - DNA, 22 bp, Homo sapiens
tagtggagagttgttttgtgca

SEQ ID NO: 8183562 - DNA, 22 bp, Homo sapiens
tagtggaggcctgttgtgtgca

SEQ ID NO: 8183563 - DNA, 22 bp, Homo sapiens
tagtggagtagaaaccaaagaa

SEQ ID NO: 8183564 - DNA, 22 bp, Homo sapiens
tagtggaggtggtctgtgaact

SEQ ID NO: 8183565 - DNA, 22 bp, Homo sapiens
tagtggaggtggtctgtgaact

SEQ ID NO: 8183566 - DNA, 22 bp, Homo sapiens
tagtggagggtgtagctgctgg

SEQ ID NO: 8183567 - DNA, 22 bp, Homo sapiens
tagttacaaaccaacaggcagc

SEQ ID NO: 8183568 - DNA, 22 bp, Homo sapiens
tagttacaaaccaacaggcagc

SEQ ID NO: 8183569 - DNA, 22 bp, Homo sapiens
tagttacaaaccaacaggcagc

SEQ ID NO: 8183570 - DNA, 22 bp, Homo sapiens
tagttacaattatgcatggaaa

SEQ ID NO: 8183571 - DNA, 22 bp, Homo sapiens
tagttacaatgggttctgtgac

SEQ ID NO: 8183572 - DNA, 22 bp, Homo sapiens
tagttacagagaaatgatttga

SEQ ID NO: 8183573 - DNA, 22 bp, Homo sapiens
taggggaggggatcatgtgctg

SEQ ID NO: 8183574 - DNA, 22 bp, Homo sapiens
taggggaggccaggaagtttta

SEQ ID NO: 8183575 - DNA, 22 bp, Homo sapiens
taggggaactggcacagggcag

SEQ ID NO: 8183576 - DNA, 22 bp, Homo sapiens
taggggaactggcacagggcag

SEQ ID NO: 8183577 - DNA, 21 bp, Homo sapiens
taggggctggggctccagctg

SEQ ID NO: 8183578 - DNA, 22 bp, Homo sapiens
tagtctctgctttgcccttggc

SEQ ID NO: 8183579 - DNA, 22 bp, Homo sapiens
tagtctctggagactctagggg

SEQ ID NO: 8183580 - DNA, 22 bp, Homo sapiens
tagtctctgctttgcccttggc

SEQ ID NO: 8183581 - DNA, 22 bp, Homo sapiens
tagtgcaaaggccctgagatgg

SEQ ID NO: 8183582 - DNA, 22 bp, Homo sapiens
tagtgcaacagggaaagagtgt

SEQ ID NO: 8183583 - DNA, 22 bp, Homo sapiens
tagtctctgttcccacaatgcc

SEQ ID NO: 8183584 - DNA, 22 bp, Homo sapiens
tagtctctgttgctgctttcat

SEQ ID NO: 8183585 - DNA, 22 bp, Homo sapiens
tagtctctgtggtcctgaggaa

SEQ ID NO: 8183586 - DNA, 22 bp, Homo sapiens
tagtctctgtggtcctgaggaa

SEQ ID NO: 8183587 - DNA, 22 bp, Homo sapiens
tagtgccaccttccaagtatca

SEQ ID NO: 8183588 - DNA, 22 bp, Homo sapiens
tagtgccaccactgtctttggc

SEQ ID NO: 8183589 - DNA, 22 bp, Homo sapiens
tagtgccaaagcctggtgtcat

SEQ ID NO: 8183590 - DNA, 22 bp, Homo sapiens
tagtgcagaggaggagcctctg

SEQ ID NO: 8183591 - DNA, 22 bp, Homo sapiens
tagctgggactactggccctgc

SEQ ID NO: 8183592 - DNA, 22 bp, Homo sapiens
tagctggggctttcattcttgc

SEQ ID NO: 8183593 - DNA, 22 bp, Homo sapiens
tagctgggagtgtctgatgggt

SEQ ID NO: 8183594 - DNA, 22 bp, Homo sapiens
tagctgggagtgtctgatgggt

SEQ ID NO: 8183595 - DNA, 22 bp, Homo sapiens
tagctgggagtgtctgatgggt

SEQ ID NO: 8183596 - DNA, 22 bp, Homo sapiens
tagctgggttgaggtcatctac

SEQ ID NO: 8183597 - DNA, 22 bp, Homo sapiens
tagctggtctttaagcatgtaa

SEQ ID NO: 8183598 - DNA, 22 bp, Homo sapiens
tagctgggtctctgttttctca

SEQ ID NO: 8183599 - DNA, 22 bp, Homo sapiens
tagctgtcagcaatcaagtggt

SEQ ID NO: 8183600 - DNA, 22 bp, Homo sapiens
tagctgtcaccagaaatggcca

SEQ ID NO: 8183601 - DNA, 22 bp, Homo sapiens
tagctggttctccaggagctag

SEQ ID NO: 8183602 - DNA, 22 bp, Homo sapiens
tagctgtgaaacagcagaagag

SEQ ID NO: 8183603 - DNA, 22 bp, Homo sapiens
tagctgtccagtgagtcccttt

SEQ ID NO: 8183604 - DNA, 22 bp, Homo sapiens
tagctgtccagtgagtcccttt

SEQ ID NO: 8183605 - DNA, 20 bp, Homo sapiens
taggcagagctgtgcagcct

SEQ ID NO: 8183606 - DNA, 20 bp, Homo sapiens
taggcagagctgtgcagcct

SEQ ID NO: 8183607 - DNA, 20 bp, Homo sapiens
taggcagagctgtgcagcct

SEQ ID NO: 8183608 - DNA, 20 bp, Homo sapiens
taggcagagctgtgcagcct

SEQ ID NO: 8183609 - DNA, 22 bp, Homo sapiens
taggcagaattgtgggctctaa

SEQ ID NO: 8183610 - DNA, 22 bp, Homo sapiens
tagctgtgtaagcttggtaaga

SEQ ID NO: 8183611 - DNA, 22 bp, Homo sapiens
taggcagaaaggaaggcaagtt

SEQ ID NO: 8183612 - DNA, 17 bp, Homo sapiens
tagctgtgtttcagcta

SEQ ID NO: 8183613 - DNA, 21 bp, Homo sapiens
taggcagaggagcaggtatct

SEQ ID NO: 8183614 - DNA, 21 bp, Homo sapiens
taggcagaggagcaggtatct

SEQ ID NO: 8183615 - DNA, 22 bp, Homo sapiens
taggcagaggtatggtaaggac

SEQ ID NO: 8183616 - DNA, 22 bp, Homo sapiens
taggcagatgttaacaggaaaa

SEQ ID NO: 8183617 - DNA, 22 bp, Homo sapiens
taggcagatgttaacaggaaaa

SEQ ID NO: 8183618 - DNA, 22 bp, Homo sapiens
taggcagatgttaacaggaaaa

SEQ ID NO: 8183619 - DNA, 22 bp, Homo sapiens
taggcagagtttaatggttaag

SEQ ID NO: 8183620 - DNA, 23 bp, Homo sapiens
taggcaggactcagatatgacag

SEQ ID NO: 8183621 - DNA, 23 bp, Homo sapiens
taggcaggactcagatatgacag

SEQ ID NO: 8183622 - DNA, 23 bp, Homo sapiens
taggcaggactcagatatgacag

SEQ ID NO: 8183623 - DNA, 23 bp, Homo sapiens
taggcaggactcagatatgacag

SEQ ID NO: 8183624 - DNA, 22 bp, Homo sapiens
taggcagattccatattttggc

SEQ ID NO: 8183625 - DNA, 22 bp, Homo sapiens
taggccaggagtcagacagatt

SEQ ID NO: 8183626 - DNA, 22 bp, Homo sapiens
taggccaggagtcagacagatt

SEQ ID NO: 8183627 - DNA, 23 bp, Homo sapiens
taggccagggtgacctggggaga

SEQ ID NO: 8183628 - DNA, 23 bp, Homo sapiens
taggccagggtgacctggggaga

SEQ ID NO: 8183629 - DNA, 22 bp, Homo sapiens
taggccaggacagagcttccag

SEQ ID NO: 8183630 - DNA, 22 bp, Homo sapiens
taggccaggagtcagacagatt

SEQ ID NO: 8183631 - DNA, 22 bp, Homo sapiens
taggccaggacagagcttccag

SEQ ID NO: 8183632 - DNA, 22 bp, Homo sapiens
taggccaggacagagcttccag

SEQ ID NO: 8183633 - DNA, 23 bp, Homo sapiens
taggccagggtgacctggggaga

SEQ ID NO: 8183634 - DNA, 22 bp, Homo sapiens
taggccagtaaaatgtttcagt

SEQ ID NO: 8183635 - DNA, 22 bp, Homo sapiens
taggccagtaaaatgtttcagt

SEQ ID NO: 8183636 - DNA, 18 bp, Homo sapiens
taggccagtatacttttc

SEQ ID NO: 8183637 - DNA, 18 bp, Homo sapiens
taggccagtatacttttc

SEQ ID NO: 8183638 - DNA, 22 bp, Homo sapiens
taggccagtaaaatgtttcagt

SEQ ID NO: 8183639 - DNA, 22 bp, Homo sapiens
taggccagtggcaggttgtgtg

SEQ ID NO: 8183640 - DNA, 22 bp, Homo sapiens
taggccagtggcaggttgtgtg

SEQ ID NO: 8183641 - DNA, 22 bp, Homo sapiens
taggccagtggcaggttgtgtg

SEQ ID NO: 8183642 - DNA, 22 bp, Homo sapiens
taggccagttggtggccctgga

SEQ ID NO: 8183643 - DNA, 22 bp, Homo sapiens
taggcaggctgaatgtagattt

SEQ ID NO: 8183644 - DNA, 22 bp, Homo sapiens
taggcaggctgaatgtagattt

SEQ ID NO: 8183645 - DNA, 22 bp, Homo sapiens
taggcaggctgaatgtagattt

SEQ ID NO: 8183646 - DNA, 22 bp, Homo sapiens
taggcaggctgaatgtagattt

SEQ ID NO: 8183647 - DNA, 22 bp, Homo sapiens
taggcaggctgaatgtagattt

SEQ ID NO: 8183648 - DNA, 22 bp, Homo sapiens
taggcaggctgaatgtagattt

SEQ ID NO: 8183649 - DNA, 22 bp, Homo sapiens
taggccagattactagagtagg

SEQ ID NO: 8183650 - DNA, 22 bp, Homo sapiens
taggccagattactagagtagg

SEQ ID NO: 8183651 - DNA, 22 bp, Homo sapiens
taggccagattactagagtagg

SEQ ID NO: 8183652 - DNA, 22 bp, Homo sapiens
taggccagattactagagtagg

SEQ ID NO: 8183653 - DNA, 22 bp, Homo sapiens
taggcagggattagggttgatt

SEQ ID NO: 8183654 - DNA, 22 bp, Homo sapiens
taggccagcccttagtcctgtc

SEQ ID NO: 8183655 - DNA, 22 bp, Homo sapiens
taggccagcccttagtcctgtc

SEQ ID NO: 8183656 - DNA, 22 bp, Homo sapiens
taggccagcccttagtcctgtc

SEQ ID NO: 8183657 - DNA, 22 bp, Homo sapiens
taggccagattgttatccatgg

SEQ ID NO: 8183658 - DNA, 22 bp, Homo sapiens
taggccagattgttatccatgg

SEQ ID NO: 8183659 - DNA, 22 bp, Homo sapiens
taggccagcccttagtcctgtc

SEQ ID NO: 8183660 - DNA, 22 bp, Homo sapiens
taggccaggaatcagcaagctt

SEQ ID NO: 8183661 - DNA, 22 bp, Homo sapiens
taggccaggaatcagcaagctt

SEQ ID NO: 8183662 - DNA, 22 bp, Homo sapiens
taggccaggaatcagcaagctt

SEQ ID NO: 8183663 - DNA, 22 bp, Homo sapiens
tagggcagccacccaggctgct

SEQ ID NO: 8183664 - DNA, 22 bp, Homo sapiens
tagggcagattcggtggagttt

SEQ ID NO: 8183665 - DNA, 22 bp, Homo sapiens
tagggcagccacccaggctgct

SEQ ID NO: 8183666 - DNA, 22 bp, Homo sapiens
tagggcagccacccaggctgct

SEQ ID NO: 8183667 - DNA, 22 bp, Homo sapiens
tagggcagccacccaggctgct

SEQ ID NO: 8183668 - DNA, 22 bp, Homo sapiens
tagggcagagtccaggatgggc

SEQ ID NO: 8183669 - DNA, 22 bp, Homo sapiens
tagggcagagtccaggatgggc

SEQ ID NO: 8183670 - DNA, 22 bp, Homo sapiens
tagggcagagtccaggatgggc

SEQ ID NO: 8183671 - DNA, 22 bp, Homo sapiens
taggccagttggtggccctgga

SEQ ID NO: 8183672 - DNA, 22 bp, Homo sapiens
taggccattgatttttataagt

SEQ ID NO: 8183673 - DNA, 22 bp, Homo sapiens
taggcccagttccgcctcccgg

SEQ ID NO: 8183674 - DNA, 22 bp, Homo sapiens
tagggcagctgcatcaggcact

SEQ ID NO: 8183675 - DNA, 23 bp, Homo sapiens
tagggcagctgggagggacatgc

SEQ ID NO: 8183676 - DNA, 22 bp, Homo sapiens
tagggcagctgcatcaggcact

SEQ ID NO: 8183677 - DNA, 22 bp, Homo sapiens
tagggcagccttatagctccca

SEQ ID NO: 8183678 - DNA, 22 bp, Homo sapiens
tagggcagctgcatcaggcact

SEQ ID NO: 8183679 - DNA, 22 bp, Homo sapiens
tagggcagctgcatcaggcact

SEQ ID NO: 8183680 - DNA, 23 bp, Homo sapiens
tagggcagctgggagggacatgc

SEQ ID NO: 8183681 - DNA, 23 bp, Homo sapiens
tagggcagctgggagggacatgc

SEQ ID NO: 8183682 - DNA, 23 bp, Homo sapiens
tagggcagctgggagggacatgc

SEQ ID NO: 8183683 - DNA, 22 bp, Homo sapiens
tagggctgaggcaacaagggag

SEQ ID NO: 8183684 - DNA, 22 bp, Homo sapiens
tagggctgtttaaaagtgaggt

SEQ ID NO: 8183685 - DNA, 22 bp, Homo sapiens
tagggctgtttaaaagtgaggt

SEQ ID NO: 8183686 - DNA, 22 bp, Homo sapiens
tagggctgtttaaaagtgaggt

SEQ ID NO: 8183687 - DNA, 22 bp, Homo sapiens
tagggctgtgtctccaggacca

SEQ ID NO: 8183688 - DNA, 22 bp, Homo sapiens
tagggctgtgtctccaggacca

SEQ ID NO: 8183689 - DNA, 22 bp, Homo sapiens
tagggctgttagtaattctcag

SEQ ID NO: 8183690 - DNA, 16 bp, Homo sapiens
tagggctgggaaggag

SEQ ID NO: 8183691 - DNA, 16 bp, Homo sapiens
tagggctgggaaggag

SEQ ID NO: 8183692 - DNA, 22 bp, Homo sapiens
tagggctggcgtgctcagggaa

SEQ ID NO: 8183693 - DNA, 22 bp, Homo sapiens
tagggctgggtacactcttgcc

SEQ ID NO: 8183694 - DNA, 22 bp, Homo sapiens
tagggctgtgtctccaggacca

SEQ ID NO: 8183695 - DNA, 22 bp, Homo sapiens
tagggctgtggtcagtcctcta

SEQ ID NO: 8183696 - DNA, 22 bp, Homo sapiens
tagggctgtggtcagtcctcta

SEQ ID NO: 8183697 - DNA, 22 bp, Homo sapiens
tagggctgggtacactcttgcc

SEQ ID NO: 8183698 - DNA, 22 bp, Homo sapiens
tagggctgcctatggctagata

SEQ ID NO: 8183699 - DNA, 22 bp, Homo sapiens
tagggctgcctatggctagata

SEQ ID NO: 8183700 - DNA, 22 bp, Homo sapiens
tagggctgccatttgcttttct

SEQ ID NO: 8183701 - DNA, 22 bp, Homo sapiens
tagggctgccatttgcttttct

SEQ ID NO: 8183702 - DNA, 22 bp, Homo sapiens
tagggctgctgcagatgacagg

SEQ ID NO: 8183703 - DNA, 22 bp, Homo sapiens
tagggctgcctatggctagata

SEQ ID NO: 8183704 - DNA, 22 bp, Homo sapiens
tagggctgcagaacaatggcct

SEQ ID NO: 8183705 - DNA, 22 bp, Homo sapiens
tagggctgccatttgcttttct

SEQ ID NO: 8183706 - DNA, 22 bp, Homo sapiens
tagggctgcagaacaatggcct

SEQ ID NO: 8183707 - DNA, 19 bp, Homo sapiens
tagggctggccgggcggtg

SEQ ID NO: 8183708 - DNA, 19 bp, Homo sapiens
tagggctggccgggcggtg

SEQ ID NO: 8183709 - DNA, 22 bp, Homo sapiens
tagggctggcgtgctcagggaa

SEQ ID NO: 8183710 - DNA, 22 bp, Homo sapiens
tagggctgctttgtattctgct

SEQ ID NO: 8183711 - DNA, 19 bp, Homo sapiens
tagggctggccgggcggtg

SEQ ID NO: 8183712 - DNA, 22 bp, Homo sapiens
tagggctgctgcagatgacagg

SEQ ID NO: 8183713 - DNA, 22 bp, Homo sapiens
tagaaatggggaagtagttagg

SEQ ID NO: 8183714 - DNA, 22 bp, Homo sapiens
tagaaatgggttacatttagag

SEQ ID NO: 8183715 - DNA, 22 bp, Homo sapiens
tacttacattagcaaacaaggt

SEQ ID NO: 8183716 - DNA, 22 bp, Homo sapiens
tacttacattagcaaacaaggt

SEQ ID NO: 8183717 - DNA, 22 bp, Homo sapiens
tagaacatgtgaaaatatagcc

SEQ ID NO: 8183718 - DNA, 22 bp, Homo sapiens
tagaacatgctcatgtataaat

SEQ ID NO: 8183719 - DNA, 22 bp, Homo sapiens
tagaactagaacaaggatttga

SEQ ID NO: 8183720 - DNA, 22 bp, Homo sapiens
tagaactagaacaaggatttga

SEQ ID NO: 8183721 - DNA, 22 bp, Homo sapiens
tagaactaaagaacaactttga

SEQ ID NO: 8183722 - DNA, 22 bp, Homo sapiens
tagaactaaagaacaactttga

SEQ ID NO: 8183723 - DNA, 22 bp, Homo sapiens
tagaacttagcactagacttgt

SEQ ID NO: 8183724 - DNA, 22 bp, Homo sapiens
tagaacttagcactagacttgt

SEQ ID NO: 8183725 - DNA, 22 bp, Homo sapiens
tagaacttcttacagctaagtt

SEQ ID NO: 8183726 - DNA, 22 bp, Homo sapiens
tagaagcacagcctgatggaca

SEQ ID NO: 8183727 - DNA, 21 bp, Homo sapiens
tagaagcacataggttcaaag

SEQ ID NO: 8183728 - DNA, 22 bp, Homo sapiens
tagaagcacagcctgatggaca

SEQ ID NO: 8183729 - DNA, 22 bp, Homo sapiens
tagaagcacagcctgatggaca

SEQ ID NO: 8183730 - DNA, 22 bp, Homo sapiens
tagaagattctgccaagagcgc

SEQ ID NO: 8183731 - DNA, 22 bp, Homo sapiens
tagaagatcttaaaagctgact

SEQ ID NO: 8183732 - DNA, 22 bp, Homo sapiens
tagaagattcatttcctctgaa

SEQ ID NO: 8183733 - DNA, 22 bp, Homo sapiens
tagaagaacatgtcaaactata

SEQ ID NO: 8183734 - DNA, 22 bp, Homo sapiens
tagaagaacatgtcaaactata

SEQ ID NO: 8183735 - DNA, 22 bp, Homo sapiens
tagaagaaaagcacttagagat

SEQ ID NO: 8183736 - DNA, 22 bp, Homo sapiens
tagaagaaagtgaagctgggga

SEQ ID NO: 8183737 - DNA, 22 bp, Homo sapiens
tagaagaaagtgaagctgggga

SEQ ID NO: 8183738 - DNA, 22 bp, Homo sapiens
tagaagaaaagcacttagagat

SEQ ID NO: 8183739 - DNA, 21 bp, Homo sapiens
tagaccagctgtgctcctcgg

SEQ ID NO: 8183740 - DNA, 22 bp, Homo sapiens
tagaccattttacaatagtgtg

SEQ ID NO: 8183741 - DNA, 22 bp, Homo sapiens
tagaccaggttgaccaggtagg

SEQ ID NO: 8183742 - DNA, 22 bp, Homo sapiens
tagacaggaaacattaggatgg

SEQ ID NO: 8183743 - DNA, 22 bp, Homo sapiens
tagaccagaattgtcagcacct

SEQ ID NO: 8183744 - DNA, 22 bp, Homo sapiens
tagactatagctcacagtgctt

SEQ ID NO: 8183745 - DNA, 22 bp, Homo sapiens
tagactggtgaattagggggaa

SEQ ID NO: 8183746 - DNA, 22 bp, Homo sapiens
tagactggtgaattagggggaa

SEQ ID NO: 8183747 - DNA, 22 bp, Homo sapiens
tagactggtgaattagggggaa

SEQ ID NO: 8183748 - DNA, 22 bp, Homo sapiens
tagactggtgaattagggggaa

SEQ ID NO: 8183749 - DNA, 22 bp, Homo sapiens
tagactggtgaattagggggaa

SEQ ID NO: 8183750 - DNA, 22 bp, Homo sapiens
tagatacttataatcttccaag

SEQ ID NO: 8183751 - DNA, 22 bp, Homo sapiens
tagatagattctcctatagagt

SEQ ID NO: 8183752 - DNA, 23 bp, Homo sapiens
tagatagcacactgacatctgac

SEQ ID NO: 8183753 - DNA, 22 bp, Homo sapiens
tagatacctgctggacctcatt

SEQ ID NO: 8183754 - DNA, 19 bp, Homo sapiens
tagatactgatgaactcca

SEQ ID NO: 8183755 - DNA, 22 bp, Homo sapiens
tagatactgcccattgagcaat

SEQ ID NO: 8183756 - DNA, 23 bp, Homo sapiens
tagatactgcatataggtggaat

SEQ ID NO: 8183757 - DNA, 21 bp, Homo sapiens
tagatactgtattaaacctag

SEQ ID NO: 8183758 - DNA, 22 bp, Homo sapiens
tagagtctagtgtatacaaagt

SEQ ID NO: 8183759 - DNA, 22 bp, Homo sapiens
tagatacatacattttaaaatg

SEQ ID NO: 8183760 - DNA, 22 bp, Homo sapiens
tagatataaggtccttagaaca

SEQ ID NO: 8183761 - DNA, 22 bp, Homo sapiens
tagatataaggtccttagaaca

SEQ ID NO: 8183762 - DNA, 22 bp, Homo sapiens
tagatataaggtccttagaaca

SEQ ID NO: 8183763 - DNA, 22 bp, Homo sapiens
tagatataaggtccttagaaca

SEQ ID NO: 8183764 - DNA, 22 bp, Homo sapiens
tagatataggacagtactgtat

SEQ ID NO: 8183765 - DNA, 22 bp, Homo sapiens
tagatataaggtccttagaaca

SEQ ID NO: 8183766 - DNA, 22 bp, Homo sapiens
tagatataaggtccttagaaca

SEQ ID NO: 8183767 - DNA, 22 bp, Homo sapiens
tagatatgtagtttttacagta

SEQ ID NO: 8183768 - DNA, 22 bp, Homo sapiens
tagatataggacagtactgtat

SEQ ID NO: 8183769 - DNA, 22 bp, Homo sapiens
tagatataggacagtactgtat

SEQ ID NO: 8183770 - DNA, 22 bp, Homo sapiens
tagatataggacagtactgtat

SEQ ID NO: 8183771 - DNA, 22 bp, Homo sapiens
tagatatatctgtcatactggt

SEQ ID NO: 8183772 - DNA, 22 bp, Homo sapiens
tagatatatctgtcatactggt

SEQ ID NO: 8183773 - DNA, 22 bp, Homo sapiens
tagatatgtatacttgtttgag

SEQ ID NO: 8183774 - DNA, 22 bp, Homo sapiens
tagatatgtgtttattatgctg

SEQ ID NO: 8183775 - DNA, 22 bp, Homo sapiens
tagatcatatttgtggagaaaa

SEQ ID NO: 8183776 - DNA, 22 bp, Homo sapiens
tagatcatggagtaaaatggaa

SEQ ID NO: 8183777 - DNA, 22 bp, Homo sapiens
tagatcatgggtactgcatatg

SEQ ID NO: 8183778 - DNA, 21 bp, Homo sapiens
tagatcatggtattctttggc

SEQ ID NO: 8183779 - DNA, 22 bp, Homo sapiens
tagatcctgagccctatctact

SEQ ID NO: 8183780 - DNA, 22 bp, Homo sapiens
tagagagagctgtggtggctct

SEQ ID NO: 8183781 - DNA, 22 bp, Homo sapiens
tagagaatggccttgaagtagt

SEQ ID NO: 8183782 - DNA, 22 bp, Homo sapiens
tagagaacaagtatggcacgga

SEQ ID NO: 8183783 - DNA, 22 bp, Homo sapiens
tagagaactcagtgtgcagcct

SEQ ID NO: 8183784 - DNA, 22 bp, Homo sapiens
tagagacagaaagtagaatggt

SEQ ID NO: 8183785 - DNA, 20 bp, Homo sapiens
tagagagatatgggggttcc

SEQ ID NO: 8183786 - DNA, 22 bp, Homo sapiens
tagagaggccgcgggtcccctc

SEQ ID NO: 8183787 - DNA, 22 bp, Homo sapiens
tagagaggccgcgggtcccctc

SEQ ID NO: 8183788 - DNA, 16 bp, Homo sapiens
tagagagggcagggag

SEQ ID NO: 8183789 - DNA, 16 bp, Homo sapiens
tagagagggcagggag

SEQ ID NO: 8183790 - DNA, 22 bp, Homo sapiens
tagagaggtttgaattggctgc

SEQ ID NO: 8183791 - DNA, 22 bp, Homo sapiens
tagagaggtttgaattggctgc

SEQ ID NO: 8183792 - DNA, 22 bp, Homo sapiens
tagagtatagctaactgtatta

SEQ ID NO: 8183793 - DNA, 22 bp, Homo sapiens
tagagtatagctaactgtatta

SEQ ID NO: 8183794 - DNA, 22 bp, Homo sapiens
tagagaaacagaaccaacaggg

SEQ ID NO: 8183795 - DNA, 20 bp, Homo sapiens
tagacttttcatcaacctta

SEQ ID NO: 8183796 - DNA, 22 bp, Homo sapiens
tagcaacataagaaacattttg

SEQ ID NO: 8183797 - DNA, 21 bp, Homo sapiens
tagcaaattggtggaatggga

SEQ ID NO: 8183798 - DNA, 22 bp, Homo sapiens
tagcaaccagaacagcactcta

SEQ ID NO: 8183799 - DNA, 22 bp, Homo sapiens
tagcagctctttactaaccagt

SEQ ID NO: 8183800 - DNA, 22 bp, Homo sapiens
tagcagctctgattctgggccc

SEQ ID NO: 8183801 - DNA, 21 bp, Homo sapiens
tagcaaatggagagtaagaga

SEQ ID NO: 8183802 - DNA, 22 bp, Homo sapiens
tagcaaatgtctgaaggaatag

SEQ ID NO: 8183803 - DNA, 22 bp, Homo sapiens
tagcaaagttttgtggtgatta

SEQ ID NO: 8183804 - DNA, 23 bp, Homo sapiens
tagcaaagttgtttgggaaattt

SEQ ID NO: 8183805 - DNA, 22 bp, Homo sapiens
tagcaaaggccttggacacgct

SEQ ID NO: 8183806 - DNA, 22 bp, Homo sapiens
tagcaaagaacctgatacccca

SEQ ID NO: 8183807 - DNA, 22 bp, Homo sapiens
tagcaaactcatacatgtgggt

SEQ ID NO: 8183808 - DNA, 22 bp, Homo sapiens
tagcaaagaagatattattgca

SEQ ID NO: 8183809 - DNA, 22 bp, Homo sapiens
tagcaaaatgtggatgtagttg

SEQ ID NO: 8183810 - DNA, 22 bp, Homo sapiens
tagcaaaatgtggatgtagttg

SEQ ID NO: 8183811 - DNA, 18 bp, Homo sapiens
tagcaaagatgtggattg

SEQ ID NO: 8183812 - DNA, 22 bp, Homo sapiens
tagatgaagcaacatgtgtaat

SEQ ID NO: 8183813 - DNA, 22 bp, Homo sapiens
tagatgaagcaacatgtgtaat

SEQ ID NO: 8183814 - DNA, 22 bp, Homo sapiens
tagatgaagagggtaggtagat

SEQ ID NO: 8183815 - DNA, 22 bp, Homo sapiens
tagcaaaagctcaacaggaagg

SEQ ID NO: 8183816 - DNA, 22 bp, Homo sapiens
tagatgaccttgtgttaggcaa

SEQ ID NO: 8183817 - DNA, 22 bp, Homo sapiens
tagatgaccttgtgttaggcaa

SEQ ID NO: 8183818 - DNA, 21 bp, Homo sapiens
tagatgaaatcagagtatttc

SEQ ID NO: 8183819 - DNA, 22 bp, Homo sapiens
tagatgaaaggtctagcacagt

SEQ ID NO: 8183820 - DNA, 22 bp, Homo sapiens
tagatgaaatttgtgtgtatgc

SEQ ID NO: 8183821 - DNA, 22 bp, Homo sapiens
tagatgaaaggtctagcacagt

SEQ ID NO: 8183822 - DNA, 22 bp, Homo sapiens
tagatgaaagagggcctgtgag

SEQ ID NO: 8183823 - DNA, 22 bp, Homo sapiens
tagatcctgcataggttgtgct

SEQ ID NO: 8183824 - DNA, 20 bp, Homo sapiens
tagatcctggggatttattg

SEQ ID NO: 8183825 - DNA, 22 bp, Homo sapiens
tagcagggttttgaagagggtt

SEQ ID NO: 8183826 - DNA, 22 bp, Homo sapiens
tagcagggtctcaggagtcagg

SEQ ID NO: 8183827 - DNA, 22 bp, Homo sapiens
tagcagggtctcaggagtcagg

SEQ ID NO: 8183828 - DNA, 22 bp, Homo sapiens
tagctgccaaaagggtgggcta

SEQ ID NO: 8183829 - DNA, 22 bp, Homo sapiens
tagcagggtctcaggagtcagg

SEQ ID NO: 8183830 - DNA, 22 bp, Homo sapiens
tagcagggtccaatgtgaggca

SEQ ID NO: 8183831 - DNA, 22 bp, Homo sapiens
tagcagggtccaatgtgaggca

SEQ ID NO: 8183832 - DNA, 22 bp, Homo sapiens
tagcaggggtagatagagtgtg

SEQ ID NO: 8183833 - DNA, 22 bp, Homo sapiens
tagcaggggtagatagagtgtg

SEQ ID NO: 8183834 - DNA, 22 bp, Homo sapiens
tagcaggggtagatagagtgtg

SEQ ID NO: 8183835 - DNA, 22 bp, Homo sapiens
tagcagggtaaatgtagatgga

SEQ ID NO: 8183836 - DNA, 22 bp, Homo sapiens
tagctgcctttgggctcctgct

SEQ ID NO: 8183837 - DNA, 22 bp, Homo sapiens
tagctgcctttgggctcctgct

SEQ ID NO: 8183838 - DNA, 19 bp, Homo sapiens
tagctgcctgttacctcca

SEQ ID NO: 8183839 - DNA, 22 bp, Homo sapiens
tagctgcctatgtgataagaga

SEQ ID NO: 8183840 - DNA, 22 bp, Homo sapiens
tagctgccagaccattcttact

SEQ ID NO: 8183841 - DNA, 22 bp, Homo sapiens
tagctgccattgctccaggaag

SEQ ID NO: 8183842 - DNA, 22 bp, Homo sapiens
tagctgcctagacagctatagc

SEQ ID NO: 8183843 - DNA, 22 bp, Homo sapiens
tagctgcccatctttcctttag

SEQ ID NO: 8183844 - DNA, 17 bp, Homo sapiens
tagctgccccgaatgct

SEQ ID NO: 8183845 - DNA, 22 bp, Homo sapiens
tagctggctaatagtatgaata

SEQ ID NO: 8183846 - DNA, 22 bp, Homo sapiens
tagctggcttatataaaagggc

SEQ ID NO: 8183847 - DNA, 22 bp, Homo sapiens
tagctgggaattatctggttgc

SEQ ID NO: 8183848 - DNA, 22 bp, Homo sapiens
tagctgggaattatctggttgc

SEQ ID NO: 8183849 - DNA, 17 bp, Homo sapiens
tagctggcactggggtt

SEQ ID NO: 8183850 - DNA, 22 bp, Homo sapiens
tagctggcatggccctgtggga

SEQ ID NO: 8183851 - DNA, 22 bp, Homo sapiens
tagctggccctgggactcccgg

SEQ ID NO: 8183852 - DNA, 22 bp, Homo sapiens
tagctgcttcagtctaggtctc

SEQ ID NO: 8183853 - DNA, 22 bp, Homo sapiens
tagctggcaaaacattatttct

SEQ ID NO: 8183854 - DNA, 22 bp, Homo sapiens
tagctggcaaaggggaattagg

SEQ ID NO: 8183855 - DNA, 22 bp, Homo sapiens
tagctgcttctcacatgggcaa

SEQ ID NO: 8183856 - DNA, 22 bp, Homo sapiens
tagcagggccaggctgggaacc

SEQ ID NO: 8183857 - DNA, 22 bp, Homo sapiens
tagcagggccaggctgggaacc

SEQ ID NO: 8183858 - DNA, 22 bp, Homo sapiens
tagcagggatacaaggtcgcct

SEQ ID NO: 8183859 - DNA, 22 bp, Homo sapiens
tagcaggcatggagatgactgt

SEQ ID NO: 8183860 - DNA, 22 bp, Homo sapiens
tagcaggcatctcagagataat

SEQ ID NO: 8183861 - DNA, 22 bp, Homo sapiens
tagcaggcttgtgaatggagcc

SEQ ID NO: 8183862 - DNA, 22 bp, Homo sapiens
tagcaggcatggagatgactgt

SEQ ID NO: 8183863 - DNA, 22 bp, Homo sapiens
tagcaggcatggagatgactgt

SEQ ID NO: 8183864 - DNA, 21 bp, Homo sapiens
tagcaggagcgaattttgatg

SEQ ID NO: 8183865 - DNA, 22 bp, Homo sapiens
tagcaggaggcagttcctcgct

SEQ ID NO: 8183866 - DNA, 22 bp, Homo sapiens
tagcaggagtgtgttctatttt

SEQ ID NO: 8183867 - DNA, 22 bp, Homo sapiens
tagcagcttaagtaattagaat

SEQ ID NO: 8183868 - DNA, 22 bp, Homo sapiens
tagcagctgtggaggggctgtg

SEQ ID NO: 8183869 - DNA, 22 bp, Homo sapiens
tagcagctgtcagtttcacata

SEQ ID NO: 8183870 - DNA, 22 bp, Homo sapiens
tagcagctgtgagtaaaagcca

SEQ ID NO: 8183871 - DNA, 22 bp, Homo sapiens
tagcagctggggctattcatca

SEQ ID NO: 8183872 - DNA, 22 bp, Homo sapiens
tagcagctgcatcattttacag

SEQ ID NO: 8183873 - DNA, 19 bp, Homo sapiens
tagcagctgccaaaggaga

SEQ ID NO: 8183874 - DNA, 22 bp, Homo sapiens
tagcagcttccagagagggcag

SEQ ID NO: 8183875 - DNA, 22 bp, Homo sapiens
tagcaggaaacctgtgttgagg

SEQ ID NO: 8183876 - DNA, 22 bp, Homo sapiens
tagcaggaagaaagctactcag

SEQ ID NO: 8183877 - DNA, 22 bp, Homo sapiens
tagcaggaatatgaggttaata

SEQ ID NO: 8183878 - DNA, 22 bp, Homo sapiens
tagcaggaatgaagttctgagg

SEQ ID NO: 8183879 - DNA, 22 bp, Homo sapiens
tagcaggaattggctgcagctg

SEQ ID NO: 8183880 - DNA, 22 bp, Homo sapiens
tattacaatttacattgcactt

SEQ ID NO: 8183881 - DNA, 22 bp, Homo sapiens
tattacaatttacattgcactt

SEQ ID NO: 8183882 - DNA, 23 bp, Homo sapiens
tattacaattggtcttattaaga

SEQ ID NO: 8183883 - DNA, 23 bp, Homo sapiens
tattacaattggtcttattaaga

SEQ ID NO: 8183884 - DNA, 22 bp, Homo sapiens
tattacaatttacattgcactt

SEQ ID NO: 8183885 - DNA, 22 bp, Homo sapiens
tattacaatttacattgcactt

SEQ ID NO: 8183886 - DNA, 23 bp, Homo sapiens
tattacaattggtcttattaaga

SEQ ID NO: 8183887 - DNA, 23 bp, Homo sapiens
tattacaattggtcttattaaga

SEQ ID NO: 8183888 - DNA, 23 bp, Homo sapiens
tattacaattggtcttattaaga

SEQ ID NO: 8183889 - DNA, 23 bp, Homo sapiens
tattacaattggtcttattaaga

SEQ ID NO: 8183890 - DNA, 23 bp, Homo sapiens
tattacaattggtcttattaaga

SEQ ID NO: 8183891 - DNA, 22 bp, Homo sapiens
tattacaaattataatgggaga

SEQ ID NO: 8183892 - DNA, 22 bp, Homo sapiens
tattacaagaaagggcatgaat

SEQ ID NO: 8183893 - DNA, 22 bp, Homo sapiens
tattacaagaaagggcatgaat

SEQ ID NO: 8183894 - DNA, 22 bp, Homo sapiens
tattacaagaaagggcatgaat

SEQ ID NO: 8183895 - DNA, 22 bp, Homo sapiens
tattacaaattataatgggaga

SEQ ID NO: 8183896 - DNA, 22 bp, Homo sapiens
tattacaaattataatgggaga

SEQ ID NO: 8183897 - DNA, 22 bp, Homo sapiens
tattacaaattataatgggaga

SEQ ID NO: 8183898 - DNA, 22 bp, Homo sapiens
tattaatttaatctccatggta

SEQ ID NO: 8183899 - DNA, 22 bp, Homo sapiens
tattaattcttgccaattctcc

SEQ ID NO: 8183900 - DNA, 21 bp, Homo sapiens
tattaatttttcttcccacta

SEQ ID NO: 8183901 - DNA, 22 bp, Homo sapiens
tattgtctctgcgttgttctat

SEQ ID NO: 8183902 - DNA, 22 bp, Homo sapiens
tattgtctctgcgttgttctat

SEQ ID NO: 8183903 - DNA, 22 bp, Homo sapiens
tattgtctaggaattgtttaaa

SEQ ID NO: 8183904 - DNA, 22 bp, Homo sapiens
tattgtcagtgcctgcctcata

SEQ ID NO: 8183905 - DNA, 22 bp, Homo sapiens
tattgtctaggaattgtttaaa

SEQ ID NO: 8183906 - DNA, 22 bp, Homo sapiens
tattgtcaagaagtttatagtg

SEQ ID NO: 8183907 - DNA, 22 bp, Homo sapiens
tattgtcacgtcttaattctag

SEQ ID NO: 8183908 - DNA, 22 bp, Homo sapiens
tattgtattaaggattcaagta

SEQ ID NO: 8183909 - DNA, 22 bp, Homo sapiens
tattgtatcttctgtttagaag

SEQ ID NO: 8183910 - DNA, 22 bp, Homo sapiens
tattgtattaaggattcaagta

SEQ ID NO: 8183911 - DNA, 22 bp, Homo sapiens
tattacaatttacattgcactt

SEQ ID NO: 8183912 - DNA, 22 bp, Homo sapiens
tattacaatttacattgcactt

SEQ ID NO: 8183913 - DNA, 22 bp, Homo sapiens
tattacaatttacattgcactt

SEQ ID NO: 8183914 - DNA, 22 bp, Homo sapiens
tattgtatcttaccacatgtat

SEQ ID NO: 8183915 - DNA, 22 bp, Homo sapiens
tattgtatcttctgtttagaag

SEQ ID NO: 8183916 - DNA, 22 bp, Homo sapiens
tattgttgttgtgagggggatg

SEQ ID NO: 8183917 - DNA, 22 bp, Homo sapiens
tattgtgttttctctgtgcgga

SEQ ID NO: 8183918 - DNA, 22 bp, Homo sapiens
tattgtgcttctgttgtgcaat

SEQ ID NO: 8183919 - DNA, 22 bp, Homo sapiens
tattgtgctcaccattacatcc

SEQ ID NO: 8183920 - DNA, 22 bp, Homo sapiens
tattgtgccaggtaatgtgttc

SEQ ID NO: 8183921 - DNA, 22 bp, Homo sapiens
tatttaaaaagaggccagctgg

SEQ ID NO: 8183922 - DNA, 22 bp, Homo sapiens
tatttaaaaagaggccagctgg

SEQ ID NO: 8183923 - DNA, 22 bp, Homo sapiens
tatttaaaaagaggccagctgg

SEQ ID NO: 8183924 - DNA, 22 bp, Homo sapiens
tatttaaaaagaggccagctgg

SEQ ID NO: 8183925 - DNA, 22 bp, Homo sapiens
tatttaaaaagaggccagctgg

SEQ ID NO: 8183926 - DNA, 22 bp, Homo sapiens
tatttaaaaagaggccagctgg

SEQ ID NO: 8183927 - DNA, 22 bp, Homo sapiens
tattgtgaagggaaaaatagtg

SEQ ID NO: 8183928 - DNA, 22 bp, Homo sapiens
tattgtgaagggaaaaatagtg

SEQ ID NO: 8183929 - DNA, 22 bp, Homo sapiens
tattgtcttcaactctactttt

SEQ ID NO: 8183930 - DNA, 22 bp, Homo sapiens
tattgtgagtataactgcattt

SEQ ID NO: 8183931 - DNA, 22 bp, Homo sapiens
tattgtgagttcagactaaaaa

SEQ ID NO: 8183932 - DNA, 20 bp, Homo sapiens
tattgtgataggtgttaatc

SEQ ID NO: 8183933 - DNA, 22 bp, Homo sapiens
tattgtgcatgttgaataacta

SEQ ID NO: 8183934 - DNA, 22 bp, Homo sapiens
tatttaagatgtgtcataaaga

SEQ ID NO: 8183935 - DNA, 22 bp, Homo sapiens
tatttaataaaactatggcatg

SEQ ID NO: 8183936 - DNA, 22 bp, Homo sapiens
tatttaactggaaacacaatga

SEQ ID NO: 8183937 - DNA, 22 bp, Homo sapiens
tatttaactggaaacacaatga

SEQ ID NO: 8183938 - DNA, 22 bp, Homo sapiens
tatttaactggaaacacaatga

SEQ ID NO: 8183939 - DNA, 22 bp, Homo sapiens
tatttaaaatagtgctccagca

SEQ ID NO: 8183940 - DNA, 22 bp, Homo sapiens
tatttaaaatagtgctccagca

SEQ ID NO: 8183941 - DNA, 22 bp, Homo sapiens
tatttaaaatagtgctccagca

SEQ ID NO: 8183942 - DNA, 22 bp, Homo sapiens
tatttaaaatagtgctccagca

SEQ ID NO: 8183943 - DNA, 22 bp, Homo sapiens
tatttaaaatagtgctccagca

SEQ ID NO: 8183944 - DNA, 22 bp, Homo sapiens
tatttaaaataagccccagtgg

SEQ ID NO: 8183945 - DNA, 22 bp, Homo sapiens
tatttaaaataagccccagtgg

SEQ ID NO: 8183946 - DNA, 22 bp, Homo sapiens
tatttaaaataagccccagtgg

SEQ ID NO: 8183947 - DNA, 22 bp, Homo sapiens
tatttaaaataagccccagtgg

SEQ ID NO: 8183948 - DNA, 22 bp, Homo sapiens
tatttaaaataagccccagtgg

SEQ ID NO: 8183949 - DNA, 22 bp, Homo sapiens
tatttgacatggtggatttgct

SEQ ID NO: 8183950 - DNA, 22 bp, Homo sapiens
tatttgaatcctggttcttcag

SEQ ID NO: 8183951 - DNA, 22 bp, Homo sapiens
tatttgaaggcatacattttga

SEQ ID NO: 8183952 - DNA, 22 bp, Homo sapiens
tatttgaaggcatacattttga

SEQ ID NO: 8183953 - DNA, 22 bp, Homo sapiens
tatttgaataaaggataaggaa

SEQ ID NO: 8183954 - DNA, 22 bp, Homo sapiens
tatttcttgagtggtcagtttc

SEQ ID NO: 8183955 - DNA, 22 bp, Homo sapiens
tatttaattagtgattgtagag

SEQ ID NO: 8183956 - DNA, 22 bp, Homo sapiens
tatttcttgttattctcgttga

SEQ ID NO: 8183957 - DNA, 22 bp, Homo sapiens
tatttcttgttattctcgttga

SEQ ID NO: 8183958 - DNA, 22 bp, Homo sapiens
tatttcttgttattctcgttga

SEQ ID NO: 8183959 - DNA, 22 bp, Homo sapiens
tatttgaaggcatacattttga

SEQ ID NO: 8183960 - DNA, 22 bp, Homo sapiens
tatttcttgttattctcgttga

SEQ ID NO: 8183961 - DNA, 22 bp, Homo sapiens
tatttgcaggacatagatatgg

SEQ ID NO: 8183962 - DNA, 22 bp, Homo sapiens
tatttgcaaagaactacactag

SEQ ID NO: 8183963 - DNA, 22 bp, Homo sapiens
tatttgatggttctaaaacagc

SEQ ID NO: 8183964 - DNA, 22 bp, Homo sapiens
tatttgatagagataaatgata

SEQ ID NO: 8183965 - DNA, 22 bp, Homo sapiens
tatttgatgaaggtaaagtctt

SEQ ID NO: 8183966 - DNA, 22 bp, Homo sapiens
tattttctggggagagtgaacc

SEQ ID NO: 8183967 - DNA, 22 bp, Homo sapiens
tattttctggggagagtgaacc

SEQ ID NO: 8183968 - DNA, 22 bp, Homo sapiens
tattttgacgattttatgcaaa

SEQ ID NO: 8183969 - DNA, 22 bp, Homo sapiens
tattttgaaagtctgttttgaa

SEQ ID NO: 8183970 - DNA, 22 bp, Homo sapiens
tattttctggacagtcttgctt

SEQ ID NO: 8183971 - DNA, 23 bp, Homo sapiens
tattttccaaatgatgactacat

SEQ ID NO: 8183972 - DNA, 22 bp, Homo sapiens
tatttggacaccaagtagaagt

SEQ ID NO: 8183973 - DNA, 22 bp, Homo sapiens
tatttggaatagcttgctaatg

SEQ ID NO: 8183974 - DNA, 22 bp, Homo sapiens
tatttggaaacaattcacatgc

SEQ ID NO: 8183975 - DNA, 22 bp, Homo sapiens
tatttgctgacagtgctggagc

SEQ ID NO: 8183976 - DNA, 22 bp, Homo sapiens
tatttggaaaagggaagggaca

SEQ ID NO: 8183977 - DNA, 22 bp, Homo sapiens
tatttgcttttgtgccacagat

SEQ ID NO: 8183978 - DNA, 22 bp, Homo sapiens
tcaaagaagtgcaaacctcatc

SEQ ID NO: 8183979 - DNA, 22 bp, Homo sapiens
tcaaagaagtgcaaacctcatc

SEQ ID NO: 8183980 - DNA, 17 bp, Homo sapiens
tcaaagaatgcatgcag

SEQ ID NO: 8183981 - DNA, 17 bp, Homo sapiens
tcaaagaatgcatgcag

SEQ ID NO: 8183982 - DNA, 22 bp, Homo sapiens
tcaaagaatgttatgagggtag

SEQ ID NO: 8183983 - DNA, 20 bp, Homo sapiens
tcaaagacaagctctcatcc

SEQ ID NO: 8183984 - DNA, 22 bp, Homo sapiens
tcaaagaacatcatctgaaatg

SEQ ID NO: 8183985 - DNA, 22 bp, Homo sapiens
tcaaagaacatcatctgaaatg

SEQ ID NO: 8183986 - DNA, 20 bp, Homo sapiens
tcaaagaagattcagctcaa

SEQ ID NO: 8183987 - DNA, 20 bp, Homo sapiens
tcaaagaagattcagctcaa

SEQ ID NO: 8183988 - DNA, 22 bp, Homo sapiens
tcaaagatagatgttgagaaat

SEQ ID NO: 8183989 - DNA, 22 bp, Homo sapiens
tcaaagactatatattttattt

SEQ ID NO: 8183990 - DNA, 21 bp, Homo sapiens
tcaaagactggggctgtgtgc

SEQ ID NO: 8183991 - DNA, 22 bp, Homo sapiens
tcaaagacatggggaagctgag

SEQ ID NO: 8183992 - DNA, 22 bp, Homo sapiens
tcaaagacagacatcagtcaaa

SEQ ID NO: 8183993 - DNA, 22 bp, Homo sapiens
tcaaagacatctggtagctgag

SEQ ID NO: 8183994 - DNA, 22 bp, Homo sapiens
tcaaagacatctggtagctgag

SEQ ID NO: 8183995 - DNA, 22 bp, Homo sapiens
tcaaagatcagatggttgtagg

SEQ ID NO: 8183996 - DNA, 22 bp, Homo sapiens
tcaaagatagatgttgagaaat

SEQ ID NO: 8183997 - DNA, 22 bp, Homo sapiens
tcaaagatgataggaaatcata

SEQ ID NO: 8183998 - DNA, 22 bp, Homo sapiens
tcaaagatgataggaaatcata

SEQ ID NO: 8183999 - DNA, 22 bp, Homo sapiens
tattttgtatttatgcaagaaa

SEQ ID NO: 8184000 - DNA, 22 bp, Homo sapiens
tattttgtatttatgcaagaaa

SEQ ID NO: 8184001 - DNA, 22 bp, Homo sapiens
tattttgtatttatgcaagaaa

SEQ ID NO: 8184002 - DNA, 22 bp, Homo sapiens
tattttgtatttatgcaagaaa

SEQ ID NO: 8184003 - DNA, 22 bp, Homo sapiens
tattttgtatttatgcaagaaa

SEQ ID NO: 8184004 - DNA, 22 bp, Homo sapiens
tattttgtcttctgctcatcac

SEQ ID NO: 8184005 - DNA, 22 bp, Homo sapiens
tattttgtcttctgctcatcac

SEQ ID NO: 8184006 - DNA, 22 bp, Homo sapiens
tattttgttttgtatccactgt

SEQ ID NO: 8184007 - DNA, 22 bp, Homo sapiens
tattttgttttgtatccactgt

SEQ ID NO: 8184008 - DNA, 22 bp, Homo sapiens
tattttgttttgtatccactgt

SEQ ID NO: 8184009 - DNA, 22 bp, Homo sapiens
tattttgttaataatccagtcc

SEQ ID NO: 8184010 - DNA, 22 bp, Homo sapiens
tattttgttaataatccagtcc

SEQ ID NO: 8184011 - DNA, 22 bp, Homo sapiens
tattttgttaataatccagtcc

SEQ ID NO: 8184012 - DNA, 22 bp, Homo sapiens
tattttgtgccatgcactgcct

SEQ ID NO: 8184013 - DNA, 22 bp, Homo sapiens
tattttgtgccatgcactgcct

SEQ ID NO: 8184014 - DNA, 22 bp, Homo sapiens
tattttgtgccatgcactgcct

SEQ ID NO: 8184015 - DNA, 22 bp, Homo sapiens
tcaaaaataagatattctggac

SEQ ID NO: 8184016 - DNA, 22 bp, Homo sapiens
tcaaaaataagatattctggac

SEQ ID NO: 8184017 - DNA, 22 bp, Homo sapiens
tatttttgcctctcagataaaa

SEQ ID NO: 8184018 - DNA, 22 bp, Homo sapiens
tatttttgcctctcagataaaa

SEQ ID NO: 8184019 - DNA, 22 bp, Homo sapiens
tattttgttttgtatccactgt

SEQ ID NO: 8184020 - DNA, 22 bp, Homo sapiens
tatttttgcctctcagataaaa

SEQ ID NO: 8184021 - DNA, 22 bp, Homo sapiens
tatttttgcctctcagataaaa

SEQ ID NO: 8184022 - DNA, 22 bp, Homo sapiens
tattttgaggtatttttgagct

SEQ ID NO: 8184023 - DNA, 22 bp, Homo sapiens
tattttgcaaacctgagtttga

SEQ ID NO: 8184024 - DNA, 22 bp, Homo sapiens
tattttgaggtatttttgagct

SEQ ID NO: 8184025 - DNA, 22 bp, Homo sapiens
tattttgacgattttatgcaaa

SEQ ID NO: 8184026 - DNA, 22 bp, Homo sapiens
tattttgacgattttatgcaaa

SEQ ID NO: 8184027 - DNA, 22 bp, Homo sapiens
tattttgacgattttatgcaaa

SEQ ID NO: 8184028 - DNA, 22 bp, Homo sapiens
tattttgtaattggtcatagct

SEQ ID NO: 8184029 - DNA, 22 bp, Homo sapiens
tattttgtaattggtcatagct

SEQ ID NO: 8184030 - DNA, 22 bp, Homo sapiens
tattttgtaattggtcatagct

SEQ ID NO: 8184031 - DNA, 22 bp, Homo sapiens
tattttgtaattggtcatagct

SEQ ID NO: 8184032 - DNA, 22 bp, Homo sapiens
tattttgtaattggtcatagct

SEQ ID NO: 8184033 - DNA, 22 bp, Homo sapiens
tattttgcgttgagtcagattt

SEQ ID NO: 8184034 - DNA, 22 bp, Homo sapiens
tattttgcgttgagtcagattt

SEQ ID NO: 8184035 - DNA, 20 bp, Homo sapiens
tattttgcaattatggttca

SEQ ID NO: 8184036 - DNA, 22 bp, Homo sapiens
tcaaatatgtgatagaagctaa

SEQ ID NO: 8184037 - DNA, 22 bp, Homo sapiens
tcaaataggcttgtagtgactg

SEQ ID NO: 8184038 - DNA, 18 bp, Homo sapiens
tcaaatactttgggcagt

SEQ ID NO: 8184039 - DNA, 22 bp, Homo sapiens
tcaaatatgtgatagaagctaa

SEQ ID NO: 8184040 - DNA, 22 bp, Homo sapiens
tcaaatattggctatttcacat

SEQ ID NO: 8184041 - DNA, 22 bp, Homo sapiens
tcaaataccagcaatttcatgt

SEQ ID NO: 8184042 - DNA, 22 bp, Homo sapiens
tcaaataccagcaatttcatgt

SEQ ID NO: 8184043 - DNA, 22 bp, Homo sapiens
tcaaataatgccattcatcatc

SEQ ID NO: 8184044 - DNA, 22 bp, Homo sapiens
tcaaataatgccattcatcatc

SEQ ID NO: 8184045 - DNA, 22 bp, Homo sapiens
tcaaatctttgaccacttatgt

SEQ ID NO: 8184046 - DNA, 22 bp, Homo sapiens
tcaaatctttaacatgtgcaaa

SEQ ID NO: 8184047 - DNA, 23 bp, Homo sapiens
tcaaatcccagctctaccacttc

SEQ ID NO: 8184048 - DNA, 21 bp, Homo sapiens
tcaaatcctgctgttaccact

SEQ ID NO: 8184049 - DNA, 21 bp, Homo sapiens
tcaaatcctgctgttaccact

SEQ ID NO: 8184050 - DNA, 22 bp, Homo sapiens
tcaaatctcattgcctaaaact

SEQ ID NO: 8184051 - DNA, 21 bp, Homo sapiens
tcaaatcaggtatcactattg

SEQ ID NO: 8184052 - DNA, 21 bp, Homo sapiens
tcaaatcaggtatcactattg

SEQ ID NO: 8184053 - DNA, 22 bp, Homo sapiens
tcaaatcagcaagcagcttccc

SEQ ID NO: 8184054 - DNA, 22 bp, Homo sapiens
tcaaatcaccaaactcactggc

SEQ ID NO: 8184055 - DNA, 22 bp, Homo sapiens
tcaaatcaccaaactcactggc

SEQ ID NO: 8184056 - DNA, 22 bp, Homo sapiens
tcaaatattggctatttcacat

SEQ ID NO: 8184057 - DNA, 22 bp, Homo sapiens
tcaaatcaccaaactcactggc

SEQ ID NO: 8184058 - DNA, 22 bp, Homo sapiens
tcaaatattggctatttcacat

SEQ ID NO: 8184059 - DNA, 22 bp, Homo sapiens
tcaaatattggctatttcacat

SEQ ID NO: 8184060 - DNA, 22 bp, Homo sapiens
tcaaagtataattgcttttttg

SEQ ID NO: 8184061 - DNA, 22 bp, Homo sapiens
tcaaagtattttaactgtatcc

SEQ ID NO: 8184062 - DNA, 19 bp, Homo sapiens
tcaaagtctgagtcacttt

SEQ ID NO: 8184063 - DNA, 22 bp, Homo sapiens
tcaaagttacttgtggttttct

SEQ ID NO: 8184064 - DNA, 22 bp, Homo sapiens
tcaaagttggaaaagctggccc

SEQ ID NO: 8184065 - DNA, 22 bp, Homo sapiens
tcaaataatgccattcatcatc

SEQ ID NO: 8184066 - DNA, 19 bp, Homo sapiens
tcaaaggcttttaggagac

SEQ ID NO: 8184067 - DNA, 22 bp, Homo sapiens
tcaaaggcttgtggttctggga

SEQ ID NO: 8184068 - DNA, 22 bp, Homo sapiens
tcaaaggttaactctgttgttc

SEQ ID NO: 8184069 - DNA, 22 bp, Homo sapiens
tcaaagtaaaagtatagagttt

SEQ ID NO: 8184070 - DNA, 22 bp, Homo sapiens
tcaaagtagccggatggaattt

SEQ ID NO: 8184071 - DNA, 22 bp, Homo sapiens
tcaaagtaagaatttattacaa

SEQ ID NO: 8184072 - DNA, 22 bp, Homo sapiens
tatcacatacttctcatccagg

SEQ ID NO: 8184073 - DNA, 22 bp, Homo sapiens
tatcactacacctggctaatta

SEQ ID NO: 8184074 - DNA, 22 bp, Homo sapiens
tatcactacacctggctaatta

SEQ ID NO: 8184075 - DNA, 22 bp, Homo sapiens
tatcacatttggagatttatga

SEQ ID NO: 8184076 - DNA, 19 bp, Homo sapiens
tatcactgggcactgagga

SEQ ID NO: 8184077 - DNA, 18 bp, Homo sapiens
tatcactgctgaacaaga

SEQ ID NO: 8184078 - DNA, 22 bp, Homo sapiens
tatcagaaatgccttaaattgg

SEQ ID NO: 8184079 - DNA, 22 bp, Homo sapiens
tatcacttgcgttttggcagag

SEQ ID NO: 8184080 - DNA, 22 bp, Homo sapiens
tatcagaagacttacagtatcg

SEQ ID NO: 8184081 - DNA, 22 bp, Homo sapiens
tatcagcatatttactttcttg

SEQ ID NO: 8184082 - DNA, 22 bp, Homo sapiens
tatcagatttagaggagtcata

SEQ ID NO: 8184083 - DNA, 22 bp, Homo sapiens
tatcagcaactcagagcagtct

SEQ ID NO: 8184084 - DNA, 22 bp, Homo sapiens
tatcagataatcttttacaagc

SEQ ID NO: 8184085 - DNA, 22 bp, Homo sapiens
tatcagaaggcacatggagtct

SEQ ID NO: 8184086 - DNA, 22 bp, Homo sapiens
tataaagtgtgaactgtgagta

SEQ ID NO: 8184087 - DNA, 22 bp, Homo sapiens
tataaagttggggctgaagtaa

SEQ ID NO: 8184088 - DNA, 22 bp, Homo sapiens
tataaagagtctcaaagaagtt

SEQ ID NO: 8184089 - DNA, 22 bp, Homo sapiens
tataaagagtctcaaagaagtt

SEQ ID NO: 8184090 - DNA, 22 bp, Homo sapiens
tataaagagtctatctggtggc

SEQ ID NO: 8184091 - DNA, 22 bp, Homo sapiens
tataaagagtctcaaagaagtt

SEQ ID NO: 8184092 - DNA, 22 bp, Homo sapiens
tataaagaatccagaagagaca

SEQ ID NO: 8184093 - DNA, 22 bp, Homo sapiens
tagttttttcaacaaatggtgc

SEQ ID NO: 8184094 - DNA, 22 bp, Homo sapiens
tataaaacagaaagcactacct

SEQ ID NO: 8184095 - DNA, 22 bp, Homo sapiens
tataaaatggcatcagctccaa

SEQ ID NO: 8184096 - DNA, 22 bp, Homo sapiens
tataaaatggcatcagctccaa

SEQ ID NO: 8184097 - DNA, 22 bp, Homo sapiens
tataaaattctcagtttggggt

SEQ ID NO: 8184098 - DNA, 22 bp, Homo sapiens
tataaaattctcagtttggggt

SEQ ID NO: 8184099 - DNA, 22 bp, Homo sapiens
tataaactcctcttgcattcct

SEQ ID NO: 8184100 - DNA, 22 bp, Homo sapiens
tataaactcctcttgcattcct

SEQ ID NO: 8184101 - DNA, 22 bp, Homo sapiens
tataaactttaaccaggatgtc

SEQ ID NO: 8184102 - DNA, 22 bp, Homo sapiens
tataaacttaatggttccgaat

SEQ ID NO: 8184103 - DNA, 22 bp, Homo sapiens
tatgacaagaaatacagaggta

SEQ ID NO: 8184104 - DNA, 22 bp, Homo sapiens
tatgacaagaaatacagaggta

SEQ ID NO: 8184105 - DNA, 20 bp, Homo sapiens
tatgacaacgcagcaaggca

SEQ ID NO: 8184106 - DNA, 22 bp, Homo sapiens
tatgaattctgttcattgatga

SEQ ID NO: 8184107 - DNA, 22 bp, Homo sapiens
tatgaattctgttcattgatga

SEQ ID NO: 8184108 - DNA, 22 bp, Homo sapiens
tatgaattctcttgtgtatagt

SEQ ID NO: 8184109 - DNA, 22 bp, Homo sapiens
tatgaagtgatgttgaattttg

SEQ ID NO: 8184110 - DNA, 22 bp, Homo sapiens
tatgaaggatacacctctgatt

SEQ ID NO: 8184111 - DNA, 22 bp, Homo sapiens
tatgaagtagagcagagatgcc

SEQ ID NO: 8184112 - DNA, 22 bp, Homo sapiens
tatgaagtctctgatgttgagt

SEQ ID NO: 8184113 - DNA, 20 bp, Homo sapiens
tatgaagtgttcttctggta

SEQ ID NO: 8184114 - DNA, 22 bp, Homo sapiens
tatgaagtgtctgttgtatctg

SEQ ID NO: 8184115 - DNA, 19 bp, Homo sapiens
tatgaagttgataaaagtt

SEQ ID NO: 8184116 - DNA, 22 bp, Homo sapiens
tatgaatataccacaatttagg

SEQ ID NO: 8184117 - DNA, 22 bp, Homo sapiens
tatgaatataccacaatttagg

SEQ ID NO: 8184118 - DNA, 22 bp, Homo sapiens
tatgaatataccacaatttagg

SEQ ID NO: 8184119 - DNA, 22 bp, Homo sapiens
tatgaaatttaaacacagatca

SEQ ID NO: 8184120 - DNA, 22 bp, Homo sapiens
tatgaaatttaaacacagatca

SEQ ID NO: 8184121 - DNA, 22 bp, Homo sapiens
tatgaaatttaaacacagatca

SEQ ID NO: 8184122 - DNA, 22 bp, Homo sapiens
tatgaaatttctagttctgctt

SEQ ID NO: 8184123 - DNA, 22 bp, Homo sapiens
tatgaaatttctagttctgctt

SEQ ID NO: 8184124 - DNA, 22 bp, Homo sapiens
tatgaagattgcggtctggaat

SEQ ID NO: 8184125 - DNA, 22 bp, Homo sapiens
tatgaaatgatggggaaaatag

SEQ ID NO: 8184126 - DNA, 22 bp, Homo sapiens
tatgaaatgatggggaaaatag

SEQ ID NO: 8184127 - DNA, 22 bp, Homo sapiens
tatgaaatggtagtaggaaggg

SEQ ID NO: 8184128 - DNA, 22 bp, Homo sapiens
tatgaaatgatggggaaaatag

SEQ ID NO: 8184129 - DNA, 22 bp, Homo sapiens
tatgaaattgccatttttatgg

SEQ ID NO: 8184130 - DNA, 22 bp, Homo sapiens
tatgaaattgccatttttatgg

SEQ ID NO: 8184131 - DNA, 22 bp, Homo sapiens
tatgaaattgccatttttatgg

SEQ ID NO: 8184132 - DNA, 22 bp, Homo sapiens
tatgaaattgccatttttatgg

SEQ ID NO: 8184133 - DNA, 22 bp, Homo sapiens
tatgaaattgccatttttatgg

SEQ ID NO: 8184134 - DNA, 22 bp, Homo sapiens
tatcattttactgtgacatttt

SEQ ID NO: 8184135 - DNA, 22 bp, Homo sapiens
tatcattttactgtgacatttt

SEQ ID NO: 8184136 - DNA, 22 bp, Homo sapiens
tatcattttactgtgacatttt

SEQ ID NO: 8184137 - DNA, 22 bp, Homo sapiens
tatccaaaggaacaatcacagc

SEQ ID NO: 8184138 - DNA, 22 bp, Homo sapiens
tatcatttagagtatttcttca

SEQ ID NO: 8184139 - DNA, 22 bp, Homo sapiens
tatcatttagagtatttcttca

SEQ ID NO: 8184140 - DNA, 22 bp, Homo sapiens
tatcatttgttattattagtgg

SEQ ID NO: 8184141 - DNA, 22 bp, Homo sapiens
tatcatttgttattattagtgg

SEQ ID NO: 8184142 - DNA, 23 bp, Homo sapiens
tatcatttcagctctctgcctgg

SEQ ID NO: 8184143 - DNA, 22 bp, Homo sapiens
tatcttttgagttctcaagatg

SEQ ID NO: 8184144 - DNA, 18 bp, Homo sapiens
tatcttttccagtggtat

SEQ ID NO: 8184145 - DNA, 23 bp, Homo sapiens
tatctttttcaatgttggaaata

SEQ ID NO: 8184146 - DNA, 22 bp, Homo sapiens
tatggaaataattagacaagtg

SEQ ID NO: 8184147 - DNA, 22 bp, Homo sapiens
tatggaaataattagacaagtg

SEQ ID NO: 8184148 - DNA, 22 bp, Homo sapiens
tatggaaaaatgtatcttgtca

SEQ ID NO: 8184149 - DNA, 22 bp, Homo sapiens
tatggaaagctctttttgattg

SEQ ID NO: 8184150 - DNA, 22 bp, Homo sapiens
tatgctttggtagagagttgtg

SEQ ID NO: 8184151 - DNA, 22 bp, Homo sapiens
tatgctttgcaattggaaaagg

SEQ ID NO: 8184152 - DNA, 17 bp, Homo sapiens
tatgcttttcttctcca

SEQ ID NO: 8184153 - DNA, 20 bp, Homo sapiens
tatgctttttataagattga

SEQ ID NO: 8184154 - DNA, 22 bp, Homo sapiens
tatgcttttaacctgtaactga

SEQ ID NO: 8184155 - DNA, 22 bp, Homo sapiens
tatgctttaaccctcttatatt

SEQ ID NO: 8184156 - DNA, 22 bp, Homo sapiens
tatgctttaaccctcttatatt

SEQ ID NO: 8184157 - DNA, 22 bp, Homo sapiens
tatgctttacttttcattgtga

SEQ ID NO: 8184158 - DNA, 22 bp, Homo sapiens
tatgctttcattcatatgtgag

SEQ ID NO: 8184159 - DNA, 21 bp, Homo sapiens
tatggtaaccagacaagaatg

SEQ ID NO: 8184160 - DNA, 22 bp, Homo sapiens
tatgggtgttaatggtgagaga

SEQ ID NO: 8184161 - DNA, 22 bp, Homo sapiens
tatggtcaaagatatgaagccc

SEQ ID NO: 8184162 - DNA, 22 bp, Homo sapiens
tatggtagaaaaactgagtccc

SEQ ID NO: 8184163 - DNA, 22 bp, Homo sapiens
tatgtacatatacacgtgtgtg

SEQ ID NO: 8184164 - DNA, 22 bp, Homo sapiens
tatgtacatacatgtgcatacg

SEQ ID NO: 8184165 - DNA, 22 bp, Homo sapiens
tatgtacatacatgtgcatacg

SEQ ID NO: 8184166 - DNA, 22 bp, Homo sapiens
tatgtacatatacacgtgtgtg

SEQ ID NO: 8184167 - DNA, 22 bp, Homo sapiens
tatgtacatatacacgtgtgtg

SEQ ID NO: 8184168 - DNA, 22 bp, Homo sapiens
tatgtacatcgttgaattcaaa

SEQ ID NO: 8184169 - DNA, 22 bp, Homo sapiens
tatgtacatcgttgaattcaaa

SEQ ID NO: 8184170 - DNA, 22 bp, Homo sapiens
tatgtagacaggctgcttttcc

SEQ ID NO: 8184171 - DNA, 22 bp, Homo sapiens
tatgtactttcctgggaatgtt

SEQ ID NO: 8184172 - DNA, 22 bp, Homo sapiens
tatgtactctaatttgtctcat

SEQ ID NO: 8184173 - DNA, 22 bp, Homo sapiens
tatgtacaagcacacatgtgac

SEQ ID NO: 8184174 - DNA, 22 bp, Homo sapiens
tatgtacatacatgtgcatacg

SEQ ID NO: 8184175 - DNA, 22 bp, Homo sapiens
tatgtacatacatgtgcatacg

SEQ ID NO: 8184176 - DNA, 22 bp, Homo sapiens
tatgtacatacatgtgcatacg

SEQ ID NO: 8184177 - DNA, 22 bp, Homo sapiens
tatggtttcaatttctgggtag

SEQ ID NO: 8184178 - DNA, 22 bp, Homo sapiens
tatgtaaaaattcatcaggctg

SEQ ID NO: 8184179 - DNA, 22 bp, Homo sapiens
tatgtaaaggattgagatgaat

SEQ ID NO: 8184180 - DNA, 21 bp, Homo sapiens
tattaatatgtctaagctgat

SEQ ID NO: 8184181 - DNA, 21 bp, Homo sapiens
tattaatatgtctaagctgat

SEQ ID NO: 8184182 - DNA, 22 bp, Homo sapiens
tattaataagtgactactagct

SEQ ID NO: 8184183 - DNA, 22 bp, Homo sapiens
tattaataagtgactactagct

SEQ ID NO: 8184184 - DNA, 22 bp, Homo sapiens
tattaattcttgccaattctcc

SEQ ID NO: 8184185 - DNA, 22 bp, Homo sapiens
tattaacattttatgaaaataa

SEQ ID NO: 8184186 - DNA, 22 bp, Homo sapiens
tattaacatgaactgacttttc

SEQ ID NO: 8184187 - DNA, 22 bp, Homo sapiens
tattaagatacgtagttgtaaa

SEQ ID NO: 8184188 - DNA, 22 bp, Homo sapiens
tattaataagtgactactagct

SEQ ID NO: 8184189 - DNA, 22 bp, Homo sapiens
tatgtttcttccttttcataca

SEQ ID NO: 8184190 - DNA, 22 bp, Homo sapiens
tattaaattatggatttaggag

SEQ ID NO: 8184191 - DNA, 22 bp, Homo sapiens
tattaaattatggatttaggag

SEQ ID NO: 8184192 - DNA, 22 bp, Homo sapiens
tattaacatgaactgacttttc

SEQ ID NO: 8184193 - DNA, 22 bp, Homo sapiens
tattaaattatggatttaggag

SEQ ID NO: 8184194 - DNA, 22 bp, Homo sapiens
tattaaattatggatttaggag

SEQ ID NO: 8184195 - DNA, 22 bp, Homo sapiens
tatgtttcatcaggcatggagt

SEQ ID NO: 8184196 - DNA, 22 bp, Homo sapiens
tatgtttcatcaggcatggagt

SEQ ID NO: 8184197 - DNA, 22 bp, Homo sapiens
tatgtttctgggcttgatattt

SEQ ID NO: 8184198 - DNA, 22 bp, Homo sapiens
tatgtttctgggcttgatattt

SEQ ID NO: 8184199 - DNA, 22 bp, Homo sapiens
tatgtttctgggcttgatattt

SEQ ID NO: 8184200 - DNA, 22 bp, Homo sapiens
tatgtttcattcttttctggta

SEQ ID NO: 8184201 - DNA, 22 bp, Homo sapiens
tatgtttctgggcttgatattt

SEQ ID NO: 8184202 - DNA, 22 bp, Homo sapiens
tatgtcactcggctcggcccac

SEQ ID NO: 8184203 - DNA, 22 bp, Homo sapiens
tatgtcaaagttaagaaatagg

SEQ ID NO: 8184204 - DNA, 22 bp, Homo sapiens
tatgtcatgggtcaaaatgaag

SEQ ID NO: 8184205 - DNA, 22 bp, Homo sapiens
tatgtagcaatagcatcatact

SEQ ID NO: 8184206 - DNA, 22 bp, Homo sapiens
tatgtagtcaagtggatatatg

SEQ ID NO: 8184207 - DNA, 18 bp, Homo sapiens
tatgtagtatatgtgtat

SEQ ID NO: 8184208 - DNA, 22 bp, Homo sapiens
tatgtagtcaagtggatatatg

SEQ ID NO: 8184209 - DNA, 22 bp, Homo sapiens
tatgtagtacttagtgcataca

SEQ ID NO: 8184210 - DNA, 22 bp, Homo sapiens
tatgtagacttcattgtttact

SEQ ID NO: 8184211 - DNA, 22 bp, Homo sapiens
tatgtagagataaaatccaaat

SEQ ID NO: 8184212 - DNA, 22 bp, Homo sapiens
tatgtagatgtcatataaattg

SEQ ID NO: 8184213 - DNA, 22 bp, Homo sapiens
tatgtagatttctctgtttttc

SEQ ID NO: 8184214 - DNA, 22 bp, Homo sapiens
tatgtataatcacagagtgtca

SEQ ID NO: 8184215 - DNA, 22 bp, Homo sapiens
tatgtatagagtcttttaaatt

SEQ ID NO: 8184216 - DNA, 22 bp, Homo sapiens
tatgtatagagtcttttaaatt

SEQ ID NO: 8184217 - DNA, 22 bp, Homo sapiens
tatgtatagagtcttttaaatt

SEQ ID NO: 8184218 - DNA, 22 bp, Homo sapiens
tatgtatataggtgtgtgtctc

SEQ ID NO: 8184219 - DNA, 22 bp, Homo sapiens
tatgtatataggtgtgtgtctc

SEQ ID NO: 8184220 - DNA, 22 bp, Homo sapiens
tatgtatataggtgtgtgtctc

SEQ ID NO: 8184221 - DNA, 22 bp, Homo sapiens
tatgtataaatgcatgtgtgga

SEQ ID NO: 8184222 - DNA, 18 bp, Homo sapiens
tatgtataacatagttca

SEQ ID NO: 8184223 - DNA, 22 bp, Homo sapiens
tatgtataaatgcatgtgtgga

SEQ ID NO: 8184224 - DNA, 22 bp, Homo sapiens
tatgtataaatgcatgtgtgga

SEQ ID NO: 8184225 - DNA, 18 bp, Homo sapiens
tatgtataacatagttca

SEQ ID NO: 8184226 - DNA, 18 bp, Homo sapiens
tatgtataacatagttca

SEQ ID NO: 8184227 - DNA, 22 bp, Homo sapiens
tatgtataatcacagagtgtca

SEQ ID NO: 8184228 - DNA, 22 bp, Homo sapiens
tatgtataatcacagagtgtca

SEQ ID NO: 8184229 - DNA, 22 bp, Homo sapiens
tatgtattctcagatttactaa

SEQ ID NO: 8184230 - DNA, 22 bp, Homo sapiens
tatgtattctcagatttactaa

SEQ ID NO: 8184231 - DNA, 22 bp, Homo sapiens
tatgtattctgagtacaagttc

SEQ ID NO: 8184232 - DNA, 23 bp, Homo sapiens
tatgtatgtatgtttgtatggaa

SEQ ID NO: 8184233 - DNA, 22 bp, Homo sapiens
tatgtattagagctccatgagg

SEQ ID NO: 8184234 - DNA, 22 bp, Homo sapiens
tatgtattatctgtgactgctt

SEQ ID NO: 8184235 - DNA, 22 bp, Homo sapiens
tatgtattagagctccatgagg

SEQ ID NO: 8184236 - DNA, 22 bp, Homo sapiens
tatgtattagagctccatgagg

SEQ ID NO: 8184237 - DNA, 22 bp, Homo sapiens
tatgtattattcatcagtggga

SEQ ID NO: 8184238 - DNA, 20 bp, Homo sapiens
tatgtatgcctacatgctat

SEQ ID NO: 8184239 - DNA, 22 bp, Homo sapiens
tatgtatatggtagaagtatgt

SEQ ID NO: 8184240 - DNA, 22 bp, Homo sapiens
tatgtatccgtgtgtgtacaga

SEQ ID NO: 8184241 - DNA, 22 bp, Homo sapiens
tatgtatccgtgtgtgtacaga

SEQ ID NO: 8184242 - DNA, 22 bp, Homo sapiens
tatgtatatgtatacacacaca

SEQ ID NO: 8184243 - DNA, 22 bp, Homo sapiens
tatgtatatggtagaagtatgt

SEQ ID NO: 8184244 - DNA, 22 bp, Homo sapiens
tatgtatatggtagaagtatgt

SEQ ID NO: 8184245 - DNA, 22 bp, Homo sapiens
tatgtatatgtatacacacaca

SEQ ID NO: 8184246 - DNA, 22 bp, Homo sapiens
tatgtatatgtgtgttgacaac

SEQ ID NO: 8184247 - DNA, 22 bp, Homo sapiens
tatgtatatgtgtgttgacaac

SEQ ID NO: 8184248 - DNA, 22 bp, Homo sapiens
tatgtatatggtagaagtatgt

SEQ ID NO: 8184249 - DNA, 22 bp, Homo sapiens
tatgtatatatgttgggtagaa

SEQ ID NO: 8184250 - DNA, 22 bp, Homo sapiens
tatgtatatatgttgggtagaa

SEQ ID NO: 8184251 - DNA, 22 bp, Homo sapiens
tatgtatatatgttgggtagaa

SEQ ID NO: 8184252 - DNA, 22 bp, Homo sapiens
tatgtatatggctcttccccat

SEQ ID NO: 8184253 - DNA, 22 bp, Homo sapiens
gaagaatctgaggacagtcatt

SEQ ID NO: 8184254 - DNA, 22 bp, Homo sapiens
gaagaatattcttgatcttaga

SEQ ID NO: 8184255 - DNA, 22 bp, Homo sapiens
gaagaaggtgctacacagggca

SEQ ID NO: 8184256 - DNA, 22 bp, Homo sapiens
gaagaaggtgctacacagggca

SEQ ID NO: 8184257 - DNA, 22 bp, Homo sapiens
gaagaaggtgccagaggcttac

SEQ ID NO: 8184258 - DNA, 22 bp, Homo sapiens
gaagaagtatttttgtcctgtt

SEQ ID NO: 8184259 - DNA, 22 bp, Homo sapiens
gaagaaggtggcccaggggtag

SEQ ID NO: 8184260 - DNA, 22 bp, Homo sapiens
gaagaaggtggcccaggggtag

SEQ ID NO: 8184261 - DNA, 22 bp, Homo sapiens
gaatgcagatggctggtgtatg

SEQ ID NO: 8184262 - DNA, 22 bp, Homo sapiens
gaatgcagctgacagtcgtttt

SEQ ID NO: 8184263 - DNA, 22 bp, Homo sapiens
gaatgcagatggctggtgtatg

SEQ ID NO: 8184264 - DNA, 22 bp, Homo sapiens
gaatgcacacgtgtgtgcatgc

SEQ ID NO: 8184265 - DNA, 22 bp, Homo sapiens
gaagacaagctgagtgttgtcc

SEQ ID NO: 8184266 - DNA, 21 bp, Homo sapiens
gaagacaaatgggaatagctg

SEQ ID NO: 8184267 - DNA, 22 bp, Homo sapiens
gaatgcagtgacggaggcttac

SEQ ID NO: 8184268 - DNA, 22 bp, Homo sapiens
gaatgcagtggtgagatcttgg

SEQ ID NO: 8184269 - DNA, 22 bp, Homo sapiens
gaatgcatgtgaagcaaagaat

SEQ ID NO: 8184270 - DNA, 22 bp, Homo sapiens
gaatgcattccacggtagtgat

SEQ ID NO: 8184271 - DNA, 22 bp, Homo sapiens
gaatgctaagcatgtgggagtt

SEQ ID NO: 8184272 - DNA, 22 bp, Homo sapiens
gaatgcattctcttagcatcta

SEQ ID NO: 8184273 - DNA, 22 bp, Homo sapiens
gaatgctgagactaaagagctt

SEQ ID NO: 8184274 - DNA, 22 bp, Homo sapiens
gaatgctaagcatgtgggagtt

SEQ ID NO: 8184275 - DNA, 22 bp, Homo sapiens
gaatgtttgtgcagagtcatct

SEQ ID NO: 8184276 - DNA, 22 bp, Homo sapiens
gaatgtttgtgcagagtcatct

SEQ ID NO: 8184277 - DNA, 22 bp, Homo sapiens
gaatgtttttaggaatgttatg

SEQ ID NO: 8184278 - DNA, 22 bp, Homo sapiens
gaatgtttttcaaacctgtggc

SEQ ID NO: 8184279 - DNA, 22 bp, Homo sapiens
gaatgtttttataagtgttaca

SEQ ID NO: 8184280 - DNA, 22 bp, Homo sapiens
gaatgtttttcattggtgactc

SEQ ID NO: 8184281 - DNA, 22 bp, Homo sapiens
gaatgtttttcattggtgactc

SEQ ID NO: 8184282 - DNA, 22 bp, Homo sapiens
gaattaaaatagttttggtcga

SEQ ID NO: 8184283 - DNA, 22 bp, Homo sapiens
gaattaaaatagttttggtcga

SEQ ID NO: 8184284 - DNA, 22 bp, Homo sapiens
gaattacataataaaatgagag

SEQ ID NO: 8184285 - DNA, 22 bp, Homo sapiens
gaattacagagttgttaagtca

SEQ ID NO: 8184286 - DNA, 22 bp, Homo sapiens
gaattacaaagtgagacaagct

SEQ ID NO: 8184287 - DNA, 22 bp, Homo sapiens
gaattaattgtgtggtttgaat

SEQ ID NO: 8184288 - DNA, 22 bp, Homo sapiens
gaattacaaagtgagacaagct

SEQ ID NO: 8184289 - DNA, 22 bp, Homo sapiens
gaattacagccagaagaatgaa

SEQ ID NO: 8184290 - DNA, 22 bp, Homo sapiens
gaattacaaagtgagacaagct

SEQ ID NO: 8184291 - DNA, 22 bp, Homo sapiens
gaattacagagttgttaagtca

SEQ ID NO: 8184292 - DNA, 22 bp, Homo sapiens
gaattacagccagaagaatgaa

SEQ ID NO: 8184293 - DNA, 19 bp, Homo sapiens
gaatgtttgtattcagcgc

SEQ ID NO: 8184294 - DNA, 22 bp, Homo sapiens
gaatgtttgtgcagagtcatct

SEQ ID NO: 8184295 - DNA, 22 bp, Homo sapiens
gaatgtaagtgggcagaagaca

SEQ ID NO: 8184296 - DNA, 22 bp, Homo sapiens
gaatgtaaaattgcctacaaga

SEQ ID NO: 8184297 - DNA, 22 bp, Homo sapiens
gaatgctttgggaattcagaat

SEQ ID NO: 8184298 - DNA, 22 bp, Homo sapiens
gaatggaaactgggagatggcc

SEQ ID NO: 8184299 - DNA, 22 bp, Homo sapiens
gaatggcatagctttctttaca

SEQ ID NO: 8184300 - DNA, 22 bp, Homo sapiens
gaatggccccagagcaccactg

SEQ ID NO: 8184301 - DNA, 22 bp, Homo sapiens
gaatgctgagtcttatctctta

SEQ ID NO: 8184302 - DNA, 22 bp, Homo sapiens
gaatgctgtagacagactctat

SEQ ID NO: 8184303 - DNA, 21 bp, Homo sapiens
gacaaacatttcatagcttta

SEQ ID NO: 8184304 - DNA, 22 bp, Homo sapiens
gacaaagagaagtaacagtacc

SEQ ID NO: 8184305 - DNA, 22 bp, Homo sapiens
gacaaaactgagatcacactgt

SEQ ID NO: 8184306 - DNA, 22 bp, Homo sapiens
gacaaaactgagatcacactgt

SEQ ID NO: 8184307 - DNA, 22 bp, Homo sapiens
gaatttacaagttgaataacaa

SEQ ID NO: 8184308 - DNA, 22 bp, Homo sapiens
gaatttacagggtgagcttcag

SEQ ID NO: 8184309 - DNA, 22 bp, Homo sapiens
gaatttaaggaccaagcatttt

SEQ ID NO: 8184310 - DNA, 22 bp, Homo sapiens
gaatttatctacgttaagtatg

SEQ ID NO: 8184311 - DNA, 22 bp, Homo sapiens
gacaaaacacattagtttaaaa

SEQ ID NO: 8184312 - DNA, 22 bp, Homo sapiens
gacaaaacacattagtttaaaa

SEQ ID NO: 8184313 - DNA, 22 bp, Homo sapiens
gaattttgcttttatgtcaagt

SEQ ID NO: 8184314 - DNA, 22 bp, Homo sapiens
gaattttgcttttatgtcaagt

SEQ ID NO: 8184315 - DNA, 22 bp, Homo sapiens
gacaacaggcagacgtcagaaa

SEQ ID NO: 8184316 - DNA, 22 bp, Homo sapiens
gacaacagcatatggactgtca

SEQ ID NO: 8184317 - DNA, 20 bp, Homo sapiens
gacaacagagtaccaggaag

SEQ ID NO: 8184318 - DNA, 22 bp, Homo sapiens
gacagcaggagatcatgataga

SEQ ID NO: 8184319 - DNA, 22 bp, Homo sapiens
gacagcaggagatcatgataga

SEQ ID NO: 8184320 - DNA, 22 bp, Homo sapiens
gacagcaggagatcatgataga

SEQ ID NO: 8184321 - DNA, 22 bp, Homo sapiens
gacagcagggaaagtccagacc

SEQ ID NO: 8184322 - DNA, 22 bp, Homo sapiens
gacaaatgaagtcactgacctt

SEQ ID NO: 8184323 - DNA, 22 bp, Homo sapiens
gacaaatgagacatcaattccc

SEQ ID NO: 8184324 - DNA, 18 bp, Homo sapiens
gacaaatgcaatttaaag

SEQ ID NO: 8184325 - DNA, 22 bp, Homo sapiens
gacaaatgagtctcatacccgg

SEQ ID NO: 8184326 - DNA, 22 bp, Homo sapiens
gacaaatgaatgatgaacacca

SEQ ID NO: 8184327 - DNA, 22 bp, Homo sapiens
gacaaatgaatgatgaacacca

SEQ ID NO: 8184328 - DNA, 22 bp, Homo sapiens
gacaacaataatgtggagctga

SEQ ID NO: 8184329 - DNA, 22 bp, Homo sapiens
gacaacaataatgtggagctga

SEQ ID NO: 8184330 - DNA, 22 bp, Homo sapiens
gacaaatgtacccctagagtct

SEQ ID NO: 8184331 - DNA, 22 bp, Homo sapiens
gacaaatgtacccctagagtct

SEQ ID NO: 8184332 - DNA, 22 bp, Homo sapiens
gaccttcttgctgtgtcctaac

SEQ ID NO: 8184333 - DNA, 22 bp, Homo sapiens
gaccttcttgctgtgtcctaac

SEQ ID NO: 8184334 - DNA, 19 bp, Homo sapiens
gactacagggggaagaagt

SEQ ID NO: 8184335 - DNA, 22 bp, Homo sapiens
gactacaggtgtgtgccaccat

SEQ ID NO: 8184336 - DNA, 22 bp, Homo sapiens
gactacaggtgtgtgccaccat

SEQ ID NO: 8184337 - DNA, 22 bp, Homo sapiens
gactatttagtttcagattagt

SEQ ID NO: 8184338 - DNA, 22 bp, Homo sapiens
gactatttagtttcagattagt

SEQ ID NO: 8184339 - DNA, 22 bp, Homo sapiens
gactatgtgtgctttgtgaatg

SEQ ID NO: 8184340 - DNA, 22 bp, Homo sapiens
gactattacatgctttcaagac

SEQ ID NO: 8184341 - DNA, 22 bp, Homo sapiens
gactattttataaactagtgaa

SEQ ID NO: 8184342 - DNA, 22 bp, Homo sapiens
gactatttccctcatcatcttc

SEQ ID NO: 8184343 - DNA, 22 bp, Homo sapiens
gactaggggcagcgtgggagct

SEQ ID NO: 8184344 - DNA, 22 bp, Homo sapiens
gactatgtaatggatggcatga

SEQ ID NO: 8184345 - DNA, 22 bp, Homo sapiens
gacctggggtaagcttggcaac

SEQ ID NO: 8184346 - DNA, 22 bp, Homo sapiens
gacctgggtaaggggctgacaa

SEQ ID NO: 8184347 - DNA, 22 bp, Homo sapiens
gacctggggtggaaggaaggca

SEQ ID NO: 8184348 - DNA, 22 bp, Homo sapiens
gacctggggtaagcttggcaac

SEQ ID NO: 8184349 - DNA, 22 bp, Homo sapiens
gacctggggtaagcttggcaac

SEQ ID NO: 8184350 - DNA, 22 bp, Homo sapiens
gacctggcctgcacagccctta

SEQ ID NO: 8184351 - DNA, 22 bp, Homo sapiens
gaccttcttgctgtgtcctaac

SEQ ID NO: 8184352 - DNA, 19 bp, Homo sapiens
gacctggccaagttactta

SEQ ID NO: 8184353 - DNA, 22 bp, Homo sapiens
gacctggattcaaattcagact

SEQ ID NO: 8184354 - DNA, 22 bp, Homo sapiens
gacctggactgagttagatggc

SEQ ID NO: 8184355 - DNA, 22 bp, Homo sapiens
gacctggaatttgtgtgtgttc

SEQ ID NO: 8184356 - DNA, 22 bp, Homo sapiens
gacctggaatgaagggtccctc

SEQ ID NO: 8184357 - DNA, 22 bp, Homo sapiens
gacctggaatttgtgtgtgttc

SEQ ID NO: 8184358 - DNA, 22 bp, Homo sapiens
gacctggaatttgtgtgtgttc

SEQ ID NO: 8184359 - DNA, 22 bp, Homo sapiens
gacctgcctgagctgcctctgc

SEQ ID NO: 8184360 - DNA, 22 bp, Homo sapiens
gacctggaagatggtcctcacc

SEQ ID NO: 8184361 - DNA, 22 bp, Homo sapiens
gacctggaagaactgaggcctt

SEQ ID NO: 8184362 - DNA, 22 bp, Homo sapiens
gacatgtgctgtctcttaaatt

SEQ ID NO: 8184363 - DNA, 22 bp, Homo sapiens
gacatgtgagcaagcgtgcggc

SEQ ID NO: 8184364 - DNA, 22 bp, Homo sapiens
gacatgtgtctgcaagttgatc

SEQ ID NO: 8184365 - DNA, 22 bp, Homo sapiens
gacatgtgagagctcggttttc

SEQ ID NO: 8184366 - DNA, 22 bp, Homo sapiens
gacattaaatgtcttagttgcc

SEQ ID NO: 8184367 - DNA, 22 bp, Homo sapiens
gacctgcccactctgaggacat

SEQ ID NO: 8184368 - DNA, 22 bp, Homo sapiens
gacctgatgccactgcctgtca

SEQ ID NO: 8184369 - DNA, 22 bp, Homo sapiens
gacctgagattttgaggctcat

SEQ ID NO: 8184370 - DNA, 22 bp, Homo sapiens
gacattaatttctttggtaatt

SEQ ID NO: 8184371 - DNA, 22 bp, Homo sapiens
gacattaatggcaaattaatta

SEQ ID NO: 8184372 - DNA, 22 bp, Homo sapiens
gacattaatggcaaattaatta

SEQ ID NO: 8184373 - DNA, 22 bp, Homo sapiens
gacatgcatattcactcttctt

SEQ ID NO: 8184374 - DNA, 22 bp, Homo sapiens
gacatgcatattcactcttctt

SEQ ID NO: 8184375 - DNA, 22 bp, Homo sapiens
gacatgcatgaatgcaggtctc

SEQ ID NO: 8184376 - DNA, 22 bp, Homo sapiens
gacatgcaacaatttggcattt

SEQ ID NO: 8184377 - DNA, 22 bp, Homo sapiens
gacatgaatgttatactttatt

SEQ ID NO: 8184378 - DNA, 22 bp, Homo sapiens
gacatgcattaagacacactga

SEQ ID NO: 8184379 - DNA, 22 bp, Homo sapiens
gacatgcattaagacacactga

SEQ ID NO: 8184380 - DNA, 22 bp, Homo sapiens
gacatgctaattactggttcaa

SEQ ID NO: 8184381 - DNA, 22 bp, Homo sapiens
gacatggcttctaggaagcttt

SEQ ID NO: 8184382 - DNA, 22 bp, Homo sapiens
gacatgctgaataactatatga

SEQ ID NO: 8184383 - DNA, 22 bp, Homo sapiens
gacatgtgagagctcggttttc

SEQ ID NO: 8184384 - DNA, 20 bp, Homo sapiens
gacatgtctttctcacacaa

SEQ ID NO: 8184385 - DNA, 22 bp, Homo sapiens
gacatgtattagtacatatggt

SEQ ID NO: 8184386 - DNA, 22 bp, Homo sapiens
gacatggcttctaggaagcttt

SEQ ID NO: 8184387 - DNA, 17 bp, Homo sapiens
gacatcagtacttacag

SEQ ID NO: 8184388 - DNA, 22 bp, Homo sapiens
gacatcatggagaggataaata

SEQ ID NO: 8184389 - DNA, 22 bp, Homo sapiens
gacatccatcatttcctgttga

SEQ ID NO: 8184390 - DNA, 21 bp, Homo sapiens
gacatccatgtgagtggcagt

SEQ ID NO: 8184391 - DNA, 22 bp, Homo sapiens
gacatctgaggccctcagagcc

SEQ ID NO: 8184392 - DNA, 22 bp, Homo sapiens
gacatacatctctggaaaaaaa

SEQ ID NO: 8184393 - DNA, 22 bp, Homo sapiens
gacatacagcatggtctatgaa

SEQ ID NO: 8184394 - DNA, 22 bp, Homo sapiens
gacatatactatggatggttct

SEQ ID NO: 8184395 - DNA, 17 bp, Homo sapiens
gacagctggttcctggc

SEQ ID NO: 8184396 - DNA, 22 bp, Homo sapiens
gacagtcctgcaggttgaactc

SEQ ID NO: 8184397 - DNA, 22 bp, Homo sapiens
gacagctgggaggatgacataa

SEQ ID NO: 8184398 - DNA, 22 bp, Homo sapiens
gacatacagaatctgcagactt

SEQ ID NO: 8184399 - DNA, 19 bp, Homo sapiens
gacagtgcagttgtagtac

SEQ ID NO: 8184400 - DNA, 22 bp, Homo sapiens
gacagtgcatttcctggcatgg

SEQ ID NO: 8184401 - DNA, 22 bp, Homo sapiens
gacagtgcatttcctggcatgg

SEQ ID NO: 8184402 - DNA, 22 bp, Homo sapiens
gacagctgaaaaatgtaaggta

SEQ ID NO: 8184403 - DNA, 22 bp, Homo sapiens
gacagctccttttggtgcatat

SEQ ID NO: 8184404 - DNA, 22 bp, Homo sapiens
gacagctggcagtggaaaggtg

SEQ ID NO: 8184405 - DNA, 22 bp, Homo sapiens
gacagctgcctctgtgtagatc

SEQ ID NO: 8184406 - DNA, 22 bp, Homo sapiens
gacagctgcctctgtgtagatc

SEQ ID NO: 8184407 - DNA, 22 bp, Homo sapiens
gacagctgaacaggtgggataa

SEQ ID NO: 8184408 - DNA, 22 bp, Homo sapiens
gacagcagtcctggagttccca

SEQ ID NO: 8184409 - DNA, 22 bp, Homo sapiens
gacagcagggacatgtaggaag

SEQ ID NO: 8184410 - DNA, 22 bp, Homo sapiens
gacagcaggtgcttgggaaagg

SEQ ID NO: 8184411 - DNA, 22 bp, Homo sapiens
gacagccaactggggagggcat

SEQ ID NO: 8184412 - DNA, 22 bp, Homo sapiens
gacagcattccatctgcaggtt

SEQ ID NO: 8184413 - DNA, 22 bp, Homo sapiens
gacagccaggcatagggagtat

SEQ ID NO: 8184414 - DNA, 22 bp, Homo sapiens
gacagcatctgtgtggcaggag

SEQ ID NO: 8184415 - DNA, 22 bp, Homo sapiens
gacagcatgagagatgccagtg

SEQ ID NO: 8184416 - DNA, 22 bp, Homo sapiens
gacagcatccaagagggaggga

SEQ ID NO: 8184417 - DNA, 22 bp, Homo sapiens
gacagcagtttttctctagggt

SEQ ID NO: 8184418 - DNA, 22 bp, Homo sapiens
gagcaacactccacattgctag

SEQ ID NO: 8184419 - DNA, 22 bp, Homo sapiens
gagcaacagggcgaggagaact

SEQ ID NO: 8184420 - DNA, 22 bp, Homo sapiens
gagcaagactacaggcagatga

SEQ ID NO: 8184421 - DNA, 22 bp, Homo sapiens
gagcaaagcttttagggccttt

SEQ ID NO: 8184422 - DNA, 22 bp, Homo sapiens
gagcaaagcttttagggccttt

SEQ ID NO: 8184423 - DNA, 22 bp, Homo sapiens
gagatttttcaacaagaatagg

SEQ ID NO: 8184424 - DNA, 22 bp, Homo sapiens
gagcaaaataaattctgacaaa

SEQ ID NO: 8184425 - DNA, 22 bp, Homo sapiens
gagcaaagcttttagggccttt

SEQ ID NO: 8184426 - DNA, 22 bp, Homo sapiens
gagaggagtccctatcacagtt

SEQ ID NO: 8184427 - DNA, 22 bp, Homo sapiens
gagaggcagaggcctgaaaccg

SEQ ID NO: 8184428 - DNA, 22 bp, Homo sapiens
gagaggcagaggcctgaaaccg

SEQ ID NO: 8184429 - DNA, 22 bp, Homo sapiens
gagaggcagaggcctgaaaccg

SEQ ID NO: 8184430 - DNA, 22 bp, Homo sapiens
gagaggcaggcgctgcaatggt

SEQ ID NO: 8184431 - DNA, 22 bp, Homo sapiens
gagaggcaggcgctgcaatggt

SEQ ID NO: 8184432 - DNA, 22 bp, Homo sapiens
gagatttaggggggaagatacg

SEQ ID NO: 8184433 - DNA, 22 bp, Homo sapiens
gagatttattgacttaacagta

SEQ ID NO: 8184434 - DNA, 22 bp, Homo sapiens
gagatttattgacttaacagta

SEQ ID NO: 8184435 - DNA, 22 bp, Homo sapiens
gagatttttcaacaagaatagg

SEQ ID NO: 8184436 - DNA, 22 bp, Homo sapiens
gagattttcagcttgactggga

SEQ ID NO: 8184437 - DNA, 22 bp, Homo sapiens
gagatttcttttgatgcctgtc

SEQ ID NO: 8184438 - DNA, 22 bp, Homo sapiens
gagatttccatattttgtaaca

SEQ ID NO: 8184439 - DNA, 20 bp, Homo sapiens
gagatttccaatcatgccca

SEQ ID NO: 8184440 - DNA, 22 bp, Homo sapiens
gagatttcacccctcttaacct

SEQ ID NO: 8184441 - DNA, 22 bp, Homo sapiens
gagcaatagcaccaattaactc

SEQ ID NO: 8184442 - DNA, 22 bp, Homo sapiens
gagcaatacatggcatgaaatt

SEQ ID NO: 8184443 - DNA, 22 bp, Homo sapiens
gagcaatagaaagaatactgct

SEQ ID NO: 8184444 - DNA, 22 bp, Homo sapiens
gagcaatagaaagaatactgct

SEQ ID NO: 8184445 - DNA, 22 bp, Homo sapiens
gagcacacagtgtgcctgtgta

SEQ ID NO: 8184446 - DNA, 22 bp, Homo sapiens
gagcacacagtgtgcctgtgta

SEQ ID NO: 8184447 - DNA, 22 bp, Homo sapiens
gagcacagaactaaatgctggt

SEQ ID NO: 8184448 - DNA, 22 bp, Homo sapiens
gagcacagaactaaatgctggt

SEQ ID NO: 8184449 - DNA, 22 bp, Homo sapiens
gagcacagatcctggagccaca

SEQ ID NO: 8184450 - DNA, 22 bp, Homo sapiens
gagcacagatcctggagccaca

SEQ ID NO: 8184451 - DNA, 22 bp, Homo sapiens
gagcacagaatcttcccatgca

SEQ ID NO: 8184452 - DNA, 22 bp, Homo sapiens
gagcacagaatcttcccatgca

SEQ ID NO: 8184453 - DNA, 22 bp, Homo sapiens
gagcacagaatcttcccatgca

SEQ ID NO: 8184454 - DNA, 22 bp, Homo sapiens
gagcaaggagggtggggccttt

SEQ ID NO: 8184455 - DNA, 22 bp, Homo sapiens
gagcaaggatggccggggccgt

SEQ ID NO: 8184456 - DNA, 22 bp, Homo sapiens
gagcaaggtagctctctggggc

SEQ ID NO: 8184457 - DNA, 22 bp, Homo sapiens
gagcaagattaaaaggctgggt

SEQ ID NO: 8184458 - DNA, 22 bp, Homo sapiens
gagcactgagctggaattggag

SEQ ID NO: 8184459 - DNA, 22 bp, Homo sapiens
gagcacctcaatttgctatttg

SEQ ID NO: 8184460 - DNA, 22 bp, Homo sapiens
gagcactgatttatttttgtct

SEQ ID NO: 8184461 - DNA, 22 bp, Homo sapiens
gagcactgatttatttttgtct

SEQ ID NO: 8184462 - DNA, 18 bp, Homo sapiens
gagcactggtgttgaggt

SEQ ID NO: 8184463 - DNA, 22 bp, Homo sapiens
gagcactgatttatttttgtct

SEQ ID NO: 8184464 - DNA, 22 bp, Homo sapiens
gagcagaacaggccgggtggga

SEQ ID NO: 8184465 - DNA, 22 bp, Homo sapiens
gagcagaaagttatgtcttgca

SEQ ID NO: 8184466 - DNA, 22 bp, Homo sapiens
gagcagaacaggccgggtggga

SEQ ID NO: 8184467 - DNA, 22 bp, Homo sapiens
gagcacttaatcctgttattca

SEQ ID NO: 8184468 - DNA, 22 bp, Homo sapiens
gagcagagaatccagctaagtg

SEQ ID NO: 8184469 - DNA, 22 bp, Homo sapiens
gagcagacgctgcagtcttggg

SEQ ID NO: 8184470 - DNA, 22 bp, Homo sapiens
gagcagaactactcacatatcg

SEQ ID NO: 8184471 - DNA, 20 bp, Homo sapiens
gagcacagtaatgactgcta

SEQ ID NO: 8184472 - DNA, 22 bp, Homo sapiens
gagcacagatcctggagccaca

SEQ ID NO: 8184473 - DNA, 22 bp, Homo sapiens
gagcacagtgtgttgtgatttc

SEQ ID NO: 8184474 - DNA, 22 bp, Homo sapiens
gagcacatgtggagagtctggg

SEQ ID NO: 8184475 - DNA, 22 bp, Homo sapiens
gagcacatgagaggaaatcaaa

SEQ ID NO: 8184476 - DNA, 23 bp, Homo sapiens
gagcagagcgggcgggggtcctg

SEQ ID NO: 8184477 - DNA, 23 bp, Homo sapiens
gagcagagcgggcgggggtcctg

SEQ ID NO: 8184478 - DNA, 22 bp, Homo sapiens
gagcagagacagtacaactggc

SEQ ID NO: 8184479 - DNA, 22 bp, Homo sapiens
gagcagagacagtacaactggc

SEQ ID NO: 8184480 - DNA, 22 bp, Homo sapiens
gagcagagaatccagctaagtg

SEQ ID NO: 8184481 - DNA, 19 bp, Homo sapiens
gagcagcttcctatctggt

SEQ ID NO: 8184482 - DNA, 18 bp, Homo sapiens
gagcagaggctcaactgg

SEQ ID NO: 8184483 - DNA, 22 bp, Homo sapiens
gagcagagcttctcaaagtaaa

SEQ ID NO: 8184484 - DNA, 22 bp, Homo sapiens
gagcaggaaggccagaagggtc

SEQ ID NO: 8184485 - DNA, 22 bp, Homo sapiens
gagcaggaactgaaaatgagac

SEQ ID NO: 8184486 - DNA, 22 bp, Homo sapiens
gagcagcttgcgctgtcttcac

SEQ ID NO: 8184487 - DNA, 22 bp, Homo sapiens
gagcaggaaggccagaagggtc

SEQ ID NO: 8184488 - DNA, 22 bp, Homo sapiens
gagcaggaaggccagaagggtc

SEQ ID NO: 8184489 - DNA, 22 bp, Homo sapiens
gagcaggaaggccagaagggtc

SEQ ID NO: 8184490 - DNA, 22 bp, Homo sapiens
gagcaggacagcagcttcctgg

SEQ ID NO: 8184491 - DNA, 22 bp, Homo sapiens
gagcaggacagcagcttcctgg

SEQ ID NO: 8184492 - DNA, 22 bp, Homo sapiens
gagcaggacgtgggaatgggaa

SEQ ID NO: 8184493 - DNA, 22 bp, Homo sapiens
gagaaagggaacttacagagtg

SEQ ID NO: 8184494 - DNA, 22 bp, Homo sapiens
gagaaagggataatttgaagag

SEQ ID NO: 8184495 - DNA, 22 bp, Homo sapiens
gagaacaggctctggagtcaga

SEQ ID NO: 8184496 - DNA, 19 bp, Homo sapiens
gactccaactttaagcatg

SEQ ID NO: 8184497 - DNA, 22 bp, Homo sapiens
gactcagtgatttgacatgcct

SEQ ID NO: 8184498 - DNA, 22 bp, Homo sapiens
gactcagatttagagggtaaga

SEQ ID NO: 8184499 - DNA, 22 bp, Homo sapiens
gactcagagatccctggaggtc

SEQ ID NO: 8184500 - DNA, 22 bp, Homo sapiens
gactcagagatccctggaggtc

SEQ ID NO: 8184501 - DNA, 19 bp, Homo sapiens
gactcacaccttccgctgt

SEQ ID NO: 8184502 - DNA, 22 bp, Homo sapiens
gactatttttatctaactgggt

SEQ ID NO: 8184503 - DNA, 22 bp, Homo sapiens
gactatttttatctaactgggt

SEQ ID NO: 8184504 - DNA, 22 bp, Homo sapiens
gactatttttatctaactgggt

SEQ ID NO: 8184505 - DNA, 21 bp, Homo sapiens
gagaactgaaccagagcagct

SEQ ID NO: 8184506 - DNA, 22 bp, Homo sapiens
gagaactaatcatgcatggagt

SEQ ID NO: 8184507 - DNA, 22 bp, Homo sapiens
gagaagcaatcagcagccaccc

SEQ ID NO: 8184508 - DNA, 16 bp, Homo sapiens
gagaagagcccggcag

SEQ ID NO: 8184509 - DNA, 22 bp, Homo sapiens
gagaagaacttgggcaaagtca

SEQ ID NO: 8184510 - DNA, 22 bp, Homo sapiens
gagaagaacttgggcaaagtca

SEQ ID NO: 8184511 - DNA, 22 bp, Homo sapiens
gagaagcaggtttagcagacaa

SEQ ID NO: 8184512 - DNA, 22 bp, Homo sapiens
gagaagcaggtttagcagacaa

SEQ ID NO: 8184513 - DNA, 22 bp, Homo sapiens
gagaagcaatttccaactgtgc

SEQ ID NO: 8184514 - DNA, 22 bp, Homo sapiens
gagaagcaatttccaactgtgc

SEQ ID NO: 8184515 - DNA, 22 bp, Homo sapiens
gagaagcaatttccaactgtgc

SEQ ID NO: 8184516 - DNA, 22 bp, Homo sapiens
gagaagccgagtcagctgagcc

SEQ ID NO: 8184517 - DNA, 22 bp, Homo sapiens
gagaagcaggtttagcagacaa

SEQ ID NO: 8184518 - DNA, 22 bp, Homo sapiens
gagaagcaggtttagcagacaa

SEQ ID NO: 8184519 - DNA, 22 bp, Homo sapiens
gagaagcaggtttagcagacaa

SEQ ID NO: 8184520 - DNA, 22 bp, Homo sapiens
gagaagcaatcgtgacatctcc

SEQ ID NO: 8184521 - DNA, 22 bp, Homo sapiens
gagaagcaatcagtggccaccc

SEQ ID NO: 8184522 - DNA, 22 bp, Homo sapiens
gagaagcaatcagtggccaccc

SEQ ID NO: 8184523 - DNA, 22 bp, Homo sapiens
gagaagcaatcgtgacatctcc

SEQ ID NO: 8184524 - DNA, 22 bp, Homo sapiens
gagaagcaatcgtgacatctcc

SEQ ID NO: 8184525 - DNA, 22 bp, Homo sapiens
gagaagcaatcgtgacatctcc

SEQ ID NO: 8184526 - DNA, 22 bp, Homo sapiens
gagaagcaatcagtggccaccc

SEQ ID NO: 8184527 - DNA, 22 bp, Homo sapiens
gagaagcaatcagcagccaccc

SEQ ID NO: 8184528 - DNA, 22 bp, Homo sapiens
gagaagcaatcagcagccaccc

SEQ ID NO: 8184529 - DNA, 22 bp, Homo sapiens
gagagaagggggatatgagcct

SEQ ID NO: 8184530 - DNA, 22 bp, Homo sapiens
gagagaagggacttctacactt

SEQ ID NO: 8184531 - DNA, 22 bp, Homo sapiens
gagagaagggacttctacactt

SEQ ID NO: 8184532 - DNA, 22 bp, Homo sapiens
gagagaagggggatatgagcct

SEQ ID NO: 8184533 - DNA, 22 bp, Homo sapiens
gagagaagaatgttccgaggcc

SEQ ID NO: 8184534 - DNA, 22 bp, Homo sapiens
gagagaagaatgttccgaggcc

SEQ ID NO: 8184535 - DNA, 22 bp, Homo sapiens
gagagaagggacttctacactt

SEQ ID NO: 8184536 - DNA, 22 bp, Homo sapiens
gagagaagaatgttccgaggcc

SEQ ID NO: 8184537 - DNA, 22 bp, Homo sapiens
gagagaagaatgttccgaggcc

SEQ ID NO: 8184538 - DNA, 22 bp, Homo sapiens
gagagaagaaagccatggtcct

SEQ ID NO: 8184539 - DNA, 22 bp, Homo sapiens
gagagaagaaagccatggtcct

SEQ ID NO: 8184540 - DNA, 22 bp, Homo sapiens
gagagaagaacaatgtcattca

SEQ ID NO: 8184541 - DNA, 22 bp, Homo sapiens
gagagaagaaagccatggtcct

SEQ ID NO: 8184542 - DNA, 22 bp, Homo sapiens
gagaaggaagttgagccagcat

SEQ ID NO: 8184543 - DNA, 22 bp, Homo sapiens
gagagcaggctctcgggggcca

SEQ ID NO: 8184544 - DNA, 22 bp, Homo sapiens
gagagcaggctctcgggggcca

SEQ ID NO: 8184545 - DNA, 22 bp, Homo sapiens
gagagcaggaggcagcgggacg

SEQ ID NO: 8184546 - DNA, 22 bp, Homo sapiens
gagagcaggaggcagcgggacg

SEQ ID NO: 8184547 - DNA, 22 bp, Homo sapiens
gagagccagcagtaaagacatt

SEQ ID NO: 8184548 - DNA, 22 bp, Homo sapiens
gagagccatggtggagatgggg

SEQ ID NO: 8184549 - DNA, 22 bp, Homo sapiens
gagagccatggtggagatgggg

SEQ ID NO: 8184550 - DNA, 22 bp, Homo sapiens
gagagccatggtggagatgggg

SEQ ID NO: 8184551 - DNA, 18 bp, Homo sapiens
gagagcccagcaggtggt

SEQ ID NO: 8184552 - DNA, 22 bp, Homo sapiens
gagagagaaaatgactccggac

SEQ ID NO: 8184553 - DNA, 22 bp, Homo sapiens
gagagactgatgtggctatgta

SEQ ID NO: 8184554 - DNA, 22 bp, Homo sapiens
gagagagaaccccgtgcccttc

SEQ ID NO: 8184555 - DNA, 22 bp, Homo sapiens
gagagagaaggcctgtgggtgt

SEQ ID NO: 8184556 - DNA, 22 bp, Homo sapiens
gagagagaaggcctgtgggtgt

SEQ ID NO: 8184557 - DNA, 22 bp, Homo sapiens
gagagagaaggcctgtgggtgt

SEQ ID NO: 8184558 - DNA, 22 bp, Homo sapiens
gagagacagcagaacgtgcagc

SEQ ID NO: 8184559 - DNA, 22 bp, Homo sapiens
gagagacagcacacagtgtggg

SEQ ID NO: 8184560 - DNA, 22 bp, Homo sapiens
gagagacagcacacagtgtggg

SEQ ID NO: 8184561 - DNA, 22 bp, Homo sapiens
gagagacagcacacagtgtggg

SEQ ID NO: 8184562 - DNA, 22 bp, Homo sapiens
gagagacagcacacagtgtggg

SEQ ID NO: 8184563 - DNA, 22 bp, Homo sapiens
gagagacagcacacagtgtggg

SEQ ID NO: 8184564 - DNA, 18 bp, Homo sapiens
gagaggagccagaatttt

SEQ ID NO: 8184565 - DNA, 22 bp, Homo sapiens
gagaggaggtggctatgacagc

SEQ ID NO: 8184566 - DNA, 22 bp, Homo sapiens
gagaggaggtggctatgacagc

SEQ ID NO: 8184567 - DNA, 22 bp, Homo sapiens
gagaggaggtggctatgacagc

SEQ ID NO: 8184568 - DNA, 22 bp, Homo sapiens
gagaggagtagacactttggtt

SEQ ID NO: 8184569 - DNA, 22 bp, Homo sapiens
gagaggagtagacactttggtt

SEQ ID NO: 8184570 - DNA, 22 bp, Homo sapiens
gagaggagtccctatcacagtt

SEQ ID NO: 8184571 - DNA, 22 bp, Homo sapiens
gagaggagtaggctgatggtgc

SEQ ID NO: 8184572 - DNA, 22 bp, Homo sapiens
gagaggagtaggctgatggtgc

SEQ ID NO: 8184573 - DNA, 22 bp, Homo sapiens
gagaggagtaggctgatggtgc

SEQ ID NO: 8184574 - DNA, 22 bp, Homo sapiens
gagaggagtaggctgatggtgc

SEQ ID NO: 8184575 - DNA, 22 bp, Homo sapiens
gagaggagtaggctgatggtgc

SEQ ID NO: 8184576 - DNA, 22 bp, Homo sapiens
gagaggagtaggctgatggtgc

SEQ ID NO: 8184577 - DNA, 22 bp, Homo sapiens
gagagctgtccggctgagcagc

SEQ ID NO: 8184578 - DNA, 22 bp, Homo sapiens
gagaggagaagcctgcgcttca

SEQ ID NO: 8184579 - DNA, 22 bp, Homo sapiens
gagaggagaagcctgcgcttca

SEQ ID NO: 8184580 - DNA, 22 bp, Homo sapiens
gagaggagacttatccagattg

SEQ ID NO: 8184581 - DNA, 18 bp, Homo sapiens
gagaggagccagaatttt

SEQ ID NO: 8184582 - DNA, 22 bp, Homo sapiens
gagaggagacttatccagattg

SEQ ID NO: 8184583 - DNA, 22 bp, Homo sapiens
gagaggagacttatccagattg

SEQ ID NO: 8184584 - DNA, 22 bp, Homo sapiens
gagaggagacttatccagattg

SEQ ID NO: 8184585 - DNA, 22 bp, Homo sapiens
gagagctgtcagcgtagcaccg

SEQ ID NO: 8184586 - DNA, 22 bp, Homo sapiens
gagaggagaagcctgcgcttca

SEQ ID NO: 8184587 - DNA, 22 bp, Homo sapiens
gagagctgtaatagtcatgtct

SEQ ID NO: 8184588 - DNA, 22 bp, Homo sapiens
gagagccctgctcctatcccag

SEQ ID NO: 8184589 - DNA, 22 bp, Homo sapiens
gagagctgtaatagtcatgtct

SEQ ID NO: 8184590 - DNA, 22 bp, Homo sapiens
gagagctgtaatagtcatgtct

SEQ ID NO: 8184591 - DNA, 22 bp, Homo sapiens
gagagccctcactccttccctg

SEQ ID NO: 8184592 - DNA, 22 bp, Homo sapiens
gagctgggatttgaacctggga

SEQ ID NO: 8184593 - DNA, 22 bp, Homo sapiens
gagctgggatttgaacctggga

SEQ ID NO: 8184594 - DNA, 22 bp, Homo sapiens
gagctctaaccagggacaatta

SEQ ID NO: 8184595 - DNA, 22 bp, Homo sapiens
gagctcctggattgctcctagg

SEQ ID NO: 8184596 - DNA, 22 bp, Homo sapiens
gagctgggattcatctatgtct

SEQ ID NO: 8184597 - DNA, 22 bp, Homo sapiens
gagctctaaccagggacaatta

SEQ ID NO: 8184598 - DNA, 22 bp, Homo sapiens
gagctgggattcatctatgtct

SEQ ID NO: 8184599 - DNA, 22 bp, Homo sapiens
gagctgggcacacgccacttga

SEQ ID NO: 8184600 - DNA, 22 bp, Homo sapiens
gagctccagggaacagcagcta

SEQ ID NO: 8184601 - DNA, 22 bp, Homo sapiens
gagctccagggaacagcagcta

SEQ ID NO: 8184602 - DNA, 22 bp, Homo sapiens
gagctcccaggccccagcaagg

SEQ ID NO: 8184603 - DNA, 22 bp, Homo sapiens
gagctccctggaggttcagata

SEQ ID NO: 8184604 - DNA, 22 bp, Homo sapiens
gagctcctatggtcggtggctc

SEQ ID NO: 8184605 - DNA, 22 bp, Homo sapiens
gagctcctgaaacgttcctgcc

SEQ ID NO: 8184606 - DNA, 22 bp, Homo sapiens
gagctcctcccagggtagcact

SEQ ID NO: 8184607 - DNA, 22 bp, Homo sapiens
gagctcctgctgcatcctgcct

SEQ ID NO: 8184608 - DNA, 22 bp, Homo sapiens
gagctcctggattgctcctagg

SEQ ID NO: 8184609 - DNA, 22 bp, Homo sapiens
gagctgggtatatggctttatg

SEQ ID NO: 8184610 - DNA, 22 bp, Homo sapiens
gagctgggtatatggctttatg

SEQ ID NO: 8184611 - DNA, 22 bp, Homo sapiens
gagctgggtctccaccttggca

SEQ ID NO: 8184612 - DNA, 22 bp, Homo sapiens
gagctgggtctccaccttggca

SEQ ID NO: 8184613 - DNA, 22 bp, Homo sapiens
gagctgggtgtttatttgccaa

SEQ ID NO: 8184614 - DNA, 22 bp, Homo sapiens
gagctgggtgtttatttgccaa

SEQ ID NO: 8184615 - DNA, 22 bp, Homo sapiens
gagctggtcagtttcagggcca

SEQ ID NO: 8184616 - DNA, 22 bp, Homo sapiens
gagctggtcagtttcagggcca

SEQ ID NO: 8184617 - DNA, 22 bp, Homo sapiens
gagctggtcagtttcaggagag

SEQ ID NO: 8184618 - DNA, 22 bp, Homo sapiens
gagctggtcagtttcaggagag

SEQ ID NO: 8184619 - DNA, 22 bp, Homo sapiens
gagctggtattccagtttagtt

SEQ ID NO: 8184620 - DNA, 22 bp, Homo sapiens
gagctggtaaaggatcttgtct

SEQ ID NO: 8184621 - DNA, 22 bp, Homo sapiens
gagctggtcgaaatgggctgac

SEQ ID NO: 8184622 - DNA, 22 bp, Homo sapiens
gagctggtccacaatctgcagg

SEQ ID NO: 8184623 - DNA, 22 bp, Homo sapiens
gagctggtgatcagctggagga

SEQ ID NO: 8184624 - DNA, 22 bp, Homo sapiens
gagctggtgatcagctggagga

SEQ ID NO: 8184625 - DNA, 22 bp, Homo sapiens
gagctggtgatcagctggagga

SEQ ID NO: 8184626 - DNA, 22 bp, Homo sapiens
gagctggtgtgtgcccaagcac

SEQ ID NO: 8184627 - DNA, 22 bp, Homo sapiens
gagctggtggtgagaaagctct

SEQ ID NO: 8184628 - DNA, 22 bp, Homo sapiens
gagctggtggtgagaaagctct

SEQ ID NO: 8184629 - DNA, 22 bp, Homo sapiens
gagctggtgtgtgcccgagcac

SEQ ID NO: 8184630 - DNA, 22 bp, Homo sapiens
gagctggtgtgtgcccgagcac

SEQ ID NO: 8184631 - DNA, 22 bp, Homo sapiens
gagctggtgatcagctggagga

SEQ ID NO: 8184632 - DNA, 22 bp, Homo sapiens
gagctggtgctcttgtcaagac

SEQ ID NO: 8184633 - DNA, 22 bp, Homo sapiens
gagctggtgctgtgcctgttct

SEQ ID NO: 8184634 - DNA, 17 bp, Homo sapiens
gaggacagggaagtagg

SEQ ID NO: 8184635 - DNA, 17 bp, Homo sapiens
gaggacagggaagtagg

SEQ ID NO: 8184636 - DNA, 22 bp, Homo sapiens
gagctgtgtgcctggatggtct

SEQ ID NO: 8184637 - DNA, 22 bp, Homo sapiens
gagctgtgtgcctggatggtct

SEQ ID NO: 8184638 - DNA, 22 bp, Homo sapiens
gagctgtggaaggcagggacca

SEQ ID NO: 8184639 - DNA, 22 bp, Homo sapiens
gagctgtggtcaacaggaaatt

SEQ ID NO: 8184640 - DNA, 22 bp, Homo sapiens
gagctgtgattggtgtctcact

SEQ ID NO: 8184641 - DNA, 22 bp, Homo sapiens
gagctgtgacacgcagcccagg

SEQ ID NO: 8184642 - DNA, 22 bp, Homo sapiens
gagctgtgattggtgtctcact

SEQ ID NO: 8184643 - DNA, 22 bp, Homo sapiens
gagctgtgagggacacattgct

SEQ ID NO: 8184644 - DNA, 18 bp, Homo sapiens
gagctgtctgagctggtc

SEQ ID NO: 8184645 - DNA, 22 bp, Homo sapiens
gagctgtcctaccaggagtcct

SEQ ID NO: 8184646 - DNA, 22 bp, Homo sapiens
gagctgtccaagatggtcgtaa

SEQ ID NO: 8184647 - DNA, 22 bp, Homo sapiens
gagctgtccgcccctgggccga

SEQ ID NO: 8184648 - DNA, 22 bp, Homo sapiens
gagctgtccgcccctgggccga

SEQ ID NO: 8184649 - DNA, 22 bp, Homo sapiens
gagctggttctgtccagggaat

SEQ ID NO: 8184650 - DNA, 22 bp, Homo sapiens
gagctggttttaggctatgtct

SEQ ID NO: 8184651 - DNA, 22 bp, Homo sapiens
gagctggtgtgtgcccgagcac

SEQ ID NO: 8184652 - DNA, 22 bp, Homo sapiens
gagctggttctgtccagggaat

SEQ ID NO: 8184653 - DNA, 22 bp, Homo sapiens
gagcaggcctggggtgaggcct

SEQ ID NO: 8184654 - DNA, 22 bp, Homo sapiens
gagcaggccagcaatggaaggg

SEQ ID NO: 8184655 - DNA, 22 bp, Homo sapiens
gagcaggcctggggtgaggcct

SEQ ID NO: 8184656 - DNA, 22 bp, Homo sapiens
gagcaggccagcaatggaaggg

SEQ ID NO: 8184657 - DNA, 22 bp, Homo sapiens
gagcaggccagcaatggaaggg

SEQ ID NO: 8184658 - DNA, 22 bp, Homo sapiens
gagctcagaggattctggggag

SEQ ID NO: 8184659 - DNA, 22 bp, Homo sapiens
gagctcagaggcgtctttgtcc

SEQ ID NO: 8184660 - DNA, 22 bp, Homo sapiens
gagctcagagcctatagttggt

SEQ ID NO: 8184661 - DNA, 22 bp, Homo sapiens
gagctcagactcgggcctgggg

SEQ ID NO: 8184662 - DNA, 22 bp, Homo sapiens
gagctcagactcgggcctgggg

SEQ ID NO: 8184663 - DNA, 22 bp, Homo sapiens
gagcaggctctgcctgtgtgtc

SEQ ID NO: 8184664 - DNA, 22 bp, Homo sapiens
gagcaggctctgcctgtgtgtc

SEQ ID NO: 8184665 - DNA, 22 bp, Homo sapiens
gagcaggctctgcctgtgtgtc

SEQ ID NO: 8184666 - DNA, 22 bp, Homo sapiens
gagcaggctctgcctgtgtgtc

SEQ ID NO: 8184667 - DNA, 22 bp, Homo sapiens
gagcaggcaactctgcagtgcc

SEQ ID NO: 8184668 - DNA, 22 bp, Homo sapiens
gagcaggcaactctgcagtgcc

SEQ ID NO: 8184669 - DNA, 22 bp, Homo sapiens
gagcaggcattctagtggctga

SEQ ID NO: 8184670 - DNA, 22 bp, Homo sapiens
gagcaggcattctagtggctga

SEQ ID NO: 8184671 - DNA, 22 bp, Homo sapiens
gagcaggcattctagtggctga

SEQ ID NO: 8184672 - DNA, 19 bp, Homo sapiens
gagcaggccacacatgtgt

SEQ ID NO: 8184673 - DNA, 22 bp, Homo sapiens
gagcaggatggcacttctgtga

SEQ ID NO: 8184674 - DNA, 22 bp, Homo sapiens
gagcaggatgggagctggggcc

SEQ ID NO: 8184675 - DNA, 22 bp, Homo sapiens
gagcaggcaaagatgaaaggag

SEQ ID NO: 8184676 - DNA, 22 bp, Homo sapiens
gagcaggcaactctgcagtgcc

SEQ ID NO: 8184677 - DNA, 22 bp, Homo sapiens
gagcaggcaaagatgaaaggag

SEQ ID NO: 8184678 - DNA, 23 bp, Homo sapiens
gagctcaggtagggctcgcccgc

SEQ ID NO: 8184679 - DNA, 22 bp, Homo sapiens
gagctcaggtggtcaaaacaat

SEQ ID NO: 8184680 - DNA, 22 bp, Homo sapiens
gagctcagggcattgagcaaga

SEQ ID NO: 8184681 - DNA, 22 bp, Homo sapiens
gagctcagggcattgagcaaga

SEQ ID NO: 8184682 - DNA, 22 bp, Homo sapiens
gagctcatccccatggtccgtc

SEQ ID NO: 8184683 - DNA, 22 bp, Homo sapiens
gagctcagtgtagtcatggctt

SEQ ID NO: 8184684 - DNA, 22 bp, Homo sapiens
gagctcagtgtagtcatggctt

SEQ ID NO: 8184685 - DNA, 22 bp, Homo sapiens
gagctccaccaccttcaggcag

SEQ ID NO: 8184686 - DNA, 22 bp, Homo sapiens
gagctccaccaccttcaggcag

SEQ ID NO: 8184687 - DNA, 22 bp, Homo sapiens
gagctcattcattcattgcctg

SEQ ID NO: 8184688 - DNA, 22 bp, Homo sapiens
gagctcattcattcattgcctg

SEQ ID NO: 8184689 - DNA, 22 bp, Homo sapiens
gagctccagcatctctgccaaa

SEQ ID NO: 8184690 - DNA, 22 bp, Homo sapiens
gagctccagcatctctgccaaa

SEQ ID NO: 8184691 - DNA, 22 bp, Homo sapiens
gagctccacttagcaaggccac

SEQ ID NO: 8184692 - DNA, 22 bp, Homo sapiens
gagctccacttagcaaggccac

SEQ ID NO: 8184693 - DNA, 22 bp, Homo sapiens
gagctcagcactaaaatcatgt

SEQ ID NO: 8184694 - DNA, 22 bp, Homo sapiens
gagctcagcccaaagagcagtg

SEQ ID NO: 8184695 - DNA, 22 bp, Homo sapiens
gagctcagcccaaagagcagtg

SEQ ID NO: 8184696 - DNA, 22 bp, Homo sapiens
gagctcagcaaaggtctgtgtg

SEQ ID NO: 8184697 - DNA, 22 bp, Homo sapiens
gagctcagcaaaggtctgtgtg

SEQ ID NO: 8184698 - DNA, 22 bp, Homo sapiens
gagctcagcaaaggtctgtgtg

SEQ ID NO: 8184699 - DNA, 22 bp, Homo sapiens
gagctcagattctggtgtcaga

SEQ ID NO: 8184700 - DNA, 22 bp, Homo sapiens
gagctcagattctggtgtcaga

SEQ ID NO: 8184701 - DNA, 22 bp, Homo sapiens
gagctcagcctgaggcctggct

SEQ ID NO: 8184702 - DNA, 22 bp, Homo sapiens
gagctcagcctgaggcctggct

SEQ ID NO: 8184703 - DNA, 22 bp, Homo sapiens
gagctcagcccaaagagcagtg

SEQ ID NO: 8184704 - DNA, 22 bp, Homo sapiens
gagctcagcccaaagagcagtg

SEQ ID NO: 8184705 - DNA, 22 bp, Homo sapiens
gagctcaggagcatcagaagaa

SEQ ID NO: 8184706 - DNA, 22 bp, Homo sapiens
gagctcaggagcatcagaagaa

SEQ ID NO: 8184707 - DNA, 22 bp, Homo sapiens
gagctcaggagcatcagaagaa

SEQ ID NO: 8184708 - DNA, 18 bp, Homo sapiens
gagctcagcgtgtttcta

SEQ ID NO: 8184709 - DNA, 22 bp, Homo sapiens
gaggccagaatgagctgaatgc

SEQ ID NO: 8184710 - DNA, 22 bp, Homo sapiens
gaggccagaatgagctgaatgc

SEQ ID NO: 8184711 - DNA, 22 bp, Homo sapiens
gaggccagaatgagctgaatgc

SEQ ID NO: 8184712 - DNA, 22 bp, Homo sapiens
gaggccagaatgagtctctggg

SEQ ID NO: 8184713 - DNA, 22 bp, Homo sapiens
gaggccagaatgagctgaatgc

SEQ ID NO: 8184714 - DNA, 22 bp, Homo sapiens
gaggccagaatgagctgaatgc

SEQ ID NO: 8184715 - DNA, 22 bp, Homo sapiens
gaggccagaagtgcctcgggct

SEQ ID NO: 8184716 - DNA, 22 bp, Homo sapiens
gaggccagaagtgcctcgggct

SEQ ID NO: 8184717 - DNA, 22 bp, Homo sapiens
gaggccagaagtgcctcgggct

SEQ ID NO: 8184718 - DNA, 22 bp, Homo sapiens
gaggccagaagtgcctcgggct

SEQ ID NO: 8184719 - DNA, 22 bp, Homo sapiens
gaggccagaagtgcctcgggct

SEQ ID NO: 8184720 - DNA, 22 bp, Homo sapiens
gaggccagaagtgcctcgggct

SEQ ID NO: 8184721 - DNA, 22 bp, Homo sapiens
gaggccagaagtctgagatcag

SEQ ID NO: 8184722 - DNA, 22 bp, Homo sapiens
gaggccagaagtctgagatcag

SEQ ID NO: 8184723 - DNA, 22 bp, Homo sapiens
gaggccagaagtctgagatcag

SEQ ID NO: 8184724 - DNA, 22 bp, Homo sapiens
gaggccagaagtctgagatcag

SEQ ID NO: 8184725 - DNA, 22 bp, Homo sapiens
gaggccacttcctactggagga

SEQ ID NO: 8184726 - DNA, 22 bp, Homo sapiens
gaggccacttcctactggagga

SEQ ID NO: 8184727 - DNA, 22 bp, Homo sapiens
gaggccactgtccctgccttcc

SEQ ID NO: 8184728 - DNA, 22 bp, Homo sapiens
gaggccacttcctactggagga

SEQ ID NO: 8184729 - DNA, 22 bp, Homo sapiens
gaggccagaagtgcctcgggct

SEQ ID NO: 8184730 - DNA, 22 bp, Homo sapiens
gaggccagaagtctgagatcag

SEQ ID NO: 8184731 - DNA, 22 bp, Homo sapiens
gaggccagaagtctgagatcag

SEQ ID NO: 8184732 - DNA, 22 bp, Homo sapiens
gaggccagaagtctgagatcag

SEQ ID NO: 8184733 - DNA, 22 bp, Homo sapiens
gaggccagaagtctgagatcag

SEQ ID NO: 8184734 - DNA, 22 bp, Homo sapiens
gaggccagaagtctgagatcag

SEQ ID NO: 8184735 - DNA, 22 bp, Homo sapiens
gaggccagaatgagtctctggg

SEQ ID NO: 8184736 - DNA, 22 bp, Homo sapiens
gaggccagaatgagtctctggg

SEQ ID NO: 8184737 - DNA, 22 bp, Homo sapiens
gaggccagaatgagtctctggg

SEQ ID NO: 8184738 - DNA, 22 bp, Homo sapiens
gaggccagaatgagtctctggg

SEQ ID NO: 8184739 - DNA, 22 bp, Homo sapiens
gaggccagaatgagtctctggg

SEQ ID NO: 8184740 - DNA, 22 bp, Homo sapiens
gaggccagagttccccgagtca

SEQ ID NO: 8184741 - DNA, 22 bp, Homo sapiens
gaggccagagttccccgagtca

SEQ ID NO: 8184742 - DNA, 22 bp, Homo sapiens
gaggccagactgccttttatga

SEQ ID NO: 8184743 - DNA, 22 bp, Homo sapiens
gaggccagactgccttttatga

SEQ ID NO: 8184744 - DNA, 22 bp, Homo sapiens
gaggccagatactctcttctgc

SEQ ID NO: 8184745 - DNA, 22 bp, Homo sapiens
gaggccagagttccccgagtca

SEQ ID NO: 8184746 - DNA, 22 bp, Homo sapiens
gaggccagagttccccgagtca

SEQ ID NO: 8184747 - DNA, 22 bp, Homo sapiens
gaggcctggaattccagcctgg

SEQ ID NO: 8184748 - DNA, 22 bp, Homo sapiens
gaggcctggaattccagcctgg

SEQ ID NO: 8184749 - DNA, 22 bp, Homo sapiens
gaggcctggaattccagcctgg

SEQ ID NO: 8184750 - DNA, 22 bp, Homo sapiens
gaggccagatactctcttctgc

SEQ ID NO: 8184751 - DNA, 22 bp, Homo sapiens
gaggccagatactctcttctgc

SEQ ID NO: 8184752 - DNA, 22 bp, Homo sapiens
gaggcctggaccagccacagag

SEQ ID NO: 8184753 - DNA, 22 bp, Homo sapiens
gaggcctggaccagccacagag

SEQ ID NO: 8184754 - DNA, 22 bp, Homo sapiens
gaggcctggaccagccacagag

SEQ ID NO: 8184755 - DNA, 22 bp, Homo sapiens
gaggcctggaccagccacagag

SEQ ID NO: 8184756 - DNA, 22 bp, Homo sapiens
gaggcctgggttggaggtgcat

SEQ ID NO: 8184757 - DNA, 22 bp, Homo sapiens
gaggcctggagccgcctaggcg

SEQ ID NO: 8184758 - DNA, 22 bp, Homo sapiens
gaggcctggagccgcctaggcg

SEQ ID NO: 8184759 - DNA, 22 bp, Homo sapiens
gaggatggtatgaggcaagcaa

SEQ ID NO: 8184760 - DNA, 22 bp, Homo sapiens
gaggatggtatgaggcaagcaa

SEQ ID NO: 8184761 - DNA, 22 bp, Homo sapiens
gaggatggaggtgtgagctatg

SEQ ID NO: 8184762 - DNA, 22 bp, Homo sapiens
gaggatggaggtgtgagctatg

SEQ ID NO: 8184763 - DNA, 22 bp, Homo sapiens
gaggatggtatgaggcaagcaa

SEQ ID NO: 8184764 - DNA, 22 bp, Homo sapiens
gaggatggtgagcaggacccag

SEQ ID NO: 8184765 - DNA, 22 bp, Homo sapiens
gaggatggtgagcaggacccag

SEQ ID NO: 8184766 - DNA, 22 bp, Homo sapiens
gaggcaacacatttggaaagca

SEQ ID NO: 8184767 - DNA, 22 bp, Homo sapiens
gaggcaagaaaggactttctag

SEQ ID NO: 8184768 - DNA, 22 bp, Homo sapiens
gaggcaacaatgatggtgtgta

SEQ ID NO: 8184769 - DNA, 22 bp, Homo sapiens
gaggcaaagcatgtggctcagg

SEQ ID NO: 8184770 - DNA, 22 bp, Homo sapiens
gaggatgtgtctggtctgggca

SEQ ID NO: 8184771 - DNA, 22 bp, Homo sapiens
gaggatgtaaaatagacaaaat

SEQ ID NO: 8184772 - DNA, 22 bp, Homo sapiens
gaggccactgtccctgccttcc

SEQ ID NO: 8184773 - DNA, 21 bp, Homo sapiens
gaggccactaataggggcaga

SEQ ID NO: 8184774 - DNA, 22 bp, Homo sapiens
gaggccacggttttccttgggg

SEQ ID NO: 8184775 - DNA, 22 bp, Homo sapiens
gaggccacggaagggagctgtg

SEQ ID NO: 8184776 - DNA, 22 bp, Homo sapiens
gaggcatgcagagctggagcag

SEQ ID NO: 8184777 - DNA, 22 bp, Homo sapiens
gaggcatggcctgaggctagga

SEQ ID NO: 8184778 - DNA, 22 bp, Homo sapiens
gaggcatgcagagctggagcag

SEQ ID NO: 8184779 - DNA, 22 bp, Homo sapiens
gaggcatgcagagctggagcag

SEQ ID NO: 8184780 - DNA, 22 bp, Homo sapiens
gaggcaagaaaggactttctag

SEQ ID NO: 8184781 - DNA, 22 bp, Homo sapiens
gaggcaagagaagccagctttc

SEQ ID NO: 8184782 - DNA, 22 bp, Homo sapiens
gaggcaagagaagccagctttc

SEQ ID NO: 8184783 - DNA, 22 bp, Homo sapiens
gaggcatggcctgaggctagga

SEQ ID NO: 8184784 - DNA, 22 bp, Homo sapiens
gaggcatggcctgaggctagga

SEQ ID NO: 8184785 - DNA, 22 bp, Homo sapiens
gaggcatggcctgaggctagga

SEQ ID NO: 8184786 - DNA, 22 bp, Homo sapiens
gaggccacggaagggagctgtg

SEQ ID NO: 8184787 - DNA, 22 bp, Homo sapiens
gaggcatggcctgaggctagga

SEQ ID NO: 8184788 - DNA, 22 bp, Homo sapiens
gaggcatggcctgaggctagga

SEQ ID NO: 8184789 - DNA, 22 bp, Homo sapiens
gaggagtggagttgctgggttg

SEQ ID NO: 8184790 - DNA, 22 bp, Homo sapiens
gaggagtgccagccgtggagtc

SEQ ID NO: 8184791 - DNA, 22 bp, Homo sapiens
gaggagtgccagccgtggagtc

SEQ ID NO: 8184792 - DNA, 22 bp, Homo sapiens
gaggaggttgacggcactgtga

SEQ ID NO: 8184793 - DNA, 22 bp, Homo sapiens
gaggagtctttccctaagtcct

SEQ ID NO: 8184794 - DNA, 22 bp, Homo sapiens
gaggagtctttttagggcctga

SEQ ID NO: 8184795 - DNA, 22 bp, Homo sapiens
gaggagagagggactgtctgca

SEQ ID NO: 8184796 - DNA, 22 bp, Homo sapiens
gaggaggtggagtcatgcagag

SEQ ID NO: 8184797 - DNA, 22 bp, Homo sapiens
gaggagagagggactgtctgca

SEQ ID NO: 8184798 - DNA, 22 bp, Homo sapiens
gaggaggtggagtcatgcagag

SEQ ID NO: 8184799 - DNA, 22 bp, Homo sapiens
gaggaggtggagtcatgcagag

SEQ ID NO: 8184800 - DNA, 22 bp, Homo sapiens
gaggaggttccgggtggagaag

SEQ ID NO: 8184801 - DNA, 22 bp, Homo sapiens
gaggaggttccgggtggagaag

SEQ ID NO: 8184802 - DNA, 22 bp, Homo sapiens
gaggatggaggcagttagggcc

SEQ ID NO: 8184803 - DNA, 18 bp, Homo sapiens
gaggatggaaggagatgc

SEQ ID NO: 8184804 - DNA, 18 bp, Homo sapiens
gaggatggaaggagatgc

SEQ ID NO: 8184805 - DNA, 22 bp, Homo sapiens
gaggagtgggttagtgcttatt

SEQ ID NO: 8184806 - DNA, 18 bp, Homo sapiens
gaggatcagaaatctgta

SEQ ID NO: 8184807 - DNA, 22 bp, Homo sapiens
gaggagtgtattccacaccact

SEQ ID NO: 8184808 - DNA, 22 bp, Homo sapiens
gaggatgctgcagtgcaggaca

SEQ ID NO: 8184809 - DNA, 22 bp, Homo sapiens
gaggatgcctgggtcggggaag

SEQ ID NO: 8184810 - DNA, 20 bp, Homo sapiens
gaggatgcagacagagggca

SEQ ID NO: 8184811 - DNA, 22 bp, Homo sapiens
gaggatcatttgagcctaggag

SEQ ID NO: 8184812 - DNA, 20 bp, Homo sapiens
gaggatgcagacagagggca

SEQ ID NO: 8184813 - DNA, 22 bp, Homo sapiens
gaggactaaaataaattgggga

SEQ ID NO: 8184814 - DNA, 22 bp, Homo sapiens
gaggacctggaatccaagagtc

SEQ ID NO: 8184815 - DNA, 22 bp, Homo sapiens
gaggaccacagatgagcctgca

SEQ ID NO: 8184816 - DNA, 22 bp, Homo sapiens
gaggacatagtccagatggcaa

SEQ ID NO: 8184817 - DNA, 22 bp, Homo sapiens
gaggacatagtggactagggtt

SEQ ID NO: 8184818 - DNA, 22 bp, Homo sapiens
gaggacatagtggactagggtt

SEQ ID NO: 8184819 - DNA, 22 bp, Homo sapiens
gaggaccacagatgagcctgca

SEQ ID NO: 8184820 - DNA, 22 bp, Homo sapiens
gaggaccacagatgagcctgca

SEQ ID NO: 8184821 - DNA, 17 bp, Homo sapiens
gaggacagggaagtagg

SEQ ID NO: 8184822 - DNA, 22 bp, Homo sapiens
gaggacagtgtgatctgccagc

SEQ ID NO: 8184823 - DNA, 22 bp, Homo sapiens
gaggacagtgtgatctgccagc

SEQ ID NO: 8184824 - DNA, 22 bp, Homo sapiens
gaggacagtgtgatctgccagc

SEQ ID NO: 8184825 - DNA, 22 bp, Homo sapiens
gaggacagtgtgatctgccagc

SEQ ID NO: 8184826 - DNA, 22 bp, Homo sapiens
gaggacagtgtgatctgccagc

SEQ ID NO: 8184827 - DNA, 22 bp, Homo sapiens
gaggacagtgtgatctgccagc

SEQ ID NO: 8184828 - DNA, 22 bp, Homo sapiens
gaggacagtgtgatctgccagc

SEQ ID NO: 8184829 - DNA, 21 bp, Homo sapiens
gaggactgcacactctgattg

SEQ ID NO: 8184830 - DNA, 22 bp, Homo sapiens
gaggactgaaacttacaggaaa

SEQ ID NO: 8184831 - DNA, 22 bp, Homo sapiens
gaggagaaagcagtgatttgtg

SEQ ID NO: 8184832 - DNA, 22 bp, Homo sapiens
gaggactgcagatgggtgcatc

SEQ ID NO: 8184833 - DNA, 22 bp, Homo sapiens
gaggagaaattatccttggtgt

SEQ ID NO: 8184834 - DNA, 22 bp, Homo sapiens
gaggagacagtggagccgctac

SEQ ID NO: 8184835 - DNA, 22 bp, Homo sapiens
gaggagacggggtgcctggagc

SEQ ID NO: 8184836 - DNA, 22 bp, Homo sapiens
gaggagacatatttttgaagca

SEQ ID NO: 8184837 - DNA, 22 bp, Homo sapiens
gaggagactgacagcagattct

SEQ ID NO: 8184838 - DNA, 22 bp, Homo sapiens
gaggagacggggtgcctggagc

SEQ ID NO: 8184839 - DNA, 22 bp, Homo sapiens
gaggagagaacattcctccata

SEQ ID NO: 8184840 - DNA, 22 bp, Homo sapiens
gaggagagaacattcctccata

SEQ ID NO: 8184841 - DNA, 22 bp, Homo sapiens
gaggagactgacagcagattct

SEQ ID NO: 8184842 - DNA, 22 bp, Homo sapiens
gaggagagaacattcctccata

SEQ ID NO: 8184843 - DNA, 22 bp, Homo sapiens
gaggagagaagctaacggtgct

SEQ ID NO: 8184844 - DNA, 22 bp, Homo sapiens
gaggagagaacattcctccata

SEQ ID NO: 8184845 - DNA, 22 bp, Homo sapiens
gagggccctggcttcttgctgg

SEQ ID NO: 8184846 - DNA, 22 bp, Homo sapiens
gagggcctactggacatgtcag

SEQ ID NO: 8184847 - DNA, 22 bp, Homo sapiens
gagggcctactggacatgtcag

SEQ ID NO: 8184848 - DNA, 22 bp, Homo sapiens
gagggcctagaagctccatatg

SEQ ID NO: 8184849 - DNA, 22 bp, Homo sapiens
gagggccaggtagatatcagga

SEQ ID NO: 8184850 - DNA, 22 bp, Homo sapiens
gagggccattctgagggggtga

SEQ ID NO: 8184851 - DNA, 22 bp, Homo sapiens
gagggcctggcacagggaggct

SEQ ID NO: 8184852 - DNA, 22 bp, Homo sapiens
gagggcctctgctgctccacat

SEQ ID NO: 8184853 - DNA, 22 bp, Homo sapiens
gagggcctctgctgctccacat

SEQ ID NO: 8184854 - DNA, 22 bp, Homo sapiens
gagggcctctgctgctccacat

SEQ ID NO: 8184855 - DNA, 22 bp, Homo sapiens
gagggcctagaagctccatatg

SEQ ID NO: 8184856 - DNA, 22 bp, Homo sapiens
gagggctgataaatgcgcatgg

SEQ ID NO: 8184857 - DNA, 22 bp, Homo sapiens
gagggctgataaatgcgcatgg

SEQ ID NO: 8184858 - DNA, 22 bp, Homo sapiens
gagggctgataaatgcgcatgg

SEQ ID NO: 8184859 - DNA, 22 bp, Homo sapiens
gagggctgataaatgcgcatgg

SEQ ID NO: 8184860 - DNA, 22 bp, Homo sapiens
gagggctgaagtgttttatgag

SEQ ID NO: 8184861 - DNA, 22 bp, Homo sapiens
gagggctgaagtgttttatgag

SEQ ID NO: 8184862 - DNA, 22 bp, Homo sapiens
gagggcctggcacagggaggct

SEQ ID NO: 8184863 - DNA, 22 bp, Homo sapiens
gagggctgaagtgttttatgag

SEQ ID NO: 8184864 - DNA, 22 bp, Homo sapiens
gagggctgataacaggaataca

SEQ ID NO: 8184865 - DNA, 22 bp, Homo sapiens
gagggctgataacaggaataca

SEQ ID NO: 8184866 - DNA, 22 bp, Homo sapiens
gagggctgataacaggaataca

SEQ ID NO: 8184867 - DNA, 22 bp, Homo sapiens
gagggctgataaatgcgcatgg

SEQ ID NO: 8184868 - DNA, 22 bp, Homo sapiens
gagggctgataaatgcgcatgg

SEQ ID NO: 8184869 - DNA, 22 bp, Homo sapiens
gagggctgataaatgcgcatgg

SEQ ID NO: 8184870 - DNA, 22 bp, Homo sapiens
gagggccaggcggagacaggcg

SEQ ID NO: 8184871 - DNA, 22 bp, Homo sapiens
gagggccaggcggagacaggcg

SEQ ID NO: 8184872 - DNA, 22 bp, Homo sapiens
gagggccaggcagcaagaaggc

SEQ ID NO: 8184873 - DNA, 22 bp, Homo sapiens
gagggccagcctgccaagggcc

SEQ ID NO: 8184874 - DNA, 22 bp, Homo sapiens
gagggccagcagcctcagcatg

SEQ ID NO: 8184875 - DNA, 22 bp, Homo sapiens
gagggccagcagcctcagcatg

SEQ ID NO: 8184876 - DNA, 22 bp, Homo sapiens
gagggccagatcccaggaggaa

SEQ ID NO: 8184877 - DNA, 22 bp, Homo sapiens
gagggccagatcccaggaggaa

SEQ ID NO: 8184878 - DNA, 22 bp, Homo sapiens
gagggccacgttcagggctctc

SEQ ID NO: 8184879 - DNA, 22 bp, Homo sapiens
gagggccagagtcctggggtca

SEQ ID NO: 8184880 - DNA, 22 bp, Homo sapiens
gagggagaattgcagccagcgt

SEQ ID NO: 8184881 - DNA, 22 bp, Homo sapiens
gagggacagctaaagagaaatt

SEQ ID NO: 8184882 - DNA, 22 bp, Homo sapiens
gagggagaaggactatcaggct

SEQ ID NO: 8184883 - DNA, 21 bp, Homo sapiens
gaggctgtctgctgctggcct

SEQ ID NO: 8184884 - DNA, 22 bp, Homo sapiens
gaggctgtctgttagcctggga

SEQ ID NO: 8184885 - DNA, 22 bp, Homo sapiens
gaggctgtaacttgggcactgg

SEQ ID NO: 8184886 - DNA, 22 bp, Homo sapiens
gaggctgtaacttgggcactgg

SEQ ID NO: 8184887 - DNA, 22 bp, Homo sapiens
gaggctggtttgccttttggca

SEQ ID NO: 8184888 - DNA, 22 bp, Homo sapiens
gagggaagtcataatgttctag

SEQ ID NO: 8184889 - DNA, 22 bp, Homo sapiens
gagggaaggtcacccttgtagc

SEQ ID NO: 8184890 - DNA, 22 bp, Homo sapiens
gagggaaggacccattttaagt

SEQ ID NO: 8184891 - DNA, 22 bp, Homo sapiens
gagggaagaggcctgacatttt

SEQ ID NO: 8184892 - DNA, 22 bp, Homo sapiens
gagggaagaggcctgacatttt

SEQ ID NO: 8184893 - DNA, 22 bp, Homo sapiens
gaggctcaaacctggacagagc

SEQ ID NO: 8184894 - DNA, 22 bp, Homo sapiens
gaggctcaaacctggacagagc

SEQ ID NO: 8184895 - DNA, 22 bp, Homo sapiens
gaggctggggtctgcctttctg

SEQ ID NO: 8184896 - DNA, 22 bp, Homo sapiens
gaggctggggtctgcctttctg

SEQ ID NO: 8184897 - DNA, 22 bp, Homo sapiens
gaggctggggtctgcctttctg

SEQ ID NO: 8184898 - DNA, 22 bp, Homo sapiens
gaggctggggtctgcctttctg

SEQ ID NO: 8184899 - DNA, 22 bp, Homo sapiens
gaggctggtaggaaaggaaaca

SEQ ID NO: 8184900 - DNA, 22 bp, Homo sapiens
gaggctggtaggaaaggaaaca

SEQ ID NO: 8184901 - DNA, 22 bp, Homo sapiens
gaggctggtaggaaaggaaaca

SEQ ID NO: 8184902 - DNA, 22 bp, Homo sapiens
gaggcggccagcgaggccgcaa

SEQ ID NO: 8184903 - DNA, 22 bp, Homo sapiens
gaggctcaaacctggacagagc

SEQ ID NO: 8184904 - DNA, 22 bp, Homo sapiens
gaggctggtaggaaaggaaaca

SEQ ID NO: 8184905 - DNA, 22 bp, Homo sapiens
gaggctggtaggaaaggaaaca

SEQ ID NO: 8184906 - DNA, 22 bp, Homo sapiens
gaggctggtaggaaaggaaaca

SEQ ID NO: 8184907 - DNA, 22 bp, Homo sapiens
gaggctggtcagccctaagatc

SEQ ID NO: 8184908 - DNA, 22 bp, Homo sapiens
gaggctggtggttagttccatt

SEQ ID NO: 8184909 - DNA, 22 bp, Homo sapiens
gaggctggttcccttgatcttt

SEQ ID NO: 8184910 - DNA, 22 bp, Homo sapiens
gaggctggttcccttgatcttt

SEQ ID NO: 8184911 - DNA, 22 bp, Homo sapiens
gaggctggttcccttgatcttt

SEQ ID NO: 8184912 - DNA, 22 bp, Homo sapiens
gaggctggttctgaagtactgt

SEQ ID NO: 8184913 - DNA, 22 bp, Homo sapiens
gaggctggtttgccttttggca

SEQ ID NO: 8184914 - DNA, 22 bp, Homo sapiens
gaggctggttctgaagtactgt

SEQ ID NO: 8184915 - DNA, 22 bp, Homo sapiens
gaggctggttctgaagtactgt

SEQ ID NO: 8184916 - DNA, 22 bp, Homo sapiens
gaggctggttctgaagtactgt

SEQ ID NO: 8184917 - DNA, 22 bp, Homo sapiens
gaggcctggtagccgagcccca

SEQ ID NO: 8184918 - DNA, 22 bp, Homo sapiens
gaggcctggtctatgagatgtt

SEQ ID NO: 8184919 - DNA, 22 bp, Homo sapiens
gaggcctggtctatgagatgtt

SEQ ID NO: 8184920 - DNA, 22 bp, Homo sapiens
gaggcctggtgctgtgtccaca

SEQ ID NO: 8184921 - DNA, 22 bp, Homo sapiens
gaggcctggtgctgtgtccaca

SEQ ID NO: 8184922 - DNA, 22 bp, Homo sapiens
gaggcctggtctatgagatgtt

SEQ ID NO: 8184923 - DNA, 22 bp, Homo sapiens
gaggcctggtgtgtctcccgct

SEQ ID NO: 8184924 - DNA, 22 bp, Homo sapiens
gaggcctggtgctgtgtccaca

SEQ ID NO: 8184925 - DNA, 22 bp, Homo sapiens
gaggcctggtgtgtctcccgct

SEQ ID NO: 8184926 - DNA, 22 bp, Homo sapiens
gaggcctggtttccagcatcct

SEQ ID NO: 8184927 - DNA, 22 bp, Homo sapiens
gaggcctggtttccagcatcct

SEQ ID NO: 8184928 - DNA, 22 bp, Homo sapiens
gaggcctggtttgcatgagaat

SEQ ID NO: 8184929 - DNA, 22 bp, Homo sapiens
gaggcctgtagtcatggatgta

SEQ ID NO: 8184930 - DNA, 22 bp, Homo sapiens
gaggcctggtttgcatgagaat

SEQ ID NO: 8184931 - DNA, 22 bp, Homo sapiens
gaggcctggtttgcatgagaat

SEQ ID NO: 8184932 - DNA, 22 bp, Homo sapiens
gaggcctggtttgcatgagaat

SEQ ID NO: 8184933 - DNA, 19 bp, Homo sapiens
gaggcgaggcgtgcaggag

SEQ ID NO: 8184934 - DNA, 18 bp, Homo sapiens
gaggcgagctcttcagaa

SEQ ID NO: 8184935 - DNA, 19 bp, Homo sapiens
gaggcgaggcgtgcaggag

SEQ ID NO: 8184936 - DNA, 19 bp, Homo sapiens
gaggcgaggcgtgcaggag

SEQ ID NO: 8184937 - DNA, 22 bp, Homo sapiens
gaggcctgtcgctaggcctctg

SEQ ID NO: 8184938 - DNA, 22 bp, Homo sapiens
gaggcctgtcgctaggcctctg

SEQ ID NO: 8184939 - DNA, 22 bp, Homo sapiens
gaggcctgtcgctaggcctctg

SEQ ID NO: 8184940 - DNA, 22 bp, Homo sapiens
gaggcctgtagtcatggatgta

SEQ ID NO: 8184941 - DNA, 22 bp, Homo sapiens
gaggcctgtcgctaggcctctg

SEQ ID NO: 8184942 - DNA, 22 bp, Homo sapiens
gaggcctgtagtcatggatgta

SEQ ID NO: 8184943 - DNA, 22 bp, Homo sapiens
gaggcctgtcgctaggcctctg

SEQ ID NO: 8184944 - DNA, 22 bp, Homo sapiens
gaggccttcacttatttaaggg

SEQ ID NO: 8184945 - DNA, 18 bp, Homo sapiens
gaggtggctgggccatct

SEQ ID NO: 8184946 - DNA, 22 bp, Homo sapiens
gaggtggctgggagtagggaat

SEQ ID NO: 8184947 - DNA, 18 bp, Homo sapiens
gaggtggctgggccatct

SEQ ID NO: 8184948 - DNA, 18 bp, Homo sapiens
gaggtggctgggccatct

SEQ ID NO: 8184949 - DNA, 22 bp, Homo sapiens
gaggtggctgtcagcttcactt

SEQ ID NO: 8184950 - DNA, 22 bp, Homo sapiens
gaggtggctgtcagcttcactt

SEQ ID NO: 8184951 - DNA, 22 bp, Homo sapiens
gaggtggctgcttgctgggaaa

SEQ ID NO: 8184952 - DNA, 22 bp, Homo sapiens
gaggtggctgcttgctgggaaa

SEQ ID NO: 8184953 - DNA, 22 bp, Homo sapiens
gaggtggctgcttgctgggaaa

SEQ ID NO: 8184954 - DNA, 22 bp, Homo sapiens
gaggtggctggctcagagccag

SEQ ID NO: 8184955 - DNA, 22 bp, Homo sapiens
gaggtggctggctcagagccag

SEQ ID NO: 8184956 - DNA, 22 bp, Homo sapiens
gaggtggctggctcagagccag

SEQ ID NO: 8184957 - DNA, 22 bp, Homo sapiens
gaggtggctccaggagcaatgc

SEQ ID NO: 8184958 - DNA, 22 bp, Homo sapiens
gaggtggctccttcagggaata

SEQ ID NO: 8184959 - DNA, 22 bp, Homo sapiens
gaggtggctccttcagggaata

SEQ ID NO: 8184960 - DNA, 22 bp, Homo sapiens
gaggtggctgcttgctgggaaa

SEQ ID NO: 8184961 - DNA, 22 bp, Homo sapiens
gaggtggctccttcagggaata

SEQ ID NO: 8184962 - DNA, 22 bp, Homo sapiens
gaggtggctccaggagcaatgc

SEQ ID NO: 8184963 - DNA, 22 bp, Homo sapiens
gaggtgctgctgtacttcttgc

SEQ ID NO: 8184964 - DNA, 22 bp, Homo sapiens
gaggtgcctttttgtaattagt

SEQ ID NO: 8184965 - DNA, 22 bp, Homo sapiens
gaggtgcctggcgatgtctctg

SEQ ID NO: 8184966 - DNA, 22 bp, Homo sapiens
gaggtgctgctgtacttcttgc

SEQ ID NO: 8184967 - DNA, 22 bp, Homo sapiens
gaggtgcccttgtgtattgctg

SEQ ID NO: 8184968 - DNA, 22 bp, Homo sapiens
gaggtgagtggatcacgaggtc

SEQ ID NO: 8184969 - DNA, 22 bp, Homo sapiens
gaggtcttgtctgatagggaaa

SEQ ID NO: 8184970 - DNA, 22 bp, Homo sapiens
gaggtgagaagggggtcagatg

SEQ ID NO: 8184971 - DNA, 22 bp, Homo sapiens
gaggtgagaagggggtcagatg

SEQ ID NO: 8184972 - DNA, 22 bp, Homo sapiens
gagtacatcttaatttgactaa

SEQ ID NO: 8184973 - DNA, 22 bp, Homo sapiens
gagtacatgtatagagattaac

SEQ ID NO: 8184974 - DNA, 22 bp, Homo sapiens
gagtaattttcttaaaacatca

SEQ ID NO: 8184975 - DNA, 22 bp, Homo sapiens
gagtaatttatccagtgaagta

SEQ ID NO: 8184976 - DNA, 22 bp, Homo sapiens
gagtaacataccaaaattcaca

SEQ ID NO: 8184977 - DNA, 22 bp, Homo sapiens
gagtaaacacaccttaccagag

SEQ ID NO: 8184978 - DNA, 21 bp, Homo sapiens
gagtaaacaggatggtgacct

SEQ ID NO: 8184979 - DNA, 22 bp, Homo sapiens
gagtaaacagatattgactttc

SEQ ID NO: 8184980 - DNA, 22 bp, Homo sapiens
gagtaaaagttggattacaaag

SEQ ID NO: 8184981 - DNA, 22 bp, Homo sapiens
gagtaagagctggctttggtgt

SEQ ID NO: 8184982 - DNA, 22 bp, Homo sapiens
gagtaatattctgtactggagg

SEQ ID NO: 8184983 - DNA, 22 bp, Homo sapiens
gaggtgtctgttaggaataggc

SEQ ID NO: 8184984 - DNA, 22 bp, Homo sapiens
gaggtgtctgttaggaataggc

SEQ ID NO: 8184985 - DNA, 19 bp, Homo sapiens
gaggtgtctttcctgagta

SEQ ID NO: 8184986 - DNA, 19 bp, Homo sapiens
gaggtgtctttcctgagta

SEQ ID NO: 8184987 - DNA, 19 bp, Homo sapiens
gaggtgtctttcctgagta

SEQ ID NO: 8184988 - DNA, 22 bp, Homo sapiens
gaggtggcttagtctctggaca

SEQ ID NO: 8184989 - DNA, 22 bp, Homo sapiens
gaggtggcttagtctctggaca

SEQ ID NO: 8184990 - DNA, 22 bp, Homo sapiens
gaggtggcttagtctctggaca

SEQ ID NO: 8184991 - DNA, 22 bp, Homo sapiens
gaggtgggagggcagtccctaa

SEQ ID NO: 8184992 - DNA, 22 bp, Homo sapiens
gagtaaaagttggattacaaag

SEQ ID NO: 8184993 - DNA, 22 bp, Homo sapiens
gaggtttcttatcaagaaagct

SEQ ID NO: 8184994 - DNA, 22 bp, Homo sapiens
gaggttttaggctgccattatt

SEQ ID NO: 8184995 - DNA, 22 bp, Homo sapiens
gaggttttaagttgaaggggga

SEQ ID NO: 8184996 - DNA, 22 bp, Homo sapiens
gaggtttcactgtgttgtccag

SEQ ID NO: 8184997 - DNA, 23 bp, Homo sapiens
gaggtgtgaattctgggtgctgc

SEQ ID NO: 8184998 - DNA, 22 bp, Homo sapiens
gaggtgtctggcctttgtagga

SEQ ID NO: 8184999 - DNA, 23 bp, Homo sapiens
gaggtgtgaattctgggtgctgc

SEQ ID NO: 8185000 - DNA, 23 bp, Homo sapiens
gaggtgtgaattctgggtgctgc

SEQ ID NO: 8185001 - DNA, 22 bp, Homo sapiens
gagggtgcagctgggccccacg

SEQ ID NO: 8185002 - DNA, 22 bp, Homo sapiens
gagggtgcaggaggatggtagt

SEQ ID NO: 8185003 - DNA, 22 bp, Homo sapiens
gagggctgatgttgccacctca

SEQ ID NO: 8185004 - DNA, 22 bp, Homo sapiens
gagggtctcttaatgccagggg

SEQ ID NO: 8185005 - DNA, 22 bp, Homo sapiens
gagggtcttacctaagcagggt

SEQ ID NO: 8185006 - DNA, 22 bp, Homo sapiens
gagggctgatgcttacttattt

SEQ ID NO: 8185007 - DNA, 22 bp, Homo sapiens
gagggctgatgcttacttattt

SEQ ID NO: 8185008 - DNA, 22 bp, Homo sapiens
gagggctgataacaggaataca

SEQ ID NO: 8185009 - DNA, 22 bp, Homo sapiens
gagggtggaagagctgctgaga

SEQ ID NO: 8185010 - DNA, 22 bp, Homo sapiens
gagggtggaagagctgctgaga

SEQ ID NO: 8185011 - DNA, 22 bp, Homo sapiens
gagggtggaagagctgctgaga

SEQ ID NO: 8185012 - DNA, 22 bp, Homo sapiens
gagggtggagctccagaatctg

SEQ ID NO: 8185013 - DNA, 22 bp, Homo sapiens
gagggtggcctttagagcccat

SEQ ID NO: 8185014 - DNA, 22 bp, Homo sapiens
gagggtggctcctccctgggcc

SEQ ID NO: 8185015 - DNA, 22 bp, Homo sapiens
gagggtggcctttagagcccat

SEQ ID NO: 8185016 - DNA, 22 bp, Homo sapiens
gagggtggcctttagagcccat

SEQ ID NO: 8185017 - DNA, 22 bp, Homo sapiens
gagggtgggtacaccagccctc

SEQ ID NO: 8185018 - DNA, 22 bp, Homo sapiens
gagggtgggtacaccagccctc

SEQ ID NO: 8185019 - DNA, 22 bp, Homo sapiens
gagggtggggaatagactgcta

SEQ ID NO: 8185020 - DNA, 22 bp, Homo sapiens
gagggtggggaatagactgcta

SEQ ID NO: 8185021 - DNA, 22 bp, Homo sapiens
gagggtggggaatagactgcta

SEQ ID NO: 8185022 - DNA, 22 bp, Homo sapiens
gagggtggggaatagactgcta

SEQ ID NO: 8185023 - DNA, 22 bp, Homo sapiens
gagggtgggctcctatctgggt

SEQ ID NO: 8185024 - DNA, 22 bp, Homo sapiens
gagggtgggccagatatgaggg

SEQ ID NO: 8185025 - DNA, 22 bp, Homo sapiens
gagggtgggccagatatgaggg

SEQ ID NO: 8185026 - DNA, 22 bp, Homo sapiens
gagggtggtggcttaaggtgct

SEQ ID NO: 8185027 - DNA, 22 bp, Homo sapiens
gagggtgtctcacgtgaaagta

SEQ ID NO: 8185028 - DNA, 22 bp, Homo sapiens
gaggtctgagtgcggaaagcct

SEQ ID NO: 8185029 - DNA, 22 bp, Homo sapiens
gaggtctcactatgttgcccag

SEQ ID NO: 8185030 - DNA, 22 bp, Homo sapiens
gaggtctgggatggggcctgaa

SEQ ID NO: 8185031 - DNA, 22 bp, Homo sapiens
gaggtctgtgtcactttagtgc

SEQ ID NO: 8185032 - DNA, 22 bp, Homo sapiens
gaggtctgtgtcactttagtgc

SEQ ID NO: 8185033 - DNA, 22 bp, Homo sapiens
gaggtctgggcttgggcctggt

SEQ ID NO: 8185034 - DNA, 22 bp, Homo sapiens
gaggtctgcttatctctcacag

SEQ ID NO: 8185035 - DNA, 22 bp, Homo sapiens
gaggtctggaccaagtcgcccc

SEQ ID NO: 8185036 - DNA, 22 bp, Homo sapiens
gaggtctgccttcaggagagtt

SEQ ID NO: 8185037 - DNA, 22 bp, Homo sapiens
gaggtctgccttcaggagagtt

SEQ ID NO: 8185038 - DNA, 22 bp, Homo sapiens
cttcttcaagaggaccatccag

SEQ ID NO: 8185039 - DNA, 22 bp, Homo sapiens
cttcttcaagagaatgggagac

SEQ ID NO: 8185040 - DNA, 19 bp, Homo sapiens
cttctgtgatacatcagtc

SEQ ID NO: 8185041 - DNA, 19 bp, Homo sapiens
cttctgtgatacatcagtc

SEQ ID NO: 8185042 - DNA, 22 bp, Homo sapiens
cttctgtgaccaccagcagccc

SEQ ID NO: 8185043 - DNA, 22 bp, Homo sapiens
cttctgtgaatgaagtgtggga

SEQ ID NO: 8185044 - DNA, 22 bp, Homo sapiens
cttctgtgaagagcagaaccat

SEQ ID NO: 8185045 - DNA, 22 bp, Homo sapiens
cttctgtgaagagcagaaccat

SEQ ID NO: 8185046 - DNA, 22 bp, Homo sapiens
cttctgtgacgtatgtgaggac

SEQ ID NO: 8185047 - DNA, 22 bp, Homo sapiens
cttctgtgacgtatgtgaggac

SEQ ID NO: 8185048 - DNA, 22 bp, Homo sapiens
cttctgtgagtcagtgtttctg

SEQ ID NO: 8185049 - DNA, 22 bp, Homo sapiens
cttctgtgaccaccagcagccc

SEQ ID NO: 8185050 - DNA, 22 bp, Homo sapiens
cttctgtgaccaccagcagccc

SEQ ID NO: 8185051 - DNA, 22 bp, Homo sapiens
cttctgtgacgtatgtgaggac

SEQ ID NO: 8185052 - DNA, 22 bp, Homo sapiens
cttccctttctggtgacttctc

SEQ ID NO: 8185053 - DNA, 22 bp, Homo sapiens
cttccctttctggtgacttctc

SEQ ID NO: 8185054 - DNA, 22 bp, Homo sapiens
cttccctttagcatatagtagt

SEQ ID NO: 8185055 - DNA, 22 bp, Homo sapiens
cttcccttctgtgcagggcaga

SEQ ID NO: 8185056 - DNA, 22 bp, Homo sapiens
cttcccttctgcagatctttgg

SEQ ID NO: 8185057 - DNA, 22 bp, Homo sapiens
cttcccttctgtgcagggcaga

SEQ ID NO: 8185058 - DNA, 22 bp, Homo sapiens
cttcccttctgtgcagggcaga

SEQ ID NO: 8185059 - DNA, 22 bp, Homo sapiens
cttcccttggtgaacagagcat

SEQ ID NO: 8185060 - DNA, 22 bp, Homo sapiens
cttcccttggtgaacagagcat

SEQ ID NO: 8185061 - DNA, 20 bp, Homo sapiens
cttcttcagcctatgcttca

SEQ ID NO: 8185062 - DNA, 22 bp, Homo sapiens
cttcttcaatagcaagcgcata

SEQ ID NO: 8185063 - DNA, 20 bp, Homo sapiens
cttcttcagcctatgcttca

SEQ ID NO: 8185064 - DNA, 20 bp, Homo sapiens
cttcttcagtagtttgttct

SEQ ID NO: 8185065 - DNA, 22 bp, Homo sapiens
cttcttcatctgtaaaacttgg

SEQ ID NO: 8185066 - DNA, 22 bp, Homo sapiens
cttcttcatctgtaaaacttgg

SEQ ID NO: 8185067 - DNA, 22 bp, Homo sapiens
cttcttcatctgtaaaacttgg

SEQ ID NO: 8185068 - DNA, 22 bp, Homo sapiens
cttcttcataggcagtcctgtt

SEQ ID NO: 8185069 - DNA, 22 bp, Homo sapiens
cttccctgagctttctcaggct

SEQ ID NO: 8185070 - DNA, 22 bp, Homo sapiens
cttccctgagctttctcaggct

SEQ ID NO: 8185071 - DNA, 19 bp, Homo sapiens
cttcccctgttacctcact

SEQ ID NO: 8185072 - DNA, 22 bp, Homo sapiens
cttccctgataagagcctcaga

SEQ ID NO: 8185073 - DNA, 22 bp, Homo sapiens
cttccctgataagagcctcaga

SEQ ID NO: 8185074 - DNA, 22 bp, Homo sapiens
cttccctgataagagcctcaga

SEQ ID NO: 8185075 - DNA, 22 bp, Homo sapiens
cttccctgataagagcctcaga

SEQ ID NO: 8185076 - DNA, 22 bp, Homo sapiens
cttcccttcccctcacggagac

SEQ ID NO: 8185077 - DNA, 22 bp, Homo sapiens
cttcccttcccctcacggagac

SEQ ID NO: 8185078 - DNA, 22 bp, Homo sapiens
cttcccttcctggggcaattta

SEQ ID NO: 8185079 - DNA, 22 bp, Homo sapiens
cttcccagacggggtggcagcc

SEQ ID NO: 8185080 - DNA, 22 bp, Homo sapiens
cttcccagacggggtggcagcc

SEQ ID NO: 8185081 - DNA, 22 bp, Homo sapiens
cttcccagcacctcagtctggc

SEQ ID NO: 8185082 - DNA, 22 bp, Homo sapiens
cttcccagcacctcagtctggc

SEQ ID NO: 8185083 - DNA, 22 bp, Homo sapiens
cttcccagaccttagagtgcag

SEQ ID NO: 8185084 - DNA, 21 bp, Homo sapiens
cttccccaggctggtctgtat

SEQ ID NO: 8185085 - DNA, 22 bp, Homo sapiens
cttccccaggacctctgctaaa

SEQ ID NO: 8185086 - DNA, 22 bp, Homo sapiens
cttccccaagtagagaggggag

SEQ ID NO: 8185087 - DNA, 22 bp, Homo sapiens
cttccccaaccccgactgtgtg

SEQ ID NO: 8185088 - DNA, 22 bp, Homo sapiens
cttcccagttctgcttgagggg

SEQ ID NO: 8185089 - DNA, 22 bp, Homo sapiens
cttcccagttctgcttgagggg

SEQ ID NO: 8185090 - DNA, 22 bp, Homo sapiens
cttcacttgctcatcatgctat

SEQ ID NO: 8185091 - DNA, 22 bp, Homo sapiens
cttcacttgctcatcatgctat

SEQ ID NO: 8185092 - DNA, 22 bp, Homo sapiens
cttcagaaataacaacaattac

SEQ ID NO: 8185093 - DNA, 22 bp, Homo sapiens
cttcagaaactagtaacagcta

SEQ ID NO: 8185094 - DNA, 22 bp, Homo sapiens
cttcactgggctcctgagaggg

SEQ ID NO: 8185095 - DNA, 22 bp, Homo sapiens
cttcactgtgcttcaagcagct

SEQ ID NO: 8185096 - DNA, 22 bp, Homo sapiens
cttcactgggctcctgagaggg

SEQ ID NO: 8185097 - DNA, 22 bp, Homo sapiens
cttcactggatctttgatttca

SEQ ID NO: 8185098 - DNA, 22 bp, Homo sapiens
cttcactgtgcttcaagcagct

SEQ ID NO: 8185099 - DNA, 22 bp, Homo sapiens
cttcactgtttggttcacagca

SEQ ID NO: 8185100 - DNA, 22 bp, Homo sapiens
cttcactgtgcttcaagcagct

SEQ ID NO: 8185101 - DNA, 22 bp, Homo sapiens
cttccaggtccttcttgagaag

SEQ ID NO: 8185102 - DNA, 22 bp, Homo sapiens
cttccaggtaggcctaaggcag

SEQ ID NO: 8185103 - DNA, 22 bp, Homo sapiens
cttccagggtccaggaagagcc

SEQ ID NO: 8185104 - DNA, 22 bp, Homo sapiens
cttccagggtccaggaagagcc

SEQ ID NO: 8185105 - DNA, 22 bp, Homo sapiens
cttccagggtccaggaagagcc

SEQ ID NO: 8185106 - DNA, 22 bp, Homo sapiens
cttcagaaccagccagaagagg

SEQ ID NO: 8185107 - DNA, 22 bp, Homo sapiens
cttccaggacaccagggtagta

SEQ ID NO: 8185108 - DNA, 22 bp, Homo sapiens
cttcactgagtagtctagactc

SEQ ID NO: 8185109 - DNA, 22 bp, Homo sapiens
cttcactggaatctgtaatagt

SEQ ID NO: 8185110 - DNA, 22 bp, Homo sapiens
cttcactgagtagtctagactc

SEQ ID NO: 8185111 - DNA, 22 bp, Homo sapiens
cttcactgagtagtctagactc

SEQ ID NO: 8185112 - DNA, 22 bp, Homo sapiens
cttcacctgtacgctggagcta

SEQ ID NO: 8185113 - DNA, 20 bp, Homo sapiens
ctgttaaaaggtatgaattc

SEQ ID NO: 8185114 - DNA, 20 bp, Homo sapiens
ctgttaaaaggtatgaattc

SEQ ID NO: 8185115 - DNA, 22 bp, Homo sapiens
ctgttaaaatgtggtcttaaaa

SEQ ID NO: 8185116 - DNA, 22 bp, Homo sapiens
ctgttaaagatagttaagcttc

SEQ ID NO: 8185117 - DNA, 22 bp, Homo sapiens
cttcaaagggtcactatttatc

SEQ ID NO: 8185118 - DNA, 22 bp, Homo sapiens
cttcaaatacaagtagattatg

SEQ ID NO: 8185119 - DNA, 20 bp, Homo sapiens
cttcaaaggcagtaacagcc

SEQ ID NO: 8185120 - DNA, 22 bp, Homo sapiens
cttcaaagatttgataaagcca

SEQ ID NO: 8185121 - DNA, 23 bp, Homo sapiens
ctgttaaattccttaagagcagg

SEQ ID NO: 8185122 - DNA, 22 bp, Homo sapiens
cttcaaagattattgaaaacaa

SEQ ID NO: 8185123 - DNA, 22 bp, Homo sapiens
ctgttaaatgagaaagcagact

SEQ ID NO: 8185124 - DNA, 22 bp, Homo sapiens
cttcacagtcaccctgctgtgt

SEQ ID NO: 8185125 - DNA, 23 bp, Homo sapiens
cttcacaggttcaggggattaag

SEQ ID NO: 8185126 - DNA, 22 bp, Homo sapiens
cttcacagtaaatccagaagaa

SEQ ID NO: 8185127 - DNA, 22 bp, Homo sapiens
cttcacagtaaatccagaagaa

SEQ ID NO: 8185128 - DNA, 16 bp, Homo sapiens
cttcacagaggagagt

SEQ ID NO: 8185129 - DNA, 22 bp, Homo sapiens
cttcaaatgtgattttaataac

SEQ ID NO: 8185130 - DNA, 22 bp, Homo sapiens
ctttctctgtgtggtaaagggc

SEQ ID NO: 8185131 - DNA, 22 bp, Homo sapiens
ctttctctgtgtttcacatgct

SEQ ID NO: 8185132 - DNA, 22 bp, Homo sapiens
ctttctctggaggggagtggtt

SEQ ID NO: 8185133 - DNA, 20 bp, Homo sapiens
ctttctctaatttataagta

SEQ ID NO: 8185134 - DNA, 20 bp, Homo sapiens
ctttctctaatttataagta

SEQ ID NO: 8185135 - DNA, 22 bp, Homo sapiens
ctttctcagtgttaattacttt

SEQ ID NO: 8185136 - DNA, 22 bp, Homo sapiens
ctttctcctactgggcgcggga

SEQ ID NO: 8185137 - DNA, 22 bp, Homo sapiens
ctttctccagagctgcttattt

SEQ ID NO: 8185138 - DNA, 22 bp, Homo sapiens
ctttctccctgtcccaaactgg

SEQ ID NO: 8185139 - DNA, 22 bp, Homo sapiens
ctttctcttcactgtcatgatc

SEQ ID NO: 8185140 - DNA, 22 bp, Homo sapiens
ctttctcttcactgtcatgatc

SEQ ID NO: 8185141 - DNA, 22 bp, Homo sapiens
ctttctcttacccaaggatctg

SEQ ID NO: 8185142 - DNA, 22 bp, Homo sapiens
ctttctctgtgtttcacatgct

SEQ ID NO: 8185143 - DNA, 22 bp, Homo sapiens
ctttctctgtgtttcacatgct

SEQ ID NO: 8185144 - DNA, 22 bp, Homo sapiens
ctttctcttacccaaggatctg

SEQ ID NO: 8185145 - DNA, 22 bp, Homo sapiens
cttggaggaggtggtgcttgat

SEQ ID NO: 8185146 - DNA, 22 bp, Homo sapiens
cttggaggaggtggtgcttgat

SEQ ID NO: 8185147 - DNA, 22 bp, Homo sapiens
cttggaggaaggggctcttctg

SEQ ID NO: 8185148 - DNA, 22 bp, Homo sapiens
cttggaggatgtgcggctgccc

SEQ ID NO: 8185149 - DNA, 22 bp, Homo sapiens
cttggaggtggaagttgcagtg

SEQ ID NO: 8185150 - DNA, 22 bp, Homo sapiens
cttggaggtggaagttgcagtg

SEQ ID NO: 8185151 - DNA, 22 bp, Homo sapiens
cttggaggatgtgcggctgccc

SEQ ID NO: 8185152 - DNA, 22 bp, Homo sapiens
cttggagctcccgcactgatta

SEQ ID NO: 8185153 - DNA, 22 bp, Homo sapiens
cttggaggaaaggcagggagac

SEQ ID NO: 8185154 - DNA, 22 bp, Homo sapiens
cttggaggaaaggcagggagac

SEQ ID NO: 8185155 - DNA, 22 bp, Homo sapiens
cttggagcccagcaggcctgga

SEQ ID NO: 8185156 - DNA, 22 bp, Homo sapiens
cttggaggaaaggcagggagac

SEQ ID NO: 8185157 - DNA, 22 bp, Homo sapiens
cttggagcccagcaggcctgga

SEQ ID NO: 8185158 - DNA, 22 bp, Homo sapiens
ctttccagacctccttgtagct

SEQ ID NO: 8185159 - DNA, 22 bp, Homo sapiens
ctttccagacctccttgtagct

SEQ ID NO: 8185160 - DNA, 22 bp, Homo sapiens
ctttccagatttgtccagttat

SEQ ID NO: 8185161 - DNA, 22 bp, Homo sapiens
ctttccaccaactcacttccct

SEQ ID NO: 8185162 - DNA, 22 bp, Homo sapiens
ctttccagacctccttgtagct

SEQ ID NO: 8185163 - DNA, 22 bp, Homo sapiens
ctttccagatttgtccagttat

SEQ ID NO: 8185164 - DNA, 22 bp, Homo sapiens
ctttccagatttgtccagttat

SEQ ID NO: 8185165 - DNA, 22 bp, Homo sapiens
ctttcctagttggtcccagcac

SEQ ID NO: 8185166 - DNA, 22 bp, Homo sapiens
ctttccaatgtcactatgaatc

SEQ ID NO: 8185167 - DNA, 22 bp, Homo sapiens
ctttccaatgcatttccaatgt

SEQ ID NO: 8185168 - DNA, 22 bp, Homo sapiens
ctttccaagaatgcagatacct

SEQ ID NO: 8185169 - DNA, 22 bp, Homo sapiens
cttggagtgaatgggggcaggt

SEQ ID NO: 8185170 - DNA, 22 bp, Homo sapiens
ctttcctctggcactgtctggt

SEQ ID NO: 8185171 - DNA, 22 bp, Homo sapiens
ctttcctggctggcagttgtgg

SEQ ID NO: 8185172 - DNA, 22 bp, Homo sapiens
ctttcctgagaaaggagaagga

SEQ ID NO: 8185173 - DNA, 23 bp, Homo sapiens
ctttcctttctttgacacccagc

SEQ ID NO: 8185174 - DNA, 23 bp, Homo sapiens
ctttcctttctttgacacccagc

SEQ ID NO: 8185175 - DNA, 22 bp, Homo sapiens
ctttccttctcgtggttctcac

SEQ ID NO: 8185176 - DNA, 22 bp, Homo sapiens
cttcttctctacatcctttgat

SEQ ID NO: 8185177 - DNA, 22 bp, Homo sapiens
cttcttctggacaggcagctcc

SEQ ID NO: 8185178 - DNA, 22 bp, Homo sapiens
cttcttcctgctgcagcctcca

SEQ ID NO: 8185179 - DNA, 22 bp, Homo sapiens
cttcttcctgctgcagcctcca

SEQ ID NO: 8185180 - DNA, 22 bp, Homo sapiens
cttcttcctgaaagctggctct

SEQ ID NO: 8185181 - DNA, 22 bp, Homo sapiens
cttcttcctgctgcagcctcca

SEQ ID NO: 8185182 - DNA, 22 bp, Homo sapiens
cttcttcctgctgcagcctcca

SEQ ID NO: 8185183 - DNA, 22 bp, Homo sapiens
cttcttcctgctgcagcctcca

SEQ ID NO: 8185184 - DNA, 22 bp, Homo sapiens
cttcttcccagcttccctcacc

SEQ ID NO: 8185185 - DNA, 22 bp, Homo sapiens
cttcttcccagcttccctcacc

SEQ ID NO: 8185186 - DNA, 22 bp, Homo sapiens
cttcttcccagcttccctcacc

SEQ ID NO: 8185187 - DNA, 22 bp, Homo sapiens
cttcttcctgaaagctggctct

SEQ ID NO: 8185188 - DNA, 22 bp, Homo sapiens
cttcttcccagcttccctcacc

SEQ ID NO: 8185189 - DNA, 22 bp, Homo sapiens
cttcttccaagcttatgctcaa

SEQ ID NO: 8185190 - DNA, 22 bp, Homo sapiens
cttcttccaagcttatgctcaa

SEQ ID NO: 8185191 - DNA, 22 bp, Homo sapiens
cttcttcatgtattgatagtct

SEQ ID NO: 8185192 - DNA, 22 bp, Homo sapiens
cttcttcatgtattgatagtct

SEQ ID NO: 8185193 - DNA, 22 bp, Homo sapiens
cttcttcatgtattgatagtct

SEQ ID NO: 8185194 - DNA, 19 bp, Homo sapiens
cttcttcttggcagccaag

SEQ ID NO: 8185195 - DNA, 22 bp, Homo sapiens
cttcttcttcccccttcagggg

SEQ ID NO: 8185196 - DNA, 22 bp, Homo sapiens
cttcttctggacaggcagctcc

SEQ ID NO: 8185197 - DNA, 22 bp, Homo sapiens
cttgcctccctcagctcacagc

SEQ ID NO: 8185198 - DNA, 22 bp, Homo sapiens
cttgcctaggtgtatattaaat

SEQ ID NO: 8185199 - DNA, 22 bp, Homo sapiens
cttgcctacttgtcaaccagca

SEQ ID NO: 8185200 - DNA, 22 bp, Homo sapiens
cttgctgtcttgcatttagagc

SEQ ID NO: 8185201 - DNA, 22 bp, Homo sapiens
cttgctggtgtcgtgccttcac

SEQ ID NO: 8185202 - DNA, 22 bp, Homo sapiens
cttgctgtcccttggtatgaac

SEQ ID NO: 8185203 - DNA, 22 bp, Homo sapiens
cttgctggtgtcgtgccttcac

SEQ ID NO: 8185204 - DNA, 19 bp, Homo sapiens
cttgctgggtggtttctgc

SEQ ID NO: 8185205 - DNA, 22 bp, Homo sapiens
cttgctggtattttctctctca

SEQ ID NO: 8185206 - DNA, 22 bp, Homo sapiens
cttgctggtggtgttttctatg

SEQ ID NO: 8185207 - DNA, 22 bp, Homo sapiens
cttgctggtggtgttttctatg

SEQ ID NO: 8185208 - DNA, 22 bp, Homo sapiens
cttgctggggtaagtctgtgct

SEQ ID NO: 8185209 - DNA, 19 bp, Homo sapiens
cttgctgggtggtttctgc

SEQ ID NO: 8185210 - DNA, 22 bp, Homo sapiens
cttggacaacttttctctggtt

SEQ ID NO: 8185211 - DNA, 22 bp, Homo sapiens
cttggagacaggacaggcagaa

SEQ ID NO: 8185212 - DNA, 22 bp, Homo sapiens
cttggagaatgacagtggatta

SEQ ID NO: 8185213 - DNA, 22 bp, Homo sapiens
cttgcttttgctgatgattaag

SEQ ID NO: 8185214 - DNA, 22 bp, Homo sapiens
cttggaaaggttttacaaagcg

SEQ ID NO: 8185215 - DNA, 22 bp, Homo sapiens
cttgctgtcttgcatttagagc

SEQ ID NO: 8185216 - DNA, 22 bp, Homo sapiens
cttgctgtgtggtgttctcaga

SEQ ID NO: 8185217 - DNA, 22 bp, Homo sapiens
gaagaagcaggagtgtgtagca

SEQ ID NO: 8185218 - DNA, 22 bp, Homo sapiens
gaagaagagataatggggagca

SEQ ID NO: 8185219 - DNA, 19 bp, Homo sapiens
gaagaagcttgagaagtag

SEQ ID NO: 8185220 - DNA, 22 bp, Homo sapiens
gaagaagcaggagtgtgtagca

SEQ ID NO: 8185221 - DNA, 19 bp, Homo sapiens
gaagaagcttgagaagtag

SEQ ID NO: 8185222 - DNA, 22 bp, Homo sapiens
gaagaagcctctgtggatctga

SEQ ID NO: 8185223 - DNA, 22 bp, Homo sapiens
gaagaagggagtgacaaatgca

SEQ ID NO: 8185224 - DNA, 22 bp, Homo sapiens
gaacttcttcaacataatggac

SEQ ID NO: 8185225 - DNA, 22 bp, Homo sapiens
gaaattgtctgtgcccaagtct

SEQ ID NO: 8185226 - DNA, 22 bp, Homo sapiens
gaaattgtcagtgatatgatac

SEQ ID NO: 8185227 - DNA, 22 bp, Homo sapiens
gaactttaaaacaaagtacagt

SEQ ID NO: 8185228 - DNA, 22 bp, Homo sapiens
gaacttgtgcactgctggtgat

SEQ ID NO: 8185229 - DNA, 22 bp, Homo sapiens
gaagaaattgaattcatgagct

SEQ ID NO: 8185230 - DNA, 22 bp, Homo sapiens
gaagaacaagcagtgctttcct

SEQ ID NO: 8185231 - DNA, 22 bp, Homo sapiens
gaagaacaagcagtgctttcct

SEQ ID NO: 8185232 - DNA, 22 bp, Homo sapiens
gaagaacacttcatgattcatt

SEQ ID NO: 8185233 - DNA, 22 bp, Homo sapiens
gaagaactgacaaactagatca

SEQ ID NO: 8185234 - DNA, 22 bp, Homo sapiens
gaaattgaaaccgatctgtgtt

SEQ ID NO: 8185235 - DNA, 22 bp, Homo sapiens
gaaattctgtgtcccagagtgc

SEQ ID NO: 8185236 - DNA, 22 bp, Homo sapiens
gaaattgtcagcttctttcagt

SEQ ID NO: 8185237 - DNA, 22 bp, Homo sapiens
gaaattgtaaaggattgcgcca

SEQ ID NO: 8185238 - DNA, 22 bp, Homo sapiens
gaaattgaataccctgcatgaa

SEQ ID NO: 8185239 - DNA, 22 bp, Homo sapiens
gaaattcactgtatttcttggg

SEQ ID NO: 8185240 - DNA, 22 bp, Homo sapiens
gaaattcactgtatttcttggg

SEQ ID NO: 8185241 - DNA, 20 bp, Homo sapiens
gaaattctcgtattagttta

SEQ ID NO: 8185242 - DNA, 22 bp, Homo sapiens
gaaattattgctagagactgca

SEQ ID NO: 8185243 - DNA, 22 bp, Homo sapiens
gaaattcaaataagatatgtag

SEQ ID NO: 8185244 - DNA, 22 bp, Homo sapiens
gaaattcaccttttacgtggcc

SEQ ID NO: 8185245 - DNA, 22 bp, Homo sapiens
gaaattcaaataagatatgtag

SEQ ID NO: 8185246 - DNA, 22 bp, Homo sapiens
gaaattcaaaatgtcagtatag

SEQ ID NO: 8185247 - DNA, 22 bp, Homo sapiens
gaaattcaaaatgtcagtatag

SEQ ID NO: 8185248 - DNA, 22 bp, Homo sapiens
gaaatgttcctgatccctgatt

SEQ ID NO: 8185249 - DNA, 22 bp, Homo sapiens
gaaatgttatgagatatgtact

SEQ ID NO: 8185250 - DNA, 22 bp, Homo sapiens
gaaatgttgtctctgcagcaat

SEQ ID NO: 8185251 - DNA, 22 bp, Homo sapiens
gaaatgttgtcctgtctcttga

SEQ ID NO: 8185252 - DNA, 22 bp, Homo sapiens
gaaatgtatttgacagtccttg

SEQ ID NO: 8185253 - DNA, 22 bp, Homo sapiens
gaaatgtatttgacagtccttg

SEQ ID NO: 8185254 - DNA, 22 bp, Homo sapiens
gaaatgtatgtcttcccccatt

SEQ ID NO: 8185255 - DNA, 22 bp, Homo sapiens
gaaatgtatgtcttcccccatt

SEQ ID NO: 8185256 - DNA, 20 bp, Homo sapiens
gaaatgtatctcttgattct

SEQ ID NO: 8185257 - DNA, 20 bp, Homo sapiens
gaaatgtatctcttgattct

SEQ ID NO: 8185258 - DNA, 22 bp, Homo sapiens
gaaatgtataagctggtctttt

SEQ ID NO: 8185259 - DNA, 22 bp, Homo sapiens
gaaatgtaggcataattatttt

SEQ ID NO: 8185260 - DNA, 22 bp, Homo sapiens
gaaatattgtactggagatgtt

SEQ ID NO: 8185261 - DNA, 22 bp, Homo sapiens
gaaatattgtactggagatgtt

SEQ ID NO: 8185262 - DNA, 22 bp, Homo sapiens
gaaatattgggactcagagctt

SEQ ID NO: 8185263 - DNA, 22 bp, Homo sapiens
gaaatattgggactcagagctt

SEQ ID NO: 8185264 - DNA, 22 bp, Homo sapiens
gaaatattgtactggagatgtt

SEQ ID NO: 8185265 - DNA, 22 bp, Homo sapiens
gaaatattgggactcagagctt

SEQ ID NO: 8185266 - DNA, 22 bp, Homo sapiens
gaaatattgggactcagagctt

SEQ ID NO: 8185267 - DNA, 22 bp, Homo sapiens
gaaatattgggactcagagctt

SEQ ID NO: 8185268 - DNA, 22 bp, Homo sapiens
gaaatattgggactcagagctt

SEQ ID NO: 8185269 - DNA, 22 bp, Homo sapiens
gaaatattgggactcagagctt

SEQ ID NO: 8185270 - DNA, 22 bp, Homo sapiens
gaaatattgggactcagagctt

SEQ ID NO: 8185271 - DNA, 22 bp, Homo sapiens
gaaatattgggactcagagctt

SEQ ID NO: 8185272 - DNA, 22 bp, Homo sapiens
gaaatgtaggcataattatttt

SEQ ID NO: 8185273 - DNA, 22 bp, Homo sapiens
gaaatgtagagtatctgaggat

SEQ ID NO: 8185274 - DNA, 22 bp, Homo sapiens
gaaatgtaggcataattatttt

SEQ ID NO: 8185275 - DNA, 22 bp, Homo sapiens
gaaatgtagaattgcttaactg

SEQ ID NO: 8185276 - DNA, 22 bp, Homo sapiens
gaaatatttctcttgagcccct

SEQ ID NO: 8185277 - DNA, 22 bp, Homo sapiens
gaaatattgtactggagatgtt

SEQ ID NO: 8185278 - DNA, 22 bp, Homo sapiens
gaaatattgtactggagatgtt

SEQ ID NO: 8185279 - DNA, 22 bp, Homo sapiens
gaaatattgtactggagatgtt

SEQ ID NO: 8185280 - DNA, 22 bp, Homo sapiens
gaaatattgtactggagatgtt

SEQ ID NO: 8185281 - DNA, 22 bp, Homo sapiens
gaaatattgtactggagatgtt

SEQ ID NO: 8185282 - DNA, 22 bp, Homo sapiens
gaaatattgtactggagatgtt

SEQ ID NO: 8185283 - DNA, 22 bp, Homo sapiens
gaaatattgtactggagatgtt

SEQ ID NO: 8185284 - DNA, 22 bp, Homo sapiens
gaaagacatagttgcaagatgg

SEQ ID NO: 8185285 - DNA, 22 bp, Homo sapiens
gaaagactaactagaaagtgca

SEQ ID NO: 8185286 - DNA, 22 bp, Homo sapiens
gaaagaccgtttgggctctaaa

SEQ ID NO: 8185287 - DNA, 22 bp, Homo sapiens
gaaagaccagcatgaggcttta

SEQ ID NO: 8185288 - DNA, 22 bp, Homo sapiens
gaaagaccagaattatggactc

SEQ ID NO: 8185289 - DNA, 22 bp, Homo sapiens
gaaatacaggaatgccacacag

SEQ ID NO: 8185290 - DNA, 22 bp, Homo sapiens
gaaatacaggaatgccacacag

SEQ ID NO: 8185291 - DNA, 22 bp, Homo sapiens
gaaatacaggaatgccacacag

SEQ ID NO: 8185292 - DNA, 22 bp, Homo sapiens
gaaatatacattgcaggaagag

SEQ ID NO: 8185293 - DNA, 22 bp, Homo sapiens
gaaagagaacctgggcctagat

SEQ ID NO: 8185294 - DNA, 22 bp, Homo sapiens
gaaagacttcctttgagagtac

SEQ ID NO: 8185295 - DNA, 22 bp, Homo sapiens
gaaagagaacctgggcctagat

SEQ ID NO: 8185296 - DNA, 22 bp, Homo sapiens
gaaatacagaaagggctgaatg

SEQ ID NO: 8185297 - DNA, 22 bp, Homo sapiens
gaaatattcttgtcttgttttc

SEQ ID NO: 8185298 - DNA, 22 bp, Homo sapiens
gaaatattcttgtcttgttttc

SEQ ID NO: 8185299 - DNA, 22 bp, Homo sapiens
gaaatattcttgtcttgttttc

SEQ ID NO: 8185300 - DNA, 22 bp, Homo sapiens
gaaatattcttgtcttgttttc

SEQ ID NO: 8185301 - DNA, 22 bp, Homo sapiens
gaaatattcttgtcttgttttc

SEQ ID NO: 8185302 - DNA, 22 bp, Homo sapiens
gaaatattcttgtcttgttttc

SEQ ID NO: 8185303 - DNA, 22 bp, Homo sapiens
gaaatattcttgtcttgttttc

SEQ ID NO: 8185304 - DNA, 22 bp, Homo sapiens
gaaatattacagtggaggggat

SEQ ID NO: 8185305 - DNA, 22 bp, Homo sapiens
gaaatattacagtggaggggat

SEQ ID NO: 8185306 - DNA, 22 bp, Homo sapiens
gaaatattcttgtcttgttttc

SEQ ID NO: 8185307 - DNA, 22 bp, Homo sapiens
gaaatattcttgtcttgttttc

SEQ ID NO: 8185308 - DNA, 22 bp, Homo sapiens
gaaatatacattgcaggaagag

SEQ ID NO: 8185309 - DNA, 22 bp, Homo sapiens
gaaatattacagtggaggggat

SEQ ID NO: 8185310 - DNA, 22 bp, Homo sapiens
gaaatatacattgcaggaagag

SEQ ID NO: 8185311 - DNA, 22 bp, Homo sapiens
gaaatatacattgcaggaagag

SEQ ID NO: 8185312 - DNA, 22 bp, Homo sapiens
gaaatattacagtggaggggat

SEQ ID NO: 8185313 - DNA, 22 bp, Homo sapiens
gaaatattacagtggaggggat

SEQ ID NO: 8185314 - DNA, 22 bp, Homo sapiens
gaaatattacagtggaggggat

SEQ ID NO: 8185315 - DNA, 22 bp, Homo sapiens
gaaatattacagtggaggggat

SEQ ID NO: 8185316 - DNA, 22 bp, Homo sapiens
gaaatattacagtggaggggat

SEQ ID NO: 8185317 - DNA, 22 bp, Homo sapiens
ctttggaagtaaagtcagcagg

SEQ ID NO: 8185318 - DNA, 22 bp, Homo sapiens
ctttggaagtgatagatatgat

SEQ ID NO: 8185319 - DNA, 22 bp, Homo sapiens
ctttggatgactggtgcaggtt

SEQ ID NO: 8185320 - DNA, 22 bp, Homo sapiens
ctttggatttttatcaggcaat

SEQ ID NO: 8185321 - DNA, 22 bp, Homo sapiens
ctttggcaagggttttaattgt

SEQ ID NO: 8185322 - DNA, 22 bp, Homo sapiens
ctttttcccaggtggagagagg

SEQ ID NO: 8185323 - DNA, 22 bp, Homo sapiens
ctttttcccaggtggagagagg

SEQ ID NO: 8185324 - DNA, 22 bp, Homo sapiens
cttttgttaggagaaaacatca

SEQ ID NO: 8185325 - DNA, 22 bp, Homo sapiens
ctttggcaatgtcattttcaat

SEQ ID NO: 8185326 - DNA, 20 bp, Homo sapiens
ctttggcaatgagaacaggg

SEQ ID NO: 8185327 - DNA, 22 bp, Homo sapiens
ctttggcacagtctcatttgat

SEQ ID NO: 8185328 - DNA, 22 bp, Homo sapiens
ctttttctgatgttccatgatt

SEQ ID NO: 8185329 - DNA, 20 bp, Homo sapiens
ctttttctccagctctgagc

SEQ ID NO: 8185330 - DNA, 22 bp, Homo sapiens
ctttttctaatcataattgtct

SEQ ID NO: 8185331 - DNA, 22 bp, Homo sapiens
ctttttctaatcataattgtct

SEQ ID NO: 8185332 - DNA, 22 bp, Homo sapiens
ctttttctaatcataattgtct

SEQ ID NO: 8185333 - DNA, 22 bp, Homo sapiens
ctttttctaatcataattgtct

SEQ ID NO: 8185334 - DNA, 22 bp, Homo sapiens
ctttttcctcgtagagcctaat

SEQ ID NO: 8185335 - DNA, 22 bp, Homo sapiens
ctttttcctcgtagagcctaat

SEQ ID NO: 8185336 - DNA, 22 bp, Homo sapiens
gaaagaagctttagatggctat

SEQ ID NO: 8185337 - DNA, 22 bp, Homo sapiens
gaaagaagctttagatggctat

SEQ ID NO: 8185338 - DNA, 22 bp, Homo sapiens
gaaactgtgatcgtgttctggg

SEQ ID NO: 8185339 - DNA, 22 bp, Homo sapiens
gaaacttgataattgaaacaga

SEQ ID NO: 8185340 - DNA, 22 bp, Homo sapiens
gaaactttggctaaaagccaga

SEQ ID NO: 8185341 - DNA, 22 bp, Homo sapiens
gaaaccatgcaagctgctagag

SEQ ID NO: 8185342 - DNA, 22 bp, Homo sapiens
gaaacccaaactaagacagtag

SEQ ID NO: 8185343 - DNA, 22 bp, Homo sapiens
gaaactgagtaggctagagcac

SEQ ID NO: 8185344 - DNA, 22 bp, Homo sapiens
gaaactgagtaggctagagcac

SEQ ID NO: 8185345 - DNA, 22 bp, Homo sapiens
gaaactggatgcagggatgcag

SEQ ID NO: 8185346 - DNA, 22 bp, Homo sapiens
gaaactgatattaactcagtgt

SEQ ID NO: 8185347 - DNA, 22 bp, Homo sapiens
gaaactgtgaggatcttaactt

SEQ ID NO: 8185348 - DNA, 22 bp, Homo sapiens
gaaactgtatgtagtttttggg

SEQ ID NO: 8185349 - DNA, 22 bp, Homo sapiens
gaaactggatgcagggatgcag

SEQ ID NO: 8185350 - DNA, 22 bp, Homo sapiens
gaaactagatgtattagagatt

SEQ ID NO: 8185351 - DNA, 22 bp, Homo sapiens
gaaactgaatataagaaaggta

SEQ ID NO: 8185352 - DNA, 22 bp, Homo sapiens
gaaactgagtaggctagagcac

SEQ ID NO: 8185353 - DNA, 22 bp, Homo sapiens
gaaactgaatataagaaaggta

SEQ ID NO: 8185354 - DNA, 22 bp, Homo sapiens
gaaactgaatataagaaaggta

SEQ ID NO: 8185355 - DNA, 22 bp, Homo sapiens
ctttttgtgtatgctacagttg

SEQ ID NO: 8185356 - DNA, 22 bp, Homo sapiens
cttttttaaggtagctcctcct

SEQ ID NO: 8185357 - DNA, 22 bp, Homo sapiens
cttttttcctaaggcaacatga

SEQ ID NO: 8185358 - DNA, 22 bp, Homo sapiens
cttttttcctaaggcaacatga

SEQ ID NO: 8185359 - DNA, 22 bp, Homo sapiens
gaaaaatgctccaaatctgtgg

SEQ ID NO: 8185360 - DNA, 22 bp, Homo sapiens
gaaaaatgagctgatgtcaggg

SEQ ID NO: 8185361 - DNA, 22 bp, Homo sapiens
gaaaacactttgatctgaaagt

SEQ ID NO: 8185362 - DNA, 22 bp, Homo sapiens
gaaacagcacgtttggagagat

SEQ ID NO: 8185363 - DNA, 22 bp, Homo sapiens
gaaaaatgctccaaatctgtgg

SEQ ID NO: 8185364 - DNA, 22 bp, Homo sapiens
gaaacagcccctgtgtgaagca

SEQ ID NO: 8185365 - DNA, 22 bp, Homo sapiens
gaaacagctagaaagccattgg

SEQ ID NO: 8185366 - DNA, 22 bp, Homo sapiens
gaaacagctagaaagccattgg

SEQ ID NO: 8185367 - DNA, 22 bp, Homo sapiens
gaaaccagataagggaggctga

SEQ ID NO: 8185368 - DNA, 22 bp, Homo sapiens
gaaacagctttaagtgatactg

SEQ ID NO: 8185369 - DNA, 22 bp, Homo sapiens
ctggtacatttgatgataatag

SEQ ID NO: 8185370 - DNA, 22 bp, Homo sapiens
ctggtacagtgttacaaaatgg

SEQ ID NO: 8185371 - DNA, 22 bp, Homo sapiens
ctgggttttattacagtgagct

SEQ ID NO: 8185372 - DNA, 22 bp, Homo sapiens
ctggtaacaatatccacaaaga

SEQ ID NO: 8185373 - DNA, 22 bp, Homo sapiens
ctggtacaaaatgctgatatca

SEQ ID NO: 8185374 - DNA, 22 bp, Homo sapiens
ctgggttgatctcagccctaag

SEQ ID NO: 8185375 - DNA, 22 bp, Homo sapiens
ctgggttgcaaagcgctggctg

SEQ ID NO: 8185376 - DNA, 22 bp, Homo sapiens
ctgggtttagggtctccccttg

SEQ ID NO: 8185377 - DNA, 22 bp, Homo sapiens
ctgggtttagggtctccccttg

SEQ ID NO: 8185378 - DNA, 22 bp, Homo sapiens
ctgggttggggttacatgactg

SEQ ID NO: 8185379 - DNA, 22 bp, Homo sapiens
ctgggttgccctgggcctgtga

SEQ ID NO: 8185380 - DNA, 22 bp, Homo sapiens
ctgggttgccctgggcctgtga

SEQ ID NO: 8185381 - DNA, 22 bp, Homo sapiens
ctgggttggggttacatgactg

SEQ ID NO: 8185382 - DNA, 22 bp, Homo sapiens
ctgggttgcaaagcgctggctg

SEQ ID NO: 8185383 - DNA, 22 bp, Homo sapiens
ctgggttgcaaagcgctggctg

SEQ ID NO: 8185384 - DNA, 22 bp, Homo sapiens
ctgggttgccctgggcctgtga

SEQ ID NO: 8185385 - DNA, 22 bp, Homo sapiens
ctgggtggaaagtgctgagaat

SEQ ID NO: 8185386 - DNA, 22 bp, Homo sapiens
ctgggtggaaagtgctgagaat

SEQ ID NO: 8185387 - DNA, 22 bp, Homo sapiens
ctgggtggttttgatgtgaatt

SEQ ID NO: 8185388 - DNA, 22 bp, Homo sapiens
ctgggtggttctaactgttgat

SEQ ID NO: 8185389 - DNA, 22 bp, Homo sapiens
ctgggtgtagcccagtatgagg

SEQ ID NO: 8185390 - DNA, 22 bp, Homo sapiens
ctgggtgtagatggaagtttgg

SEQ ID NO: 8185391 - DNA, 22 bp, Homo sapiens
ctgggtgtgggtcaagcaacca

SEQ ID NO: 8185392 - DNA, 22 bp, Homo sapiens
ctgggtgttcacccgaggcgct

SEQ ID NO: 8185393 - DNA, 22 bp, Homo sapiens
ctgggtgtcaggagacatgatg

SEQ ID NO: 8185394 - DNA, 22 bp, Homo sapiens
ctgggtgttgggtactgaccgt

SEQ ID NO: 8185395 - DNA, 22 bp, Homo sapiens
ctgggttacaagaagcaaaaac

SEQ ID NO: 8185396 - DNA, 22 bp, Homo sapiens
ctgggtgttcaggagctgggct

SEQ ID NO: 8185397 - DNA, 22 bp, Homo sapiens
ctgggtgttcacccgaggcgct

SEQ ID NO: 8185398 - DNA, 22 bp, Homo sapiens
ctggtgtccgcaacgggcagcg

SEQ ID NO: 8185399 - DNA, 22 bp, Homo sapiens
ctggtgtccagcatgtgtggaa

SEQ ID NO: 8185400 - DNA, 22 bp, Homo sapiens
ctggtggttcaggagaatggct

SEQ ID NO: 8185401 - DNA, 22 bp, Homo sapiens
ctggtgtctgctccctcacagc

SEQ ID NO: 8185402 - DNA, 22 bp, Homo sapiens
ctggtgtctgctccctcacagc

SEQ ID NO: 8185403 - DNA, 22 bp, Homo sapiens
ctggtgtgattgagcccaggtg

SEQ ID NO: 8185404 - DNA, 22 bp, Homo sapiens
ctggtgtgattgagcccaggtg

SEQ ID NO: 8185405 - DNA, 22 bp, Homo sapiens
ctggttaaatgaaaaagtatta

SEQ ID NO: 8185406 - DNA, 22 bp, Homo sapiens
ctggtgtttatctgactgccta

SEQ ID NO: 8185407 - DNA, 22 bp, Homo sapiens
ctggttaaatgaaaaagtatta

SEQ ID NO: 8185408 - DNA, 22 bp, Homo sapiens
ctggtgtttattacaggtgctc

SEQ ID NO: 8185409 - DNA, 22 bp, Homo sapiens
ctggtgtggcggcgccctgtag

SEQ ID NO: 8185410 - DNA, 22 bp, Homo sapiens
ctggtgtggcggcgccctgtag

SEQ ID NO: 8185411 - DNA, 22 bp, Homo sapiens
ctggtgtggcggcgccctgtag

SEQ ID NO: 8185412 - DNA, 22 bp, Homo sapiens
ctggtgtggactccgcgcggag

SEQ ID NO: 8185413 - DNA, 22 bp, Homo sapiens
ctggtaggggtgactgttatcg

SEQ ID NO: 8185414 - DNA, 22 bp, Homo sapiens
ctggtagtgtctgccgaggtcc

SEQ ID NO: 8185415 - DNA, 22 bp, Homo sapiens
ctggtagtttgcaaaatggtgt

SEQ ID NO: 8185416 - DNA, 22 bp, Homo sapiens
ctggtcacctccttcccagcta

SEQ ID NO: 8185417 - DNA, 22 bp, Homo sapiens
ctggtgcctcctccctgtgctt

SEQ ID NO: 8185418 - DNA, 22 bp, Homo sapiens
ctggtgcctcctccctgtgctt

SEQ ID NO: 8185419 - DNA, 22 bp, Homo sapiens
ctggtgcctcctccctgtgctt

SEQ ID NO: 8185420 - DNA, 22 bp, Homo sapiens
ctggtcacctccttcccagcta

SEQ ID NO: 8185421 - DNA, 22 bp, Homo sapiens
ctggtgggtagagggcatcagg

SEQ ID NO: 8185422 - DNA, 22 bp, Homo sapiens
ctggtgcctcctctcccaggtc

SEQ ID NO: 8185423 - DNA, 22 bp, Homo sapiens
ctggtgctggagcctagtccct

SEQ ID NO: 8185424 - DNA, 20 bp, Homo sapiens
ctgggctcggtggccctggc

SEQ ID NO: 8185425 - DNA, 22 bp, Homo sapiens
ctgggctctaagggagcaccgt

SEQ ID NO: 8185426 - DNA, 20 bp, Homo sapiens
ctgggctcggtggccctggc

SEQ ID NO: 8185427 - DNA, 18 bp, Homo sapiens
ctgggctcgagagatcct

SEQ ID NO: 8185428 - DNA, 18 bp, Homo sapiens
ctgggctcgagagatcct

SEQ ID NO: 8185429 - DNA, 22 bp, Homo sapiens
ctgggctcctaaccatccaggt

SEQ ID NO: 8185430 - DNA, 18 bp, Homo sapiens
ctgggctcgagagatcct

SEQ ID NO: 8185431 - DNA, 22 bp, Homo sapiens
ctgggctcctaaccatccaggt

SEQ ID NO: 8185432 - DNA, 22 bp, Homo sapiens
ctgggctcctaaccatccaggt

SEQ ID NO: 8185433 - DNA, 22 bp, Homo sapiens
ctgggctccctcatgtgtctgc

SEQ ID NO: 8185434 - DNA, 22 bp, Homo sapiens
ctgggctcctaaccatccaggt

SEQ ID NO: 8185435 - DNA, 22 bp, Homo sapiens
ctgggctccctcatgtgtctgc

SEQ ID NO: 8185436 - DNA, 22 bp, Homo sapiens
ctgggctccctcatgtgtctgc

SEQ ID NO: 8185437 - DNA, 22 bp, Homo sapiens
ctggggggctactgacagagga

SEQ ID NO: 8185438 - DNA, 22 bp, Homo sapiens
ctgggggcaatggtcagagtgt

SEQ ID NO: 8185439 - DNA, 22 bp, Homo sapiens
ctggggctgtaggaggacttat

SEQ ID NO: 8185440 - DNA, 22 bp, Homo sapiens
ctggggctggtgaggcaggctc

SEQ ID NO: 8185441 - DNA, 22 bp, Homo sapiens
ctggggctggtgaggcaggctc

SEQ ID NO: 8185442 - DNA, 22 bp, Homo sapiens
ctggggctggtgaggcaggctc

SEQ ID NO: 8185443 - DNA, 22 bp, Homo sapiens
ctggggctggtgaggcaggctc

SEQ ID NO: 8185444 - DNA, 22 bp, Homo sapiens
ctgggctctagaaaggaaagaa

SEQ ID NO: 8185445 - DNA, 22 bp, Homo sapiens
ctgggctctaagggagcaccgt

SEQ ID NO: 8185446 - DNA, 22 bp, Homo sapiens
ctggggctggtgaggcaggctc

SEQ ID NO: 8185447 - DNA, 22 bp, Homo sapiens
ctggggctggtgaggcaggctc

SEQ ID NO: 8185448 - DNA, 22 bp, Homo sapiens
ctggggctggtgaggcaggctc

SEQ ID NO: 8185449 - DNA, 22 bp, Homo sapiens
ctgggggtcttgaaagggagag

SEQ ID NO: 8185450 - DNA, 22 bp, Homo sapiens
ctgggggtgagcagcagcgacg

SEQ ID NO: 8185451 - DNA, 22 bp, Homo sapiens
ctgggggtgagcagcagcgacg

SEQ ID NO: 8185452 - DNA, 22 bp, Homo sapiens
ctgggggtgagcagcagcgacg

SEQ ID NO: 8185453 - DNA, 22 bp, Homo sapiens
ctgggggtcgcgcctctgggca

SEQ ID NO: 8185454 - DNA, 22 bp, Homo sapiens
ctgggggtcgcgcctctgggca

SEQ ID NO: 8185455 - DNA, 22 bp, Homo sapiens
ctggggggctactgacagagga

SEQ ID NO: 8185456 - DNA, 22 bp, Homo sapiens
ctggggggctactgacagagga

SEQ ID NO: 8185457 - DNA, 22 bp, Homo sapiens
ctgggggtcgcgcctctgggca

SEQ ID NO: 8185458 - DNA, 22 bp, Homo sapiens
ctgggggtgagcagcagcgacg

SEQ ID NO: 8185459 - DNA, 22 bp, Homo sapiens
ctgggggtgagcagcagcgacg

SEQ ID NO: 8185460 - DNA, 22 bp, Homo sapiens
ctggggtatctgccacaactct

SEQ ID NO: 8185461 - DNA, 22 bp, Homo sapiens
ctggggtcagggatcagagagc

SEQ ID NO: 8185462 - DNA, 22 bp, Homo sapiens
ctggggtctcaattctagcggg

SEQ ID NO: 8185463 - DNA, 22 bp, Homo sapiens
ctggggtgagcagaaacagggg

SEQ ID NO: 8185464 - DNA, 22 bp, Homo sapiens
ctggggtgaaggattacctgag

SEQ ID NO: 8185465 - DNA, 22 bp, Homo sapiens
ctggggtggatgggtccaagtt

SEQ ID NO: 8185466 - DNA, 22 bp, Homo sapiens
ctggggtggatgggtccaagtt

SEQ ID NO: 8185467 - DNA, 22 bp, Homo sapiens
ctggggtggatgggtccaagtt

SEQ ID NO: 8185468 - DNA, 22 bp, Homo sapiens
ctggggtggtgcaggcctcatg

SEQ ID NO: 8185469 - DNA, 22 bp, Homo sapiens
ctggggtggaggagctcccctg

SEQ ID NO: 8185470 - DNA, 22 bp, Homo sapiens
ctggggtggagattggcaatct

SEQ ID NO: 8185471 - DNA, 22 bp, Homo sapiens
ctggggtggagattggcaatct

SEQ ID NO: 8185472 - DNA, 22 bp, Homo sapiens
ctggggtggagattggcaatct

SEQ ID NO: 8185473 - DNA, 22 bp, Homo sapiens
ctggggtgagcagaaacagggg

SEQ ID NO: 8185474 - DNA, 22 bp, Homo sapiens
ctggggtgagcagaaacagggg

SEQ ID NO: 8185475 - DNA, 22 bp, Homo sapiens
ctggggtgtctcgtctgccatt

SEQ ID NO: 8185476 - DNA, 22 bp, Homo sapiens
ctggggtgtctcgtctgccatt

SEQ ID NO: 8185477 - DNA, 22 bp, Homo sapiens
ctggggtggtgcaggcctcatg

SEQ ID NO: 8185478 - DNA, 22 bp, Homo sapiens
ctggggtgtctcgtctgccatt

SEQ ID NO: 8185479 - DNA, 22 bp, Homo sapiens
ctgggtggaaagtgctgagaat

SEQ ID NO: 8185480 - DNA, 22 bp, Homo sapiens
ctgggtggaaagtgctgagaat

SEQ ID NO: 8185481 - DNA, 22 bp, Homo sapiens
ctgggtgcttactttgtgctag

SEQ ID NO: 8185482 - DNA, 22 bp, Homo sapiens
ctgggtggaaagtgctgagaat

SEQ ID NO: 8185483 - DNA, 22 bp, Homo sapiens
ctgggccctatggaagaaaggg

SEQ ID NO: 8185484 - DNA, 22 bp, Homo sapiens
ctgggcctagaggaagctgaca

SEQ ID NO: 8185485 - DNA, 22 bp, Homo sapiens
ctgggcctaacccacagcgttt

SEQ ID NO: 8185486 - DNA, 22 bp, Homo sapiens
ctgggcctaacccacagcgttt

SEQ ID NO: 8185487 - DNA, 22 bp, Homo sapiens
ctgggccctgaagacagtcagg

SEQ ID NO: 8185488 - DNA, 22 bp, Homo sapiens
ctgggcctagcaacagaggagt

SEQ ID NO: 8185489 - DNA, 22 bp, Homo sapiens
ctgggcctagcaacagaggagt

SEQ ID NO: 8185490 - DNA, 22 bp, Homo sapiens
ctgggcctagaggaagctgaca

SEQ ID NO: 8185491 - DNA, 22 bp, Homo sapiens
ctgggcctcatccccagagttt

SEQ ID NO: 8185492 - DNA, 22 bp, Homo sapiens
ctgggcctcatccccagagttt

SEQ ID NO: 8185493 - DNA, 22 bp, Homo sapiens
ctgggcctcaagctcagatttc

SEQ ID NO: 8185494 - DNA, 22 bp, Homo sapiens
ctgggcctcacacccaccaaat

SEQ ID NO: 8185495 - DNA, 22 bp, Homo sapiens
ctgggctcaagaagtcttccct

SEQ ID NO: 8185496 - DNA, 22 bp, Homo sapiens
ctgggctcaaatcctggccctg

SEQ ID NO: 8185497 - DNA, 22 bp, Homo sapiens
ctgggctcaaatcctggccctg

SEQ ID NO: 8185498 - DNA, 22 bp, Homo sapiens
ctgggctcagcccatgctgtcc

SEQ ID NO: 8185499 - DNA, 22 bp, Homo sapiens
ctgggctcagcccatgctgtcc

SEQ ID NO: 8185500 - DNA, 22 bp, Homo sapiens
ctgggcctccacgggccatcac

SEQ ID NO: 8185501 - DNA, 22 bp, Homo sapiens
ctgggcctccagctctgccagc

SEQ ID NO: 8185502 - DNA, 22 bp, Homo sapiens
ctgggcctccagctctgccagc

SEQ ID NO: 8185503 - DNA, 22 bp, Homo sapiens
ctgggcctccagctctgccagc

SEQ ID NO: 8185504 - DNA, 22 bp, Homo sapiens
ctgggcctccacgggccatcac

SEQ ID NO: 8185505 - DNA, 22 bp, Homo sapiens
ctgggcctccacgggccatcac

SEQ ID NO: 8185506 - DNA, 22 bp, Homo sapiens
ctgggcctcatgcacagagatg

SEQ ID NO: 8185507 - DNA, 22 bp, Homo sapiens
ctgggctcagtggctcatggct

SEQ ID NO: 8185508 - DNA, 22 bp, Homo sapiens
ctgggctcagtggctcatggct

SEQ ID NO: 8185509 - DNA, 22 bp, Homo sapiens
ctgggctcagtggctcatggct

SEQ ID NO: 8185510 - DNA, 22 bp, Homo sapiens
ctgggctcagtggctcatggct

SEQ ID NO: 8185511 - DNA, 22 bp, Homo sapiens
ctgggctcagtggctcatggct

SEQ ID NO: 8185512 - DNA, 22 bp, Homo sapiens
ctgggctccactacttgctaac

SEQ ID NO: 8185513 - DNA, 22 bp, Homo sapiens
ctgggctccactacttgctaac

SEQ ID NO: 8185514 - DNA, 22 bp, Homo sapiens
ctgggctccactacttgctaac

SEQ ID NO: 8185515 - DNA, 21 bp, Homo sapiens
ctgggctcatggtgttacaga

SEQ ID NO: 8185516 - DNA, 22 bp, Homo sapiens
ctgggctccctcatgtgtctgc

SEQ ID NO: 8185517 - DNA, 22 bp, Homo sapiens
ctgggctccactcccacagtgt

SEQ ID NO: 8185518 - DNA, 22 bp, Homo sapiens
ctgggctccactacttgctaac

SEQ ID NO: 8185519 - DNA, 22 bp, Homo sapiens
ctggagctctccagagccccgt

SEQ ID NO: 8185520 - DNA, 22 bp, Homo sapiens
ctggagctccagggtctcctct

SEQ ID NO: 8185521 - DNA, 22 bp, Homo sapiens
ctgggaggcggaggttgcagtg

SEQ ID NO: 8185522 - DNA, 22 bp, Homo sapiens
ctgggaggcggaggttgcagtg

SEQ ID NO: 8185523 - DNA, 22 bp, Homo sapiens
ctggagctccagggtctcctct

SEQ ID NO: 8185524 - DNA, 22 bp, Homo sapiens
ctggagctccagggtctcctct

SEQ ID NO: 8185525 - DNA, 22 bp, Homo sapiens
ctggagctcagcccaggttcca

SEQ ID NO: 8185526 - DNA, 22 bp, Homo sapiens
ctggagctccagggtctcctct

SEQ ID NO: 8185527 - DNA, 22 bp, Homo sapiens
ctggagccttcaccaggggaaa

SEQ ID NO: 8185528 - DNA, 22 bp, Homo sapiens
ctggagctaataatccatctga

SEQ ID NO: 8185529 - DNA, 22 bp, Homo sapiens
ctggagccttcaccaggggaaa

SEQ ID NO: 8185530 - DNA, 22 bp, Homo sapiens
ctggagctaataatccatctga

SEQ ID NO: 8185531 - DNA, 22 bp, Homo sapiens
ctggagctcagcccaggttcca

SEQ ID NO: 8185532 - DNA, 22 bp, Homo sapiens
ctggagctcagcccaggttcca

SEQ ID NO: 8185533 - DNA, 22 bp, Homo sapiens
ctggagctaggaagtccaagat

SEQ ID NO: 8185534 - DNA, 22 bp, Homo sapiens
ctgggagtcaccaggagcaagg

SEQ ID NO: 8185535 - DNA, 22 bp, Homo sapiens
ctgggagtactgggggatgtca

SEQ ID NO: 8185536 - DNA, 22 bp, Homo sapiens
ctgggagtactgggggatgtca

SEQ ID NO: 8185537 - DNA, 22 bp, Homo sapiens
ctgggagtactgggggatgtca

SEQ ID NO: 8185538 - DNA, 22 bp, Homo sapiens
ctgggagtactgggggatgtca

SEQ ID NO: 8185539 - DNA, 22 bp, Homo sapiens
ctgggaggcggaggttgcagtg

SEQ ID NO: 8185540 - DNA, 22 bp, Homo sapiens
ctgggagtcaccaggagcaagg

SEQ ID NO: 8185541 - DNA, 22 bp, Homo sapiens
ctgggagtcaccaggagcaagg

SEQ ID NO: 8185542 - DNA, 22 bp, Homo sapiens
ctgggagtccctggaatagctc

SEQ ID NO: 8185543 - DNA, 22 bp, Homo sapiens
ctgggagtccaggatacagatg

SEQ ID NO: 8185544 - DNA, 22 bp, Homo sapiens
ctgggagtccaggatacagatg

SEQ ID NO: 8185545 - DNA, 22 bp, Homo sapiens
ctgggagtcagtataagaagca

SEQ ID NO: 8185546 - DNA, 22 bp, Homo sapiens
ctgggagtcagtataagaagca

SEQ ID NO: 8185547 - DNA, 22 bp, Homo sapiens
ctgggagtggtgacagctctcg

SEQ ID NO: 8185548 - DNA, 22 bp, Homo sapiens
ctgggagtgaaaggagggctgc

SEQ ID NO: 8185549 - DNA, 22 bp, Homo sapiens
ctgggagtggtgacagctctcg

SEQ ID NO: 8185550 - DNA, 22 bp, Homo sapiens
ctgggagtctggcctctggtcc

SEQ ID NO: 8185551 - DNA, 22 bp, Homo sapiens
ctgggagtgaaaggagggctgc

SEQ ID NO: 8185552 - DNA, 22 bp, Homo sapiens
ctgggagtgaaaggagggctgc

SEQ ID NO: 8185553 - DNA, 22 bp, Homo sapiens
ctgggagtgaaaggagggctgc

SEQ ID NO: 8185554 - DNA, 22 bp, Homo sapiens
ctgggagtccctggaatagctc

SEQ ID NO: 8185555 - DNA, 22 bp, Homo sapiens
ctgggagtccctggaatagctc

SEQ ID NO: 8185556 - DNA, 22 bp, Homo sapiens
ctgggagtctaagctagcaccg

SEQ ID NO: 8185557 - DNA, 22 bp, Homo sapiens
ctgggagtctaagctagcaccg

SEQ ID NO: 8185558 - DNA, 22 bp, Homo sapiens
ctgggagtctaagctagcaccg

SEQ ID NO: 8185559 - DNA, 22 bp, Homo sapiens
ctgggagtctggcctctggtcc

SEQ ID NO: 8185560 - DNA, 22 bp, Homo sapiens
ctgggagtctggcctctggtcc

SEQ ID NO: 8185561 - DNA, 22 bp, Homo sapiens
ctgggagtctggaattttggta

SEQ ID NO: 8185562 - DNA, 22 bp, Homo sapiens
ctgggagtctggaattttggta

SEQ ID NO: 8185563 - DNA, 22 bp, Homo sapiens
ctgggatggctccgctgctgct

SEQ ID NO: 8185564 - DNA, 22 bp, Homo sapiens
ctgggatggctccgctgctgct

SEQ ID NO: 8185565 - DNA, 22 bp, Homo sapiens
ctgggatggctttcctgcatta

SEQ ID NO: 8185566 - DNA, 22 bp, Homo sapiens
ctgggatggctttcctgcatta

SEQ ID NO: 8185567 - DNA, 22 bp, Homo sapiens
ctgggatgtctatagaacactt

SEQ ID NO: 8185568 - DNA, 22 bp, Homo sapiens
ctgggatgtgaggagcgcctct

SEQ ID NO: 8185569 - DNA, 22 bp, Homo sapiens
ctgggatgtctatagaacactt

SEQ ID NO: 8185570 - DNA, 22 bp, Homo sapiens
ctgggatgtctatagaacactt

SEQ ID NO: 8185571 - DNA, 22 bp, Homo sapiens
ctgggatgtgaggagcgcctct

SEQ ID NO: 8185572 - DNA, 22 bp, Homo sapiens
ctgggccaggaccagggttgaa

SEQ ID NO: 8185573 - DNA, 22 bp, Homo sapiens
ctgggcccacgagggctctggg

SEQ ID NO: 8185574 - DNA, 22 bp, Homo sapiens
ctgggagtgttctaggtcacat

SEQ ID NO: 8185575 - DNA, 22 bp, Homo sapiens
ctgggagtgttctaggtcacat

SEQ ID NO: 8185576 - DNA, 22 bp, Homo sapiens
ctgggagtgtccctctggtaat

SEQ ID NO: 8185577 - DNA, 22 bp, Homo sapiens
ctgggagtgtccctctggtaat

SEQ ID NO: 8185578 - DNA, 22 bp, Homo sapiens
ctgggagtgttctaggtcacat

SEQ ID NO: 8185579 - DNA, 19 bp, Homo sapiens
ctgggagttcactgctgcc

SEQ ID NO: 8185580 - DNA, 22 bp, Homo sapiens
ctgggagtgttctaggtcacat

SEQ ID NO: 8185581 - DNA, 22 bp, Homo sapiens
ctgggagttgacgaggcttgta

SEQ ID NO: 8185582 - DNA, 22 bp, Homo sapiens
ctgggagttgacgaggcttgta

SEQ ID NO: 8185583 - DNA, 22 bp, Homo sapiens
ctgggagttgacgaggcttgta

SEQ ID NO: 8185584 - DNA, 22 bp, Homo sapiens
ctgggagttgacgaggcttgta

SEQ ID NO: 8185585 - DNA, 19 bp, Homo sapiens
ctgggagttcactgctgcc

SEQ ID NO: 8185586 - DNA, 19 bp, Homo sapiens
ctgggagttcactgctgcc

SEQ ID NO: 8185587 - DNA, 19 bp, Homo sapiens
ctgggagttcactgctgcc

SEQ ID NO: 8185588 - DNA, 19 bp, Homo sapiens
ctgggagttcactgctgcc

SEQ ID NO: 8185589 - DNA, 22 bp, Homo sapiens
ctgggagttgacgaggcttgta

SEQ ID NO: 8185590 - DNA, 22 bp, Homo sapiens
ctgggatccacgggctcccaag

SEQ ID NO: 8185591 - DNA, 22 bp, Homo sapiens
ctgggagtttgttagtaatgca

SEQ ID NO: 8185592 - DNA, 22 bp, Homo sapiens
ctgggagtttgttagtaatgca

SEQ ID NO: 8185593 - DNA, 22 bp, Homo sapiens
ctgggagttgacgaggcttgta

SEQ ID NO: 8185594 - DNA, 22 bp, Homo sapiens
ctgggagtttctagagaaagac

SEQ ID NO: 8185595 - DNA, 22 bp, Homo sapiens
ctgggagtttctagagaaagac

SEQ ID NO: 8185596 - DNA, 22 bp, Homo sapiens
ctgggatgatagtgctagtatt

SEQ ID NO: 8185597 - DNA, 22 bp, Homo sapiens
ctgggatgcggaggttgcggtg

SEQ ID NO: 8185598 - DNA, 22 bp, Homo sapiens
ctgggatgctccggcctggatg

SEQ ID NO: 8185599 - DNA, 22 bp, Homo sapiens
ctgggatggctccgctgctgct

SEQ ID NO: 8185600 - DNA, 22 bp, Homo sapiens
ctgggatgctccggcctggatg

SEQ ID NO: 8185601 - DNA, 22 bp, Homo sapiens
ctgggatgctccggcctggatg

SEQ ID NO: 8185602 - DNA, 22 bp, Homo sapiens
ctgtcattcttacataatgtga

SEQ ID NO: 8185603 - DNA, 22 bp, Homo sapiens
ctgtccagtgcagagaacagag

SEQ ID NO: 8185604 - DNA, 22 bp, Homo sapiens
ctgtcattgagcctgtcagggc

SEQ ID NO: 8185605 - DNA, 22 bp, Homo sapiens
ctgtcatcacagttgagcagcc

SEQ ID NO: 8185606 - DNA, 22 bp, Homo sapiens
ctgtcatcacagttgagcagcc

SEQ ID NO: 8185607 - DNA, 22 bp, Homo sapiens
ctgtcagttcttccagatagag

SEQ ID NO: 8185608 - DNA, 22 bp, Homo sapiens
ctgtcagttctatctttgtgct

SEQ ID NO: 8185609 - DNA, 22 bp, Homo sapiens
ctggttttccaatgttttgact

SEQ ID NO: 8185610 - DNA, 22 bp, Homo sapiens
ctggttttctagtccactggct

SEQ ID NO: 8185611 - DNA, 22 bp, Homo sapiens
ctggttttccaatgttttgact

SEQ ID NO: 8185612 - DNA, 22 bp, Homo sapiens
ctggttttggctggcaaggttg

SEQ ID NO: 8185613 - DNA, 22 bp, Homo sapiens
ctggttttggctggcaaggttg

SEQ ID NO: 8185614 - DNA, 22 bp, Homo sapiens
ctggttttgaatatgtctgctt

SEQ ID NO: 8185615 - DNA, 22 bp, Homo sapiens
ctggttttaatgttatgtttat

SEQ ID NO: 8185616 - DNA, 22 bp, Homo sapiens
ctggttttaagctgtcagagag

SEQ ID NO: 8185617 - DNA, 22 bp, Homo sapiens
ctggttttaatgttatgtttat

SEQ ID NO: 8185618 - DNA, 22 bp, Homo sapiens
ctggttttaatgttatgtttat

SEQ ID NO: 8185619 - DNA, 22 bp, Homo sapiens
ctggttcatccccttccaggaa

SEQ ID NO: 8185620 - DNA, 22 bp, Homo sapiens
ctggttggaggagaagtttgga

SEQ ID NO: 8185621 - DNA, 22 bp, Homo sapiens
ctggttctgattttgctgcatt

SEQ ID NO: 8185622 - DNA, 22 bp, Homo sapiens
ctggttggaagtgcagactctc

SEQ ID NO: 8185623 - DNA, 22 bp, Homo sapiens
ctggttctgattttgctgcatt

SEQ ID NO: 8185624 - DNA, 22 bp, Homo sapiens
ctggttggtgccacatggtggc

SEQ ID NO: 8185625 - DNA, 22 bp, Homo sapiens
ctggttgggaggttggctttca

SEQ ID NO: 8185626 - DNA, 22 bp, Homo sapiens
ctggtttaagcttatatagttg

SEQ ID NO: 8185627 - DNA, 22 bp, Homo sapiens
ctggtttaagcttatatagttg

SEQ ID NO: 8185628 - DNA, 22 bp, Homo sapiens
ctggtttagtcataatggagaa

SEQ ID NO: 8185629 - DNA, 19 bp, Homo sapiens
ctggtttaggtagtgagtc

SEQ ID NO: 8185630 - DNA, 22 bp, Homo sapiens
ctgtcccatccttactctaccc

SEQ ID NO: 8185631 - DNA, 18 bp, Homo sapiens
ctgtcccatcctcaggtt

SEQ ID NO: 8185632 - DNA, 18 bp, Homo sapiens
ctgtcccatcctcaggtt

SEQ ID NO: 8185633 - DNA, 22 bp, Homo sapiens
ctgtcccagtgatcctgagtgc

SEQ ID NO: 8185634 - DNA, 22 bp, Homo sapiens
ctgtcccagtgatcctgagtgc

SEQ ID NO: 8185635 - DNA, 22 bp, Homo sapiens
ctgtccccattgtttgagggtt

SEQ ID NO: 8185636 - DNA, 21 bp, Homo sapiens
ctgtccccagtgagcaccccc

SEQ ID NO: 8185637 - DNA, 22 bp, Homo sapiens
ctgtccccacccaaatctcatc

SEQ ID NO: 8185638 - DNA, 21 bp, Homo sapiens
ctgtccccagtgagcaccccc

SEQ ID NO: 8185639 - DNA, 21 bp, Homo sapiens
ctgtccccagtgagcaccccc

SEQ ID NO: 8185640 - DNA, 22 bp, Homo sapiens
ctgtccccacccaaatctcatc

SEQ ID NO: 8185641 - DNA, 22 bp, Homo sapiens
ctgtcccctgtgctttcacttg

SEQ ID NO: 8185642 - DNA, 22 bp, Homo sapiens
ctgtccctcagttctgggcaaa

SEQ ID NO: 8185643 - DNA, 22 bp, Homo sapiens
ctgtccccgcgagtccagagct

SEQ ID NO: 8185644 - DNA, 20 bp, Homo sapiens
ctgtccccgaggtcaccagg

SEQ ID NO: 8185645 - DNA, 20 bp, Homo sapiens
ctgtccccgaggtcaccagg

SEQ ID NO: 8185646 - DNA, 22 bp, Homo sapiens
ctgtccccgcgagtccagagct

SEQ ID NO: 8185647 - DNA, 19 bp, Homo sapiens
ctgtcccagactctgctct

SEQ ID NO: 8185648 - DNA, 22 bp, Homo sapiens
ctgtcccagatgttctcagcac

SEQ ID NO: 8185649 - DNA, 22 bp, Homo sapiens
ctgtcccagatgttctcagcac

SEQ ID NO: 8185650 - DNA, 22 bp, Homo sapiens
ctgtcccagccccgtactctaa

SEQ ID NO: 8185651 - DNA, 22 bp, Homo sapiens
ctgtcccagccccgtactctaa

SEQ ID NO: 8185652 - DNA, 22 bp, Homo sapiens
ctgtcccaggagctgtaagaca

SEQ ID NO: 8185653 - DNA, 22 bp, Homo sapiens
ctgtcccaggagctgtaagaca

SEQ ID NO: 8185654 - DNA, 22 bp, Homo sapiens
ctgtccagtgcagagaacagag

SEQ ID NO: 8185655 - DNA, 22 bp, Homo sapiens
ctgtccatattcaaggggtagg

SEQ ID NO: 8185656 - DNA, 22 bp, Homo sapiens
ctgtccatattcaaggggtagg

SEQ ID NO: 8185657 - DNA, 22 bp, Homo sapiens
ctgtccatgcatgttgtctgct

SEQ ID NO: 8185658 - DNA, 22 bp, Homo sapiens
ctgtccatggcaatgatgcaga

SEQ ID NO: 8185659 - DNA, 22 bp, Homo sapiens
ctgtcccacaagcagtgtgcac

SEQ ID NO: 8185660 - DNA, 22 bp, Homo sapiens
ctgtcccacaagcagtgtgcac

SEQ ID NO: 8185661 - DNA, 22 bp, Homo sapiens
ctgtcccacaagcagtgtgcac

SEQ ID NO: 8185662 - DNA, 22 bp, Homo sapiens
ctgtgacagagcttgagtgaga

SEQ ID NO: 8185663 - DNA, 22 bp, Homo sapiens
ctgtgacctccaggaaggggtg

SEQ ID NO: 8185664 - DNA, 22 bp, Homo sapiens
ctgtgacagtttctcagacttt

SEQ ID NO: 8185665 - DNA, 22 bp, Homo sapiens
ctgtgacagtttctcagaattt

SEQ ID NO: 8185666 - DNA, 22 bp, Homo sapiens
ctgtgaagtgaatgctcctagt

SEQ ID NO: 8185667 - DNA, 22 bp, Homo sapiens
ctgtgaagtgaatgctcctagt

SEQ ID NO: 8185668 - DNA, 22 bp, Homo sapiens
ctgtctgttatctcaccagtcc

SEQ ID NO: 8185669 - DNA, 22 bp, Homo sapiens
ctgtgaaatcaaccttgagccc

SEQ ID NO: 8185670 - DNA, 22 bp, Homo sapiens
ctgtgaaactggacagcacttg

SEQ ID NO: 8185671 - DNA, 22 bp, Homo sapiens
ctgtccctcatcacctctgggt

SEQ ID NO: 8185672 - DNA, 22 bp, Homo sapiens
ctgtccctcatcacctctgggt

SEQ ID NO: 8185673 - DNA, 22 bp, Homo sapiens
ctgtccctcatcacctctgggt

SEQ ID NO: 8185674 - DNA, 19 bp, Homo sapiens
ctgtccctcccaggtatga

SEQ ID NO: 8185675 - DNA, 22 bp, Homo sapiens
ctgtccctctcacacctcacca

SEQ ID NO: 8185676 - DNA, 21 bp, Homo sapiens
ctgtccctctttgcttccctc

SEQ ID NO: 8185677 - DNA, 21 bp, Homo sapiens
ctgtccctctttgcttccctc

SEQ ID NO: 8185678 - DNA, 22 bp, Homo sapiens
ctgtgacttccggatgacatga

SEQ ID NO: 8185679 - DNA, 22 bp, Homo sapiens
ctgtgacttccactactgatca

SEQ ID NO: 8185680 - DNA, 22 bp, Homo sapiens
ctgtgactttgaataagaggga

SEQ ID NO: 8185681 - DNA, 22 bp, Homo sapiens
ctgtgaggcctttggccagata

SEQ ID NO: 8185682 - DNA, 22 bp, Homo sapiens
ctgtgagctgggtggccaggac

SEQ ID NO: 8185683 - DNA, 22 bp, Homo sapiens
ctgtgagctgggtggccaggac

SEQ ID NO: 8185684 - DNA, 22 bp, Homo sapiens
ctgtgagggcagggaccagagg

SEQ ID NO: 8185685 - DNA, 22 bp, Homo sapiens
ctgtgaggcgggtggagtggag

SEQ ID NO: 8185686 - DNA, 22 bp, Homo sapiens
ctgtgaggcggaaaggactctc

SEQ ID NO: 8185687 - DNA, 22 bp, Homo sapiens
ctgtggaatcatcaggtcttac

SEQ ID NO: 8185688 - DNA, 20 bp, Homo sapiens
ctgtggaattttaccatgcg

SEQ ID NO: 8185689 - DNA, 20 bp, Homo sapiens
ctgtggaattttaccatgcg

SEQ ID NO: 8185690 - DNA, 22 bp, Homo sapiens
ctgtggatttaggcagagctga

SEQ ID NO: 8185691 - DNA, 22 bp, Homo sapiens
ctgtggagtttgtggcgctgac

SEQ ID NO: 8185692 - DNA, 22 bp, Homo sapiens
ctgtggagtttgtggcgctgac

SEQ ID NO: 8185693 - DNA, 23 bp, Homo sapiens
ctgtggcaagtcctgcacctgcc

SEQ ID NO: 8185694 - DNA, 23 bp, Homo sapiens
ctgtggcaagtcctgcacctgcc

SEQ ID NO: 8185695 - DNA, 22 bp, Homo sapiens
ctgtggcaagtctgcctgtcac

SEQ ID NO: 8185696 - DNA, 22 bp, Homo sapiens
ctgtggcaagtctgcctgtcac

SEQ ID NO: 8185697 - DNA, 22 bp, Homo sapiens
ctgtggcaaatgatacctccca

SEQ ID NO: 8185698 - DNA, 22 bp, Homo sapiens
ctgtggcaaatgatacctccca

SEQ ID NO: 8185699 - DNA, 22 bp, Homo sapiens
ctgtggcaaatgatacctccca

SEQ ID NO: 8185700 - DNA, 22 bp, Homo sapiens
ctgtggcaagtctgcctgtcac

SEQ ID NO: 8185701 - DNA, 22 bp, Homo sapiens
ctgtggcaccaatacatttttc

SEQ ID NO: 8185702 - DNA, 22 bp, Homo sapiens
ctgtggcacatgtggcaaggcc

SEQ ID NO: 8185703 - DNA, 22 bp, Homo sapiens
ctgtggcagaggtgacacctct

SEQ ID NO: 8185704 - DNA, 22 bp, Homo sapiens
ctgtggcagaggtgacacctct

SEQ ID NO: 8185705 - DNA, 22 bp, Homo sapiens
ctgtggcactcaagaagcctcc

SEQ ID NO: 8185706 - DNA, 22 bp, Homo sapiens
ctgtggcactcaagaagcctcc

SEQ ID NO: 8185707 - DNA, 22 bp, Homo sapiens
ctgtggcactcaagaagcctcc

SEQ ID NO: 8185708 - DNA, 22 bp, Homo sapiens
ctgtggcaggaagggactagca

SEQ ID NO: 8185709 - DNA, 22 bp, Homo sapiens
ctgtggcaggaagggactagca

SEQ ID NO: 8185710 - DNA, 20 bp, Homo sapiens
ctgtggcatcttgaaggagg

SEQ ID NO: 8185711 - DNA, 22 bp, Homo sapiens
ctgtggcattgccgaggctggc

SEQ ID NO: 8185712 - DNA, 22 bp, Homo sapiens
ctgtggcattgccgaggctggc

SEQ ID NO: 8185713 - DNA, 22 bp, Homo sapiens
ctgtggcattaataaaagtgca

SEQ ID NO: 8185714 - DNA, 22 bp, Homo sapiens
ctgtggcattgccgaggctggc

SEQ ID NO: 8185715 - DNA, 22 bp, Homo sapiens
ctgtggcattgtgaggactgca

SEQ ID NO: 8185716 - DNA, 22 bp, Homo sapiens
ctgtggcattgtgaggactgca

SEQ ID NO: 8185717 - DNA, 22 bp, Homo sapiens
ctgtggcattgccgaggctggc

SEQ ID NO: 8185718 - DNA, 20 bp, Homo sapiens
ctgtggcatctgtcatggtg

SEQ ID NO: 8185719 - DNA, 20 bp, Homo sapiens
ctgtggcatctgtcatggtg

SEQ ID NO: 8185720 - DNA, 20 bp, Homo sapiens
ctgtggcatctgtcatggtg

SEQ ID NO: 8185721 - DNA, 22 bp, Homo sapiens
ctgtggcagggaagaggccatg

SEQ ID NO: 8185722 - DNA, 22 bp, Homo sapiens
ctgtggcagggaagaggccatg

SEQ ID NO: 8185723 - DNA, 22 bp, Homo sapiens
ctgtggcagggaagaggccatg

SEQ ID NO: 8185724 - DNA, 22 bp, Homo sapiens
ctgtggcaggtgtctggggcag

SEQ ID NO: 8185725 - DNA, 22 bp, Homo sapiens
ctgtgggcctagtctggcctag

SEQ ID NO: 8185726 - DNA, 22 bp, Homo sapiens
ctgtgggcatttgagtgtgggt

SEQ ID NO: 8185727 - DNA, 22 bp, Homo sapiens
ctgtgggcagctcctcctgtca

SEQ ID NO: 8185728 - DNA, 22 bp, Homo sapiens
ctgtgggcagctcctcctgtca

SEQ ID NO: 8185729 - DNA, 20 bp, Homo sapiens
ctgtgggcctcacttggggt

SEQ ID NO: 8185730 - DNA, 19 bp, Homo sapiens
ctgtgggcggaggaggggc

SEQ ID NO: 8185731 - DNA, 22 bp, Homo sapiens
ctgtgggctcccagcttctctc

SEQ ID NO: 8185732 - DNA, 23 bp, Homo sapiens
ctgtggccacccctagctggagg

SEQ ID NO: 8185733 - DNA, 22 bp, Homo sapiens
ctgtggcatttagaggttgcgt

SEQ ID NO: 8185734 - DNA, 22 bp, Homo sapiens
ctgtggcatttagaggttgcgt

SEQ ID NO: 8185735 - DNA, 22 bp, Homo sapiens
ctgtggcattgtgaggactgca

SEQ ID NO: 8185736 - DNA, 23 bp, Homo sapiens
ctgtggccacccctagctggagg

SEQ ID NO: 8185737 - DNA, 22 bp, Homo sapiens
ctgtggctttctctgcctcctt

SEQ ID NO: 8185738 - DNA, 22 bp, Homo sapiens
ctgtggcttctgggtcagttca

SEQ ID NO: 8185739 - DNA, 22 bp, Homo sapiens
ctgtgggatgggacctcagctg

SEQ ID NO: 8185740 - DNA, 22 bp, Homo sapiens
ctgtgggagggaaggcgcggcc

SEQ ID NO: 8185741 - DNA, 22 bp, Homo sapiens
ctgtgggagggaaggcgcggcc

SEQ ID NO: 8185742 - DNA, 22 bp, Homo sapiens
ctgtggctttctctgcctcctt

SEQ ID NO: 8185743 - DNA, 22 bp, Homo sapiens
ctgtggctttgcagggcttgtt

SEQ ID NO: 8185744 - DNA, 22 bp, Homo sapiens
ctgtgggagcactggggaccga

SEQ ID NO: 8185745 - DNA, 22 bp, Homo sapiens
ctgtgggagcactggggaccga

SEQ ID NO: 8185746 - DNA, 22 bp, Homo sapiens
ctgtgggagcactggggaccga

SEQ ID NO: 8185747 - DNA, 22 bp, Homo sapiens
ctgtgtgtgaacacagcccagc

SEQ ID NO: 8185748 - DNA, 22 bp, Homo sapiens
ctgtgtgatgggaagaatgttt

SEQ ID NO: 8185749 - DNA, 22 bp, Homo sapiens
ctgtgtgaatagtgaggtctat

SEQ ID NO: 8185750 - DNA, 22 bp, Homo sapiens
ctgtgtgacaagtgaggacgcc

SEQ ID NO: 8185751 - DNA, 22 bp, Homo sapiens
ctgtgtctttcctactttgtgg

SEQ ID NO: 8185752 - DNA, 22 bp, Homo sapiens
ctgtgtgaatagtgaggtctat

SEQ ID NO: 8185753 - DNA, 22 bp, Homo sapiens
ctgtgtgagcatcacttcagat

SEQ ID NO: 8185754 - DNA, 22 bp, Homo sapiens
ctgtgtgagtgactgcatctca

SEQ ID NO: 8185755 - DNA, 22 bp, Homo sapiens
ctgtgtctttcctactttgtgg

SEQ ID NO: 8185756 - DNA, 22 bp, Homo sapiens
ctgtgtcttctgttttgaagtt

SEQ ID NO: 8185757 - DNA, 21 bp, Homo sapiens
ctgtggtacagctgggacgga

SEQ ID NO: 8185758 - DNA, 21 bp, Homo sapiens
ctgtggtacagctgggacgga

SEQ ID NO: 8185759 - DNA, 22 bp, Homo sapiens
ctgtggtgagcaactgactgaa

SEQ ID NO: 8185760 - DNA, 22 bp, Homo sapiens
ctgtggtgagcaactgactgaa

SEQ ID NO: 8185761 - DNA, 20 bp, Homo sapiens
ctgtggtgagcaggagagta

SEQ ID NO: 8185762 - DNA, 18 bp, Homo sapiens
ctgtgggctggtgcatga

SEQ ID NO: 8185763 - DNA, 22 bp, Homo sapiens
ctgtggggaaagggtcctgctc

SEQ ID NO: 8185764 - DNA, 22 bp, Homo sapiens
ctgtggggaaagggtcctgctc

SEQ ID NO: 8185765 - DNA, 18 bp, Homo sapiens
ctgtgggctggtgcatga

SEQ ID NO: 8185766 - DNA, 22 bp, Homo sapiens
ctgtgggcttgaggttagacag

SEQ ID NO: 8185767 - DNA, 22 bp, Homo sapiens
ctgtggggccaaattctcctct

SEQ ID NO: 8185768 - DNA, 22 bp, Homo sapiens
ctgtggggagctgatcagatca

SEQ ID NO: 8185769 - DNA, 22 bp, Homo sapiens
ctgtggggagctgatcagatca

SEQ ID NO: 8185770 - DNA, 22 bp, Homo sapiens
ctgtggggccaaattctcctct

SEQ ID NO: 8185771 - DNA, 22 bp, Homo sapiens
ctgtggggaagatagaaccgac

SEQ ID NO: 8185772 - DNA, 22 bp, Homo sapiens
ctgtggggaagatagaaccgac

SEQ ID NO: 8185773 - DNA, 19 bp, Homo sapiens
ctgtgggtgtgcaagggtg

SEQ ID NO: 8185774 - DNA, 19 bp, Homo sapiens
ctgtgggtgtgcaagggtg

SEQ ID NO: 8185775 - DNA, 22 bp, Homo sapiens
ctgtgggtgaagacaagggaga

SEQ ID NO: 8185776 - DNA, 21 bp, Homo sapiens
ctgtggtacagctgggacgga

SEQ ID NO: 8185777 - DNA, 22 bp, Homo sapiens
ctgtggtcaccaggctggggcc

SEQ ID NO: 8185778 - DNA, 22 bp, Homo sapiens
ctgtggtcaccaggctggggcc

SEQ ID NO: 8185779 - DNA, 22 bp, Homo sapiens
ctgtgtgtttatatcatttcct

SEQ ID NO: 8185780 - DNA, 22 bp, Homo sapiens
ctgtgtttctaagtaaaggagc

SEQ ID NO: 8185781 - DNA, 22 bp, Homo sapiens
ctgtgttggcttttctcttgta

SEQ ID NO: 8185782 - DNA, 22 bp, Homo sapiens
ctgtgttcccctgctgctgagg

SEQ ID NO: 8185783 - DNA, 22 bp, Homo sapiens
ctgtgttttgagatattattaa

SEQ ID NO: 8185784 - DNA, 22 bp, Homo sapiens
ctgtgtttggacaacttttcag

SEQ ID NO: 8185785 - DNA, 22 bp, Homo sapiens
ctgtgtttttggtctgatctat

SEQ ID NO: 8185786 - DNA, 22 bp, Homo sapiens
ctgtgtttttggtctgatctat

SEQ ID NO: 8185787 - DNA, 22 bp, Homo sapiens
ctgtgtttgatgagaagccacc

SEQ ID NO: 8185788 - DNA, 22 bp, Homo sapiens
ctgtgtgtgtctgcagcatact

SEQ ID NO: 8185789 - DNA, 22 bp, Homo sapiens
ctgtgtgtgtctgcagcatact

SEQ ID NO: 8185790 - DNA, 22 bp, Homo sapiens
ctgtgtgtgtctgcagcatact

SEQ ID NO: 8185791 - DNA, 22 bp, Homo sapiens
ctgtgtgtgctacaggcttcca

SEQ ID NO: 8185792 - DNA, 22 bp, Homo sapiens
ctgtgtgtgctacaggcttcca

SEQ ID NO: 8185793 - DNA, 22 bp, Homo sapiens
ctgtgtgtgagaagcaggttga

SEQ ID NO: 8185794 - DNA, 22 bp, Homo sapiens
ctgtgtgtgagaagcaggttga

SEQ ID NO: 8185795 - DNA, 22 bp, Homo sapiens
ctgtgtgtgaacacagcccagc

SEQ ID NO: 8185796 - DNA, 23 bp, Homo sapiens
ctgtgtgtgccgagggtggccac

SEQ ID NO: 8185797 - DNA, 22 bp, Homo sapiens
ctcactcagacatccagtgcag

SEQ ID NO: 8185798 - DNA, 22 bp, Homo sapiens
ctcactcagtttttagttcatc

SEQ ID NO: 8185799 - DNA, 22 bp, Homo sapiens
ctcactgactgcaagtcaagtt

SEQ ID NO: 8185800 - DNA, 22 bp, Homo sapiens
ctcactgcaacctccgcctcct

SEQ ID NO: 8185801 - DNA, 22 bp, Homo sapiens
ctcactgcaacctctgcctccc

SEQ ID NO: 8185802 - DNA, 22 bp, Homo sapiens
ctcactgcaacctctgcctccc

SEQ ID NO: 8185803 - DNA, 22 bp, Homo sapiens
ctcactgcaagctcagcctccc

SEQ ID NO: 8185804 - DNA, 22 bp, Homo sapiens
ctcactgcaacctctgcctccc

SEQ ID NO: 8185805 - DNA, 22 bp, Homo sapiens
ctcactgcaagctcagcctccc

SEQ ID NO: 8185806 - DNA, 22 bp, Homo sapiens
ctcactgcaagctcagcctccc

SEQ ID NO: 8185807 - DNA, 22 bp, Homo sapiens
ctcacccctgtaattccagcac

SEQ ID NO: 8185808 - DNA, 22 bp, Homo sapiens
ctcaccccactaccccttggtg

SEQ ID NO: 8185809 - DNA, 22 bp, Homo sapiens
ctatactactatacagatgtaa

SEQ ID NO: 8185810 - DNA, 22 bp, Homo sapiens
ctatacatcccaatttcagaga

SEQ ID NO: 8185811 - DNA, 22 bp, Homo sapiens
ctatacagtaaccacagtgatt

SEQ ID NO: 8185812 - DNA, 22 bp, Homo sapiens
ctatacagcagcttactagtta

SEQ ID NO: 8185813 - DNA, 22 bp, Homo sapiens
ctcacaggttctgcagctcaca

SEQ ID NO: 8185814 - DNA, 22 bp, Homo sapiens
ctatagatgtcattttacatcc

SEQ ID NO: 8185815 - DNA, 22 bp, Homo sapiens
ctcacccatatctccatgactc

SEQ ID NO: 8185816 - DNA, 22 bp, Homo sapiens
ctcacccatatctccatgactc

SEQ ID NO: 8185817 - DNA, 22 bp, Homo sapiens
ctataagacagatactgacttt

SEQ ID NO: 8185818 - DNA, 22 bp, Homo sapiens
ctatacactttttgaaaataga

SEQ ID NO: 8185819 - DNA, 22 bp, Homo sapiens
ctataaatctacccagcattgg

SEQ ID NO: 8185820 - DNA, 22 bp, Homo sapiens
ctataaatctacccagcattgg

SEQ ID NO: 8185821 - DNA, 22 bp, Homo sapiens
ctataaatctacccagcattgg

SEQ ID NO: 8185822 - DNA, 22 bp, Homo sapiens
ctataaatctacccagcattgg

SEQ ID NO: 8185823 - DNA, 22 bp, Homo sapiens
ctataaatctacccagcattgg

SEQ ID NO: 8185824 - DNA, 22 bp, Homo sapiens
ctataaatctacccagcattgg

SEQ ID NO: 8185825 - DNA, 22 bp, Homo sapiens
ttctggcttacttcactcattt

SEQ ID NO: 8185826 - DNA, 22 bp, Homo sapiens
ttctggcttacttcactcattt

SEQ ID NO: 8185827 - DNA, 23 bp, Homo sapiens
ttctggctgtgggtggcgtctct

SEQ ID NO: 8185828 - DNA, 22 bp, Homo sapiens
ttctggcttagttgttgtatat

SEQ ID NO: 8185829 - DNA, 22 bp, Homo sapiens
ttctggcttagttgttgtatat

SEQ ID NO: 8185830 - DNA, 22 bp, Homo sapiens
ctataaatctacccagcattgg

SEQ ID NO: 8185831 - DNA, 22 bp, Homo sapiens
ttctggctttaggcttttcaag

SEQ ID NO: 8185832 - DNA, 22 bp, Homo sapiens
ttctggctttacttcccatcca

SEQ ID NO: 8185833 - DNA, 22 bp, Homo sapiens
ttctggcttgacccctacttcc

SEQ ID NO: 8185834 - DNA, 22 bp, Homo sapiens
ttctggcttcatctgacaagcc

SEQ ID NO: 8185835 - DNA, 22 bp, Homo sapiens
ttctggcttcatctgacaagcc

SEQ ID NO: 8185836 - DNA, 22 bp, Homo sapiens
ttctggcttatgagctataatg

SEQ ID NO: 8185837 - DNA, 22 bp, Homo sapiens
ttctggctcgattctctgaccg

SEQ ID NO: 8185838 - DNA, 22 bp, Homo sapiens
ttctggctgaaagtttatttga

SEQ ID NO: 8185839 - DNA, 22 bp, Homo sapiens
ttctggctctcccctgctgggt

SEQ ID NO: 8185840 - DNA, 22 bp, Homo sapiens
ttctggctgtatgatatttaat

SEQ ID NO: 8185841 - DNA, 22 bp, Homo sapiens
ttctggctgtatgatatttaat

SEQ ID NO: 8185842 - DNA, 22 bp, Homo sapiens
ttctggctgcagtccctgtaat

SEQ ID NO: 8185843 - DNA, 22 bp, Homo sapiens
ttctggctgaaagtttatttga

SEQ ID NO: 8185844 - DNA, 22 bp, Homo sapiens
ttctggctccactcagccccac

SEQ ID NO: 8185845 - DNA, 22 bp, Homo sapiens
ttctggctcatatgctaagaag

SEQ ID NO: 8185846 - DNA, 23 bp, Homo sapiens
ttctggctccgagctccatcttc

SEQ ID NO: 8185847 - DNA, 22 bp, Homo sapiens
ttctggctcgattctctgaccg

SEQ ID NO: 8185848 - DNA, 22 bp, Homo sapiens
ttctggctcgattctctgaccg

SEQ ID NO: 8185849 - DNA, 22 bp, Homo sapiens
ttctggctcgattctctgaccg

SEQ ID NO: 8185850 - DNA, 22 bp, Homo sapiens
ttctggattagcatgatcccta

SEQ ID NO: 8185851 - DNA, 18 bp, Homo sapiens
ttctggctcactcatgct

SEQ ID NO: 8185852 - DNA, 22 bp, Homo sapiens
ttctggctcatatgctaagaag

SEQ ID NO: 8185853 - DNA, 18 bp, Homo sapiens
ttctggctcactcatgct

SEQ ID NO: 8185854 - DNA, 22 bp, Homo sapiens
ttctggccaaggctgccagatt

SEQ ID NO: 8185855 - DNA, 22 bp, Homo sapiens
ttctggccaaggctgccagatt

SEQ ID NO: 8185856 - DNA, 22 bp, Homo sapiens
ttctggctaccctcctaatgtt

SEQ ID NO: 8185857 - DNA, 22 bp, Homo sapiens
ttctggctaccctcctaatgtt

SEQ ID NO: 8185858 - DNA, 22 bp, Homo sapiens
ttctttctctgtaaaaggaaaa

SEQ ID NO: 8185859 - DNA, 22 bp, Homo sapiens
ttctttctctgtaaaaggaaaa

SEQ ID NO: 8185860 - DNA, 22 bp, Homo sapiens
ttctttctctccacaaggcttg

SEQ ID NO: 8185861 - DNA, 22 bp, Homo sapiens
ttctttctctccacaaggcttg

SEQ ID NO: 8185862 - DNA, 22 bp, Homo sapiens
ttctttctgaatacagttgagt

SEQ ID NO: 8185863 - DNA, 22 bp, Homo sapiens
ttctttctgaatacagttgagt

SEQ ID NO: 8185864 - DNA, 22 bp, Homo sapiens
ctcactgcaagctcagcctccc

SEQ ID NO: 8185865 - DNA, 22 bp, Homo sapiens
ttctttctctactagcagagct

SEQ ID NO: 8185866 - DNA, 22 bp, Homo sapiens
ttctttctctccacaaggcttg

SEQ ID NO: 8185867 - DNA, 22 bp, Homo sapiens
ctcactgcaagctccacctctt

SEQ ID NO: 8185868 - DNA, 22 bp, Homo sapiens
ttctttctgaatacagttgagt

SEQ ID NO: 8185869 - DNA, 21 bp, Homo sapiens
ttctttctgaatctgaagtat

SEQ ID NO: 8185870 - DNA, 21 bp, Homo sapiens
ttctttctgaatctgaagtat

SEQ ID NO: 8185871 - DNA, 21 bp, Homo sapiens
ttctttctgaatctgaagtat

SEQ ID NO: 8185872 - DNA, 21 bp, Homo sapiens
ttctttctgaatctgaagtat

SEQ ID NO: 8185873 - DNA, 21 bp, Homo sapiens
ttctttctgaatctgaagtat

SEQ ID NO: 8185874 - DNA, 22 bp, Homo sapiens
ttctttctggggtccttcggct

SEQ ID NO: 8185875 - DNA, 22 bp, Homo sapiens
ttctttctggggtccttcggct

SEQ ID NO: 8185876 - DNA, 22 bp, Homo sapiens
ttctttctgggaagagttcaga

SEQ ID NO: 8185877 - DNA, 21 bp, Homo sapiens
ttctttctgaatctgaagtat

SEQ ID NO: 8185878 - DNA, 22 bp, Homo sapiens
ttctttctgggaagagttcaga

SEQ ID NO: 8185879 - DNA, 22 bp, Homo sapiens
ttctttctgggaagagttcaga

SEQ ID NO: 8185880 - DNA, 22 bp, Homo sapiens
ctcagagaacctaagcggagga

SEQ ID NO: 8185881 - DNA, 22 bp, Homo sapiens
ctcagagaacctaagcggagga

SEQ ID NO: 8185882 - DNA, 21 bp, Homo sapiens
ctcagagacaaatgccatccc

SEQ ID NO: 8185883 - DNA, 22 bp, Homo sapiens
ctcagagaagatggatgaggta

SEQ ID NO: 8185884 - DNA, 22 bp, Homo sapiens
ctcagagaaaaggagcaagggt

SEQ ID NO: 8185885 - DNA, 22 bp, Homo sapiens
ctcagagaaaaggagcaagggt

SEQ ID NO: 8185886 - DNA, 22 bp, Homo sapiens
ctcagaaagggttgctgagggc

SEQ ID NO: 8185887 - DNA, 22 bp, Homo sapiens
ctcagaaagggttgctgagggc

SEQ ID NO: 8185888 - DNA, 22 bp, Homo sapiens
ctcagagaaaaggagcaagggt

SEQ ID NO: 8185889 - DNA, 22 bp, Homo sapiens
ctcagaaaggtgccatttatgt

SEQ ID NO: 8185890 - DNA, 22 bp, Homo sapiens
ttctttctgtccataatgagac

SEQ ID NO: 8185891 - DNA, 22 bp, Homo sapiens
ttctttctgtccataatgagac

SEQ ID NO: 8185892 - DNA, 22 bp, Homo sapiens
ttctttctgtccataatgagac

SEQ ID NO: 8185893 - DNA, 22 bp, Homo sapiens
ttctttctgtcatggtgtactg

SEQ ID NO: 8185894 - DNA, 22 bp, Homo sapiens
ttctttctgtcatggtgtactg

SEQ ID NO: 8185895 - DNA, 22 bp, Homo sapiens
ctcagagatatagtccctgctt

SEQ ID NO: 8185896 - DNA, 22 bp, Homo sapiens
ctcagagcaatgaacatgcaaa

SEQ ID NO: 8185897 - DNA, 22 bp, Homo sapiens
ctcagagcaatgaacatgcaaa

SEQ ID NO: 8185898 - DNA, 22 bp, Homo sapiens
ctcagagcaatgaacatgcaaa

SEQ ID NO: 8185899 - DNA, 22 bp, Homo sapiens
ctcagagcacttttgaaagctc

SEQ ID NO: 8185900 - DNA, 22 bp, Homo sapiens
ctcagagcacttttgaaagctc

SEQ ID NO: 8185901 - DNA, 22 bp, Homo sapiens
ctcagagcacagtttatgacag

SEQ ID NO: 8185902 - DNA, 22 bp, Homo sapiens
ctcagagcacagtttatgacag

SEQ ID NO: 8185903 - DNA, 17 bp, Homo sapiens
ctcagagcaggacagaa

SEQ ID NO: 8185904 - DNA, 17 bp, Homo sapiens
ctcagagcaggacagaa

SEQ ID NO: 8185905 - DNA, 17 bp, Homo sapiens
ctcagagcaggacagaa

SEQ ID NO: 8185906 - DNA, 22 bp, Homo sapiens
ctcagagaggcagtggaagtca

SEQ ID NO: 8185907 - DNA, 17 bp, Homo sapiens
ctcagagagggtaagta

SEQ ID NO: 8185908 - DNA, 22 bp, Homo sapiens
ctcagagagttaagtgaattac

SEQ ID NO: 8185909 - DNA, 22 bp, Homo sapiens
ctcagagctgaggccagggaca

SEQ ID NO: 8185910 - DNA, 22 bp, Homo sapiens
ctcagaggcaagcaaggagctg

SEQ ID NO: 8185911 - DNA, 22 bp, Homo sapiens
ctcagaggcaagcaaggagctg

SEQ ID NO: 8185912 - DNA, 22 bp, Homo sapiens
ctcagagctcgtgggaccttgg

SEQ ID NO: 8185913 - DNA, 22 bp, Homo sapiens
ctcagagctcagctttgttagt

SEQ ID NO: 8185914 - DNA, 22 bp, Homo sapiens
ctcagagctcagctttgttagt

SEQ ID NO: 8185915 - DNA, 22 bp, Homo sapiens
ctcagagcccagggtacacccg

SEQ ID NO: 8185916 - DNA, 22 bp, Homo sapiens
ctcagagcccagggtacacccg

SEQ ID NO: 8185917 - DNA, 22 bp, Homo sapiens
ctcagagccccaggagggtgtg

SEQ ID NO: 8185918 - DNA, 22 bp, Homo sapiens
ctcagagcccagggtacacccg

SEQ ID NO: 8185919 - DNA, 22 bp, Homo sapiens
ctcagagcccagggtacacccg

SEQ ID NO: 8185920 - DNA, 22 bp, Homo sapiens
ctcagagccagttagcaggtgc

SEQ ID NO: 8185921 - DNA, 22 bp, Homo sapiens
ctcagagccagttagcaggtgc

SEQ ID NO: 8185922 - DNA, 22 bp, Homo sapiens
ctcagagccagttagcaggtgc

SEQ ID NO: 8185923 - DNA, 17 bp, Homo sapiens
ctcagagcaggacagaa

SEQ ID NO: 8185924 - DNA, 17 bp, Homo sapiens
ctcagagcaggacagaa

SEQ ID NO: 8185925 - DNA, 21 bp, Homo sapiens
ctcagagcagttcagagggat

SEQ ID NO: 8185926 - DNA, 22 bp, Homo sapiens
cgtttattttgaagattccact

SEQ ID NO: 8185927 - DNA, 22 bp, Homo sapiens
cgtttattttgaagattccact

SEQ ID NO: 8185928 - DNA, 22 bp, Homo sapiens
cgtttattttgaagattccact

SEQ ID NO: 8185929 - DNA, 22 bp, Homo sapiens
ctaaaaatccacactaggtgaa

SEQ ID NO: 8185930 - DNA, 22 bp, Homo sapiens
cgtttttcagtggtcttaggtc

SEQ ID NO: 8185931 - DNA, 22 bp, Homo sapiens
cgttaataggtgcaaggtaagg

SEQ ID NO: 8185932 - DNA, 22 bp, Homo sapiens
cgttcctctactccagctaccc

SEQ ID NO: 8185933 - DNA, 22 bp, Homo sapiens
cgttggagacacttgaggactt

SEQ ID NO: 8185934 - DNA, 22 bp, Homo sapiens
cgtttattttgaagattccact

SEQ ID NO: 8185935 - DNA, 23 bp, Homo sapiens
cgtgtccttcagggagagtgtgg

SEQ ID NO: 8185936 - DNA, 20 bp, Homo sapiens
cgtgtccttggcgggagagc

SEQ ID NO: 8185937 - DNA, 22 bp, Homo sapiens
cgtgtccttttagcttcaggtc

SEQ ID NO: 8185938 - DNA, 22 bp, Homo sapiens
cgtgtccttttagcttcaggtc

SEQ ID NO: 8185939 - DNA, 20 bp, Homo sapiens
cgtgtccttggcgggagagc

SEQ ID NO: 8185940 - DNA, 23 bp, Homo sapiens
cgtgtccttcagggagagtgtgg

SEQ ID NO: 8185941 - DNA, 22 bp, Homo sapiens
cgtgtacacgcacacgtgtcct

SEQ ID NO: 8185942 - DNA, 16 bp, Homo sapiens
cgtggtctgatttcct

SEQ ID NO: 8185943 - DNA, 22 bp, Homo sapiens
cgtggtctcccacagaaagaag

SEQ ID NO: 8185944 - DNA, 22 bp, Homo sapiens
cgtgtacagtctatcttttttc

SEQ ID NO: 8185945 - DNA, 21 bp, Homo sapiens
cgtggtctggatttgggtttg

SEQ ID NO: 8185946 - DNA, 17 bp, Homo sapiens
cgtgtgcttgtgtgcac

SEQ ID NO: 8185947 - DNA, 22 bp, Homo sapiens
cgtgtggtcccggcaaggcaag

SEQ ID NO: 8185948 - DNA, 22 bp, Homo sapiens
cgtgtggtcccggcaaggcaag

SEQ ID NO: 8185949 - DNA, 20 bp, Homo sapiens
cgtgtgtggctattttgggt

SEQ ID NO: 8185950 - DNA, 22 bp, Homo sapiens
cgtgtgtgtacctgcgcattta

SEQ ID NO: 8185951 - DNA, 17 bp, Homo sapiens
ctagagagaaagagcta

SEQ ID NO: 8185952 - DNA, 17 bp, Homo sapiens
ctagagagaaagagcta

SEQ ID NO: 8185953 - DNA, 22 bp, Homo sapiens
ctagagaattgtcttgagagtt

SEQ ID NO: 8185954 - DNA, 22 bp, Homo sapiens
ctagagaggtggtgttgggtgg

SEQ ID NO: 8185955 - DNA, 22 bp, Homo sapiens
ctagagcagattgcagagtagg

SEQ ID NO: 8185956 - DNA, 22 bp, Homo sapiens
ctagagaggtggtgttgggtgg

SEQ ID NO: 8185957 - DNA, 22 bp, Homo sapiens
ctagagagccgctgtggaaaat

SEQ ID NO: 8185958 - DNA, 22 bp, Homo sapiens
ctagagagccgctgtggaaaat

SEQ ID NO: 8185959 - DNA, 22 bp, Homo sapiens
ctagagctttctgctggtgttg

SEQ ID NO: 8185960 - DNA, 22 bp, Homo sapiens
ctagaggtagaggcagtgggaa

SEQ ID NO: 8185961 - DNA, 22 bp, Homo sapiens
ctagataaggtggcttggaatt

SEQ ID NO: 8185962 - DNA, 22 bp, Homo sapiens
ttctatgattcatttagaagtt

SEQ ID NO: 8185963 - DNA, 22 bp, Homo sapiens
ctagaaagatacttaaatcaag

SEQ ID NO: 8185964 - DNA, 22 bp, Homo sapiens
ctaaaaatccacactaggtgaa

SEQ ID NO: 8185965 - DNA, 22 bp, Homo sapiens
ctagaaagatacttaaatcaag

SEQ ID NO: 8185966 - DNA, 22 bp, Homo sapiens
ctaaaaatccacactaggtgaa

SEQ ID NO: 8185967 - DNA, 22 bp, Homo sapiens
ctagagaaaatgttaatacagt

SEQ ID NO: 8185968 - DNA, 22 bp, Homo sapiens
ctagagaaaggcagtggagcaa

SEQ ID NO: 8185969 - DNA, 22 bp, Homo sapiens
ttctggaaccagcctgcctggg

SEQ ID NO: 8185970 - DNA, 22 bp, Homo sapiens
ttctggaaccagcctgcctggg

SEQ ID NO: 8185971 - DNA, 22 bp, Homo sapiens
ttctggaaccaacatgccagtt

SEQ ID NO: 8185972 - DNA, 22 bp, Homo sapiens
ttctggaaccaacatgccagtt

SEQ ID NO: 8185973 - DNA, 22 bp, Homo sapiens
ttctggaagaataatgggcaaa

SEQ ID NO: 8185974 - DNA, 22 bp, Homo sapiens
ttctggaactatactgttggtg

SEQ ID NO: 8185975 - DNA, 22 bp, Homo sapiens
ttctggaagaataatgggcaaa

SEQ ID NO: 8185976 - DNA, 22 bp, Homo sapiens
ttctggaagatacctctcctaa

SEQ ID NO: 8185977 - DNA, 22 bp, Homo sapiens
ttctggaagagtaaaataagcc

SEQ ID NO: 8185978 - DNA, 22 bp, Homo sapiens
ttctggaagaggtgtaagtata

SEQ ID NO: 8185979 - DNA, 22 bp, Homo sapiens
ttctggaagagtaaaataagcc

SEQ ID NO: 8185980 - DNA, 22 bp, Homo sapiens
ttctgcatgatattaaatgtaa

SEQ ID NO: 8185981 - DNA, 22 bp, Homo sapiens
ttctgcatgaacagtttattcc

SEQ ID NO: 8185982 - DNA, 22 bp, Homo sapiens
ttctgcatgtgtttcaaatact

SEQ ID NO: 8185983 - DNA, 17 bp, Homo sapiens
ttctgcatgtgaagatg

SEQ ID NO: 8185984 - DNA, 22 bp, Homo sapiens
ttctgcatggagaaactgagtc

SEQ ID NO: 8185985 - DNA, 22 bp, Homo sapiens
ttctgcatggagaaactgagtc

SEQ ID NO: 8185986 - DNA, 22 bp, Homo sapiens
ttctggaaggatgtttctatct

SEQ ID NO: 8185987 - DNA, 22 bp, Homo sapiens
ttctggaagctgggcagcaccc

SEQ ID NO: 8185988 - DNA, 22 bp, Homo sapiens
ttctggaagcttttggagagaa

SEQ ID NO: 8185989 - DNA, 22 bp, Homo sapiens
ttctggaagctggaaaaggcaa

SEQ ID NO: 8185990 - DNA, 22 bp, Homo sapiens
ttctggaagctggaaaaggcaa

SEQ ID NO: 8185991 - DNA, 22 bp, Homo sapiens
ttctggaaggcagggagaaccc

SEQ ID NO: 8185992 - DNA, 22 bp, Homo sapiens
ttctggaaggatgtttctatct

SEQ ID NO: 8185993 - DNA, 22 bp, Homo sapiens
ttctggaagggtggagtagctt

SEQ ID NO: 8185994 - DNA, 22 bp, Homo sapiens
ttctggaagggtggagtagctt

SEQ ID NO: 8185995 - DNA, 22 bp, Homo sapiens
ttctggaagggtggagtagctt

SEQ ID NO: 8185996 - DNA, 22 bp, Homo sapiens
ttctggatgatccatttacaga

SEQ ID NO: 8185997 - DNA, 22 bp, Homo sapiens
ttctggaagccatgggaacagg

SEQ ID NO: 8185998 - DNA, 22 bp, Homo sapiens
ttctggaagcagtggggagtga

SEQ ID NO: 8185999 - DNA, 23 bp, Homo sapiens
ttctggaagatttacttgagaca

SEQ ID NO: 8186000 - DNA, 22 bp, Homo sapiens
ttctggaagctgcaggtggccg

SEQ ID NO: 8186001 - DNA, 22 bp, Homo sapiens
ttctggaagctgcaggtggccg

SEQ ID NO: 8186002 - DNA, 22 bp, Homo sapiens
ttctggaagccctaagggagaa

SEQ ID NO: 8186003 - DNA, 22 bp, Homo sapiens
ttctggaagctgcaggtggccg

SEQ ID NO: 8186004 - DNA, 22 bp, Homo sapiens
ttctggaagccccagagtcaga

SEQ ID NO: 8186005 - DNA, 22 bp, Homo sapiens
ttctatgtagataaggctgctc

SEQ ID NO: 8186006 - DNA, 22 bp, Homo sapiens
ttctatgtacctagcgttgtat

SEQ ID NO: 8186007 - DNA, 22 bp, Homo sapiens
ttctatgtcagtgtgctctgtg

SEQ ID NO: 8186008 - DNA, 22 bp, Homo sapiens
ttctatgtgaacgttatagttt

SEQ ID NO: 8186009 - DNA, 22 bp, Homo sapiens
ttctatgtgaacgttatagttt

SEQ ID NO: 8186010 - DNA, 22 bp, Homo sapiens
ttctatgtgttgacaagcctga

SEQ ID NO: 8186011 - DNA, 22 bp, Homo sapiens
ttctatgtggcatcaagctcag

SEQ ID NO: 8186012 - DNA, 22 bp, Homo sapiens
ttctatgttagtatgggtctcc

SEQ ID NO: 8186013 - DNA, 22 bp, Homo sapiens
ttctatgtgctggagaatattt

SEQ ID NO: 8186014 - DNA, 22 bp, Homo sapiens
ttctattgcacacaaataatta

SEQ ID NO: 8186015 - DNA, 22 bp, Homo sapiens
ttctattgcacacaaataatta

SEQ ID NO: 8186016 - DNA, 22 bp, Homo sapiens
ttctattaatatgttaattctg

SEQ ID NO: 8186017 - DNA, 22 bp, Homo sapiens
ttctattgcacacaaataatta

SEQ ID NO: 8186018 - DNA, 22 bp, Homo sapiens
ttctattgcacacaaataatta

SEQ ID NO: 8186019 - DNA, 22 bp, Homo sapiens
ttctatttccagtccttcagag

SEQ ID NO: 8186020 - DNA, 22 bp, Homo sapiens
ttctatttcttaatcttggctg

SEQ ID NO: 8186021 - DNA, 22 bp, Homo sapiens
ttctatttcttaatcttggctg

SEQ ID NO: 8186022 - DNA, 22 bp, Homo sapiens
ttctatttcttaatcttggctg

SEQ ID NO: 8186023 - DNA, 22 bp, Homo sapiens
ttctgcagcccaacagtagttt

SEQ ID NO: 8186024 - DNA, 22 bp, Homo sapiens
ttctgcagcccaacagtagttt

SEQ ID NO: 8186025 - DNA, 22 bp, Homo sapiens
ttctgaaggctcctcaggaaag

SEQ ID NO: 8186026 - DNA, 21 bp, Homo sapiens
ttctgcagccatgttggtttt

SEQ ID NO: 8186027 - DNA, 22 bp, Homo sapiens
ttctgcatacactgaatgtagt

SEQ ID NO: 8186028 - DNA, 22 bp, Homo sapiens
ttctgcataacttcctgggtca

SEQ ID NO: 8186029 - DNA, 22 bp, Homo sapiens
ttctgcatacactgaatgtagt

SEQ ID NO: 8186030 - DNA, 22 bp, Homo sapiens
ttctgcataggctatatttgtt

SEQ ID NO: 8186031 - DNA, 22 bp, Homo sapiens
ttctgcataggctatatttgtt

SEQ ID NO: 8186032 - DNA, 22 bp, Homo sapiens
ttctgcaggatgctctggtggt

SEQ ID NO: 8186033 - DNA, 22 bp, Homo sapiens
ttctgcaggatgctctggtggt

SEQ ID NO: 8186034 - DNA, 22 bp, Homo sapiens
ttctgcaggagccctagtgtat

SEQ ID NO: 8186035 - DNA, 22 bp, Homo sapiens
ttctgcagtgtgcagggcctgt

SEQ ID NO: 8186036 - DNA, 22 bp, Homo sapiens
ttctgcagtgttaacaatgtca

SEQ ID NO: 8186037 - DNA, 22 bp, Homo sapiens
ctcaggacccaccttattagga

SEQ ID NO: 8186038 - DNA, 22 bp, Homo sapiens
ctcaggacagattccagagaaa

SEQ ID NO: 8186039 - DNA, 22 bp, Homo sapiens
ctcaggacagattccagagaaa

SEQ ID NO: 8186040 - DNA, 22 bp, Homo sapiens
ctcaggaaccgcggcagcagcc

SEQ ID NO: 8186041 - DNA, 22 bp, Homo sapiens
ctcaggagatgacagaaggtat

SEQ ID NO: 8186042 - DNA, 22 bp, Homo sapiens
ctcaggagatgacagaaggtat

SEQ ID NO: 8186043 - DNA, 22 bp, Homo sapiens
ctcaggagatgacagaaggtat

SEQ ID NO: 8186044 - DNA, 22 bp, Homo sapiens
ctcaggagacagtgtccacatg

SEQ ID NO: 8186045 - DNA, 22 bp, Homo sapiens
ctcaggactttcaaatagaaat

SEQ ID NO: 8186046 - DNA, 22 bp, Homo sapiens
ctcaggactttcaaatagaaat

SEQ ID NO: 8186047 - DNA, 22 bp, Homo sapiens
ctcagccccaatttgccctctt

SEQ ID NO: 8186048 - DNA, 22 bp, Homo sapiens
ctcagccccaatttgccctctt

SEQ ID NO: 8186049 - DNA, 19 bp, Homo sapiens
ctcagctgtagctcatgtg

SEQ ID NO: 8186050 - DNA, 19 bp, Homo sapiens
ctcagctgtagctcatgtg

SEQ ID NO: 8186051 - DNA, 22 bp, Homo sapiens
ctcagctggcaattctggctcc

SEQ ID NO: 8186052 - DNA, 22 bp, Homo sapiens
ctcagccccaatttgccctctt

SEQ ID NO: 8186053 - DNA, 23 bp, Homo sapiens
ctcagaggcctgtccagggtggt

SEQ ID NO: 8186054 - DNA, 22 bp, Homo sapiens
ctcagctgtctcatgggtctgt

SEQ ID NO: 8186055 - DNA, 22 bp, Homo sapiens
ctcagctgtctcatgggtctgt

SEQ ID NO: 8186056 - DNA, 22 bp, Homo sapiens
ctcagcttcatttgttccatga

SEQ ID NO: 8186057 - DNA, 22 bp, Homo sapiens
ctcagcttcatttgttccatga

SEQ ID NO: 8186058 - DNA, 22 bp, Homo sapiens
ctcagcttctacctcctgagtg

SEQ ID NO: 8186059 - DNA, 22 bp, Homo sapiens
ctcagcttctacctcctgagtg

SEQ ID NO: 8186060 - DNA, 22 bp, Homo sapiens
ctcagcttctacctcctgagtg

SEQ ID NO: 8186061 - DNA, 22 bp, Homo sapiens
ctcagcttctacctcctgagtg

SEQ ID NO: 8186062 - DNA, 22 bp, Homo sapiens
ctcagcttttcccggataggtg

SEQ ID NO: 8186063 - DNA, 22 bp, Homo sapiens
ctcaggaaccgcggcagcagcc

SEQ ID NO: 8186064 - DNA, 22 bp, Homo sapiens
ctcaggaaaggccatgcaaggg

SEQ ID NO: 8186065 - DNA, 22 bp, Homo sapiens
ctcaggaggtttcctgtctagg

SEQ ID NO: 8186066 - DNA, 22 bp, Homo sapiens
ctcaggaggtttcctgtctagg

SEQ ID NO: 8186067 - DNA, 22 bp, Homo sapiens
ctcaggagtagttcagcagctg

SEQ ID NO: 8186068 - DNA, 22 bp, Homo sapiens
ctcaggagtagttcagcagctg

SEQ ID NO: 8186069 - DNA, 22 bp, Homo sapiens
ctcaggagtagttcagcagctg

SEQ ID NO: 8186070 - DNA, 22 bp, Homo sapiens
ctcaggaggtggtagaggccct

SEQ ID NO: 8186071 - DNA, 22 bp, Homo sapiens
ctcaggaggtggtagaggccct

SEQ ID NO: 8186072 - DNA, 22 bp, Homo sapiens
ctcaggaggatgactgccttgg

SEQ ID NO: 8186073 - DNA, 22 bp, Homo sapiens
ctcaggaggatgactgccttgg

SEQ ID NO: 8186074 - DNA, 22 bp, Homo sapiens
ctcaggaggatgactgccttgg

SEQ ID NO: 8186075 - DNA, 22 bp, Homo sapiens
ctcaggaggccattctcaaggt

SEQ ID NO: 8186076 - DNA, 22 bp, Homo sapiens
ctcaggagcttcctcagcccat

SEQ ID NO: 8186077 - DNA, 22 bp, Homo sapiens
ctcaggagcttcctcagcccat

SEQ ID NO: 8186078 - DNA, 22 bp, Homo sapiens
ttgcataaagattttattgcat

SEQ ID NO: 8186079 - DNA, 23 bp, Homo sapiens
ttgcatagacatcctcatagatt

SEQ ID NO: 8186080 - DNA, 22 bp, Homo sapiens
ttgcagttttctgcctcatttc

SEQ ID NO: 8186081 - DNA, 22 bp, Homo sapiens
ttgcactttatagaaacttttg

SEQ ID NO: 8186082 - DNA, 22 bp, Homo sapiens
ttgcactttgaaataacagtgg

SEQ ID NO: 8186083 - DNA, 22 bp, Homo sapiens
ttgcagaacttaaagacagagt

SEQ ID NO: 8186084 - DNA, 22 bp, Homo sapiens
ttgcagtttatgttcctgcagt

SEQ ID NO: 8186085 - DNA, 22 bp, Homo sapiens
ctcagggcagtatggctgagag

SEQ ID NO: 8186086 - DNA, 22 bp, Homo sapiens
ctcagggatgggcagatgttaa

SEQ ID NO: 8186087 - DNA, 22 bp, Homo sapiens
ctcagggatgggcagatgttaa

SEQ ID NO: 8186088 - DNA, 23 bp, Homo sapiens
ctcagggatagaaaggaagacag

SEQ ID NO: 8186089 - DNA, 22 bp, Homo sapiens
ctcagggaagctatggtgaggg

SEQ ID NO: 8186090 - DNA, 22 bp, Homo sapiens
ctcagggaattatttctgtcct

SEQ ID NO: 8186091 - DNA, 22 bp, Homo sapiens
ctcagggaattgaatctccttg

SEQ ID NO: 8186092 - DNA, 22 bp, Homo sapiens
ctcagggctctgcatgcacacg

SEQ ID NO: 8186093 - DNA, 22 bp, Homo sapiens
ctcagggctggaaagccaggaa

SEQ ID NO: 8186094 - DNA, 22 bp, Homo sapiens
ctcagggcggcgggcagcccag

SEQ ID NO: 8186095 - DNA, 22 bp, Homo sapiens
ctcagggctctgcatgcacacg

SEQ ID NO: 8186096 - DNA, 21 bp, Homo sapiens
ctcagggcttggtgtcctcat

SEQ ID NO: 8186097 - DNA, 22 bp, Homo sapiens
ctcagggcttgagtgtccagga

SEQ ID NO: 8186098 - DNA, 21 bp, Homo sapiens
ctcaggggattttgagattag

SEQ ID NO: 8186099 - DNA, 22 bp, Homo sapiens
ctcaggtagagtctgcatgggg

SEQ ID NO: 8186100 - DNA, 22 bp, Homo sapiens
ctcaggtcacaggatggccagg

SEQ ID NO: 8186101 - DNA, 22 bp, Homo sapiens
ctcaggtcttagttctgtcatc

SEQ ID NO: 8186102 - DNA, 22 bp, Homo sapiens
ctcagtaaggatgcttcagcgg

SEQ ID NO: 8186103 - DNA, 22 bp, Homo sapiens
ttgcatcttctggttgagcccc

SEQ ID NO: 8186104 - DNA, 22 bp, Homo sapiens
ttgcatatgaagctgacttaaa

SEQ ID NO: 8186105 - DNA, 22 bp, Homo sapiens
ttgcatcagaaaatatgggaag

SEQ ID NO: 8186106 - DNA, 22 bp, Homo sapiens
ttgcatagtgctgaggttcggg

SEQ ID NO: 8186107 - DNA, 22 bp, Homo sapiens
ttgcatatcctccaacacatgg

SEQ ID NO: 8186108 - DNA, 17 bp, Homo sapiens
ttgccctgatttttaac

SEQ ID NO: 8186109 - DNA, 22 bp, Homo sapiens
ttgccctagggtcttatcctcc

SEQ ID NO: 8186110 - DNA, 22 bp, Homo sapiens
ttgccctggggctggcctggca

SEQ ID NO: 8186111 - DNA, 22 bp, Homo sapiens
ttgccctggggctggcctggca

SEQ ID NO: 8186112 - DNA, 22 bp, Homo sapiens
ttgccctgcgggtcctgcgcaa

SEQ ID NO: 8186113 - DNA, 22 bp, Homo sapiens
ttgccctgcgttaccatctctt

SEQ ID NO: 8186114 - DNA, 22 bp, Homo sapiens
ttgccctgtcttaagctggcaa

SEQ ID NO: 8186115 - DNA, 22 bp, Homo sapiens
ttgccctgtcttaagctggcaa

SEQ ID NO: 8186116 - DNA, 22 bp, Homo sapiens
ttgccctgtcttaagctggcaa

SEQ ID NO: 8186117 - DNA, 22 bp, Homo sapiens
ttgccctgtcagtagaagtgca

SEQ ID NO: 8186118 - DNA, 22 bp, Homo sapiens
ttgccctgtcagtagaagtgca

SEQ ID NO: 8186119 - DNA, 22 bp, Homo sapiens
ctccagagggtcagactctgag

SEQ ID NO: 8186120 - DNA, 22 bp, Homo sapiens
ctccagaggtccccgcggcact

SEQ ID NO: 8186121 - DNA, 22 bp, Homo sapiens
ctccagaggtccccgcggcact

SEQ ID NO: 8186122 - DNA, 22 bp, Homo sapiens
ctccagaggttctcatctggga

SEQ ID NO: 8186123 - DNA, 22 bp, Homo sapiens
ctccagagggtcagactctgag

SEQ ID NO: 8186124 - DNA, 22 bp, Homo sapiens
ctccagaggcgacttgcatcac

SEQ ID NO: 8186125 - DNA, 22 bp, Homo sapiens
ctccagaggcgacttgcatcac

SEQ ID NO: 8186126 - DNA, 22 bp, Homo sapiens
ctccagaggcgacttgcatcac

SEQ ID NO: 8186127 - DNA, 22 bp, Homo sapiens
ctccagaggccctatcccacta

SEQ ID NO: 8186128 - DNA, 22 bp, Homo sapiens
ctccagaggccctatcccacta

SEQ ID NO: 8186129 - DNA, 22 bp, Homo sapiens
ctccagaggatgcaggtgaggg

SEQ ID NO: 8186130 - DNA, 22 bp, Homo sapiens
ctccagaggatgcaggtgaggg

SEQ ID NO: 8186131 - DNA, 22 bp, Homo sapiens
ctccagaggatgcaggtgaggg

SEQ ID NO: 8186132 - DNA, 22 bp, Homo sapiens
ctccagaggaaagcacatagtg

SEQ ID NO: 8186133 - DNA, 18 bp, Homo sapiens
ctccagagctgtgagaca

SEQ ID NO: 8186134 - DNA, 18 bp, Homo sapiens
ctccagagctgtgagaca

SEQ ID NO: 8186135 - DNA, 22 bp, Homo sapiens
ctccagagtcacactgcctggg

SEQ ID NO: 8186136 - DNA, 22 bp, Homo sapiens
ctccagagtcatcgagcattcc

SEQ ID NO: 8186137 - DNA, 22 bp, Homo sapiens
ctccagataggagggggtcccc

SEQ ID NO: 8186138 - DNA, 22 bp, Homo sapiens
ctccagaggttctcatctggga

SEQ ID NO: 8186139 - DNA, 22 bp, Homo sapiens
ctccagaggttctcatctggga

SEQ ID NO: 8186140 - DNA, 22 bp, Homo sapiens
ctccagagtcacactgcctggg

SEQ ID NO: 8186141 - DNA, 22 bp, Homo sapiens
ctccagagtcacactgcctggg

SEQ ID NO: 8186142 - DNA, 20 bp, Homo sapiens
ttggctctgatcagtggagc

SEQ ID NO: 8186143 - DNA, 22 bp, Homo sapiens
ttggctctgatggggatcagga

SEQ ID NO: 8186144 - DNA, 22 bp, Homo sapiens
ttggctctggaactatttctga

SEQ ID NO: 8186145 - DNA, 17 bp, Homo sapiens
ttggctctattgcctct

SEQ ID NO: 8186146 - DNA, 21 bp, Homo sapiens
ttggctctgaaacttgcacct

SEQ ID NO: 8186147 - DNA, 22 bp, Homo sapiens
ctccaggacccagtggctccag

SEQ ID NO: 8186148 - DNA, 22 bp, Homo sapiens
ctccaggacccagtggctccag

SEQ ID NO: 8186149 - DNA, 22 bp, Homo sapiens
ctccaggactcaggcccctggg

SEQ ID NO: 8186150 - DNA, 22 bp, Homo sapiens
ctccaggactgaggacagagct

SEQ ID NO: 8186151 - DNA, 22 bp, Homo sapiens
ctccaggacagattcagggcca

SEQ ID NO: 8186152 - DNA, 22 bp, Homo sapiens
ctccaggacactaacccaggct

SEQ ID NO: 8186153 - DNA, 22 bp, Homo sapiens
ctccaggaccagggctcctgga

SEQ ID NO: 8186154 - DNA, 22 bp, Homo sapiens
ctccaggaccagggctcctgga

SEQ ID NO: 8186155 - DNA, 22 bp, Homo sapiens
ttggctgaactgagctccatcg

SEQ ID NO: 8186156 - DNA, 22 bp, Homo sapiens
ctccagcctcatctcctggctg

SEQ ID NO: 8186157 - DNA, 22 bp, Homo sapiens
ttggctgctaatggctgacagc

SEQ ID NO: 8186158 - DNA, 22 bp, Homo sapiens
ctccaggacactaacccaggct

SEQ ID NO: 8186159 - DNA, 22 bp, Homo sapiens
ctccagcctcatctcctggctg

SEQ ID NO: 8186160 - DNA, 22 bp, Homo sapiens
ctccagcctcatctcctggctg

SEQ ID NO: 8186161 - DNA, 22 bp, Homo sapiens
ctccagcctcatctcctggctg

SEQ ID NO: 8186162 - DNA, 22 bp, Homo sapiens
ttggctgctagatggtgttaga

SEQ ID NO: 8186163 - DNA, 22 bp, Homo sapiens
ttggctgcaatcacagggactc

SEQ ID NO: 8186164 - DNA, 22 bp, Homo sapiens
ttggctgcattttgggttcgtt

SEQ ID NO: 8186165 - DNA, 22 bp, Homo sapiens
ttggctgccgagcgcatcccgg

SEQ ID NO: 8186166 - DNA, 21 bp, Homo sapiens
ttggctgcctgagattagaat

SEQ ID NO: 8186167 - DNA, 22 bp, Homo sapiens
ttggctgcctgtggatcgcatt

SEQ ID NO: 8186168 - DNA, 22 bp, Homo sapiens
ttggctgccttcacccctggcc

SEQ ID NO: 8186169 - DNA, 22 bp, Homo sapiens
ctccactcaccagatgccagga

SEQ ID NO: 8186170 - DNA, 22 bp, Homo sapiens
ttggatccatctcaggcatagg

SEQ ID NO: 8186171 - DNA, 22 bp, Homo sapiens
ttggatccatctcaggcatagg

SEQ ID NO: 8186172 - DNA, 22 bp, Homo sapiens
ttggataaagaggaagattatc

SEQ ID NO: 8186173 - DNA, 22 bp, Homo sapiens
ttggagtgacagatgaggaaac

SEQ ID NO: 8186174 - DNA, 22 bp, Homo sapiens
ttggagtccttgctgcttcact

SEQ ID NO: 8186175 - DNA, 22 bp, Homo sapiens
ttggagtcattggcctgggtga

SEQ ID NO: 8186176 - DNA, 22 bp, Homo sapiens
ttggagtcatatggaattcaca

SEQ ID NO: 8186177 - DNA, 22 bp, Homo sapiens
ttggagtcacaggagaagaatg

SEQ ID NO: 8186178 - DNA, 22 bp, Homo sapiens
ttggagtcagatgactgtagga

SEQ ID NO: 8186179 - DNA, 22 bp, Homo sapiens
ttggaggtttcccaactgtggg

SEQ ID NO: 8186180 - DNA, 22 bp, Homo sapiens
ttggaggttattaacactggcc

SEQ ID NO: 8186181 - DNA, 20 bp, Homo sapiens
ttggaggtgcagtgcatgca

SEQ ID NO: 8186182 - DNA, 20 bp, Homo sapiens
ttggaggtgcagtgcatgca

SEQ ID NO: 8186183 - DNA, 22 bp, Homo sapiens
ttggagggtcttccacagccat

SEQ ID NO: 8186184 - DNA, 22 bp, Homo sapiens
ttggagggtcttccacagccat

SEQ ID NO: 8186185 - DNA, 22 bp, Homo sapiens
ttggaggggccactgcagagct

SEQ ID NO: 8186186 - DNA, 22 bp, Homo sapiens
ttggaggggccactgcagagct

SEQ ID NO: 8186187 - DNA, 22 bp, Homo sapiens
ttggagggacagatggctaggc

SEQ ID NO: 8186188 - DNA, 22 bp, Homo sapiens
ttggagggactgagcttcagtc

SEQ ID NO: 8186189 - DNA, 22 bp, Homo sapiens
ttggagggactgagcttcagtc

SEQ ID NO: 8186190 - DNA, 23 bp, Homo sapiens
ttggaagggaagagcatttgaga

SEQ ID NO: 8186191 - DNA, 22 bp, Homo sapiens
ctcagtgcttagtgtgttttgg

SEQ ID NO: 8186192 - DNA, 22 bp, Homo sapiens
ctcagtgcttctagcttgatga

SEQ ID NO: 8186193 - DNA, 22 bp, Homo sapiens
ttggaaaatgaggcacagagag

SEQ ID NO: 8186194 - DNA, 22 bp, Homo sapiens
ttggaaaagtgaaactagatgc

SEQ ID NO: 8186195 - DNA, 22 bp, Homo sapiens
ctcagtgcagctaggcatgaga

SEQ ID NO: 8186196 - DNA, 22 bp, Homo sapiens
ctcagtgctagaagtagattgc

SEQ ID NO: 8186197 - DNA, 22 bp, Homo sapiens
ctcagtgctgaggaaagttgaa

SEQ ID NO: 8186198 - DNA, 22 bp, Homo sapiens
ctcagtgctacggttaccatat

SEQ ID NO: 8186199 - DNA, 22 bp, Homo sapiens
ctcagtgcaaccaaagtgatct

SEQ ID NO: 8186200 - DNA, 22 bp, Homo sapiens
ctcagtgcaaccaaagtgatct

SEQ ID NO: 8186201 - DNA, 22 bp, Homo sapiens
ctcagtcttctcctccaatgga

SEQ ID NO: 8186202 - DNA, 22 bp, Homo sapiens
ctcagtcttctcctccaatgga

SEQ ID NO: 8186203 - DNA, 19 bp, Homo sapiens
ctcagtctggctctgcctg

SEQ ID NO: 8186204 - DNA, 19 bp, Homo sapiens
ctcagtctggctctgcctg

SEQ ID NO: 8186205 - DNA, 22 bp, Homo sapiens
ctcagtctgtcttgtctgtgtt

SEQ ID NO: 8186206 - DNA, 22 bp, Homo sapiens
ctcagtctgtcttgtctgtgtt

SEQ ID NO: 8186207 - DNA, 22 bp, Homo sapiens
ctcagtcatgacgctcaggacc

SEQ ID NO: 8186208 - DNA, 22 bp, Homo sapiens
ctcagtccacgcagcctcctga

SEQ ID NO: 8186209 - DNA, 22 bp, Homo sapiens
ctcagtccgtcccgctaggtgc

SEQ ID NO: 8186210 - DNA, 22 bp, Homo sapiens
ctcagtctcttgggctgtgaag

SEQ ID NO: 8186211 - DNA, 22 bp, Homo sapiens
ttggaagctactttaatgtaat

SEQ ID NO: 8186212 - DNA, 22 bp, Homo sapiens
ttggaagcgagcacatggagga

SEQ ID NO: 8186213 - DNA, 22 bp, Homo sapiens
ttggaagcgagcacatggagga

SEQ ID NO: 8186214 - DNA, 22 bp, Homo sapiens
ttggaaggccagcaccttgagt

SEQ ID NO: 8186215 - DNA, 22 bp, Homo sapiens
ttggaagatctaacagaggcat

SEQ ID NO: 8186216 - DNA, 22 bp, Homo sapiens
ttggaagattctgtgtctggtg

SEQ ID NO: 8186217 - DNA, 22 bp, Homo sapiens
ttggaagcaataaatggaaaga

SEQ ID NO: 8186218 - DNA, 22 bp, Homo sapiens
ttggaagcagtgtacactgtac

SEQ ID NO: 8186219 - DNA, 22 bp, Homo sapiens
ttggaagcagtgtacactgtac

SEQ ID NO: 8186220 - DNA, 22 bp, Homo sapiens
ttggaagcaatgtaagtcgcat

SEQ ID NO: 8186221 - DNA, 22 bp, Homo sapiens
ttggaagcctagttaagatgaa

SEQ ID NO: 8186222 - DNA, 22 bp, Homo sapiens
ttggaagcgagcacatggagga

SEQ ID NO: 8186223 - DNA, 22 bp, Homo sapiens
ttggaagccctgtgataggcca

SEQ ID NO: 8186224 - DNA, 22 bp, Homo sapiens
ttggaagccctgtgataggcca

SEQ ID NO: 8186225 - DNA, 22 bp, Homo sapiens
ttggaagccctctgcaagatcc

SEQ ID NO: 8186226 - DNA, 22 bp, Homo sapiens
ttggaagccagaggaccaggga

SEQ ID NO: 8186227 - DNA, 23 bp, Homo sapiens
ttggaagccagacagctgtgcag

SEQ ID NO: 8186228 - DNA, 22 bp, Homo sapiens
ttggaagcattctgaatgtcca

SEQ ID NO: 8186229 - DNA, 23 bp, Homo sapiens
ttggaagccagacagctgtgcag

SEQ ID NO: 8186230 - DNA, 22 bp, Homo sapiens
ttaaattatttctagtgaggtg

SEQ ID NO: 8186231 - DNA, 22 bp, Homo sapiens
ttaaattgtcatttgagcaatg

SEQ ID NO: 8186232 - DNA, 22 bp, Homo sapiens
ttaaattgtcatttgagcaatg

SEQ ID NO: 8186233 - DNA, 22 bp, Homo sapiens
ttaaattccagcctcataatag

SEQ ID NO: 8186234 - DNA, 22 bp, Homo sapiens
ttaaatttctacgtgatccagg

SEQ ID NO: 8186235 - DNA, 22 bp, Homo sapiens
ttaagagggtgatgctagcatt

SEQ ID NO: 8186236 - DNA, 22 bp, Homo sapiens
ttaagaggagatcatactggag

SEQ ID NO: 8186237 - DNA, 22 bp, Homo sapiens
ttaagaggagatcatactggag

SEQ ID NO: 8186238 - DNA, 22 bp, Homo sapiens
ttaagaggtgaggcctttaaga

SEQ ID NO: 8186239 - DNA, 22 bp, Homo sapiens
ttaagaggtggtcgtgtctgtg

SEQ ID NO: 8186240 - DNA, 22 bp, Homo sapiens
ttaagagggtgatgctagcatt

SEQ ID NO: 8186241 - DNA, 22 bp, Homo sapiens
ttaagaggtgaggcctttaaga

SEQ ID NO: 8186242 - DNA, 22 bp, Homo sapiens
ttaaattttagaaacagactct

SEQ ID NO: 8186243 - DNA, 21 bp, Homo sapiens
ttaagagcttagcagtaggcc

SEQ ID NO: 8186244 - DNA, 22 bp, Homo sapiens
ttaagaggagatcatactggag

SEQ ID NO: 8186245 - DNA, 22 bp, Homo sapiens
ttaagagcaacatatggtgaca

SEQ ID NO: 8186246 - DNA, 18 bp, Homo sapiens
ttaagagctgaaagggga

SEQ ID NO: 8186247 - DNA, 22 bp, Homo sapiens
ttaagagccaacttatccatct

SEQ ID NO: 8186248 - DNA, 22 bp, Homo sapiens
ttaagattttcttcagtattat

SEQ ID NO: 8186249 - DNA, 22 bp, Homo sapiens
ttaagatagaacccagtagtct

SEQ ID NO: 8186250 - DNA, 22 bp, Homo sapiens
ttaagatagaacccagtagtct

SEQ ID NO: 8186251 - DNA, 22 bp, Homo sapiens
ttaagaggtggtcgtgtctgtg

SEQ ID NO: 8186252 - DNA, 22 bp, Homo sapiens
tgtcagcacatctgtaatcaca

SEQ ID NO: 8186253 - DNA, 21 bp, Homo sapiens
tgtcagcacgcatgaggccag

SEQ ID NO: 8186254 - DNA, 22 bp, Homo sapiens
tgtcagcagaaatctggtctgc

SEQ ID NO: 8186255 - DNA, 21 bp, Homo sapiens
tgtcagcaacaatactttctc

SEQ ID NO: 8186256 - DNA, 21 bp, Homo sapiens
tgtcagagcttgtaggacatt

SEQ ID NO: 8186257 - DNA, 20 bp, Homo sapiens
tgtcagataactagctgtta

SEQ ID NO: 8186258 - DNA, 22 bp, Homo sapiens
tgtcagagagcaggcagtagaa

SEQ ID NO: 8186259 - DNA, 22 bp, Homo sapiens
tgtcaatagttttgagttctct

SEQ ID NO: 8186260 - DNA, 22 bp, Homo sapiens
tgtcagcagctggtttgctgtt

SEQ ID NO: 8186261 - DNA, 22 bp, Homo sapiens
tgtcagcagatctcctgcagcc

SEQ ID NO: 8186262 - DNA, 22 bp, Homo sapiens
tgtcagcagtatctctatctca

SEQ ID NO: 8186263 - DNA, 22 bp, Homo sapiens
tgtcagcagtttttagtggagg

SEQ ID NO: 8186264 - DNA, 22 bp, Homo sapiens
ttaaattagtcaagcttctctg

SEQ ID NO: 8186265 - DNA, 22 bp, Homo sapiens
ttaaattagtcaagcttctctg

SEQ ID NO: 8186266 - DNA, 22 bp, Homo sapiens
ttaaattagtcaagcttctctg

SEQ ID NO: 8186267 - DNA, 22 bp, Homo sapiens
ccttacctgattgctggcatcc

SEQ ID NO: 8186268 - DNA, 22 bp, Homo sapiens
ccttacctgattgctggcatcc

SEQ ID NO: 8186269 - DNA, 22 bp, Homo sapiens
ccttatcacaatggagtgtcac

SEQ ID NO: 8186270 - DNA, 22 bp, Homo sapiens
ccttagtgtgcctgaggcagat

SEQ ID NO: 8186271 - DNA, 22 bp, Homo sapiens
ccttatcacaatggagtgtcac

SEQ ID NO: 8186272 - DNA, 17 bp, Homo sapiens
ccttagggcagtgtggt

SEQ ID NO: 8186273 - DNA, 22 bp, Homo sapiens
ccttagtgtgaggggatacccc

SEQ ID NO: 8186274 - DNA, 22 bp, Homo sapiens
ccttagtgaaacagaggcaatt

SEQ ID NO: 8186275 - DNA, 21 bp, Homo sapiens
ccttagtcttccacatagtcc

SEQ ID NO: 8186276 - DNA, 22 bp, Homo sapiens
ccttaaattctccatttgaaag

SEQ ID NO: 8186277 - DNA, 22 bp, Homo sapiens
ccttaaattctccatttgaaag

SEQ ID NO: 8186278 - DNA, 22 bp, Homo sapiens
ccttaaattctccatttgaaag

SEQ ID NO: 8186279 - DNA, 22 bp, Homo sapiens
ccttaaattctccatttgaaag

SEQ ID NO: 8186280 - DNA, 22 bp, Homo sapiens
ccttaaaagaactatctcttct

SEQ ID NO: 8186281 - DNA, 22 bp, Homo sapiens
ttaagcacctatgttgtgccag

SEQ ID NO: 8186282 - DNA, 18 bp, Homo sapiens
cctgtgtgtgttgcaggc

SEQ ID NO: 8186283 - DNA, 21 bp, Homo sapiens
cctgtgtgtgtccctttaaga

SEQ ID NO: 8186284 - DNA, 22 bp, Homo sapiens
cctgtgtgtctgtcactgcaca

SEQ ID NO: 8186285 - DNA, 22 bp, Homo sapiens
ttacaaagcgttgagacaagta

SEQ ID NO: 8186286 - DNA, 22 bp, Homo sapiens
ttacaaagcgttgagacaagta

SEQ ID NO: 8186287 - DNA, 22 bp, Homo sapiens
ttacaaagcgttgagacaagta

SEQ ID NO: 8186288 - DNA, 22 bp, Homo sapiens
ttacaaagcgctttacctctga

SEQ ID NO: 8186289 - DNA, 22 bp, Homo sapiens
ttacaaagcaggtcagctgaaa

SEQ ID NO: 8186290 - DNA, 22 bp, Homo sapiens
ttacaaagcaggtcagctgaaa

SEQ ID NO: 8186291 - DNA, 22 bp, Homo sapiens
ttacaaagattatattcagtta

SEQ ID NO: 8186292 - DNA, 22 bp, Homo sapiens
ttacaaagattatattcagtta

SEQ ID NO: 8186293 - DNA, 22 bp, Homo sapiens
ttacaaagcaggtcagctgaaa

SEQ ID NO: 8186294 - DNA, 22 bp, Homo sapiens
ttacagtggtcatttgggaaaa

SEQ ID NO: 8186295 - DNA, 22 bp, Homo sapiens
ttacagtgtgcaatcccagaat

SEQ ID NO: 8186296 - DNA, 22 bp, Homo sapiens
ttacagtgttacttgatgtcca

SEQ ID NO: 8186297 - DNA, 21 bp, Homo sapiens
ttacagaatccatgggaagtc

SEQ ID NO: 8186298 - DNA, 21 bp, Homo sapiens
ttacagaatccatgggaagtc

SEQ ID NO: 8186299 - DNA, 22 bp, Homo sapiens
ttacagttgctacaaaggataa

SEQ ID NO: 8186300 - DNA, 21 bp, Homo sapiens
ttacagttgatggagtattcc

SEQ ID NO: 8186301 - DNA, 22 bp, Homo sapiens
ttacagttaatgtgactaacca

SEQ ID NO: 8186302 - DNA, 22 bp, Homo sapiens
ttacagttactggtactgttaa

SEQ ID NO: 8186303 - DNA, 22 bp, Homo sapiens
ttacagttactggtactgttaa

SEQ ID NO: 8186304 - DNA, 22 bp, Homo sapiens
ttacagttagaatctgatgaaa

SEQ ID NO: 8186305 - DNA, 22 bp, Homo sapiens
ttacagttaggtgtgtagtggt

SEQ ID NO: 8186306 - DNA, 22 bp, Homo sapiens
ttacagttgtagaaagtggttg

SEQ ID NO: 8186307 - DNA, 22 bp, Homo sapiens
ttacagttggtattagaccaaa

SEQ ID NO: 8186308 - DNA, 22 bp, Homo sapiens
ttacagttgtagaaagtggttg

SEQ ID NO: 8186309 - DNA, 22 bp, Homo sapiens
ttacagtttacataagaattgt

SEQ ID NO: 8186310 - DNA, 22 bp, Homo sapiens
ttacagtttaagaggaaacaaa

SEQ ID NO: 8186311 - DNA, 22 bp, Homo sapiens
ttacagtttagtccaagccaga

SEQ ID NO: 8186312 - DNA, 22 bp, Homo sapiens
ttacagtttaccaagaatattg

SEQ ID NO: 8186313 - DNA, 22 bp, Homo sapiens
ttacagtttaccaagaatattg

SEQ ID NO: 8186314 - DNA, 22 bp, Homo sapiens
ttacagtttacataagaattgt

SEQ ID NO: 8186315 - DNA, 22 bp, Homo sapiens
ttacagtttacataagaattgt

SEQ ID NO: 8186316 - DNA, 22 bp, Homo sapiens
ttagcaagaaagattgcagcac

SEQ ID NO: 8186317 - DNA, 22 bp, Homo sapiens
ttagcactggatttcatcagaa

SEQ ID NO: 8186318 - DNA, 21 bp, Homo sapiens
ttagcaaagcaaacacatgct

SEQ ID NO: 8186319 - DNA, 22 bp, Homo sapiens
ttagcaaatatcttgaaacagg

SEQ ID NO: 8186320 - DNA, 22 bp, Homo sapiens
ttagcaaagtttgccatctagt

SEQ ID NO: 8186321 - DNA, 22 bp, Homo sapiens
ccttcagcctttgtttatcaga

SEQ ID NO: 8186322 - DNA, 22 bp, Homo sapiens
ccttcagcgtcccctttacccg

SEQ ID NO: 8186323 - DNA, 18 bp, Homo sapiens
ccttcagctctgccagta

SEQ ID NO: 8186324 - DNA, 22 bp, Homo sapiens
ttagcaaactctgttagattct

SEQ ID NO: 8186325 - DNA, 22 bp, Homo sapiens
ttagacagtaaggcttcagttg

SEQ ID NO: 8186326 - DNA, 22 bp, Homo sapiens
ttagacagagctccttgagggc

SEQ ID NO: 8186327 - DNA, 22 bp, Homo sapiens
ttagacaggatgtatgaaagct

SEQ ID NO: 8186328 - DNA, 22 bp, Homo sapiens
ccttcacactttcacttggata

SEQ ID NO: 8186329 - DNA, 22 bp, Homo sapiens
ccttcaagttcctggtccctgg

SEQ ID NO: 8186330 - DNA, 22 bp, Homo sapiens
ccttcagccagttttctttgtt

SEQ ID NO: 8186331 - DNA, 22 bp, Homo sapiens
ccttcagcctagaacttgagag

SEQ ID NO: 8186332 - DNA, 22 bp, Homo sapiens
ttacatagttaaatagtacagc

SEQ ID NO: 8186333 - DNA, 22 bp, Homo sapiens
ttacataactttaaaatgccgt

SEQ ID NO: 8186334 - DNA, 22 bp, Homo sapiens
ttacatacttactagatctatg

SEQ ID NO: 8186335 - DNA, 22 bp, Homo sapiens
ttacatacttactagatctatg

SEQ ID NO: 8186336 - DNA, 22 bp, Homo sapiens
ttacatacctcatagactcagg

SEQ ID NO: 8186337 - DNA, 22 bp, Homo sapiens
ttacataacggtatgaaaaatg

SEQ ID NO: 8186338 - DNA, 22 bp, Homo sapiens
ttacataaaagttcacgtaggc

SEQ ID NO: 8186339 - DNA, 22 bp, Homo sapiens
ttacagtttatccaggaagagc

SEQ ID NO: 8186340 - DNA, 22 bp, Homo sapiens
ttacagtttctagtaatacttg

SEQ ID NO: 8186341 - DNA, 22 bp, Homo sapiens
ttacagtttctagtaatacttg

SEQ ID NO: 8186342 - DNA, 22 bp, Homo sapiens
ccttgaaatgttctcactgggg

SEQ ID NO: 8186343 - DNA, 22 bp, Homo sapiens
ccttgagagaagtctgtgcctt

SEQ ID NO: 8186344 - DNA, 22 bp, Homo sapiens
ccttgagaggaacgtggtcatg

SEQ ID NO: 8186345 - DNA, 21 bp, Homo sapiens
ccttgaggcccaggccaggcc

SEQ ID NO: 8186346 - DNA, 22 bp, Homo sapiens
ccttgcagacatcagtagtggc

SEQ ID NO: 8186347 - DNA, 22 bp, Homo sapiens
ccttgagccagggagctggcag

SEQ ID NO: 8186348 - DNA, 22 bp, Homo sapiens
ccttgagaggaacgtggtcatg

SEQ ID NO: 8186349 - DNA, 22 bp, Homo sapiens
ccttgagccagggagctggcag

SEQ ID NO: 8186350 - DNA, 22 bp, Homo sapiens
ccttgagccagggagctggcag

SEQ ID NO: 8186351 - DNA, 22 bp, Homo sapiens
ccttgcagggaaactggaccca

SEQ ID NO: 8186352 - DNA, 22 bp, Homo sapiens
ccttgcagggaaactggaccca

SEQ ID NO: 8186353 - DNA, 22 bp, Homo sapiens
ccttgcaggggaacaggcagtg

SEQ ID NO: 8186354 - DNA, 22 bp, Homo sapiens
ccttgcaggggaacaggcagtg

SEQ ID NO: 8186355 - DNA, 22 bp, Homo sapiens
ccttgcagcatatagagtccct

SEQ ID NO: 8186356 - DNA, 22 bp, Homo sapiens
ccttgcagagcataggagccct

SEQ ID NO: 8186357 - DNA, 22 bp, Homo sapiens
ccttgcagagcataggagccct

SEQ ID NO: 8186358 - DNA, 22 bp, Homo sapiens
ccttgcagttgttactgtagcc

SEQ ID NO: 8186359 - DNA, 22 bp, Homo sapiens
ccttgcatatattatatctttg

SEQ ID NO: 8186360 - DNA, 22 bp, Homo sapiens
ccttgcccgctgcctctgagtt

SEQ ID NO: 8186361 - DNA, 22 bp, Homo sapiens
ccttgcccgctgcctctgagtt

SEQ ID NO: 8186362 - DNA, 22 bp, Homo sapiens
ccttgccctgagcaggggtcag

SEQ ID NO: 8186363 - DNA, 22 bp, Homo sapiens
ccttgcctcattgtgcttctcc

SEQ ID NO: 8186364 - DNA, 22 bp, Homo sapiens
ttagggaaacaaacattttctt

SEQ ID NO: 8186365 - DNA, 22 bp, Homo sapiens
ccttgcctcattgtgcttctcc

SEQ ID NO: 8186366 - DNA, 22 bp, Homo sapiens
ccttgcctcattgtgcttctcc

SEQ ID NO: 8186367 - DNA, 22 bp, Homo sapiens
ttagggaaagcagcattccctt

SEQ ID NO: 8186368 - DNA, 22 bp, Homo sapiens
ttagtttataattcatttctgt

SEQ ID NO: 8186369 - DNA, 22 bp, Homo sapiens
ttagtttataattcatttctgt

SEQ ID NO: 8186370 - DNA, 22 bp, Homo sapiens
ttagtttcctgtggtgtgaagt

SEQ ID NO: 8186371 - DNA, 22 bp, Homo sapiens
ttataaagattgttatgtatct

SEQ ID NO: 8186372 - DNA, 22 bp, Homo sapiens
ttagttttctcatctatctcac

SEQ ID NO: 8186373 - DNA, 22 bp, Homo sapiens
ttatatttctggtagccttcag

SEQ ID NO: 8186374 - DNA, 22 bp, Homo sapiens
ttatatttctggtagccttcag

SEQ ID NO: 8186375 - DNA, 22 bp, Homo sapiens
ttatatttctggtagccttcag

SEQ ID NO: 8186376 - DNA, 22 bp, Homo sapiens
ttatcacttatgagctttttgc

SEQ ID NO: 8186377 - DNA, 22 bp, Homo sapiens
ttatatttctggtagccttcag

SEQ ID NO: 8186378 - DNA, 22 bp, Homo sapiens
ttatcagttgtgtgtatacacg

SEQ ID NO: 8186379 - DNA, 22 bp, Homo sapiens
ttataacatcaatcagagttaa

SEQ ID NO: 8186380 - DNA, 22 bp, Homo sapiens
ttataacaacagtttactttaa

SEQ ID NO: 8186381 - DNA, 22 bp, Homo sapiens
ttataacactgccttgtcacca

SEQ ID NO: 8186382 - DNA, 22 bp, Homo sapiens
ttataacaacagtttactttaa

SEQ ID NO: 8186383 - DNA, 22 bp, Homo sapiens
ttataacattataaagtggaga

SEQ ID NO: 8186384 - DNA, 22 bp, Homo sapiens
ttatattagttagacttgctgt

SEQ ID NO: 8186385 - DNA, 22 bp, Homo sapiens
ttatattagttagacttgctgt

SEQ ID NO: 8186386 - DNA, 23 bp, Homo sapiens
ttataaatattttcaggtgtgtt

SEQ ID NO: 8186387 - DNA, 23 bp, Homo sapiens
ttataaatattttcaggtgtgtt

SEQ ID NO: 8186388 - DNA, 23 bp, Homo sapiens
ttataaatattttcaggtgtgtt

SEQ ID NO: 8186389 - DNA, 23 bp, Homo sapiens
ttataaatattttcaggtgtgtt

SEQ ID NO: 8186390 - DNA, 23 bp, Homo sapiens
ttataaatattttcaggtgtgtt

SEQ ID NO: 8186391 - DNA, 23 bp, Homo sapiens
ttataaatattttcaggtgtgtt

SEQ ID NO: 8186392 - DNA, 23 bp, Homo sapiens
ttataaatattttcaggtgtgtt

SEQ ID NO: 8186393 - DNA, 22 bp, Homo sapiens
ttataaagtgagaagtgctatg

SEQ ID NO: 8186394 - DNA, 22 bp, Homo sapiens
ttataaagtgagaagtgctatg

SEQ ID NO: 8186395 - DNA, 22 bp, Homo sapiens
ccttttctgtttcctgtcactg

SEQ ID NO: 8186396 - DNA, 22 bp, Homo sapiens
ccttttcttgccactgactcgg

SEQ ID NO: 8186397 - DNA, 22 bp, Homo sapiens
ccttttgaaggtgttgttaagt

SEQ ID NO: 8186398 - DNA, 22 bp, Homo sapiens
ccttttctgtgtgggtaattta

SEQ ID NO: 8186399 - DNA, 22 bp, Homo sapiens
ccttttctgaaccacttaaata

SEQ ID NO: 8186400 - DNA, 22 bp, Homo sapiens
ccttttctggccaccaagcgct

SEQ ID NO: 8186401 - DNA, 22 bp, Homo sapiens
ttatccaacatgacttatgtcc

SEQ ID NO: 8186402 - DNA, 22 bp, Homo sapiens
ccttttcccatgtttctggagc

SEQ ID NO: 8186403 - DNA, 22 bp, Homo sapiens
cctttggtaattctgtgtagag

SEQ ID NO: 8186404 - DNA, 22 bp, Homo sapiens
ttatccactttagtttcagtat

SEQ ID NO: 8186405 - DNA, 22 bp, Homo sapiens
cctttggtaacattccaacctt

SEQ ID NO: 8186406 - DNA, 22 bp, Homo sapiens
ccttttctaggatgctttatag

SEQ ID NO: 8186407 - DNA, 22 bp, Homo sapiens
ccttttctatccttctaggttc

SEQ ID NO: 8186408 - DNA, 16 bp, Homo sapiens
ccttttctcatctcta

SEQ ID NO: 8186409 - DNA, 22 bp, Homo sapiens
ccttttctatgtaccagcagtg

SEQ ID NO: 8186410 - DNA, 22 bp, Homo sapiens
ccttttctaatcttaagaatgt

SEQ ID NO: 8186411 - DNA, 22 bp, Homo sapiens
ccttttctaatcttaagaatgt

SEQ ID NO: 8186412 - DNA, 22 bp, Homo sapiens
ccttttctacaagcaaatgtgc

SEQ ID NO: 8186413 - DNA, 22 bp, Homo sapiens
ccttttctagaaagggaggcaa

SEQ ID NO: 8186414 - DNA, 22 bp, Homo sapiens
cgagagatgggttggcaggggc

SEQ ID NO: 8186415 - DNA, 22 bp, Homo sapiens
cgagagatgggttggcaggggc

SEQ ID NO: 8186416 - DNA, 22 bp, Homo sapiens
cgagagatgggttggcaggggc

SEQ ID NO: 8186417 - DNA, 22 bp, Homo sapiens
cgagaaatgagaaacccatttt

SEQ ID NO: 8186418 - DNA, 22 bp, Homo sapiens
cgaaaatagatctgtttcccag

SEQ ID NO: 8186419 - DNA, 22 bp, Homo sapiens
ccttttttctatgccaactctg

SEQ ID NO: 8186420 - DNA, 19 bp, Homo sapiens
ccttttttaacttcagcaa

SEQ ID NO: 8186421 - DNA, 22 bp, Homo sapiens
ttattgagtttacagctttaga

SEQ ID NO: 8186422 - DNA, 22 bp, Homo sapiens
ttattgcaaccttttctggtgt

SEQ ID NO: 8186423 - DNA, 22 bp, Homo sapiens
ttattgcaactcctaaatagag

SEQ ID NO: 8186424 - DNA, 22 bp, Homo sapiens
ttattgagttgtaagagctctt

SEQ ID NO: 8186425 - DNA, 22 bp, Homo sapiens
ttattgagtttacagctttaga

SEQ ID NO: 8186426 - DNA, 23 bp, Homo sapiens
ttattgagggtgtagattggtgt

SEQ ID NO: 8186427 - DNA, 16 bp, Homo sapiens
ttattgaggccaagga

SEQ ID NO: 8186428 - DNA, 22 bp, Homo sapiens
ttattgagtatctgcttggtgt

SEQ ID NO: 8186429 - DNA, 22 bp, Homo sapiens
cgagatccttcagagcgcggac

SEQ ID NO: 8186430 - DNA, 22 bp, Homo sapiens
cgagagttagctaggagtcaca

SEQ ID NO: 8186431 - DNA, 22 bp, Homo sapiens
cgagagttagctaggagtcaca

SEQ ID NO: 8186432 - DNA, 22 bp, Homo sapiens
cgagagttagctaggagtcaca

SEQ ID NO: 8186433 - DNA, 22 bp, Homo sapiens
cgagagttagctaggagtcaca

SEQ ID NO: 8186434 - DNA, 22 bp, Homo sapiens
ttattcagattggctacaggat

SEQ ID NO: 8186435 - DNA, 20 bp, Homo sapiens
ttatttcagttgctagattg

SEQ ID NO: 8186436 - DNA, 20 bp, Homo sapiens
ttatttcagttgctagattg

SEQ ID NO: 8186437 - DNA, 21 bp, Homo sapiens
ttatttcacatggacttccag

SEQ ID NO: 8186438 - DNA, 22 bp, Homo sapiens
ttatttattgtgtacctactgt

SEQ ID NO: 8186439 - DNA, 22 bp, Homo sapiens
ttatttattgtgtacctactgt

SEQ ID NO: 8186440 - DNA, 22 bp, Homo sapiens
ttatttatgttaacagtcgaga

SEQ ID NO: 8186441 - DNA, 22 bp, Homo sapiens
ttattgctatgatgatgtgtag

SEQ ID NO: 8186442 - DNA, 22 bp, Homo sapiens
ttattgctagtgtcatttcaca

SEQ ID NO: 8186443 - DNA, 22 bp, Homo sapiens
ttatttattcattctgtctgtc

SEQ ID NO: 8186444 - DNA, 22 bp, Homo sapiens
ttattgcagatggtgtgagaga

SEQ ID NO: 8186445 - DNA, 22 bp, Homo sapiens
ttattgcaactttagggataga

SEQ ID NO: 8186446 - DNA, 22 bp, Homo sapiens
ttattgcaactcctaaatagag

SEQ ID NO: 8186447 - DNA, 22 bp, Homo sapiens
ttattgcaactttagggataga

SEQ ID NO: 8186448 - DNA, 22 bp, Homo sapiens
ttattgcaactttagggataga

SEQ ID NO: 8186449 - DNA, 22 bp, Homo sapiens
ttattgcactattgattttcta

SEQ ID NO: 8186450 - DNA, 22 bp, Homo sapiens
cgctccttgagcgtgtcggcct

SEQ ID NO: 8186451 - DNA, 22 bp, Homo sapiens
cgcctctctttttctcccagac

SEQ ID NO: 8186452 - DNA, 22 bp, Homo sapiens
cgctgcacgtgtcacactaacc

SEQ ID NO: 8186453 - DNA, 22 bp, Homo sapiens
cgctgataaacgtcacgttccc

SEQ ID NO: 8186454 - DNA, 22 bp, Homo sapiens
cgctctggcaggcacaggaggg

SEQ ID NO: 8186455 - DNA, 22 bp, Homo sapiens
cgctctggagaatagtagcttt

SEQ ID NO: 8186456 - DNA, 22 bp, Homo sapiens
cgctctggagaatagtagcttt

SEQ ID NO: 8186457 - DNA, 22 bp, Homo sapiens
ttatttcatataatgttatcaa

SEQ ID NO: 8186458 - DNA, 22 bp, Homo sapiens
ttatttcatgtaaaatttatgt

SEQ ID NO: 8186459 - DNA, 22 bp, Homo sapiens
ttatttcatgtaaaatttatgt

SEQ ID NO: 8186460 - DNA, 22 bp, Homo sapiens
cgcctcagccgtggtcatcttc

SEQ ID NO: 8186461 - DNA, 22 bp, Homo sapiens
ttcaaagtagggtagggggtcc

SEQ ID NO: 8186462 - DNA, 22 bp, Homo sapiens
cgctggcattagggcagtggcc

SEQ ID NO: 8186463 - DNA, 22 bp, Homo sapiens
cgctggcattagggcagtggcc

SEQ ID NO: 8186464 - DNA, 22 bp, Homo sapiens
cgctggcttcctcctggggcca

SEQ ID NO: 8186465 - DNA, 22 bp, Homo sapiens
cgctgcgaggcgcccttgttgc

SEQ ID NO: 8186466 - DNA, 22 bp, Homo sapiens
cgctgcgaggcgcccttgttgc

SEQ ID NO: 8186467 - DNA, 22 bp, Homo sapiens
cgctggcattagggcagtggcc

SEQ ID NO: 8186468 - DNA, 22 bp, Homo sapiens
cgctggcagggctgatctgaag

SEQ ID NO: 8186469 - DNA, 22 bp, Homo sapiens
cgctgcagatgggagctggttg

SEQ ID NO: 8186470 - DNA, 22 bp, Homo sapiens
cgctgcagctggctgcagggaa

SEQ ID NO: 8186471 - DNA, 22 bp, Homo sapiens
cgctgcagaagcgtgttcagga

SEQ ID NO: 8186472 - DNA, 22 bp, Homo sapiens
cgctgcagaagcgtgttcagga

SEQ ID NO: 8186473 - DNA, 22 bp, Homo sapiens
cgctgccaggtcaccaggggta

SEQ ID NO: 8186474 - DNA, 22 bp, Homo sapiens
cgctgccaggtcaccaggggta

SEQ ID NO: 8186475 - DNA, 22 bp, Homo sapiens
cgctgccaggatcccctgccgg

SEQ ID NO: 8186476 - DNA, 22 bp, Homo sapiens
cgctgccaggatcccctgccgg

SEQ ID NO: 8186477 - DNA, 22 bp, Homo sapiens
cgctgcctctctggggccctgg

SEQ ID NO: 8186478 - DNA, 22 bp, Homo sapiens
cgctgcctccaggtgcagcagg

SEQ ID NO: 8186479 - DNA, 22 bp, Homo sapiens
cgtgggagtggtgggtgctcag

SEQ ID NO: 8186480 - DNA, 22 bp, Homo sapiens
cgtgggccccagccactccctc

SEQ ID NO: 8186481 - DNA, 22 bp, Homo sapiens
cgtgggtcgggactccgcctcg

SEQ ID NO: 8186482 - DNA, 22 bp, Homo sapiens
cgtggtctcccacagaaagaag

SEQ ID NO: 8186483 - DNA, 22 bp, Homo sapiens
cgtggggcgggtggacacttgc

SEQ ID NO: 8186484 - DNA, 22 bp, Homo sapiens
cggggctgctcgtcctcctgtg

SEQ ID NO: 8186485 - DNA, 22 bp, Homo sapiens
cggggctggcacaggtgaccac

SEQ ID NO: 8186486 - DNA, 22 bp, Homo sapiens
cggggctggcacaggtgaccac

SEQ ID NO: 8186487 - DNA, 22 bp, Homo sapiens
cggggctgacagcaggtgtgct

SEQ ID NO: 8186488 - DNA, 22 bp, Homo sapiens
cggggctgacagcaggtgtgct

SEQ ID NO: 8186489 - DNA, 22 bp, Homo sapiens
cggggctgacagcaggtgtgct

SEQ ID NO: 8186490 - DNA, 22 bp, Homo sapiens
cggggctgaggcaacgcggaga

SEQ ID NO: 8186491 - DNA, 22 bp, Homo sapiens
cggggccctggggctgaaggtc

SEQ ID NO: 8186492 - DNA, 22 bp, Homo sapiens
cggggccctggggctgaaggtc

SEQ ID NO: 8186493 - DNA, 22 bp, Homo sapiens
cggggaggcttcggattaaagc

SEQ ID NO: 8186494 - DNA, 22 bp, Homo sapiens
cggcaggtgtgctcactctgcc

SEQ ID NO: 8186495 - DNA, 22 bp, Homo sapiens
cgggaggaaaggcgaggctctg

SEQ ID NO: 8186496 - DNA, 22 bp, Homo sapiens
cgggcaaggcgagactaggccc

SEQ ID NO: 8186497 - DNA, 22 bp, Homo sapiens
cgggcaaggcgagactaggccc

SEQ ID NO: 8186498 - DNA, 22 bp, Homo sapiens
cgggcaaggcgagactaggccc

SEQ ID NO: 8186499 - DNA, 22 bp, Homo sapiens
cggggaaaatgaagcaggtgga

SEQ ID NO: 8186500 - DNA, 22 bp, Homo sapiens
cgggcttcctccagggaagtgc

SEQ ID NO: 8186501 - DNA, 22 bp, Homo sapiens
cgggctggctgcagctgctgga

SEQ ID NO: 8186502 - DNA, 22 bp, Homo sapiens
cgggctggctgcagctgctgga

SEQ ID NO: 8186503 - DNA, 22 bp, Homo sapiens
cggggccctggggctgaaggtc

SEQ ID NO: 8186504 - DNA, 22 bp, Homo sapiens
cggggcaggagtccctgtagag

SEQ ID NO: 8186505 - DNA, 22 bp, Homo sapiens
cggggcaggagtccctgtagag

SEQ ID NO: 8186506 - DNA, 22 bp, Homo sapiens
cggggcaggagtccctgtagag

SEQ ID NO: 8186507 - DNA, 22 bp, Homo sapiens
cggggccctggggctgaaggtc

SEQ ID NO: 8186508 - DNA, 22 bp, Homo sapiens
cggggccctggggctgaaggtc

SEQ ID NO: 8186509 - DNA, 22 bp, Homo sapiens
cggggccctggggctgaaggtc

SEQ ID NO: 8186510 - DNA, 22 bp, Homo sapiens
cggggagggcagaggctccctc

SEQ ID NO: 8186511 - DNA, 22 bp, Homo sapiens
cggggagggcagaggctccctc

SEQ ID NO: 8186512 - DNA, 22 bp, Homo sapiens
cggggcagaaagttgtcttttg

SEQ ID NO: 8186513 - DNA, 22 bp, Homo sapiens
cggggcagagggtcttctccag

SEQ ID NO: 8186514 - DNA, 22 bp, Homo sapiens
cggggcaggagtccctgtagag

SEQ ID NO: 8186515 - DNA, 22 bp, Homo sapiens
cggcagagccctgagtcagcct

SEQ ID NO: 8186516 - DNA, 22 bp, Homo sapiens
cggcagagccctgagtcagcct

SEQ ID NO: 8186517 - DNA, 22 bp, Homo sapiens
cggcagagcggcgagcccctcc

SEQ ID NO: 8186518 - DNA, 22 bp, Homo sapiens
cggcagagcggcgagcccctcc

SEQ ID NO: 8186519 - DNA, 22 bp, Homo sapiens
cggcagagcttcctgctcagcg

SEQ ID NO: 8186520 - DNA, 22 bp, Homo sapiens
cggcagagacggcgctttgaac

SEQ ID NO: 8186521 - DNA, 22 bp, Homo sapiens
cggcagagacggcgctttgaac

SEQ ID NO: 8186522 - DNA, 22 bp, Homo sapiens
cggagttgtaagggatgtggct

SEQ ID NO: 8186523 - DNA, 18 bp, Homo sapiens
cggatcatgcgctgaggc

SEQ ID NO: 8186524 - DNA, 22 bp, Homo sapiens
cggatgtctttgagggagagtc

SEQ ID NO: 8186525 - DNA, 22 bp, Homo sapiens
cggcacagccgggcaaggctgg

SEQ ID NO: 8186526 - DNA, 22 bp, Homo sapiens
cggatcatgtgacctttgagtg

SEQ ID NO: 8186527 - DNA, 22 bp, Homo sapiens
cggcagcaaaggaagccaggtc

SEQ ID NO: 8186528 - DNA, 22 bp, Homo sapiens
cggcagagtgtgtgcgtgcatg

SEQ ID NO: 8186529 - DNA, 22 bp, Homo sapiens
cggcagagtgtgtgcgtgcatg

SEQ ID NO: 8186530 - DNA, 18 bp, Homo sapiens
cggcagagtgcttctagc

SEQ ID NO: 8186531 - DNA, 22 bp, Homo sapiens
cggcagagcttcctgctcagcg

SEQ ID NO: 8186532 - DNA, 18 bp, Homo sapiens
cggcagagtgcttctagc

SEQ ID NO: 8186533 - DNA, 22 bp, Homo sapiens
cggcagggttggttttctctga

SEQ ID NO: 8186534 - DNA, 22 bp, Homo sapiens
cggcagggctccatgcatttct

SEQ ID NO: 8186535 - DNA, 22 bp, Homo sapiens
cggcagcggttggaggttgtag

SEQ ID NO: 8186536 - DNA, 23 bp, Homo sapiens
cggcagcgtccggctacgggagg

SEQ ID NO: 8186537 - DNA, 22 bp, Homo sapiens
cggcaggacctcatttccttct

SEQ ID NO: 8186538 - DNA, 22 bp, Homo sapiens
cggcaggacctcatttccttct

SEQ ID NO: 8186539 - DNA, 22 bp, Homo sapiens
cggagtggggactggggtaatc

SEQ ID NO: 8186540 - DNA, 22 bp, Homo sapiens
cggagtggagaaggtcacagaa

SEQ ID NO: 8186541 - DNA, 22 bp, Homo sapiens
cggagtgcctgtcatgcaggtt

SEQ ID NO: 8186542 - DNA, 22 bp, Homo sapiens
cggagtcttgctatgttgccca

SEQ ID NO: 8186543 - DNA, 22 bp, Homo sapiens
cggagtcttgctatgttgccca

SEQ ID NO: 8186544 - DNA, 22 bp, Homo sapiens
cggagtcttgctatgttgccca

SEQ ID NO: 8186545 - DNA, 22 bp, Homo sapiens
cggaggttgaggctgcagtgag

SEQ ID NO: 8186546 - DNA, 22 bp, Homo sapiens
cggaggttgaggctgcagtgag

SEQ ID NO: 8186547 - DNA, 22 bp, Homo sapiens
ttcaaattaccacatttgctta

SEQ ID NO: 8186548 - DNA, 22 bp, Homo sapiens
ttcaaatggttagactgttagc

SEQ ID NO: 8186549 - DNA, 20 bp, Homo sapiens
cggactttcttctcagggca

SEQ ID NO: 8186550 - DNA, 22 bp, Homo sapiens
ttcaaattaccacatttgctta

SEQ ID NO: 8186551 - DNA, 22 bp, Homo sapiens
cggagaggacctgcaactcgct

SEQ ID NO: 8186552 - DNA, 22 bp, Homo sapiens
ttcaaatacattctttgccact

SEQ ID NO: 8186553 - DNA, 22 bp, Homo sapiens
ttcaaatacattctttgccact

SEQ ID NO: 8186554 - DNA, 22 bp, Homo sapiens
ttcaaatacattctttgccact

SEQ ID NO: 8186555 - DNA, 22 bp, Homo sapiens
ttcaaagtgtgacctgacaagc

SEQ ID NO: 8186556 - DNA, 22 bp, Homo sapiens
ttcaaagtgcttttaaccttta

SEQ ID NO: 8186557 - DNA, 22 bp, Homo sapiens
tttcttggatgtgaaactaggg

SEQ ID NO: 8186558 - DNA, 22 bp, Homo sapiens
tttgaaaaaggcctttggtatg

SEQ ID NO: 8186559 - DNA, 22 bp, Homo sapiens
tttgaaaagaaccatcgcctta

SEQ ID NO: 8186560 - DNA, 22 bp, Homo sapiens
tttgaaaacttaatttggtcgt

SEQ ID NO: 8186561 - DNA, 22 bp, Homo sapiens
tttgaaaacttaatttggtcgt

SEQ ID NO: 8186562 - DNA, 22 bp, Homo sapiens
tttgaaaacttaatttggtcgt

SEQ ID NO: 8186563 - DNA, 22 bp, Homo sapiens
tttgaaaaaggcctttggtatg

SEQ ID NO: 8186564 - DNA, 21 bp, Homo sapiens
ctctgaatcctgcttctcagt

SEQ ID NO: 8186565 - DNA, 22 bp, Homo sapiens
ctctgacaagacagaccataac

SEQ ID NO: 8186566 - DNA, 22 bp, Homo sapiens
ctctgacagccacatagaggct

SEQ ID NO: 8186567 - DNA, 22 bp, Homo sapiens
ctctgaagccccaaatagtccg

SEQ ID NO: 8186568 - DNA, 22 bp, Homo sapiens
ctctgaaggtttctgttactgt

SEQ ID NO: 8186569 - DNA, 22 bp, Homo sapiens
tttgaaaatttaagtgctacac

SEQ ID NO: 8186570 - DNA, 22 bp, Homo sapiens
tttgaaaatttaagtgctacac

SEQ ID NO: 8186571 - DNA, 22 bp, Homo sapiens
tttgaaaattagacacaggcta

SEQ ID NO: 8186572 - DNA, 22 bp, Homo sapiens
tttgaaaagaaccatcgcctta

SEQ ID NO: 8186573 - DNA, 22 bp, Homo sapiens
tttgaaaatttaagtgctacac

SEQ ID NO: 8186574 - DNA, 22 bp, Homo sapiens
tttgaaacccgtcactttgagt

SEQ ID NO: 8186575 - DNA, 22 bp, Homo sapiens
tttgaaacctagttatatgact

SEQ ID NO: 8186576 - DNA, 22 bp, Homo sapiens
tttgaaagacagaatatttttg

SEQ ID NO: 8186577 - DNA, 22 bp, Homo sapiens
tttgaaagaatttatgtacttt

SEQ ID NO: 8186578 - DNA, 22 bp, Homo sapiens
tttgaaagaatttatgtacttt

SEQ ID NO: 8186579 - DNA, 22 bp, Homo sapiens
tttgaaactctgaacatgtttc

SEQ ID NO: 8186580 - DNA, 22 bp, Homo sapiens
ctctgcagaatttgagctgctc

SEQ ID NO: 8186581 - DNA, 22 bp, Homo sapiens
ctctgcagaatttgagctgctc

SEQ ID NO: 8186582 - DNA, 22 bp, Homo sapiens
ctctgcaccttgtaggaggcaa

SEQ ID NO: 8186583 - DNA, 22 bp, Homo sapiens
ctctgcagaatttgagctgctc

SEQ ID NO: 8186584 - DNA, 22 bp, Homo sapiens
ctctgcagaggcccaaggctga

SEQ ID NO: 8186585 - DNA, 22 bp, Homo sapiens
ctctgcagaggcccaaggctga

SEQ ID NO: 8186586 - DNA, 22 bp, Homo sapiens
ctctgcagaggcccaaggctga

SEQ ID NO: 8186587 - DNA, 22 bp, Homo sapiens
ctctgcagagcctccagcccag

SEQ ID NO: 8186588 - DNA, 22 bp, Homo sapiens
tttgacattggcttattctgtt

SEQ ID NO: 8186589 - DNA, 22 bp, Homo sapiens
tttgaatagaggcccctcagaa

SEQ ID NO: 8186590 - DNA, 22 bp, Homo sapiens
tttgaatagcataggattacat

SEQ ID NO: 8186591 - DNA, 21 bp, Homo sapiens
tttgaatagaaatagtgctta

SEQ ID NO: 8186592 - DNA, 22 bp, Homo sapiens
tttgaccctgttattctccctg

SEQ ID NO: 8186593 - DNA, 19 bp, Homo sapiens
tttgaaagagttttattgg

SEQ ID NO: 8186594 - DNA, 22 bp, Homo sapiens
ctctgaggttcctttgccctcg

SEQ ID NO: 8186595 - DNA, 22 bp, Homo sapiens
ctctgaggtctaggaccatggc

SEQ ID NO: 8186596 - DNA, 22 bp, Homo sapiens
ctctgcaacttctagcagtgtc

SEQ ID NO: 8186597 - DNA, 22 bp, Homo sapiens
ctctgagttgaggcaggagagt

SEQ ID NO: 8186598 - DNA, 22 bp, Homo sapiens
ctctgaggtttcctcacaagct

SEQ ID NO: 8186599 - DNA, 22 bp, Homo sapiens
ctctgcacccccggctcctcgt

SEQ ID NO: 8186600 - DNA, 22 bp, Homo sapiens
ctctgcacccccggctcctcgt

SEQ ID NO: 8186601 - DNA, 22 bp, Homo sapiens
ctctgcacctacacaacaggaa

SEQ ID NO: 8186602 - DNA, 22 bp, Homo sapiens
ctctgcacccccggctcctcgt

SEQ ID NO: 8186603 - DNA, 22 bp, Homo sapiens
ctctgcaatctgagcacttgta

SEQ ID NO: 8186604 - DNA, 22 bp, Homo sapiens
tttgactcctgtgtttctggaa

SEQ ID NO: 8186605 - DNA, 22 bp, Homo sapiens
tttgagaaaaccagaaagatct

SEQ ID NO: 8186606 - DNA, 22 bp, Homo sapiens
tttgagaaaaccagaaagatct

SEQ ID NO: 8186607 - DNA, 22 bp, Homo sapiens
tttgagaaacagacgaaagaca

SEQ ID NO: 8186608 - DNA, 22 bp, Homo sapiens
tttgagaaacagacgaaagaca

SEQ ID NO: 8186609 - DNA, 22 bp, Homo sapiens
tttgagaaccctgtattttaag

SEQ ID NO: 8186610 - DNA, 22 bp, Homo sapiens
tttgagaaaggggatttaattc

SEQ ID NO: 8186611 - DNA, 22 bp, Homo sapiens
tttgagaaactgattattatgg

SEQ ID NO: 8186612 - DNA, 22 bp, Homo sapiens
tttgcaaaattattcccagcat

SEQ ID NO: 8186613 - DNA, 22 bp, Homo sapiens
tttgcaaaatgtcttgtgttag

SEQ ID NO: 8186614 - DNA, 22 bp, Homo sapiens
tttgagaagagtttgaggtatt

SEQ ID NO: 8186615 - DNA, 22 bp, Homo sapiens
ctctggcagagctgtagacttc

SEQ ID NO: 8186616 - DNA, 22 bp, Homo sapiens
ctctggcacactccttccaggt

SEQ ID NO: 8186617 - DNA, 22 bp, Homo sapiens
ctctggcacactccttccaggt

SEQ ID NO: 8186618 - DNA, 22 bp, Homo sapiens
ctctggccagagcctgcgggaa

SEQ ID NO: 8186619 - DNA, 22 bp, Homo sapiens
ctctggcagagctgtagacttc

SEQ ID NO: 8186620 - DNA, 22 bp, Homo sapiens
ctctggccgagcatgggggtta

SEQ ID NO: 8186621 - DNA, 22 bp, Homo sapiens
ctctggccgcagctcagctctg

SEQ ID NO: 8186622 - DNA, 22 bp, Homo sapiens
ctctggcctggggcctgctccc

SEQ ID NO: 8186623 - DNA, 22 bp, Homo sapiens
ctctggcctggggcctgctccc

SEQ ID NO: 8186624 - DNA, 22 bp, Homo sapiens
ctctggcctggggcctgctccc

SEQ ID NO: 8186625 - DNA, 22 bp, Homo sapiens
ctctggcctggggcctgctccc

SEQ ID NO: 8186626 - DNA, 22 bp, Homo sapiens
ctctggcctgcagatccatgct

SEQ ID NO: 8186627 - DNA, 22 bp, Homo sapiens
ctctggcctgcagatccatgct

SEQ ID NO: 8186628 - DNA, 22 bp, Homo sapiens
ctctggcctgcttcctcaggta

SEQ ID NO: 8186629 - DNA, 22 bp, Homo sapiens
ctctggagtgggtggccgggag

SEQ ID NO: 8186630 - DNA, 20 bp, Homo sapiens
ctctggcaaaggatgcctat

SEQ ID NO: 8186631 - DNA, 22 bp, Homo sapiens
ctctggcaattgctgctgactc

SEQ ID NO: 8186632 - DNA, 22 bp, Homo sapiens
ctctggcacactccttccaggt

SEQ ID NO: 8186633 - DNA, 22 bp, Homo sapiens
tttgcaaagtgactattatatg

SEQ ID NO: 8186634 - DNA, 22 bp, Homo sapiens
ctctggagtgcagcctggtggc

SEQ ID NO: 8186635 - DNA, 18 bp, Homo sapiens
tttgcaaaggaagtatgg

SEQ ID NO: 8186636 - DNA, 22 bp, Homo sapiens
tttggaatgacagatatcaata

SEQ ID NO: 8186637 - DNA, 22 bp, Homo sapiens
tttggaatattaaaatgtctca

SEQ ID NO: 8186638 - DNA, 22 bp, Homo sapiens
tttggaagtcctgaaatagagg

SEQ ID NO: 8186639 - DNA, 22 bp, Homo sapiens
ctctggctcccgcagcccccat

SEQ ID NO: 8186640 - DNA, 22 bp, Homo sapiens
tttggaatggtgctgtacagat

SEQ ID NO: 8186641 - DNA, 22 bp, Homo sapiens
tttggaatggtaccttcagttg

SEQ ID NO: 8186642 - DNA, 22 bp, Homo sapiens
tttggaatggaatagagattgc

SEQ ID NO: 8186643 - DNA, 22 bp, Homo sapiens
tttggaatgtagtttaatcatc

SEQ ID NO: 8186644 - DNA, 22 bp, Homo sapiens
tttggaatgtatttgaccaaag

SEQ ID NO: 8186645 - DNA, 22 bp, Homo sapiens
ctctgggtcccacgtcattgct

SEQ ID NO: 8186646 - DNA, 19 bp, Homo sapiens
ctctgggctgcatcttggt

SEQ ID NO: 8186647 - DNA, 19 bp, Homo sapiens
ctctgggctgcatcttggt

SEQ ID NO: 8186648 - DNA, 23 bp, Homo sapiens
ctctgggtccgatgtcctgacag

SEQ ID NO: 8186649 - DNA, 23 bp, Homo sapiens
ctctgggtccgatgtcctgacag

SEQ ID NO: 8186650 - DNA, 22 bp, Homo sapiens
tttggaattctgcagctcatgt

SEQ ID NO: 8186651 - DNA, 22 bp, Homo sapiens
tttggaattggaaagtgctgtg

SEQ ID NO: 8186652 - DNA, 22 bp, Homo sapiens
ctctgggctgaatggctgaacc

SEQ ID NO: 8186653 - DNA, 22 bp, Homo sapiens
tttgttcataatggcaaagaga

SEQ ID NO: 8186654 - DNA, 23 bp, Homo sapiens
tttgttcatcattagagtctagc

SEQ ID NO: 8186655 - DNA, 22 bp, Homo sapiens
tttgttcatgaaaacctagatc

SEQ ID NO: 8186656 - DNA, 21 bp, Homo sapiens
tttgttcatagctcactcttt

SEQ ID NO: 8186657 - DNA, 21 bp, Homo sapiens
tttgttcatagctcactcttt

SEQ ID NO: 8186658 - DNA, 23 bp, Homo sapiens
tttgttcatcattagagtctagc

SEQ ID NO: 8186659 - DNA, 22 bp, Homo sapiens
tttgttcatgcctatattctca

SEQ ID NO: 8186660 - DNA, 22 bp, Homo sapiens
tttgttcattaaaagtgctgta

SEQ ID NO: 8186661 - DNA, 22 bp, Homo sapiens
tttgttcattagcattggcctt

SEQ ID NO: 8186662 - DNA, 22 bp, Homo sapiens
tttgttcattagtacagttgta

SEQ ID NO: 8186663 - DNA, 22 bp, Homo sapiens
ctctgggtgtgacagcacctgg

SEQ ID NO: 8186664 - DNA, 22 bp, Homo sapiens
ctctgggtgttaatgtcagtgt

SEQ ID NO: 8186665 - DNA, 22 bp, Homo sapiens
tttgttcagctctcattgatta

SEQ ID NO: 8186666 - DNA, 22 bp, Homo sapiens
tttgttcagctctcattgatta

SEQ ID NO: 8186667 - DNA, 22 bp, Homo sapiens
tttgttcagctctcattgatta

SEQ ID NO: 8186668 - DNA, 21 bp, Homo sapiens
tttgttcaggcaagttacagt

SEQ ID NO: 8186669 - DNA, 21 bp, Homo sapiens
tttgttcaggggcaaagttaa

SEQ ID NO: 8186670 - DNA, 21 bp, Homo sapiens
tttgttcaggcaagttacagt

SEQ ID NO: 8186671 - DNA, 21 bp, Homo sapiens
tttgttcaggcaagttacagt

SEQ ID NO: 8186672 - DNA, 22 bp, Homo sapiens
ctctgggtgcagcgctgaccgg

SEQ ID NO: 8186673 - DNA, 22 bp, Homo sapiens
ctctgggtgagacagacctggt

SEQ ID NO: 8186674 - DNA, 17 bp, Homo sapiens
ctctgggtgcctgtgtg

SEQ ID NO: 8186675 - DNA, 22 bp, Homo sapiens
ctctgggtgcagcgctgaccgg

SEQ ID NO: 8186676 - DNA, 22 bp, Homo sapiens
ctctgggtgggcagcagatgga

SEQ ID NO: 8186677 - DNA, 22 bp, Homo sapiens
ctctgggtgggcagcagatgga

SEQ ID NO: 8186678 - DNA, 22 bp, Homo sapiens
ctctgggtgtcttaggagctca

SEQ ID NO: 8186679 - DNA, 22 bp, Homo sapiens
ctctgggtggtctcactgagtg

SEQ ID NO: 8186680 - DNA, 22 bp, Homo sapiens
ctctgggtggtctcactgagtg

SEQ ID NO: 8186681 - DNA, 22 bp, Homo sapiens
ctctgggtgtcttaggagctca

SEQ ID NO: 8186682 - DNA, 22 bp, Homo sapiens
ctctgggtgtgacagcacctgg

SEQ ID NO: 8186683 - DNA, 22 bp, Homo sapiens
ctctgggtctataatgcagctg

SEQ ID NO: 8186684 - DNA, 20 bp, Homo sapiens
ctctgggtcgagacagactt

SEQ ID NO: 8186685 - DNA, 20 bp, Homo sapiens
ctctgggtcgagacagactt

SEQ ID NO: 8186686 - DNA, 20 bp, Homo sapiens
ctctgggtcgagacagactt

SEQ ID NO: 8186687 - DNA, 22 bp, Homo sapiens
ctctgggtctacctgtggccag

SEQ ID NO: 8186688 - DNA, 22 bp, Homo sapiens
ctctgggtctataatgcagctg

SEQ ID NO: 8186689 - DNA, 22 bp, Homo sapiens
ctctgggtctccctgaggctaa

SEQ ID NO: 8186690 - DNA, 17 bp, Homo sapiens
ctctgggtctcctgctt

SEQ ID NO: 8186691 - DNA, 22 bp, Homo sapiens
ctctggtttatttcttggaaag

SEQ ID NO: 8186692 - DNA, 22 bp, Homo sapiens
ctctggtttcgcaggaaataga

SEQ ID NO: 8186693 - DNA, 22 bp, Homo sapiens
ctctggttgagtgagaaccaag

SEQ ID NO: 8186694 - DNA, 22 bp, Homo sapiens
ctctggttgcagctgaagttcc

SEQ ID NO: 8186695 - DNA, 22 bp, Homo sapiens
tttgttctagatcgtgtttgtg

SEQ ID NO: 8186696 - DNA, 22 bp, Homo sapiens
tttgttctaacttctgcagaca

SEQ ID NO: 8186697 - DNA, 22 bp, Homo sapiens
tttgttcattttgagctcatca

SEQ ID NO: 8186698 - DNA, 22 bp, Homo sapiens
tttgttcattttgagctcatca

SEQ ID NO: 8186699 - DNA, 22 bp, Homo sapiens
tttgttcattttgagctcatca

SEQ ID NO: 8186700 - DNA, 17 bp, Homo sapiens
tttgttcattgaagaga

SEQ ID NO: 8186701 - DNA, 22 bp, Homo sapiens
tttgttcattagtacagttgta

SEQ ID NO: 8186702 - DNA, 22 bp, Homo sapiens
ctctgtgccctactgctcagct

SEQ ID NO: 8186703 - DNA, 22 bp, Homo sapiens
ctctgtgccctactgctcagct

SEQ ID NO: 8186704 - DNA, 22 bp, Homo sapiens
ctctgtgccagtctgcactcgg

SEQ ID NO: 8186705 - DNA, 22 bp, Homo sapiens
ctctgtgctcccatgctagtaa

SEQ ID NO: 8186706 - DNA, 22 bp, Homo sapiens
ctctgtgcgggccatggtcagg

SEQ ID NO: 8186707 - DNA, 22 bp, Homo sapiens
ctctgtgcttatgctccatggg

SEQ ID NO: 8186708 - DNA, 22 bp, Homo sapiens
ctctgtgcttatgctccatggg

SEQ ID NO: 8186709 - DNA, 22 bp, Homo sapiens
ctctgtgcttatgctccatggg

SEQ ID NO: 8186710 - DNA, 22 bp, Homo sapiens
ctctgtggaagaagaaagaagg

SEQ ID NO: 8186711 - DNA, 22 bp, Homo sapiens
ctctgtgggccagagaggcccc

SEQ ID NO: 8186712 - DNA, 22 bp, Homo sapiens
ctctgtgggccagagaggcccc

SEQ ID NO: 8186713 - DNA, 22 bp, Homo sapiens
ctctgtgggccagagaggcccc

SEQ ID NO: 8186714 - DNA, 22 bp, Homo sapiens
ctctgtgggaggaggagtaggc

SEQ ID NO: 8186715 - DNA, 22 bp, Homo sapiens
ctctgtgggaagctgggtgtga

SEQ ID NO: 8186716 - DNA, 22 bp, Homo sapiens
ctctgtgggaagctgggtgtga

SEQ ID NO: 8186717 - DNA, 22 bp, Homo sapiens
ctctgtgggaagctgggtgtga

SEQ ID NO: 8186718 - DNA, 22 bp, Homo sapiens
ctctgtgggaagctgggtgtga

SEQ ID NO: 8186719 - DNA, 22 bp, Homo sapiens
ctctgtgggaggaggagtaggc

SEQ ID NO: 8186720 - DNA, 22 bp, Homo sapiens
ctctgtgggaggaggagtaggc

SEQ ID NO: 8186721 - DNA, 17 bp, Homo sapiens
ctctgtggaggtgttta

SEQ ID NO: 8186722 - DNA, 17 bp, Homo sapiens
ctctgtggaggtgttta

SEQ ID NO: 8186723 - DNA, 22 bp, Homo sapiens
ctctgtggctacacaaacctcc

SEQ ID NO: 8186724 - DNA, 17 bp, Homo sapiens
ctctgtggaggtgttta

SEQ ID NO: 8186725 - DNA, 22 bp, Homo sapiens
ctctgtggcttgcctttctgtc

SEQ ID NO: 8186726 - DNA, 22 bp, Homo sapiens
ctctgtggctacacaaacctcc

SEQ ID NO: 8186727 - DNA, 22 bp, Homo sapiens
ctctgtggcttgcctttctgtc

SEQ ID NO: 8186728 - DNA, 22 bp, Homo sapiens
ctctgtgggggagaggcagctg

SEQ ID NO: 8186729 - DNA, 22 bp, Homo sapiens
ctctgtgggggagaggcagctg

SEQ ID NO: 8186730 - DNA, 22 bp, Homo sapiens
ctctgtgggggagaggcagctg

SEQ ID NO: 8186731 - DNA, 22 bp, Homo sapiens
ctctgtgggcctgtgctttagt

SEQ ID NO: 8186732 - DNA, 22 bp, Homo sapiens
ctctgtgggccagagaggcccc

SEQ ID NO: 8186733 - DNA, 22 bp, Homo sapiens
ctctgtggtggagtgggtcacc

SEQ ID NO: 8186734 - DNA, 22 bp, Homo sapiens
ctctgtggtggagtgggtcacc

SEQ ID NO: 8186735 - DNA, 22 bp, Homo sapiens
ctctgtggtggagtgggtcacc

SEQ ID NO: 8186736 - DNA, 22 bp, Homo sapiens
ctctgtggtaaaatagcagtat

SEQ ID NO: 8186737 - DNA, 22 bp, Homo sapiens
ctctgtggtaaaatagcagtat

SEQ ID NO: 8186738 - DNA, 22 bp, Homo sapiens
ctctgtgggtatttatatgtat

SEQ ID NO: 8186739 - DNA, 22 bp, Homo sapiens
ctctgtgggtatttatatgtat

SEQ ID NO: 8186740 - DNA, 22 bp, Homo sapiens
ttttgctgcattgaagtcagat

SEQ ID NO: 8186741 - DNA, 22 bp, Homo sapiens
ttttgctgttatatgctattat

SEQ ID NO: 8186742 - DNA, 22 bp, Homo sapiens
ttttgcttaatctagattttgc

SEQ ID NO: 8186743 - DNA, 22 bp, Homo sapiens
ttttgcttaatctagattttgc

SEQ ID NO: 8186744 - DNA, 22 bp, Homo sapiens
ttttgcctaagaatctctctga

SEQ ID NO: 8186745 - DNA, 22 bp, Homo sapiens
ttttgcctgagagtgaaaataa

SEQ ID NO: 8186746 - DNA, 17 bp, Homo sapiens
ttttctctcttggattc

SEQ ID NO: 8186747 - DNA, 17 bp, Homo sapiens
ttttctctcttggattc

SEQ ID NO: 8186748 - DNA, 22 bp, Homo sapiens
ctctgtgtctgagttatggtct

SEQ ID NO: 8186749 - DNA, 22 bp, Homo sapiens
ctctgtgtgctggtggggtcct

SEQ ID NO: 8186750 - DNA, 22 bp, Homo sapiens
ctctgtgtatccaagttcaggt

SEQ ID NO: 8186751 - DNA, 22 bp, Homo sapiens
ctctgtggttagactatggctg

SEQ ID NO: 8186752 - DNA, 22 bp, Homo sapiens
ctctgtggttagactatggctg

SEQ ID NO: 8186753 - DNA, 22 bp, Homo sapiens
ctctgtggttagactatggctg

SEQ ID NO: 8186754 - DNA, 22 bp, Homo sapiens
ctctgtggttagactatggctg

SEQ ID NO: 8186755 - DNA, 22 bp, Homo sapiens
ctctgtgtggtatgattgtcat

SEQ ID NO: 8186756 - DNA, 22 bp, Homo sapiens
ctctgtgttccgggttgctgct

SEQ ID NO: 8186757 - DNA, 22 bp, Homo sapiens
ctctgtgttccgggttgctgct

SEQ ID NO: 8186758 - DNA, 22 bp, Homo sapiens
ctctgtgttcagcctagcagaa

SEQ ID NO: 8186759 - DNA, 22 bp, Homo sapiens
ctctgtgttcagcctagcagaa

SEQ ID NO: 8186760 - DNA, 22 bp, Homo sapiens
ctctgtgttcagcctagcagaa

SEQ ID NO: 8186761 - DNA, 23 bp, Homo sapiens
tttcatgttggcatgactgactt

SEQ ID NO: 8186762 - DNA, 22 bp, Homo sapiens
tttcatgttggatactgtttca

SEQ ID NO: 8186763 - DNA, 22 bp, Homo sapiens
tttcatgttggatactgtttca

SEQ ID NO: 8186764 - DNA, 22 bp, Homo sapiens
tttcatgttacatttaaaatgt

SEQ ID NO: 8186765 - DNA, 22 bp, Homo sapiens
tttcatgttagttggttcttgg

SEQ ID NO: 8186766 - DNA, 22 bp, Homo sapiens
tttcatgttacatttaaaatgt

SEQ ID NO: 8186767 - DNA, 22 bp, Homo sapiens
tttcattacgtgtttgacttgt

SEQ ID NO: 8186768 - DNA, 22 bp, Homo sapiens
tttcattacgtgtttgacttgt

SEQ ID NO: 8186769 - DNA, 22 bp, Homo sapiens
tttcattaaagtcaaatctggt

SEQ ID NO: 8186770 - DNA, 22 bp, Homo sapiens
tttcattaaagtcaaatctggt

SEQ ID NO: 8186771 - DNA, 22 bp, Homo sapiens
tttcattaaagtcaaatctggt

SEQ ID NO: 8186772 - DNA, 22 bp, Homo sapiens
tttcatgtttatggaaaatgag

SEQ ID NO: 8186773 - DNA, 18 bp, Homo sapiens
tttccaagaagagagctc

SEQ ID NO: 8186774 - DNA, 22 bp, Homo sapiens
tttccaagagcttatttctgaa

SEQ ID NO: 8186775 - DNA, 22 bp, Homo sapiens
tttccaagctgtcttggcccac

SEQ ID NO: 8186776 - DNA, 22 bp, Homo sapiens
tttccaataaagtgtcattgtt

SEQ ID NO: 8186777 - DNA, 22 bp, Homo sapiens
tttccaagtactgagctgtcaa

SEQ ID NO: 8186778 - DNA, 22 bp, Homo sapiens
tttcattatacagcttcataaa

SEQ ID NO: 8186779 - DNA, 18 bp, Homo sapiens
tttcattataaagcaggc

SEQ ID NO: 8186780 - DNA, 18 bp, Homo sapiens
tttcattataaagcaggc

SEQ ID NO: 8186781 - DNA, 22 bp, Homo sapiens
tttcattacgtgtttgacttgt

SEQ ID NO: 8186782 - DNA, 22 bp, Homo sapiens
tttcattagtatgacagcacgc

SEQ ID NO: 8186783 - DNA, 22 bp, Homo sapiens
tttcattataaaaagttggctt

SEQ ID NO: 8186784 - DNA, 22 bp, Homo sapiens
tttcattataaaaagttggctt

SEQ ID NO: 8186785 - DNA, 22 bp, Homo sapiens
tttcattagtatgacagcacgc

SEQ ID NO: 8186786 - DNA, 22 bp, Homo sapiens
tttccacaatttgagcagcaga

SEQ ID NO: 8186787 - DNA, 22 bp, Homo sapiens
tttccacactgcagccagcaaa

SEQ ID NO: 8186788 - DNA, 22 bp, Homo sapiens
tttccacactcactgcactcat

SEQ ID NO: 8186789 - DNA, 22 bp, Homo sapiens
tttccaatttttaagtggatga

SEQ ID NO: 8186790 - DNA, 22 bp, Homo sapiens
tttccactcctattgcatctca

SEQ ID NO: 8186791 - DNA, 22 bp, Homo sapiens
tttccactgggcacggggccag

SEQ ID NO: 8186792 - DNA, 22 bp, Homo sapiens
tttccactctggccaccatctt

SEQ ID NO: 8186793 - DNA, 22 bp, Homo sapiens
tttctacagctggtgcaacttt

SEQ ID NO: 8186794 - DNA, 22 bp, Homo sapiens
tttctacagaagatacactgct

SEQ ID NO: 8186795 - DNA, 22 bp, Homo sapiens
tttctacagaagatacactgct

SEQ ID NO: 8186796 - DNA, 22 bp, Homo sapiens
tttctacagaagatacactgct

SEQ ID NO: 8186797 - DNA, 22 bp, Homo sapiens
tttctacagctggtgcaacttt

SEQ ID NO: 8186798 - DNA, 22 bp, Homo sapiens
tttctacagctggtgcaacttt

SEQ ID NO: 8186799 - DNA, 22 bp, Homo sapiens
tttctacaggttgatgggtttg

SEQ ID NO: 8186800 - DNA, 22 bp, Homo sapiens
tttctacagtactgatttcata

SEQ ID NO: 8186801 - DNA, 22 bp, Homo sapiens
tttctacaggttgatgggtttg

SEQ ID NO: 8186802 - DNA, 22 bp, Homo sapiens
tttctacacttcgtggtgtttt

SEQ ID NO: 8186803 - DNA, 22 bp, Homo sapiens
tttctacaatttttggcatgag

SEQ ID NO: 8186804 - DNA, 22 bp, Homo sapiens
tttctacaatttttggcatgag

SEQ ID NO: 8186805 - DNA, 22 bp, Homo sapiens
tttctacaacacttctgaatct

SEQ ID NO: 8186806 - DNA, 22 bp, Homo sapiens
tttctacagaagatacactgct

SEQ ID NO: 8186807 - DNA, 22 bp, Homo sapiens
tttctacacttcgtggtgtttt

SEQ ID NO: 8186808 - DNA, 22 bp, Homo sapiens
tttctacaacacttctgaatct

SEQ ID NO: 8186809 - DNA, 22 bp, Homo sapiens
tttctacaacacttctgaatct

SEQ ID NO: 8186810 - DNA, 22 bp, Homo sapiens
tttctacaacacttctgaatct

SEQ ID NO: 8186811 - DNA, 22 bp, Homo sapiens
tttctacatgtcaatccaaacc

SEQ ID NO: 8186812 - DNA, 22 bp, Homo sapiens
tttctacatgtcaatccaaacc

SEQ ID NO: 8186813 - DNA, 22 bp, Homo sapiens
tttctacagtactgatttcata

SEQ ID NO: 8186814 - DNA, 17 bp, Homo sapiens
tttctacagttggcagc

SEQ ID NO: 8186815 - DNA, 17 bp, Homo sapiens
tttctacagttggcagc

SEQ ID NO: 8186816 - DNA, 22 bp, Homo sapiens
tttctacatgtcaatccaaacc

SEQ ID NO: 8186817 - DNA, 22 bp, Homo sapiens
tttctattttaaaggcatatgg

SEQ ID NO: 8186818 - DNA, 22 bp, Homo sapiens
tttctattttaaaggcatatgg

SEQ ID NO: 8186819 - DNA, 22 bp, Homo sapiens
tttctacatgtcagtaactgat

SEQ ID NO: 8186820 - DNA, 22 bp, Homo sapiens
tttctacatgtcagtaactgat

SEQ ID NO: 8186821 - DNA, 22 bp, Homo sapiens
tttctacatgtcagtaactgat

SEQ ID NO: 8186822 - DNA, 22 bp, Homo sapiens
tttctacatgtcagtaactgat

SEQ ID NO: 8186823 - DNA, 23 bp, Homo sapiens
tttctcaaagagtggcagcttca

SEQ ID NO: 8186824 - DNA, 22 bp, Homo sapiens
tttctcaaaattcagtggtatc

SEQ ID NO: 8186825 - DNA, 22 bp, Homo sapiens
tttctcaaaagacagaagtgaa

SEQ ID NO: 8186826 - DNA, 22 bp, Homo sapiens
tttctcaaatactgttccagga

SEQ ID NO: 8186827 - DNA, 19 bp, Homo sapiens
ctctctggcggtgtctgcg

SEQ ID NO: 8186828 - DNA, 18 bp, Homo sapiens
ctctctggtctggatccc

SEQ ID NO: 8186829 - DNA, 18 bp, Homo sapiens
ctctctggtctggatccc

SEQ ID NO: 8186830 - DNA, 19 bp, Homo sapiens
ctctctggcggtgtctgcg

SEQ ID NO: 8186831 - DNA, 22 bp, Homo sapiens
tttctcaagtactgcacatgaa

SEQ ID NO: 8186832 - DNA, 22 bp, Homo sapiens
tttctcaaggtgtcatgtattt

SEQ ID NO: 8186833 - DNA, 22 bp, Homo sapiens
tttctcaactgtattatgcaga

SEQ ID NO: 8186834 - DNA, 22 bp, Homo sapiens
ctctgaaactcctgcaccttct

SEQ ID NO: 8186835 - DNA, 22 bp, Homo sapiens
ctctgaaactcctgcaccttct

SEQ ID NO: 8186836 - DNA, 22 bp, Homo sapiens
ctctgaaactccagccccaggt

SEQ ID NO: 8186837 - DNA, 22 bp, Homo sapiens
ctctgaaaatgtggtggggaaa

SEQ ID NO: 8186838 - DNA, 22 bp, Homo sapiens
ctctctttgatgtataaataat

SEQ ID NO: 8186839 - DNA, 18 bp, Homo sapiens
ctctctttccactctttg

SEQ ID NO: 8186840 - DNA, 22 bp, Homo sapiens
ctctctttctgaatgaggacta

SEQ ID NO: 8186841 - DNA, 18 bp, Homo sapiens
ctctctttccactctttg

SEQ ID NO: 8186842 - DNA, 18 bp, Homo sapiens
ctctctttccactctttg

SEQ ID NO: 8186843 - DNA, 22 bp, Homo sapiens
ctctgaaagttagagaaaatag

SEQ ID NO: 8186844 - DNA, 22 bp, Homo sapiens
ctctgaaattggccctcagcag

SEQ ID NO: 8186845 - DNA, 22 bp, Homo sapiens
ctctgaaagttagagaaaatag

SEQ ID NO: 8186846 - DNA, 22 bp, Homo sapiens
ctctgaaagcaaaactagagaa

SEQ ID NO: 8186847 - DNA, 22 bp, Homo sapiens
ctctgaaagcaaaactagagaa

SEQ ID NO: 8186848 - DNA, 22 bp, Homo sapiens
ctctgaaagcaaaactagagaa

SEQ ID NO: 8186849 - DNA, 22 bp, Homo sapiens
ctctgaaagagtttagtattat

SEQ ID NO: 8186850 - DNA, 22 bp, Homo sapiens
ctctgaaagagtttagtattat

SEQ ID NO: 8186851 - DNA, 22 bp, Homo sapiens
ctctgaaagagtttagtattat

SEQ ID NO: 8186852 - DNA, 22 bp, Homo sapiens
ctctgaaagagtttagtattat

SEQ ID NO: 8186853 - DNA, 18 bp, Homo sapiens
ctctgaaagacacaccag

SEQ ID NO: 8186854 - DNA, 22 bp, Homo sapiens
ctctgaaagacaagctctcatt

SEQ ID NO: 8186855 - DNA, 22 bp, Homo sapiens
ctctctgttatgctttcatgaa

SEQ ID NO: 8186856 - DNA, 22 bp, Homo sapiens
ctctctgttcattgagtcaaaa

SEQ ID NO: 8186857 - DNA, 22 bp, Homo sapiens
ctctcttcccgtgagtgttgca

SEQ ID NO: 8186858 - DNA, 22 bp, Homo sapiens
ctctcttcccgtgagtgttgca

SEQ ID NO: 8186859 - DNA, 22 bp, Homo sapiens
ctctcttcccgtgagtgttgca

SEQ ID NO: 8186860 - DNA, 22 bp, Homo sapiens
ctctctggtttcagcgaagggg

SEQ ID NO: 8186861 - DNA, 22 bp, Homo sapiens
ctctctggtttcagcgaagggg

SEQ ID NO: 8186862 - DNA, 22 bp, Homo sapiens
ctctctgtggtggctgtcccat

SEQ ID NO: 8186863 - DNA, 22 bp, Homo sapiens
ctctctgtggtggctgtcccat

SEQ ID NO: 8186864 - DNA, 22 bp, Homo sapiens
ctctctgtggtggctgtcccat

SEQ ID NO: 8186865 - DNA, 22 bp, Homo sapiens
ctctctgtggtggctgtcccat

SEQ ID NO: 8186866 - DNA, 22 bp, Homo sapiens
ctctctgtgctcacaagggcag

SEQ ID NO: 8186867 - DNA, 22 bp, Homo sapiens
tttattcatcatctgttcatat

SEQ ID NO: 8186868 - DNA, 22 bp, Homo sapiens
tttattcatcatctgttcatat

SEQ ID NO: 8186869 - DNA, 20 bp, Homo sapiens
tttattcagcctaccctctt

SEQ ID NO: 8186870 - DNA, 22 bp, Homo sapiens
tttattcagcagcagcagtggt

SEQ ID NO: 8186871 - DNA, 22 bp, Homo sapiens
tttattcagcagcagcagtggt

SEQ ID NO: 8186872 - DNA, 22 bp, Homo sapiens
tttattccaaagcttgcacttt

SEQ ID NO: 8186873 - DNA, 22 bp, Homo sapiens
tttattcattgtttcgtcgcag

SEQ ID NO: 8186874 - DNA, 22 bp, Homo sapiens
tttattcatcatctgttcatat

SEQ ID NO: 8186875 - DNA, 22 bp, Homo sapiens
tttattcatcatctgttcatat

SEQ ID NO: 8186876 - DNA, 22 bp, Homo sapiens
tttattcattgtttcgtcgcag

SEQ ID NO: 8186877 - DNA, 22 bp, Homo sapiens
tttcagaaattatattagatgc

SEQ ID NO: 8186878 - DNA, 22 bp, Homo sapiens
tttcagaaattatattagatgc

SEQ ID NO: 8186879 - DNA, 22 bp, Homo sapiens
tttcagaaccaagagagacatc

SEQ ID NO: 8186880 - DNA, 22 bp, Homo sapiens
tttcagaaccaagagagacatc

SEQ ID NO: 8186881 - DNA, 22 bp, Homo sapiens
tttcagaaccgctaaaataaat

SEQ ID NO: 8186882 - DNA, 22 bp, Homo sapiens
tttcagaaggggagaaaggtca

SEQ ID NO: 8186883 - DNA, 22 bp, Homo sapiens
tttcagaaggggagaaaggtca

SEQ ID NO: 8186884 - DNA, 22 bp, Homo sapiens
tttcagaagtcaactaggtaaa

SEQ ID NO: 8186885 - DNA, 22 bp, Homo sapiens
ctccttcccatgagtgtgggca

SEQ ID NO: 8186886 - DNA, 22 bp, Homo sapiens
ctccttcccatgagtgtgggca

SEQ ID NO: 8186887 - DNA, 22 bp, Homo sapiens
ctccttccaacaagagaaagag

SEQ ID NO: 8186888 - DNA, 22 bp, Homo sapiens
ctccttccctaccatcaatgtt

SEQ ID NO: 8186889 - DNA, 22 bp, Homo sapiens
ctccttcctgccccagtgataa

SEQ ID NO: 8186890 - DNA, 22 bp, Homo sapiens
tttcagaatagcaaagcaagct

SEQ ID NO: 8186891 - DNA, 22 bp, Homo sapiens
tttcagaatatcgattcagtga

SEQ ID NO: 8186892 - DNA, 22 bp, Homo sapiens
ctcctgtgttcaagcgattctc

SEQ ID NO: 8186893 - DNA, 23 bp, Homo sapiens
tttcagaagtggtcctaggaagc

SEQ ID NO: 8186894 - DNA, 23 bp, Homo sapiens
tttcagaagtggtcctaggaagc

SEQ ID NO: 8186895 - DNA, 23 bp, Homo sapiens
tttcagaagtggtcctaggaagc

SEQ ID NO: 8186896 - DNA, 22 bp, Homo sapiens
ctccttcatgtcatgtgtccgg

SEQ ID NO: 8186897 - DNA, 22 bp, Homo sapiens
ctccttcacgcaggctgccatg

SEQ ID NO: 8186898 - DNA, 22 bp, Homo sapiens
tttatgcagcctcagtatcaga

SEQ ID NO: 8186899 - DNA, 22 bp, Homo sapiens
tttatgcagcctcagtatcaga

SEQ ID NO: 8186900 - DNA, 22 bp, Homo sapiens
tttatgcagcctcagtatcaga

SEQ ID NO: 8186901 - DNA, 22 bp, Homo sapiens
tttatgcagcactttacatttg

SEQ ID NO: 8186902 - DNA, 21 bp, Homo sapiens
tttatgcagataatgctattt

SEQ ID NO: 8186903 - DNA, 23 bp, Homo sapiens
tttatgcagcatgtagaacatgg

SEQ ID NO: 8186904 - DNA, 23 bp, Homo sapiens
tttatgcagcatgtagaacatgg

SEQ ID NO: 8186905 - DNA, 22 bp, Homo sapiens
tttatgcacacttagacatggc

SEQ ID NO: 8186906 - DNA, 22 bp, Homo sapiens
tttatgcacacttagacatggc

SEQ ID NO: 8186907 - DNA, 22 bp, Homo sapiens
tttatgcacacttagacatggc

SEQ ID NO: 8186908 - DNA, 22 bp, Homo sapiens
tttatgattattttaaagcagc

SEQ ID NO: 8186909 - DNA, 22 bp, Homo sapiens
tttatgattattttaaagcagc

SEQ ID NO: 8186910 - DNA, 22 bp, Homo sapiens
tttatgattattttaaagcagc

SEQ ID NO: 8186911 - DNA, 22 bp, Homo sapiens
tttattcactggggtctgcccg

SEQ ID NO: 8186912 - DNA, 22 bp, Homo sapiens
tttattcactggggtctgcccg

SEQ ID NO: 8186913 - DNA, 22 bp, Homo sapiens
tttattcacttcagtgccaaag

SEQ ID NO: 8186914 - DNA, 22 bp, Homo sapiens
tttattcacttcagtgccaaag

SEQ ID NO: 8186915 - DNA, 22 bp, Homo sapiens
tttattcagcagcagcagtggt

SEQ ID NO: 8186916 - DNA, 22 bp, Homo sapiens
tttattcactcattcagccagt

SEQ ID NO: 8186917 - DNA, 19 bp, Homo sapiens
tttattcacctttaccttg

SEQ ID NO: 8186918 - DNA, 22 bp, Homo sapiens
tttattcactcattcagccagt

SEQ ID NO: 8186919 - DNA, 19 bp, Homo sapiens
tttattcacctttaccttg

SEQ ID NO: 8186920 - DNA, 22 bp, Homo sapiens
tttatgtaagtggaatgatgcc

SEQ ID NO: 8186921 - DNA, 22 bp, Homo sapiens
tttatgtaagtggaatgatgcc

SEQ ID NO: 8186922 - DNA, 22 bp, Homo sapiens
tttatgtaagtggaatgatgcc

SEQ ID NO: 8186923 - DNA, 22 bp, Homo sapiens
tttatgtaagtggaatgatgcc

SEQ ID NO: 8186924 - DNA, 22 bp, Homo sapiens
tttatgtaagtggaatgatgcc

SEQ ID NO: 8186925 - DNA, 22 bp, Homo sapiens
ctccaggcccacgtcgaggagg

SEQ ID NO: 8186926 - DNA, 22 bp, Homo sapiens
ctccaggccatggctgcggagg

SEQ ID NO: 8186927 - DNA, 22 bp, Homo sapiens
ctccaggcccacggccgcggcc

SEQ ID NO: 8186928 - DNA, 22 bp, Homo sapiens
ctccaggccatggctgcggagg

SEQ ID NO: 8186929 - DNA, 22 bp, Homo sapiens
ctccaggccatggctgcggagg

SEQ ID NO: 8186930 - DNA, 22 bp, Homo sapiens
ctccaggccagggaagtggaca

SEQ ID NO: 8186931 - DNA, 22 bp, Homo sapiens
ctccaggccagggaagtggaca

SEQ ID NO: 8186932 - DNA, 22 bp, Homo sapiens
tttatgattaatccaattctgt

SEQ ID NO: 8186933 - DNA, 22 bp, Homo sapiens
tttatgattattttaaagcagc

SEQ ID NO: 8186934 - DNA, 22 bp, Homo sapiens
tttatgattattttaaagcagc

SEQ ID NO: 8186935 - DNA, 22 bp, Homo sapiens
ctccaggcccctggccttctgc

SEQ ID NO: 8186936 - DNA, 23 bp, Homo sapiens
tttatattcctaatgtcttgagc

SEQ ID NO: 8186937 - DNA, 23 bp, Homo sapiens
tttatattcctaatgtcttgagc

SEQ ID NO: 8186938 - DNA, 22 bp, Homo sapiens
ctccaggagggcttcctgtgat

SEQ ID NO: 8186939 - DNA, 22 bp, Homo sapiens
ctccaggagggggatggctgta

SEQ ID NO: 8186940 - DNA, 22 bp, Homo sapiens
ctccaggagggggatggctgta

SEQ ID NO: 8186941 - DNA, 22 bp, Homo sapiens
ctccaggagtggcctggacacc

SEQ ID NO: 8186942 - DNA, 22 bp, Homo sapiens
ctccaggagtggcctggacacc

SEQ ID NO: 8186943 - DNA, 19 bp, Homo sapiens
ctccaggatggctgggcga

SEQ ID NO: 8186944 - DNA, 19 bp, Homo sapiens
ctccaggatggctgggcga

SEQ ID NO: 8186945 - DNA, 22 bp, Homo sapiens
ctccaggccaagattaagtaat

SEQ ID NO: 8186946 - DNA, 22 bp, Homo sapiens
ctccaggccaagattaagtaat

SEQ ID NO: 8186947 - DNA, 22 bp, Homo sapiens
ctccaggatgttagacgtccag

SEQ ID NO: 8186948 - DNA, 19 bp, Homo sapiens
ctccaggatggctgggcga

SEQ ID NO: 8186949 - DNA, 22 bp, Homo sapiens
ttttgcttgagtgcacaaaatg

SEQ ID NO: 8186950 - DNA, 22 bp, Homo sapiens
ttttgcttgagtgcacaaaatg

SEQ ID NO: 8186951 - DNA, 22 bp, Homo sapiens
ttttgcttgagtgcacaaaatg

SEQ ID NO: 8186952 - DNA, 19 bp, Homo sapiens
ttttggaaatgtgaacagc

SEQ ID NO: 8186953 - DNA, 22 bp, Homo sapiens
ttttgctttaagatggagagga

SEQ ID NO: 8186954 - DNA, 20 bp, Homo sapiens
ctcttccggaggggcgctcc

SEQ ID NO: 8186955 - DNA, 22 bp, Homo sapiens
ctcttcccagctccacgagagg

SEQ ID NO: 8186956 - DNA, 22 bp, Homo sapiens
ctcttcctacagtctgctatgc

SEQ ID NO: 8186957 - DNA, 22 bp, Homo sapiens
ctcttcctacagtctgctatgc

SEQ ID NO: 8186958 - DNA, 22 bp, Homo sapiens
ttttggaacacagacattagaa

SEQ ID NO: 8186959 - DNA, 22 bp, Homo sapiens
ctcttcctagtgtgcagcgtgg

SEQ ID NO: 8186960 - DNA, 22 bp, Homo sapiens
ctcttcctctcatgcggtcata

SEQ ID NO: 8186961 - DNA, 22 bp, Homo sapiens
ctcttcctctcatgcggtcata

SEQ ID NO: 8186962 - DNA, 22 bp, Homo sapiens
ctcttctctgcagcctttgaag

SEQ ID NO: 8186963 - DNA, 22 bp, Homo sapiens
ctcttcctttcccttgagggtg

SEQ ID NO: 8186964 - DNA, 22 bp, Homo sapiens
ctcttccttaagactataaaga

SEQ ID NO: 8186965 - DNA, 22 bp, Homo sapiens
ctcttctgtacctcggcctcca

SEQ ID NO: 8186966 - DNA, 22 bp, Homo sapiens
ctcttctctgcagcctttgaag

SEQ ID NO: 8186967 - DNA, 22 bp, Homo sapiens
ctcttctgtacctcggcctcca

SEQ ID NO: 8186968 - DNA, 22 bp, Homo sapiens
ctcttctctgcagcctttgaag

SEQ ID NO: 8186969 - DNA, 22 bp, Homo sapiens
ctcttcttatggccgtggctga

SEQ ID NO: 8186970 - DNA, 22 bp, Homo sapiens
ctcttcttatggccgtggctga

SEQ ID NO: 8186971 - DNA, 22 bp, Homo sapiens
ctcttcttatggccgtggctga

SEQ ID NO: 8186972 - DNA, 22 bp, Homo sapiens
ctcttcttgaaagaggaattca

SEQ ID NO: 8186973 - DNA, 22 bp, Homo sapiens
ctgagcactgggcacatagctg

SEQ ID NO: 8186974 - DNA, 22 bp, Homo sapiens
ctgagcagaagggtgcacgtgc

SEQ ID NO: 8186975 - DNA, 22 bp, Homo sapiens
ctgagcagaagggtgcacgtgc

SEQ ID NO: 8186976 - DNA, 22 bp, Homo sapiens
ctgagcagaccatggcagaggt

SEQ ID NO: 8186977 - DNA, 22 bp, Homo sapiens
ctgagcagaccatggcagaggt

SEQ ID NO: 8186978 - DNA, 22 bp, Homo sapiens
ctgagcagaccatggcagaggt

SEQ ID NO: 8186979 - DNA, 22 bp, Homo sapiens
ctgagcagaccatggcagaggt

SEQ ID NO: 8186980 - DNA, 19 bp, Homo sapiens
ctgagcagcggcagcactt

SEQ ID NO: 8186981 - DNA, 19 bp, Homo sapiens
ctgagcagcggcagcactt

SEQ ID NO: 8186982 - DNA, 22 bp, Homo sapiens
ctgagcagctccctgagtggtc

SEQ ID NO: 8186983 - DNA, 22 bp, Homo sapiens
ctgagcagcgtggggagctggc

SEQ ID NO: 8186984 - DNA, 22 bp, Homo sapiens
ctgagcagcgtggggagctggc

SEQ ID NO: 8186985 - DNA, 22 bp, Homo sapiens
ctgagcagcgtggggagctggc

SEQ ID NO: 8186986 - DNA, 22 bp, Homo sapiens
ctgagcagcgtggggagctggc

SEQ ID NO: 8186987 - DNA, 22 bp, Homo sapiens
ctgagcaggatattcacagcag

SEQ ID NO: 8186988 - DNA, 22 bp, Homo sapiens
ctgagcaggatattcacagcag

SEQ ID NO: 8186989 - DNA, 22 bp, Homo sapiens
ctgagcaggatattcacagcag

SEQ ID NO: 8186990 - DNA, 22 bp, Homo sapiens
ctgagcaggacagtgggagacc

SEQ ID NO: 8186991 - DNA, 22 bp, Homo sapiens
ctgagcaggacagtgggagacc

SEQ ID NO: 8186992 - DNA, 22 bp, Homo sapiens
ctgagcagctgttacagagtgt

SEQ ID NO: 8186993 - DNA, 22 bp, Homo sapiens
ctgagcaggcggtggagcggct

SEQ ID NO: 8186994 - DNA, 22 bp, Homo sapiens
ctgagcaggcggtggagcggct

SEQ ID NO: 8186995 - DNA, 22 bp, Homo sapiens
ctgagcaggatattcacagcag

SEQ ID NO: 8186996 - DNA, 19 bp, Homo sapiens
ctgagcaggcaggtaggat

SEQ ID NO: 8186997 - DNA, 22 bp, Homo sapiens
ctgagcagtagagggtctcttt

SEQ ID NO: 8186998 - DNA, 22 bp, Homo sapiens
ctgagcagtctagccaggtgtt

SEQ ID NO: 8186999 - DNA, 22 bp, Homo sapiens
ctgagcagtctagccaggtgtt

SEQ ID NO: 8187000 - DNA, 22 bp, Homo sapiens
ctgagcagtctgactcaagcta

SEQ ID NO: 8187001 - DNA, 22 bp, Homo sapiens
ctgagcagtgctttgcagtggg

SEQ ID NO: 8187002 - DNA, 22 bp, Homo sapiens
ctgagcagtgctttgcagtggg

SEQ ID NO: 8187003 - DNA, 22 bp, Homo sapiens
ctgagcagtggttcttgagcgc

SEQ ID NO: 8187004 - DNA, 22 bp, Homo sapiens
ctgagcagtggttcttgagcgc

SEQ ID NO: 8187005 - DNA, 22 bp, Homo sapiens
ctgagcagtggttcttgagcgc

SEQ ID NO: 8187006 - DNA, 22 bp, Homo sapiens
ctgagcagtggttcttgagcgc

SEQ ID NO: 8187007 - DNA, 22 bp, Homo sapiens
ctgagcagtttcttagggctca

SEQ ID NO: 8187008 - DNA, 22 bp, Homo sapiens
ctgagcagtttcttagggctca

SEQ ID NO: 8187009 - DNA, 22 bp, Homo sapiens
ctgagccaaaaagcagagcttg

SEQ ID NO: 8187010 - DNA, 22 bp, Homo sapiens
ctgagccaaaaagcagagcttg

SEQ ID NO: 8187011 - DNA, 22 bp, Homo sapiens
ctgaggccgttggtgggcctta

SEQ ID NO: 8187012 - DNA, 22 bp, Homo sapiens
ctgaggccgttggtgggcctta

SEQ ID NO: 8187013 - DNA, 22 bp, Homo sapiens
ctgaggccgtctgggtctgcag

SEQ ID NO: 8187014 - DNA, 22 bp, Homo sapiens
ctgaggccgtctgggtctgcag

SEQ ID NO: 8187015 - DNA, 22 bp, Homo sapiens
ctgagccaaccacagcaggagc

SEQ ID NO: 8187016 - DNA, 22 bp, Homo sapiens
ctgagccaaaaagcagagcttg

SEQ ID NO: 8187017 - DNA, 22 bp, Homo sapiens
ctgaggcctggccccaccacag

SEQ ID NO: 8187018 - DNA, 22 bp, Homo sapiens
ctgaggcctggccccaccacag

SEQ ID NO: 8187019 - DNA, 22 bp, Homo sapiens
ctgaggcctggccccaccacag

SEQ ID NO: 8187020 - DNA, 22 bp, Homo sapiens
ctgaggcctggtgaggtggtga

SEQ ID NO: 8187021 - DNA, 22 bp, Homo sapiens
ctgaggcctgggggcgtggacg

SEQ ID NO: 8187022 - DNA, 22 bp, Homo sapiens
ctgaggcctgtgttggggcagt

SEQ ID NO: 8187023 - DNA, 22 bp, Homo sapiens
ctgaggcctgtgttggggcagt

SEQ ID NO: 8187024 - DNA, 22 bp, Homo sapiens
ctgaggctaacctcgagagaca

SEQ ID NO: 8187025 - DNA, 22 bp, Homo sapiens
ctgaggctaacctcgagagaca

SEQ ID NO: 8187026 - DNA, 22 bp, Homo sapiens
ctgaggctcaagggcaggtggg

SEQ ID NO: 8187027 - DNA, 22 bp, Homo sapiens
ctgaggctcaagggcaggtggg

SEQ ID NO: 8187028 - DNA, 22 bp, Homo sapiens
ctgaggctaacctcgagagaca

SEQ ID NO: 8187029 - DNA, 22 bp, Homo sapiens
ctgaggctagtataaagagcat

SEQ ID NO: 8187030 - DNA, 22 bp, Homo sapiens
ctgaggctcaagggcaggtggg

SEQ ID NO: 8187031 - DNA, 22 bp, Homo sapiens
ctgaggctcaagggcaggtggg

SEQ ID NO: 8187032 - DNA, 22 bp, Homo sapiens
ctgaggctcaagggcaggtggg

SEQ ID NO: 8187033 - DNA, 22 bp, Homo sapiens
ctgaggctcaagggcaggtggg

SEQ ID NO: 8187034 - DNA, 22 bp, Homo sapiens
ctgaggctcaagggcaggtggg

SEQ ID NO: 8187035 - DNA, 22 bp, Homo sapiens
ctgaggctcaagggcaggtggg

SEQ ID NO: 8187036 - DNA, 22 bp, Homo sapiens
ctgaggtctattttgaaactgc

SEQ ID NO: 8187037 - DNA, 22 bp, Homo sapiens
ctgaggtccttgactgcttgcc

SEQ ID NO: 8187038 - DNA, 22 bp, Homo sapiens
ctgaggtctagacaccccaggg

SEQ ID NO: 8187039 - DNA, 22 bp, Homo sapiens
ctgaggtccttgactgcttgcc

SEQ ID NO: 8187040 - DNA, 22 bp, Homo sapiens
ctgaggtctagacaccccaggg

SEQ ID NO: 8187041 - DNA, 22 bp, Homo sapiens
ctgaggtcctcagagggaaagg

SEQ ID NO: 8187042 - DNA, 22 bp, Homo sapiens
ctgaggtcctcagagggaaagg

SEQ ID NO: 8187043 - DNA, 22 bp, Homo sapiens
ctgaggtcaggagttcaagctg

SEQ ID NO: 8187044 - DNA, 17 bp, Homo sapiens
ctgaggggagtgctgtg

SEQ ID NO: 8187045 - DNA, 22 bp, Homo sapiens
ctgaggtcaggagttcaagctg

SEQ ID NO: 8187046 - DNA, 18 bp, Homo sapiens
ctgaggctggcaggagcc

SEQ ID NO: 8187047 - DNA, 23 bp, Homo sapiens
ctgaggggaaaagggcttcaggc

SEQ ID NO: 8187048 - DNA, 18 bp, Homo sapiens
ctgaggctggcaggagcc

SEQ ID NO: 8187049 - DNA, 22 bp, Homo sapiens
ctgaggctggagtgcagtggtg

SEQ ID NO: 8187050 - DNA, 22 bp, Homo sapiens
ctgaggctggagtgcagtggtg

SEQ ID NO: 8187051 - DNA, 22 bp, Homo sapiens
ctgaggctggagtgcagtggtg

SEQ ID NO: 8187052 - DNA, 22 bp, Homo sapiens
ctgaggctggagtgcagtggtg

SEQ ID NO: 8187053 - DNA, 22 bp, Homo sapiens
ctgaggctccctcgggtctgct

SEQ ID NO: 8187054 - DNA, 22 bp, Homo sapiens
ctgaggctctgagaaagccaaa

SEQ ID NO: 8187055 - DNA, 22 bp, Homo sapiens
ctgaggctcagcgtgaggaaag

SEQ ID NO: 8187056 - DNA, 22 bp, Homo sapiens
ctgaggctcagcgtgaggaaag

SEQ ID NO: 8187057 - DNA, 22 bp, Homo sapiens
ctgaggctccctcgggtctgct

SEQ ID NO: 8187058 - DNA, 22 bp, Homo sapiens
ctgaggctggagtgcagtggtg

SEQ ID NO: 8187059 - DNA, 22 bp, Homo sapiens
ctgaggctggagtgcagtggtg

SEQ ID NO: 8187060 - DNA, 22 bp, Homo sapiens
ctgaggctgcccagggccaggt

SEQ ID NO: 8187061 - DNA, 22 bp, Homo sapiens
ctgaggctgcccagggccaggt

SEQ ID NO: 8187062 - DNA, 22 bp, Homo sapiens
ctgaggctgagacaggtgaaat

SEQ ID NO: 8187063 - DNA, 22 bp, Homo sapiens
ctgaggctgaagagggcctacg

SEQ ID NO: 8187064 - DNA, 22 bp, Homo sapiens
ctgaggctgcccagggccaggt

SEQ ID NO: 8187065 - DNA, 22 bp, Homo sapiens
ctgaggctgagacaggtgaaat

SEQ ID NO: 8187066 - DNA, 22 bp, Homo sapiens
ctgcccaggaaccagaggggca

SEQ ID NO: 8187067 - DNA, 22 bp, Homo sapiens
ctgcccataaactttccacctg

SEQ ID NO: 8187068 - DNA, 22 bp, Homo sapiens
ctgcccatctgcagacatgcgt

SEQ ID NO: 8187069 - DNA, 22 bp, Homo sapiens
ctgcccagtttgggagcctttc

SEQ ID NO: 8187070 - DNA, 23 bp, Homo sapiens
ctgccccaattataaaagaagat

SEQ ID NO: 8187071 - DNA, 23 bp, Homo sapiens
ctgccccaattataaaagaagat

SEQ ID NO: 8187072 - DNA, 22 bp, Homo sapiens
ctgccccacaggcttggtaggg

SEQ ID NO: 8187073 - DNA, 22 bp, Homo sapiens
ctgcccatctggccacacacag

SEQ ID NO: 8187074 - DNA, 22 bp, Homo sapiens
ctgcccctgccaggcagctgtc

SEQ ID NO: 8187075 - DNA, 22 bp, Homo sapiens
ctgccccatggtccctggtggg

SEQ ID NO: 8187076 - DNA, 22 bp, Homo sapiens
ctgccccatggtccctggtggg

SEQ ID NO: 8187077 - DNA, 22 bp, Homo sapiens
ctgccccatggtccctggtggg

SEQ ID NO: 8187078 - DNA, 22 bp, Homo sapiens
ctgccccatggtccctggtggg

SEQ ID NO: 8187079 - DNA, 22 bp, Homo sapiens
ctgccccaggacctcttctgga

SEQ ID NO: 8187080 - DNA, 22 bp, Homo sapiens
ctgccccaggcctccttttctt

SEQ ID NO: 8187081 - DNA, 22 bp, Homo sapiens
ctgccccaggcctccttttctt

SEQ ID NO: 8187082 - DNA, 22 bp, Homo sapiens
ctgccccaggcctccttttctt

SEQ ID NO: 8187083 - DNA, 22 bp, Homo sapiens
ctgccccagtgccaggcaggtg

SEQ ID NO: 8187084 - DNA, 22 bp, Homo sapiens
ctgccccagtgccaggcaggtg

SEQ ID NO: 8187085 - DNA, 22 bp, Homo sapiens
ctgccccagtgccaggcaggtg

SEQ ID NO: 8187086 - DNA, 22 bp, Homo sapiens
ctgccccaggcctcgggaggag

SEQ ID NO: 8187087 - DNA, 22 bp, Homo sapiens
ctgccccaggcctcgggaggag

SEQ ID NO: 8187088 - DNA, 22 bp, Homo sapiens
ctgccccaggcctccttttctt

SEQ ID NO: 8187089 - DNA, 22 bp, Homo sapiens
ctgccccaccccaacctgaggt

SEQ ID NO: 8187090 - DNA, 22 bp, Homo sapiens
ctgccccaccccaacctgaggt

SEQ ID NO: 8187091 - DNA, 22 bp, Homo sapiens
ctgccccaggacctcttctgga

SEQ ID NO: 8187092 - DNA, 22 bp, Homo sapiens
ctgccccagcctggggccttct

SEQ ID NO: 8187093 - DNA, 22 bp, Homo sapiens
ctgccccagcctggggccttct

SEQ ID NO: 8187094 - DNA, 22 bp, Homo sapiens
ctgccccagcctggggccttct

SEQ ID NO: 8187095 - DNA, 22 bp, Homo sapiens
ctgccccaggacctcttctgga

SEQ ID NO: 8187096 - DNA, 22 bp, Homo sapiens
ctgccccaggacctcttctgga

SEQ ID NO: 8187097 - DNA, 20 bp, Homo sapiens
ctgcccagccactgagggat

SEQ ID NO: 8187098 - DNA, 20 bp, Homo sapiens
ctgcccagccactgagggat

SEQ ID NO: 8187099 - DNA, 20 bp, Homo sapiens
ctgcccagccactgagggat

SEQ ID NO: 8187100 - DNA, 20 bp, Homo sapiens
ctgcccagccactgagggat

SEQ ID NO: 8187101 - DNA, 22 bp, Homo sapiens
ctgcccacactcatggggaagg

SEQ ID NO: 8187102 - DNA, 22 bp, Homo sapiens
ctgcccacacctgagctgggcc

SEQ ID NO: 8187103 - DNA, 22 bp, Homo sapiens
ctgcccacacctgagctgggcc

SEQ ID NO: 8187104 - DNA, 22 bp, Homo sapiens
ctgcccagattttaccacctgc

SEQ ID NO: 8187105 - DNA, 18 bp, Homo sapiens
ctgccatgtcctactgtc

SEQ ID NO: 8187106 - DNA, 22 bp, Homo sapiens
ctgccatgttacctgcacaggt

SEQ ID NO: 8187107 - DNA, 22 bp, Homo sapiens
ctgccatgttacctgcacaggt

SEQ ID NO: 8187108 - DNA, 22 bp, Homo sapiens
ctgcaggaggatcctgagagtg

SEQ ID NO: 8187109 - DNA, 22 bp, Homo sapiens
ctgcaggaggatcctgagagtg

SEQ ID NO: 8187110 - DNA, 22 bp, Homo sapiens
ctgcaggaggatcctgagagtg

SEQ ID NO: 8187111 - DNA, 22 bp, Homo sapiens
ctgcaggagggctggggaagcc

SEQ ID NO: 8187112 - DNA, 22 bp, Homo sapiens
ctgcaggagtgaaagcaggcct

SEQ ID NO: 8187113 - DNA, 22 bp, Homo sapiens
ctgcaggaggatcctgagagtg

SEQ ID NO: 8187114 - DNA, 22 bp, Homo sapiens
ctgcaggagcaagcctgggaga

SEQ ID NO: 8187115 - DNA, 22 bp, Homo sapiens
ctgcaggagcaagcctgggaga

SEQ ID NO: 8187116 - DNA, 22 bp, Homo sapiens
ctgcaggagcaaagcctctgct

SEQ ID NO: 8187117 - DNA, 21 bp, Homo sapiens
ctgcaggatgctgaagccagg

SEQ ID NO: 8187118 - DNA, 21 bp, Homo sapiens
ctgcaggatgctgaagccagg

SEQ ID NO: 8187119 - DNA, 22 bp, Homo sapiens
ctgcaggagtgaaagcaggcct

SEQ ID NO: 8187120 - DNA, 22 bp, Homo sapiens
ctgcaggcatctaactgtgggc

SEQ ID NO: 8187121 - DNA, 22 bp, Homo sapiens
ctgcaggatttcatgggctgac

SEQ ID NO: 8187122 - DNA, 22 bp, Homo sapiens
ctgcagcctaggtgcagctggg

SEQ ID NO: 8187123 - DNA, 22 bp, Homo sapiens
ctgcagcctaggtgcagctggg

SEQ ID NO: 8187124 - DNA, 22 bp, Homo sapiens
ctgcagcctaggtgcagctggg

SEQ ID NO: 8187125 - DNA, 16 bp, Homo sapiens
ctgaggtttggccaca

SEQ ID NO: 8187126 - DNA, 22 bp, Homo sapiens
ctgcagcctaggtgcagctggg

SEQ ID NO: 8187127 - DNA, 22 bp, Homo sapiens
ctgcagcctaggtgcagctggg

SEQ ID NO: 8187128 - DNA, 23 bp, Homo sapiens
ctgcagccgcgtggggacgtgga

SEQ ID NO: 8187129 - DNA, 22 bp, Homo sapiens
ctgcagcctcaacctcctgagc

SEQ ID NO: 8187130 - DNA, 22 bp, Homo sapiens
ctgcagctgggccagggccacc

SEQ ID NO: 8187131 - DNA, 22 bp, Homo sapiens
ctgcagctgggccagggccacc

SEQ ID NO: 8187132 - DNA, 22 bp, Homo sapiens
ctgcagcctcaacctcctgagc

SEQ ID NO: 8187133 - DNA, 22 bp, Homo sapiens
ctgcagcctcaacctcctgagc

SEQ ID NO: 8187134 - DNA, 22 bp, Homo sapiens
ctgcagcctcaacctcctgagc

SEQ ID NO: 8187135 - DNA, 22 bp, Homo sapiens
ctgcagcttaagggaggggttg

SEQ ID NO: 8187136 - DNA, 22 bp, Homo sapiens
ctgcagcttaaaggagttcaat

SEQ ID NO: 8187137 - DNA, 22 bp, Homo sapiens
ctgcagctgtgagtgctggatg

SEQ ID NO: 8187138 - DNA, 22 bp, Homo sapiens
ctgcagctgtgagtgctggatg

SEQ ID NO: 8187139 - DNA, 22 bp, Homo sapiens
ctgcagctgtgagtgctggatg

SEQ ID NO: 8187140 - DNA, 22 bp, Homo sapiens
ctgcagctgtctctactgggca

SEQ ID NO: 8187141 - DNA, 22 bp, Homo sapiens
ctgcagctgtagaggacagtgg

SEQ ID NO: 8187142 - DNA, 22 bp, Homo sapiens
ctgcagctgtagaggacagtgg

SEQ ID NO: 8187143 - DNA, 22 bp, Homo sapiens
ctgcaggacagggccggaggcc

SEQ ID NO: 8187144 - DNA, 22 bp, Homo sapiens
ctgcaggacagggaggagcaag

SEQ ID NO: 8187145 - DNA, 22 bp, Homo sapiens
ctgcaggacagggaggagcaag

SEQ ID NO: 8187146 - DNA, 22 bp, Homo sapiens
ctgcaggacagggaggagcaag

SEQ ID NO: 8187147 - DNA, 22 bp, Homo sapiens
ctgcaggacagggaggagcaag

SEQ ID NO: 8187148 - DNA, 22 bp, Homo sapiens
ctgcaggaattcaaagtgagct

SEQ ID NO: 8187149 - DNA, 22 bp, Homo sapiens
ctgcaggaattcaaagtgagct

SEQ ID NO: 8187150 - DNA, 22 bp, Homo sapiens
ctgcaggactgaaagatgaggt

SEQ ID NO: 8187151 - DNA, 22 bp, Homo sapiens
ctgcaggactgaaagatgaggt

SEQ ID NO: 8187152 - DNA, 22 bp, Homo sapiens
ctgcagctttttgtgcttgtaa

SEQ ID NO: 8187153 - DNA, 22 bp, Homo sapiens
ctgcagctttggaaacctgttt

SEQ ID NO: 8187154 - DNA, 22 bp, Homo sapiens
ctgcagctttcgctccatcagc

SEQ ID NO: 8187155 - DNA, 22 bp, Homo sapiens
ctgcagctttcgctccatcagc

SEQ ID NO: 8187156 - DNA, 22 bp, Homo sapiens
ctgcagcttatttgctgtgtga

SEQ ID NO: 8187157 - DNA, 23 bp, Homo sapiens
ctgaggtctgcaattctagtagt

SEQ ID NO: 8187158 - DNA, 22 bp, Homo sapiens
ctgaggtctctttccatagtga

SEQ ID NO: 8187159 - DNA, 22 bp, Homo sapiens
ctgaggtctattttgaaactgc

SEQ ID NO: 8187160 - DNA, 22 bp, Homo sapiens
ctgaggtctattttgaaactgc

SEQ ID NO: 8187161 - DNA, 23 bp, Homo sapiens
ctgaggtctgcaattctagtagt

SEQ ID NO: 8187162 - DNA, 23 bp, Homo sapiens
ctgaggtctgcaattctagtagt

SEQ ID NO: 8187163 - DNA, 22 bp, Homo sapiens
ctgaggtctctttccatagtga

SEQ ID NO: 8187164 - DNA, 22 bp, Homo sapiens
ctgaggtcaggagttcaagctg

SEQ ID NO: 8187165 - DNA, 22 bp, Homo sapiens
ctgaggtgagaggaggccatgt

SEQ ID NO: 8187166 - DNA, 22 bp, Homo sapiens
ctgaggtgagcttccctgggct

SEQ ID NO: 8187167 - DNA, 19 bp, Homo sapiens
ctgaggtgaggggcatcat

SEQ ID NO: 8187168 - DNA, 19 bp, Homo sapiens
ctgaggtgaggggcatcat

SEQ ID NO: 8187169 - DNA, 22 bp, Homo sapiens
ctgaggtgagcttccctgggct

SEQ ID NO: 8187170 - DNA, 22 bp, Homo sapiens
ctgaggtgagaggaggccatgt

SEQ ID NO: 8187171 - DNA, 22 bp, Homo sapiens
ctgaggtgctagggtccctgct

SEQ ID NO: 8187172 - DNA, 22 bp, Homo sapiens
ctgaggtggaacagaggtgaag

SEQ ID NO: 8187173 - DNA, 22 bp, Homo sapiens
ctgaggtggaacagaggtgaag

SEQ ID NO: 8187174 - DNA, 22 bp, Homo sapiens
ctgaggtgatgtcaaatgggtt

SEQ ID NO: 8187175 - DNA, 22 bp, Homo sapiens
ctgaggtgatgtcaaatgggtt

SEQ ID NO: 8187176 - DNA, 19 bp, Homo sapiens
ctgaggtgcagtaagaggc

SEQ ID NO: 8187177 - DNA, 22 bp, Homo sapiens
ctgaggtgctagggtccctgct

SEQ ID NO: 8187178 - DNA, 22 bp, Homo sapiens
ctgaggtgctagggtccctgct

SEQ ID NO: 8187179 - DNA, 22 bp, Homo sapiens
ctgaggttggagatattgcaga

SEQ ID NO: 8187180 - DNA, 22 bp, Homo sapiens
ctgaggtgtttagtaggggcgg

SEQ ID NO: 8187181 - DNA, 22 bp, Homo sapiens
ctgaggtgtttagtaggggcgg

SEQ ID NO: 8187182 - DNA, 22 bp, Homo sapiens
ctgaggtgttgatgacctatgc

SEQ ID NO: 8187183 - DNA, 22 bp, Homo sapiens
ctgaggtgtggtctgggagtat

SEQ ID NO: 8187184 - DNA, 22 bp, Homo sapiens
ctgaggtgtgctttcaatgggt

SEQ ID NO: 8187185 - DNA, 22 bp, Homo sapiens
ctgaggtggcgcctctctttaa

SEQ ID NO: 8187186 - DNA, 22 bp, Homo sapiens
ctgaggtggcatcctagctcta

SEQ ID NO: 8187187 - DNA, 22 bp, Homo sapiens
ctgaggtggcctctgccgggga

SEQ ID NO: 8187188 - DNA, 22 bp, Homo sapiens
ctgaggtgtgaaatggtggcaa

SEQ ID NO: 8187189 - DNA, 22 bp, Homo sapiens
ctgaggtggggcctgggcatca

SEQ ID NO: 8187190 - DNA, 22 bp, Homo sapiens
ctgaggtggcatcctagctcta

SEQ ID NO: 8187191 - DNA, 22 bp, Homo sapiens
ctgaggtggcatcctagctcta

SEQ ID NO: 8187192 - DNA, 22 bp, Homo sapiens
ctggaagaggacacacgaatca

SEQ ID NO: 8187193 - DNA, 22 bp, Homo sapiens
ctggaagaggggaaatgccatg

SEQ ID NO: 8187194 - DNA, 22 bp, Homo sapiens
ctggaagaggaagccagctgga

SEQ ID NO: 8187195 - DNA, 22 bp, Homo sapiens
ctggaagaggacacacgaatca

SEQ ID NO: 8187196 - DNA, 22 bp, Homo sapiens
ctggaagagtcctaaacagata

SEQ ID NO: 8187197 - DNA, 22 bp, Homo sapiens
ctggaagagtcctaaacagata

SEQ ID NO: 8187198 - DNA, 22 bp, Homo sapiens
ctggaagagtaatataaattag

SEQ ID NO: 8187199 - DNA, 22 bp, Homo sapiens
ctggaagagtaatataaattag

SEQ ID NO: 8187200 - DNA, 22 bp, Homo sapiens
ctggaaggagaaggaggctgtg

SEQ ID NO: 8187201 - DNA, 22 bp, Homo sapiens
ctggaaggagaaggaggctgtg

SEQ ID NO: 8187202 - DNA, 22 bp, Homo sapiens
ctggaaggagaaggaggctgtg

SEQ ID NO: 8187203 - DNA, 22 bp, Homo sapiens
ctggaagctggaacaggtgtgg

SEQ ID NO: 8187204 - DNA, 22 bp, Homo sapiens
ctggaagctggaacaggtgtgg

SEQ ID NO: 8187205 - DNA, 22 bp, Homo sapiens
ctggaagcttgtttgccagtct

SEQ ID NO: 8187206 - DNA, 22 bp, Homo sapiens
ctggaagagtgactttgcattt

SEQ ID NO: 8187207 - DNA, 22 bp, Homo sapiens
ctggaagagtgactttgcattt

SEQ ID NO: 8187208 - DNA, 20 bp, Homo sapiens
ctggaagcctttccagagca

SEQ ID NO: 8187209 - DNA, 20 bp, Homo sapiens
ctggaagcctttccagagca

SEQ ID NO: 8187210 - DNA, 20 bp, Homo sapiens
ctggaagcctttccagagca

SEQ ID NO: 8187211 - DNA, 22 bp, Homo sapiens
ctggaagctaacatccttttcc

SEQ ID NO: 8187212 - DNA, 22 bp, Homo sapiens
ctggaagctaacatccttttcc

SEQ ID NO: 8187213 - DNA, 22 bp, Homo sapiens
ctggaagcgtcggaggaagggc

SEQ ID NO: 8187214 - DNA, 22 bp, Homo sapiens
ctggaagcgtcggaggaagggc

SEQ ID NO: 8187215 - DNA, 22 bp, Homo sapiens
ctggaagctggaacaggtgtgg

SEQ ID NO: 8187216 - DNA, 22 bp, Homo sapiens
ctggaaagtgaggagagttcca

SEQ ID NO: 8187217 - DNA, 22 bp, Homo sapiens
ctggaaagtcaggtcagaaact

SEQ ID NO: 8187218 - DNA, 22 bp, Homo sapiens
ctgctgtgagtttggaggtcta

SEQ ID NO: 8187219 - DNA, 22 bp, Homo sapiens
ctggaaagtgcttttctgagag

SEQ ID NO: 8187220 - DNA, 22 bp, Homo sapiens
ctgctgtgagtggttcttgcct

SEQ ID NO: 8187221 - DNA, 22 bp, Homo sapiens
ctgctgtgagcactccagcctg

SEQ ID NO: 8187222 - DNA, 22 bp, Homo sapiens
ctgctgtgacagctgccgtgtt

SEQ ID NO: 8187223 - DNA, 22 bp, Homo sapiens
ctgctgtgacagctgccgtgtt

SEQ ID NO: 8187224 - DNA, 23 bp, Homo sapiens
ctgctgtgaaacatggttttggt

SEQ ID NO: 8187225 - DNA, 23 bp, Homo sapiens
ctgctgtgaaacatggttttggt

SEQ ID NO: 8187226 - DNA, 22 bp, Homo sapiens
ctgctgtctttatttcactgct

SEQ ID NO: 8187227 - DNA, 22 bp, Homo sapiens
ctggaaggttcctcccagctcc

SEQ ID NO: 8187228 - DNA, 22 bp, Homo sapiens
ctggagaaaatccatgtgtatg

SEQ ID NO: 8187229 - DNA, 22 bp, Homo sapiens
ctggagagaccgaaagaggctg

SEQ ID NO: 8187230 - DNA, 22 bp, Homo sapiens
ctggagagaccgaaagaggctg

SEQ ID NO: 8187231 - DNA, 22 bp, Homo sapiens
ctggaaggtaacaaggccatta

SEQ ID NO: 8187232 - DNA, 22 bp, Homo sapiens
ctggaaggtgactgtcttgaat

SEQ ID NO: 8187233 - DNA, 22 bp, Homo sapiens
ctggaaggtggatggcgaggcc

SEQ ID NO: 8187234 - DNA, 22 bp, Homo sapiens
ctggaagggtctacttagcaga

SEQ ID NO: 8187235 - DNA, 22 bp, Homo sapiens
ctggaagggtctacttagcaga

SEQ ID NO: 8187236 - DNA, 22 bp, Homo sapiens
ctggaagggtcagagtgatgag

SEQ ID NO: 8187237 - DNA, 19 bp, Homo sapiens
ctggaaggagggactgttc

SEQ ID NO: 8187238 - DNA, 22 bp, Homo sapiens
ctggaaggcagaggttgcagtg

SEQ ID NO: 8187239 - DNA, 22 bp, Homo sapiens
ctggaaggcagaggttgcagtg

SEQ ID NO: 8187240 - DNA, 22 bp, Homo sapiens
ctggaaggcagaggttgcagtg

SEQ ID NO: 8187241 - DNA, 19 bp, Homo sapiens
ctggaaggagggactgttc

SEQ ID NO: 8187242 - DNA, 22 bp, Homo sapiens
ctggaaggcggaggttgtagtg

SEQ ID NO: 8187243 - DNA, 22 bp, Homo sapiens
ctggaaggctctgctgcctgtc

SEQ ID NO: 8187244 - DNA, 22 bp, Homo sapiens
ctggaagggagcactgtagaga

SEQ ID NO: 8187245 - DNA, 22 bp, Homo sapiens
ctggaagggaaatctcttggca

SEQ ID NO: 8187246 - DNA, 22 bp, Homo sapiens
ctggaaggctctgctgcctgtc

SEQ ID NO: 8187247 - DNA, 22 bp, Homo sapiens
ctggaaggggcagtctttgggc

SEQ ID NO: 8187248 - DNA, 22 bp, Homo sapiens
ctggaaggggcagtctttgggc

SEQ ID NO: 8187249 - DNA, 22 bp, Homo sapiens
ctggaagggggacagccacaca

SEQ ID NO: 8187250 - DNA, 22 bp, Homo sapiens
ctggagcctaggttgacctggg

SEQ ID NO: 8187251 - DNA, 22 bp, Homo sapiens
ctggagccggcgagccccagcc

SEQ ID NO: 8187252 - DNA, 22 bp, Homo sapiens
ctggagcctgcagttttcactt

SEQ ID NO: 8187253 - DNA, 17 bp, Homo sapiens
ctggagcctccaactcc

SEQ ID NO: 8187254 - DNA, 22 bp, Homo sapiens
ctggagcctaggttgacctggg

SEQ ID NO: 8187255 - DNA, 22 bp, Homo sapiens
ctggagccgcatggagcaggga

SEQ ID NO: 8187256 - DNA, 22 bp, Homo sapiens
ctggagccgcatggagcaggga

SEQ ID NO: 8187257 - DNA, 22 bp, Homo sapiens
ctggagccctgaatgggcagga

SEQ ID NO: 8187258 - DNA, 22 bp, Homo sapiens
ctggagccggaccagggacggt

SEQ ID NO: 8187259 - DNA, 22 bp, Homo sapiens
ctggagccgcatggagcaggga

SEQ ID NO: 8187260 - DNA, 22 bp, Homo sapiens
ctggagccggaccagggacggt

SEQ ID NO: 8187261 - DNA, 22 bp, Homo sapiens
ctggagccctgaatgggcagga

SEQ ID NO: 8187262 - DNA, 22 bp, Homo sapiens
ctggagccccaggctgtgcaga

SEQ ID NO: 8187263 - DNA, 22 bp, Homo sapiens
ctggagccccaggctgtgcaga

SEQ ID NO: 8187264 - DNA, 22 bp, Homo sapiens
ctggagccctgaatgggcagga

SEQ ID NO: 8187265 - DNA, 22 bp, Homo sapiens
ctggagccctgaatgggcagga

SEQ ID NO: 8187266 - DNA, 22 bp, Homo sapiens
ctggagccccaggctgtgcaga

SEQ ID NO: 8187267 - DNA, 22 bp, Homo sapiens
ctggagccccaggctgtgcaga

SEQ ID NO: 8187268 - DNA, 22 bp, Homo sapiens
ctggagcaggtttaggagtccc

SEQ ID NO: 8187269 - DNA, 22 bp, Homo sapiens
ctggagcatccatgcccagggt

SEQ ID NO: 8187270 - DNA, 22 bp, Homo sapiens
ctggagcatccatgcccagggt

SEQ ID NO: 8187271 - DNA, 22 bp, Homo sapiens
ctggagcaggtttaggagtccc

SEQ ID NO: 8187272 - DNA, 22 bp, Homo sapiens
ctggagcaggtttaggagtccc

SEQ ID NO: 8187273 - DNA, 22 bp, Homo sapiens
ctggagcaggtttaggagtccc

SEQ ID NO: 8187274 - DNA, 22 bp, Homo sapiens
ctggagcaggcttgtcccagct

SEQ ID NO: 8187275 - DNA, 22 bp, Homo sapiens
ctggagcagcaggtggccaggg

SEQ ID NO: 8187276 - DNA, 22 bp, Homo sapiens
ctggagcagcaggtggccaggg

SEQ ID NO: 8187277 - DNA, 22 bp, Homo sapiens
ctggagcagcaggtggccaggg

SEQ ID NO: 8187278 - DNA, 22 bp, Homo sapiens
ctggagatgtccgggtgctgtt

SEQ ID NO: 8187279 - DNA, 22 bp, Homo sapiens
ctggagagttggaagatggact

SEQ ID NO: 8187280 - DNA, 22 bp, Homo sapiens
ctggagataagtaaagaggcaa

SEQ ID NO: 8187281 - DNA, 22 bp, Homo sapiens
ctggagatgtccgggtgctgtt

SEQ ID NO: 8187282 - DNA, 22 bp, Homo sapiens
ctggagcagcaggtggccaggg

SEQ ID NO: 8187283 - DNA, 17 bp, Homo sapiens
ctggagcagacaaaagg

SEQ ID NO: 8187284 - DNA, 22 bp, Homo sapiens
ctggagagttggaagatggact

SEQ ID NO: 8187285 - DNA, 22 bp, Homo sapiens
ctggagagttggaagatggact

SEQ ID NO: 8187286 - DNA, 22 bp, Homo sapiens
ctggagagttggaagatggact

SEQ ID NO: 8187287 - DNA, 22 bp, Homo sapiens
ctggagagttggaagatggact

SEQ ID NO: 8187288 - DNA, 22 bp, Homo sapiens
ctggagagttggaagatggact

SEQ ID NO: 8187289 - DNA, 22 bp, Homo sapiens
ctggagagttggaagatggact

SEQ ID NO: 8187290 - DNA, 22 bp, Homo sapiens
ctggagagttggaagatggact

SEQ ID NO: 8187291 - DNA, 22 bp, Homo sapiens
ctggagagggagctgttggaag

SEQ ID NO: 8187292 - DNA, 22 bp, Homo sapiens
ctggagagggagctgttggaag

SEQ ID NO: 8187293 - DNA, 22 bp, Homo sapiens
ctggagagggagctgttggaag

SEQ ID NO: 8187294 - DNA, 22 bp, Homo sapiens
ctggagagtaatctctgtgtta

SEQ ID NO: 8187295 - DNA, 22 bp, Homo sapiens
ctggagagtaatctctgtgtta

SEQ ID NO: 8187296 - DNA, 22 bp, Homo sapiens
ctggagaggctgggaacaggtt

SEQ ID NO: 8187297 - DNA, 22 bp, Homo sapiens
ctggagaggctgggaacaggtt

SEQ ID NO: 8187298 - DNA, 22 bp, Homo sapiens
ctggagaggctgggaacaggtt

SEQ ID NO: 8187299 - DNA, 22 bp, Homo sapiens
ctggagaggccccaagatattt

SEQ ID NO: 8187300 - DNA, 22 bp, Homo sapiens
ctggagaggccccaagatattt

SEQ ID NO: 8187301 - DNA, 22 bp, Homo sapiens
ctggagaggccccaagatattt

SEQ ID NO: 8187302 - DNA, 22 bp, Homo sapiens
ctggagagatcctcctgaaaaa

SEQ ID NO: 8187303 - DNA, 22 bp, Homo sapiens
ctggagagatcctcctgaaaaa

SEQ ID NO: 8187304 - DNA, 22 bp, Homo sapiens
ctggagagagaaaaagccttaa

SEQ ID NO: 8187305 - DNA, 22 bp, Homo sapiens
ctggagagagaaaaagccttaa

SEQ ID NO: 8187306 - DNA, 22 bp, Homo sapiens
ctggagagatcctcctgaaaaa

SEQ ID NO: 8187307 - DNA, 22 bp, Homo sapiens
ctggagagaccgaaagaggctg

SEQ ID NO: 8187308 - DNA, 22 bp, Homo sapiens
ctggagagaccgaaagaggctg

SEQ ID NO: 8187309 - DNA, 22 bp, Homo sapiens
ctggagagggagccctggcagt

SEQ ID NO: 8187310 - DNA, 22 bp, Homo sapiens
ctggagagggagccctggcagt

SEQ ID NO: 8187311 - DNA, 22 bp, Homo sapiens
ctggagagggagccctggcagt

SEQ ID NO: 8187312 - DNA, 22 bp, Homo sapiens
ctggagagggagctgttggaag

SEQ ID NO: 8187313 - DNA, 22 bp, Homo sapiens
ctggagagggagccctggcagt

SEQ ID NO: 8187314 - DNA, 22 bp, Homo sapiens
ctggagaggctgggaacaggtt

SEQ ID NO: 8187315 - DNA, 22 bp, Homo sapiens
ctggagagggagccctggcagt

SEQ ID NO: 8187316 - DNA, 22 bp, Homo sapiens
ctggagaggctgggaacaggtt

SEQ ID NO: 8187317 - DNA, 22 bp, Homo sapiens
ctggagaggctgggaacaggtt

SEQ ID NO: 8187318 - DNA, 22 bp, Homo sapiens
ctgcctgtgggtacaagtggaa

SEQ ID NO: 8187319 - DNA, 22 bp, Homo sapiens
ctgcctgtggtctgtgatctaa

SEQ ID NO: 8187320 - DNA, 22 bp, Homo sapiens
ctgcctgtgtctattccttttt

SEQ ID NO: 8187321 - DNA, 22 bp, Homo sapiens
ctgcctgtgtgtgcctgcagaa

SEQ ID NO: 8187322 - DNA, 22 bp, Homo sapiens
ctgcctgttagtctagcagtta

SEQ ID NO: 8187323 - DNA, 22 bp, Homo sapiens
ctgcctgttagtctagcagtta

SEQ ID NO: 8187324 - DNA, 19 bp, Homo sapiens
ctgcctgttatggagagaa

SEQ ID NO: 8187325 - DNA, 22 bp, Homo sapiens
ctgcctgtgtgtgcctgcagaa

SEQ ID NO: 8187326 - DNA, 22 bp, Homo sapiens
ctgcctgtgtgtgcctgcagaa

SEQ ID NO: 8187327 - DNA, 22 bp, Homo sapiens
ctgcctgtgtgtgcctgcagaa

SEQ ID NO: 8187328 - DNA, 22 bp, Homo sapiens
ctgcccctgccaggcagctgtc

SEQ ID NO: 8187329 - DNA, 22 bp, Homo sapiens
ctgcctggggaatgtgaggatt

SEQ ID NO: 8187330 - DNA, 22 bp, Homo sapiens
ctgcctggggaatgtgaggatt

SEQ ID NO: 8187331 - DNA, 22 bp, Homo sapiens
ctgcctgtggacaccctggagg

SEQ ID NO: 8187332 - DNA, 22 bp, Homo sapiens
ctgcctgtggacaccctggagg

SEQ ID NO: 8187333 - DNA, 22 bp, Homo sapiens
ctgcctggggcatcagtcaagg

SEQ ID NO: 8187334 - DNA, 22 bp, Homo sapiens
ctgcctggggcatcagtcaagg

SEQ ID NO: 8187335 - DNA, 22 bp, Homo sapiens
ctgcctggggaatgtgaggatt

SEQ ID NO: 8187336 - DNA, 22 bp, Homo sapiens
ctgcctggggaatgtgaggatt

SEQ ID NO: 8187337 - DNA, 18 bp, Homo sapiens
ctgcctgttgctgagagg

SEQ ID NO: 8187338 - DNA, 18 bp, Homo sapiens
ctgcctgttgctgagagg

SEQ ID NO: 8187339 - DNA, 22 bp, Homo sapiens
ctgcctgttttctgatagattt

SEQ ID NO: 8187340 - DNA, 22 bp, Homo sapiens
ctgccttcatctctgagctggg

SEQ ID NO: 8187341 - DNA, 22 bp, Homo sapiens
ctgccttcatctctgagctggg

SEQ ID NO: 8187342 - DNA, 22 bp, Homo sapiens
ctgccttcatctctgagctggg

SEQ ID NO: 8187343 - DNA, 22 bp, Homo sapiens
ctgcctgtttcctcttgctccc

SEQ ID NO: 8187344 - DNA, 22 bp, Homo sapiens
ctgcctgtttcctcttgctccc

SEQ ID NO: 8187345 - DNA, 22 bp, Homo sapiens
ctgcctgttttctgatagattt

SEQ ID NO: 8187346 - DNA, 22 bp, Homo sapiens
ctgccttgcaccggctctctgg

SEQ ID NO: 8187347 - DNA, 22 bp, Homo sapiens
ctgccttccaaccccagactcc

SEQ ID NO: 8187348 - DNA, 22 bp, Homo sapiens
ctgccttccaaccccagactcc

SEQ ID NO: 8187349 - DNA, 22 bp, Homo sapiens
ctgccttccaaccccagactcc

SEQ ID NO: 8187350 - DNA, 22 bp, Homo sapiens
ctgctctgtttcttagctgggt

SEQ ID NO: 8187351 - DNA, 22 bp, Homo sapiens
ctgctctgtttcttagctgggt

SEQ ID NO: 8187352 - DNA, 22 bp, Homo sapiens
ctgctcttcacactacacccgt

SEQ ID NO: 8187353 - DNA, 22 bp, Homo sapiens
ctgctctgttcccccatcatct

SEQ ID NO: 8187354 - DNA, 22 bp, Homo sapiens
ctgctctgttcccccatcatct

SEQ ID NO: 8187355 - DNA, 22 bp, Homo sapiens
ctgctctgttcccccatcatct

SEQ ID NO: 8187356 - DNA, 22 bp, Homo sapiens
ctgctctgttcccccatcatct

SEQ ID NO: 8187357 - DNA, 22 bp, Homo sapiens
ctgctctgaccctttcaccttc

SEQ ID NO: 8187358 - DNA, 22 bp, Homo sapiens
ctgctctgagaggctcttccta

SEQ ID NO: 8187359 - DNA, 22 bp, Homo sapiens
ctgctctgaccctttcaccttc

SEQ ID NO: 8187360 - DNA, 22 bp, Homo sapiens
ctgctctgaccctttcaccttc

SEQ ID NO: 8187361 - DNA, 22 bp, Homo sapiens
ctgctctgttaattaaactttg

SEQ ID NO: 8187362 - DNA, 22 bp, Homo sapiens
ctgctctgtggtccatgagaca

SEQ ID NO: 8187363 - DNA, 22 bp, Homo sapiens
ctgctctgtgcacttgttcagg

SEQ ID NO: 8187364 - DNA, 22 bp, Homo sapiens
ctgccttggttcccagccagca

SEQ ID NO: 8187365 - DNA, 22 bp, Homo sapiens
ctgccttggtttctagcagggc

SEQ ID NO: 8187366 - DNA, 22 bp, Homo sapiens
ctgcctttgcccttgacactgt

SEQ ID NO: 8187367 - DNA, 22 bp, Homo sapiens
ctgcgcaggggtggcgccagaa

SEQ ID NO: 8187368 - DNA, 22 bp, Homo sapiens
ctgcgatgaccctctcttgctg

SEQ ID NO: 8187369 - DNA, 21 bp, Homo sapiens
ctgctctgacagtgaggccag

SEQ ID NO: 8187370 - DNA, 22 bp, Homo sapiens
ctgcctttggaagtccagagct

SEQ ID NO: 8187371 - DNA, 19 bp, Homo sapiens
ctgctgggtgctgagggag

SEQ ID NO: 8187372 - DNA, 19 bp, Homo sapiens
ctgctgggtgctgagggag

SEQ ID NO: 8187373 - DNA, 19 bp, Homo sapiens
ctgctgggtgctgagggag

SEQ ID NO: 8187374 - DNA, 22 bp, Homo sapiens
ctgctgggtttgcctttcacca

SEQ ID NO: 8187375 - DNA, 22 bp, Homo sapiens
ctgctggtctctttggattgcg

SEQ ID NO: 8187376 - DNA, 22 bp, Homo sapiens
ctgctgggtctatgcaagtgga

SEQ ID NO: 8187377 - DNA, 22 bp, Homo sapiens
ctgctgggtctatgcaagtgga

SEQ ID NO: 8187378 - DNA, 22 bp, Homo sapiens
ctgctgggtctatgcaagtgga

SEQ ID NO: 8187379 - DNA, 22 bp, Homo sapiens
ctgctgggcagaggctgcatga

SEQ ID NO: 8187380 - DNA, 22 bp, Homo sapiens
ctgctgggtccccctgctgatt

SEQ ID NO: 8187381 - DNA, 22 bp, Homo sapiens
ctgctgggcagaggctgcatga

SEQ ID NO: 8187382 - DNA, 22 bp, Homo sapiens
ctgctgggtccccctgctgatt

SEQ ID NO: 8187383 - DNA, 22 bp, Homo sapiens
ctgctgggtccccctgctgatt

SEQ ID NO: 8187384 - DNA, 22 bp, Homo sapiens
ctgctgtcaaaaatcactccat

SEQ ID NO: 8187385 - DNA, 22 bp, Homo sapiens
ctgctgtcaaaggaaatatttg

SEQ ID NO: 8187386 - DNA, 22 bp, Homo sapiens
ctgctgtatagtagtccattgt

SEQ ID NO: 8187387 - DNA, 22 bp, Homo sapiens
ctgctggttgcacagagctagg

SEQ ID NO: 8187388 - DNA, 22 bp, Homo sapiens
ctgctggtgggaatttacaaga

SEQ ID NO: 8187389 - DNA, 22 bp, Homo sapiens
ctgctggttagtcttagtggga

SEQ ID NO: 8187390 - DNA, 22 bp, Homo sapiens
ctgctggtgggaatttacaaga

SEQ ID NO: 8187391 - DNA, 22 bp, Homo sapiens
ctgctggtgcagagtggggctg

SEQ ID NO: 8187392 - DNA, 22 bp, Homo sapiens
ctgctgtccaggagtgccctgt

SEQ ID NO: 8187393 - DNA, 22 bp, Homo sapiens
ctgctgtcccagcctcctcaca

SEQ ID NO: 8187394 - DNA, 22 bp, Homo sapiens
ctgctgtcatagccatccctcc

SEQ ID NO: 8187395 - DNA, 22 bp, Homo sapiens
ctgctgtcaaaggaaatatttg

SEQ ID NO: 8187396 - DNA, 22 bp, Homo sapiens
ctgctgtccaacctgcactcgc

SEQ ID NO: 8187397 - DNA, 22 bp, Homo sapiens
ctgctgagagctgaaggctgta

SEQ ID NO: 8187398 - DNA, 22 bp, Homo sapiens
ctgctgagatgccaggagctct

SEQ ID NO: 8187399 - DNA, 20 bp, Homo sapiens
ctgctgagagcctggcttgc

SEQ ID NO: 8187400 - DNA, 20 bp, Homo sapiens
ctgctgagagcctggcttgc

SEQ ID NO: 8187401 - DNA, 20 bp, Homo sapiens
ctgctgagagcctggcttgc

SEQ ID NO: 8187402 - DNA, 20 bp, Homo sapiens
ctgctgagagcctggcttgc

SEQ ID NO: 8187403 - DNA, 22 bp, Homo sapiens
ctgctgagagccacgtggcaca

SEQ ID NO: 8187404 - DNA, 22 bp, Homo sapiens
ctgctgagagccccagctgaga

SEQ ID NO: 8187405 - DNA, 22 bp, Homo sapiens
ctgctgagcatcagggctgccc

SEQ ID NO: 8187406 - DNA, 22 bp, Homo sapiens
ctgctgagcatcagggctgccc

SEQ ID NO: 8187407 - DNA, 22 bp, Homo sapiens
ctgctgagcatcagggctgccc

SEQ ID NO: 8187408 - DNA, 22 bp, Homo sapiens
ctgctgagcatcagggctgccc

SEQ ID NO: 8187409 - DNA, 22 bp, Homo sapiens
ctgctgggaaggtctgctcagt

SEQ ID NO: 8187410 - DNA, 22 bp, Homo sapiens
ctgctgggaaggtctgctcagt

SEQ ID NO: 8187411 - DNA, 22 bp, Homo sapiens
ctgctgggatagaagtatctca

SEQ ID NO: 8187412 - DNA, 22 bp, Homo sapiens
ctgctgggcagaggctgcatga

SEQ ID NO: 8187413 - DNA, 22 bp, Homo sapiens
ctgctgggatagaagtatctca

SEQ ID NO: 8187414 - DNA, 22 bp, Homo sapiens
ctgctgaatgtctctttggttt

SEQ ID NO: 8187415 - DNA, 19 bp, Homo sapiens
ctgctgaattagctctgga

SEQ ID NO: 8187416 - DNA, 22 bp, Homo sapiens
ctgctcttgagggactgcggtc

SEQ ID NO: 8187417 - DNA, 22 bp, Homo sapiens
ctgctgagactggctttgtgtc

SEQ ID NO: 8187418 - DNA, 22 bp, Homo sapiens
ctgctgagaaccagggagaatt

SEQ ID NO: 8187419 - DNA, 22 bp, Homo sapiens
ctgctgagaacccagattacta

SEQ ID NO: 8187420 - DNA, 22 bp, Homo sapiens
ctgctgagagatgccaatctca

SEQ ID NO: 8187421 - DNA, 22 bp, Homo sapiens
ctgctgagactggctttgtgtc

SEQ ID NO: 8187422 - DNA, 22 bp, Homo sapiens
ctgctgagaaatgcatccagtt

SEQ ID NO: 8187423 - DNA, 22 bp, Homo sapiens
ctgctgagaaatgcatccagtt

SEQ ID NO: 8187424 - DNA, 22 bp, Homo sapiens
ctgctgagaaatgcatccagtt

SEQ ID NO: 8187425 - DNA, 22 bp, Homo sapiens
ctgctgagaaaagactgaggga

SEQ ID NO: 8187426 - DNA, 22 bp, Homo sapiens
ctgctgagaaaagactgaggga

SEQ ID NO: 8187427 - DNA, 22 bp, Homo sapiens
ctgctgagaaaagactgaggga

SEQ ID NO: 8187428 - DNA, 22 bp, Homo sapiens
tgggtaggtgctggggattcag

SEQ ID NO: 8187429 - DNA, 22 bp, Homo sapiens
tgggtaggtgctggggattcag

SEQ ID NO: 8187430 - DNA, 18 bp, Homo sapiens
cctgccagtctggagcag

SEQ ID NO: 8187431 - DNA, 18 bp, Homo sapiens
cctgccagtctggagcag

SEQ ID NO: 8187432 - DNA, 22 bp, Homo sapiens
tgggtcaaatggtaattctatg

SEQ ID NO: 8187433 - DNA, 22 bp, Homo sapiens
tgggtcaacctgataaaatgtg

SEQ ID NO: 8187434 - DNA, 22 bp, Homo sapiens
tgggtaggtgtggcctgaatgt

SEQ ID NO: 8187435 - DNA, 22 bp, Homo sapiens
tgggtagtttcccctgccctgc

SEQ ID NO: 8187436 - DNA, 22 bp, Homo sapiens
tgggtcagagcagacctctgga

SEQ ID NO: 8187437 - DNA, 22 bp, Homo sapiens
tgggtcagagcagacctctgga

SEQ ID NO: 8187438 - DNA, 22 bp, Homo sapiens
tgggtcagacagccagtgggcc

SEQ ID NO: 8187439 - DNA, 22 bp, Homo sapiens
tgggtcagagctgtgctgccca

SEQ ID NO: 8187440 - DNA, 22 bp, Homo sapiens
tgggtcagagctgtgctgccca

SEQ ID NO: 8187441 - DNA, 22 bp, Homo sapiens
tgggtcagaatcagagagttgc

SEQ ID NO: 8187442 - DNA, 22 bp, Homo sapiens
tgggtcagacagccagtgggcc

SEQ ID NO: 8187443 - DNA, 22 bp, Homo sapiens
tgggtcagaatcagagagttgc

SEQ ID NO: 8187444 - DNA, 22 bp, Homo sapiens
tgggtcagacagccagtgggcc

SEQ ID NO: 8187445 - DNA, 22 bp, Homo sapiens
tgggtcagacagccagtgggcc

SEQ ID NO: 8187446 - DNA, 22 bp, Homo sapiens
tgggtcagacagccagtgggcc

SEQ ID NO: 8187447 - DNA, 22 bp, Homo sapiens
cctgccagggccagaggccagc

SEQ ID NO: 8187448 - DNA, 22 bp, Homo sapiens
cctgccagggccttggaagaaa

SEQ ID NO: 8187449 - DNA, 22 bp, Homo sapiens
cctgccagggccttggaagaaa

SEQ ID NO: 8187450 - DNA, 22 bp, Homo sapiens
cctgccagggccttggaagaaa

SEQ ID NO: 8187451 - DNA, 18 bp, Homo sapiens
cctgccagtctggagcag

SEQ ID NO: 8187452 - DNA, 18 bp, Homo sapiens
cctgccagtctggagcag

SEQ ID NO: 8187453 - DNA, 22 bp, Homo sapiens
cctgccaggctttcaggtttgg

SEQ ID NO: 8187454 - DNA, 22 bp, Homo sapiens
cctgccaggctttcaggtttgg

SEQ ID NO: 8187455 - DNA, 22 bp, Homo sapiens
cctgccaggctttgggcttctg

SEQ ID NO: 8187456 - DNA, 22 bp, Homo sapiens
cctgccaggctttgggcttctg

SEQ ID NO: 8187457 - DNA, 22 bp, Homo sapiens
cctgccagggccagaggccagc

SEQ ID NO: 8187458 - DNA, 22 bp, Homo sapiens
cctgccaggcgagtctaggcca

SEQ ID NO: 8187459 - DNA, 22 bp, Homo sapiens
cctgccaggcgagtctaggcca

SEQ ID NO: 8187460 - DNA, 22 bp, Homo sapiens
cctgccaggcgagtctaggcca

SEQ ID NO: 8187461 - DNA, 22 bp, Homo sapiens
cctgccaggcgagtctaggcca

SEQ ID NO: 8187462 - DNA, 22 bp, Homo sapiens
cctgccaggccagtgagcttcc

SEQ ID NO: 8187463 - DNA, 22 bp, Homo sapiens
cctgccaggccagtgagcttcc

SEQ ID NO: 8187464 - DNA, 22 bp, Homo sapiens
cctgccaggcgagtctaggcca

SEQ ID NO: 8187465 - DNA, 22 bp, Homo sapiens
tgggtcagaggacctcgtggcc

SEQ ID NO: 8187466 - DNA, 22 bp, Homo sapiens
tgggtcagaggacctcgtggcc

SEQ ID NO: 8187467 - DNA, 22 bp, Homo sapiens
tgggtcagattgagcccctggt

SEQ ID NO: 8187468 - DNA, 23 bp, Homo sapiens
tgggtcagctgcctccaggacaa

SEQ ID NO: 8187469 - DNA, 23 bp, Homo sapiens
tgggtcagctgcctccaggacaa

SEQ ID NO: 8187470 - DNA, 22 bp, Homo sapiens
tgggtcagattgagcccctggt

SEQ ID NO: 8187471 - DNA, 20 bp, Homo sapiens
cctgcctgcctcggctcatt

SEQ ID NO: 8187472 - DNA, 22 bp, Homo sapiens
tgggtcagtttgggggccagcc

SEQ ID NO: 8187473 - DNA, 22 bp, Homo sapiens
tgggtcaggctgggagtcctga

SEQ ID NO: 8187474 - DNA, 22 bp, Homo sapiens
tgggtcaggctgggagtcctga

SEQ ID NO: 8187475 - DNA, 22 bp, Homo sapiens
tgggtcaggctgggagtcctga

SEQ ID NO: 8187476 - DNA, 22 bp, Homo sapiens
tgggtcaggctgggagtcctga

SEQ ID NO: 8187477 - DNA, 20 bp, Homo sapiens
cctgcctgcctcggctcatt

SEQ ID NO: 8187478 - DNA, 22 bp, Homo sapiens
cctgcctggcttccagaagaga

SEQ ID NO: 8187479 - DNA, 22 bp, Homo sapiens
tgggtcagtttgggggccagcc

SEQ ID NO: 8187480 - DNA, 22 bp, Homo sapiens
cctgcctggggacaaaggaggg

SEQ ID NO: 8187481 - DNA, 22 bp, Homo sapiens
cctgcctgggctcacttgccag

SEQ ID NO: 8187482 - DNA, 22 bp, Homo sapiens
cctgcctgggctcacttgccag

SEQ ID NO: 8187483 - DNA, 22 bp, Homo sapiens
cctgcctggtgtaagtctaagg

SEQ ID NO: 8187484 - DNA, 22 bp, Homo sapiens
cctgcctgtcatcgcctgcgcc

SEQ ID NO: 8187485 - DNA, 22 bp, Homo sapiens
cctgcctgtaagatgggtacaa

SEQ ID NO: 8187486 - DNA, 22 bp, Homo sapiens
cctgcctgtactagagacccag

SEQ ID NO: 8187487 - DNA, 22 bp, Homo sapiens
cctgcctgtactagagacccag

SEQ ID NO: 8187488 - DNA, 20 bp, Homo sapiens
cctgcctgtgtttgtgatga

SEQ ID NO: 8187489 - DNA, 23 bp, Homo sapiens
cctgcctgttctaactccatttc

SEQ ID NO: 8187490 - DNA, 23 bp, Homo sapiens
cctgcctgttctaactccatttc

SEQ ID NO: 8187491 - DNA, 22 bp, Homo sapiens
cctgcctgtctttatcccctgt

SEQ ID NO: 8187492 - DNA, 22 bp, Homo sapiens
cctgcctgtccctcagtccaca

SEQ ID NO: 8187493 - DNA, 22 bp, Homo sapiens
cctgcctgtctttatcccctgt

SEQ ID NO: 8187494 - DNA, 22 bp, Homo sapiens
cctgcctgtccctcagtccaca

SEQ ID NO: 8187495 - DNA, 22 bp, Homo sapiens
cctgcctgtccctcagtccaca

SEQ ID NO: 8187496 - DNA, 21 bp, Homo sapiens
cctgctgtgatcttagtgagt

SEQ ID NO: 8187497 - DNA, 22 bp, Homo sapiens
cctgctgtgaccggggagcagg

SEQ ID NO: 8187498 - DNA, 22 bp, Homo sapiens
cctgctgtgaagccaggcctgt

SEQ ID NO: 8187499 - DNA, 22 bp, Homo sapiens
cctgctgtgaagccaggcctgt

SEQ ID NO: 8187500 - DNA, 22 bp, Homo sapiens
cctgctgtgaagccaggcctgt

SEQ ID NO: 8187501 - DNA, 22 bp, Homo sapiens
cctgctgtccctctgggctcca

SEQ ID NO: 8187502 - DNA, 22 bp, Homo sapiens
cctgctgtctctgggcaggcag

SEQ ID NO: 8187503 - DNA, 22 bp, Homo sapiens
cctgctgtctctgggcaggcag

SEQ ID NO: 8187504 - DNA, 22 bp, Homo sapiens
cctgctgtgaaactggcatatg

SEQ ID NO: 8187505 - DNA, 22 bp, Homo sapiens
cctgctgtaatgtgtctttatt

SEQ ID NO: 8187506 - DNA, 22 bp, Homo sapiens
cctgctgtaccctactcggagt

SEQ ID NO: 8187507 - DNA, 22 bp, Homo sapiens
cctgctgtcccctgagcctgga

SEQ ID NO: 8187508 - DNA, 22 bp, Homo sapiens
cctgctgtcagcatcctcgcga

SEQ ID NO: 8187509 - DNA, 22 bp, Homo sapiens
cctgctggccagtggagggctg

SEQ ID NO: 8187510 - DNA, 22 bp, Homo sapiens
cctgctgggcctgagcaatgag

SEQ ID NO: 8187511 - DNA, 22 bp, Homo sapiens
tggtctggaactcctggcttca

SEQ ID NO: 8187512 - DNA, 17 bp, Homo sapiens
tggtctggaagaactga

SEQ ID NO: 8187513 - DNA, 17 bp, Homo sapiens
tggtctggaagaactga

SEQ ID NO: 8187514 - DNA, 22 bp, Homo sapiens
tggtctgctgaacagccgtatc

SEQ ID NO: 8187515 - DNA, 20 bp, Homo sapiens
tggtctggagccagtgagga

SEQ ID NO: 8187516 - DNA, 22 bp, Homo sapiens
tggtctggggaccgagggttac

SEQ ID NO: 8187517 - DNA, 22 bp, Homo sapiens
tggtctggttatttcttaatga

SEQ ID NO: 8187518 - DNA, 22 bp, Homo sapiens
tggtctggggaccgagggttac

SEQ ID NO: 8187519 - DNA, 22 bp, Homo sapiens
tggtctgggcaaatccttctga

SEQ ID NO: 8187520 - DNA, 22 bp, Homo sapiens
cctgctctaaatctcatggaac

SEQ ID NO: 8187521 - DNA, 22 bp, Homo sapiens
cctgctctaaatctcatggaac

SEQ ID NO: 8187522 - DNA, 22 bp, Homo sapiens
cctgctctaaatctcatggaac

SEQ ID NO: 8187523 - DNA, 22 bp, Homo sapiens
tggtcttaaaaacatcaaatgg

SEQ ID NO: 8187524 - DNA, 22 bp, Homo sapiens
tggtctcttcttccaagatggc

SEQ ID NO: 8187525 - DNA, 22 bp, Homo sapiens
tggtctcttcttccaagatggc

SEQ ID NO: 8187526 - DNA, 22 bp, Homo sapiens
tggtctcttttcagcctgggga

SEQ ID NO: 8187527 - DNA, 22 bp, Homo sapiens
tggtctcttttcagcctgggga

SEQ ID NO: 8187528 - DNA, 22 bp, Homo sapiens
tggtctgatggtcccaccaccg

SEQ ID NO: 8187529 - DNA, 22 bp, Homo sapiens
tggtctgaaggtggatttgaga

SEQ ID NO: 8187530 - DNA, 22 bp, Homo sapiens
tgtacagttttaactctgaggg

SEQ ID NO: 8187531 - DNA, 18 bp, Homo sapiens
tgtacagttatgagcatt

SEQ ID NO: 8187532 - DNA, 18 bp, Homo sapiens
tgtacagttatgagcatt

SEQ ID NO: 8187533 - DNA, 23 bp, Homo sapiens
tgtacagttgtttgactcagctc

SEQ ID NO: 8187534 - DNA, 22 bp, Homo sapiens
tgtacagtgtaaataagtggat

SEQ ID NO: 8187535 - DNA, 22 bp, Homo sapiens
tgtacagtgtagtcatgaggtt

SEQ ID NO: 8187536 - DNA, 22 bp, Homo sapiens
tgtacagtgccatgcagtttgc

SEQ ID NO: 8187537 - DNA, 22 bp, Homo sapiens
tgtacagtgccatgcagtttgc

SEQ ID NO: 8187538 - DNA, 22 bp, Homo sapiens
tgtacagtggaaaatggattcg

SEQ ID NO: 8187539 - DNA, 22 bp, Homo sapiens
tgtaatttgcatggctgaatgc

SEQ ID NO: 8187540 - DNA, 22 bp, Homo sapiens
tgtaatgttagaaacaattgct

SEQ ID NO: 8187541 - DNA, 22 bp, Homo sapiens
cctggagcactctccctggctg

SEQ ID NO: 8187542 - DNA, 22 bp, Homo sapiens
cctggagcacatggcaggaggc

SEQ ID NO: 8187543 - DNA, 22 bp, Homo sapiens
tgtacattttctcagagtttat

SEQ ID NO: 8187544 - DNA, 22 bp, Homo sapiens
tgtacattgtcactcatcaagt

SEQ ID NO: 8187545 - DNA, 22 bp, Homo sapiens
tgtacattgtcactcatcaagt

SEQ ID NO: 8187546 - DNA, 22 bp, Homo sapiens
tgtacatgaataaaagatcttg

SEQ ID NO: 8187547 - DNA, 22 bp, Homo sapiens
tgtacatgtgtctgtatatctt

SEQ ID NO: 8187548 - DNA, 22 bp, Homo sapiens
tgtacatttagagctcaataga

SEQ ID NO: 8187549 - DNA, 22 bp, Homo sapiens
tgtacattttctcagagtttat

SEQ ID NO: 8187550 - DNA, 22 bp, Homo sapiens
tgtacatacatagatatacaca

SEQ ID NO: 8187551 - DNA, 22 bp, Homo sapiens
tgtacatacatagatatacaca

SEQ ID NO: 8187552 - DNA, 22 bp, Homo sapiens
tgtacatacatagatatacaca

SEQ ID NO: 8187553 - DNA, 22 bp, Homo sapiens
tgtacatagaaaggatacagct

SEQ ID NO: 8187554 - DNA, 22 bp, Homo sapiens
tgtacatattcaagcacttcta

SEQ ID NO: 8187555 - DNA, 19 bp, Homo sapiens
tgtacatatagagctcagt

SEQ ID NO: 8187556 - DNA, 22 bp, Homo sapiens
tgtacatagatcttgaaaatta

SEQ ID NO: 8187557 - DNA, 19 bp, Homo sapiens
tgtacatatagagctcagt

SEQ ID NO: 8187558 - DNA, 22 bp, Homo sapiens
tgtaatgagaaagagagtgaat

SEQ ID NO: 8187559 - DNA, 22 bp, Homo sapiens
tgtaatgatgtacttagaagga

SEQ ID NO: 8187560 - DNA, 22 bp, Homo sapiens
tgtaatcattacagtacatgga

SEQ ID NO: 8187561 - DNA, 22 bp, Homo sapiens
tgtaataatgaggcatccagcc

SEQ ID NO: 8187562 - DNA, 21 bp, Homo sapiens
tgtaagtttcatctgaattgg

SEQ ID NO: 8187563 - DNA, 21 bp, Homo sapiens
tgtaagtttcatctgaattgg

SEQ ID NO: 8187564 - DNA, 22 bp, Homo sapiens
tgtaagtagtaatggaaggaca

SEQ ID NO: 8187565 - DNA, 22 bp, Homo sapiens
tgtaagtagtaatggaaggaca

SEQ ID NO: 8187566 - DNA, 21 bp, Homo sapiens
tgtaagtttcatctgaattgg

SEQ ID NO: 8187567 - DNA, 22 bp, Homo sapiens
tgtaaagaaatagcatttgtag

SEQ ID NO: 8187568 - DNA, 22 bp, Homo sapiens
tgtaagtagtaatggaaggaca

SEQ ID NO: 8187569 - DNA, 22 bp, Homo sapiens
cctgcttcagggatgatggcac

SEQ ID NO: 8187570 - DNA, 22 bp, Homo sapiens
cctgctttgagatgggcagcag

SEQ ID NO: 8187571 - DNA, 22 bp, Homo sapiens
cctgctttgagatgggcagcag

SEQ ID NO: 8187572 - DNA, 22 bp, Homo sapiens
cctgctttggcaggcagctcct

SEQ ID NO: 8187573 - DNA, 22 bp, Homo sapiens
cctgctttggcaggcagctcct

SEQ ID NO: 8187574 - DNA, 22 bp, Homo sapiens
cctgctttgctggtaccatcag

SEQ ID NO: 8187575 - DNA, 22 bp, Homo sapiens
cctggaaaacatgggaatcaca

SEQ ID NO: 8187576 - DNA, 22 bp, Homo sapiens
cctgctgttttcttcacttcag

SEQ ID NO: 8187577 - DNA, 22 bp, Homo sapiens
cctgcttcagggatgatggcac

SEQ ID NO: 8187578 - DNA, 20 bp, Homo sapiens
cctgctgtgctttccatgga

SEQ ID NO: 8187579 - DNA, 20 bp, Homo sapiens
cctgctgtgctttccatgga

SEQ ID NO: 8187580 - DNA, 22 bp, Homo sapiens
cctgctgtgtccctggctttct

SEQ ID NO: 8187581 - DNA, 22 bp, Homo sapiens
cctgctgttctgtttagtgaac

SEQ ID NO: 8187582 - DNA, 22 bp, Homo sapiens
cctggagcttttccagttgaca

SEQ ID NO: 8187583 - DNA, 22 bp, Homo sapiens
cctggagcttttccagttgaca

SEQ ID NO: 8187584 - DNA, 22 bp, Homo sapiens
cctggagcttggtcacgctgcg

SEQ ID NO: 8187585 - DNA, 22 bp, Homo sapiens
cctggagcttggtcacgctgcg

SEQ ID NO: 8187586 - DNA, 22 bp, Homo sapiens
cctggagcttggtcacgctgcg

SEQ ID NO: 8187587 - DNA, 22 bp, Homo sapiens
cctggagcttggtcacgctgcg

SEQ ID NO: 8187588 - DNA, 18 bp, Homo sapiens
cctggagctccacagcaa

SEQ ID NO: 8187589 - DNA, 18 bp, Homo sapiens
cctggagctccacagcaa

SEQ ID NO: 8187590 - DNA, 18 bp, Homo sapiens
cctggagctccacagcaa

SEQ ID NO: 8187591 - DNA, 22 bp, Homo sapiens
cctggagcttttccatcctgga

SEQ ID NO: 8187592 - DNA, 22 bp, Homo sapiens
cctggagcttttccatcctgga

SEQ ID NO: 8187593 - DNA, 22 bp, Homo sapiens
cctggagcttttccatcctgga

SEQ ID NO: 8187594 - DNA, 22 bp, Homo sapiens
cctggagcttttccagttgaca

SEQ ID NO: 8187595 - DNA, 22 bp, Homo sapiens
cctggagcttttccatcctgga

SEQ ID NO: 8187596 - DNA, 22 bp, Homo sapiens
cctggagcttttccatcctgga

SEQ ID NO: 8187597 - DNA, 22 bp, Homo sapiens
cctggaggagcgctgaccagct

SEQ ID NO: 8187598 - DNA, 22 bp, Homo sapiens
cctggaggagcgctgaccagct

SEQ ID NO: 8187599 - DNA, 22 bp, Homo sapiens
cctggaggagcgctgaccagct

SEQ ID NO: 8187600 - DNA, 22 bp, Homo sapiens
cctggaggagcgctgaccagct

SEQ ID NO: 8187601 - DNA, 22 bp, Homo sapiens
cctggaggagcgctgaccagct

SEQ ID NO: 8187602 - DNA, 22 bp, Homo sapiens
cctggagggaccctggccctgt

SEQ ID NO: 8187603 - DNA, 22 bp, Homo sapiens
cctggagggaccctggccctgt

SEQ ID NO: 8187604 - DNA, 22 bp, Homo sapiens
cctggagggaccctggccctgt

SEQ ID NO: 8187605 - DNA, 22 bp, Homo sapiens
cctggagggaccctggccctgt

SEQ ID NO: 8187606 - DNA, 22 bp, Homo sapiens
cctggagggcgccgcacagtcc

SEQ ID NO: 8187607 - DNA, 22 bp, Homo sapiens
cctggagggcagcccattctgg

SEQ ID NO: 8187608 - DNA, 22 bp, Homo sapiens
cctggagggcgccgcacagtcc

SEQ ID NO: 8187609 - DNA, 22 bp, Homo sapiens
cctggagggcgccgcacagtcc

SEQ ID NO: 8187610 - DNA, 22 bp, Homo sapiens
cctggaggcggaggttgcagtg

SEQ ID NO: 8187611 - DNA, 22 bp, Homo sapiens
cctggaggctctgggagggcag

SEQ ID NO: 8187612 - DNA, 22 bp, Homo sapiens
cctggaggctctgggagggcag

SEQ ID NO: 8187613 - DNA, 22 bp, Homo sapiens
cctggaggctctgggagggcag

SEQ ID NO: 8187614 - DNA, 22 bp, Homo sapiens
cctggaggctctgggagggcag

SEQ ID NO: 8187615 - DNA, 22 bp, Homo sapiens
cctggaggagcgctgaccagct

SEQ ID NO: 8187616 - DNA, 22 bp, Homo sapiens
cctggaggcagaaataggactt

SEQ ID NO: 8187617 - DNA, 22 bp, Homo sapiens
cctggaggcggaggttgcagtg

SEQ ID NO: 8187618 - DNA, 22 bp, Homo sapiens
cctggaggcggaggttgcagtg

SEQ ID NO: 8187619 - DNA, 19 bp, Homo sapiens
cctggaggtgaaggttctc

SEQ ID NO: 8187620 - DNA, 19 bp, Homo sapiens
cctggaggtgaaggttctc

SEQ ID NO: 8187621 - DNA, 18 bp, Homo sapiens
cctggaggtcttcggggt

SEQ ID NO: 8187622 - DNA, 18 bp, Homo sapiens
cctggaggtcttcggggt

SEQ ID NO: 8187623 - DNA, 18 bp, Homo sapiens
cctggaggtcttcggggt

SEQ ID NO: 8187624 - DNA, 16 bp, Homo sapiens
cctggaggtcacttca

SEQ ID NO: 8187625 - DNA, 22 bp, Homo sapiens
cctggagggcgccgcacagtcc

SEQ ID NO: 8187626 - DNA, 22 bp, Homo sapiens
cctggaggggaccaggaccagg

SEQ ID NO: 8187627 - DNA, 22 bp, Homo sapiens
cctggaggggaccaggaccagg

SEQ ID NO: 8187628 - DNA, 22 bp, Homo sapiens
cctggaggggaccaggaccagg

SEQ ID NO: 8187629 - DNA, 22 bp, Homo sapiens
tgtcaaatagtagaaagatggc

SEQ ID NO: 8187630 - DNA, 22 bp, Homo sapiens
tgtcaaatttttattgcagtat

SEQ ID NO: 8187631 - DNA, 19 bp, Homo sapiens
cctggaggtgaaggttctc

SEQ ID NO: 8187632 - DNA, 19 bp, Homo sapiens
cctggaggtgaaggttctc

SEQ ID NO: 8187633 - DNA, 22 bp, Homo sapiens
tgtcaaccaggtattttggtct

SEQ ID NO: 8187634 - DNA, 22 bp, Homo sapiens
tgtcaaccacttcattatgaga

SEQ ID NO: 8187635 - DNA, 22 bp, Homo sapiens
tgtcaacagatactagagagct

SEQ ID NO: 8187636 - DNA, 22 bp, Homo sapiens
tgtcaagagtgcacacatctgc

SEQ ID NO: 8187637 - DNA, 22 bp, Homo sapiens
tgtcaactttgaaccaaatgct

SEQ ID NO: 8187638 - DNA, 22 bp, Homo sapiens
tgtcaactgtgatgtcaacact

SEQ ID NO: 8187639 - DNA, 22 bp, Homo sapiens
tgtcaactgtgatgtcaacact

SEQ ID NO: 8187640 - DNA, 23 bp, Homo sapiens
tgtcaagtatagcaggccctccc

SEQ ID NO: 8187641 - DNA, 22 bp, Homo sapiens
tgtcaaggacgtgcatgaaccc

SEQ ID NO: 8187642 - DNA, 22 bp, Homo sapiens
tgtcaataacatttacttctat

SEQ ID NO: 8187643 - DNA, 22 bp, Homo sapiens
tgtcaagttgtggcatgtctaa

SEQ ID NO: 8187644 - DNA, 22 bp, Homo sapiens
tgtcaagtgattagccataatg

SEQ ID NO: 8187645 - DNA, 22 bp, Homo sapiens
tgtcaagtctagttgctggctt

SEQ ID NO: 8187646 - DNA, 22 bp, Homo sapiens
tgtcaagtctctgaatgaaatg

SEQ ID NO: 8187647 - DNA, 22 bp, Homo sapiens
tggggtacacgtggggcaggat

SEQ ID NO: 8187648 - DNA, 22 bp, Homo sapiens
tggggtacttgtatcaaagcac

SEQ ID NO: 8187649 - DNA, 22 bp, Homo sapiens
tggggtacttgtatcaaagcac

SEQ ID NO: 8187650 - DNA, 22 bp, Homo sapiens
tggggtacttgtatcaaagcac

SEQ ID NO: 8187651 - DNA, 22 bp, Homo sapiens
tggggtaggagtcagcgagaga

SEQ ID NO: 8187652 - DNA, 22 bp, Homo sapiens
tggggtaggagtcagcgagaga

SEQ ID NO: 8187653 - DNA, 22 bp, Homo sapiens
tggggtaggagtcagcgagaga

SEQ ID NO: 8187654 - DNA, 22 bp, Homo sapiens
tggggtaggagtcagcgagaga

SEQ ID NO: 8187655 - DNA, 22 bp, Homo sapiens
tgggggtgtcctggtgcacaca

SEQ ID NO: 8187656 - DNA, 22 bp, Homo sapiens
tggggtaggtatgaaaactagg

SEQ ID NO: 8187657 - DNA, 19 bp, Homo sapiens
tggggtcaagagaggcttc

SEQ ID NO: 8187658 - DNA, 22 bp, Homo sapiens
tggggtaggtatgaaaactagg

SEQ ID NO: 8187659 - DNA, 22 bp, Homo sapiens
tggggtagggaaaagaagtcga

SEQ ID NO: 8187660 - DNA, 22 bp, Homo sapiens
tggggtagggaaaagaagtcga

SEQ ID NO: 8187661 - DNA, 22 bp, Homo sapiens
tggggtagggaaaagaagtcga

SEQ ID NO: 8187662 - DNA, 22 bp, Homo sapiens
tggggtcagcaggcctggcctg

SEQ ID NO: 8187663 - DNA, 22 bp, Homo sapiens
tgggggtgtcctggtgcacaca

SEQ ID NO: 8187664 - DNA, 22 bp, Homo sapiens
tgggggtggttcttgcctccag

SEQ ID NO: 8187665 - DNA, 22 bp, Homo sapiens
tgggggtgtcctggtgcacaca

SEQ ID NO: 8187666 - DNA, 22 bp, Homo sapiens
cctgaggtcatggtccagtgtt

SEQ ID NO: 8187667 - DNA, 22 bp, Homo sapiens
tgggggagagaggcattctttc

SEQ ID NO: 8187668 - DNA, 22 bp, Homo sapiens
tgggggagagaggcattctttc

SEQ ID NO: 8187669 - DNA, 22 bp, Homo sapiens
tgggggtggttcttgcctccag

SEQ ID NO: 8187670 - DNA, 22 bp, Homo sapiens
tgggggagagaggcattctttc

SEQ ID NO: 8187671 - DNA, 22 bp, Homo sapiens
cctgaggtcacaacttgcttat

SEQ ID NO: 8187672 - DNA, 22 bp, Homo sapiens
cctgaggtcacaacttgcttat

SEQ ID NO: 8187673 - DNA, 22 bp, Homo sapiens
cctgagggtcaaggagccctag

SEQ ID NO: 8187674 - DNA, 22 bp, Homo sapiens
cctgagggtcaaggagccctag

SEQ ID NO: 8187675 - DNA, 22 bp, Homo sapiens
cctgaggtcacaacttgcttat

SEQ ID NO: 8187676 - DNA, 22 bp, Homo sapiens
cctgaggtcagccattcttgcc

SEQ ID NO: 8187677 - DNA, 22 bp, Homo sapiens
cctgaggtcagccattcttgcc

SEQ ID NO: 8187678 - DNA, 22 bp, Homo sapiens
cctgaggtcagccattcttgcc

SEQ ID NO: 8187679 - DNA, 22 bp, Homo sapiens
cctgaggtcatggtccagtgtt

SEQ ID NO: 8187680 - DNA, 22 bp, Homo sapiens
cctgaggtcatgcatttccaac

SEQ ID NO: 8187681 - DNA, 22 bp, Homo sapiens
cctgaggtcagcggttcccaca

SEQ ID NO: 8187682 - DNA, 22 bp, Homo sapiens
cctgaggtcagcggttcccaca

SEQ ID NO: 8187683 - DNA, 22 bp, Homo sapiens
cctgcacctgccatgtgagata

SEQ ID NO: 8187684 - DNA, 22 bp, Homo sapiens
cctgcacctctgtgcttggaac

SEQ ID NO: 8187685 - DNA, 22 bp, Homo sapiens
cctgcacctgagcagcctgact

SEQ ID NO: 8187686 - DNA, 22 bp, Homo sapiens
cctgcagaagagtccagctcat

SEQ ID NO: 8187687 - DNA, 22 bp, Homo sapiens
cctgcacttctcacagctgctg

SEQ ID NO: 8187688 - DNA, 22 bp, Homo sapiens
cctgcactacctggggctgctg

SEQ ID NO: 8187689 - DNA, 22 bp, Homo sapiens
cctgccaggccagtgagcttcc

SEQ ID NO: 8187690 - DNA, 22 bp, Homo sapiens
cctgccaggagctggtgctgca

SEQ ID NO: 8187691 - DNA, 22 bp, Homo sapiens
cctgccaggagctggtgctgca

SEQ ID NO: 8187692 - DNA, 22 bp, Homo sapiens
cctgccagagcagcttgtcctc

SEQ ID NO: 8187693 - DNA, 22 bp, Homo sapiens
cctgccagagcagcttgtcctc

SEQ ID NO: 8187694 - DNA, 22 bp, Homo sapiens
cctgccagacgcaccagggggc

SEQ ID NO: 8187695 - DNA, 22 bp, Homo sapiens
cctgcagacacttgtccagcaa

SEQ ID NO: 8187696 - DNA, 22 bp, Homo sapiens
cctgccagacgcaccagggggc

SEQ ID NO: 8187697 - DNA, 22 bp, Homo sapiens
cctgcagaagagtccagctcat

SEQ ID NO: 8187698 - DNA, 22 bp, Homo sapiens
cctgccagacgcaccagggggc

SEQ ID NO: 8187699 - DNA, 22 bp, Homo sapiens
cctgcacataggcttttcagaa

SEQ ID NO: 8187700 - DNA, 22 bp, Homo sapiens
cctgcaagagcggagaagccag

SEQ ID NO: 8187701 - DNA, 23 bp, Homo sapiens
cctgcaaagaaacaagccacctg

SEQ ID NO: 8187702 - DNA, 22 bp, Homo sapiens
cctgattctgccactactagcc

SEQ ID NO: 8187703 - DNA, 22 bp, Homo sapiens
cctgcaagactatttagttcca

SEQ ID NO: 8187704 - DNA, 22 bp, Homo sapiens
cctgcaagacctgagacacacc

SEQ ID NO: 8187705 - DNA, 22 bp, Homo sapiens
tggggtcctctcacttggaggg

SEQ ID NO: 8187706 - DNA, 22 bp, Homo sapiens
cctgattctgatgcctcatgga

SEQ ID NO: 8187707 - DNA, 22 bp, Homo sapiens
cctgattcagtggtgcccagag

SEQ ID NO: 8187708 - DNA, 22 bp, Homo sapiens
cctgatggctgtctgggcctga

SEQ ID NO: 8187709 - DNA, 22 bp, Homo sapiens
cctgatggtatattgttgggag

SEQ ID NO: 8187710 - DNA, 22 bp, Homo sapiens
cctgattagggtctttcaaatg

SEQ ID NO: 8187711 - DNA, 22 bp, Homo sapiens
cctgaggcttaatctgtcccaa

SEQ ID NO: 8187712 - DNA, 22 bp, Homo sapiens
cctgaggcttgggagttccgcc

SEQ ID NO: 8187713 - DNA, 22 bp, Homo sapiens
cctgaggcttgggagttccgcc

SEQ ID NO: 8187714 - DNA, 22 bp, Homo sapiens
cctgaggcttaatctgtcccaa

SEQ ID NO: 8187715 - DNA, 22 bp, Homo sapiens
cctgaggcttaatctgtcccaa

SEQ ID NO: 8187716 - DNA, 22 bp, Homo sapiens
cctgaggcttaatctgtcccaa

SEQ ID NO: 8187717 - DNA, 22 bp, Homo sapiens
cctgagggagggtataggctgt

SEQ ID NO: 8187718 - DNA, 22 bp, Homo sapiens
cctgagggaaggatgctaccca

SEQ ID NO: 8187719 - DNA, 22 bp, Homo sapiens
cctgagggaacatgcacccaat

SEQ ID NO: 8187720 - DNA, 22 bp, Homo sapiens
cctgaggcttgggagttccgcc

SEQ ID NO: 8187721 - DNA, 22 bp, Homo sapiens
cctgagggaacatgcacccaat

SEQ ID NO: 8187722 - DNA, 22 bp, Homo sapiens
cctgagggtcaaggagccctag

SEQ ID NO: 8187723 - DNA, 22 bp, Homo sapiens
cctgaggggctgcaggccagct

SEQ ID NO: 8187724 - DNA, 22 bp, Homo sapiens
cctgaggggctgcaggccagct

SEQ ID NO: 8187725 - DNA, 22 bp, Homo sapiens
cctgaggggaagcttcccaaga

SEQ ID NO: 8187726 - DNA, 22 bp, Homo sapiens
cctgagggctcagcccccagcc

SEQ ID NO: 8187727 - DNA, 22 bp, Homo sapiens
cctgagggcgccgagctcccag

SEQ ID NO: 8187728 - DNA, 22 bp, Homo sapiens
cctgaggctcgcgcgcccctgg

SEQ ID NO: 8187729 - DNA, 22 bp, Homo sapiens
cctgaggctccacctccagaga

SEQ ID NO: 8187730 - DNA, 22 bp, Homo sapiens
cctgaggctctcctgaataatg

SEQ ID NO: 8187731 - DNA, 22 bp, Homo sapiens
cctgaggctctcctgaataatg

SEQ ID NO: 8187732 - DNA, 22 bp, Homo sapiens
cctgaggctctcctgaataatg

SEQ ID NO: 8187733 - DNA, 22 bp, Homo sapiens
cctgaggctcgcgcgcccctgg

SEQ ID NO: 8187734 - DNA, 22 bp, Homo sapiens
cctgaggctggcccttccatcc

SEQ ID NO: 8187735 - DNA, 22 bp, Homo sapiens
cctgaggctggcccttccatcc

SEQ ID NO: 8187736 - DNA, 22 bp, Homo sapiens
cctgaggctggcccttccatcc

SEQ ID NO: 8187737 - DNA, 22 bp, Homo sapiens
cctgaggccctggctgtgctga

SEQ ID NO: 8187738 - DNA, 22 bp, Homo sapiens
cctgaggccctggctgtgctga

SEQ ID NO: 8187739 - DNA, 22 bp, Homo sapiens
cctgagctggcagtgacctgga

SEQ ID NO: 8187740 - DNA, 22 bp, Homo sapiens
cctgagctggcagtgacctgga

SEQ ID NO: 8187741 - DNA, 22 bp, Homo sapiens
cctgagcttgatccttctgtct

SEQ ID NO: 8187742 - DNA, 22 bp, Homo sapiens
cctgaggctccacctccagaga

SEQ ID NO: 8187743 - DNA, 22 bp, Homo sapiens
cctgaggctccacctccagaga

SEQ ID NO: 8187744 - DNA, 22 bp, Homo sapiens
cctgaggctccacctccagaga

SEQ ID NO: 8187745 - DNA, 22 bp, Homo sapiens
cctgaccctccttagagtccag

SEQ ID NO: 8187746 - DNA, 21 bp, Homo sapiens
cctgaccattcagcttgtctt

SEQ ID NO: 8187747 - DNA, 22 bp, Homo sapiens
cctgaccatttgccacatgggt

SEQ ID NO: 8187748 - DNA, 22 bp, Homo sapiens
cctgacaggagaagcgcagcat

SEQ ID NO: 8187749 - DNA, 22 bp, Homo sapiens
cctgacaggagaagcgcagcat

SEQ ID NO: 8187750 - DNA, 22 bp, Homo sapiens
cctgaatgctggttcctctcct

SEQ ID NO: 8187751 - DNA, 22 bp, Homo sapiens
cctgaatggtctccaaatagat

SEQ ID NO: 8187752 - DNA, 19 bp, Homo sapiens
cctgaccacacaggccttg

SEQ ID NO: 8187753 - DNA, 21 bp, Homo sapiens
cctgaccaatacttgatcaaa

SEQ ID NO: 8187754 - DNA, 22 bp, Homo sapiens
cctgacagttaattgtcctgta

SEQ ID NO: 8187755 - DNA, 22 bp, Homo sapiens
cctgacagttaattgtcctgta

SEQ ID NO: 8187756 - DNA, 22 bp, Homo sapiens
cctgacagtggtagccttggca

SEQ ID NO: 8187757 - DNA, 22 bp, Homo sapiens
cctgacaggcggaggctgcagt

SEQ ID NO: 8187758 - DNA, 22 bp, Homo sapiens
cctgacagtccttttctagtgt

SEQ ID NO: 8187759 - DNA, 22 bp, Homo sapiens
cctgagacatgaaccaggctcc

SEQ ID NO: 8187760 - DNA, 22 bp, Homo sapiens
cctgagaatgtttaacagagaa

SEQ ID NO: 8187761 - DNA, 22 bp, Homo sapiens
cctgagaagagcttatgagtga

SEQ ID NO: 8187762 - DNA, 22 bp, Homo sapiens
cctgactcctgggcaaaaccaa

SEQ ID NO: 8187763 - DNA, 22 bp, Homo sapiens
cctgactctggccaggccagct

SEQ ID NO: 8187764 - DNA, 22 bp, Homo sapiens
cctgactctggccaggccagct

SEQ ID NO: 8187765 - DNA, 22 bp, Homo sapiens
cctgagaaacctggtgcaatta

SEQ ID NO: 8187766 - DNA, 22 bp, Homo sapiens
cctgacttaagtctcctgttgg

SEQ ID NO: 8187767 - DNA, 22 bp, Homo sapiens
cctgagaaacctggtgcaatta

SEQ ID NO: 8187768 - DNA, 22 bp, Homo sapiens
tgggccagaggcatggagctat

SEQ ID NO: 8187769 - DNA, 22 bp, Homo sapiens
tgggccagatccatggcaataa

SEQ ID NO: 8187770 - DNA, 22 bp, Homo sapiens
tgggccagaggcatggagctat

SEQ ID NO: 8187771 - DNA, 22 bp, Homo sapiens
tgggccagatccatggcaataa

SEQ ID NO: 8187772 - DNA, 21 bp, Homo sapiens
tgggccagatctgagtttcta

SEQ ID NO: 8187773 - DNA, 22 bp, Homo sapiens
tgggccagatccatggcaataa

SEQ ID NO: 8187774 - DNA, 21 bp, Homo sapiens
tgggccagatctgagtttcta

SEQ ID NO: 8187775 - DNA, 22 bp, Homo sapiens
tgggccagaagtatgcatgttt

SEQ ID NO: 8187776 - DNA, 22 bp, Homo sapiens
tgggccagaagtatgcatgttt

SEQ ID NO: 8187777 - DNA, 22 bp, Homo sapiens
tgggccagaggcatggagctat

SEQ ID NO: 8187778 - DNA, 22 bp, Homo sapiens
tgggccagagagtaagaaaggt

SEQ ID NO: 8187779 - DNA, 22 bp, Homo sapiens
tgggccacgtgacccttaccct

SEQ ID NO: 8187780 - DNA, 22 bp, Homo sapiens
tgggcagggagctggaaccaca

SEQ ID NO: 8187781 - DNA, 22 bp, Homo sapiens
tgggcagggagctggaaccaca

SEQ ID NO: 8187782 - DNA, 22 bp, Homo sapiens
tgggcagggagctggaaccaca

SEQ ID NO: 8187783 - DNA, 22 bp, Homo sapiens
cctctggcctaggccgggagag

SEQ ID NO: 8187784 - DNA, 22 bp, Homo sapiens
cctctggccagagaaaggccag

SEQ ID NO: 8187785 - DNA, 22 bp, Homo sapiens
cctctggccacatgggacatag

SEQ ID NO: 8187786 - DNA, 22 bp, Homo sapiens
cctgaagcaagggtaggcaggt

SEQ ID NO: 8187787 - DNA, 22 bp, Homo sapiens
cctgaaaatcaaggtagtttgg

SEQ ID NO: 8187788 - DNA, 22 bp, Homo sapiens
cctctttgttcaggctgctggc

SEQ ID NO: 8187789 - DNA, 22 bp, Homo sapiens
cctctttgtgcctgcaggctgc

SEQ ID NO: 8187790 - DNA, 22 bp, Homo sapiens
cctctttgtgcctgcaggctgc

SEQ ID NO: 8187791 - DNA, 22 bp, Homo sapiens
cctgaatactggtgctgaaagt

SEQ ID NO: 8187792 - DNA, 22 bp, Homo sapiens
cctgaataatttgtgaaaagat

SEQ ID NO: 8187793 - DNA, 22 bp, Homo sapiens
cctgaataggctctgctcaaaa

SEQ ID NO: 8187794 - DNA, 22 bp, Homo sapiens
cctgaataggctctgctcaaaa

SEQ ID NO: 8187795 - DNA, 22 bp, Homo sapiens
cctgaatgcctgacatttcact

SEQ ID NO: 8187796 - DNA, 22 bp, Homo sapiens
cctgaagctcttaagaccttta

SEQ ID NO: 8187797 - DNA, 17 bp, Homo sapiens
cctgaaggcacttccag

SEQ ID NO: 8187798 - DNA, 22 bp, Homo sapiens
cctgaagggactccagagagca

SEQ ID NO: 8187799 - DNA, 22 bp, Homo sapiens
cctcttctgcttcaggagcact

SEQ ID NO: 8187800 - DNA, 22 bp, Homo sapiens
tgggccagcaattgctgctcag

SEQ ID NO: 8187801 - DNA, 22 bp, Homo sapiens
cctcttctgagtgagactccct

SEQ ID NO: 8187802 - DNA, 22 bp, Homo sapiens
cctcttgacagcctctgtttcc

SEQ ID NO: 8187803 - DNA, 22 bp, Homo sapiens
cctcttctgcttcaggagcact

SEQ ID NO: 8187804 - DNA, 22 bp, Homo sapiens
cctcttgaacctaggcaagact

SEQ ID NO: 8187805 - DNA, 20 bp, Homo sapiens
cctcttgcaaaagagatgac

SEQ ID NO: 8187806 - DNA, 22 bp, Homo sapiens
cctcttgccaatcagctacaga

SEQ ID NO: 8187807 - DNA, 22 bp, Homo sapiens
cctcttgccaatcagctacaga

SEQ ID NO: 8187808 - DNA, 22 bp, Homo sapiens
cctctttgactctcaggtcttt

SEQ ID NO: 8187809 - DNA, 22 bp, Homo sapiens
cctctttgactctcaggtcttt

SEQ ID NO: 8187810 - DNA, 22 bp, Homo sapiens
cctctttaatcccatccatgtg

SEQ ID NO: 8187811 - DNA, 22 bp, Homo sapiens
cctctttgacaagtacctgccc

SEQ ID NO: 8187812 - DNA, 22 bp, Homo sapiens
cctcttgagaggcactcaggtt

SEQ ID NO: 8187813 - DNA, 22 bp, Homo sapiens
cctcttgagtgtctgttttcca

SEQ ID NO: 8187814 - DNA, 22 bp, Homo sapiens
tggctctgaccaggtagaggag

SEQ ID NO: 8187815 - DNA, 21 bp, Homo sapiens
tggctctgaaagagtgctgca

SEQ ID NO: 8187816 - DNA, 21 bp, Homo sapiens
tggctctgaaagagtgctgca

SEQ ID NO: 8187817 - DNA, 21 bp, Homo sapiens
tggctctgaaagagtgctgca

SEQ ID NO: 8187818 - DNA, 21 bp, Homo sapiens
tggctctgaaagagtgctgca

SEQ ID NO: 8187819 - DNA, 22 bp, Homo sapiens
tggctctcttgtaaggtagtag

SEQ ID NO: 8187820 - DNA, 22 bp, Homo sapiens
tggctctcttgtaaggtagtag

SEQ ID NO: 8187821 - DNA, 22 bp, Homo sapiens
tggctctctgggaggtcctggc

SEQ ID NO: 8187822 - DNA, 21 bp, Homo sapiens
tgggagagcgttgctgtcctc

SEQ ID NO: 8187823 - DNA, 22 bp, Homo sapiens
tggctctgaccaggtagaggag

SEQ ID NO: 8187824 - DNA, 21 bp, Homo sapiens
tgggagagcgttgctgtcctc

SEQ ID NO: 8187825 - DNA, 22 bp, Homo sapiens
tggctctgaccaggtagaggag

SEQ ID NO: 8187826 - DNA, 22 bp, Homo sapiens
tgggagcaggtgtgctagggaa

SEQ ID NO: 8187827 - DNA, 22 bp, Homo sapiens
tgggagcaggctgatgataggt

SEQ ID NO: 8187828 - DNA, 22 bp, Homo sapiens
tgggagcaggaagcaggaagta

SEQ ID NO: 8187829 - DNA, 22 bp, Homo sapiens
cctccctgccggctggactagt

SEQ ID NO: 8187830 - DNA, 22 bp, Homo sapiens
cctccctctttcagtcccacag

SEQ ID NO: 8187831 - DNA, 22 bp, Homo sapiens
cctccctgcgctcctgcggcgg

SEQ ID NO: 8187832 - DNA, 22 bp, Homo sapiens
cctccctgcgctcctgcggcgg

SEQ ID NO: 8187833 - DNA, 22 bp, Homo sapiens
cctccctgctcctcaactggca

SEQ ID NO: 8187834 - DNA, 22 bp, Homo sapiens
cctccctgctcctcaactggca

SEQ ID NO: 8187835 - DNA, 22 bp, Homo sapiens
cctccctgcgctcctgcggcgg

SEQ ID NO: 8187836 - DNA, 22 bp, Homo sapiens
tggctctcagctcccagcagcc

SEQ ID NO: 8187837 - DNA, 22 bp, Homo sapiens
tggctctcaggcctgctgcgtt

SEQ ID NO: 8187838 - DNA, 22 bp, Homo sapiens
tggctctcaggcctgctgcgtt

SEQ ID NO: 8187839 - DNA, 22 bp, Homo sapiens
tggctctccagagcctatggta

SEQ ID NO: 8187840 - DNA, 22 bp, Homo sapiens
tggctctccagctctaaggcct

SEQ ID NO: 8187841 - DNA, 23 bp, Homo sapiens
tggctctctcagtgctgcagagg

SEQ ID NO: 8187842 - DNA, 20 bp, Homo sapiens
tggctctctctagtaagtgg

SEQ ID NO: 8187843 - DNA, 22 bp, Homo sapiens
tggctctctacaggtcaagacc

SEQ ID NO: 8187844 - DNA, 22 bp, Homo sapiens
cctctggcaacttcacagccca

SEQ ID NO: 8187845 - DNA, 22 bp, Homo sapiens
cctctggcagccagccagttgt

SEQ ID NO: 8187846 - DNA, 22 bp, Homo sapiens
cctctggccacatgggacatag

SEQ ID NO: 8187847 - DNA, 22 bp, Homo sapiens
cctctggcagccagccagttgt

SEQ ID NO: 8187848 - DNA, 22 bp, Homo sapiens
cctctggcaacttcacagccca

SEQ ID NO: 8187849 - DNA, 22 bp, Homo sapiens
cctctggcaacttcacagccca

SEQ ID NO: 8187850 - DNA, 22 bp, Homo sapiens
cctctggagtcagaccagcttg

SEQ ID NO: 8187851 - DNA, 22 bp, Homo sapiens
tgggagctcagaaagggaggtc

SEQ ID NO: 8187852 - DNA, 22 bp, Homo sapiens
tgggagctcacaggcctggctc

SEQ ID NO: 8187853 - DNA, 23 bp, Homo sapiens
tgggagctcaagggaggctgccc

SEQ ID NO: 8187854 - DNA, 22 bp, Homo sapiens
tgggagcctggcaggccagagg

SEQ ID NO: 8187855 - DNA, 22 bp, Homo sapiens
tgggagcccaagggagctgccg

SEQ ID NO: 8187856 - DNA, 22 bp, Homo sapiens
tgggagcccaagggagctgccg

SEQ ID NO: 8187857 - DNA, 22 bp, Homo sapiens
tgggagccattttagaggctgc

SEQ ID NO: 8187858 - DNA, 22 bp, Homo sapiens
tgggagcagttgtgaagctcag

SEQ ID NO: 8187859 - DNA, 22 bp, Homo sapiens
tgggagcagttgtgaagctcag

SEQ ID NO: 8187860 - DNA, 22 bp, Homo sapiens
tgggagcagttcaggtgtggct

SEQ ID NO: 8187861 - DNA, 21 bp, Homo sapiens
tgctttcagactcttacagaa

SEQ ID NO: 8187862 - DNA, 22 bp, Homo sapiens
tgctttcagggatgtctgtgag

SEQ ID NO: 8187863 - DNA, 22 bp, Homo sapiens
tgctttcagggatgtctgtgag

SEQ ID NO: 8187864 - DNA, 22 bp, Homo sapiens
tgctttcattgtgataggaagc

SEQ ID NO: 8187865 - DNA, 22 bp, Homo sapiens
tgctttcacctgtttgcaccca

SEQ ID NO: 8187866 - DNA, 22 bp, Homo sapiens
tgctttcacatgtatgcacaaa

SEQ ID NO: 8187867 - DNA, 22 bp, Homo sapiens
tgctttcacaccatgcctataa

SEQ ID NO: 8187868 - DNA, 22 bp, Homo sapiens
tgctttattttaaatatgccat

SEQ ID NO: 8187869 - DNA, 22 bp, Homo sapiens
tgctttcaaaggctttctagat

SEQ ID NO: 8187870 - DNA, 19 bp, Homo sapiens
tgcctgctcctggcttcca

SEQ ID NO: 8187871 - DNA, 22 bp, Homo sapiens
tgcttgtccgaggtgagtactt

SEQ ID NO: 8187872 - DNA, 22 bp, Homo sapiens
tgcttgtctctctgtgcccact

SEQ ID NO: 8187873 - DNA, 22 bp, Homo sapiens
tgcttgtctcagataaaactat

SEQ ID NO: 8187874 - DNA, 22 bp, Homo sapiens
tgcctgctaggcactttcaaac

SEQ ID NO: 8187875 - DNA, 22 bp, Homo sapiens
tgcctgctaggccctgctgggt

SEQ ID NO: 8187876 - DNA, 22 bp, Homo sapiens
tgcctgctccagtcctgtccac

SEQ ID NO: 8187877 - DNA, 22 bp, Homo sapiens
tgctttatttataaaatagcaa

SEQ ID NO: 8187878 - DNA, 22 bp, Homo sapiens
tgctttatttataaaatagcaa

SEQ ID NO: 8187879 - DNA, 22 bp, Homo sapiens
tgctttattttaaatatgccat

SEQ ID NO: 8187880 - DNA, 22 bp, Homo sapiens
tgctttatttataaaatagcaa

SEQ ID NO: 8187881 - DNA, 22 bp, Homo sapiens
tgctttattgcatcagtgtggg

SEQ ID NO: 8187882 - DNA, 22 bp, Homo sapiens
tgctttattggaacctcatcct

SEQ ID NO: 8187883 - DNA, 22 bp, Homo sapiens
tgcctcagtttctccatatgaa

SEQ ID NO: 8187884 - DNA, 22 bp, Homo sapiens
tgcctcagtttctccatatgaa

SEQ ID NO: 8187885 - DNA, 22 bp, Homo sapiens
tgcctcagtttcatctgcagaa

SEQ ID NO: 8187886 - DNA, 22 bp, Homo sapiens
tgcctcagtttcatctgcagaa

SEQ ID NO: 8187887 - DNA, 22 bp, Homo sapiens
tgcctcagtttcatctgcagaa

SEQ ID NO: 8187888 - DNA, 22 bp, Homo sapiens
tgcctcagtttctccatatgaa

SEQ ID NO: 8187889 - DNA, 22 bp, Homo sapiens
tgcctccaccattgctcacttt

SEQ ID NO: 8187890 - DNA, 22 bp, Homo sapiens
tgcctccaggaggggcagctct

SEQ ID NO: 8187891 - DNA, 22 bp, Homo sapiens
tgcctccatgtttcagcatcta

SEQ ID NO: 8187892 - DNA, 23 bp, Homo sapiens
tgcctccaccgagggccaggcat

SEQ ID NO: 8187893 - DNA, 17 bp, Homo sapiens
tgcctccagcagggtga

SEQ ID NO: 8187894 - DNA, 22 bp, Homo sapiens
tgcctgccctttccacacagcc

SEQ ID NO: 8187895 - DNA, 22 bp, Homo sapiens
tgcctccattcctgggtcattg

SEQ ID NO: 8187896 - DNA, 22 bp, Homo sapiens
tgcctgccctttccacacagcc

SEQ ID NO: 8187897 - DNA, 22 bp, Homo sapiens
tgcctgcctctggagcccatcc

SEQ ID NO: 8187898 - DNA, 22 bp, Homo sapiens
tgcctgcctctggcagccctgc

SEQ ID NO: 8187899 - DNA, 22 bp, Homo sapiens
tgcctgcctctggcagccctgc

SEQ ID NO: 8187900 - DNA, 22 bp, Homo sapiens
tgcctgcctctggcagccctgc

SEQ ID NO: 8187901 - DNA, 22 bp, Homo sapiens
tgcctgcctctggcagccctgc

SEQ ID NO: 8187902 - DNA, 22 bp, Homo sapiens
tgcctgctagatatccaggtga

SEQ ID NO: 8187903 - DNA, 22 bp, Homo sapiens
tgcctgcctgcatagtcccacg

SEQ ID NO: 8187904 - DNA, 22 bp, Homo sapiens
tggaagacaaagattcaatatt

SEQ ID NO: 8187905 - DNA, 22 bp, Homo sapiens
tggaagacaagtgttagcatgg

SEQ ID NO: 8187906 - DNA, 22 bp, Homo sapiens
tggaagacaagtgttagcatgg

SEQ ID NO: 8187907 - DNA, 22 bp, Homo sapiens
tggaagacactatttaccaggt

SEQ ID NO: 8187908 - DNA, 20 bp, Homo sapiens
tggaagacactgaagggcca

SEQ ID NO: 8187909 - DNA, 22 bp, Homo sapiens
tggaagacaggagatgtgtgta

SEQ ID NO: 8187910 - DNA, 22 bp, Homo sapiens
tggaagacaatttgaaaacatt

SEQ ID NO: 8187911 - DNA, 22 bp, Homo sapiens
tggaagacaatgtacatgcagt

SEQ ID NO: 8187912 - DNA, 22 bp, Homo sapiens
tggaagacaatgtacatgcagt

SEQ ID NO: 8187913 - DNA, 22 bp, Homo sapiens
tggaaggcaggacctgccttgg

SEQ ID NO: 8187914 - DNA, 22 bp, Homo sapiens
tggaagacatactgttttctta

SEQ ID NO: 8187915 - DNA, 22 bp, Homo sapiens
tggaagacatactgttttctta

SEQ ID NO: 8187916 - DNA, 22 bp, Homo sapiens
tggaagacagtgactggttgtg

SEQ ID NO: 8187917 - DNA, 22 bp, Homo sapiens
tggaagacagttgatgggagtt

SEQ ID NO: 8187918 - DNA, 22 bp, Homo sapiens
tggaagacaggcatggaagtgg

SEQ ID NO: 8187919 - DNA, 22 bp, Homo sapiens
tggaagacaggctgtattttaa

SEQ ID NO: 8187920 - DNA, 22 bp, Homo sapiens
tggaagacaggctgtattttaa

SEQ ID NO: 8187921 - DNA, 22 bp, Homo sapiens
tggaagacagtgactggttgtg

SEQ ID NO: 8187922 - DNA, 22 bp, Homo sapiens
tggaagggaaagtttggggtcc

SEQ ID NO: 8187923 - DNA, 22 bp, Homo sapiens
tggaagggaaagtttggggtcc

SEQ ID NO: 8187924 - DNA, 22 bp, Homo sapiens
tggaagggaaagtttggggtcc

SEQ ID NO: 8187925 - DNA, 22 bp, Homo sapiens
tggaaggctaggtgctaggccc

SEQ ID NO: 8187926 - DNA, 22 bp, Homo sapiens
tggaaggcgtctcgaaggccta

SEQ ID NO: 8187927 - DNA, 22 bp, Homo sapiens
tggaaggctgagagtcctgggg

SEQ ID NO: 8187928 - DNA, 21 bp, Homo sapiens
tggaaggctgctctgccaggg

SEQ ID NO: 8187929 - DNA, 22 bp, Homo sapiens
cccgtgtgtgcgaggctcccgc

SEQ ID NO: 8187930 - DNA, 22 bp, Homo sapiens
cccgtgtgtgcgaggctcccgc

SEQ ID NO: 8187931 - DNA, 17 bp, Homo sapiens
cccgttctcttcgctgg

SEQ ID NO: 8187932 - DNA, 21 bp, Homo sapiens
ccctaactctaaaggatccat

SEQ ID NO: 8187933 - DNA, 23 bp, Homo sapiens
ccctaactaattctagggcctaa

SEQ ID NO: 8187934 - DNA, 22 bp, Homo sapiens
ccctactccatagtcaattcat

SEQ ID NO: 8187935 - DNA, 22 bp, Homo sapiens
ccctactcaccacacatcttta

SEQ ID NO: 8187936 - DNA, 22 bp, Homo sapiens
ccctactctgccactttttctg

SEQ ID NO: 8187937 - DNA, 22 bp, Homo sapiens
ccctaaggacacctgctgtcca

SEQ ID NO: 8187938 - DNA, 22 bp, Homo sapiens
ccctaaggcagcccagtctgtg

SEQ ID NO: 8187939 - DNA, 22 bp, Homo sapiens
cccgggaggtggaggttgcagt

SEQ ID NO: 8187940 - DNA, 22 bp, Homo sapiens
cccgggaggcggaggttgcagt

SEQ ID NO: 8187941 - DNA, 22 bp, Homo sapiens
cccgggaggcagaggttgcagt

SEQ ID NO: 8187942 - DNA, 18 bp, Homo sapiens
cccggctaatttttggta

SEQ ID NO: 8187943 - DNA, 22 bp, Homo sapiens
cccgggttgtccgcgcgtccgg

SEQ ID NO: 8187944 - DNA, 22 bp, Homo sapiens
cccgtgtggacagcgtgccagt

SEQ ID NO: 8187945 - DNA, 22 bp, Homo sapiens
cccgtcccttttgcccgctggt

SEQ ID NO: 8187946 - DNA, 22 bp, Homo sapiens
cccgtcccttttgcccgctggt

SEQ ID NO: 8187947 - DNA, 22 bp, Homo sapiens
ccctagaacacgcagacactga

SEQ ID NO: 8187948 - DNA, 22 bp, Homo sapiens
ccctagaacacgcagacactga

SEQ ID NO: 8187949 - DNA, 22 bp, Homo sapiens
tggaagaaggcagagaggcatt

SEQ ID NO: 8187950 - DNA, 22 bp, Homo sapiens
tggaagaagctacaagcggtga

SEQ ID NO: 8187951 - DNA, 22 bp, Homo sapiens
tggaagaatagaagatggttga

SEQ ID NO: 8187952 - DNA, 22 bp, Homo sapiens
tggaagaataggatagaagaac

SEQ ID NO: 8187953 - DNA, 22 bp, Homo sapiens
tggaagaataggatagaagaac

SEQ ID NO: 8187954 - DNA, 22 bp, Homo sapiens
ccctgccttcttggcctttaaa

SEQ ID NO: 8187955 - DNA, 22 bp, Homo sapiens
ccctgcctgtgggcatcaacat

SEQ ID NO: 8187956 - DNA, 22 bp, Homo sapiens
ccctgcctgtgggcatcaacat

SEQ ID NO: 8187957 - DNA, 22 bp, Homo sapiens
ccctgcctgtgggcatcaacat

SEQ ID NO: 8187958 - DNA, 22 bp, Homo sapiens
ccctgcctgtgggcatcaacat

SEQ ID NO: 8187959 - DNA, 22 bp, Homo sapiens
ccctgcctctgaagctgctcag

SEQ ID NO: 8187960 - DNA, 22 bp, Homo sapiens
ccctgcctctgaagctgctcag

SEQ ID NO: 8187961 - DNA, 22 bp, Homo sapiens
ccctgcctctgaagctgctcag

SEQ ID NO: 8187962 - DNA, 22 bp, Homo sapiens
ccctgcagtcctttcttggctc

SEQ ID NO: 8187963 - DNA, 22 bp, Homo sapiens
ccctgcagtgtgacctcaccta

SEQ ID NO: 8187964 - DNA, 22 bp, Homo sapiens
ccctgcagtgtgacctcaccta

SEQ ID NO: 8187965 - DNA, 22 bp, Homo sapiens
ccctgcctacagggttttcttt

SEQ ID NO: 8187966 - DNA, 22 bp, Homo sapiens
ccctgcctctgaagctgctcag

SEQ ID NO: 8187967 - DNA, 22 bp, Homo sapiens
ccctgcctacagggttttcttt

SEQ ID NO: 8187968 - DNA, 22 bp, Homo sapiens
tggacagtattgtgaagcaggc

SEQ ID NO: 8187969 - DNA, 22 bp, Homo sapiens
tggacagtaggaagagtgtggg

SEQ ID NO: 8187970 - DNA, 22 bp, Homo sapiens
tggacatgacctcgagcgagat

SEQ ID NO: 8187971 - DNA, 22 bp, Homo sapiens
tggacagttgtcttgtagctaa

SEQ ID NO: 8187972 - DNA, 22 bp, Homo sapiens
tggacatgtaaaggctcaaggt

SEQ ID NO: 8187973 - DNA, 22 bp, Homo sapiens
tggacatgagctgagtgggtgt

SEQ ID NO: 8187974 - DNA, 22 bp, Homo sapiens
tggacaggtttgggtgcctgtt

SEQ ID NO: 8187975 - DNA, 22 bp, Homo sapiens
tggacaggttgagtaggaggag

SEQ ID NO: 8187976 - DNA, 22 bp, Homo sapiens
tggacaggttgagtaggaggag

SEQ ID NO: 8187977 - DNA, 22 bp, Homo sapiens
tggacaggtgcacacagcagcc

SEQ ID NO: 8187978 - DNA, 22 bp, Homo sapiens
tggacaggtgcacacagcagcc

SEQ ID NO: 8187979 - DNA, 22 bp, Homo sapiens
tggacaggttgagtaggaggag

SEQ ID NO: 8187980 - DNA, 22 bp, Homo sapiens
tggacaggttgagtaggaggag

SEQ ID NO: 8187981 - DNA, 20 bp, Homo sapiens
ccctgcagccatgggagtgg

SEQ ID NO: 8187982 - DNA, 22 bp, Homo sapiens
ccctgcagccggccagctcatt

SEQ ID NO: 8187983 - DNA, 22 bp, Homo sapiens
ccctgcagatctagggtccttc

SEQ ID NO: 8187984 - DNA, 22 bp, Homo sapiens
ccctgcagatcagtgagaactt

SEQ ID NO: 8187985 - DNA, 22 bp, Homo sapiens
ccctgcagagggatgggggcag

SEQ ID NO: 8187986 - DNA, 22 bp, Homo sapiens
ccctgcagacgtcttgatgcct

SEQ ID NO: 8187987 - DNA, 22 bp, Homo sapiens
ccctgcagacgtcttgatgcct

SEQ ID NO: 8187988 - DNA, 22 bp, Homo sapiens
ccctgcagaccaatgccataga

SEQ ID NO: 8187989 - DNA, 22 bp, Homo sapiens
ccctgcagaccaatgccataga

SEQ ID NO: 8187990 - DNA, 22 bp, Homo sapiens
ccctgcagaaccacagacaaac

SEQ ID NO: 8187991 - DNA, 22 bp, Homo sapiens
ccctgcagagaccactgacctt

SEQ ID NO: 8187992 - DNA, 22 bp, Homo sapiens
ccctgcagagccagccctgacc

SEQ ID NO: 8187993 - DNA, 22 bp, Homo sapiens
ccctgcagagagtgcttttgtg

SEQ ID NO: 8187994 - DNA, 22 bp, Homo sapiens
ccctgcagagccagccctgacc

SEQ ID NO: 8187995 - DNA, 21 bp, Homo sapiens
tggaagggaagtcttggttgt

SEQ ID NO: 8187996 - DNA, 22 bp, Homo sapiens
ccctgaggaccaggaaggaggg

SEQ ID NO: 8187997 - DNA, 22 bp, Homo sapiens
tggaagggaacaggtgggtgtt

SEQ ID NO: 8187998 - DNA, 22 bp, Homo sapiens
tggaagggaacaggtgggtgtt

SEQ ID NO: 8187999 - DNA, 22 bp, Homo sapiens
tggaagggaacaggtgggtgtt

SEQ ID NO: 8188000 - DNA, 22 bp, Homo sapiens
ccctgaggagagcgcttcccga

SEQ ID NO: 8188001 - DNA, 22 bp, Homo sapiens
ccctgctgaatcccatggagtc

SEQ ID NO: 8188002 - DNA, 19 bp, Homo sapiens
tggaggccaggacacaggt

SEQ ID NO: 8188003 - DNA, 22 bp, Homo sapiens
tggaggccaggaaggcagcgag

SEQ ID NO: 8188004 - DNA, 22 bp, Homo sapiens
tggaggggcaatggagcgcgga

SEQ ID NO: 8188005 - DNA, 22 bp, Homo sapiens
tggaggggcaatggagcgcgga

SEQ ID NO: 8188006 - DNA, 22 bp, Homo sapiens
ccctgctcttctgactcaagct

SEQ ID NO: 8188007 - DNA, 22 bp, Homo sapiens
ccctgctcttctgactcaagct

SEQ ID NO: 8188008 - DNA, 22 bp, Homo sapiens
ccctgctcttctgactcaagct

SEQ ID NO: 8188009 - DNA, 22 bp, Homo sapiens
ccctgctagttgtctcagtgat

SEQ ID NO: 8188010 - DNA, 23 bp, Homo sapiens
ccctgctcaggggtctgattctc

SEQ ID NO: 8188011 - DNA, 22 bp, Homo sapiens
ccctgctcttagtgcctgtgtg

SEQ ID NO: 8188012 - DNA, 22 bp, Homo sapiens
ccctgctcttagtgcctgtgtg

SEQ ID NO: 8188013 - DNA, 22 bp, Homo sapiens
ccctgctcttagtgcctgtgtg

SEQ ID NO: 8188014 - DNA, 22 bp, Homo sapiens
ccctgccttgtctgggctaggt

SEQ ID NO: 8188015 - DNA, 22 bp, Homo sapiens
ccctgccttgttggagcctatg

SEQ ID NO: 8188016 - DNA, 22 bp, Homo sapiens
ccctgccttgtctgggctaggt

SEQ ID NO: 8188017 - DNA, 22 bp, Homo sapiens
ccctgccttgttggagcctatg

SEQ ID NO: 8188018 - DNA, 22 bp, Homo sapiens
ccctgccttgttggagcctatg

SEQ ID NO: 8188019 - DNA, 22 bp, Homo sapiens
ccctgccttgttggagcctatg

SEQ ID NO: 8188020 - DNA, 22 bp, Homo sapiens
ccctgccttgttggagcctatg

SEQ ID NO: 8188021 - DNA, 22 bp, Homo sapiens
ccctgccttgtctgggctaggt

SEQ ID NO: 8188022 - DNA, 22 bp, Homo sapiens
ccctgccttggggtccacaccg

SEQ ID NO: 8188023 - DNA, 22 bp, Homo sapiens
ccctgccttggggtccacaccg

SEQ ID NO: 8188024 - DNA, 22 bp, Homo sapiens
ccctgccttggggtccacaccg

SEQ ID NO: 8188025 - DNA, 22 bp, Homo sapiens
ccctgccttcttggcctttaaa

SEQ ID NO: 8188026 - DNA, 22 bp, Homo sapiens
ccctgccttggggtccacaccg

SEQ ID NO: 8188027 - DNA, 22 bp, Homo sapiens
ccctgccttcttggcctttaaa

SEQ ID NO: 8188028 - DNA, 23 bp, Homo sapiens
ccctggagctagtctgagcagag

SEQ ID NO: 8188029 - DNA, 22 bp, Homo sapiens
ccctggagctagtctgagcaga

SEQ ID NO: 8188030 - DNA, 22 bp, Homo sapiens
ccctggagctagtctgagcaga

SEQ ID NO: 8188031 - DNA, 23 bp, Homo sapiens
ccctggagctagtctgagcagag

SEQ ID NO: 8188032 - DNA, 23 bp, Homo sapiens
ccctggagctagtctgagcagag

SEQ ID NO: 8188033 - DNA, 23 bp, Homo sapiens
ccctggagctagtctgagcgggg

SEQ ID NO: 8188034 - DNA, 23 bp, Homo sapiens
ccctggagctagtctgagcagag

SEQ ID NO: 8188035 - DNA, 23 bp, Homo sapiens
ccctggagctagtctgagcagag

SEQ ID NO: 8188036 - DNA, 22 bp, Homo sapiens
ccctggagctgcttgcatgttg

SEQ ID NO: 8188037 - DNA, 22 bp, Homo sapiens
ccctggagctgcttgcatgttg

SEQ ID NO: 8188038 - DNA, 23 bp, Homo sapiens
ccctggagctagtctgagcgggg

SEQ ID NO: 8188039 - DNA, 22 bp, Homo sapiens
tggaggtggagttggaaactga

SEQ ID NO: 8188040 - DNA, 22 bp, Homo sapiens
ccctggagctagtctgagcaga

SEQ ID NO: 8188041 - DNA, 22 bp, Homo sapiens
ccctggagctagtctgagcaga

SEQ ID NO: 8188042 - DNA, 22 bp, Homo sapiens
tggaggtgagtgtggtacagca

SEQ ID NO: 8188043 - DNA, 22 bp, Homo sapiens
tggaggtgacggggcctcgttg

SEQ ID NO: 8188044 - DNA, 22 bp, Homo sapiens
tggaggtgacggggcctcgttg

SEQ ID NO: 8188045 - DNA, 22 bp, Homo sapiens
tggaggtgacggggcctcgttg

SEQ ID NO: 8188046 - DNA, 22 bp, Homo sapiens
tggaggtgagtgtggtacagca

SEQ ID NO: 8188047 - DNA, 22 bp, Homo sapiens
tggaggtgagtgtggtacagca

SEQ ID NO: 8188048 - DNA, 19 bp, Homo sapiens
tggaggggtttgaatgtgg

SEQ ID NO: 8188049 - DNA, 19 bp, Homo sapiens
tggaggggtttgaatgtgg

SEQ ID NO: 8188050 - DNA, 19 bp, Homo sapiens
tggaggggtttgaatgtgg

SEQ ID NO: 8188051 - DNA, 22 bp, Homo sapiens
tggagggtcaccccttgctgag

SEQ ID NO: 8188052 - DNA, 22 bp, Homo sapiens
tggagggtcaccccttgctgag

SEQ ID NO: 8188053 - DNA, 22 bp, Homo sapiens
tggaggtcgcgcgggtgctgca

SEQ ID NO: 8188054 - DNA, 22 bp, Homo sapiens
tggaggtctcctggtattgacc

SEQ ID NO: 8188055 - DNA, 22 bp, Homo sapiens
tggaggtctctgtctgggcagg

SEQ ID NO: 8188056 - DNA, 22 bp, Homo sapiens
tggaggtctctgtctgggcagg

SEQ ID NO: 8188057 - DNA, 22 bp, Homo sapiens
tggaggtgaaatgagattttgt

SEQ ID NO: 8188058 - DNA, 22 bp, Homo sapiens
cctcagaagctcaaggacattg

SEQ ID NO: 8188059 - DNA, 22 bp, Homo sapiens
cctcagaagctcaaggacattg

SEQ ID NO: 8188060 - DNA, 21 bp, Homo sapiens
tggccctggccacggctgcca

SEQ ID NO: 8188061 - DNA, 22 bp, Homo sapiens
tggcctcaagtctgagggcctt

SEQ ID NO: 8188062 - DNA, 22 bp, Homo sapiens
tggcctcaatctgtcctccagc

SEQ ID NO: 8188063 - DNA, 22 bp, Homo sapiens
tggcctcagattattgcacagt

SEQ ID NO: 8188064 - DNA, 22 bp, Homo sapiens
tggcctcagatttcaggggtgg

SEQ ID NO: 8188065 - DNA, 22 bp, Homo sapiens
cctcactgaagaggtgacattt

SEQ ID NO: 8188066 - DNA, 22 bp, Homo sapiens
cctcactctgcaccctgcagca

SEQ ID NO: 8188067 - DNA, 22 bp, Homo sapiens
cctcactctgcaccctgcagca

SEQ ID NO: 8188068 - DNA, 22 bp, Homo sapiens
cctcaccttttctctgattgct

SEQ ID NO: 8188069 - DNA, 22 bp, Homo sapiens
cctcagaagactttagggaaga

SEQ ID NO: 8188070 - DNA, 22 bp, Homo sapiens
cctcagaacggaaatggttttg

SEQ ID NO: 8188071 - DNA, 22 bp, Homo sapiens
cctcagaagaagtggaattgat

SEQ ID NO: 8188072 - DNA, 22 bp, Homo sapiens
cctcactttcctttctcctggg

SEQ ID NO: 8188073 - DNA, 22 bp, Homo sapiens
cctcactgtcacttatagtggt

SEQ ID NO: 8188074 - DNA, 22 bp, Homo sapiens
cctcactgtcatcagtagttat

SEQ ID NO: 8188075 - DNA, 22 bp, Homo sapiens
cctcactggccagccaggggtg

SEQ ID NO: 8188076 - DNA, 22 bp, Homo sapiens
cctcactggccagccaggggtg

SEQ ID NO: 8188077 - DNA, 22 bp, Homo sapiens
cctcactgctatgtgtttgctc

SEQ ID NO: 8188078 - DNA, 22 bp, Homo sapiens
cctcactgaagaggtgacattt

SEQ ID NO: 8188079 - DNA, 22 bp, Homo sapiens
cctcagccttggccccaggcag

SEQ ID NO: 8188080 - DNA, 22 bp, Homo sapiens
cctcagccttggccccaggcag

SEQ ID NO: 8188081 - DNA, 22 bp, Homo sapiens
cctcagcccctgaatggagaga

SEQ ID NO: 8188082 - DNA, 23 bp, Homo sapiens
cctcagcatggcaggagcccagc

SEQ ID NO: 8188083 - DNA, 22 bp, Homo sapiens
cctcagcatcctcctgctcagt

SEQ ID NO: 8188084 - DNA, 22 bp, Homo sapiens
cctcagcatcctggtgaagtag

SEQ ID NO: 8188085 - DNA, 22 bp, Homo sapiens
cctcagcatcctggtgaagtag

SEQ ID NO: 8188086 - DNA, 22 bp, Homo sapiens
tggcctcggcatccagcaagag

SEQ ID NO: 8188087 - DNA, 22 bp, Homo sapiens
tggcctcggcatccagcaagag

SEQ ID NO: 8188088 - DNA, 23 bp, Homo sapiens
tggcctctccccacctggcagaa

SEQ ID NO: 8188089 - DNA, 22 bp, Homo sapiens
cctcagctcccatgagatctgc

SEQ ID NO: 8188090 - DNA, 22 bp, Homo sapiens
cctcagctcccatgagatctgc

SEQ ID NO: 8188091 - DNA, 22 bp, Homo sapiens
cctcagctcttccctgtgcaca

SEQ ID NO: 8188092 - DNA, 22 bp, Homo sapiens
cctcagctcttccctgtgcaca

SEQ ID NO: 8188093 - DNA, 22 bp, Homo sapiens
cctcagctgcttccctggagcc

SEQ ID NO: 8188094 - DNA, 22 bp, Homo sapiens
cctcagctgctgcacagctttt

SEQ ID NO: 8188095 - DNA, 22 bp, Homo sapiens
cctcagctgcttccctggagcc

SEQ ID NO: 8188096 - DNA, 22 bp, Homo sapiens
cctcagctgcttccctggagcc

SEQ ID NO: 8188097 - DNA, 22 bp, Homo sapiens
tggctaacaaggtgaaaccccg

SEQ ID NO: 8188098 - DNA, 22 bp, Homo sapiens
tggctaacaaggtgaaaccccg

SEQ ID NO: 8188099 - DNA, 22 bp, Homo sapiens
tggctaacaaggtgaaaccccg

SEQ ID NO: 8188100 - DNA, 22 bp, Homo sapiens
tggctaacaaggtgaaaccccg

SEQ ID NO: 8188101 - DNA, 22 bp, Homo sapiens
tggctaacaaggtgaaaccccg

SEQ ID NO: 8188102 - DNA, 22 bp, Homo sapiens
tggcctgggtcacaccagggtc

SEQ ID NO: 8188103 - DNA, 22 bp, Homo sapiens
tggcctggggacctgtgagacc

SEQ ID NO: 8188104 - DNA, 22 bp, Homo sapiens
cctcagctgtcttttccgaggt

SEQ ID NO: 8188105 - DNA, 22 bp, Homo sapiens
tggctcagcgcggcctggtctt

SEQ ID NO: 8188106 - DNA, 22 bp, Homo sapiens
tggctcagcgcggcctggtctt

SEQ ID NO: 8188107 - DNA, 22 bp, Homo sapiens
tggctcagcgcggcctggtctt

SEQ ID NO: 8188108 - DNA, 22 bp, Homo sapiens
tggctcagcctggccctttcat

SEQ ID NO: 8188109 - DNA, 22 bp, Homo sapiens
tggctcagccattcgtgttgcc

SEQ ID NO: 8188110 - DNA, 22 bp, Homo sapiens
tggctcagcctggccctttcat

SEQ ID NO: 8188111 - DNA, 22 bp, Homo sapiens
tggctcagccattcgtgttgcc

SEQ ID NO: 8188112 - DNA, 22 bp, Homo sapiens
tggctcagccattcgtgttgcc

SEQ ID NO: 8188113 - DNA, 22 bp, Homo sapiens
tggctaggacctctgcggagca

SEQ ID NO: 8188114 - DNA, 22 bp, Homo sapiens
tggctaggctccaagagctgga

SEQ ID NO: 8188115 - DNA, 22 bp, Homo sapiens
tggctaggctccaagagctgga

SEQ ID NO: 8188116 - DNA, 22 bp, Homo sapiens
tggctaggctggtgtcaagctc

SEQ ID NO: 8188117 - DNA, 22 bp, Homo sapiens
tggctagtaggtgagtagtgct

SEQ ID NO: 8188118 - DNA, 22 bp, Homo sapiens
tggctagggcctttaacgagta

SEQ ID NO: 8188119 - DNA, 23 bp, Homo sapiens
tggctagctgaagaggtatgggt

SEQ ID NO: 8188120 - DNA, 22 bp, Homo sapiens
tggctagctgtgggctggaagc

SEQ ID NO: 8188121 - DNA, 22 bp, Homo sapiens
tggctaggaaagagttctggga

SEQ ID NO: 8188122 - DNA, 22 bp, Homo sapiens
tggctaggaaagagttctggga

SEQ ID NO: 8188123 - DNA, 22 bp, Homo sapiens
tggctaggaatccatgactctc

SEQ ID NO: 8188124 - DNA, 22 bp, Homo sapiens
tggctagccgaggggtgggccc

SEQ ID NO: 8188125 - DNA, 22 bp, Homo sapiens
tggctagcccttgtggggagag

SEQ ID NO: 8188126 - DNA, 22 bp, Homo sapiens
tggctagatggcagaaagctgg

SEQ ID NO: 8188127 - DNA, 22 bp, Homo sapiens
tggctagatttattgctgagca

SEQ ID NO: 8188128 - DNA, 22 bp, Homo sapiens
tggctagatttattgctgagca

SEQ ID NO: 8188129 - DNA, 22 bp, Homo sapiens
tggctacagatttgctgacaat

SEQ ID NO: 8188130 - DNA, 22 bp, Homo sapiens
tggctacatcacagagaattcc

SEQ ID NO: 8188131 - DNA, 22 bp, Homo sapiens
tggctactcaacatgtactcat

SEQ ID NO: 8188132 - DNA, 22 bp, Homo sapiens
tggctactgtacttgagctatt

SEQ ID NO: 8188133 - DNA, 22 bp, Homo sapiens
tggctactgtatttggacgaca

SEQ ID NO: 8188134 - DNA, 23 bp, Homo sapiens
tggctactttatgaggttgagga

SEQ ID NO: 8188135 - DNA, 22 bp, Homo sapiens
tggctaaggtcgatagaggctt

SEQ ID NO: 8188136 - DNA, 22 bp, Homo sapiens
tggctacaagtgtgtttagttt

SEQ ID NO: 8188137 - DNA, 22 bp, Homo sapiens
cctcccctcagacagagactgg

SEQ ID NO: 8188138 - DNA, 22 bp, Homo sapiens
cctcccagatgtgcccaatgga

SEQ ID NO: 8188139 - DNA, 22 bp, Homo sapiens
cctcccaggcattgccattttc

SEQ ID NO: 8188140 - DNA, 22 bp, Homo sapiens
cctcccagatgtgcccaatgga

SEQ ID NO: 8188141 - DNA, 22 bp, Homo sapiens
tggctcagctgactcggcttct

SEQ ID NO: 8188142 - DNA, 22 bp, Homo sapiens
cctcccacttcttgctgaggtc

SEQ ID NO: 8188143 - DNA, 22 bp, Homo sapiens
tggctcagcggtggcagcagac

SEQ ID NO: 8188144 - DNA, 22 bp, Homo sapiens
tggctcagcgcggcctggtctt

SEQ ID NO: 8188145 - DNA, 23 bp, Homo sapiens
tggctcagctagttttccatttc

SEQ ID NO: 8188146 - DNA, 22 bp, Homo sapiens
tggctcagcggtggcagcagac

SEQ ID NO: 8188147 - DNA, 22 bp, Homo sapiens
tggctcagcggtggcagcagac

SEQ ID NO: 8188148 - DNA, 22 bp, Homo sapiens
tggctcagcggtggcagcagac

SEQ ID NO: 8188149 - DNA, 22 bp, Homo sapiens
cctccctccctcttatggttta

SEQ ID NO: 8188150 - DNA, 22 bp, Homo sapiens
cctccctctttcagtcccacag

SEQ ID NO: 8188151 - DNA, 22 bp, Homo sapiens
cctccctctttcagtcccacag

SEQ ID NO: 8188152 - DNA, 22 bp, Homo sapiens
cctccctctgttagagctgtct

SEQ ID NO: 8188153 - DNA, 22 bp, Homo sapiens
cctccctccctgcagaagccac

SEQ ID NO: 8188154 - DNA, 23 bp, Homo sapiens
cctccccttcccacagctgggtg

SEQ ID NO: 8188155 - DNA, 22 bp, Homo sapiens
cctcccctgctcagaactctgg

SEQ ID NO: 8188156 - DNA, 18 bp, Homo sapiens
cctccctcattttcccag

SEQ ID NO: 8188157 - DNA, 18 bp, Homo sapiens
cctccctcattttcccag

SEQ ID NO: 8188158 - DNA, 22 bp, Homo sapiens
cctccctccattgccatcgtct

SEQ ID NO: 8188159 - DNA, 22 bp, Homo sapiens
cctccctccattgccatcgtct

SEQ ID NO: 8188160 - DNA, 19 bp, Homo sapiens
cctccccttggaccagcaa

SEQ ID NO: 8188161 - DNA, 19 bp, Homo sapiens
cctccccttggaccagcaa

SEQ ID NO: 8188162 - DNA, 22 bp, Homo sapiens
ccctgtgcagatggcagctggg

SEQ ID NO: 8188163 - DNA, 22 bp, Homo sapiens
ccctgtgcattggagggtgttt

SEQ ID NO: 8188164 - DNA, 22 bp, Homo sapiens
ccctgtgcacacacttcactct

SEQ ID NO: 8188165 - DNA, 22 bp, Homo sapiens
ccctgtgcacacacttcactct

SEQ ID NO: 8188166 - DNA, 22 bp, Homo sapiens
ccctgtgccagagaggcaggag

SEQ ID NO: 8188167 - DNA, 22 bp, Homo sapiens
ccctgtgccagagaggcaggag

SEQ ID NO: 8188168 - DNA, 22 bp, Homo sapiens
ccctgtgcctagttggcctaaa

SEQ ID NO: 8188169 - DNA, 22 bp, Homo sapiens
ccctgtgcctcagtttcctcat

SEQ ID NO: 8188170 - DNA, 22 bp, Homo sapiens
ccctgtgctgtcatgctgggcg

SEQ ID NO: 8188171 - DNA, 22 bp, Homo sapiens
ccctgtggaggcagcatcctgc

SEQ ID NO: 8188172 - DNA, 22 bp, Homo sapiens
ccgcggggcgtgggctcttacc

SEQ ID NO: 8188173 - DNA, 22 bp, Homo sapiens
ccctttcatattttataaatgg

SEQ ID NO: 8188174 - DNA, 22 bp, Homo sapiens
ccctttcattggcagagctctc

SEQ ID NO: 8188175 - DNA, 22 bp, Homo sapiens
ccctttcattggcagagctctc

SEQ ID NO: 8188176 - DNA, 22 bp, Homo sapiens
ccctgtggcaggaggaggagca

SEQ ID NO: 8188177 - DNA, 22 bp, Homo sapiens
ccctgtgggaactcctgagttg

SEQ ID NO: 8188178 - DNA, 22 bp, Homo sapiens
ccgcgtggcaccctcctggagg

SEQ ID NO: 8188179 - DNA, 22 bp, Homo sapiens
ccgctgtctcatcagtgcccgg

SEQ ID NO: 8188180 - DNA, 22 bp, Homo sapiens
ccggagaaactggcaaacccta

SEQ ID NO: 8188181 - DNA, 22 bp, Homo sapiens
ccggagtgtctggcctgctggg

SEQ ID NO: 8188182 - DNA, 22 bp, Homo sapiens
ccggcgtctcttccacttccta

SEQ ID NO: 8188183 - DNA, 22 bp, Homo sapiens
ccctgtcctgctaggccctggt

SEQ ID NO: 8188184 - DNA, 20 bp, Homo sapiens
ccctgtatgtggatgagtgg

SEQ ID NO: 8188185 - DNA, 23 bp, Homo sapiens
ccctgtagcccaggacaggcttt

SEQ ID NO: 8188186 - DNA, 22 bp, Homo sapiens
ccctgtctgtaccgtgatgagc

SEQ ID NO: 8188187 - DNA, 22 bp, Homo sapiens
ccctgtctgtaccgtgatgagc

SEQ ID NO: 8188188 - DNA, 22 bp, Homo sapiens
ccctgtctcattgatcacttgt

SEQ ID NO: 8188189 - DNA, 22 bp, Homo sapiens
ccctgtcctggatgggagcact

SEQ ID NO: 8188190 - DNA, 22 bp, Homo sapiens
ccctggtggtacggcactggca

SEQ ID NO: 8188191 - DNA, 22 bp, Homo sapiens
ccctggtggtacggcactggca

SEQ ID NO: 8188192 - DNA, 22 bp, Homo sapiens
ccctggtgtccactggaggaag

SEQ ID NO: 8188193 - DNA, 21 bp, Homo sapiens
ccctggttccactgtcaccgc

SEQ ID NO: 8188194 - DNA, 22 bp, Homo sapiens
ccctggttgacaagccagctca

SEQ ID NO: 8188195 - DNA, 22 bp, Homo sapiens
ccctggttgacaagccagctca

SEQ ID NO: 8188196 - DNA, 22 bp, Homo sapiens
ccctggaggaagaaacaatggc

SEQ ID NO: 8188197 - DNA, 22 bp, Homo sapiens
ccctggaggaagaaacaatggc

SEQ ID NO: 8188198 - DNA, 22 bp, Homo sapiens
ccctggaggaagaaacaatggc

SEQ ID NO: 8188199 - DNA, 22 bp, Homo sapiens
ccctggaggaagaaacaatggc

SEQ ID NO: 8188200 - DNA, 22 bp, Homo sapiens
ccctggaggaaaatctgaggct

SEQ ID NO: 8188201 - DNA, 22 bp, Homo sapiens
ccctggaggaaaatctgaggct

SEQ ID NO: 8188202 - DNA, 22 bp, Homo sapiens
ccctggaggaaaatctgaggct

SEQ ID NO: 8188203 - DNA, 22 bp, Homo sapiens
ccctggaggaaaatctgaggct

SEQ ID NO: 8188204 - DNA, 22 bp, Homo sapiens
ccctggaggaaaatctgaggct

SEQ ID NO: 8188205 - DNA, 22 bp, Homo sapiens
ccctggaggaaaatctgaggct

SEQ ID NO: 8188206 - DNA, 22 bp, Homo sapiens
ccctggaggaaaatctgaggct

SEQ ID NO: 8188207 - DNA, 22 bp, Homo sapiens
ccctggagctgcttgcatgttg

SEQ ID NO: 8188208 - DNA, 22 bp, Homo sapiens
ccctggagctgcttgcatgttg

SEQ ID NO: 8188209 - DNA, 22 bp, Homo sapiens
ccctggagctgcttgcatgttg

SEQ ID NO: 8188210 - DNA, 22 bp, Homo sapiens
ccctgggatggattggcaggaa

SEQ ID NO: 8188211 - DNA, 22 bp, Homo sapiens
ccctggtcagggaaggcgcctg

SEQ ID NO: 8188212 - DNA, 22 bp, Homo sapiens
ccctgggataccagacaccaga

SEQ ID NO: 8188213 - DNA, 22 bp, Homo sapiens
ccctgggataccagacaccaga

SEQ ID NO: 8188214 - DNA, 22 bp, Homo sapiens
ccctgggatggattggcaggaa

SEQ ID NO: 8188215 - DNA, 22 bp, Homo sapiens
cctcacagccctcctctagcac

SEQ ID NO: 8188216 - DNA, 22 bp, Homo sapiens
cctaaatagagtcagatgtaat

SEQ ID NO: 8188217 - DNA, 22 bp, Homo sapiens
cctcacagagcccagatgtcta

SEQ ID NO: 8188218 - DNA, 20 bp, Homo sapiens
cctaaatacctgtcaccagg

SEQ ID NO: 8188219 - DNA, 21 bp, Homo sapiens
cctaaacaagactgacacaca

SEQ ID NO: 8188220 - DNA, 22 bp, Homo sapiens
ccgttggaaagctccgagttga

SEQ ID NO: 8188221 - DNA, 22 bp, Homo sapiens
cctcacagtcagttcttagtct

SEQ ID NO: 8188222 - DNA, 22 bp, Homo sapiens
cctcacccagtcacctaggtgg

SEQ ID NO: 8188223 - DNA, 22 bp, Homo sapiens
cctcacagcctcatgcccagcc

SEQ ID NO: 8188224 - DNA, 22 bp, Homo sapiens
ccgggcgggggctctcgtcacc

SEQ ID NO: 8188225 - DNA, 22 bp, Homo sapiens
ccgggccccacggtgacctcag

SEQ ID NO: 8188226 - DNA, 22 bp, Homo sapiens
ccgggcctcgggacaccgggta

SEQ ID NO: 8188227 - DNA, 22 bp, Homo sapiens
ccgggagcaggcgccaccgcca

SEQ ID NO: 8188228 - DNA, 22 bp, Homo sapiens
ccgggagagtggaaccaagagg

SEQ ID NO: 8188229 - DNA, 22 bp, Homo sapiens
ccggctcggcgaccaggctgaa

SEQ ID NO: 8188230 - DNA, 22 bp, Homo sapiens
ccgggagactttgagcaccatg

SEQ ID NO: 8188231 - DNA, 22 bp, Homo sapiens
ccgggagagtggaaccaagagg

SEQ ID NO: 8188232 - DNA, 22 bp, Homo sapiens
ccgggagactttgagcaccatg

SEQ ID NO: 8188233 - DNA, 22 bp, Homo sapiens
ccggctactcgggaggctgacg

SEQ ID NO: 8188234 - DNA, 22 bp, Homo sapiens
ccggctactcgggaggctgacg

SEQ ID NO: 8188235 - DNA, 22 bp, Homo sapiens
ccggctactcgggaggctgacg

SEQ ID NO: 8188236 - DNA, 22 bp, Homo sapiens
ccgggttgaggttcccatagat

SEQ ID NO: 8188237 - DNA, 22 bp, Homo sapiens
ccggggtgcgaggagcgtcttt

SEQ ID NO: 8188238 - DNA, 22 bp, Homo sapiens
ccggtcccaggtgccccggtga

SEQ ID NO: 8188239 - DNA, 22 bp, Homo sapiens
ccgtattataagtttttccttc

SEQ ID NO: 8188240 - DNA, 22 bp, Homo sapiens
ccggtgttcaaagtctggtatg

SEQ ID NO: 8188241 - DNA, 22 bp, Homo sapiens
ccggtgttcaaagtctggtatg

SEQ ID NO: 8188242 - DNA, 22 bp, Homo sapiens
ccgtggagttgtgctgagtatg

SEQ ID NO: 8188243 - DNA, 22 bp, Homo sapiens
ccgtggagttgtgctgagtatg

SEQ ID NO: 8188244 - DNA, 22 bp, Homo sapiens
ccgtggtcacctgagctccttg

SEQ ID NO: 8188245 - DNA, 19 bp, Homo sapiens
cccaacttgactattttct

SEQ ID NO: 8188246 - DNA, 22 bp, Homo sapiens
cccaagagatcgcatgtagttg

SEQ ID NO: 8188247 - DNA, 22 bp, Homo sapiens
cccaagatctttcgtgcactaa

SEQ ID NO: 8188248 - DNA, 22 bp, Homo sapiens
cccaagagcttctaggacgctg

SEQ ID NO: 8188249 - DNA, 22 bp, Homo sapiens
cccaagaggtggaggttgcagt

SEQ ID NO: 8188250 - DNA, 22 bp, Homo sapiens
cccaagatctttcgtgcactaa

SEQ ID NO: 8188251 - DNA, 22 bp, Homo sapiens
cccaagcagggtgcagaggcat

SEQ ID NO: 8188252 - DNA, 22 bp, Homo sapiens
cccaagcagggtgcagaggcat

SEQ ID NO: 8188253 - DNA, 22 bp, Homo sapiens
tgattacacaccacagtgctcc

SEQ ID NO: 8188254 - DNA, 22 bp, Homo sapiens
cccaaccccaacttcctatgtt

SEQ ID NO: 8188255 - DNA, 22 bp, Homo sapiens
cccaactactctcaggcagctt

SEQ ID NO: 8188256 - DNA, 22 bp, Homo sapiens
cccaactactctcaggcagctt

SEQ ID NO: 8188257 - DNA, 21 bp, Homo sapiens
cccaacccatttccagttcat

SEQ ID NO: 8188258 - DNA, 22 bp, Homo sapiens
tgattacactatttgggaatag

SEQ ID NO: 8188259 - DNA, 22 bp, Homo sapiens
cccaagccagaccctgaccctg

SEQ ID NO: 8188260 - DNA, 22 bp, Homo sapiens
tgattacacagcagtaatttca

SEQ ID NO: 8188261 - DNA, 23 bp, Homo sapiens
tgattacaggaagttcaagtgtt

SEQ ID NO: 8188262 - DNA, 22 bp, Homo sapiens
tgattacagtatttgagatcca

SEQ ID NO: 8188263 - DNA, 22 bp, Homo sapiens
tgattacagtctgacagatgtt

SEQ ID NO: 8188264 - DNA, 22 bp, Homo sapiens
tgattacagtctgacagatgtt

SEQ ID NO: 8188265 - DNA, 22 bp, Homo sapiens
tgattacattggtaatgtttat

SEQ ID NO: 8188266 - DNA, 22 bp, Homo sapiens
tgattacattggtaatgtttat

SEQ ID NO: 8188267 - DNA, 22 bp, Homo sapiens
tgattatattaactatgttcct

SEQ ID NO: 8188268 - DNA, 22 bp, Homo sapiens
tgattagatagtaagtgactaa

SEQ ID NO: 8188269 - DNA, 22 bp, Homo sapiens
tgattatattctaacttcataa

SEQ ID NO: 8188270 - DNA, 22 bp, Homo sapiens
tgattatattctaacttcataa

SEQ ID NO: 8188271 - DNA, 17 bp, Homo sapiens
tgattcaactagaaact

SEQ ID NO: 8188272 - DNA, 20 bp, Homo sapiens
ccatggccacatctgtgctg

SEQ ID NO: 8188273 - DNA, 22 bp, Homo sapiens
ccatggccaggaaagccaaggt

SEQ ID NO: 8188274 - DNA, 22 bp, Homo sapiens
ccatggccaattgcaccttgct

SEQ ID NO: 8188275 - DNA, 23 bp, Homo sapiens
ccatggccaatgtcaagctacta

SEQ ID NO: 8188276 - DNA, 22 bp, Homo sapiens
ccatggcattttatgtgtctta

SEQ ID NO: 8188277 - DNA, 22 bp, Homo sapiens
ccatggcagcctggcctggctt

SEQ ID NO: 8188278 - DNA, 22 bp, Homo sapiens
ccatggcagccatgggagccac

SEQ ID NO: 8188279 - DNA, 22 bp, Homo sapiens
ccatggcagcctggcctggctt

SEQ ID NO: 8188280 - DNA, 22 bp, Homo sapiens
ccatggagcgggtgagtgagtg

SEQ ID NO: 8188281 - DNA, 23 bp, Homo sapiens
ccatggagcatggctcactaggc

SEQ ID NO: 8188282 - DNA, 22 bp, Homo sapiens
ccatggagcgggtgagtgagtg

SEQ ID NO: 8188283 - DNA, 22 bp, Homo sapiens
ccatggagttcctctggtctat

SEQ ID NO: 8188284 - DNA, 22 bp, Homo sapiens
ccatggagttcctctggtctat

SEQ ID NO: 8188285 - DNA, 22 bp, Homo sapiens
ccatggagttcctctggtctat

SEQ ID NO: 8188286 - DNA, 22 bp, Homo sapiens
cccaaaggcattttgctgacca

SEQ ID NO: 8188287 - DNA, 22 bp, Homo sapiens
cccaaaggctctggagatttga

SEQ ID NO: 8188288 - DNA, 22 bp, Homo sapiens
cccaaagggcttcctgttctca

SEQ ID NO: 8188289 - DNA, 22 bp, Homo sapiens
ccatttttcataaactatccaa

SEQ ID NO: 8188290 - DNA, 22 bp, Homo sapiens
ccatggcctcgctctacgtggg

SEQ ID NO: 8188291 - DNA, 22 bp, Homo sapiens
ccattgtaaattctgtggaagt

SEQ ID NO: 8188292 - DNA, 22 bp, Homo sapiens
ccatggccgccgctgctcagga

SEQ ID NO: 8188293 - DNA, 19 bp, Homo sapiens
ccattgtttgttgcccaag

SEQ ID NO: 8188294 - DNA, 23 bp, Homo sapiens
ccattttgtgttttggagaaaca

SEQ ID NO: 8188295 - DNA, 22 bp, Homo sapiens
ccattgtttatttagacttaat

SEQ ID NO: 8188296 - DNA, 23 bp, Homo sapiens
ccattttgtgttttggagaaaca

SEQ ID NO: 8188297 - DNA, 19 bp, Homo sapiens
ccatggagagagatgcatt

SEQ ID NO: 8188298 - DNA, 22 bp, Homo sapiens
ccatggaagaactgatgtgcca

SEQ ID NO: 8188299 - DNA, 21 bp, Homo sapiens
tgatgaggtcatagcaccctc

SEQ ID NO: 8188300 - DNA, 22 bp, Homo sapiens
tgatgaggtggattcaaagcag

SEQ ID NO: 8188301 - DNA, 19 bp, Homo sapiens
ccatggagagagatgcatt

SEQ ID NO: 8188302 - DNA, 22 bp, Homo sapiens
tgatgaggggctcagaggtcag

SEQ ID NO: 8188303 - DNA, 22 bp, Homo sapiens
tgatgaggacctggtctctgct

SEQ ID NO: 8188304 - DNA, 22 bp, Homo sapiens
tgatgaggacccatcacctggt

SEQ ID NO: 8188305 - DNA, 22 bp, Homo sapiens
tgatgaccgccaacgtttaggt

SEQ ID NO: 8188306 - DNA, 22 bp, Homo sapiens
tgatgagggaactggttcatac

SEQ ID NO: 8188307 - DNA, 22 bp, Homo sapiens
tgatgaggacctggtctctgct

SEQ ID NO: 8188308 - DNA, 22 bp, Homo sapiens
tgatgaggacccatcacctggt

SEQ ID NO: 8188309 - DNA, 22 bp, Homo sapiens
tgatgaggcatatgctacacat

SEQ ID NO: 8188310 - DNA, 22 bp, Homo sapiens
tgatgacaaactttcctgatgc

SEQ ID NO: 8188311 - DNA, 22 bp, Homo sapiens
tgatgaattggaaattctgatt

SEQ ID NO: 8188312 - DNA, 22 bp, Homo sapiens
tgatgaattagtaacaaatgag

SEQ ID NO: 8188313 - DNA, 22 bp, Homo sapiens
tgatacataaaccatcattttg

SEQ ID NO: 8188314 - DNA, 22 bp, Homo sapiens
tgatacataaaccatcattttg

SEQ ID NO: 8188315 - DNA, 22 bp, Homo sapiens
tgatgaattagtaacaaatgag

SEQ ID NO: 8188316 - DNA, 22 bp, Homo sapiens
tgatgacatgtgggctgtggct

SEQ ID NO: 8188317 - DNA, 22 bp, Homo sapiens
tgatgacagcaaaaaatgctag

SEQ ID NO: 8188318 - DNA, 22 bp, Homo sapiens
tgatgacaatgttgctgcaata

SEQ ID NO: 8188319 - DNA, 18 bp, Homo sapiens
tgaggcagtcagtgatgg

SEQ ID NO: 8188320 - DNA, 18 bp, Homo sapiens
tgaggcagtcagtgatgg

SEQ ID NO: 8188321 - DNA, 22 bp, Homo sapiens
tgaggcagtgctgggaagcctg

SEQ ID NO: 8188322 - DNA, 22 bp, Homo sapiens
ccagtgttccagagagctgatg

SEQ ID NO: 8188323 - DNA, 22 bp, Homo sapiens
tgaggcaggtaagcaagttttg

SEQ ID NO: 8188324 - DNA, 22 bp, Homo sapiens
tgaggcaggtaagcaagttttg

SEQ ID NO: 8188325 - DNA, 22 bp, Homo sapiens
tgaggcaggtaagcaagttttg

SEQ ID NO: 8188326 - DNA, 22 bp, Homo sapiens
tgaggcagtattctccattcca

SEQ ID NO: 8188327 - DNA, 22 bp, Homo sapiens
tgaggcagtattctccattcca

SEQ ID NO: 8188328 - DNA, 22 bp, Homo sapiens
tgaggcaggtggattacaaggt

SEQ ID NO: 8188329 - DNA, 22 bp, Homo sapiens
tgaggcagtattttagtgactt

SEQ ID NO: 8188330 - DNA, 22 bp, Homo sapiens
tgaggcagtattttagtgactt

SEQ ID NO: 8188331 - DNA, 22 bp, Homo sapiens
tgaggcagtattttagtgactt

SEQ ID NO: 8188332 - DNA, 22 bp, Homo sapiens
tgaggcagtcaccccctcctgc

SEQ ID NO: 8188333 - DNA, 18 bp, Homo sapiens
tgaggcagtcagtgatgg

SEQ ID NO: 8188334 - DNA, 18 bp, Homo sapiens
tgaggcagtcagtgatgg

SEQ ID NO: 8188335 - DNA, 22 bp, Homo sapiens
ccagtgttcaatacatatttgt

SEQ ID NO: 8188336 - DNA, 22 bp, Homo sapiens
ccagtgttcagtatgcattaag

SEQ ID NO: 8188337 - DNA, 22 bp, Homo sapiens
ccagtgttcatcaagaaaatgt

SEQ ID NO: 8188338 - DNA, 22 bp, Homo sapiens
ccagtgttcataattttacact

SEQ ID NO: 8188339 - DNA, 22 bp, Homo sapiens
ccagtgttacggcttgaactat

SEQ ID NO: 8188340 - DNA, 22 bp, Homo sapiens
ccagtgttattttagagtgtga

SEQ ID NO: 8188341 - DNA, 22 bp, Homo sapiens
ccagtgttagagactgatacag

SEQ ID NO: 8188342 - DNA, 22 bp, Homo sapiens
ccagtgtgggcccggcctcctc

SEQ ID NO: 8188343 - DNA, 22 bp, Homo sapiens
ccagtgtggccaggtgctggta

SEQ ID NO: 8188344 - DNA, 22 bp, Homo sapiens
ccagtgtgggctggtggaggac

SEQ ID NO: 8188345 - DNA, 22 bp, Homo sapiens
ccagtgtggtaggtccacaggt

SEQ ID NO: 8188346 - DNA, 22 bp, Homo sapiens
ccagtgtggtttaggataggga

SEQ ID NO: 8188347 - DNA, 23 bp, Homo sapiens
ccagtgtggtaggtccacaggtg

SEQ ID NO: 8188348 - DNA, 22 bp, Homo sapiens
tgcagaggtttccaggcaagtt

SEQ ID NO: 8188349 - DNA, 22 bp, Homo sapiens
cccagagaagtgaagtgacttg

SEQ ID NO: 8188350 - DNA, 22 bp, Homo sapiens
cccagagaagtgaagtgacttg

SEQ ID NO: 8188351 - DNA, 22 bp, Homo sapiens
cccagagaaccttctgtgccac

SEQ ID NO: 8188352 - DNA, 22 bp, Homo sapiens
cccagactgcagagcgggcaga

SEQ ID NO: 8188353 - DNA, 22 bp, Homo sapiens
cccagagaaccttctgtgccac

SEQ ID NO: 8188354 - DNA, 22 bp, Homo sapiens
cccagagaattccacatagagg

SEQ ID NO: 8188355 - DNA, 22 bp, Homo sapiens
cccagagaatctttcagaaagg

SEQ ID NO: 8188356 - DNA, 22 bp, Homo sapiens
cccagagaattccacatagagg

SEQ ID NO: 8188357 - DNA, 22 bp, Homo sapiens
cccagaggtgaaggaggtggga

SEQ ID NO: 8188358 - DNA, 22 bp, Homo sapiens
cccagaggtgaaggaggtggga

SEQ ID NO: 8188359 - DNA, 22 bp, Homo sapiens
cccagcactcagcaggctcata

SEQ ID NO: 8188360 - DNA, 22 bp, Homo sapiens
cccagagggtggaggttgcagt

SEQ ID NO: 8188361 - DNA, 17 bp, Homo sapiens
cccagagatgctgcctt

SEQ ID NO: 8188362 - DNA, 22 bp, Homo sapiens
cccagagatctactgagcccag

SEQ ID NO: 8188363 - DNA, 22 bp, Homo sapiens
cccagagatcttgtcctttcca

SEQ ID NO: 8188364 - DNA, 23 bp, Homo sapiens
cccagcagagatgaggaggggtc

SEQ ID NO: 8188365 - DNA, 23 bp, Homo sapiens
cccagcagagatgaggaggggtc

SEQ ID NO: 8188366 - DNA, 22 bp, Homo sapiens
cccagcagaccgctgtgatggc

SEQ ID NO: 8188367 - DNA, 23 bp, Homo sapiens
cccagcagagatgaggaggggtc

SEQ ID NO: 8188368 - DNA, 18 bp, Homo sapiens
cccagcactttgggagcc

SEQ ID NO: 8188369 - DNA, 22 bp, Homo sapiens
cccagcagaatctgatgagggc

SEQ ID NO: 8188370 - DNA, 22 bp, Homo sapiens
cccagcactcagcaggctcata

SEQ ID NO: 8188371 - DNA, 22 bp, Homo sapiens
cccagcactttgaatatgtcac

SEQ ID NO: 8188372 - DNA, 22 bp, Homo sapiens
cccagcactttgaatatgtcac

SEQ ID NO: 8188373 - DNA, 22 bp, Homo sapiens
cccagcactttgaatatgtcac

SEQ ID NO: 8188374 - DNA, 22 bp, Homo sapiens
cccagcactttgaatatgtcac

SEQ ID NO: 8188375 - DNA, 22 bp, Homo sapiens
cccagcagaatctgatgagggc

SEQ ID NO: 8188376 - DNA, 22 bp, Homo sapiens
tgcagcaggttccaaagggtta

SEQ ID NO: 8188377 - DNA, 22 bp, Homo sapiens
cccagcagccagaatgaggagc

SEQ ID NO: 8188378 - DNA, 22 bp, Homo sapiens
cccagcagccagaatgaggagc

SEQ ID NO: 8188379 - DNA, 22 bp, Homo sapiens
cccagcagccagaatgaggagc

SEQ ID NO: 8188380 - DNA, 22 bp, Homo sapiens
cccagcagccagaatgaggagc

SEQ ID NO: 8188381 - DNA, 22 bp, Homo sapiens
tgcagaggtgaaagactagcaa

SEQ ID NO: 8188382 - DNA, 21 bp, Homo sapiens
tgcagagatatctgaagcaga

SEQ ID NO: 8188383 - DNA, 22 bp, Homo sapiens
tgcagaggtgttgctgagataa

SEQ ID NO: 8188384 - DNA, 22 bp, Homo sapiens
tgcagaggtgttgctgagataa

SEQ ID NO: 8188385 - DNA, 22 bp, Homo sapiens
tgcagaggtgttgctgagataa

SEQ ID NO: 8188386 - DNA, 22 bp, Homo sapiens
tgcagaggtgttgctgagataa

SEQ ID NO: 8188387 - DNA, 22 bp, Homo sapiens
tgcagaggtttccaggcaagtt

SEQ ID NO: 8188388 - DNA, 22 bp, Homo sapiens
tgcagaggtttccaggcaagtt

SEQ ID NO: 8188389 - DNA, 22 bp, Homo sapiens
tgcagaggtttccaggcaagtt

SEQ ID NO: 8188390 - DNA, 22 bp, Homo sapiens
tgcagaggtttccaggcaagtt

SEQ ID NO: 8188391 - DNA, 22 bp, Homo sapiens
tgcagaggtttccaggcaagtt

SEQ ID NO: 8188392 - DNA, 22 bp, Homo sapiens
tgcagaggtttccaggcaagtt

SEQ ID NO: 8188393 - DNA, 22 bp, Homo sapiens
cccacccactctgaccagaagc

SEQ ID NO: 8188394 - DNA, 22 bp, Homo sapiens
cccaccagccatctgagagtgt

SEQ ID NO: 8188395 - DNA, 22 bp, Homo sapiens
cccaccatgtgcccattggctt

SEQ ID NO: 8188396 - DNA, 22 bp, Homo sapiens
cccacccagctgagccgctcac

SEQ ID NO: 8188397 - DNA, 21 bp, Homo sapiens
cccaccccataaggcagaacc

SEQ ID NO: 8188398 - DNA, 21 bp, Homo sapiens
cccaccccataaggcagaacc

SEQ ID NO: 8188399 - DNA, 22 bp, Homo sapiens
cccacaggccctgctgccttga

SEQ ID NO: 8188400 - DNA, 22 bp, Homo sapiens
cccacaggctaggggtagggca

SEQ ID NO: 8188401 - DNA, 22 bp, Homo sapiens
cccacaggctaggggtagggca

SEQ ID NO: 8188402 - DNA, 22 bp, Homo sapiens
cccacagggctgctgatggcag

SEQ ID NO: 8188403 - DNA, 22 bp, Homo sapiens
cccacaggtccccatgaactcg

SEQ ID NO: 8188404 - DNA, 22 bp, Homo sapiens
cccacagggctgctgatggcag

SEQ ID NO: 8188405 - DNA, 22 bp, Homo sapiens
cccacagggctgctgatggcag

SEQ ID NO: 8188406 - DNA, 22 bp, Homo sapiens
cccacagggctgctgatggcag

SEQ ID NO: 8188407 - DNA, 22 bp, Homo sapiens
cccacagggctgctgatggcag

SEQ ID NO: 8188408 - DNA, 22 bp, Homo sapiens
cccacaggtggaagcctcggaa

SEQ ID NO: 8188409 - DNA, 22 bp, Homo sapiens
cccacaggtggaagcctcggaa

SEQ ID NO: 8188410 - DNA, 22 bp, Homo sapiens
cccacaggtccccatgaactcg

SEQ ID NO: 8188411 - DNA, 22 bp, Homo sapiens
cccacaggtccccatgaactcg

SEQ ID NO: 8188412 - DNA, 22 bp, Homo sapiens
cccacaggtgtgagcttgctgg

SEQ ID NO: 8188413 - DNA, 22 bp, Homo sapiens
cccacaggtgtgagcttgctgg

SEQ ID NO: 8188414 - DNA, 22 bp, Homo sapiens
cccacaggtgtgagcttgctgg

SEQ ID NO: 8188415 - DNA, 22 bp, Homo sapiens
cccacaggcaggtgcatgggct

SEQ ID NO: 8188416 - DNA, 22 bp, Homo sapiens
cccacaggcaggggcagagaca

SEQ ID NO: 8188417 - DNA, 22 bp, Homo sapiens
cccacaggcaggggcagagaca

SEQ ID NO: 8188418 - DNA, 22 bp, Homo sapiens
cccacaggccctgctgccttga

SEQ ID NO: 8188419 - DNA, 22 bp, Homo sapiens
cccacaggccctgctgccttga

SEQ ID NO: 8188420 - DNA, 22 bp, Homo sapiens
cccacaggccctgctgccttga

SEQ ID NO: 8188421 - DNA, 22 bp, Homo sapiens
cccacaggccctgctgccttga

SEQ ID NO: 8188422 - DNA, 22 bp, Homo sapiens
cccacaggcaggtgcatgggct

SEQ ID NO: 8188423 - DNA, 22 bp, Homo sapiens
cccacagaatgccaatgagacc

SEQ ID NO: 8188424 - DNA, 22 bp, Homo sapiens
cccacaggcaggggcagagaca

SEQ ID NO: 8188425 - DNA, 19 bp, Homo sapiens
cccacaggaggacatatgg

SEQ ID NO: 8188426 - DNA, 22 bp, Homo sapiens
cccaagggtgcccagcagagga

SEQ ID NO: 8188427 - DNA, 22 bp, Homo sapiens
cccaagggtgcccagcagagga

SEQ ID NO: 8188428 - DNA, 22 bp, Homo sapiens
tgcagcatttgctgaagcagga

SEQ ID NO: 8188429 - DNA, 22 bp, Homo sapiens
tgcagcattagtacaagtctca

SEQ ID NO: 8188430 - DNA, 22 bp, Homo sapiens
tgcagcagtttaatgcagggtt

SEQ ID NO: 8188431 - DNA, 22 bp, Homo sapiens
cccagcatttctgggctgcact

SEQ ID NO: 8188432 - DNA, 22 bp, Homo sapiens
cccagcatttctgggctgcact

SEQ ID NO: 8188433 - DNA, 22 bp, Homo sapiens
cccagcatttctgggctgcact

SEQ ID NO: 8188434 - DNA, 22 bp, Homo sapiens
cccagccaaggtgctggtgttg

SEQ ID NO: 8188435 - DNA, 22 bp, Homo sapiens
cccagccaagtgatctgaccgc

SEQ ID NO: 8188436 - DNA, 22 bp, Homo sapiens
cccagccagcctcttcccatat

SEQ ID NO: 8188437 - DNA, 22 bp, Homo sapiens
cccagccagcctcttcccatat

SEQ ID NO: 8188438 - DNA, 22 bp, Homo sapiens
cccagcatctccaggcatggcc

SEQ ID NO: 8188439 - DNA, 22 bp, Homo sapiens
cccagcatggagtgaggactca

SEQ ID NO: 8188440 - DNA, 22 bp, Homo sapiens
cccagcatggagtgaggactca

SEQ ID NO: 8188441 - DNA, 22 bp, Homo sapiens
cccagcccatctcaaaggtcta

SEQ ID NO: 8188442 - DNA, 22 bp, Homo sapiens
cccagcccagcgttcgaggggt

SEQ ID NO: 8188443 - DNA, 22 bp, Homo sapiens
cccagcccagcgttcgaggggt

SEQ ID NO: 8188444 - DNA, 22 bp, Homo sapiens
cccagcccacggtcctgggtgg

SEQ ID NO: 8188445 - DNA, 22 bp, Homo sapiens
cccagcccagcgttcgaggggt

SEQ ID NO: 8188446 - DNA, 18 bp, Homo sapiens
cccagcccaccatttctc

SEQ ID NO: 8188447 - DNA, 18 bp, Homo sapiens
cccagcccaccatttctc

SEQ ID NO: 8188448 - DNA, 18 bp, Homo sapiens
cccagcccaccatttctc

SEQ ID NO: 8188449 - DNA, 18 bp, Homo sapiens
cccagcccaccatttctc

SEQ ID NO: 8188450 - DNA, 18 bp, Homo sapiens
cccagcccaccatttctc

SEQ ID NO: 8188451 - DNA, 18 bp, Homo sapiens
cccagcccaccatttctc

SEQ ID NO: 8188452 - DNA, 22 bp, Homo sapiens
cccagccctgacctattggaaa

SEQ ID NO: 8188453 - DNA, 22 bp, Homo sapiens
cccagccctgacctattggaaa

SEQ ID NO: 8188454 - DNA, 20 bp, Homo sapiens
cccagcccgggccgcgctcg

SEQ ID NO: 8188455 - DNA, 20 bp, Homo sapiens
cccagcccgggccgcgctcg

SEQ ID NO: 8188456 - DNA, 20 bp, Homo sapiens
cccagcccctacctgttgcc

SEQ ID NO: 8188457 - DNA, 20 bp, Homo sapiens
cccagcccgggccgcgctcg

SEQ ID NO: 8188458 - DNA, 20 bp, Homo sapiens
cccagcccctacctgttgcc

SEQ ID NO: 8188459 - DNA, 22 bp, Homo sapiens
cccagcccccgagtgtctggaa

SEQ ID NO: 8188460 - DNA, 20 bp, Homo sapiens
cccagcccctacctgttgcc

SEQ ID NO: 8188461 - DNA, 22 bp, Homo sapiens
cccagcccccgagtgtctggaa

SEQ ID NO: 8188462 - DNA, 22 bp, Homo sapiens
cccagcccccgagtgtctggaa

SEQ ID NO: 8188463 - DNA, 22 bp, Homo sapiens
tgcagtctggatgtcctcagat

SEQ ID NO: 8188464 - DNA, 22 bp, Homo sapiens
tgcaggtggacacgggagacgg

SEQ ID NO: 8188465 - DNA, 22 bp, Homo sapiens
tgcaggtggacacgggagacgg

SEQ ID NO: 8188466 - DNA, 22 bp, Homo sapiens
tgcagtggaagaggtggagatc

SEQ ID NO: 8188467 - DNA, 22 bp, Homo sapiens
tgcagtggaaagactcagactt

SEQ ID NO: 8188468 - DNA, 22 bp, Homo sapiens
tgcagtgctttggaacaaagtc

SEQ ID NO: 8188469 - DNA, 22 bp, Homo sapiens
tgcagtggaaagactcagactt

SEQ ID NO: 8188470 - DNA, 22 bp, Homo sapiens
tgcagtgcctcggcagtgcagc

SEQ ID NO: 8188471 - DNA, 22 bp, Homo sapiens
tgcagtggaagaggtggagatc

SEQ ID NO: 8188472 - DNA, 22 bp, Homo sapiens
tgcagtggaagaggtggagatc

SEQ ID NO: 8188473 - DNA, 22 bp, Homo sapiens
tgcagtggaatctggagagcag

SEQ ID NO: 8188474 - DNA, 22 bp, Homo sapiens
tgcagtggaatctggagagcag

SEQ ID NO: 8188475 - DNA, 22 bp, Homo sapiens
tgcagtggaggccgtgagacag

SEQ ID NO: 8188476 - DNA, 22 bp, Homo sapiens
tgcagtggaggccgtgagacag

SEQ ID NO: 8188477 - DNA, 22 bp, Homo sapiens
tgcagtggaggccgtgagacag

SEQ ID NO: 8188478 - DNA, 22 bp, Homo sapiens
tgcagtggcgccatctcagctc

SEQ ID NO: 8188479 - DNA, 22 bp, Homo sapiens
tgcagtggaggccgtgagacag

SEQ ID NO: 8188480 - DNA, 22 bp, Homo sapiens
cccagctcatcaggagccgccc

SEQ ID NO: 8188481 - DNA, 22 bp, Homo sapiens
cccagctcatcaggagccgccc

SEQ ID NO: 8188482 - DNA, 22 bp, Homo sapiens
cccagctcatcaggagccgccc

SEQ ID NO: 8188483 - DNA, 22 bp, Homo sapiens
cccagctccaagggacagcgaa

SEQ ID NO: 8188484 - DNA, 22 bp, Homo sapiens
cccagctccaagggacagcgaa

SEQ ID NO: 8188485 - DNA, 18 bp, Homo sapiens
cccagctccacttccctc

SEQ ID NO: 8188486 - DNA, 18 bp, Homo sapiens
cccagctccacttccctc

SEQ ID NO: 8188487 - DNA, 22 bp, Homo sapiens
cccaggaccatccttctgtgcc

SEQ ID NO: 8188488 - DNA, 22 bp, Homo sapiens
cccaggaccatccttctgtgcc

SEQ ID NO: 8188489 - DNA, 22 bp, Homo sapiens
cccaggaccgcgcggctgagcg

SEQ ID NO: 8188490 - DNA, 22 bp, Homo sapiens
cccaggaccgcgcggctgagcg

SEQ ID NO: 8188491 - DNA, 22 bp, Homo sapiens
cccaggactaatgagctctacg

SEQ ID NO: 8188492 - DNA, 22 bp, Homo sapiens
cccaggactcttcactgcagcc

SEQ ID NO: 8188493 - DNA, 22 bp, Homo sapiens
cccaggactcttcactgcagcc

SEQ ID NO: 8188494 - DNA, 22 bp, Homo sapiens
cccaggactcttcactgcagcc

SEQ ID NO: 8188495 - DNA, 22 bp, Homo sapiens
cccagctcccatgttctccaat

SEQ ID NO: 8188496 - DNA, 22 bp, Homo sapiens
cccagctcccaagttgctatgg

SEQ ID NO: 8188497 - DNA, 22 bp, Homo sapiens
cccagctcccatgttctccaat

SEQ ID NO: 8188498 - DNA, 22 bp, Homo sapiens
cccagctccagagccagaaaca

SEQ ID NO: 8188499 - DNA, 22 bp, Homo sapiens
cccagctccagagccagaaaca

SEQ ID NO: 8188500 - DNA, 18 bp, Homo sapiens
cccagctccacttccctc

SEQ ID NO: 8188501 - DNA, 22 bp, Homo sapiens
cccagctccgagctccgagccg

SEQ ID NO: 8188502 - DNA, 22 bp, Homo sapiens
cccagctccgagctccgagccg

SEQ ID NO: 8188503 - DNA, 22 bp, Homo sapiens
cccagctccgagctccgagccg

SEQ ID NO: 8188504 - DNA, 22 bp, Homo sapiens
cccagctccgagctccgagccg

SEQ ID NO: 8188505 - DNA, 22 bp, Homo sapiens
cccagctccgagctccgagccg

SEQ ID NO: 8188506 - DNA, 22 bp, Homo sapiens
cccaggaaatagccaggaggtg

SEQ ID NO: 8188507 - DNA, 22 bp, Homo sapiens
cccaggaaatagccaggaggtg

SEQ ID NO: 8188508 - DNA, 22 bp, Homo sapiens
cccaggaattggaggctgcagt

SEQ ID NO: 8188509 - DNA, 22 bp, Homo sapiens
tgccctctgcctcctctgcaga

SEQ ID NO: 8188510 - DNA, 22 bp, Homo sapiens
tgccctctgcctcctctgcaga

SEQ ID NO: 8188511 - DNA, 22 bp, Homo sapiens
tgccctcttaggtctgcgcagc

SEQ ID NO: 8188512 - DNA, 22 bp, Homo sapiens
tgccctcttaggtctgcgcagc

SEQ ID NO: 8188513 - DNA, 22 bp, Homo sapiens
tgccctcctcctgagcccatgt

SEQ ID NO: 8188514 - DNA, 22 bp, Homo sapiens
tgccctcctcctgagcccatgt

SEQ ID NO: 8188515 - DNA, 22 bp, Homo sapiens
tgccctcctcctgagcccatgt

SEQ ID NO: 8188516 - DNA, 22 bp, Homo sapiens
tgccctctcaagttgagtcaga

SEQ ID NO: 8188517 - DNA, 22 bp, Homo sapiens
tgccctccctgtactgtcagga

SEQ ID NO: 8188518 - DNA, 22 bp, Homo sapiens
tgccctccacagtggctccacc

SEQ ID NO: 8188519 - DNA, 22 bp, Homo sapiens
tgccctcaggagtccctgacca

SEQ ID NO: 8188520 - DNA, 21 bp, Homo sapiens
cccaggaggctgagaagagca

SEQ ID NO: 8188521 - DNA, 22 bp, Homo sapiens
tgcccaggatctggcgatgctc

SEQ ID NO: 8188522 - DNA, 22 bp, Homo sapiens
tgcccaggatctggcgatgctc

SEQ ID NO: 8188523 - DNA, 22 bp, Homo sapiens
tgcccaggatctggcgatgctc

SEQ ID NO: 8188524 - DNA, 21 bp, Homo sapiens
cccaggaggctgagaagagca

SEQ ID NO: 8188525 - DNA, 22 bp, Homo sapiens
cccaggaggcggaggttgcagt

SEQ ID NO: 8188526 - DNA, 22 bp, Homo sapiens
cccaggaggttggggctacagt

SEQ ID NO: 8188527 - DNA, 22 bp, Homo sapiens
cccaggagtaagtgacattgtt

SEQ ID NO: 8188528 - DNA, 22 bp, Homo sapiens
cccaggagtaagtgacattgtt

SEQ ID NO: 8188529 - DNA, 19 bp, Homo sapiens
tgccctgcacgctgtcctg

SEQ ID NO: 8188530 - DNA, 19 bp, Homo sapiens
tgccctgcacgctgtcctg

SEQ ID NO: 8188531 - DNA, 19 bp, Homo sapiens
tgccctgcacgctgtcctg

SEQ ID NO: 8188532 - DNA, 22 bp, Homo sapiens
tgccctgaggcactccatccat

SEQ ID NO: 8188533 - DNA, 22 bp, Homo sapiens
cccaggaggttggggctacagt

SEQ ID NO: 8188534 - DNA, 22 bp, Homo sapiens
cccaggaggttggggctacagt

SEQ ID NO: 8188535 - DNA, 22 bp, Homo sapiens
cccaggaggttggggctacagt

SEQ ID NO: 8188536 - DNA, 20 bp, Homo sapiens
cccaggagtgagcagcttta

SEQ ID NO: 8188537 - DNA, 20 bp, Homo sapiens
cccaggagtgagcagcttta

SEQ ID NO: 8188538 - DNA, 22 bp, Homo sapiens
tgccctggttacactggagtcc

SEQ ID NO: 8188539 - DNA, 20 bp, Homo sapiens
cccaggagtgagcagcttta

SEQ ID NO: 8188540 - DNA, 20 bp, Homo sapiens
cccaggagtgagcagcttta

SEQ ID NO: 8188541 - DNA, 22 bp, Homo sapiens
tgcctcagtctaaagtctctca

SEQ ID NO: 8188542 - DNA, 22 bp, Homo sapiens
tgcctcagtctaaagtctctca

SEQ ID NO: 8188543 - DNA, 22 bp, Homo sapiens
tgccctggttctgtgggtgagc

SEQ ID NO: 8188544 - DNA, 22 bp, Homo sapiens
tgcctcagtttcatctgcagaa

SEQ ID NO: 8188545 - DNA, 22 bp, Homo sapiens
tgcctcagtttcatctgcagaa

SEQ ID NO: 8188546 - DNA, 22 bp, Homo sapiens
tgcctcagtttcatctgcagaa

SEQ ID NO: 8188547 - DNA, 23 bp, Homo sapiens
tgcctcagtggaatgtgagggtg

SEQ ID NO: 8188548 - DNA, 23 bp, Homo sapiens
tgcctcagtggaatgtgagggtg

SEQ ID NO: 8188549 - DNA, 23 bp, Homo sapiens
tgcctcagtggaatgtgagggtg

SEQ ID NO: 8188550 - DNA, 22 bp, Homo sapiens
cccaggaggcagaggttgcagt

SEQ ID NO: 8188551 - DNA, 22 bp, Homo sapiens
cccaggaggcctgcctggccgg

SEQ ID NO: 8188552 - DNA, 22 bp, Homo sapiens
cccaggaggcctgcctggccgg

SEQ ID NO: 8188553 - DNA, 22 bp, Homo sapiens
cccaggaggccaaggttgcagt

SEQ ID NO: 8188554 - DNA, 22 bp, Homo sapiens
cccaggaggcagaagttgcagt

SEQ ID NO: 8188555 - DNA, 22 bp, Homo sapiens
cccaggaggcagaagttgcagt

SEQ ID NO: 8188556 - DNA, 21 bp, Homo sapiens
cccaggaggagctccggctcc

SEQ ID NO: 8188557 - DNA, 22 bp, Homo sapiens
cccaggaggcagagcttgcagt

SEQ ID NO: 8188558 - DNA, 22 bp, Homo sapiens
cccaggaggcagagcttgcagt

SEQ ID NO: 8188559 - DNA, 21 bp, Homo sapiens
cccaggaggagctccggctcc

SEQ ID NO: 8188560 - DNA, 22 bp, Homo sapiens
tgcatatttgattgagatacct

SEQ ID NO: 8188561 - DNA, 22 bp, Homo sapiens
tgcatattgtccttgatattat

SEQ ID NO: 8188562 - DNA, 22 bp, Homo sapiens
tgcatattgtccttgatattat

SEQ ID NO: 8188563 - DNA, 22 bp, Homo sapiens
tgcatatatttgagattatggc

SEQ ID NO: 8188564 - DNA, 19 bp, Homo sapiens
tgcatatatctatgaaaga

SEQ ID NO: 8188565 - DNA, 22 bp, Homo sapiens
tgcatatccacaccttatctct

SEQ ID NO: 8188566 - DNA, 22 bp, Homo sapiens
tgcatatcttcaatgctgttgc

SEQ ID NO: 8188567 - DNA, 22 bp, Homo sapiens
tgcatattctcctttattttgt

SEQ ID NO: 8188568 - DNA, 22 bp, Homo sapiens
tgcatattatgtgtatctgtct

SEQ ID NO: 8188569 - DNA, 19 bp, Homo sapiens
tgcatatatctatgaaaga

SEQ ID NO: 8188570 - DNA, 21 bp, Homo sapiens
tgcatatataagtgcatacac

SEQ ID NO: 8188571 - DNA, 22 bp, Homo sapiens
cccaggagacagaaacagaggt

SEQ ID NO: 8188572 - DNA, 22 bp, Homo sapiens
cccaggagacagaaacagaggt

SEQ ID NO: 8188573 - DNA, 22 bp, Homo sapiens
tgacagagacttcagagccaaa

SEQ ID NO: 8188574 - DNA, 22 bp, Homo sapiens
tgacagactttacttctcctat

SEQ ID NO: 8188575 - DNA, 22 bp, Homo sapiens
tgacaattcattatatctacag

SEQ ID NO: 8188576 - DNA, 22 bp, Homo sapiens
tgacagactactgcctctattg

SEQ ID NO: 8188577 - DNA, 21 bp, Homo sapiens
ccagggaagaaatgagggcag

SEQ ID NO: 8188578 - DNA, 21 bp, Homo sapiens
ccagggaagaaatgagggcag

SEQ ID NO: 8188579 - DNA, 22 bp, Homo sapiens
tgaaggagaattaataggcatt

SEQ ID NO: 8188580 - DNA, 22 bp, Homo sapiens
tgaaggagaattaataggcatt

SEQ ID NO: 8188581 - DNA, 22 bp, Homo sapiens
tgaaggagaattaataggcatt

SEQ ID NO: 8188582 - DNA, 21 bp, Homo sapiens
tgaaggagaggaccgagtgct

SEQ ID NO: 8188583 - DNA, 21 bp, Homo sapiens
tgaaggagaggaccgagtgct

SEQ ID NO: 8188584 - DNA, 19 bp, Homo sapiens
ccaggctttatgcaaatac

SEQ ID NO: 8188585 - DNA, 19 bp, Homo sapiens
ccaggctttatgcaaatac

SEQ ID NO: 8188586 - DNA, 22 bp, Homo sapiens
ccaggcttggtgtgtggtcagg

SEQ ID NO: 8188587 - DNA, 22 bp, Homo sapiens
ccaggctttaagaggtggaaac

SEQ ID NO: 8188588 - DNA, 22 bp, Homo sapiens
ccaggctttcccagcctctcca

SEQ ID NO: 8188589 - DNA, 22 bp, Homo sapiens
ccaggctttcccagcctctcca

SEQ ID NO: 8188590 - DNA, 22 bp, Homo sapiens
ccaggctttctcctgactcaca

SEQ ID NO: 8188591 - DNA, 22 bp, Homo sapiens
ccaggctttcccagcctctcca

SEQ ID NO: 8188592 - DNA, 22 bp, Homo sapiens
ccaggcttttagctgcatggca

SEQ ID NO: 8188593 - DNA, 22 bp, Homo sapiens
ccaggctttctcctgactcaca

SEQ ID NO: 8188594 - DNA, 22 bp, Homo sapiens
ccaggcttttctcatggagtca

SEQ ID NO: 8188595 - DNA, 22 bp, Homo sapiens
ccagggaaaatcaacttctact

SEQ ID NO: 8188596 - DNA, 22 bp, Homo sapiens
tgacagagtcggggcaagctgt

SEQ ID NO: 8188597 - DNA, 22 bp, Homo sapiens
tgacagagtcggggcaagctgt

SEQ ID NO: 8188598 - DNA, 22 bp, Homo sapiens
tgacagagttcggattgagttt

SEQ ID NO: 8188599 - DNA, 22 bp, Homo sapiens
ccagggcatgggaagaactgaa

SEQ ID NO: 8188600 - DNA, 22 bp, Homo sapiens
ccagggcatgggaagaactgaa

SEQ ID NO: 8188601 - DNA, 22 bp, Homo sapiens
ccagggcatgggaagaactgaa

SEQ ID NO: 8188602 - DNA, 22 bp, Homo sapiens
ccagggcatgtaactaatggtg

SEQ ID NO: 8188603 - DNA, 22 bp, Homo sapiens
ccagggcatgggaagaactgaa

SEQ ID NO: 8188604 - DNA, 22 bp, Homo sapiens
ccagggcatgtaactaatggtg

SEQ ID NO: 8188605 - DNA, 22 bp, Homo sapiens
ccagggcatgtccaagacttag

SEQ ID NO: 8188606 - DNA, 22 bp, Homo sapiens
ccagggcatgtaactaatggtg

SEQ ID NO: 8188607 - DNA, 22 bp, Homo sapiens
ccagggcatgtaactaatggtg

SEQ ID NO: 8188608 - DNA, 22 bp, Homo sapiens
ccagggcatgtccaagacttag

SEQ ID NO: 8188609 - DNA, 22 bp, Homo sapiens
ccagggcatgtccaagacttag

SEQ ID NO: 8188610 - DNA, 22 bp, Homo sapiens
ccagggccaagagacctcgagg

SEQ ID NO: 8188611 - DNA, 22 bp, Homo sapiens
tgacagagcatgtagtgacagc

SEQ ID NO: 8188612 - DNA, 22 bp, Homo sapiens
tgacagagcatgtagtgacagc

SEQ ID NO: 8188613 - DNA, 22 bp, Homo sapiens
tgacagagcatgtagtgacagc

SEQ ID NO: 8188614 - DNA, 22 bp, Homo sapiens
tgacagagcatgtagtgacagc

SEQ ID NO: 8188615 - DNA, 22 bp, Homo sapiens
tgacagagcatgtagtgacagc

SEQ ID NO: 8188616 - DNA, 22 bp, Homo sapiens
tgacagagctggagaataattt

SEQ ID NO: 8188617 - DNA, 22 bp, Homo sapiens
tgacagagccaagatcagtact

SEQ ID NO: 8188618 - DNA, 22 bp, Homo sapiens
tgacagagccaagatcagtact

SEQ ID NO: 8188619 - DNA, 22 bp, Homo sapiens
tgacagagaggtaagttatgaa

SEQ ID NO: 8188620 - DNA, 19 bp, Homo sapiens
tgacagagagcagggtggt

SEQ ID NO: 8188621 - DNA, 19 bp, Homo sapiens
tgacagagagcagggtggt

SEQ ID NO: 8188622 - DNA, 19 bp, Homo sapiens
tgacagagagcagggtggt

SEQ ID NO: 8188623 - DNA, 19 bp, Homo sapiens
tgacagagagcagggtggt

SEQ ID NO: 8188624 - DNA, 22 bp, Homo sapiens
tgacagagcaagatctagataa

SEQ ID NO: 8188625 - DNA, 23 bp, Homo sapiens
tgacagagcaagacttggtctca

SEQ ID NO: 8188626 - DNA, 22 bp, Homo sapiens
tgacagagatggaatgaatctt

SEQ ID NO: 8188627 - DNA, 23 bp, Homo sapiens
tgacagagcacagtgggggagat

SEQ ID NO: 8188628 - DNA, 22 bp, Homo sapiens
tgacagagcaagatcttatctc

SEQ ID NO: 8188629 - DNA, 22 bp, Homo sapiens
tgacagagcaagatctagataa

SEQ ID NO: 8188630 - DNA, 22 bp, Homo sapiens
tgactttgtccctttcaaatcc

SEQ ID NO: 8188631 - DNA, 22 bp, Homo sapiens
ccagggtggcgtagatgctggg

SEQ ID NO: 8188632 - DNA, 22 bp, Homo sapiens
ccagggtctctgctgcctgaga

SEQ ID NO: 8188633 - DNA, 22 bp, Homo sapiens
ccagggtctctgctgcctgaga

SEQ ID NO: 8188634 - DNA, 22 bp, Homo sapiens
tgactttaagctatctgattct

SEQ ID NO: 8188635 - DNA, 22 bp, Homo sapiens
tgaccctgcttcttggtgcagg

SEQ ID NO: 8188636 - DNA, 22 bp, Homo sapiens
tgaccctcttccccatgcgctc

SEQ ID NO: 8188637 - DNA, 22 bp, Homo sapiens
tgaccctctggccccacagcca

SEQ ID NO: 8188638 - DNA, 21 bp, Homo sapiens
tgaccctcccagccctgccaa

SEQ ID NO: 8188639 - DNA, 22 bp, Homo sapiens
tgaccctgagagctgaatggct

SEQ ID NO: 8188640 - DNA, 22 bp, Homo sapiens
tgaccctcttccccatgcgctc

SEQ ID NO: 8188641 - DNA, 19 bp, Homo sapiens
tgaccccacgctccagagc

SEQ ID NO: 8188642 - DNA, 17 bp, Homo sapiens
tgactttatttgcttgg

SEQ ID NO: 8188643 - DNA, 22 bp, Homo sapiens
tgactttcttaactagctgttc

SEQ ID NO: 8188644 - DNA, 22 bp, Homo sapiens
tgactttacagatatgtttcct

SEQ ID NO: 8188645 - DNA, 22 bp, Homo sapiens
tgactttagacttagtcaagtt

SEQ ID NO: 8188646 - DNA, 22 bp, Homo sapiens
tgactttagaattttatccaga

SEQ ID NO: 8188647 - DNA, 22 bp, Homo sapiens
tgaccagtgacccgaggcaagt

SEQ ID NO: 8188648 - DNA, 22 bp, Homo sapiens
tgaccagttaagtcatcctgtc

SEQ ID NO: 8188649 - DNA, 21 bp, Homo sapiens
tgaccagtgccccatcctgtc

SEQ ID NO: 8188650 - DNA, 22 bp, Homo sapiens
tgaccagtggcgctgggtgcaa

SEQ ID NO: 8188651 - DNA, 22 bp, Homo sapiens
tgaccagtgatctactgggatt

SEQ ID NO: 8188652 - DNA, 22 bp, Homo sapiens
tgaccagtgcagggggagttag

SEQ ID NO: 8188653 - DNA, 22 bp, Homo sapiens
tgaccaaagagttgcttgtatt

SEQ ID NO: 8188654 - DNA, 22 bp, Homo sapiens
tgaccaatactgtggatgccag

SEQ ID NO: 8188655 - DNA, 22 bp, Homo sapiens
tgaccacagacccaatgactac

SEQ ID NO: 8188656 - DNA, 22 bp, Homo sapiens
tgaccacagacccaatgactac

SEQ ID NO: 8188657 - DNA, 22 bp, Homo sapiens
tgaccacagacccaatgactac

SEQ ID NO: 8188658 - DNA, 22 bp, Homo sapiens
tgaccactgaatatgactgcct

SEQ ID NO: 8188659 - DNA, 22 bp, Homo sapiens
tgaccactgacctcagccctgg

SEQ ID NO: 8188660 - DNA, 23 bp, Homo sapiens
ccagggcccctacaccactgtcc

SEQ ID NO: 8188661 - DNA, 23 bp, Homo sapiens
ccagggcccctacaccactgtcc

SEQ ID NO: 8188662 - DNA, 22 bp, Homo sapiens
tgacatctagtaggtagagacc

SEQ ID NO: 8188663 - DNA, 22 bp, Homo sapiens
tgacatctttgatctcatttag

SEQ ID NO: 8188664 - DNA, 22 bp, Homo sapiens
tgacatttttgtacaaagtcag

SEQ ID NO: 8188665 - DNA, 22 bp, Homo sapiens
ccagggccagtaagattggcat

SEQ ID NO: 8188666 - DNA, 22 bp, Homo sapiens
ccagggccagtaagattggcat

SEQ ID NO: 8188667 - DNA, 22 bp, Homo sapiens
ccagggccagtaagattggcat

SEQ ID NO: 8188668 - DNA, 22 bp, Homo sapiens
ccagggccagtaagattggcat

SEQ ID NO: 8188669 - DNA, 22 bp, Homo sapiens
ccagggcccacggccagaatag

SEQ ID NO: 8188670 - DNA, 22 bp, Homo sapiens
tgaggaatgctgagcagaggaa

SEQ ID NO: 8188671 - DNA, 22 bp, Homo sapiens
tgaggaatgttttgagtgccga

SEQ ID NO: 8188672 - DNA, 22 bp, Homo sapiens
tgaggacatgagtgggacagag

SEQ ID NO: 8188673 - DNA, 22 bp, Homo sapiens
tgaggacaatccctaactcaga

SEQ ID NO: 8188674 - DNA, 23 bp, Homo sapiens
tgagctggtattgtccatctcca

SEQ ID NO: 8188675 - DNA, 22 bp, Homo sapiens
tgaggaatgctgagcagaggaa

SEQ ID NO: 8188676 - DNA, 22 bp, Homo sapiens
tgaggaagttgtttctcttcta

SEQ ID NO: 8188677 - DNA, 22 bp, Homo sapiens
tgagctgggctgggctgagctg

SEQ ID NO: 8188678 - DNA, 22 bp, Homo sapiens
tgagctgggctgggctgagctg

SEQ ID NO: 8188679 - DNA, 22 bp, Homo sapiens
tgagctgggctgggctgagctg

SEQ ID NO: 8188680 - DNA, 23 bp, Homo sapiens
tgagctgggcctgcaggggtctc

SEQ ID NO: 8188681 - DNA, 22 bp, Homo sapiens
tgagctgggctgggctgagctg

SEQ ID NO: 8188682 - DNA, 23 bp, Homo sapiens
tgagctgggcctgcaggggtctc

SEQ ID NO: 8188683 - DNA, 23 bp, Homo sapiens
tgagctgggcctgcaggggtctc

SEQ ID NO: 8188684 - DNA, 22 bp, Homo sapiens
tgaggacattggtcaggacatg

SEQ ID NO: 8188685 - DNA, 22 bp, Homo sapiens
tgaggacattggtcaggacatg

SEQ ID NO: 8188686 - DNA, 22 bp, Homo sapiens
tgaggacattggtcaggacatg

SEQ ID NO: 8188687 - DNA, 22 bp, Homo sapiens
tgaggacatttatcttggcgca

SEQ ID NO: 8188688 - DNA, 22 bp, Homo sapiens
ccagtggccatgcacgagcagc

SEQ ID NO: 8188689 - DNA, 23 bp, Homo sapiens
ccagtggcgtaaactagaggata

SEQ ID NO: 8188690 - DNA, 22 bp, Homo sapiens
ccagtggccatgcacgagcagc

SEQ ID NO: 8188691 - DNA, 23 bp, Homo sapiens
ccagtggcgtaaactagaggata

SEQ ID NO: 8188692 - DNA, 23 bp, Homo sapiens
ccagtggcgtaaactagaggata

SEQ ID NO: 8188693 - DNA, 22 bp, Homo sapiens
ccagtggctacaggggggttga

SEQ ID NO: 8188694 - DNA, 20 bp, Homo sapiens
ccagtgggaagtgattaggt

SEQ ID NO: 8188695 - DNA, 22 bp, Homo sapiens
ccagtgggaacactggcattgc

SEQ ID NO: 8188696 - DNA, 22 bp, Homo sapiens
tgaggacattgagactggagac

SEQ ID NO: 8188697 - DNA, 22 bp, Homo sapiens
tgaggacattgagactggagac

SEQ ID NO: 8188698 - DNA, 22 bp, Homo sapiens
tgaggacattgagactggagac

SEQ ID NO: 8188699 - DNA, 22 bp, Homo sapiens
tgaggacattgagactggagac

SEQ ID NO: 8188700 - DNA, 22 bp, Homo sapiens
tgaggacattgagactggagac

SEQ ID NO: 8188701 - DNA, 22 bp, Homo sapiens
tgaggacattaggaagtgaagg

SEQ ID NO: 8188702 - DNA, 22 bp, Homo sapiens
tgaggacatgagtgggacagag

SEQ ID NO: 8188703 - DNA, 22 bp, Homo sapiens
tgaggacattaggaagtgaagg

SEQ ID NO: 8188704 - DNA, 22 bp, Homo sapiens
tgaggacattaggaagtgaagg

SEQ ID NO: 8188705 - DNA, 22 bp, Homo sapiens
tgagcagacttgatgaggcagc

SEQ ID NO: 8188706 - DNA, 22 bp, Homo sapiens
tgagcccaggagttggaggctg

SEQ ID NO: 8188707 - DNA, 22 bp, Homo sapiens
tgagcagaagccctcctggact

SEQ ID NO: 8188708 - DNA, 22 bp, Homo sapiens
tgagcagaacacgggatccatg

SEQ ID NO: 8188709 - DNA, 22 bp, Homo sapiens
tgagctggcacttttcctggga

SEQ ID NO: 8188710 - DNA, 22 bp, Homo sapiens
tgagcccaggagttggaggctg

SEQ ID NO: 8188711 - DNA, 22 bp, Homo sapiens
tgagctggcaggggctcaggga

SEQ ID NO: 8188712 - DNA, 22 bp, Homo sapiens
tgagctggcacttttcctggga

SEQ ID NO: 8188713 - DNA, 22 bp, Homo sapiens
tgagctggcttgtcaaccaggg

SEQ ID NO: 8188714 - DNA, 22 bp, Homo sapiens
tgagctgggaagagcagccaga

SEQ ID NO: 8188715 - DNA, 22 bp, Homo sapiens
tgagctggcttgtcaaccaggg

SEQ ID NO: 8188716 - DNA, 21 bp, Homo sapiens
tgagctgggagttctgaaaag

SEQ ID NO: 8188717 - DNA, 21 bp, Homo sapiens
tgagctgggagttctgaaaag

SEQ ID NO: 8188718 - DNA, 21 bp, Homo sapiens
tgagctgggagttctgaaaag

SEQ ID NO: 8188719 - DNA, 22 bp, Homo sapiens
tgagctgggagtggtgatgagg

SEQ ID NO: 8188720 - DNA, 22 bp, Homo sapiens
tgagctgggagtggtgatgagg

SEQ ID NO: 8188721 - DNA, 22 bp, Homo sapiens
tgagctgggagtggtgatgagg

SEQ ID NO: 8188722 - DNA, 22 bp, Homo sapiens
ccagggtgtgagaaggaagtag

SEQ ID NO: 8188723 - DNA, 22 bp, Homo sapiens
ccagggtgtgagaaggaagtag

SEQ ID NO: 8188724 - DNA, 22 bp, Homo sapiens
ccagggtggggtccaggaacca

SEQ ID NO: 8188725 - DNA, 22 bp, Homo sapiens
ccagggtggggtccaggaacca

SEQ ID NO: 8188726 - DNA, 22 bp, Homo sapiens
ccagggtggggtccaggaacca

SEQ ID NO: 8188727 - DNA, 22 bp, Homo sapiens
ccagggtgtagggattccagat

SEQ ID NO: 8188728 - DNA, 22 bp, Homo sapiens
ccagggtggggcaggcccactg

SEQ ID NO: 8188729 - DNA, 22 bp, Homo sapiens
ccagggtggggcaggcccactg

SEQ ID NO: 8188730 - DNA, 22 bp, Homo sapiens
ccagggtggggcaggcccactg

SEQ ID NO: 8188731 - DNA, 22 bp, Homo sapiens
ccagggtgggaggctgaaggcg

SEQ ID NO: 8188732 - DNA, 22 bp, Homo sapiens
ccagggtggcgtagatgctggg

SEQ ID NO: 8188733 - DNA, 22 bp, Homo sapiens
ccagggtggcgtagatgctggg

SEQ ID NO: 8188734 - DNA, 22 bp, Homo sapiens
ccagggtggcgtagatgctggg

SEQ ID NO: 8188735 - DNA, 22 bp, Homo sapiens
ccagggtgggaggctgaaggcg

SEQ ID NO: 8188736 - DNA, 22 bp, Homo sapiens
ccagggtgtgggcgtcggcacg

SEQ ID NO: 8188737 - DNA, 22 bp, Homo sapiens
ccagggtgtgggcgtcggcacg

SEQ ID NO: 8188738 - DNA, 22 bp, Homo sapiens
ccagggttgcagggagccagca

SEQ ID NO: 8188739 - DNA, 22 bp, Homo sapiens
ccagggttgctgtatggcactt

SEQ ID NO: 8188740 - DNA, 22 bp, Homo sapiens
ccagggttgcagggagccagca

SEQ ID NO: 8188741 - DNA, 22 bp, Homo sapiens
ccagggttggatgagtcactta

SEQ ID NO: 8188742 - DNA, 22 bp, Homo sapiens
ccagggttgctgtatggcactt

SEQ ID NO: 8188743 - DNA, 22 bp, Homo sapiens
ccagggttggcaagcaaggctt

SEQ ID NO: 8188744 - DNA, 22 bp, Homo sapiens
ccagggttggtattcacctgga

SEQ ID NO: 8188745 - DNA, 22 bp, Homo sapiens
ccagggttggcaagcaaggctt

SEQ ID NO: 8188746 - DNA, 22 bp, Homo sapiens
ccaggtcaagctcccctgtggt

SEQ ID NO: 8188747 - DNA, 22 bp, Homo sapiens
ccaggtcaagctcccctgtggt

SEQ ID NO: 8188748 - DNA, 22 bp, Homo sapiens
ccagggtttagcaagcctacaa

SEQ ID NO: 8188749 - DNA, 22 bp, Homo sapiens
ccagggttggtctctctgaggt

SEQ ID NO: 8188750 - DNA, 22 bp, Homo sapiens
ccagggtttaaattctgactat

SEQ ID NO: 8188751 - DNA, 22 bp, Homo sapiens
tgagactcagcacttgtgtgtc

SEQ ID NO: 8188752 - DNA, 22 bp, Homo sapiens
tgagacttggcactgaggaact

SEQ ID NO: 8188753 - DNA, 22 bp, Homo sapiens
ccaggtctatcaagttgggctc

SEQ ID NO: 8188754 - DNA, 22 bp, Homo sapiens
ccaggtctatcaagttgggctc

SEQ ID NO: 8188755 - DNA, 22 bp, Homo sapiens
ccaggtcctgttttcaccacag

SEQ ID NO: 8188756 - DNA, 17 bp, Homo sapiens
ccaggtctccttgcttt

SEQ ID NO: 8188757 - DNA, 22 bp, Homo sapiens
ccaggtctatcaagttgggctc

SEQ ID NO: 8188758 - DNA, 22 bp, Homo sapiens
tgagagtggttcagctcagaag

SEQ ID NO: 8188759 - DNA, 22 bp, Homo sapiens
tgagagtggttcagctcagaag

SEQ ID NO: 8188760 - DNA, 22 bp, Homo sapiens
tgagagtgaaatgtcacatgtc

SEQ ID NO: 8188761 - DNA, 22 bp, Homo sapiens
tgagagtctttaaattctgaga

SEQ ID NO: 8188762 - DNA, 22 bp, Homo sapiens
tgagagtagagtcttcatctgt

SEQ ID NO: 8188763 - DNA, 22 bp, Homo sapiens
tgagagttttgacgcttgtaac

SEQ ID NO: 8188764 - DNA, 22 bp, Homo sapiens
tgagagttcctcctctttccac

SEQ ID NO: 8188765 - DNA, 22 bp, Homo sapiens
tgagagttctctcttcaggtgg

SEQ ID NO: 8188766 - DNA, 22 bp, Homo sapiens
tgagcacctaccttgtccagtg

SEQ ID NO: 8188767 - DNA, 22 bp, Homo sapiens
tgaagatttccaccaaatcaca

SEQ ID NO: 8188768 - DNA, 22 bp, Homo sapiens
tgaagctttaggatgggttcat

SEQ ID NO: 8188769 - DNA, 22 bp, Homo sapiens
tgaagatttaagcatctcaatt

SEQ ID NO: 8188770 - DNA, 22 bp, Homo sapiens
tgaagatttccaccaaatcaca

SEQ ID NO: 8188771 - DNA, 22 bp, Homo sapiens
tgaaggaaagagggaacatccc

SEQ ID NO: 8188772 - DNA, 22 bp, Homo sapiens
tgaagctttaggatgggttcat

SEQ ID NO: 8188773 - DNA, 22 bp, Homo sapiens
tgaagatttccaccaaatcaca

SEQ ID NO: 8188774 - DNA, 22 bp, Homo sapiens
tgaagatgtcagcaggggtggt

SEQ ID NO: 8188775 - DNA, 17 bp, Homo sapiens
tgaagatgcatggcagc

SEQ ID NO: 8188776 - DNA, 17 bp, Homo sapiens
tgaagatgcatggcagc

SEQ ID NO: 8188777 - DNA, 22 bp, Homo sapiens
tgaagatctgtcaaccccatat

SEQ ID NO: 8188778 - DNA, 22 bp, Homo sapiens
tgaagataaattgtactgaaga

SEQ ID NO: 8188779 - DNA, 22 bp, Homo sapiens
tgaagagtttccagcctgcttg

SEQ ID NO: 8188780 - DNA, 22 bp, Homo sapiens
tgaagagtgtgactgcacctag

SEQ ID NO: 8188781 - DNA, 22 bp, Homo sapiens
tgaaggaatgagtatactgttt

SEQ ID NO: 8188782 - DNA, 22 bp, Homo sapiens
tgaaggaatgagtatactgttt

SEQ ID NO: 8188783 - DNA, 22 bp, Homo sapiens
tgaaggaatgagggagtgggtc

SEQ ID NO: 8188784 - DNA, 22 bp, Homo sapiens
tgaaggagaattaataggcatt

SEQ ID NO: 8188785 - DNA, 22 bp, Homo sapiens
tgaaggagaaatggaaagtggg

SEQ ID NO: 8188786 - DNA, 22 bp, Homo sapiens
tgaaggaatggaggatcagagc

SEQ ID NO: 8188787 - DNA, 19 bp, Homo sapiens
tgaaggacagtgcacatca

SEQ ID NO: 8188788 - DNA, 22 bp, Homo sapiens
tgaaggaagaataggcagtgtt

SEQ ID NO: 8188789 - DNA, 22 bp, Homo sapiens
tgaaggaaatgacggcagaaga

SEQ ID NO: 8188790 - DNA, 22 bp, Homo sapiens
tgaaggaagaataggcagtgtt

SEQ ID NO: 8188791 - DNA, 17 bp, Homo sapiens
tgaaggaaggatgatgt

SEQ ID NO: 8188792 - DNA, 17 bp, Homo sapiens
tgaaggaaggatgatgt

SEQ ID NO: 8188793 - DNA, 17 bp, Homo sapiens
tgaaggaaggatgatgt

SEQ ID NO: 8188794 - DNA, 23 bp, Homo sapiens
tgaacagtatgtgggacattgag

SEQ ID NO: 8188795 - DNA, 22 bp, Homo sapiens
tgaacaggctgtactcatgagg

SEQ ID NO: 8188796 - DNA, 22 bp, Homo sapiens
tgaacagtcatttagaatgtgc

SEQ ID NO: 8188797 - DNA, 22 bp, Homo sapiens
tgaacagtcaaaaagtgaccat

SEQ ID NO: 8188798 - DNA, 22 bp, Homo sapiens
tgaagagatagaagtacatgct

SEQ ID NO: 8188799 - DNA, 22 bp, Homo sapiens
tgaagagatagaagtacatgct

SEQ ID NO: 8188800 - DNA, 20 bp, Homo sapiens
tgaagagtgcgcacattgcc

SEQ ID NO: 8188801 - DNA, 22 bp, Homo sapiens
tgaagagtgcttgagattttaa

SEQ ID NO: 8188802 - DNA, 22 bp, Homo sapiens
tgaagagttaattatgaggtgc

SEQ ID NO: 8188803 - DNA, 22 bp, Homo sapiens
tgaagaggccgtgtgcaggtga

SEQ ID NO: 8188804 - DNA, 22 bp, Homo sapiens
tgaagagtattaggttatttga

SEQ ID NO: 8188805 - DNA, 22 bp, Homo sapiens
tgaagagtcatttcattcccag

SEQ ID NO: 8188806 - DNA, 22 bp, Homo sapiens
tgaagagtgattcatgcagtca

SEQ ID NO: 8188807 - DNA, 22 bp, Homo sapiens
tgaagaggccaaactatcattg

SEQ ID NO: 8188808 - DNA, 20 bp, Homo sapiens
tgaagaggaagaggacggcc

SEQ ID NO: 8188809 - DNA, 22 bp, Homo sapiens
tgaagaggccaaactatcattg

SEQ ID NO: 8188810 - DNA, 21 bp, Homo sapiens
tgaacactctacccatttttt

SEQ ID NO: 8188811 - DNA, 20 bp, Homo sapiens
tgaacactggggtgtttcag

SEQ ID NO: 8188812 - DNA, 20 bp, Homo sapiens
tgaacactggggtgtttcag

SEQ ID NO: 8188813 - DNA, 22 bp, Homo sapiens
tgaacactctggggtgggaggt

SEQ ID NO: 8188814 - DNA, 22 bp, Homo sapiens
tgaacactgccatatttaagaa

SEQ ID NO: 8188815 - DNA, 20 bp, Homo sapiens
tgaacactggggtgtttcag

SEQ ID NO: 8188816 - DNA, 22 bp, Homo sapiens
tgaacactgtatattcttcttg

SEQ ID NO: 8188817 - DNA, 22 bp, Homo sapiens
tgaacagatcaatagaactgac

SEQ ID NO: 8188818 - DNA, 22 bp, Homo sapiens
tgaacagatgccttctcccatg

SEQ ID NO: 8188819 - DNA, 22 bp, Homo sapiens
tgaacagatggcccagcagagg

SEQ ID NO: 8188820 - DNA, 18 bp, Homo sapiens
tgaacagatgagttgaag

SEQ ID NO: 8188821 - DNA, 22 bp, Homo sapiens
tgaaagcatatgctaaagacca

SEQ ID NO: 8188822 - DNA, 22 bp, Homo sapiens
tgaaagcagtgccatgattatg

SEQ ID NO: 8188823 - DNA, 22 bp, Homo sapiens
tgaaagctgaggacaggagggt

SEQ ID NO: 8188824 - DNA, 20 bp, Homo sapiens
tgaaagcatgtggtatttgg

SEQ ID NO: 8188825 - DNA, 22 bp, Homo sapiens
tgaaagcagcaccaataccatt

SEQ ID NO: 8188826 - DNA, 22 bp, Homo sapiens
tgaaagcagcaccaataccatt

SEQ ID NO: 8188827 - DNA, 22 bp, Homo sapiens
tgaaagcagatagctctgttgt

SEQ ID NO: 8188828 - DNA, 21 bp, Homo sapiens
tgaaacagatggaagtatttg

SEQ ID NO: 8188829 - DNA, 22 bp, Homo sapiens
ccaggctcctcatgatcttgtt

SEQ ID NO: 8188830 - DNA, 22 bp, Homo sapiens
ccaggctccgcatagaccccac

SEQ ID NO: 8188831 - DNA, 22 bp, Homo sapiens
ccaggctccgcatagaccccac

SEQ ID NO: 8188832 - DNA, 22 bp, Homo sapiens
ccaggctccgcatagaccccac

SEQ ID NO: 8188833 - DNA, 21 bp, Homo sapiens
ccaggctcctgaggctggtca

SEQ ID NO: 8188834 - DNA, 22 bp, Homo sapiens
ccaggctcctcatgatcttgtt

SEQ ID NO: 8188835 - DNA, 22 bp, Homo sapiens
ccaggctccgcatagaccccac

SEQ ID NO: 8188836 - DNA, 22 bp, Homo sapiens
ccaggctccccaggaggccctt

SEQ ID NO: 8188837 - DNA, 22 bp, Homo sapiens
ccaggctgcagtcaaggggcat

SEQ ID NO: 8188838 - DNA, 22 bp, Homo sapiens
ccaggctgagcatgattggagc

SEQ ID NO: 8188839 - DNA, 22 bp, Homo sapiens
tgaaagggaacctgctggactg

SEQ ID NO: 8188840 - DNA, 22 bp, Homo sapiens
tgaaagggaacctgctggactg

SEQ ID NO: 8188841 - DNA, 22 bp, Homo sapiens
tgaaaggggttgagttacagct

SEQ ID NO: 8188842 - DNA, 22 bp, Homo sapiens
ccaggctgagcatgattggagc

SEQ ID NO: 8188843 - DNA, 22 bp, Homo sapiens
ccaggctgagcatgattggagc

SEQ ID NO: 8188844 - DNA, 22 bp, Homo sapiens
ccaggctgccgaggaaagaaag

SEQ ID NO: 8188845 - DNA, 22 bp, Homo sapiens
ccaggctgctcacaagctgccc

SEQ ID NO: 8188846 - DNA, 22 bp, Homo sapiens
ccaggctgccgaggaaagaaag

SEQ ID NO: 8188847 - DNA, 22 bp, Homo sapiens
ccaggctgcagtcaaggggcat

SEQ ID NO: 8188848 - DNA, 22 bp, Homo sapiens
ccaggctgcagtcaaggggcat

SEQ ID NO: 8188849 - DNA, 22 bp, Homo sapiens
ccaggctgcagtcaaggggcat

SEQ ID NO: 8188850 - DNA, 22 bp, Homo sapiens
ccaggctgcagtcaaggggcat

SEQ ID NO: 8188851 - DNA, 22 bp, Homo sapiens
ccaggctgctcacaagctgccc

SEQ ID NO: 8188852 - DNA, 22 bp, Homo sapiens
ccaggctgctcacaagctgccc

SEQ ID NO: 8188853 - DNA, 22 bp, Homo sapiens
ccaggctgctcacaagctgccc

SEQ ID NO: 8188854 - DNA, 22 bp, Homo sapiens
ccaggctgctcacaagctgccc

SEQ ID NO: 8188855 - DNA, 22 bp, Homo sapiens
ccaggctgctcacaagctgccc

SEQ ID NO: 8188856 - DNA, 22 bp, Homo sapiens
ccaggctgctcacaagctgccc

SEQ ID NO: 8188857 - DNA, 22 bp, Homo sapiens
ccaggctgctcacaagctgccc

SEQ ID NO: 8188858 - DNA, 22 bp, Homo sapiens
ccaggctgctgttggtgtccgc

SEQ ID NO: 8188859 - DNA, 22 bp, Homo sapiens
tgaaatgattatatggtgtttg

SEQ ID NO: 8188860 - DNA, 22 bp, Homo sapiens
tgaaatgattatatggtgtttg

SEQ ID NO: 8188861 - DNA, 22 bp, Homo sapiens
tgaaatgcaacagttatttttg

SEQ ID NO: 8188862 - DNA, 22 bp, Homo sapiens
tgaaatgcaacagttatttttg

SEQ ID NO: 8188863 - DNA, 22 bp, Homo sapiens
tgaaatgattatatggtgtttg

SEQ ID NO: 8188864 - DNA, 22 bp, Homo sapiens
tgaacacagttctgatgagctt

SEQ ID NO: 8188865 - DNA, 22 bp, Homo sapiens
tgaacacataaaagcaaagggt

SEQ ID NO: 8188866 - DNA, 22 bp, Homo sapiens
ccagcctcactggcatcaccta

SEQ ID NO: 8188867 - DNA, 22 bp, Homo sapiens
ccagccctttgtggttcactga

SEQ ID NO: 8188868 - DNA, 22 bp, Homo sapiens
ccagccctttgtggttcactga

SEQ ID NO: 8188869 - DNA, 22 bp, Homo sapiens
ccagccctttgtggttcactga

SEQ ID NO: 8188870 - DNA, 22 bp, Homo sapiens
ccagcccttgaggtctgtccat

SEQ ID NO: 8188871 - DNA, 22 bp, Homo sapiens
ccagcccttgctgaagggtggc

SEQ ID NO: 8188872 - DNA, 22 bp, Homo sapiens
ccagcccttgagatggaaggga

SEQ ID NO: 8188873 - DNA, 22 bp, Homo sapiens
ccagcccttgaggtctgtccat

SEQ ID NO: 8188874 - DNA, 22 bp, Homo sapiens
ccagcccttgaggtctgtccat

SEQ ID NO: 8188875 - DNA, 22 bp, Homo sapiens
tctgcagatttatcagcagctg

SEQ ID NO: 8188876 - DNA, 22 bp, Homo sapiens
ccagcccttgagatggaaggga

SEQ ID NO: 8188877 - DNA, 22 bp, Homo sapiens
ccagcccttgagatggaaggga

SEQ ID NO: 8188878 - DNA, 22 bp, Homo sapiens
ccagcccttgagatggaaggga

SEQ ID NO: 8188879 - DNA, 23 bp, Homo sapiens
tctgcagacgctgttctattgtc

SEQ ID NO: 8188880 - DNA, 22 bp, Homo sapiens
tctgcagacaggaagctgaggc

SEQ ID NO: 8188881 - DNA, 22 bp, Homo sapiens
tctgcagacaggaagctgaggc

SEQ ID NO: 8188882 - DNA, 22 bp, Homo sapiens
tctgcagagattctgggctgag

SEQ ID NO: 8188883 - DNA, 22 bp, Homo sapiens
tctgcagagattctgggctgag

SEQ ID NO: 8188884 - DNA, 17 bp, Homo sapiens
tctgcagaggcaaacct

SEQ ID NO: 8188885 - DNA, 22 bp, Homo sapiens
tctgcagagggagtgctgggtc

SEQ ID NO: 8188886 - DNA, 22 bp, Homo sapiens
tctgcagagggagtgctgggtc

SEQ ID NO: 8188887 - DNA, 22 bp, Homo sapiens
tctgcagagcctcaggagaaca

SEQ ID NO: 8188888 - DNA, 22 bp, Homo sapiens
ccagcctcactggcatcaccta

SEQ ID NO: 8188889 - DNA, 22 bp, Homo sapiens
ccagcctcactggcatcaccta

SEQ ID NO: 8188890 - DNA, 21 bp, Homo sapiens
ccagcctcagatcagggagct

SEQ ID NO: 8188891 - DNA, 21 bp, Homo sapiens
ccagcctcagatcagggagct

SEQ ID NO: 8188892 - DNA, 22 bp, Homo sapiens
tcttgcctcttcccctttccat

SEQ ID NO: 8188893 - DNA, 18 bp, Homo sapiens
tcttgcctgcaccctctc

SEQ ID NO: 8188894 - DNA, 22 bp, Homo sapiens
tcttggtctttcatccttcaac

SEQ ID NO: 8188895 - DNA, 22 bp, Homo sapiens
tcttgtaattaactagaaagat

SEQ ID NO: 8188896 - DNA, 22 bp, Homo sapiens
tcttgggggactttggcatgga

SEQ ID NO: 8188897 - DNA, 22 bp, Homo sapiens
tcttgggggactttggcatgga

SEQ ID NO: 8188898 - DNA, 18 bp, Homo sapiens
tcttgcctgcaccctctc

SEQ ID NO: 8188899 - DNA, 22 bp, Homo sapiens
tcttggggtagacctgagaatt

SEQ ID NO: 8188900 - DNA, 22 bp, Homo sapiens
tcttgggggactttggcatgga

SEQ ID NO: 8188901 - DNA, 22 bp, Homo sapiens
tcttgtgtggtggaagatatgg

SEQ ID NO: 8188902 - DNA, 22 bp, Homo sapiens
tcttgttatcaggaaaacagta

SEQ ID NO: 8188903 - DNA, 21 bp, Homo sapiens
tcttgtccttgctctcccact

SEQ ID NO: 8188904 - DNA, 21 bp, Homo sapiens
tcttgtccttgctctcccact

SEQ ID NO: 8188905 - DNA, 22 bp, Homo sapiens
tcttgttttgaactcatcagga

SEQ ID NO: 8188906 - DNA, 22 bp, Homo sapiens
tctttaaagttggagcttgcaa

SEQ ID NO: 8188907 - DNA, 22 bp, Homo sapiens
tctttaagagttcatttgcatg

SEQ ID NO: 8188908 - DNA, 22 bp, Homo sapiens
tcttgtttctgtatataatgac

SEQ ID NO: 8188909 - DNA, 22 bp, Homo sapiens
tcttgtttctgtatataatgac

SEQ ID NO: 8188910 - DNA, 17 bp, Homo sapiens
ccaggctccatcactgt

SEQ ID NO: 8188911 - DNA, 22 bp, Homo sapiens
ccaggctccccaggaggccctt

SEQ ID NO: 8188912 - DNA, 22 bp, Homo sapiens
ccaggctccccaggaggccctt

SEQ ID NO: 8188913 - DNA, 22 bp, Homo sapiens
ccaggctcagggcagactttca

SEQ ID NO: 8188914 - DNA, 17 bp, Homo sapiens
ccaggctccatcactgt

SEQ ID NO: 8188915 - DNA, 17 bp, Homo sapiens
ccaggctccatcactgt

SEQ ID NO: 8188916 - DNA, 22 bp, Homo sapiens
ccaggctcaggtgcgagagaca

SEQ ID NO: 8188917 - DNA, 22 bp, Homo sapiens
ccaggctcaggcctgctcgttg

SEQ ID NO: 8188918 - DNA, 22 bp, Homo sapiens
ccaggctcagggcagactttca

SEQ ID NO: 8188919 - DNA, 22 bp, Homo sapiens
ccaggctcagggcagactttca

SEQ ID NO: 8188920 - DNA, 22 bp, Homo sapiens
ccaggctcaggcctgctcgttg

SEQ ID NO: 8188921 - DNA, 22 bp, Homo sapiens
ccaggctcaggcctgctcgttg

SEQ ID NO: 8188922 - DNA, 22 bp, Homo sapiens
ccaggctcaggcctgctcgttg

SEQ ID NO: 8188923 - DNA, 22 bp, Homo sapiens
ccaggctcaggcctgctcgttg

SEQ ID NO: 8188924 - DNA, 22 bp, Homo sapiens
ccaggctcagcgcgcacgtctg

SEQ ID NO: 8188925 - DNA, 22 bp, Homo sapiens
ccaggctcagctattaagaaac

SEQ ID NO: 8188926 - DNA, 22 bp, Homo sapiens
ccaggctcagctattaagaaac

SEQ ID NO: 8188927 - DNA, 22 bp, Homo sapiens
ccaggctcagcgcgcacgtctg

SEQ ID NO: 8188928 - DNA, 22 bp, Homo sapiens
ccaggctcacagcatcccagga

SEQ ID NO: 8188929 - DNA, 22 bp, Homo sapiens
ccaggctcacagcatcccagga

SEQ ID NO: 8188930 - DNA, 22 bp, Homo sapiens
ccaggctcacagcatcccagga

SEQ ID NO: 8188931 - DNA, 17 bp, Homo sapiens
ccaggctataccaggct

SEQ ID NO: 8188932 - DNA, 22 bp, Homo sapiens
ccaggctagcccagaccacagg

SEQ ID NO: 8188933 - DNA, 22 bp, Homo sapiens
ccaggctagagagcagtggcat

SEQ ID NO: 8188934 - DNA, 22 bp, Homo sapiens
ccaggctagagtgcaatggcat

SEQ ID NO: 8188935 - DNA, 22 bp, Homo sapiens
ccaggctagagtgcaatggcat

SEQ ID NO: 8188936 - DNA, 22 bp, Homo sapiens
ccaggctagagtgcagtggcat

SEQ ID NO: 8188937 - DNA, 22 bp, Homo sapiens
ccaggctagagtgcaatggcgc

SEQ ID NO: 8188938 - DNA, 22 bp, Homo sapiens
ccaggctagagtgcaatggcgc

SEQ ID NO: 8188939 - DNA, 22 bp, Homo sapiens
ccaggctagagtgcagtggcgt

SEQ ID NO: 8188940 - DNA, 22 bp, Homo sapiens
ccaggctcactgactaccacat

SEQ ID NO: 8188941 - DNA, 22 bp, Homo sapiens
ccaggctcagcgcgcacgtctg

SEQ ID NO: 8188942 - DNA, 22 bp, Homo sapiens
ccaggctcagcgcgcacgtctg

SEQ ID NO: 8188943 - DNA, 22 bp, Homo sapiens
ccaggctcactgactaccacat

SEQ ID NO: 8188944 - DNA, 22 bp, Homo sapiens
ccaggctcacctggagcccctg

SEQ ID NO: 8188945 - DNA, 22 bp, Homo sapiens
ccaggctcacctggagcccctg

SEQ ID NO: 8188946 - DNA, 22 bp, Homo sapiens
ccaggctcactgactaccacat

SEQ ID NO: 8188947 - DNA, 22 bp, Homo sapiens
ccaggctcacctggagcccctg

SEQ ID NO: 8188948 - DNA, 22 bp, Homo sapiens
ccaggctcacctggagcccctg

SEQ ID NO: 8188949 - DNA, 22 bp, Homo sapiens
tctttatttaagtctgttgtaa

SEQ ID NO: 8188950 - DNA, 22 bp, Homo sapiens
tctttatttaagtctgttgtaa

SEQ ID NO: 8188951 - DNA, 22 bp, Homo sapiens
tctttatttaagtctgttgtaa

SEQ ID NO: 8188952 - DNA, 22 bp, Homo sapiens
tctttatttaagtctgttgtaa

SEQ ID NO: 8188953 - DNA, 18 bp, Homo sapiens
tctttaagttgtcagagt

SEQ ID NO: 8188954 - DNA, 22 bp, Homo sapiens
tctttaagccaagatatattta

SEQ ID NO: 8188955 - DNA, 22 bp, Homo sapiens
tctttaagagttcatttgcatg

SEQ ID NO: 8188956 - DNA, 22 bp, Homo sapiens
tctttatttctgaatcccccat

SEQ ID NO: 8188957 - DNA, 22 bp, Homo sapiens
tctttatttctgaatcccccat

SEQ ID NO: 8188958 - DNA, 22 bp, Homo sapiens
tctttatttctgaatcccccat

SEQ ID NO: 8188959 - DNA, 22 bp, Homo sapiens
tctttatttctgaatcccccat

SEQ ID NO: 8188960 - DNA, 22 bp, Homo sapiens
tctttatttctgaatcccccat

SEQ ID NO: 8188961 - DNA, 22 bp, Homo sapiens
tctttatttaagtctgttgtaa

SEQ ID NO: 8188962 - DNA, 22 bp, Homo sapiens
tctttatttctgaatcccccat

SEQ ID NO: 8188963 - DNA, 19 bp, Homo sapiens
ccaggcctggcgtctccgc

SEQ ID NO: 8188964 - DNA, 22 bp, Homo sapiens
ccaggctagaaactgaggcaca

SEQ ID NO: 8188965 - DNA, 22 bp, Homo sapiens
ccaggctagagagcagtggcac

SEQ ID NO: 8188966 - DNA, 23 bp, Homo sapiens
ccaggctaaatgttagagtctga

SEQ ID NO: 8188967 - DNA, 19 bp, Homo sapiens
ccaggcctggcgtctccgc

SEQ ID NO: 8188968 - DNA, 22 bp, Homo sapiens
tctttattttatgcttgtgcaa

SEQ ID NO: 8188969 - DNA, 22 bp, Homo sapiens
tctttattttatgcttgtgcaa

SEQ ID NO: 8188970 - DNA, 22 bp, Homo sapiens
tctttattttatgcttgtgcaa

SEQ ID NO: 8188971 - DNA, 22 bp, Homo sapiens
tctttattttatgcttgtgcaa

SEQ ID NO: 8188972 - DNA, 22 bp, Homo sapiens
tctttattttatgcttgtgcaa

SEQ ID NO: 8188973 - DNA, 22 bp, Homo sapiens
tctttattttatgcttgtgcaa

SEQ ID NO: 8188974 - DNA, 22 bp, Homo sapiens
tctttattttatgcttgtgcaa

SEQ ID NO: 8188975 - DNA, 22 bp, Homo sapiens
tctttattttatgcttgtgcaa

SEQ ID NO: 8188976 - DNA, 19 bp, Homo sapiens
tctctgcagcgcgcccggc

SEQ ID NO: 8188977 - DNA, 22 bp, Homo sapiens
tctctgcacttgcacataagct

SEQ ID NO: 8188978 - DNA, 22 bp, Homo sapiens
tctctgcacagaagtagatagc

SEQ ID NO: 8188979 - DNA, 22 bp, Homo sapiens
tctctgcaagatgagaaatatt

SEQ ID NO: 8188980 - DNA, 22 bp, Homo sapiens
tctctgatgctgccagggaaaa

SEQ ID NO: 8188981 - DNA, 22 bp, Homo sapiens
tctctgatgtatatcagagaac

SEQ ID NO: 8188982 - DNA, 23 bp, Homo sapiens
tctctgagttgtactttcccttg

SEQ ID NO: 8188983 - DNA, 22 bp, Homo sapiens
tctctgagttctcctccagccc

SEQ ID NO: 8188984 - DNA, 22 bp, Homo sapiens
tctctgagttttaaggatgatg

SEQ ID NO: 8188985 - DNA, 22 bp, Homo sapiens
tctctcttgtcaccccatctgc

SEQ ID NO: 8188986 - DNA, 22 bp, Homo sapiens
tctctgagttctcctccagccc

SEQ ID NO: 8188987 - DNA, 22 bp, Homo sapiens
tctctcttgtcaccccatctgc

SEQ ID NO: 8188988 - DNA, 22 bp, Homo sapiens
tctcctggctcaccaggctgga

SEQ ID NO: 8188989 - DNA, 22 bp, Homo sapiens
tctcctggctcaccaggctgga

SEQ ID NO: 8188990 - DNA, 22 bp, Homo sapiens
tctcctggctctaaaaggctgt

SEQ ID NO: 8188991 - DNA, 22 bp, Homo sapiens
tctcctggctctaaaaggctgt

SEQ ID NO: 8188992 - DNA, 22 bp, Homo sapiens
tctcctggctctaaaaggctgt

SEQ ID NO: 8188993 - DNA, 22 bp, Homo sapiens
tctcctggctctaaaaggctgt

SEQ ID NO: 8188994 - DNA, 17 bp, Homo sapiens
tctcctggctctatcag

SEQ ID NO: 8188995 - DNA, 17 bp, Homo sapiens
tctcctggctctatcag

SEQ ID NO: 8188996 - DNA, 23 bp, Homo sapiens
tctcctggctgcactgtggccac

SEQ ID NO: 8188997 - DNA, 23 bp, Homo sapiens
tctcctggctgcactgtggccac

SEQ ID NO: 8188998 - DNA, 23 bp, Homo sapiens
tctcctggctgcactgtggccac

SEQ ID NO: 8188999 - DNA, 22 bp, Homo sapiens
tctcctggccgggctgtcccct

SEQ ID NO: 8189000 - DNA, 22 bp, Homo sapiens
tctcctggccgggctgtcccct

SEQ ID NO: 8189001 - DNA, 22 bp, Homo sapiens
tctccgtgccgtgggaggctcc

SEQ ID NO: 8189002 - DNA, 22 bp, Homo sapiens
tctcctggccgggctgtcccct

SEQ ID NO: 8189003 - DNA, 22 bp, Homo sapiens
tctcctggcctttaggttaagg

SEQ ID NO: 8189004 - DNA, 22 bp, Homo sapiens
tctcctggcctttaggttaagg

SEQ ID NO: 8189005 - DNA, 22 bp, Homo sapiens
tctcctggctcaccaggctgga

SEQ ID NO: 8189006 - DNA, 22 bp, Homo sapiens
tctcctggctcaccaggctgga

SEQ ID NO: 8189007 - DNA, 22 bp, Homo sapiens
tctcctggctcaccaggctgga

SEQ ID NO: 8189008 - DNA, 22 bp, Homo sapiens
tctcctggctcaccaggctgga

SEQ ID NO: 8189009 - DNA, 22 bp, Homo sapiens
tctcctggctcaccaggctgga

SEQ ID NO: 8189010 - DNA, 23 bp, Homo sapiens
tctctgcatgtcctgagcacatc

SEQ ID NO: 8189011 - DNA, 22 bp, Homo sapiens
tctctgccacagcttctgcctt

SEQ ID NO: 8189012 - DNA, 22 bp, Homo sapiens
tctctgccacagcttctgcctt

SEQ ID NO: 8189013 - DNA, 22 bp, Homo sapiens
tctctgccacagcttctgcctt

SEQ ID NO: 8189014 - DNA, 22 bp, Homo sapiens
tctctgcccatcctcagtccac

SEQ ID NO: 8189015 - DNA, 22 bp, Homo sapiens
tctctgcccaagtttctcaagt

SEQ ID NO: 8189016 - DNA, 22 bp, Homo sapiens
tctctgcccatcctcagtccac

SEQ ID NO: 8189017 - DNA, 22 bp, Homo sapiens
tctctgcccatcctcagtccac

SEQ ID NO: 8189018 - DNA, 22 bp, Homo sapiens
tctctgcccatcctcagtccac

SEQ ID NO: 8189019 - DNA, 22 bp, Homo sapiens
tctctgggaattcacaagccct

SEQ ID NO: 8189020 - DNA, 22 bp, Homo sapiens
tctctgggaatgggcctgggta

SEQ ID NO: 8189021 - DNA, 22 bp, Homo sapiens
tctctgggaatgggcctgggta

SEQ ID NO: 8189022 - DNA, 22 bp, Homo sapiens
tctctgggaatgggcctgggta

SEQ ID NO: 8189023 - DNA, 22 bp, Homo sapiens
tctctgggaaatggagaatttt

SEQ ID NO: 8189024 - DNA, 22 bp, Homo sapiens
tctctgcccatcctcagtccac

SEQ ID NO: 8189025 - DNA, 21 bp, Homo sapiens
tctctgggaggacttgtgaga

SEQ ID NO: 8189026 - DNA, 21 bp, Homo sapiens
tctctgggaggacttgtgaga

SEQ ID NO: 8189027 - DNA, 21 bp, Homo sapiens
tctctgggaggacttgtgaga

SEQ ID NO: 8189028 - DNA, 21 bp, Homo sapiens
tctctgggaggacttgtgaga

SEQ ID NO: 8189029 - DNA, 22 bp, Homo sapiens
tctctgggagccaggatgacac

SEQ ID NO: 8189030 - DNA, 22 bp, Homo sapiens
ccagcactctgtcccagcttcc

SEQ ID NO: 8189031 - DNA, 22 bp, Homo sapiens
tctctgggagttgagcagcagc

SEQ ID NO: 8189032 - DNA, 22 bp, Homo sapiens
tctctgggagttgagcagcagc

SEQ ID NO: 8189033 - DNA, 22 bp, Homo sapiens
tctctgggagttgagcagcagc

SEQ ID NO: 8189034 - DNA, 21 bp, Homo sapiens
tctctgggaggacttgtgaga

SEQ ID NO: 8189035 - DNA, 22 bp, Homo sapiens
tctctgggacactgggtcagtt

SEQ ID NO: 8189036 - DNA, 22 bp, Homo sapiens
tctctgggacactgggtcagtt

SEQ ID NO: 8189037 - DNA, 22 bp, Homo sapiens
tctctgggacactgggtcagtt

SEQ ID NO: 8189038 - DNA, 22 bp, Homo sapiens
tctctgggacactgggtcagtt

SEQ ID NO: 8189039 - DNA, 22 bp, Homo sapiens
tctctgggaattttttggacat

SEQ ID NO: 8189040 - DNA, 22 bp, Homo sapiens
tctctgggaattttttggacat

SEQ ID NO: 8189041 - DNA, 22 bp, Homo sapiens
tctctgggagcaattgtttgct

SEQ ID NO: 8189042 - DNA, 22 bp, Homo sapiens
tctctgggagcaattgtttgct

SEQ ID NO: 8189043 - DNA, 22 bp, Homo sapiens
tctctgggagcaattgtttgct

SEQ ID NO: 8189044 - DNA, 22 bp, Homo sapiens
tctctgggagccaggatgacac

SEQ ID NO: 8189045 - DNA, 22 bp, Homo sapiens
ccagcagggcagtgccctggac

SEQ ID NO: 8189046 - DNA, 22 bp, Homo sapiens
ccagcagggcagtgccctggac

SEQ ID NO: 8189047 - DNA, 22 bp, Homo sapiens
ccagcagggcagtgccctggac

SEQ ID NO: 8189048 - DNA, 22 bp, Homo sapiens
ccagcagggcagtgccctggac

SEQ ID NO: 8189049 - DNA, 22 bp, Homo sapiens
ccagcaggggaatatttttagg

SEQ ID NO: 8189050 - DNA, 22 bp, Homo sapiens
ccagcagggcagtgccctggac

SEQ ID NO: 8189051 - DNA, 22 bp, Homo sapiens
ccagcagggcagtgccctggac

SEQ ID NO: 8189052 - DNA, 22 bp, Homo sapiens
ccagcagggcagtgccctggac

SEQ ID NO: 8189053 - DNA, 22 bp, Homo sapiens
ccagcagggcagtgccctggac

SEQ ID NO: 8189054 - DNA, 22 bp, Homo sapiens
ccagcagctgtggctttgcctc

SEQ ID NO: 8189055 - DNA, 22 bp, Homo sapiens
ccagcagggaaaaacccaccaa

SEQ ID NO: 8189056 - DNA, 22 bp, Homo sapiens
ccagcagctgtggctttgcctc

SEQ ID NO: 8189057 - DNA, 22 bp, Homo sapiens
ccagcagctttattggctctcc

SEQ ID NO: 8189058 - DNA, 22 bp, Homo sapiens
ccagcagctccctcagggtccg

SEQ ID NO: 8189059 - DNA, 22 bp, Homo sapiens
ccagcagctccctcagggtccg

SEQ ID NO: 8189060 - DNA, 22 bp, Homo sapiens
ccagcagctcagctactggtca

SEQ ID NO: 8189061 - DNA, 22 bp, Homo sapiens
ccagcagctgacaccagtccca

SEQ ID NO: 8189062 - DNA, 22 bp, Homo sapiens
ccagcagctgacaccagtccca

SEQ ID NO: 8189063 - DNA, 22 bp, Homo sapiens
ccagcagctgacaccagtccca

SEQ ID NO: 8189064 - DNA, 22 bp, Homo sapiens
ccagcagctgcaaagcctgggt

SEQ ID NO: 8189065 - DNA, 22 bp, Homo sapiens
ccagcagctgacaccagtccca

SEQ ID NO: 8189066 - DNA, 22 bp, Homo sapiens
ccagcagctgctatgtggtttt

SEQ ID NO: 8189067 - DNA, 22 bp, Homo sapiens
ccagcagctgcaaagcctgggt

SEQ ID NO: 8189068 - DNA, 22 bp, Homo sapiens
ccagcagcccacaggcgtccct

SEQ ID NO: 8189069 - DNA, 22 bp, Homo sapiens
ccagcagcgatagggtgagtgc

SEQ ID NO: 8189070 - DNA, 22 bp, Homo sapiens
ccagcagccctcttccaagact

SEQ ID NO: 8189071 - DNA, 22 bp, Homo sapiens
ccagcagcatcctgcagcactt

SEQ ID NO: 8189072 - DNA, 22 bp, Homo sapiens
ccagcagcatcctgcagcactt

SEQ ID NO: 8189073 - DNA, 22 bp, Homo sapiens
ccagcagcatcctgcagcactt

SEQ ID NO: 8189074 - DNA, 22 bp, Homo sapiens
ccagcagccaccttctcgaaat

SEQ ID NO: 8189075 - DNA, 22 bp, Homo sapiens
ccagcagccagagaaggacctc

SEQ ID NO: 8189076 - DNA, 22 bp, Homo sapiens
ccagcagccagagaaggacctc

SEQ ID NO: 8189077 - DNA, 22 bp, Homo sapiens
ccagcagcaggccaggccctcc

SEQ ID NO: 8189078 - DNA, 22 bp, Homo sapiens
ccagcagcagcgtccaaggaga

SEQ ID NO: 8189079 - DNA, 22 bp, Homo sapiens
ccagcagcagcgtccaaggaga

SEQ ID NO: 8189080 - DNA, 22 bp, Homo sapiens
ccagcagcagcgtccaaggaga

SEQ ID NO: 8189081 - DNA, 22 bp, Homo sapiens
ccagcagcagcgtccaaggaga

SEQ ID NO: 8189082 - DNA, 22 bp, Homo sapiens
ccagcagagtctaggaaggagg

SEQ ID NO: 8189083 - DNA, 22 bp, Homo sapiens
ccagcactgctctcagactgag

SEQ ID NO: 8189084 - DNA, 22 bp, Homo sapiens
ccagcactgctctcagactgag

SEQ ID NO: 8189085 - DNA, 22 bp, Homo sapiens
ccagcactgctctcagactgag

SEQ ID NO: 8189086 - DNA, 22 bp, Homo sapiens
ccagcagagggtcttggccatt

SEQ ID NO: 8189087 - DNA, 22 bp, Homo sapiens
ccagccctgtaaggatgaggca

SEQ ID NO: 8189088 - DNA, 22 bp, Homo sapiens
ccagccctgtcaccaactggag

SEQ ID NO: 8189089 - DNA, 22 bp, Homo sapiens
ccagccctgtcaccaactggag

SEQ ID NO: 8189090 - DNA, 22 bp, Homo sapiens
ccagccctgtaaggatgaggca

SEQ ID NO: 8189091 - DNA, 22 bp, Homo sapiens
ccagccctgtaaggatgaggca

SEQ ID NO: 8189092 - DNA, 22 bp, Homo sapiens
ccagccctgtaaggatgaggca

SEQ ID NO: 8189093 - DNA, 22 bp, Homo sapiens
ccagccctgtcaccaactggag

SEQ ID NO: 8189094 - DNA, 22 bp, Homo sapiens
ccagccctgtcaccaactggag

SEQ ID NO: 8189095 - DNA, 19 bp, Homo sapiens
ccagccctgtcacttcttg

SEQ ID NO: 8189096 - DNA, 19 bp, Homo sapiens
ccagccctgtcacttcttg

SEQ ID NO: 8189097 - DNA, 22 bp, Homo sapiens
ccagccctgtcaccaactggag

SEQ ID NO: 8189098 - DNA, 22 bp, Homo sapiens
ccagccctgtcaccaactggag

SEQ ID NO: 8189099 - DNA, 22 bp, Homo sapiens
ccagcccttagataaacctggc

SEQ ID NO: 8189100 - DNA, 22 bp, Homo sapiens
ccagcccttagataaacctggc

SEQ ID NO: 8189101 - DNA, 22 bp, Homo sapiens
ccagcccttcccaactggccag

SEQ ID NO: 8189102 - DNA, 22 bp, Homo sapiens
ccagcccttcccaactggccag

SEQ ID NO: 8189103 - DNA, 22 bp, Homo sapiens
ccagccctgtttatgtgtcact

SEQ ID NO: 8189104 - DNA, 22 bp, Homo sapiens
ccagccctgtttatgtgtcact

SEQ ID NO: 8189105 - DNA, 22 bp, Homo sapiens
ccagccctgtttatgtgtcact

SEQ ID NO: 8189106 - DNA, 19 bp, Homo sapiens
ccagccctgtcacttcttg

SEQ ID NO: 8189107 - DNA, 19 bp, Homo sapiens
ccagccctgtcacttcttg

SEQ ID NO: 8189108 - DNA, 22 bp, Homo sapiens
ccagcatttgcttaatttggag

SEQ ID NO: 8189109 - DNA, 22 bp, Homo sapiens
ccagccacagcttccagctcct

SEQ ID NO: 8189110 - DNA, 22 bp, Homo sapiens
ccagcatggcacctgagatgag

SEQ ID NO: 8189111 - DNA, 20 bp, Homo sapiens
ccagcatgtacacatgtgga

SEQ ID NO: 8189112 - DNA, 22 bp, Homo sapiens
ccagcatgctcagtctaaattg

SEQ ID NO: 8189113 - DNA, 22 bp, Homo sapiens
ccagcatggcacctgagatgag

SEQ ID NO: 8189114 - DNA, 20 bp, Homo sapiens
ccagcatgtacacatgtgga

SEQ ID NO: 8189115 - DNA, 20 bp, Homo sapiens
ccagcatgtacacatgtgga

SEQ ID NO: 8189116 - DNA, 22 bp, Homo sapiens
ccagccctgcctctcagggccc

SEQ ID NO: 8189117 - DNA, 22 bp, Homo sapiens
ccagccctgcctctcagggccc

SEQ ID NO: 8189118 - DNA, 22 bp, Homo sapiens
ccagccctgcctctcagggccc

SEQ ID NO: 8189119 - DNA, 22 bp, Homo sapiens
ccagccctgcctctcagggccc

SEQ ID NO: 8189120 - DNA, 22 bp, Homo sapiens
ccagccctgcctctcagggccc

SEQ ID NO: 8189121 - DNA, 22 bp, Homo sapiens
ccagccacgaagctcccttcat

SEQ ID NO: 8189122 - DNA, 22 bp, Homo sapiens
ccagccctcactgaggcctctc

SEQ ID NO: 8189123 - DNA, 22 bp, Homo sapiens
ccagccctcactgaggcctctc

SEQ ID NO: 8189124 - DNA, 22 bp, Homo sapiens
ccagccctcactgaggcctctc

SEQ ID NO: 8189125 - DNA, 22 bp, Homo sapiens
tctgagaggtgaattcagcaaa

SEQ ID NO: 8189126 - DNA, 22 bp, Homo sapiens
tctgagaggttaagcaatttga

SEQ ID NO: 8189127 - DNA, 22 bp, Homo sapiens
tctgagaggcatctgcacttct

SEQ ID NO: 8189128 - DNA, 22 bp, Homo sapiens
tctgagagccactgaacagcaa

SEQ ID NO: 8189129 - DNA, 22 bp, Homo sapiens
tctgagagcaggaggagctgct

SEQ ID NO: 8189130 - DNA, 22 bp, Homo sapiens
tctgagagcaggaggagctgct

SEQ ID NO: 8189131 - DNA, 22 bp, Homo sapiens
tctgagagcaggaggagctgct

SEQ ID NO: 8189132 - DNA, 22 bp, Homo sapiens
tctgagagatacaaggaggcaa

SEQ ID NO: 8189133 - DNA, 21 bp, Homo sapiens
tctgagagcaactgcccttta

SEQ ID NO: 8189134 - DNA, 22 bp, Homo sapiens
ccagcccttcccaactggccag

SEQ ID NO: 8189135 - DNA, 22 bp, Homo sapiens
tctgagagatacaaggaggcaa

SEQ ID NO: 8189136 - DNA, 22 bp, Homo sapiens
tctgagagtctctgaggcagat

SEQ ID NO: 8189137 - DNA, 22 bp, Homo sapiens
tctgatatcgcactaaactctg

SEQ ID NO: 8189138 - DNA, 21 bp, Homo sapiens
tctgatatatccccaagttac

SEQ ID NO: 8189139 - DNA, 22 bp, Homo sapiens
tctgcagaattcgaggaagaaa

SEQ ID NO: 8189140 - DNA, 22 bp, Homo sapiens
tctgcagaattcgaggaagaaa

SEQ ID NO: 8189141 - DNA, 22 bp, Homo sapiens
tctgcagaattcgaggaagaaa

SEQ ID NO: 8189142 - DNA, 22 bp, Homo sapiens
tctgcagaaggaatcagctgag

SEQ ID NO: 8189143 - DNA, 22 bp, Homo sapiens
tctgcagaaggaatcagctgag

SEQ ID NO: 8189144 - DNA, 22 bp, Homo sapiens
tctctgttcatggcactatgtc

SEQ ID NO: 8189145 - DNA, 22 bp, Homo sapiens
tctctgttcatggcactatgtc

SEQ ID NO: 8189146 - DNA, 22 bp, Homo sapiens
tctctgttcatggcactatgtc

SEQ ID NO: 8189147 - DNA, 22 bp, Homo sapiens
tctctgtgttgcaggaaaatct

SEQ ID NO: 8189148 - DNA, 22 bp, Homo sapiens
tctctgtgttgcaggaaaatct

SEQ ID NO: 8189149 - DNA, 22 bp, Homo sapiens
tctgaaatgaactcttgaactt

SEQ ID NO: 8189150 - DNA, 22 bp, Homo sapiens
tctgaaatgacctttccccact

SEQ ID NO: 8189151 - DNA, 21 bp, Homo sapiens
tctctgtgttcaaggtgccag

SEQ ID NO: 8189152 - DNA, 21 bp, Homo sapiens
tctctgtgttcaaggtgccag

SEQ ID NO: 8189153 - DNA, 22 bp, Homo sapiens
tctctgtgtgttggctgtatat

SEQ ID NO: 8189154 - DNA, 22 bp, Homo sapiens
tctctgtgttccctgttttctc

SEQ ID NO: 8189155 - DNA, 22 bp, Homo sapiens
tctctgtgttccctgttttctc

SEQ ID NO: 8189156 - DNA, 22 bp, Homo sapiens
tctctgtgtgtgtgacagcatt

SEQ ID NO: 8189157 - DNA, 22 bp, Homo sapiens
tctctgtgtgtgtgacagcatt

SEQ ID NO: 8189158 - DNA, 22 bp, Homo sapiens
tctctgtgtgtgtgacagcatt

SEQ ID NO: 8189159 - DNA, 22 bp, Homo sapiens
tctctgtgtgtgtgacagcatt

SEQ ID NO: 8189160 - DNA, 22 bp, Homo sapiens
tctctgtgtgggagatcttttt

SEQ ID NO: 8189161 - DNA, 22 bp, Homo sapiens
tctctgtgtgttggctgtatat

SEQ ID NO: 8189162 - DNA, 22 bp, Homo sapiens
tctctgtgtgttggctgtatat

SEQ ID NO: 8189163 - DNA, 22 bp, Homo sapiens
tctctgtgtgtgtgacagcatt

SEQ ID NO: 8189164 - DNA, 19 bp, Homo sapiens
ccagcaggttcatttcagg

SEQ ID NO: 8189165 - DNA, 19 bp, Homo sapiens
ccagcaggttcatttcagg

SEQ ID NO: 8189166 - DNA, 22 bp, Homo sapiens
ccagcatcagcattgtcttagg

SEQ ID NO: 8189167 - DNA, 22 bp, Homo sapiens
tctctgtgtgggagatcttttt

SEQ ID NO: 8189168 - DNA, 22 bp, Homo sapiens
tctctgtgtgggagatcttttt

SEQ ID NO: 8189169 - DNA, 22 bp, Homo sapiens
tctctgtgtgccttcatctgcc

SEQ ID NO: 8189170 - DNA, 22 bp, Homo sapiens
tctctgtgtgccttcatctgcc

SEQ ID NO: 8189171 - DNA, 22 bp, Homo sapiens
tctctgtgtgccttcatctgcc

SEQ ID NO: 8189172 - DNA, 22 bp, Homo sapiens
ccagcaggtgtagggctcatgg

SEQ ID NO: 8189173 - DNA, 22 bp, Homo sapiens
ccagcaggtgtagggctcatgg

SEQ ID NO: 8189174 - DNA, 22 bp, Homo sapiens
ccagcagggttggtttcttctg

SEQ ID NO: 8189175 - DNA, 22 bp, Homo sapiens
ccagcaggggaatatttttagg

SEQ ID NO: 8189176 - DNA, 22 bp, Homo sapiens
ccagcaggtgtagggctcatgg

SEQ ID NO: 8189177 - DNA, 22 bp, Homo sapiens
ccagcaggtgtagggctcatgg

SEQ ID NO: 8189178 - DNA, 22 bp, Homo sapiens
ccagcagggttggtttcttctg

SEQ ID NO: 8189179 - DNA, 22 bp, Homo sapiens
tctgaataatgtccttgtatca

SEQ ID NO: 8189180 - DNA, 22 bp, Homo sapiens
tctgaataatgtccttgtatca

SEQ ID NO: 8189181 - DNA, 22 bp, Homo sapiens
tctgaataatgtccttgtatca

SEQ ID NO: 8189182 - DNA, 19 bp, Homo sapiens
tctgaagtccagggcatac

SEQ ID NO: 8189183 - DNA, 22 bp, Homo sapiens
tctgaaggtttgattggagcta

SEQ ID NO: 8189184 - DNA, 22 bp, Homo sapiens
tctgaatatgtttatcatctct

SEQ ID NO: 8189185 - DNA, 22 bp, Homo sapiens
tctgaatatgtttatcatctct

SEQ ID NO: 8189186 - DNA, 22 bp, Homo sapiens
tctgaatatgtttatcatctct

SEQ ID NO: 8189187 - DNA, 22 bp, Homo sapiens
tctgaatatgtttatcatctct

SEQ ID NO: 8189188 - DNA, 22 bp, Homo sapiens
tctgaatagttctattttaaag

SEQ ID NO: 8189189 - DNA, 22 bp, Homo sapiens
tctgaatagtatattgaaagca

SEQ ID NO: 8189190 - DNA, 22 bp, Homo sapiens
tctgaatagagagaggtccttt

SEQ ID NO: 8189191 - DNA, 18 bp, Homo sapiens
tctgaatattatgcagtg

SEQ ID NO: 8189192 - DNA, 22 bp, Homo sapiens
tctgaattaatcatgcctcttt

SEQ ID NO: 8189193 - DNA, 19 bp, Homo sapiens
tctgaattatttatgtacc

SEQ ID NO: 8189194 - DNA, 22 bp, Homo sapiens
tctgaattcagtatggtctttc

SEQ ID NO: 8189195 - DNA, 22 bp, Homo sapiens
ccagcatctaacgctcctggga

SEQ ID NO: 8189196 - DNA, 18 bp, Homo sapiens
ccagcatgccagaggctg

SEQ ID NO: 8189197 - DNA, 18 bp, Homo sapiens
ccagcatgccagaggctg

SEQ ID NO: 8189198 - DNA, 22 bp, Homo sapiens
ccagcatgagacgatgatgaag

SEQ ID NO: 8189199 - DNA, 22 bp, Homo sapiens
tctgaatttagtgattagcttt

SEQ ID NO: 8189200 - DNA, 22 bp, Homo sapiens
tctgaattctgacaatttgaat

SEQ ID NO: 8189201 - DNA, 22 bp, Homo sapiens
tctgaattcttagaattaaagg

SEQ ID NO: 8189202 - DNA, 22 bp, Homo sapiens
ccagcatccctggggttggcca

SEQ ID NO: 8189203 - DNA, 19 bp, Homo sapiens
ccacatggctggatgacag

SEQ ID NO: 8189204 - DNA, 19 bp, Homo sapiens
ccacatggctggatgacag

SEQ ID NO: 8189205 - DNA, 19 bp, Homo sapiens
ccacatggctggatgacag

SEQ ID NO: 8189206 - DNA, 22 bp, Homo sapiens
ccacatgtgcactgctgtatgg

SEQ ID NO: 8189207 - DNA, 21 bp, Homo sapiens
ccacatggtgaaaccctatct

SEQ ID NO: 8189208 - DNA, 22 bp, Homo sapiens
ccacatggagcaggaggtgggg

SEQ ID NO: 8189209 - DNA, 22 bp, Homo sapiens
ccacatgctctctctccaggtt

SEQ ID NO: 8189210 - DNA, 22 bp, Homo sapiens
ccacatgctcttgttacagtgt

SEQ ID NO: 8189211 - DNA, 23 bp, Homo sapiens
ccacatggcaagatgatgcattc

SEQ ID NO: 8189212 - DNA, 23 bp, Homo sapiens
ccacatggcaagatgatgcattc

SEQ ID NO: 8189213 - DNA, 22 bp, Homo sapiens
ccacatggatagatagggacat

SEQ ID NO: 8189214 - DNA, 23 bp, Homo sapiens
ccacatggcaagatgatgcattc

SEQ ID NO: 8189215 - DNA, 22 bp, Homo sapiens
ccacattgactgtctgtagatt

SEQ ID NO: 8189216 - DNA, 22 bp, Homo sapiens
ccacatctgcagtcccttctgt

SEQ ID NO: 8189217 - DNA, 22 bp, Homo sapiens
ccacatctcttgatgtacctac

SEQ ID NO: 8189218 - DNA, 22 bp, Homo sapiens
ccacatctgcatttaatgtata

SEQ ID NO: 8189219 - DNA, 22 bp, Homo sapiens
ccacatctgttcttagttctga

SEQ ID NO: 8189220 - DNA, 22 bp, Homo sapiens
ccacatgaaattgcttatattt

SEQ ID NO: 8189221 - DNA, 22 bp, Homo sapiens
ccacatctgttcttagttctga

SEQ ID NO: 8189222 - DNA, 22 bp, Homo sapiens
ccacatcttttttcctgaacag

SEQ ID NO: 8189223 - DNA, 22 bp, Homo sapiens
ccacatgctctctctccaggtt

SEQ ID NO: 8189224 - DNA, 22 bp, Homo sapiens
ccacagtgagttctgtactctg

SEQ ID NO: 8189225 - DNA, 22 bp, Homo sapiens
tcctgactctggtgtcctctac

SEQ ID NO: 8189226 - DNA, 22 bp, Homo sapiens
tcctgactccaggtcctgtgtg

SEQ ID NO: 8189227 - DNA, 22 bp, Homo sapiens
ccacagtgatccctgcctgcga

SEQ ID NO: 8189228 - DNA, 22 bp, Homo sapiens
ccacagtgatccctgcctgcga

SEQ ID NO: 8189229 - DNA, 22 bp, Homo sapiens
ccacagtgagttctgtactctg

SEQ ID NO: 8189230 - DNA, 20 bp, Homo sapiens
tcctgaatttcctttctgct

SEQ ID NO: 8189231 - DNA, 22 bp, Homo sapiens
tcctgaccactaggaccaggct

SEQ ID NO: 8189232 - DNA, 22 bp, Homo sapiens
tcctgaatccaggagagtaggg

SEQ ID NO: 8189233 - DNA, 22 bp, Homo sapiens
tcctgaataaattagctgtcac

SEQ ID NO: 8189234 - DNA, 22 bp, Homo sapiens
tcctgaataaattagctgtcac

SEQ ID NO: 8189235 - DNA, 22 bp, Homo sapiens
tcctgaatgagttgatcacaat

SEQ ID NO: 8189236 - DNA, 22 bp, Homo sapiens
tcctgaatccaggagagtaggg

SEQ ID NO: 8189237 - DNA, 22 bp, Homo sapiens
tcctgaatgagttgatcacaat

SEQ ID NO: 8189238 - DNA, 22 bp, Homo sapiens
tcctgaattcctctttgcatcc

SEQ ID NO: 8189239 - DNA, 22 bp, Homo sapiens
tcctgaattgaactcagttaat

SEQ ID NO: 8189240 - DNA, 22 bp, Homo sapiens
tcctgaattgccttagtttctg

SEQ ID NO: 8189241 - DNA, 22 bp, Homo sapiens
tcctgaattgaactcagttaat

SEQ ID NO: 8189242 - DNA, 22 bp, Homo sapiens
tcctgaattgttgagaagcagc

SEQ ID NO: 8189243 - DNA, 20 bp, Homo sapiens
tcctgaatttcctttctgct

SEQ ID NO: 8189244 - DNA, 22 bp, Homo sapiens
tcctgaatttcccagcatgaac

SEQ ID NO: 8189245 - DNA, 22 bp, Homo sapiens
tcctgaatttcccagcatgaac

SEQ ID NO: 8189246 - DNA, 22 bp, Homo sapiens
tcctgaattgttgagaagcagc

SEQ ID NO: 8189247 - DNA, 22 bp, Homo sapiens
tcctgaattgttgagaagcagc

SEQ ID NO: 8189248 - DNA, 22 bp, Homo sapiens
tcctctgagacatcaggttgag

SEQ ID NO: 8189249 - DNA, 18 bp, Homo sapiens
tcctctctttccccaggg

SEQ ID NO: 8189250 - DNA, 18 bp, Homo sapiens
tcctctctttccccaggg

SEQ ID NO: 8189251 - DNA, 22 bp, Homo sapiens
tcctctgaatgctgttgaagaa

SEQ ID NO: 8189252 - DNA, 22 bp, Homo sapiens
tcctctgaattcgctctgtgat

SEQ ID NO: 8189253 - DNA, 22 bp, Homo sapiens
tcctctctgcactggccctgcc

SEQ ID NO: 8189254 - DNA, 22 bp, Homo sapiens
tcctctctgcactggccctgcc

SEQ ID NO: 8189255 - DNA, 22 bp, Homo sapiens
tcctctccatgtctcacgccac

SEQ ID NO: 8189256 - DNA, 22 bp, Homo sapiens
tcctctccatgtctcacgccac

SEQ ID NO: 8189257 - DNA, 22 bp, Homo sapiens
tcctctctgcactggccctgcc

SEQ ID NO: 8189258 - DNA, 22 bp, Homo sapiens
tcctctccatgtctcacgccac

SEQ ID NO: 8189259 - DNA, 22 bp, Homo sapiens
ccaccagctttgccaccctgct

SEQ ID NO: 8189260 - DNA, 22 bp, Homo sapiens
ccaccaggacagccctgagggg

SEQ ID NO: 8189261 - DNA, 22 bp, Homo sapiens
ccaccaggacagccctgagggg

SEQ ID NO: 8189262 - DNA, 18 bp, Homo sapiens
tcctttcaccccttctct

SEQ ID NO: 8189263 - DNA, 22 bp, Homo sapiens
tcgcgctgtagccgcgcagagt

SEQ ID NO: 8189264 - DNA, 22 bp, Homo sapiens
tcgctggcctggaggggagcca

SEQ ID NO: 8189265 - DNA, 22 bp, Homo sapiens
tcgctggcctggaggggagcca

SEQ ID NO: 8189266 - DNA, 22 bp, Homo sapiens
tcgctgaggctgcacggctgcc

SEQ ID NO: 8189267 - DNA, 22 bp, Homo sapiens
tcgctgaggctgcacggctgcc

SEQ ID NO: 8189268 - DNA, 22 bp, Homo sapiens
ccaccagcttcagcagccgcgg

SEQ ID NO: 8189269 - DNA, 22 bp, Homo sapiens
ccaccagcttcagcagccgcgg

SEQ ID NO: 8189270 - DNA, 22 bp, Homo sapiens
ccaccagcagtgtgcaaggatt

SEQ ID NO: 8189271 - DNA, 22 bp, Homo sapiens
ccaccagatttactttactatt

SEQ ID NO: 8189272 - DNA, 22 bp, Homo sapiens
ccaccacatttgcctagacttt

SEQ ID NO: 8189273 - DNA, 22 bp, Homo sapiens
tcgggctcgctctcctagcgga

SEQ ID NO: 8189274 - DNA, 21 bp, Homo sapiens
tcgggcttggctgcggtgctg

SEQ ID NO: 8189275 - DNA, 23 bp, Homo sapiens
tcggtgggcgtggaggccgaggc

SEQ ID NO: 8189276 - DNA, 22 bp, Homo sapiens
tcggtgacaaattctctgccat

SEQ ID NO: 8189277 - DNA, 21 bp, Homo sapiens
tcggtgaccagctgtccttca

SEQ ID NO: 8189278 - DNA, 22 bp, Homo sapiens
tcggggtctttgacacgctctg

SEQ ID NO: 8189279 - DNA, 22 bp, Homo sapiens
tcggtacctacatcctctcgac

SEQ ID NO: 8189280 - DNA, 22 bp, Homo sapiens
tcgcttgaacccaggaagtgga

SEQ ID NO: 8189281 - DNA, 22 bp, Homo sapiens
tcgctgtggtttctgtacatgg

SEQ ID NO: 8189282 - DNA, 22 bp, Homo sapiens
tcgcttgaacccaggaagtgga

SEQ ID NO: 8189283 - DNA, 22 bp, Homo sapiens
tcggagctgtagatgaaaccct

SEQ ID NO: 8189284 - DNA, 22 bp, Homo sapiens
tcggagagttggaagtagcaga

SEQ ID NO: 8189285 - DNA, 22 bp, Homo sapiens
tcggagagctcacagctgtggc

SEQ ID NO: 8189286 - DNA, 22 bp, Homo sapiens
tcggagagttcatgaagacccg

SEQ ID NO: 8189287 - DNA, 22 bp, Homo sapiens
ccacccttccattcttcctctt

SEQ ID NO: 8189288 - DNA, 22 bp, Homo sapiens
ccaccgccatggcgttgtacag

SEQ ID NO: 8189289 - DNA, 22 bp, Homo sapiens
ccaccgccatggcgttgtacag

SEQ ID NO: 8189290 - DNA, 22 bp, Homo sapiens
ccaccgccatggcgttgtacag

SEQ ID NO: 8189291 - DNA, 22 bp, Homo sapiens
ccacccttgggttcggaggccg

SEQ ID NO: 8189292 - DNA, 22 bp, Homo sapiens
ccacccttgggttcggaggccg

SEQ ID NO: 8189293 - DNA, 22 bp, Homo sapiens
ccaccctgtgcaggcgtgggta

SEQ ID NO: 8189294 - DNA, 23 bp, Homo sapiens
tcggtgggcgtggaggccgaggc

SEQ ID NO: 8189295 - DNA, 22 bp, Homo sapiens
ccaccctggacaggcctctgag

SEQ ID NO: 8189296 - DNA, 23 bp, Homo sapiens
tcggtgggcgtggaggccgaggc

SEQ ID NO: 8189297 - DNA, 22 bp, Homo sapiens
ccagagaggccttggcaagaca

SEQ ID NO: 8189298 - DNA, 22 bp, Homo sapiens
tctccctcattcctgcttccat

SEQ ID NO: 8189299 - DNA, 22 bp, Homo sapiens
tctccctcattcctgcttccat

SEQ ID NO: 8189300 - DNA, 22 bp, Homo sapiens
tctccctctcagatttattcac

SEQ ID NO: 8189301 - DNA, 22 bp, Homo sapiens
tctcccacggtacaggataaac

SEQ ID NO: 8189302 - DNA, 22 bp, Homo sapiens
tctccctcattcctgcttccat

SEQ ID NO: 8189303 - DNA, 22 bp, Homo sapiens
tctccctctttgtctgctttgg

SEQ ID NO: 8189304 - DNA, 22 bp, Homo sapiens
tctccctctgtaagatcagggg

SEQ ID NO: 8189305 - DNA, 22 bp, Homo sapiens
tctccctctcagatttattcac

SEQ ID NO: 8189306 - DNA, 22 bp, Homo sapiens
tctcctggccgggctgtcccct

SEQ ID NO: 8189307 - DNA, 22 bp, Homo sapiens
tctcctggccctgtcgccatct

SEQ ID NO: 8189308 - DNA, 22 bp, Homo sapiens
tctcccttggtcacagattcct

SEQ ID NO: 8189309 - DNA, 16 bp, Homo sapiens
tctcccttgtcacctg

SEQ ID NO: 8189310 - DNA, 22 bp, Homo sapiens
tctcccttggtcacagattcct

SEQ ID NO: 8189311 - DNA, 22 bp, Homo sapiens
tctccgatcacaggttttcaat

SEQ ID NO: 8189312 - DNA, 22 bp, Homo sapiens
tctccctgtggaggacccctta

SEQ ID NO: 8189313 - DNA, 16 bp, Homo sapiens
tctccctgttctccaa

SEQ ID NO: 8189314 - DNA, 22 bp, Homo sapiens
tctcccttctctggattccgtt

SEQ ID NO: 8189315 - DNA, 22 bp, Homo sapiens
tctcccttctctggattccgtt

SEQ ID NO: 8189316 - DNA, 22 bp, Homo sapiens
tctccctggagccctgaagcat

SEQ ID NO: 8189317 - DNA, 22 bp, Homo sapiens
tctccctggagccctgaagcat

SEQ ID NO: 8189318 - DNA, 22 bp, Homo sapiens
tctccctggagccctgaagcat

SEQ ID NO: 8189319 - DNA, 22 bp, Homo sapiens
tctccctctttgtctgctttgg

SEQ ID NO: 8189320 - DNA, 23 bp, Homo sapiens
tctccctgaggttgttagcatta

SEQ ID NO: 8189321 - DNA, 23 bp, Homo sapiens
tctccctgaggttgttagcatta

SEQ ID NO: 8189322 - DNA, 22 bp, Homo sapiens
tctccctctttgtctgctttgg

SEQ ID NO: 8189323 - DNA, 22 bp, Homo sapiens
tctccctctttgtctgctttgg

SEQ ID NO: 8189324 - DNA, 20 bp, Homo sapiens
tctccctgcccatctcagat

SEQ ID NO: 8189325 - DNA, 20 bp, Homo sapiens
tctccctgcccatctcagat

SEQ ID NO: 8189326 - DNA, 23 bp, Homo sapiens
tctccctgaggttgttagcatta

SEQ ID NO: 8189327 - DNA, 20 bp, Homo sapiens
tctccctgcccatctcagat

SEQ ID NO: 8189328 - DNA, 20 bp, Homo sapiens
tctccctgcccatctcagat

SEQ ID NO: 8189329 - DNA, 19 bp, Homo sapiens
ccagagagctaggtacaga

SEQ ID NO: 8189330 - DNA, 19 bp, Homo sapiens
ccagagagctaggtacaga

SEQ ID NO: 8189331 - DNA, 22 bp, Homo sapiens
ccagagagctacaaggcataaa

SEQ ID NO: 8189332 - DNA, 22 bp, Homo sapiens
ccagagagctacaaggcataaa

SEQ ID NO: 8189333 - DNA, 22 bp, Homo sapiens
ccagagagctacaaggcataaa

SEQ ID NO: 8189334 - DNA, 22 bp, Homo sapiens
ccagagagattgcttctaaaga

SEQ ID NO: 8189335 - DNA, 22 bp, Homo sapiens
ccagagagagtactgggctctg

SEQ ID NO: 8189336 - DNA, 22 bp, Homo sapiens
ccagagagagtactgggctctg

SEQ ID NO: 8189337 - DNA, 21 bp, Homo sapiens
ccagagagagggaagtgggtt

SEQ ID NO: 8189338 - DNA, 22 bp, Homo sapiens
tctccaggaagccctccctgac

SEQ ID NO: 8189339 - DNA, 22 bp, Homo sapiens
tctccaggaagccctccctgac

SEQ ID NO: 8189340 - DNA, 22 bp, Homo sapiens
tctccaggaagccctccctgac

SEQ ID NO: 8189341 - DNA, 22 bp, Homo sapiens
tctccaggaaccatcatggtaa

SEQ ID NO: 8189342 - DNA, 22 bp, Homo sapiens
tctccaggaaccatcatggtaa

SEQ ID NO: 8189343 - DNA, 22 bp, Homo sapiens
tctccaggaaagacactggact

SEQ ID NO: 8189344 - DNA, 19 bp, Homo sapiens
tctccagctttgggctttt

SEQ ID NO: 8189345 - DNA, 21 bp, Homo sapiens
tctccagagtgggaggaaatc

SEQ ID NO: 8189346 - DNA, 22 bp, Homo sapiens
tctccagaggtcccttgtctct

SEQ ID NO: 8189347 - DNA, 18 bp, Homo sapiens
tctccacttctgtgagaa

SEQ ID NO: 8189348 - DNA, 21 bp, Homo sapiens
tctccagagtgggaggaaatc

SEQ ID NO: 8189349 - DNA, 22 bp, Homo sapiens
tctccagagtaaccttggagca

SEQ ID NO: 8189350 - DNA, 20 bp, Homo sapiens
tctccagatgcagatgacat

SEQ ID NO: 8189351 - DNA, 22 bp, Homo sapiens
tctcaaatttgttagataaaat

SEQ ID NO: 8189352 - DNA, 22 bp, Homo sapiens
tctcaaatttgttagataaaat

SEQ ID NO: 8189353 - DNA, 22 bp, Homo sapiens
tctcaaatttgttagataaaat

SEQ ID NO: 8189354 - DNA, 22 bp, Homo sapiens
tctcaaatttatacagagttca

SEQ ID NO: 8189355 - DNA, 22 bp, Homo sapiens
tctcaaatttatacagagttca

SEQ ID NO: 8189356 - DNA, 22 bp, Homo sapiens
tctcaaatttgctggaccagta

SEQ ID NO: 8189357 - DNA, 22 bp, Homo sapiens
tctcaaattcccttttcctcct

SEQ ID NO: 8189358 - DNA, 22 bp, Homo sapiens
tctcaaatttatacagagttca

SEQ ID NO: 8189359 - DNA, 22 bp, Homo sapiens
tctcaagagggaggcaatcatg

SEQ ID NO: 8189360 - DNA, 22 bp, Homo sapiens
tctcaagactggttttcacagc

SEQ ID NO: 8189361 - DNA, 22 bp, Homo sapiens
tctcaactaatggtgcaagatg

SEQ ID NO: 8189362 - DNA, 22 bp, Homo sapiens
tctcaactttgagaaacattgt

SEQ ID NO: 8189363 - DNA, 21 bp, Homo sapiens
tctcaacttttctctttgggc

SEQ ID NO: 8189364 - DNA, 22 bp, Homo sapiens
tctcaactttgagaaacattgt

SEQ ID NO: 8189365 - DNA, 22 bp, Homo sapiens
tctcaagcttgttggtatgttt

SEQ ID NO: 8189366 - DNA, 22 bp, Homo sapiens
tctcaagctagtgtttatagta

SEQ ID NO: 8189367 - DNA, 22 bp, Homo sapiens
ccacctctcagggtttcctaat

SEQ ID NO: 8189368 - DNA, 22 bp, Homo sapiens
ccacctcctcggccatgtgacg

SEQ ID NO: 8189369 - DNA, 22 bp, Homo sapiens
ccacctcctcggccatgtgacg

SEQ ID NO: 8189370 - DNA, 22 bp, Homo sapiens
ccacctcctaggcctggagaag

SEQ ID NO: 8189371 - DNA, 22 bp, Homo sapiens
ccacctcctaggcctggagaag

SEQ ID NO: 8189372 - DNA, 22 bp, Homo sapiens
ccacctccacctattgccagcc

SEQ ID NO: 8189373 - DNA, 22 bp, Homo sapiens
ccacctccacctattgccagcc

SEQ ID NO: 8189374 - DNA, 22 bp, Homo sapiens
tctatattccagatacagatta

SEQ ID NO: 8189375 - DNA, 22 bp, Homo sapiens
tctcaaatgtaaagcatgattt

SEQ ID NO: 8189376 - DNA, 22 bp, Homo sapiens
tctcaaattcccttttcctcct

SEQ ID NO: 8189377 - DNA, 22 bp, Homo sapiens
tctcaaatgtaaagcatgattt

SEQ ID NO: 8189378 - DNA, 22 bp, Homo sapiens
tctcaaatgtaaagcatgattt

SEQ ID NO: 8189379 - DNA, 22 bp, Homo sapiens
ccacctctgagcccaaaccctg

SEQ ID NO: 8189380 - DNA, 22 bp, Homo sapiens
tctatagtgtagataatttgaa

SEQ ID NO: 8189381 - DNA, 22 bp, Homo sapiens
tctatagtttctgagtttcttc

SEQ ID NO: 8189382 - DNA, 22 bp, Homo sapiens
tctatataacctccacttctac

SEQ ID NO: 8189383 - DNA, 20 bp, Homo sapiens
tctccaccacagagagcaga

SEQ ID NO: 8189384 - DNA, 22 bp, Homo sapiens
tctccactattttctagctctt

SEQ ID NO: 8189385 - DNA, 22 bp, Homo sapiens
tctccacagtcccacctcgctt

SEQ ID NO: 8189386 - DNA, 22 bp, Homo sapiens
tctccacactttctctcccagg

SEQ ID NO: 8189387 - DNA, 22 bp, Homo sapiens
tctccacaagctttctcctttt

SEQ ID NO: 8189388 - DNA, 22 bp, Homo sapiens
tctccacaagctttctcctttt

SEQ ID NO: 8189389 - DNA, 20 bp, Homo sapiens
tctcagtttctagagtcagg

SEQ ID NO: 8189390 - DNA, 22 bp, Homo sapiens
tctcagtttcctcatatgtaaa

SEQ ID NO: 8189391 - DNA, 22 bp, Homo sapiens
ccacttttttctccatctctga

SEQ ID NO: 8189392 - DNA, 22 bp, Homo sapiens
ccactttttcagtgtgcatgca

SEQ ID NO: 8189393 - DNA, 22 bp, Homo sapiens
ccactttttagagaacaaaact

SEQ ID NO: 8189394 - DNA, 22 bp, Homo sapiens
ccacttttttctccatctctga

SEQ ID NO: 8189395 - DNA, 22 bp, Homo sapiens
ccactttttagagaacaaaact

SEQ ID NO: 8189396 - DNA, 22 bp, Homo sapiens
ccacttttgggaacagtgagta

SEQ ID NO: 8189397 - DNA, 22 bp, Homo sapiens
ccacttttctacccactgtgac

SEQ ID NO: 8189398 - DNA, 22 bp, Homo sapiens
ccacttttcactaagatgaatt

SEQ ID NO: 8189399 - DNA, 22 bp, Homo sapiens
ccacttttcactaagatgaatt

SEQ ID NO: 8189400 - DNA, 22 bp, Homo sapiens
ccacttttcactaagatgaatt

SEQ ID NO: 8189401 - DNA, 22 bp, Homo sapiens
tccacatgaccattgtgctcct

SEQ ID NO: 8189402 - DNA, 22 bp, Homo sapiens
tccacatggctgggaggcctca

SEQ ID NO: 8189403 - DNA, 22 bp, Homo sapiens
tccagaccaaggaaggctgggc

SEQ ID NO: 8189404 - DNA, 22 bp, Homo sapiens
tccagaccatggatggctgcaa

SEQ ID NO: 8189405 - DNA, 22 bp, Homo sapiens
tccagaccatgtgagaggcgca

SEQ ID NO: 8189406 - DNA, 22 bp, Homo sapiens
tccacatccattgcttgacttt

SEQ ID NO: 8189407 - DNA, 22 bp, Homo sapiens
tccacatctaggtttgtcaaca

SEQ ID NO: 8189408 - DNA, 22 bp, Homo sapiens
tccacatagtcattaatttctg

SEQ ID NO: 8189409 - DNA, 22 bp, Homo sapiens
tccacatcaagggcagagaggt

SEQ ID NO: 8189410 - DNA, 22 bp, Homo sapiens
tccacagtggttgaactagtaa

SEQ ID NO: 8189411 - DNA, 22 bp, Homo sapiens
tccacagtggttgaactagttt

SEQ ID NO: 8189412 - DNA, 22 bp, Homo sapiens
tccacagttttgccactagctg

SEQ ID NO: 8189413 - DNA, 22 bp, Homo sapiens
tccacagttttgccactagctg

SEQ ID NO: 8189414 - DNA, 22 bp, Homo sapiens
tccacagtctatttttagtcta

SEQ ID NO: 8189415 - DNA, 22 bp, Homo sapiens
tccacaggtccggcatgaacag

SEQ ID NO: 8189416 - DNA, 22 bp, Homo sapiens
tccacaggtatttctccttgct

SEQ ID NO: 8189417 - DNA, 22 bp, Homo sapiens
tccacaggtatttctccttgct

SEQ ID NO: 8189418 - DNA, 22 bp, Homo sapiens
tccacagggcctttctggtgtg

SEQ ID NO: 8189419 - DNA, 22 bp, Homo sapiens
tccacaggtatgaggccccacc

SEQ ID NO: 8189420 - DNA, 20 bp, Homo sapiens
tccaagccctccttccattc

SEQ ID NO: 8189421 - DNA, 22 bp, Homo sapiens
tccacagggcctttctggtgtg

SEQ ID NO: 8189422 - DNA, 22 bp, Homo sapiens
tccacagggcctttctggtgtg

SEQ ID NO: 8189423 - DNA, 22 bp, Homo sapiens
tcatttatttgactttggagtg

SEQ ID NO: 8189424 - DNA, 22 bp, Homo sapiens
tcatttatttgactttggagtg

SEQ ID NO: 8189425 - DNA, 22 bp, Homo sapiens
tcatttatttataccattgcct

SEQ ID NO: 8189426 - DNA, 22 bp, Homo sapiens
tcatttatttataccattgcct

SEQ ID NO: 8189427 - DNA, 22 bp, Homo sapiens
tcatttatttataccattgcct

SEQ ID NO: 8189428 - DNA, 22 bp, Homo sapiens
tcatttatcgctgccttttaaa

SEQ ID NO: 8189429 - DNA, 22 bp, Homo sapiens
tcatttatcgctgccttttaaa

SEQ ID NO: 8189430 - DNA, 22 bp, Homo sapiens
tcatttatcgctgccttttaaa

SEQ ID NO: 8189431 - DNA, 22 bp, Homo sapiens
tcatttatcgctgccttttaaa

SEQ ID NO: 8189432 - DNA, 22 bp, Homo sapiens
tcatttatcatttgtgctgtag

SEQ ID NO: 8189433 - DNA, 22 bp, Homo sapiens
tcatttatcatttgtgctgtag

SEQ ID NO: 8189434 - DNA, 22 bp, Homo sapiens
tcattgaaaactcagcatctac

SEQ ID NO: 8189435 - DNA, 22 bp, Homo sapiens
tcatttatgcaggaatggcata

SEQ ID NO: 8189436 - DNA, 22 bp, Homo sapiens
tcatttatgcaggaatggcata

SEQ ID NO: 8189437 - DNA, 22 bp, Homo sapiens
tcatttatgcaggaatggcata

SEQ ID NO: 8189438 - DNA, 22 bp, Homo sapiens
tcatttatgcaggaatggcata

SEQ ID NO: 8189439 - DNA, 22 bp, Homo sapiens
tcatttatcgctgccttttaaa

SEQ ID NO: 8189440 - DNA, 22 bp, Homo sapiens
tcatttatcgctgccttttaaa

SEQ ID NO: 8189441 - DNA, 22 bp, Homo sapiens
tcatttatgcaggaatggcata

SEQ ID NO: 8189442 - DNA, 22 bp, Homo sapiens
tcatttatgcaggaatggcata

SEQ ID NO: 8189443 - DNA, 21 bp, Homo sapiens
tcatttattgagaaatgactg

SEQ ID NO: 8189444 - DNA, 22 bp, Homo sapiens
tcatttatgtctttgccatcca

SEQ ID NO: 8189445 - DNA, 22 bp, Homo sapiens
tcatttatgtctttgccatcca

SEQ ID NO: 8189446 - DNA, 21 bp, Homo sapiens
tcatttattgagaaatgactg

SEQ ID NO: 8189447 - DNA, 21 bp, Homo sapiens
tcatttattgagaaatgactg

SEQ ID NO: 8189448 - DNA, 21 bp, Homo sapiens
tcatttattgagaaatgactg

SEQ ID NO: 8189449 - DNA, 21 bp, Homo sapiens
tcatttattgagaaatgactg

SEQ ID NO: 8189450 - DNA, 21 bp, Homo sapiens
tcatttattgagaaatgactg

SEQ ID NO: 8189451 - DNA, 21 bp, Homo sapiens
tcatttattgagaaatgactg

SEQ ID NO: 8189452 - DNA, 21 bp, Homo sapiens
tcatttattgagaaatgactg

SEQ ID NO: 8189453 - DNA, 21 bp, Homo sapiens
tcatttattgagaaatgactg

SEQ ID NO: 8189454 - DNA, 22 bp, Homo sapiens
tcattccctcattgttcactgg

SEQ ID NO: 8189455 - DNA, 22 bp, Homo sapiens
tcattctttaccaagttgtcac

SEQ ID NO: 8189456 - DNA, 22 bp, Homo sapiens
tcattctctgggatgcagtttg

SEQ ID NO: 8189457 - DNA, 22 bp, Homo sapiens
tcattcttgatcactagttagt

SEQ ID NO: 8189458 - DNA, 22 bp, Homo sapiens
tcattcttgatcactagttagt

SEQ ID NO: 8189459 - DNA, 22 bp, Homo sapiens
tcattctgcatcactcttgctc

SEQ ID NO: 8189460 - DNA, 22 bp, Homo sapiens
tcattctgcatcactcttgctc

SEQ ID NO: 8189461 - DNA, 22 bp, Homo sapiens
tcattctgcatcactcttgctc

SEQ ID NO: 8189462 - DNA, 22 bp, Homo sapiens
tcatgaagtccaaactaaagca

SEQ ID NO: 8189463 - DNA, 20 bp, Homo sapiens
tcatgaagcctacaaacatc

SEQ ID NO: 8189464 - DNA, 21 bp, Homo sapiens
tcatgaagcatcacttctgcc

SEQ ID NO: 8189465 - DNA, 22 bp, Homo sapiens
tcatgaatattgaatgcttcat

SEQ ID NO: 8189466 - DNA, 22 bp, Homo sapiens
tcatgaatcgtggaatgattta

SEQ ID NO: 8189467 - DNA, 22 bp, Homo sapiens
cataacacctgatggcaatgat

SEQ ID NO: 8189468 - DNA, 22 bp, Homo sapiens
cataaattgtacccattccaac

SEQ ID NO: 8189469 - DNA, 22 bp, Homo sapiens
tcatcagtgtccttatcactta

SEQ ID NO: 8189470 - DNA, 22 bp, Homo sapiens
tcatcagtttagaaaaaatatg

SEQ ID NO: 8189471 - DNA, 22 bp, Homo sapiens
tcatcatcactctggcaagcat

SEQ ID NO: 8189472 - DNA, 22 bp, Homo sapiens
tcatcatccttttttgaagagt

SEQ ID NO: 8189473 - DNA, 22 bp, Homo sapiens
tcatcatcattctcccccactt

SEQ ID NO: 8189474 - DNA, 22 bp, Homo sapiens
tcatcataatatggaatcttgt

SEQ ID NO: 8189475 - DNA, 22 bp, Homo sapiens
tcatgattggaatggaatatgt

SEQ ID NO: 8189476 - DNA, 22 bp, Homo sapiens
tcatgatttttctttacagttg

SEQ ID NO: 8189477 - DNA, 22 bp, Homo sapiens
tcatgatttttctttacagttg

SEQ ID NO: 8189478 - DNA, 22 bp, Homo sapiens
tcatgatttttctttacagttg

SEQ ID NO: 8189479 - DNA, 22 bp, Homo sapiens
tcatgatttttctttacagttg

SEQ ID NO: 8189480 - DNA, 22 bp, Homo sapiens
tcatgagtttaaggtttaggct

SEQ ID NO: 8189481 - DNA, 22 bp, Homo sapiens
tcatgattcttctaccacagca

SEQ ID NO: 8189482 - DNA, 22 bp, Homo sapiens
tcatgattaacatttccaagca

SEQ ID NO: 8189483 - DNA, 22 bp, Homo sapiens
tcatgagtctgcaaattatgga

SEQ ID NO: 8189484 - DNA, 22 bp, Homo sapiens
tcatgagtggattaatatggct

SEQ ID NO: 8189485 - DNA, 22 bp, Homo sapiens
tcatgcaagaataataggaagg

SEQ ID NO: 8189486 - DNA, 22 bp, Homo sapiens
tcatgcaagaataataggaagg

SEQ ID NO: 8189487 - DNA, 22 bp, Homo sapiens
tcatgcaaggctgaaacatggt

SEQ ID NO: 8189488 - DNA, 18 bp, Homo sapiens
tcattcattaaacttggc

SEQ ID NO: 8189489 - DNA, 22 bp, Homo sapiens
tcattcattcatccagcttgag

SEQ ID NO: 8189490 - DNA, 22 bp, Homo sapiens
tcattcatttgctcactccaca

SEQ ID NO: 8189491 - DNA, 22 bp, Homo sapiens
tcattcatttgctcactccaca

SEQ ID NO: 8189492 - DNA, 22 bp, Homo sapiens
tcattcatttgctcactccaca

SEQ ID NO: 8189493 - DNA, 23 bp, Homo sapiens
tcattccacaaatacttatctag

SEQ ID NO: 8189494 - DNA, 20 bp, Homo sapiens
tcattccaaatagttcagca

SEQ ID NO: 8189495 - DNA, 23 bp, Homo sapiens
tcattccacaaatacttatctag

SEQ ID NO: 8189496 - DNA, 22 bp, Homo sapiens
tcattcatctggtgttagtcct

SEQ ID NO: 8189497 - DNA, 21 bp, Homo sapiens
tcatgtgctgaggatgatgcc

SEQ ID NO: 8189498 - DNA, 22 bp, Homo sapiens
tcattcatatctctcaagctta

SEQ ID NO: 8189499 - DNA, 23 bp, Homo sapiens
tcatgtggaaaaggatctggtct

SEQ ID NO: 8189500 - DNA, 22 bp, Homo sapiens
catcttttggcctattctgagg

SEQ ID NO: 8189501 - DNA, 22 bp, Homo sapiens
catgaaaaatttactgttaaca

SEQ ID NO: 8189502 - DNA, 22 bp, Homo sapiens
tcatgtcttctgtgatgtccaa

SEQ ID NO: 8189503 - DNA, 22 bp, Homo sapiens
tcatgcacagctcttagcacca

SEQ ID NO: 8189504 - DNA, 22 bp, Homo sapiens
tcatgcactacataacgatgtt

SEQ ID NO: 8189505 - DNA, 22 bp, Homo sapiens
tcatgcactacataacgatgtt

SEQ ID NO: 8189506 - DNA, 22 bp, Homo sapiens
catctttgggctgcatggaagg

SEQ ID NO: 8189507 - DNA, 22 bp, Homo sapiens
catgtgtgtctccaccagctgc

SEQ ID NO: 8189508 - DNA, 22 bp, Homo sapiens
catgtgtgtgagggaaacatgt

SEQ ID NO: 8189509 - DNA, 22 bp, Homo sapiens
catgtgtgtctccaccagctgc

SEQ ID NO: 8189510 - DNA, 22 bp, Homo sapiens
catgtgtgtggacgagcgtggc

SEQ ID NO: 8189511 - DNA, 22 bp, Homo sapiens
catgtgtgtgagggaaacatgt

SEQ ID NO: 8189512 - DNA, 22 bp, Homo sapiens
catgtgtgtccatgtgactaag

SEQ ID NO: 8189513 - DNA, 22 bp, Homo sapiens
catgtgtgtccatgtgactaag

SEQ ID NO: 8189514 - DNA, 22 bp, Homo sapiens
catgtgtccacccttgaacaca

SEQ ID NO: 8189515 - DNA, 20 bp, Homo sapiens
catgtgtcagttctcaccca

SEQ ID NO: 8189516 - DNA, 21 bp, Homo sapiens
catgtgtcattggagagcaat

SEQ ID NO: 8189517 - DNA, 22 bp, Homo sapiens
catgtgtggttacctacttgac

SEQ ID NO: 8189518 - DNA, 22 bp, Homo sapiens
catgtgtggttacctacttgac

SEQ ID NO: 8189519 - DNA, 22 bp, Homo sapiens
catgtgttttgtcatttcaata

SEQ ID NO: 8189520 - DNA, 22 bp, Homo sapiens
catgtgtttcgagactgttgag

SEQ ID NO: 8189521 - DNA, 22 bp, Homo sapiens
catgtgttttgtcatttcaata

SEQ ID NO: 8189522 - DNA, 22 bp, Homo sapiens
catgtgtttcgagactgttgag

SEQ ID NO: 8189523 - DNA, 22 bp, Homo sapiens
catgtgtgtggctgacaatttt

SEQ ID NO: 8189524 - DNA, 22 bp, Homo sapiens
catgtgttaatctttctgcaaa

SEQ ID NO: 8189525 - DNA, 22 bp, Homo sapiens
catgtgttgtctcatttaatcc

SEQ ID NO: 8189526 - DNA, 18 bp, Homo sapiens
catgtgttctacatcagt

SEQ ID NO: 8189527 - DNA, 22 bp, Homo sapiens
tccaggctcccctgcgtgctcc

SEQ ID NO: 8189528 - DNA, 22 bp, Homo sapiens
tccaggctccctcaggatgcac

SEQ ID NO: 8189529 - DNA, 22 bp, Homo sapiens
tccaggctccctcaggatgcac

SEQ ID NO: 8189530 - DNA, 22 bp, Homo sapiens
tccaggctccctcaggatgcac

SEQ ID NO: 8189531 - DNA, 22 bp, Homo sapiens
tccaggctccctcaggatgcac

SEQ ID NO: 8189532 - DNA, 21 bp, Homo sapiens
catgtgtcattggagagcaat

SEQ ID NO: 8189533 - DNA, 20 bp, Homo sapiens
tccaggctcctccacttagt

SEQ ID NO: 8189534 - DNA, 20 bp, Homo sapiens
tccaggctcctccacttagt

SEQ ID NO: 8189535 - DNA, 18 bp, Homo sapiens
tccaggctccaggctaac

SEQ ID NO: 8189536 - DNA, 18 bp, Homo sapiens
tccaggctccaggctaac

SEQ ID NO: 8189537 - DNA, 22 bp, Homo sapiens
tccaggctcagtcaagcacttc

SEQ ID NO: 8189538 - DNA, 22 bp, Homo sapiens
tccaggctcagtcaagcacttc

SEQ ID NO: 8189539 - DNA, 18 bp, Homo sapiens
tccaggctccaggctaac

SEQ ID NO: 8189540 - DNA, 18 bp, Homo sapiens
tccaggctccaggctaac

SEQ ID NO: 8189541 - DNA, 22 bp, Homo sapiens
tccaggctcccctgcgtgctcc

SEQ ID NO: 8189542 - DNA, 22 bp, Homo sapiens
tccaggctcccctgcgtgctcc

SEQ ID NO: 8189543 - DNA, 22 bp, Homo sapiens
tccaggctcccctgcgtgctcc

SEQ ID NO: 8189544 - DNA, 19 bp, Homo sapiens
tccaggctccattggcaga

SEQ ID NO: 8189545 - DNA, 19 bp, Homo sapiens
tccaggctccattggcaga

SEQ ID NO: 8189546 - DNA, 22 bp, Homo sapiens
tccaggcccatggagcagagct

SEQ ID NO: 8189547 - DNA, 22 bp, Homo sapiens
tccaggccccactgaagcccct

SEQ ID NO: 8189548 - DNA, 22 bp, Homo sapiens
tccaggccccactgaagcccct

SEQ ID NO: 8189549 - DNA, 22 bp, Homo sapiens
tccaggccccactgaagcccct

SEQ ID NO: 8189550 - DNA, 22 bp, Homo sapiens
tccaggcccatggagcagagct

SEQ ID NO: 8189551 - DNA, 22 bp, Homo sapiens
tccaggcccatggagcagagct

SEQ ID NO: 8189552 - DNA, 22 bp, Homo sapiens
tccaggcccatagacacttctc

SEQ ID NO: 8189553 - DNA, 20 bp, Homo sapiens
tccaggcagctcagagtgtc

SEQ ID NO: 8189554 - DNA, 22 bp, Homo sapiens
tccaggcagcccttcctgactc

SEQ ID NO: 8189555 - DNA, 20 bp, Homo sapiens
tccagctgggaacagctgat

SEQ ID NO: 8189556 - DNA, 22 bp, Homo sapiens
tccaggcagcccttcctgactc

SEQ ID NO: 8189557 - DNA, 22 bp, Homo sapiens
tccagctggcttcggaagtgga

SEQ ID NO: 8189558 - DNA, 22 bp, Homo sapiens
tccagctggcttcggaagtgga

SEQ ID NO: 8189559 - DNA, 22 bp, Homo sapiens
tccagctggcctaacttcaggg

SEQ ID NO: 8189560 - DNA, 22 bp, Homo sapiens
tccagctggcccggccatgaat

SEQ ID NO: 8189561 - DNA, 22 bp, Homo sapiens
tccagctggcccggccatgaat

SEQ ID NO: 8189562 - DNA, 22 bp, Homo sapiens
tccaggccccagaccgtactgc

SEQ ID NO: 8189563 - DNA, 22 bp, Homo sapiens
tccaggccccagaccgtactgc

SEQ ID NO: 8189564 - DNA, 22 bp, Homo sapiens
tccaggccccccacgctaatgg

SEQ ID NO: 8189565 - DNA, 22 bp, Homo sapiens
tccaggccccccacgctaatgg

SEQ ID NO: 8189566 - DNA, 22 bp, Homo sapiens
tccaggccccagcaccttggga

SEQ ID NO: 8189567 - DNA, 22 bp, Homo sapiens
tccaggccccagcaccttggga

SEQ ID NO: 8189568 - DNA, 22 bp, Homo sapiens
tccaggcccctgcctgggcctg

SEQ ID NO: 8189569 - DNA, 22 bp, Homo sapiens
tccaggcccgagatgggctgga

SEQ ID NO: 8189570 - DNA, 22 bp, Homo sapiens
tccaggcccctgcctgggcctg

SEQ ID NO: 8189571 - DNA, 22 bp, Homo sapiens
tccaggcccgagatgggctgga

SEQ ID NO: 8189572 - DNA, 22 bp, Homo sapiens
tccaggctcagtcaagcacttc

SEQ ID NO: 8189573 - DNA, 22 bp, Homo sapiens
tccaggctcagtcaagcacttc

SEQ ID NO: 8189574 - DNA, 22 bp, Homo sapiens
tccaggcccgagatgggctgga

SEQ ID NO: 8189575 - DNA, 22 bp, Homo sapiens
tccagctgccaaccgggccccg

SEQ ID NO: 8189576 - DNA, 23 bp, Homo sapiens
tccagctgcagtgggatggggaa

SEQ ID NO: 8189577 - DNA, 22 bp, Homo sapiens
tccagctgctgacccagtagcc

SEQ ID NO: 8189578 - DNA, 22 bp, Homo sapiens
tccagctgctagctagatgcaa

SEQ ID NO: 8189579 - DNA, 22 bp, Homo sapiens
tccagctgctgacccagtagcc

SEQ ID NO: 8189580 - DNA, 22 bp, Homo sapiens
tccagctgctgccagccaagct

SEQ ID NO: 8189581 - DNA, 22 bp, Homo sapiens
tccagctgctgccagccaagct

SEQ ID NO: 8189582 - DNA, 21 bp, Homo sapiens
tccagctgcacaagcatgggg

SEQ ID NO: 8189583 - DNA, 23 bp, Homo sapiens
tccagctgcagtgggatggggaa

SEQ ID NO: 8189584 - DNA, 21 bp, Homo sapiens
tccagctgcacaagcatgggg

SEQ ID NO: 8189585 - DNA, 22 bp, Homo sapiens
tccagctgacagttcaaaatga

SEQ ID NO: 8189586 - DNA, 22 bp, Homo sapiens
tccagctgacatctcctgaggg

SEQ ID NO: 8189587 - DNA, 22 bp, Homo sapiens
tccagctgacatctcctgaggg

SEQ ID NO: 8189588 - DNA, 22 bp, Homo sapiens
tccagctgacacttaaggggag

SEQ ID NO: 8189589 - DNA, 22 bp, Homo sapiens
tccagctgcaaggggcacagct

SEQ ID NO: 8189590 - DNA, 22 bp, Homo sapiens
tccagctgcaaggggcacagct

SEQ ID NO: 8189591 - DNA, 22 bp, Homo sapiens
tccagctgcaaggggcacagct

SEQ ID NO: 8189592 - DNA, 22 bp, Homo sapiens
tccagctgaggtggcctctgtg

SEQ ID NO: 8189593 - DNA, 22 bp, Homo sapiens
tccagctgaggtggcctctgtg

SEQ ID NO: 8189594 - DNA, 20 bp, Homo sapiens
tccagctgacattctctttc

SEQ ID NO: 8189595 - DNA, 22 bp, Homo sapiens
tccagctgaggtggcctctgtg

SEQ ID NO: 8189596 - DNA, 20 bp, Homo sapiens
tccagctgacattctctttc

SEQ ID NO: 8189597 - DNA, 22 bp, Homo sapiens
tccagcctcatttctcctgctt

SEQ ID NO: 8189598 - DNA, 22 bp, Homo sapiens
tccagcctaggggaacagctgc

SEQ ID NO: 8189599 - DNA, 22 bp, Homo sapiens
tccagcctaatgttcttcccac

SEQ ID NO: 8189600 - DNA, 22 bp, Homo sapiens
tccagcctcctatttaccctaa

SEQ ID NO: 8189601 - DNA, 22 bp, Homo sapiens
tccagcctcatttctcctgctt

SEQ ID NO: 8189602 - DNA, 22 bp, Homo sapiens
tccagcctcatttctcctgctt

SEQ ID NO: 8189603 - DNA, 17 bp, Homo sapiens
tccagcctcctctgctg

SEQ ID NO: 8189604 - DNA, 22 bp, Homo sapiens
tccagcctcctatttaccctaa

SEQ ID NO: 8189605 - DNA, 17 bp, Homo sapiens
tccagcctcctctgctg

SEQ ID NO: 8189606 - DNA, 22 bp, Homo sapiens
tccagctcttcagttctgcaaa

SEQ ID NO: 8189607 - DNA, 22 bp, Homo sapiens
tccagcctaatgttcttcccac

SEQ ID NO: 8189608 - DNA, 19 bp, Homo sapiens
tccagccctgttccctttt

SEQ ID NO: 8189609 - DNA, 22 bp, Homo sapiens
tccagccctgtgtctgggagag

SEQ ID NO: 8189610 - DNA, 22 bp, Homo sapiens
tccagccctgtgtctgggagag

SEQ ID NO: 8189611 - DNA, 22 bp, Homo sapiens
tccagccctgtgtctgggagag

SEQ ID NO: 8189612 - DNA, 22 bp, Homo sapiens
tccagccctgtggcttccaccc

SEQ ID NO: 8189613 - DNA, 22 bp, Homo sapiens
tccagccctgtggcttccaccc

SEQ ID NO: 8189614 - DNA, 17 bp, Homo sapiens
tccagagaggcttccct

SEQ ID NO: 8189615 - DNA, 22 bp, Homo sapiens
tccagcccagctgtccccttca

SEQ ID NO: 8189616 - DNA, 22 bp, Homo sapiens
tccagcccagctgtccccttca

SEQ ID NO: 8189617 - DNA, 22 bp, Homo sapiens
tccagagaggcatatttacaag

SEQ ID NO: 8189618 - DNA, 22 bp, Homo sapiens
tccagagaggcatatttacaag

SEQ ID NO: 8189619 - DNA, 22 bp, Homo sapiens
tccagagagatagtggctaata

SEQ ID NO: 8189620 - DNA, 22 bp, Homo sapiens
tccagactctgtcacttcctag

SEQ ID NO: 8189621 - DNA, 22 bp, Homo sapiens
tccagagaaatctagtcttaca

SEQ ID NO: 8189622 - DNA, 22 bp, Homo sapiens
tccagagaaatctagtcttaca

SEQ ID NO: 8189623 - DNA, 22 bp, Homo sapiens
tccagagaattctacgcagtgc

SEQ ID NO: 8189624 - DNA, 22 bp, Homo sapiens
tccagagacttgcatgtgcttg

SEQ ID NO: 8189625 - DNA, 22 bp, Homo sapiens
tccagagagaaaaacaagcttt

SEQ ID NO: 8189626 - DNA, 20 bp, Homo sapiens
catttgggatcatgaggttt

SEQ ID NO: 8189627 - DNA, 22 bp, Homo sapiens
tcctcagggaagatgagcctca

SEQ ID NO: 8189628 - DNA, 22 bp, Homo sapiens
tcctcaggctgcctggaagact

SEQ ID NO: 8189629 - DNA, 21 bp, Homo sapiens
tcctctccatgatctgtttgt

SEQ ID NO: 8189630 - DNA, 22 bp, Homo sapiens
tcctctccatattttctgattt

SEQ ID NO: 8189631 - DNA, 22 bp, Homo sapiens
tcctcccctcagggcaacggat

SEQ ID NO: 8189632 - DNA, 22 bp, Homo sapiens
catttgtagtatctgtttatat

SEQ ID NO: 8189633 - DNA, 22 bp, Homo sapiens
tccctaggtcctagtcacagta

SEQ ID NO: 8189634 - DNA, 22 bp, Homo sapiens
tccctaggtcctagtcacagta

SEQ ID NO: 8189635 - DNA, 22 bp, Homo sapiens
tccctagtcgcatctgtggaga

SEQ ID NO: 8189636 - DNA, 22 bp, Homo sapiens
tccctagtcgcatctgtggaga

SEQ ID NO: 8189637 - DNA, 22 bp, Homo sapiens
tcctagaagatggatcagagaa

SEQ ID NO: 8189638 - DNA, 22 bp, Homo sapiens
tcctagaaggatcattctagtg

SEQ ID NO: 8189639 - DNA, 18 bp, Homo sapiens
tcctcagcctcacctagc

SEQ ID NO: 8189640 - DNA, 22 bp, Homo sapiens
tccctcagaaattctctctgaa

SEQ ID NO: 8189641 - DNA, 22 bp, Homo sapiens
tccctcactggttctgcatccc

SEQ ID NO: 8189642 - DNA, 22 bp, Homo sapiens
tccctcagaaattctctctgaa

SEQ ID NO: 8189643 - DNA, 22 bp, Homo sapiens
tccctcagaaattctctctgaa

SEQ ID NO: 8189644 - DNA, 22 bp, Homo sapiens
tccctcagaaattctctctgaa

SEQ ID NO: 8189645 - DNA, 22 bp, Homo sapiens
tcctcagctttggtttactcat

SEQ ID NO: 8189646 - DNA, 22 bp, Homo sapiens
tcctcagcttttatttcacttg

SEQ ID NO: 8189647 - DNA, 22 bp, Homo sapiens
tcctcagctttggtttactcat

SEQ ID NO: 8189648 - DNA, 22 bp, Homo sapiens
tcctcaggcggtgaggaggggc

SEQ ID NO: 8189649 - DNA, 22 bp, Homo sapiens
tcctcaggatctaggagtgctt

SEQ ID NO: 8189650 - DNA, 22 bp, Homo sapiens
tcctcaggatgtggagtagaat

SEQ ID NO: 8189651 - DNA, 22 bp, Homo sapiens
tcccagggtcctcttctggaat

SEQ ID NO: 8189652 - DNA, 22 bp, Homo sapiens
cattgcacatctgagaagagat

SEQ ID NO: 8189653 - DNA, 22 bp, Homo sapiens
cattgcaacttcaaactcctgg

SEQ ID NO: 8189654 - DNA, 22 bp, Homo sapiens
cattgagaatctgggctacagc

SEQ ID NO: 8189655 - DNA, 22 bp, Homo sapiens
cattgagagaatcacatagaag

SEQ ID NO: 8189656 - DNA, 22 bp, Homo sapiens
cattgagagaatcacatagaag

SEQ ID NO: 8189657 - DNA, 22 bp, Homo sapiens
cattgcaacttcaaactcctgg

SEQ ID NO: 8189658 - DNA, 22 bp, Homo sapiens
cattgattatggaaagcagtgg

SEQ ID NO: 8189659 - DNA, 22 bp, Homo sapiens
cattgattatggaaagcagtgg

SEQ ID NO: 8189660 - DNA, 18 bp, Homo sapiens
cattcttggcagcttttg

SEQ ID NO: 8189661 - DNA, 18 bp, Homo sapiens
cattcttggcagcttttg

SEQ ID NO: 8189662 - DNA, 22 bp, Homo sapiens
tcccaggatctgagggcagaga

SEQ ID NO: 8189663 - DNA, 16 bp, Homo sapiens
tcccaggaggcggaac

SEQ ID NO: 8189664 - DNA, 22 bp, Homo sapiens
tcccaggaggtgcttcctagga

SEQ ID NO: 8189665 - DNA, 22 bp, Homo sapiens
cattgaaatatggaaactgatg

SEQ ID NO: 8189666 - DNA, 22 bp, Homo sapiens
cattgaaagagataaagccttt

SEQ ID NO: 8189667 - DNA, 19 bp, Homo sapiens
tccccagcacctctgagtc

SEQ ID NO: 8189668 - DNA, 19 bp, Homo sapiens
tccccagcacctctgagtc

SEQ ID NO: 8189669 - DNA, 19 bp, Homo sapiens
tccccagcacctctgagtc

SEQ ID NO: 8189670 - DNA, 19 bp, Homo sapiens
tccccagcacctctgagtc

SEQ ID NO: 8189671 - DNA, 22 bp, Homo sapiens
tccccagatggccagctacatg

SEQ ID NO: 8189672 - DNA, 22 bp, Homo sapiens
tccccagatgacatcaaaaggc

SEQ ID NO: 8189673 - DNA, 22 bp, Homo sapiens
tccccagatggccagctacatg

SEQ ID NO: 8189674 - DNA, 22 bp, Homo sapiens
tccccagaggaatatgagattg

SEQ ID NO: 8189675 - DNA, 22 bp, Homo sapiens
tccccagaggtgaggcagcttt

SEQ ID NO: 8189676 - DNA, 22 bp, Homo sapiens
tccccagaggtgaggcagcttt

SEQ ID NO: 8189677 - DNA, 22 bp, Homo sapiens
tccccactgggcctcctctttc

SEQ ID NO: 8189678 - DNA, 22 bp, Homo sapiens
tccctaggagaattgccgcagc

SEQ ID NO: 8189679 - DNA, 20 bp, Homo sapiens
tccctaggcaggagggcact

SEQ ID NO: 8189680 - DNA, 22 bp, Homo sapiens
tccctaggagaattgccgcagc

SEQ ID NO: 8189681 - DNA, 22 bp, Homo sapiens
tccctaggagaattgccgcagc

SEQ ID NO: 8189682 - DNA, 22 bp, Homo sapiens
tccctaggaccccaccttccgc

SEQ ID NO: 8189683 - DNA, 22 bp, Homo sapiens
tccctagcttatttgtgctcta

SEQ ID NO: 8189684 - DNA, 22 bp, Homo sapiens
tcccggcgctgggaggtgggtc

SEQ ID NO: 8189685 - DNA, 22 bp, Homo sapiens
tccccaggaaattctgattctt

SEQ ID NO: 8189686 - DNA, 22 bp, Homo sapiens
tccccaggaaattctgattctt

SEQ ID NO: 8189687 - DNA, 22 bp, Homo sapiens
tccccagcttgctacttctgct

SEQ ID NO: 8189688 - DNA, 22 bp, Homo sapiens
tcccgtaggttgctgtagtcgg

SEQ ID NO: 8189689 - DNA, 22 bp, Homo sapiens
tcccgttgatgacggtgcatcc

SEQ ID NO: 8189690 - DNA, 22 bp, Homo sapiens
tccccagccgtgaaggagagga

SEQ ID NO: 8189691 - DNA, 22 bp, Homo sapiens
tccccagctctgtgcttccact

SEQ ID NO: 8189692 - DNA, 22 bp, Homo sapiens
tccccagccgtgaaggagagga

SEQ ID NO: 8189693 - DNA, 22 bp, Homo sapiens
tccccagcttgctacttctgct

SEQ ID NO: 8189694 - DNA, 22 bp, Homo sapiens
catgtttaattgcgatgtttga

SEQ ID NO: 8189695 - DNA, 22 bp, Homo sapiens
catgtttaattgcgatgtttga

SEQ ID NO: 8189696 - DNA, 22 bp, Homo sapiens
catgtttaattgcgatgtttga

SEQ ID NO: 8189697 - DNA, 22 bp, Homo sapiens
catgtttgtacaaaggtacaca

SEQ ID NO: 8189698 - DNA, 22 bp, Homo sapiens
catgttttctaggctttcacaa

SEQ ID NO: 8189699 - DNA, 22 bp, Homo sapiens
catgtttctgagaaaagtagga

SEQ ID NO: 8189700 - DNA, 22 bp, Homo sapiens
catgtttctgagaaaagtagga

SEQ ID NO: 8189701 - DNA, 22 bp, Homo sapiens
cattcaaaggcatgtcctattt

SEQ ID NO: 8189702 - DNA, 22 bp, Homo sapiens
cattatctcagttgaacttatg

SEQ ID NO: 8189703 - DNA, 22 bp, Homo sapiens
cattatattttactgcatggga

SEQ ID NO: 8189704 - DNA, 22 bp, Homo sapiens
cattatattacagcactgttaa

SEQ ID NO: 8189705 - DNA, 22 bp, Homo sapiens
catgttggcaaggatacagcag

SEQ ID NO: 8189706 - DNA, 22 bp, Homo sapiens
catgttctaatattgtgacata

SEQ ID NO: 8189707 - DNA, 22 bp, Homo sapiens
catgttctaatattgtgacata

SEQ ID NO: 8189708 - DNA, 22 bp, Homo sapiens
catgttctaacaatgagaaacc

SEQ ID NO: 8189709 - DNA, 19 bp, Homo sapiens
catgttatgctgtagtatc

SEQ ID NO: 8189710 - DNA, 19 bp, Homo sapiens
catgttatgctgtagtatc

SEQ ID NO: 8189711 - DNA, 22 bp, Homo sapiens
catgttaagtgtttgataacca

SEQ ID NO: 8189712 - DNA, 22 bp, Homo sapiens
catgttaagtgtttgataacca

SEQ ID NO: 8189713 - DNA, 22 bp, Homo sapiens
cattcacaaaaccacatgccat

SEQ ID NO: 8189714 - DNA, 22 bp, Homo sapiens
cattcaaattaagattttgtta

SEQ ID NO: 8189715 - DNA, 22 bp, Homo sapiens
cattcaaatgtgccactgtcct

SEQ ID NO: 8189716 - DNA, 22 bp, Homo sapiens
cattcacaaagctgattgatgg

SEQ ID NO: 8189717 - DNA, 22 bp, Homo sapiens
cattcacaatagttgaaaggtg

SEQ ID NO: 8189718 - DNA, 22 bp, Homo sapiens
cattcacagagggggaagcatc

SEQ ID NO: 8189719 - DNA, 22 bp, Homo sapiens
cattcaggtacactcagtgcta

SEQ ID NO: 8189720 - DNA, 22 bp, Homo sapiens
cattcagagctttcttatcata

SEQ ID NO: 8189721 - DNA, 22 bp, Homo sapiens
cattcagtcatgctggttttga

SEQ ID NO: 8189722 - DNA, 22 bp, Homo sapiens
cattcagtcatgctggttttga

SEQ ID NO: 8189723 - DNA, 22 bp, Homo sapiens
cattcagtggagtattattcag

SEQ ID NO: 8189724 - DNA, 22 bp, Homo sapiens
cattcattagaatagatatgta

SEQ ID NO: 8189725 - DNA, 22 bp, Homo sapiens
cattcattagaatagatatgta

SEQ ID NO: 8189726 - DNA, 22 bp, Homo sapiens
cattcattagaatagatatgta

SEQ ID NO: 8189727 - DNA, 22 bp, Homo sapiens
cattcattacactcataaggtt

SEQ ID NO: 8189728 - DNA, 22 bp, Homo sapiens
cattcattacactcataaggtt

SEQ ID NO: 8189729 - DNA, 22 bp, Homo sapiens
tcccagccacagtttccacctg

SEQ ID NO: 8189730 - DNA, 22 bp, Homo sapiens
tcccagccaggctctaccactt

SEQ ID NO: 8189731 - DNA, 22 bp, Homo sapiens
tcccagccaggctctaccactt

SEQ ID NO: 8189732 - DNA, 22 bp, Homo sapiens
tcccagcccagacttctccagt

SEQ ID NO: 8189733 - DNA, 22 bp, Homo sapiens
tcccagccattcctttaggtgt

SEQ ID NO: 8189734 - DNA, 22 bp, Homo sapiens
tcccagccattcctttaggtgt

SEQ ID NO: 8189735 - DNA, 22 bp, Homo sapiens
tcccagcccagatttgtgtgac

SEQ ID NO: 8189736 - DNA, 22 bp, Homo sapiens
tcccagcccagacttctccagt

SEQ ID NO: 8189737 - DNA, 22 bp, Homo sapiens
tcccagcccagatttgtgtgac

SEQ ID NO: 8189738 - DNA, 22 bp, Homo sapiens
tcccagcccaggtatgatgata

SEQ ID NO: 8189739 - DNA, 23 bp, Homo sapiens
tcccaggaatctgcatttttaac

SEQ ID NO: 8189740 - DNA, 22 bp, Homo sapiens
tcccaggaatgtctgaaagtga

SEQ ID NO: 8189741 - DNA, 22 bp, Homo sapiens
tcccaggaattgaagccagtgt

SEQ ID NO: 8189742 - DNA, 22 bp, Homo sapiens
tcccaggacaggccacatggaa

SEQ ID NO: 8189743 - DNA, 22 bp, Homo sapiens
tcccaggacaggccacatggaa

SEQ ID NO: 8189744 - DNA, 22 bp, Homo sapiens
tcccaggacaggccacatggaa

SEQ ID NO: 8189745 - DNA, 22 bp, Homo sapiens
tcccaggacaggccacatggaa

SEQ ID NO: 8189746 - DNA, 22 bp, Homo sapiens
tcccaggacatgggctctgctc

SEQ ID NO: 8189747 - DNA, 22 bp, Homo sapiens
tcccaggacatgggctctgctc

SEQ ID NO: 8189748 - DNA, 22 bp, Homo sapiens
tcccaggacatgggctctgctc

SEQ ID NO: 8189749 - DNA, 22 bp, Homo sapiens
tcccaggagcaccttttgagcc

SEQ ID NO: 8189750 - DNA, 22 bp, Homo sapiens
tcccaggacttccagttggagg

SEQ ID NO: 8189751 - DNA, 22 bp, Homo sapiens
tcccaggacccaggcattcaca

SEQ ID NO: 8189752 - DNA, 21 bp, Homo sapiens
tcccactctaaatggactgaa

SEQ ID NO: 8189753 - DNA, 20 bp, Homo sapiens
tcccactcttgtgttttcag

SEQ ID NO: 8189754 - DNA, 21 bp, Homo sapiens
tcccactctaaatggactgaa

SEQ ID NO: 8189755 - DNA, 22 bp, Homo sapiens
tcccagagcctctgccactctg

SEQ ID NO: 8189756 - DNA, 22 bp, Homo sapiens
cattcattctgtaagtaactat

SEQ ID NO: 8189757 - DNA, 22 bp, Homo sapiens
cattcattctgtaagtaactat

SEQ ID NO: 8189758 - DNA, 22 bp, Homo sapiens
cattcatttactttcaacagct

SEQ ID NO: 8189759 - DNA, 22 bp, Homo sapiens
cattcatttactttcaacagct

SEQ ID NO: 8189760 - DNA, 22 bp, Homo sapiens
cattcatttactttcaacagct

SEQ ID NO: 8189761 - DNA, 22 bp, Homo sapiens
cattcatttatgaaatatctat

SEQ ID NO: 8189762 - DNA, 22 bp, Homo sapiens
cattcatttactttcaacagct

SEQ ID NO: 8189763 - DNA, 22 bp, Homo sapiens
cattcattcagcaactgttatt

SEQ ID NO: 8189764 - DNA, 22 bp, Homo sapiens
cattcattcagcaactgttatt

SEQ ID NO: 8189765 - DNA, 22 bp, Homo sapiens
cattcattcacattttgtctat

SEQ ID NO: 8189766 - DNA, 22 bp, Homo sapiens
cattcattcacattttgtctat

SEQ ID NO: 8189767 - DNA, 22 bp, Homo sapiens
cattcattcacattttgtctat

SEQ ID NO: 8189768 - DNA, 22 bp, Homo sapiens
cattcattcagcaactgttatt

SEQ ID NO: 8189769 - DNA, 22 bp, Homo sapiens
tcccagagctctggaggttgga

SEQ ID NO: 8189770 - DNA, 22 bp, Homo sapiens
tcccagagctctgacaccagct

SEQ ID NO: 8189771 - DNA, 22 bp, Homo sapiens
tcccagagcctctgccactctg

SEQ ID NO: 8189772 - DNA, 22 bp, Homo sapiens
tcccagagctctgacaccagct

SEQ ID NO: 8189773 - DNA, 22 bp, Homo sapiens
tcccagagctctgacaccagct

SEQ ID NO: 8189774 - DNA, 22 bp, Homo sapiens
tcccagagcctctgccactctg

SEQ ID NO: 8189775 - DNA, 22 bp, Homo sapiens
tcccagaggaaatggcagctga

SEQ ID NO: 8189776 - DNA, 22 bp, Homo sapiens
tcccagagctgataagccttta

SEQ ID NO: 8189777 - DNA, 22 bp, Homo sapiens
tcccagagctgataagccttta

SEQ ID NO: 8189778 - DNA, 22 bp, Homo sapiens
tcccagccacaggtgtagccct

SEQ ID NO: 8189779 - DNA, 22 bp, Homo sapiens
tatttcttgttccctccaagtt

SEQ ID NO: 8189780 - DNA, 22 bp, Homo sapiens
cagtcccagacccagaaggtgg

SEQ ID NO: 8189781 - DNA, 22 bp, Homo sapiens
cagtcccagacccagaaggtgg

SEQ ID NO: 8189782 - DNA, 22 bp, Homo sapiens
tatttcttgttccctccaagtt

SEQ ID NO: 8189783 - DNA, 22 bp, Homo sapiens
tatttcttgttccctccaagtt

SEQ ID NO: 8189784 - DNA, 22 bp, Homo sapiens
cagtcccagacatagtaaggga

SEQ ID NO: 8189785 - DNA, 22 bp, Homo sapiens
cagtcccagaagagcctgggag

SEQ ID NO: 8189786 - DNA, 22 bp, Homo sapiens
cagtcccagaagagcctgggag

SEQ ID NO: 8189787 - DNA, 22 bp, Homo sapiens
tatttctttcaggtatgtgttg

SEQ ID NO: 8189788 - DNA, 22 bp, Homo sapiens
tatttctttcaggtatgtgttg

SEQ ID NO: 8189789 - DNA, 22 bp, Homo sapiens
tatttctttcaggtatgtgttg

SEQ ID NO: 8189790 - DNA, 22 bp, Homo sapiens
tatttctttcaggtatgtgttg

SEQ ID NO: 8189791 - DNA, 21 bp, Homo sapiens
tatttctttgactctctccct

SEQ ID NO: 8189792 - DNA, 22 bp, Homo sapiens
tatttcttttcgtgacttattg

SEQ ID NO: 8189793 - DNA, 22 bp, Homo sapiens
tatttcttttcgtgacttattg

SEQ ID NO: 8189794 - DNA, 21 bp, Homo sapiens
tatttctttgactctctccct

SEQ ID NO: 8189795 - DNA, 22 bp, Homo sapiens
tatttcttttcgtgacttattg

SEQ ID NO: 8189796 - DNA, 22 bp, Homo sapiens
cagtccagagcccaccagagga

SEQ ID NO: 8189797 - DNA, 20 bp, Homo sapiens
cagtccaatcagaggccacc

SEQ ID NO: 8189798 - DNA, 22 bp, Homo sapiens
cagtcccaaggaggaagcagtc

SEQ ID NO: 8189799 - DNA, 22 bp, Homo sapiens
cagtcccaaggaggaagcagtc

SEQ ID NO: 8189800 - DNA, 22 bp, Homo sapiens
cagtcccaaggaggaagcagtc

SEQ ID NO: 8189801 - DNA, 20 bp, Homo sapiens
cagtcccaatccagggccag

SEQ ID NO: 8189802 - DNA, 20 bp, Homo sapiens
cagtcccaatccagggccag

SEQ ID NO: 8189803 - DNA, 20 bp, Homo sapiens
cagtcccaatccagggccag

SEQ ID NO: 8189804 - DNA, 22 bp, Homo sapiens
cagtcccaccaggatcgctctt

SEQ ID NO: 8189805 - DNA, 22 bp, Homo sapiens
tatttccacctattattttctg

SEQ ID NO: 8189806 - DNA, 22 bp, Homo sapiens
tatttccacctattattttctg

SEQ ID NO: 8189807 - DNA, 22 bp, Homo sapiens
tatttccacctattattttctg

SEQ ID NO: 8189808 - DNA, 22 bp, Homo sapiens
tatttccacttaggtgcctgtt

SEQ ID NO: 8189809 - DNA, 22 bp, Homo sapiens
tatttccagaggagtatagaag

SEQ ID NO: 8189810 - DNA, 22 bp, Homo sapiens
tatttccagaggagtatagaag

SEQ ID NO: 8189811 - DNA, 22 bp, Homo sapiens
tatttccagaggagtatagaag

SEQ ID NO: 8189812 - DNA, 22 bp, Homo sapiens
tatttccagaggagtatagaag

SEQ ID NO: 8189813 - DNA, 22 bp, Homo sapiens
tatttccagatgaggttacatt

SEQ ID NO: 8189814 - DNA, 22 bp, Homo sapiens
cagtagccaactccaggaacta

SEQ ID NO: 8189815 - DNA, 22 bp, Homo sapiens
cagtagccactagacacatgta

SEQ ID NO: 8189816 - DNA, 22 bp, Homo sapiens
cagtagccttatttggatcatt

SEQ ID NO: 8189817 - DNA, 22 bp, Homo sapiens
cagtagcccactagtatgcagt

SEQ ID NO: 8189818 - DNA, 22 bp, Homo sapiens
cagtagcccactagtatgcagt

SEQ ID NO: 8189819 - DNA, 21 bp, Homo sapiens
tatttccaaccctttatcctt

SEQ ID NO: 8189820 - DNA, 21 bp, Homo sapiens
tatttccaaccctttatcctt

SEQ ID NO: 8189821 - DNA, 22 bp, Homo sapiens
tatttccaaaagcctattatga

SEQ ID NO: 8189822 - DNA, 22 bp, Homo sapiens
tatttccaaaagcctattatga

SEQ ID NO: 8189823 - DNA, 22 bp, Homo sapiens
tatttccaagctgaatccaatg

SEQ ID NO: 8189824 - DNA, 22 bp, Homo sapiens
tatttccaccctcagtaaggaa

SEQ ID NO: 8189825 - DNA, 22 bp, Homo sapiens
tatttccacaccttttgaatct

SEQ ID NO: 8189826 - DNA, 22 bp, Homo sapiens
tatttccaccctcagtaaggaa

SEQ ID NO: 8189827 - DNA, 22 bp, Homo sapiens
tatttccacaccttttgaatct

SEQ ID NO: 8189828 - DNA, 22 bp, Homo sapiens
tatttccacaccttttgaatct

SEQ ID NO: 8189829 - DNA, 22 bp, Homo sapiens
cagtaggaaggatgcagaaaaa

SEQ ID NO: 8189830 - DNA, 22 bp, Homo sapiens
cagtagcttacttttcttgatc

SEQ ID NO: 8189831 - DNA, 22 bp, Homo sapiens
cagtagctgtctagccttatgg

SEQ ID NO: 8189832 - DNA, 22 bp, Homo sapiens
cagtagctaaattattttcatg

SEQ ID NO: 8189833 - DNA, 22 bp, Homo sapiens
cagtagtctttttcctcctaga

SEQ ID NO: 8189834 - DNA, 22 bp, Homo sapiens
cagtagggaatgtgggaggctg

SEQ ID NO: 8189835 - DNA, 23 bp, Homo sapiens
cagtataatgtatggatggggca

SEQ ID NO: 8189836 - DNA, 22 bp, Homo sapiens
cagtataatgccccctgtgggg

SEQ ID NO: 8189837 - DNA, 22 bp, Homo sapiens
cagtataagagtgaggaagggc

SEQ ID NO: 8189838 - DNA, 18 bp, Homo sapiens
cagtataaccagcaactc

SEQ ID NO: 8189839 - DNA, 21 bp, Homo sapiens
cagtataacgttgggctcttc

SEQ ID NO: 8189840 - DNA, 22 bp, Homo sapiens
tatttcatctggaacaaggtaa

SEQ ID NO: 8189841 - DNA, 22 bp, Homo sapiens
tatttcattctttatcaggagc

SEQ ID NO: 8189842 - DNA, 22 bp, Homo sapiens
tatttcattctttatcaggagc

SEQ ID NO: 8189843 - DNA, 22 bp, Homo sapiens
tatttccaaaaaggccatattc

SEQ ID NO: 8189844 - DNA, 22 bp, Homo sapiens
caggtttctagttctaagaata

SEQ ID NO: 8189845 - DNA, 21 bp, Homo sapiens
tatttagttttacaaatgtgg

SEQ ID NO: 8189846 - DNA, 22 bp, Homo sapiens
tatttcagtcacttcttctctg

SEQ ID NO: 8189847 - DNA, 22 bp, Homo sapiens
tatttataacagtgagaacggg

SEQ ID NO: 8189848 - DNA, 22 bp, Homo sapiens
caggttctgggtcctgggtcct

SEQ ID NO: 8189849 - DNA, 22 bp, Homo sapiens
caggttctggggctccactgtg

SEQ ID NO: 8189850 - DNA, 22 bp, Homo sapiens
caggttcttgaagccttctggc

SEQ ID NO: 8189851 - DNA, 22 bp, Homo sapiens
caggttcttgtttcaaacagac

SEQ ID NO: 8189852 - DNA, 22 bp, Homo sapiens
caggttcttaagtaacagcaca

SEQ ID NO: 8189853 - DNA, 22 bp, Homo sapiens
caggttctgaggatggtgcctg

SEQ ID NO: 8189854 - DNA, 22 bp, Homo sapiens
caggtttctagttctaagaata

SEQ ID NO: 8189855 - DNA, 22 bp, Homo sapiens
cagggtggccctgtggtctcat

SEQ ID NO: 8189856 - DNA, 22 bp, Homo sapiens
cagggtggccctgtggtctcat

SEQ ID NO: 8189857 - DNA, 22 bp, Homo sapiens
cagggtggccctgtggtctcat

SEQ ID NO: 8189858 - DNA, 22 bp, Homo sapiens
cagggtgggcacccagcctcca

SEQ ID NO: 8189859 - DNA, 22 bp, Homo sapiens
cagggtgggcacccagcctcca

SEQ ID NO: 8189860 - DNA, 22 bp, Homo sapiens
cagggtgggcacccagcctcca

SEQ ID NO: 8189861 - DNA, 22 bp, Homo sapiens
caggtggtcaggcaaggacacg

SEQ ID NO: 8189862 - DNA, 22 bp, Homo sapiens
cagggtggggaaatagcgccct

SEQ ID NO: 8189863 - DNA, 22 bp, Homo sapiens
caggtggtcaggcagatgggct

SEQ ID NO: 8189864 - DNA, 22 bp, Homo sapiens
caggtggtcaggcagatgggct

SEQ ID NO: 8189865 - DNA, 22 bp, Homo sapiens
cagggtggggaaatagcgccct

SEQ ID NO: 8189866 - DNA, 22 bp, Homo sapiens
caggtgttcaagctggaggcca

SEQ ID NO: 8189867 - DNA, 22 bp, Homo sapiens
caggtgttatacatgaaattta

SEQ ID NO: 8189868 - DNA, 22 bp, Homo sapiens
caggtgttaattgttggagcaa

SEQ ID NO: 8189869 - DNA, 22 bp, Homo sapiens
caggtgttaattgttggagcaa

SEQ ID NO: 8189870 - DNA, 22 bp, Homo sapiens
caggtgttaatcacttttaagc

SEQ ID NO: 8189871 - DNA, 22 bp, Homo sapiens
caggtgtgccgggagcagtttg

SEQ ID NO: 8189872 - DNA, 22 bp, Homo sapiens
caggtgtgccgggagcagtttg

SEQ ID NO: 8189873 - DNA, 22 bp, Homo sapiens
caggtgtctaattctcaccccc

SEQ ID NO: 8189874 - DNA, 22 bp, Homo sapiens
caggtggtcaggcagatgggct

SEQ ID NO: 8189875 - DNA, 22 bp, Homo sapiens
caggtggtcaggcagatgggct

SEQ ID NO: 8189876 - DNA, 22 bp, Homo sapiens
caggtgttggaagggcagtggg

SEQ ID NO: 8189877 - DNA, 22 bp, Homo sapiens
caggtgttgatgtttattgagt

SEQ ID NO: 8189878 - DNA, 22 bp, Homo sapiens
caggtgttgcagttgaagactg

SEQ ID NO: 8189879 - DNA, 22 bp, Homo sapiens
caggtgttgcctaaattgacaa

SEQ ID NO: 8189880 - DNA, 22 bp, Homo sapiens
caggtgttcaagctggaggcca

SEQ ID NO: 8189881 - DNA, 22 bp, Homo sapiens
caggtgttctaagccgggcagt

SEQ ID NO: 8189882 - DNA, 22 bp, Homo sapiens
caggtgttctggaaatcagcag

SEQ ID NO: 8189883 - DNA, 17 bp, Homo sapiens
caggtgttctgtttttc

SEQ ID NO: 8189884 - DNA, 22 bp, Homo sapiens
caggtgttgatactaatcgtgg

SEQ ID NO: 8189885 - DNA, 22 bp, Homo sapiens
caggtgttggaagggcagtggg

SEQ ID NO: 8189886 - DNA, 22 bp, Homo sapiens
caggtgttgggagaagagataa

SEQ ID NO: 8189887 - DNA, 22 bp, Homo sapiens
caggtgttgggagaagagataa

SEQ ID NO: 8189888 - DNA, 22 bp, Homo sapiens
caggtgttgtctaaagcttcag

SEQ ID NO: 8189889 - DNA, 22 bp, Homo sapiens
caggtgttgtctaaagcttcag

SEQ ID NO: 8189890 - DNA, 22 bp, Homo sapiens
caggtgtttaggtttcatggat

SEQ ID NO: 8189891 - DNA, 22 bp, Homo sapiens
caggtgtttcaaatgtgaaact

SEQ ID NO: 8189892 - DNA, 22 bp, Homo sapiens
caggtgtttcaatcccaagtca

SEQ ID NO: 8189893 - DNA, 22 bp, Homo sapiens
caggttcagcaggaggcatccc

SEQ ID NO: 8189894 - DNA, 23 bp, Homo sapiens
caggtgttttacatatggtagtt

SEQ ID NO: 8189895 - DNA, 23 bp, Homo sapiens
caggtgttttacatatggtagtt

SEQ ID NO: 8189896 - DNA, 22 bp, Homo sapiens
caggtgttttttattctgaaag

SEQ ID NO: 8189897 - DNA, 22 bp, Homo sapiens
caggtgtttcctgaagttgatg

SEQ ID NO: 8189898 - DNA, 22 bp, Homo sapiens
caggtgtttgtcaattccatcc

SEQ ID NO: 8189899 - DNA, 22 bp, Homo sapiens
caggttccctagcagcaaagcc

SEQ ID NO: 8189900 - DNA, 22 bp, Homo sapiens
caggttcccttgcagctaagtg

SEQ ID NO: 8189901 - DNA, 22 bp, Homo sapiens
cagtgagaaaactaagacatta

SEQ ID NO: 8189902 - DNA, 22 bp, Homo sapiens
cagtgacgtaaactgcatgtgc

SEQ ID NO: 8189903 - DNA, 22 bp, Homo sapiens
cagtgacaggttccatgccgca

SEQ ID NO: 8189904 - DNA, 22 bp, Homo sapiens
cagtgacagcaagcagtgctgg

SEQ ID NO: 8189905 - DNA, 22 bp, Homo sapiens
cagtgacagcaagcagtgctgg

SEQ ID NO: 8189906 - DNA, 22 bp, Homo sapiens
cagtgacacgggctggcccacg

SEQ ID NO: 8189907 - DNA, 22 bp, Homo sapiens
cagtgacctaatattctgccac

SEQ ID NO: 8189908 - DNA, 22 bp, Homo sapiens
cagtgaagtttaaagtgtagat

SEQ ID NO: 8189909 - DNA, 22 bp, Homo sapiens
tcacaagagctggactgtcttt

SEQ ID NO: 8189910 - DNA, 22 bp, Homo sapiens
tcacaagagctggactgtcttt

SEQ ID NO: 8189911 - DNA, 22 bp, Homo sapiens
tcacaagacagaaaacatttag

SEQ ID NO: 8189912 - DNA, 22 bp, Homo sapiens
tcacaagactgagcttgcttga

SEQ ID NO: 8189913 - DNA, 22 bp, Homo sapiens
tcacactttatttatttcatgc

SEQ ID NO: 8189914 - DNA, 22 bp, Homo sapiens
tcacagacctggtgggaggtgg

SEQ ID NO: 8189915 - DNA, 22 bp, Homo sapiens
cagtgaggaagctgtctggacc

SEQ ID NO: 8189916 - DNA, 22 bp, Homo sapiens
cagtgagctcctgtctgtccct

SEQ ID NO: 8189917 - DNA, 22 bp, Homo sapiens
cagtgaggaagctgtctggacc

SEQ ID NO: 8189918 - DNA, 22 bp, Homo sapiens
cagtgaggaagctgtctggacc

SEQ ID NO: 8189919 - DNA, 22 bp, Homo sapiens
cagtgagataccacagagcaaa

SEQ ID NO: 8189920 - DNA, 22 bp, Homo sapiens
cagtgagataccacagagcaaa

SEQ ID NO: 8189921 - DNA, 22 bp, Homo sapiens
cagtgagataccacagagcaaa

SEQ ID NO: 8189922 - DNA, 22 bp, Homo sapiens
cagtgagcacggccagagggga

SEQ ID NO: 8189923 - DNA, 22 bp, Homo sapiens
cagtgagataccacagagcaaa

SEQ ID NO: 8189924 - DNA, 22 bp, Homo sapiens
cagtgagataccacagagcaaa

SEQ ID NO: 8189925 - DNA, 22 bp, Homo sapiens
tcacaagaactttggagggata

SEQ ID NO: 8189926 - DNA, 22 bp, Homo sapiens
tcacaagacagaaaacatttag

SEQ ID NO: 8189927 - DNA, 22 bp, Homo sapiens
tcacaactgggtgtcttcatca

SEQ ID NO: 8189928 - DNA, 21 bp, Homo sapiens
tcacaactttgaatttcaata

SEQ ID NO: 8189929 - DNA, 22 bp, Homo sapiens
tcacaactctttccatttaata

SEQ ID NO: 8189930 - DNA, 22 bp, Homo sapiens
tcacaacaggaaggaccagctg

SEQ ID NO: 8189931 - DNA, 20 bp, Homo sapiens
tcacaactccatcatttccc

SEQ ID NO: 8189932 - DNA, 22 bp, Homo sapiens
tcacaactcacagccaccggtg

SEQ ID NO: 8189933 - DNA, 22 bp, Homo sapiens
tcacaaatcattttatctgtgt

SEQ ID NO: 8189934 - DNA, 22 bp, Homo sapiens
tcacaaatgtttgcatgtgtct

SEQ ID NO: 8189935 - DNA, 22 bp, Homo sapiens
tcacaaatgtctcctgtcctgt

SEQ ID NO: 8189936 - DNA, 22 bp, Homo sapiens
tcacaaatttcagctccctgaa

SEQ ID NO: 8189937 - DNA, 22 bp, Homo sapiens
tcacaaatcattttatctgtgt

SEQ ID NO: 8189938 - DNA, 22 bp, Homo sapiens
tcacaaatattttaacagtagg

SEQ ID NO: 8189939 - DNA, 22 bp, Homo sapiens
tcaatgactggtccaaggtggc

SEQ ID NO: 8189940 - DNA, 22 bp, Homo sapiens
tcaatgactggtccaaggtggc

SEQ ID NO: 8189941 - DNA, 22 bp, Homo sapiens
tatttcttttcgtgacttattg

SEQ ID NO: 8189942 - DNA, 22 bp, Homo sapiens
tatttcttttcgtgacttattg

SEQ ID NO: 8189943 - DNA, 22 bp, Homo sapiens
tatttcttttcgtgacttattg

SEQ ID NO: 8189944 - DNA, 22 bp, Homo sapiens
tatttcttttcgtgacttattg

SEQ ID NO: 8189945 - DNA, 22 bp, Homo sapiens
tatttcttttcgtgacttattg

SEQ ID NO: 8189946 - DNA, 22 bp, Homo sapiens
tatttcttttcgtgacttattg

SEQ ID NO: 8189947 - DNA, 22 bp, Homo sapiens
tatttgaaagtgtacaaaaact

SEQ ID NO: 8189948 - DNA, 22 bp, Homo sapiens
tcacagactgtgttgctactca

SEQ ID NO: 8189949 - DNA, 18 bp, Homo sapiens
tcacagacttactgggcc

SEQ ID NO: 8189950 - DNA, 22 bp, Homo sapiens
tcacagacttgtctccagggat

SEQ ID NO: 8189951 - DNA, 22 bp, Homo sapiens
tcacagagaaaagctatcacaa

SEQ ID NO: 8189952 - DNA, 22 bp, Homo sapiens
tcacagctttcagattgttccc

SEQ ID NO: 8189953 - DNA, 22 bp, Homo sapiens
tcacagctttcagattgttccc

SEQ ID NO: 8189954 - DNA, 22 bp, Homo sapiens
tcacagagaaatgtggcacaaa

SEQ ID NO: 8189955 - DNA, 22 bp, Homo sapiens
tcacagagaaatgtggcacaaa

SEQ ID NO: 8189956 - DNA, 22 bp, Homo sapiens
tcacagagaactataatccatc

SEQ ID NO: 8189957 - DNA, 22 bp, Homo sapiens
tcacaggaggaacctggcctgg

SEQ ID NO: 8189958 - DNA, 22 bp, Homo sapiens
tcacaggaggaacctggcctgg

SEQ ID NO: 8189959 - DNA, 22 bp, Homo sapiens
tcacaggagaatgtacttacca

SEQ ID NO: 8189960 - DNA, 22 bp, Homo sapiens
tcacaggacagccttccacccg

SEQ ID NO: 8189961 - DNA, 22 bp, Homo sapiens
tcacaggaccctgagggtggcg

SEQ ID NO: 8189962 - DNA, 22 bp, Homo sapiens
tcacaggacagccttccacccg

SEQ ID NO: 8189963 - DNA, 22 bp, Homo sapiens
tcacaggaaccatcagagaaat

SEQ ID NO: 8189964 - DNA, 22 bp, Homo sapiens
tcacaggaagaggtgtctatct

SEQ ID NO: 8189965 - DNA, 22 bp, Homo sapiens
tcacagttcatctgataaacta

SEQ ID NO: 8189966 - DNA, 21 bp, Homo sapiens
tcacagttcaagatgaacccc

SEQ ID NO: 8189967 - DNA, 23 bp, Homo sapiens
tcacagttacttttgcatcaacc

SEQ ID NO: 8189968 - DNA, 22 bp, Homo sapiens
cagtgccaagccacagatcact

SEQ ID NO: 8189969 - DNA, 22 bp, Homo sapiens
cagtgcatgaaacaatatgcag

SEQ ID NO: 8189970 - DNA, 22 bp, Homo sapiens
tcacagttactccttcagatga

SEQ ID NO: 8189971 - DNA, 22 bp, Homo sapiens
tcacagttaattgttggaatgt

SEQ ID NO: 8189972 - DNA, 22 bp, Homo sapiens
tcacagtgtggcaactcacaga

SEQ ID NO: 8189973 - DNA, 22 bp, Homo sapiens
tcacagtgtggcaactcacaga

SEQ ID NO: 8189974 - DNA, 22 bp, Homo sapiens
tcacagtgtggcaactcacaga

SEQ ID NO: 8189975 - DNA, 22 bp, Homo sapiens
tcacagtgttggaatcagagct

SEQ ID NO: 8189976 - DNA, 22 bp, Homo sapiens
tcacagtgttaaacctttcttt

SEQ ID NO: 8189977 - DNA, 22 bp, Homo sapiens
tcacagtgttggaatcagagct

SEQ ID NO: 8189978 - DNA, 22 bp, Homo sapiens
tcacagtgttggaatcagagct

SEQ ID NO: 8189979 - DNA, 22 bp, Homo sapiens
tcacaggagggagagacaccca

SEQ ID NO: 8189980 - DNA, 22 bp, Homo sapiens
tcacaggagggagagacaccca

SEQ ID NO: 8189981 - DNA, 22 bp, Homo sapiens
tcacaggagggagagacaccca

SEQ ID NO: 8189982 - DNA, 22 bp, Homo sapiens
tcacagtgtggcaactcacaga

SEQ ID NO: 8189983 - DNA, 22 bp, Homo sapiens
cagtgtttgtggaattcaggtg

SEQ ID NO: 8189984 - DNA, 22 bp, Homo sapiens
cagttaaaatgtgctataagaa

SEQ ID NO: 8189985 - DNA, 22 bp, Homo sapiens
cagttaaaagaagtctatctta

SEQ ID NO: 8189986 - DNA, 22 bp, Homo sapiens
cagttaaaagaagtctatctta

SEQ ID NO: 8189987 - DNA, 23 bp, Homo sapiens
cagtgtgacgaggtgaggcaggc

SEQ ID NO: 8189988 - DNA, 23 bp, Homo sapiens
cagtgtgacaaaacttattactt

SEQ ID NO: 8189989 - DNA, 22 bp, Homo sapiens
cagtgtctttcagactcagaaa

SEQ ID NO: 8189990 - DNA, 22 bp, Homo sapiens
cagtgtctttcagactcagaaa

SEQ ID NO: 8189991 - DNA, 23 bp, Homo sapiens
cagtgtgacgaggtgaggcaggc

SEQ ID NO: 8189992 - DNA, 22 bp, Homo sapiens
cagtgtgcctgaatcaagtgtt

SEQ ID NO: 8189993 - DNA, 22 bp, Homo sapiens
cagtgtgaggaattagtgtcca

SEQ ID NO: 8189994 - DNA, 22 bp, Homo sapiens
cagtgtttccgtcagtatgtga

SEQ ID NO: 8189995 - DNA, 22 bp, Homo sapiens
cagtgtctcccccaggttctgt

SEQ ID NO: 8189996 - DNA, 22 bp, Homo sapiens
cagtgtctgaaataacaccgga

SEQ ID NO: 8189997 - DNA, 22 bp, Homo sapiens
cagtgtctcccccaggttctgt

SEQ ID NO: 8189998 - DNA, 22 bp, Homo sapiens
cagtgtctccagatgctccaat

SEQ ID NO: 8189999 - DNA, 22 bp, Homo sapiens
cagtgtctgcctttctgtttgg

SEQ ID NO: 8190000 - DNA, 22 bp, Homo sapiens
cagtgtctgggacagaaagtca

SEQ ID NO: 8190001 - DNA, 22 bp, Homo sapiens
cagtgtctgggacagaaagtca

SEQ ID NO: 8190002 - DNA, 22 bp, Homo sapiens
cagtgtctggttggctctacgt

SEQ ID NO: 8190003 - DNA, 22 bp, Homo sapiens
cagtgtcttatttgtagctcag

SEQ ID NO: 8190004 - DNA, 22 bp, Homo sapiens
cagtgtctggttggctctacgt

SEQ ID NO: 8190005 - DNA, 18 bp, Homo sapiens
cagtgtcttggtaaaata

SEQ ID NO: 8190006 - DNA, 22 bp, Homo sapiens
cagtgtcttatttgtagctcag

SEQ ID NO: 8190007 - DNA, 22 bp, Homo sapiens
cagtgtctttcagactcagaaa

SEQ ID NO: 8190008 - DNA, 22 bp, Homo sapiens
tcagacttctactttgcagagc

SEQ ID NO: 8190009 - DNA, 21 bp, Homo sapiens
tcagacttgagctcttctaca

SEQ ID NO: 8190010 - DNA, 22 bp, Homo sapiens
tcagacttgcctttttataaaa

SEQ ID NO: 8190011 - DNA, 22 bp, Homo sapiens
tcagagaaaggccaaaatatca

SEQ ID NO: 8190012 - DNA, 22 bp, Homo sapiens
tcagagaaaatggaaactttta

SEQ ID NO: 8190013 - DNA, 22 bp, Homo sapiens
tcagagaaaatggaaactttta

SEQ ID NO: 8190014 - DNA, 22 bp, Homo sapiens
tcagacttttaaagactgaatg

SEQ ID NO: 8190015 - DNA, 22 bp, Homo sapiens
tcagactggattttcacgtttt

SEQ ID NO: 8190016 - DNA, 22 bp, Homo sapiens
tcagactgaaagatacacctct

SEQ ID NO: 8190017 - DNA, 19 bp, Homo sapiens
tcagactgaaagtttagat

SEQ ID NO: 8190018 - DNA, 21 bp, Homo sapiens
tcagagaacccggcaggcaag

SEQ ID NO: 8190019 - DNA, 22 bp, Homo sapiens
cagtgtctcagtttcacttgaa

SEQ ID NO: 8190020 - DNA, 22 bp, Homo sapiens
cagtgtctccagatgctccaat

SEQ ID NO: 8190021 - DNA, 22 bp, Homo sapiens
cagtgtctcagtttcacttgaa

SEQ ID NO: 8190022 - DNA, 22 bp, Homo sapiens
tcagagaaataattgctgagtt

SEQ ID NO: 8190023 - DNA, 22 bp, Homo sapiens
tcagagaaatgaagtagggatt

SEQ ID NO: 8190024 - DNA, 22 bp, Homo sapiens
tcagagaaatgacaatatatag

SEQ ID NO: 8190025 - DNA, 23 bp, Homo sapiens
cagtgggcttctaactgctcctg

SEQ ID NO: 8190026 - DNA, 22 bp, Homo sapiens
cagtggggaggccaggatagaa

SEQ ID NO: 8190027 - DNA, 23 bp, Homo sapiens
cagtgggcttctaactgctcctg

SEQ ID NO: 8190028 - DNA, 22 bp, Homo sapiens
cagtggggaggccaggatagaa

SEQ ID NO: 8190029 - DNA, 22 bp, Homo sapiens
cagtggggaggccaggatagaa

SEQ ID NO: 8190030 - DNA, 22 bp, Homo sapiens
cagtgggggtgaggccgaggta

SEQ ID NO: 8190031 - DNA, 22 bp, Homo sapiens
cagtggggggactgaggcctga

SEQ ID NO: 8190032 - DNA, 22 bp, Homo sapiens
cagtggggggactgaggcctga

SEQ ID NO: 8190033 - DNA, 22 bp, Homo sapiens
cagtgggggtgaggccgaggta

SEQ ID NO: 8190034 - DNA, 22 bp, Homo sapiens
cagtggggtttctgtgggtgct

SEQ ID NO: 8190035 - DNA, 22 bp, Homo sapiens
cagtgggtaaataagtgggtaa

SEQ ID NO: 8190036 - DNA, 22 bp, Homo sapiens
cagtgggtaaataagtgggtaa

SEQ ID NO: 8190037 - DNA, 22 bp, Homo sapiens
cagtgggtaggaaaggctcttc

SEQ ID NO: 8190038 - DNA, 22 bp, Homo sapiens
cagtgggtaggaaaggctcttc

SEQ ID NO: 8190039 - DNA, 22 bp, Homo sapiens
cagtgggtagtggggattagca

SEQ ID NO: 8190040 - DNA, 22 bp, Homo sapiens
cagtgggtcctgcgtctgccag

SEQ ID NO: 8190041 - DNA, 22 bp, Homo sapiens
cagtgggtagtggggattagca

SEQ ID NO: 8190042 - DNA, 22 bp, Homo sapiens
cagtgggtcctaagtacagttc

SEQ ID NO: 8190043 - DNA, 22 bp, Homo sapiens
cagtgggtatttactgattcct

SEQ ID NO: 8190044 - DNA, 22 bp, Homo sapiens
cagtgggtcctaagtacagttc

SEQ ID NO: 8190045 - DNA, 22 bp, Homo sapiens
cagtgggctgtgatggattcac

SEQ ID NO: 8190046 - DNA, 22 bp, Homo sapiens
cagtgggacatgggcactgggc

SEQ ID NO: 8190047 - DNA, 22 bp, Homo sapiens
cagtgggatatgggggcagcat

SEQ ID NO: 8190048 - DNA, 22 bp, Homo sapiens
cagtgggaatgaagtggaggcc

SEQ ID NO: 8190049 - DNA, 22 bp, Homo sapiens
cagtgccaggagacaagatcag

SEQ ID NO: 8190050 - DNA, 22 bp, Homo sapiens
cagtgccagtggatgaactgtt

SEQ ID NO: 8190051 - DNA, 22 bp, Homo sapiens
cagtgccatattgaaagacatt

SEQ ID NO: 8190052 - DNA, 22 bp, Homo sapiens
cagtgccatgatgcagagcaat

SEQ ID NO: 8190053 - DNA, 22 bp, Homo sapiens
cagtgcccaagatgtgccatgc

SEQ ID NO: 8190054 - DNA, 22 bp, Homo sapiens
cagtggcaggggaagcaggtgt

SEQ ID NO: 8190055 - DNA, 23 bp, Homo sapiens
cagtgccatttgtcttgcctatg

SEQ ID NO: 8190056 - DNA, 22 bp, Homo sapiens
cagtgccatgatgcagagcaat

SEQ ID NO: 8190057 - DNA, 22 bp, Homo sapiens
cagtgccatgtctgagccccta

SEQ ID NO: 8190058 - DNA, 22 bp, Homo sapiens
cagtgccatgtctgagccccta

SEQ ID NO: 8190059 - DNA, 22 bp, Homo sapiens
cagtgccaaggctcttggtctg

SEQ ID NO: 8190060 - DNA, 22 bp, Homo sapiens
cagtgccaaggatggcctggga

SEQ ID NO: 8190061 - DNA, 22 bp, Homo sapiens
cagtgccaaggagaaggacagc

SEQ ID NO: 8190062 - DNA, 22 bp, Homo sapiens
cagtgccacaggaatggccaat

SEQ ID NO: 8190063 - DNA, 22 bp, Homo sapiens
cagtgccacttaatgaggctgc

SEQ ID NO: 8190064 - DNA, 21 bp, Homo sapiens
cagtgccagccacaggacgcc

SEQ ID NO: 8190065 - DNA, 22 bp, Homo sapiens
cagtgccagctgcttggcctac

SEQ ID NO: 8190066 - DNA, 21 bp, Homo sapiens
cagtgccagccacaggacgcc

SEQ ID NO: 8190067 - DNA, 22 bp, Homo sapiens
cagtgccagaggtactagtgga

SEQ ID NO: 8190068 - DNA, 22 bp, Homo sapiens
cagtgccacttaatgaggctgc

SEQ ID NO: 8190069 - DNA, 22 bp, Homo sapiens
cagtggcttctcatgtcattca

SEQ ID NO: 8190070 - DNA, 22 bp, Homo sapiens
cagtggcttcttcctagagcca

SEQ ID NO: 8190071 - DNA, 22 bp, Homo sapiens
cagtggcttcttcctagagcca

SEQ ID NO: 8190072 - DNA, 22 bp, Homo sapiens
cagtggcttacaatgaactaga

SEQ ID NO: 8190073 - DNA, 22 bp, Homo sapiens
cagtggctgtttctggaaggca

SEQ ID NO: 8190074 - DNA, 22 bp, Homo sapiens
cagtggctgtttctggaaggca

SEQ ID NO: 8190075 - DNA, 22 bp, Homo sapiens
cagtggctgtttctggaaggca

SEQ ID NO: 8190076 - DNA, 21 bp, Homo sapiens
cagtggcagttcttgcctctg

SEQ ID NO: 8190077 - DNA, 22 bp, Homo sapiens
cagtggcagttagaaaatattc

SEQ ID NO: 8190078 - DNA, 22 bp, Homo sapiens
cagtggcaggggaagcaggtgt

SEQ ID NO: 8190079 - DNA, 22 bp, Homo sapiens
cagtggctgtgaccagggacct

SEQ ID NO: 8190080 - DNA, 22 bp, Homo sapiens
cagtggctgtgaccagggacct

SEQ ID NO: 8190081 - DNA, 22 bp, Homo sapiens
cagtggctggttagggacagga

SEQ ID NO: 8190082 - DNA, 22 bp, Homo sapiens
cagtggctggttagggacagga

SEQ ID NO: 8190083 - DNA, 22 bp, Homo sapiens
tcagctttgggggtctcaggag

SEQ ID NO: 8190084 - DNA, 22 bp, Homo sapiens
tcagctttgccaccagctgtaa

SEQ ID NO: 8190085 - DNA, 22 bp, Homo sapiens
tcagctttgccaccagctgtaa

SEQ ID NO: 8190086 - DNA, 22 bp, Homo sapiens
tcagctttgccaccagctgtaa

SEQ ID NO: 8190087 - DNA, 22 bp, Homo sapiens
tcagctttgcaagttagaaaat

SEQ ID NO: 8190088 - DNA, 22 bp, Homo sapiens
tcagctttgcaagttagaaaat

SEQ ID NO: 8190089 - DNA, 22 bp, Homo sapiens
tcagctttggtcacattgagtt

SEQ ID NO: 8190090 - DNA, 22 bp, Homo sapiens
tcagcttttaaaaacaagaagt

SEQ ID NO: 8190091 - DNA, 22 bp, Homo sapiens
tcagctttggtcacattgagtt

SEQ ID NO: 8190092 - DNA, 22 bp, Homo sapiens
tcagctttggtcacattgagtt

SEQ ID NO: 8190093 - DNA, 22 bp, Homo sapiens
tcagcttttaaaaacaagaagt

SEQ ID NO: 8190094 - DNA, 22 bp, Homo sapiens
tcagcttttaaaaacaagaagt

SEQ ID NO: 8190095 - DNA, 21 bp, Homo sapiens
tcagctttgcaactgcacatc

SEQ ID NO: 8190096 - DNA, 22 bp, Homo sapiens
tcagctttgatctcaggcaatc

SEQ ID NO: 8190097 - DNA, 22 bp, Homo sapiens
tcagctttgatctcaggcaatc

SEQ ID NO: 8190098 - DNA, 22 bp, Homo sapiens
tcagctttgatctcaggcaatc

SEQ ID NO: 8190099 - DNA, 22 bp, Homo sapiens
cagtttatatataagcacattg

SEQ ID NO: 8190100 - DNA, 22 bp, Homo sapiens
cagtttatatataagcacattg

SEQ ID NO: 8190101 - DNA, 22 bp, Homo sapiens
tcagctgccccagtggccccag

SEQ ID NO: 8190102 - DNA, 22 bp, Homo sapiens
tcagctgccccagtggccccag

SEQ ID NO: 8190103 - DNA, 22 bp, Homo sapiens
tcagctgccccagtggccccag

SEQ ID NO: 8190104 - DNA, 22 bp, Homo sapiens
tcagctttctcttctatcgata

SEQ ID NO: 8190105 - DNA, 22 bp, Homo sapiens
cagtttagcaaatttgtatcaa

SEQ ID NO: 8190106 - DNA, 21 bp, Homo sapiens
cagtttaataacaaagaagga

SEQ ID NO: 8190107 - DNA, 22 bp, Homo sapiens
cagtttaagtagaactgagaat

SEQ ID NO: 8190108 - DNA, 22 bp, Homo sapiens
cagtttatagttgttatgtgtg

SEQ ID NO: 8190109 - DNA, 22 bp, Homo sapiens
cagtttatagttgttatgtgtg

SEQ ID NO: 8190110 - DNA, 22 bp, Homo sapiens
cagtttatatataagcacattg

SEQ ID NO: 8190111 - DNA, 22 bp, Homo sapiens
cagtttatatataagcacattg

SEQ ID NO: 8190112 - DNA, 22 bp, Homo sapiens
cagtttatatataagcacattg

SEQ ID NO: 8190113 - DNA, 22 bp, Homo sapiens
cagtttatagctctagcagctt

SEQ ID NO: 8190114 - DNA, 22 bp, Homo sapiens
cagtttatagctctagcagctt

SEQ ID NO: 8190115 - DNA, 22 bp, Homo sapiens
cagtttatagctctagcagctt

SEQ ID NO: 8190116 - DNA, 22 bp, Homo sapiens
cagtttatagctctagcagctt

SEQ ID NO: 8190117 - DNA, 22 bp, Homo sapiens
cagtttatagctctagcagctt

SEQ ID NO: 8190118 - DNA, 22 bp, Homo sapiens
cagtttatagttgttatgtgtg

SEQ ID NO: 8190119 - DNA, 22 bp, Homo sapiens
cagtttatagttgttatgtgtg

SEQ ID NO: 8190120 - DNA, 22 bp, Homo sapiens
cagtttatagttgttatgtgtg

SEQ ID NO: 8190121 - DNA, 22 bp, Homo sapiens
tcagctttttggattgcccaag

SEQ ID NO: 8190122 - DNA, 22 bp, Homo sapiens
tcagcttttgtcagaaattgta

SEQ ID NO: 8190123 - DNA, 22 bp, Homo sapiens
tcagcttttgtcagaaattgta

SEQ ID NO: 8190124 - DNA, 18 bp, Homo sapiens
tcagcttttgaaaaccaa

SEQ ID NO: 8190125 - DNA, 18 bp, Homo sapiens
tcagcttttgaaaaccaa

SEQ ID NO: 8190126 - DNA, 22 bp, Homo sapiens
tcagctttttacatgtgaaata

SEQ ID NO: 8190127 - DNA, 22 bp, Homo sapiens
tcagctttttacatgtgaaata

SEQ ID NO: 8190128 - DNA, 22 bp, Homo sapiens
cataaaatggcttgttctttaa

SEQ ID NO: 8190129 - DNA, 22 bp, Homo sapiens
cataaaatggcttgttctttaa

SEQ ID NO: 8190130 - DNA, 22 bp, Homo sapiens
cataaactcttgagattcttgt

SEQ ID NO: 8190131 - DNA, 22 bp, Homo sapiens
cataaaatggcttgttctttaa

SEQ ID NO: 8190132 - DNA, 22 bp, Homo sapiens
cataaaatggcttgttctttaa

SEQ ID NO: 8190133 - DNA, 22 bp, Homo sapiens
cataaagtagcagagcatgact

SEQ ID NO: 8190134 - DNA, 19 bp, Homo sapiens
cataaatgtacaagataca

SEQ ID NO: 8190135 - DNA, 19 bp, Homo sapiens
cataaatgtacaagataca

SEQ ID NO: 8190136 - DNA, 22 bp, Homo sapiens
cataaattgtacccattccaac

SEQ ID NO: 8190137 - DNA, 22 bp, Homo sapiens
cataaattcagttctgcctctt

SEQ ID NO: 8190138 - DNA, 22 bp, Homo sapiens
tcagcagcagctcagcatgttt

SEQ ID NO: 8190139 - DNA, 21 bp, Homo sapiens
tcagcagcatctgcctagagt

SEQ ID NO: 8190140 - DNA, 21 bp, Homo sapiens
tcagcagcatctgcctagagt

SEQ ID NO: 8190141 - DNA, 21 bp, Homo sapiens
tcagcagcatctgcctagagt

SEQ ID NO: 8190142 - DNA, 22 bp, Homo sapiens
tcagcagcagctcagcatgttt

SEQ ID NO: 8190143 - DNA, 22 bp, Homo sapiens
tcagcagcagctcagcatgttt

SEQ ID NO: 8190144 - DNA, 19 bp, Homo sapiens
tcagcagcactgtgatttc

SEQ ID NO: 8190145 - DNA, 19 bp, Homo sapiens
tcagcagcactgtgatttc

SEQ ID NO: 8190146 - DNA, 22 bp, Homo sapiens
tcagcagccgcagctgactcag

SEQ ID NO: 8190147 - DNA, 19 bp, Homo sapiens
cagtttaactaattttatc

SEQ ID NO: 8190148 - DNA, 22 bp, Homo sapiens
tcagcagaggagtgtcttgccc

SEQ ID NO: 8190149 - DNA, 22 bp, Homo sapiens
tcagcagactaggcagattact

SEQ ID NO: 8190150 - DNA, 22 bp, Homo sapiens
tcagcagactaggcagattact

SEQ ID NO: 8190151 - DNA, 22 bp, Homo sapiens
tcagcagacattattttctggc

SEQ ID NO: 8190152 - DNA, 22 bp, Homo sapiens
tcagcagacattattttctggc

SEQ ID NO: 8190153 - DNA, 22 bp, Homo sapiens
tcagcagacctgttatttggat

SEQ ID NO: 8190154 - DNA, 22 bp, Homo sapiens
tcagcagaggggaaggcatctg

SEQ ID NO: 8190155 - DNA, 22 bp, Homo sapiens
tcagcagaggggaaggcatctg

SEQ ID NO: 8190156 - DNA, 22 bp, Homo sapiens
tcagcagaggggaaggcatctg

SEQ ID NO: 8190157 - DNA, 22 bp, Homo sapiens
tcagcagagtttcatcttggga

SEQ ID NO: 8190158 - DNA, 22 bp, Homo sapiens
tcagcagatgggttgtgttggc

SEQ ID NO: 8190159 - DNA, 22 bp, Homo sapiens
cagttacataaatgataaaatg

SEQ ID NO: 8190160 - DNA, 22 bp, Homo sapiens
cagttacagctgcaccagagcc

SEQ ID NO: 8190161 - DNA, 22 bp, Homo sapiens
tcagatgcctgtggggtctagg

SEQ ID NO: 8190162 - DNA, 22 bp, Homo sapiens
tcagatgctaaagatggaatta

SEQ ID NO: 8190163 - DNA, 22 bp, Homo sapiens
cagttacatgctcatgtcatca

SEQ ID NO: 8190164 - DNA, 22 bp, Homo sapiens
cagttaacttcatatgatcatt

SEQ ID NO: 8190165 - DNA, 22 bp, Homo sapiens
cagttaaatttggctgttttct

SEQ ID NO: 8190166 - DNA, 22 bp, Homo sapiens
cagttaaacgggccatgtgagt

SEQ ID NO: 8190167 - DNA, 22 bp, Homo sapiens
cagttaaacgggccatgtgagt

SEQ ID NO: 8190168 - DNA, 22 bp, Homo sapiens
cagttaaagctgcatgtgtcag

SEQ ID NO: 8190169 - DNA, 22 bp, Homo sapiens
cagttaaaggcccaatatctgg

SEQ ID NO: 8190170 - DNA, 22 bp, Homo sapiens
cagttaaagctgcatgtgtcag

SEQ ID NO: 8190171 - DNA, 22 bp, Homo sapiens
cagttaaagtgcttatcacaga

SEQ ID NO: 8190172 - DNA, 22 bp, Homo sapiens
cagggcagccaggccccgtggg

SEQ ID NO: 8190173 - DNA, 22 bp, Homo sapiens
cagggcagccaggccccgtggg

SEQ ID NO: 8190174 - DNA, 22 bp, Homo sapiens
cagggcagcttcctttgttagg

SEQ ID NO: 8190175 - DNA, 22 bp, Homo sapiens
cagggcaggaatttgacattgc

SEQ ID NO: 8190176 - DNA, 22 bp, Homo sapiens
cagggcaggaatttgacattgc

SEQ ID NO: 8190177 - DNA, 22 bp, Homo sapiens
cagggcagcttcctttgttagg

SEQ ID NO: 8190178 - DNA, 22 bp, Homo sapiens
cagggcagccaggccccgtggg

SEQ ID NO: 8190179 - DNA, 22 bp, Homo sapiens
cagggcagagggaaactccttt

SEQ ID NO: 8190180 - DNA, 22 bp, Homo sapiens
cagggcagagccaggatttcaa

SEQ ID NO: 8190181 - DNA, 22 bp, Homo sapiens
cagggcagagccaggatttcaa

SEQ ID NO: 8190182 - DNA, 22 bp, Homo sapiens
cagggcagagggaaactccttt

SEQ ID NO: 8190183 - DNA, 22 bp, Homo sapiens
cagggcagagggaaactccttt

SEQ ID NO: 8190184 - DNA, 22 bp, Homo sapiens
cagggcagccaggccccgtggg

SEQ ID NO: 8190185 - DNA, 22 bp, Homo sapiens
cagggcagagggaaactccttt

SEQ ID NO: 8190186 - DNA, 22 bp, Homo sapiens
tagctacatttatacactgtag

SEQ ID NO: 8190187 - DNA, 22 bp, Homo sapiens
tagctattgttggtagttaccc

SEQ ID NO: 8190188 - DNA, 22 bp, Homo sapiens
tagctatttagcccagataagt

SEQ ID NO: 8190189 - DNA, 22 bp, Homo sapiens
tagctattgttggtagttaccc

SEQ ID NO: 8190190 - DNA, 22 bp, Homo sapiens
tagctatttggaaaattccaat

SEQ ID NO: 8190191 - DNA, 22 bp, Homo sapiens
tagctatttgagcatattccag

SEQ ID NO: 8190192 - DNA, 22 bp, Homo sapiens
tagctatttggaaaattccaat

SEQ ID NO: 8190193 - DNA, 22 bp, Homo sapiens
tagctcagcaggtgggacaggt

SEQ ID NO: 8190194 - DNA, 22 bp, Homo sapiens
tagctatttggaaaattccaat

SEQ ID NO: 8190195 - DNA, 22 bp, Homo sapiens
tagctattttgcttggaaatac

SEQ ID NO: 8190196 - DNA, 22 bp, Homo sapiens
tagctattttgcttggaaatac

SEQ ID NO: 8190197 - DNA, 22 bp, Homo sapiens
tagctcctacaagtacagcaaa

SEQ ID NO: 8190198 - DNA, 22 bp, Homo sapiens
tagctcagcaggtgggacaggt

SEQ ID NO: 8190199 - DNA, 22 bp, Homo sapiens
tagctcctccccatccaggttc

SEQ ID NO: 8190200 - DNA, 22 bp, Homo sapiens
tagctcctggctgcagggcctc

SEQ ID NO: 8190201 - DNA, 22 bp, Homo sapiens
tagctcctggctgcagggcctc

SEQ ID NO: 8190202 - DNA, 22 bp, Homo sapiens
taggaaatttgaaatatgtggg

SEQ ID NO: 8190203 - DNA, 22 bp, Homo sapiens
taggaaatttgaaatatgtggg

SEQ ID NO: 8190204 - DNA, 22 bp, Homo sapiens
taggaaatttgaaatatgtggg

SEQ ID NO: 8190205 - DNA, 22 bp, Homo sapiens
taggaaattttactggtctggg

SEQ ID NO: 8190206 - DNA, 22 bp, Homo sapiens
taggaaattggaaactcttcac

SEQ ID NO: 8190207 - DNA, 22 bp, Homo sapiens
taggaaatttatagaggtgttt

SEQ ID NO: 8190208 - DNA, 22 bp, Homo sapiens
taggaacacatcctcctctagc

SEQ ID NO: 8190209 - DNA, 22 bp, Homo sapiens
taggaaattgccaatatatgac

SEQ ID NO: 8190210 - DNA, 22 bp, Homo sapiens
taggaaattgccaatatatgac

SEQ ID NO: 8190211 - DNA, 22 bp, Homo sapiens
taggaaattgccaatatatgac

SEQ ID NO: 8190212 - DNA, 22 bp, Homo sapiens
taggaaattgacacctgcttga

SEQ ID NO: 8190213 - DNA, 22 bp, Homo sapiens
taggaaattaagtctcttttgt

SEQ ID NO: 8190214 - DNA, 22 bp, Homo sapiens
taggaaattctcttgctaagtt

SEQ ID NO: 8190215 - DNA, 22 bp, Homo sapiens
cagggcaggaatttgacattgc

SEQ ID NO: 8190216 - DNA, 22 bp, Homo sapiens
cagggcagcttcctttgttagg

SEQ ID NO: 8190217 - DNA, 22 bp, Homo sapiens
cagggcaggaatttgacattgc

SEQ ID NO: 8190218 - DNA, 22 bp, Homo sapiens
cagggcaggaatttgacattgc

SEQ ID NO: 8190219 - DNA, 22 bp, Homo sapiens
tagctttaataagctgctgaat

SEQ ID NO: 8190220 - DNA, 22 bp, Homo sapiens
tagctttaagacatggtgaatg

SEQ ID NO: 8190221 - DNA, 22 bp, Homo sapiens
tagctttaagatgagatgtgga

SEQ ID NO: 8190222 - DNA, 21 bp, Homo sapiens
cagggctagagagaatgacaa

SEQ ID NO: 8190223 - DNA, 22 bp, Homo sapiens
cagggccttttagcatcttctc

SEQ ID NO: 8190224 - DNA, 22 bp, Homo sapiens
cagggccttttagcatcttctc

SEQ ID NO: 8190225 - DNA, 22 bp, Homo sapiens
cagggccttttagcatcttctc

SEQ ID NO: 8190226 - DNA, 22 bp, Homo sapiens
cagggccttgttcaggagtgaa

SEQ ID NO: 8190227 - DNA, 22 bp, Homo sapiens
cagggccttgttcaggagtgaa

SEQ ID NO: 8190228 - DNA, 22 bp, Homo sapiens
cagggccttgttcaggagtgaa

SEQ ID NO: 8190229 - DNA, 22 bp, Homo sapiens
cagggccttgttcaggagtgaa

SEQ ID NO: 8190230 - DNA, 22 bp, Homo sapiens
cagggcctttcagggtaaaagg

SEQ ID NO: 8190231 - DNA, 22 bp, Homo sapiens
cagggcctgtcacgacgctcat

SEQ ID NO: 8190232 - DNA, 22 bp, Homo sapiens
cagggcctgtcacgacgctcat

SEQ ID NO: 8190233 - DNA, 22 bp, Homo sapiens
cagggcctgtcacgacgctcat

SEQ ID NO: 8190234 - DNA, 22 bp, Homo sapiens
cagggcctgtacaagtcccacc

SEQ ID NO: 8190235 - DNA, 22 bp, Homo sapiens
cagggccttcgtaagtgtccgg

SEQ ID NO: 8190236 - DNA, 22 bp, Homo sapiens
cagggccttcgtaagtgtccgg

SEQ ID NO: 8190237 - DNA, 22 bp, Homo sapiens
cagggccttatcctgccattga

SEQ ID NO: 8190238 - DNA, 22 bp, Homo sapiens
cagggccttcgtaagtgtccgg

SEQ ID NO: 8190239 - DNA, 22 bp, Homo sapiens
cagggccttatcctgccattga

SEQ ID NO: 8190240 - DNA, 22 bp, Homo sapiens
cagggctcagaagacagacctc

SEQ ID NO: 8190241 - DNA, 22 bp, Homo sapiens
cagggctcactcggctggcgtc

SEQ ID NO: 8190242 - DNA, 22 bp, Homo sapiens
cagggctcactcggctggcgtc

SEQ ID NO: 8190243 - DNA, 22 bp, Homo sapiens
cagggctcaggaaatcagacgt

SEQ ID NO: 8190244 - DNA, 22 bp, Homo sapiens
cagggctcagaagacagacctc

SEQ ID NO: 8190245 - DNA, 22 bp, Homo sapiens
cagggctcactcggctggcgtc

SEQ ID NO: 8190246 - DNA, 22 bp, Homo sapiens
cagggctcagggactgcagaaa

SEQ ID NO: 8190247 - DNA, 22 bp, Homo sapiens
cagggctcagggactgcagaaa

SEQ ID NO: 8190248 - DNA, 22 bp, Homo sapiens
cagggctcagggactgcagaaa

SEQ ID NO: 8190249 - DNA, 22 bp, Homo sapiens
cagggctcagggactgcagaaa

SEQ ID NO: 8190250 - DNA, 22 bp, Homo sapiens
cagggctcagggactgcagaaa

SEQ ID NO: 8190251 - DNA, 22 bp, Homo sapiens
cagggctcagggactgcagaaa

SEQ ID NO: 8190252 - DNA, 22 bp, Homo sapiens
cagggctcaggctctgggattc

SEQ ID NO: 8190253 - DNA, 22 bp, Homo sapiens
cagggctcaggaaatcagacgt

SEQ ID NO: 8190254 - DNA, 22 bp, Homo sapiens
cagggctcaggaaatcagacgt

SEQ ID NO: 8190255 - DNA, 22 bp, Homo sapiens
cagggcctggagctgggcctgc

SEQ ID NO: 8190256 - DNA, 22 bp, Homo sapiens
cagggcctggagctgggcctgc

SEQ ID NO: 8190257 - DNA, 22 bp, Homo sapiens
cagggcctggagctgggcctgc

SEQ ID NO: 8190258 - DNA, 22 bp, Homo sapiens
cagggcctggagctgggcctgc

SEQ ID NO: 8190259 - DNA, 22 bp, Homo sapiens
cagggcctggagctgggcctgc

SEQ ID NO: 8190260 - DNA, 22 bp, Homo sapiens
cagggcctgcttccttcttgtt

SEQ ID NO: 8190261 - DNA, 22 bp, Homo sapiens
cagggcctgcttccttcttgtt

SEQ ID NO: 8190262 - DNA, 22 bp, Homo sapiens
cagggcctgcttccttcttgtt

SEQ ID NO: 8190263 - DNA, 22 bp, Homo sapiens
cagggcctgcctggttcctgga

SEQ ID NO: 8190264 - DNA, 22 bp, Homo sapiens
cagggcctgcttccttcttgtt

SEQ ID NO: 8190265 - DNA, 22 bp, Homo sapiens
taggaggagggcatttgaagta

SEQ ID NO: 8190266 - DNA, 22 bp, Homo sapiens
cagggcctcattgtcagtcctg

SEQ ID NO: 8190267 - DNA, 22 bp, Homo sapiens
cagggcctcattgtcagtcctg

SEQ ID NO: 8190268 - DNA, 22 bp, Homo sapiens
cagggcctccccggcagtcttt

SEQ ID NO: 8190269 - DNA, 22 bp, Homo sapiens
cagggcctcattgtcagtcctg

SEQ ID NO: 8190270 - DNA, 22 bp, Homo sapiens
taggagctataatgtgaagtct

SEQ ID NO: 8190271 - DNA, 22 bp, Homo sapiens
taggagctgagacatctttaaa

SEQ ID NO: 8190272 - DNA, 23 bp, Homo sapiens
taggaggagaccgcagtgttacc

SEQ ID NO: 8190273 - DNA, 22 bp, Homo sapiens
taggaggaactttttgtttgga

SEQ ID NO: 8190274 - DNA, 19 bp, Homo sapiens
taggaccctggtggccccc

SEQ ID NO: 8190275 - DNA, 19 bp, Homo sapiens
taggaccctggtggccccc

SEQ ID NO: 8190276 - DNA, 22 bp, Homo sapiens
taggacttggtgactctcaatg

SEQ ID NO: 8190277 - DNA, 22 bp, Homo sapiens
taggagagctgaactattgtct

SEQ ID NO: 8190278 - DNA, 22 bp, Homo sapiens
taggagatagtttttacctggc

SEQ ID NO: 8190279 - DNA, 20 bp, Homo sapiens
taggagcaatgagagtagaa

SEQ ID NO: 8190280 - DNA, 22 bp, Homo sapiens
taggagacattgatcccaagaa

SEQ ID NO: 8190281 - DNA, 17 bp, Homo sapiens
taggagactggctgtcc

SEQ ID NO: 8190282 - DNA, 22 bp, Homo sapiens
taggagaagagtcagggcctaa

SEQ ID NO: 8190283 - DNA, 22 bp, Homo sapiens
taggactttggcgtcagaactg

SEQ ID NO: 8190284 - DNA, 22 bp, Homo sapiens
tatatttaaatccaggttgaaa

SEQ ID NO: 8190285 - DNA, 22 bp, Homo sapiens
tatatttaaatccaggttgaaa

SEQ ID NO: 8190286 - DNA, 22 bp, Homo sapiens
tatatttaaatccaggttgaaa

SEQ ID NO: 8190287 - DNA, 22 bp, Homo sapiens
tatcaggagttgacagttgcta

SEQ ID NO: 8190288 - DNA, 22 bp, Homo sapiens
tagtgattcgatgtgggtaagt

SEQ ID NO: 8190289 - DNA, 22 bp, Homo sapiens
tagtgataatgtttatgctttt

SEQ ID NO: 8190290 - DNA, 22 bp, Homo sapiens
tagtgattcctgttgccctgga

SEQ ID NO: 8190291 - DNA, 22 bp, Homo sapiens
tagtgattccctatcaaccctg

SEQ ID NO: 8190292 - DNA, 22 bp, Homo sapiens
tagtgattccaatgtgaagtgg

SEQ ID NO: 8190293 - DNA, 22 bp, Homo sapiens
tagtgattaaaggcagaatgtt

SEQ ID NO: 8190294 - DNA, 22 bp, Homo sapiens
tagtgattataaaacagttttt

SEQ ID NO: 8190295 - DNA, 22 bp, Homo sapiens
tagtgaaatgataacagagcag

SEQ ID NO: 8190296 - DNA, 22 bp, Homo sapiens
tagtgaaagtattaaacagctg

SEQ ID NO: 8190297 - DNA, 22 bp, Homo sapiens
tagtgaaagtcaaagacagcta

SEQ ID NO: 8190298 - DNA, 22 bp, Homo sapiens
tagtgaaatatgtgctgatagc

SEQ ID NO: 8190299 - DNA, 22 bp, Homo sapiens
tagtgaaatatgtgctgatagc

SEQ ID NO: 8190300 - DNA, 22 bp, Homo sapiens
caggggagtgagtccctctctg

SEQ ID NO: 8190301 - DNA, 22 bp, Homo sapiens
caggggagttttatgcaacaga

SEQ ID NO: 8190302 - DNA, 22 bp, Homo sapiens
caggggcaagaatgctgtcagc

SEQ ID NO: 8190303 - DNA, 22 bp, Homo sapiens
caggggcaagaatgctgtcagc

SEQ ID NO: 8190304 - DNA, 22 bp, Homo sapiens
tagtctggacttcttagtgtca

SEQ ID NO: 8190305 - DNA, 22 bp, Homo sapiens
tagtcttaagtaattcatggaa

SEQ ID NO: 8190306 - DNA, 22 bp, Homo sapiens
tagtctcttatcaggcacacac

SEQ ID NO: 8190307 - DNA, 22 bp, Homo sapiens
tagtgaaacagttatcaatctg

SEQ ID NO: 8190308 - DNA, 22 bp, Homo sapiens
tagtgaaacctgacagatcatg

SEQ ID NO: 8190309 - DNA, 22 bp, Homo sapiens
tagtgaaacctgacagatcatg

SEQ ID NO: 8190310 - DNA, 22 bp, Homo sapiens
tatcatttaacagaatcattgc

SEQ ID NO: 8190311 - DNA, 22 bp, Homo sapiens
cagggtggcactcagcgcatct

SEQ ID NO: 8190312 - DNA, 22 bp, Homo sapiens
tatcatttaacagaatcattgc

SEQ ID NO: 8190313 - DNA, 22 bp, Homo sapiens
tatcatgtgcgcttattgattt

SEQ ID NO: 8190314 - DNA, 22 bp, Homo sapiens
tatcatttaacagaatcattgc

SEQ ID NO: 8190315 - DNA, 22 bp, Homo sapiens
cagggtggcactcagcgcatct

SEQ ID NO: 8190316 - DNA, 22 bp, Homo sapiens
cagggtggcaggcaccatggcc

SEQ ID NO: 8190317 - DNA, 22 bp, Homo sapiens
cagggtggcaggcaccatggcc

SEQ ID NO: 8190318 - DNA, 22 bp, Homo sapiens
cagggtggcaggcaccatggcc

SEQ ID NO: 8190319 - DNA, 22 bp, Homo sapiens
cagggtggccaggtagataata

SEQ ID NO: 8190320 - DNA, 22 bp, Homo sapiens
cagggtggccaggtagataata

SEQ ID NO: 8190321 - DNA, 22 bp, Homo sapiens
tatcagtccagggttttgtgac

SEQ ID NO: 8190322 - DNA, 22 bp, Homo sapiens
tatcagtagaacaatggacatt

SEQ ID NO: 8190323 - DNA, 22 bp, Homo sapiens
tatcagtgtgcatctctgaatg

SEQ ID NO: 8190324 - DNA, 22 bp, Homo sapiens
tatcagtttaaaatctgtgaat

SEQ ID NO: 8190325 - DNA, 22 bp, Homo sapiens
tatcatgctaagattgattctt

SEQ ID NO: 8190326 - DNA, 22 bp, Homo sapiens
tatcatctgcaaagcacatcta

SEQ ID NO: 8190327 - DNA, 22 bp, Homo sapiens
tatcatcagttcaggtattgat

SEQ ID NO: 8190328 - DNA, 22 bp, Homo sapiens
tatcatcactgtaatccgttga

SEQ ID NO: 8190329 - DNA, 22 bp, Homo sapiens
tatcatctgcaaagcacatcta

SEQ ID NO: 8190330 - DNA, 22 bp, Homo sapiens
tatcatcattggcaggtgagaa

SEQ ID NO: 8190331 - DNA, 22 bp, Homo sapiens
tatcataagttaattaaacagt

SEQ ID NO: 8190332 - DNA, 22 bp, Homo sapiens
tatcataagttaattaaacagt

SEQ ID NO: 8190333 - DNA, 22 bp, Homo sapiens
tatcatcacattacctcttggg

SEQ ID NO: 8190334 - DNA, 22 bp, Homo sapiens
tagggtgggcagttcttgggga

SEQ ID NO: 8190335 - DNA, 22 bp, Homo sapiens
tagggtggagactggaagcagg

SEQ ID NO: 8190336 - DNA, 22 bp, Homo sapiens
tagggtggagactggaagcagg

SEQ ID NO: 8190337 - DNA, 22 bp, Homo sapiens
taggtacaaggagggattcttg

SEQ ID NO: 8190338 - DNA, 22 bp, Homo sapiens
tagggtggttagaaggagtatg

SEQ ID NO: 8190339 - DNA, 22 bp, Homo sapiens
tagggtggttagaaggagtatg

SEQ ID NO: 8190340 - DNA, 22 bp, Homo sapiens
tagggtggttagaaggagtatg

SEQ ID NO: 8190341 - DNA, 22 bp, Homo sapiens
taggtacatggaattggacatt

SEQ ID NO: 8190342 - DNA, 22 bp, Homo sapiens
taggtacagtttctggtgtctt

SEQ ID NO: 8190343 - DNA, 22 bp, Homo sapiens
taggtaggtaaacaggactaat

SEQ ID NO: 8190344 - DNA, 19 bp, Homo sapiens
taggtaggtaggtaggtat

SEQ ID NO: 8190345 - DNA, 18 bp, Homo sapiens
cagggctgtggggtcact

SEQ ID NO: 8190346 - DNA, 22 bp, Homo sapiens
cagggctgtggctttgtgctgt

SEQ ID NO: 8190347 - DNA, 22 bp, Homo sapiens
cagggctttcccttgtagaaat

SEQ ID NO: 8190348 - DNA, 22 bp, Homo sapiens
cagggctttcctgagaagtgat

SEQ ID NO: 8190349 - DNA, 22 bp, Homo sapiens
cagggctttcctgagaagtgat

SEQ ID NO: 8190350 - DNA, 22 bp, Homo sapiens
cagggctttgaacaggcatcaa

SEQ ID NO: 8190351 - DNA, 22 bp, Homo sapiens
cagggctttgaacaggcatcaa

SEQ ID NO: 8190352 - DNA, 22 bp, Homo sapiens
cagggctttttattagctgcct

SEQ ID NO: 8190353 - DNA, 22 bp, Homo sapiens
cagggctttgtgtgcctgggga

SEQ ID NO: 8190354 - DNA, 22 bp, Homo sapiens
caggggaagatgccaagggaga

SEQ ID NO: 8190355 - DNA, 22 bp, Homo sapiens
cagggctttttattagctgcct

SEQ ID NO: 8190356 - DNA, 22 bp, Homo sapiens
cagggctttttattagctgcct

SEQ ID NO: 8190357 - DNA, 22 bp, Homo sapiens
caggggaaggagccttgaaact

SEQ ID NO: 8190358 - DNA, 22 bp, Homo sapiens
caggggaagatgccaagggaga

SEQ ID NO: 8190359 - DNA, 22 bp, Homo sapiens
caggggacattaaagctccata

SEQ ID NO: 8190360 - DNA, 22 bp, Homo sapiens
tagggctcgggcacaggacagg

SEQ ID NO: 8190361 - DNA, 22 bp, Homo sapiens
tagggctccactcccagagatt

SEQ ID NO: 8190362 - DNA, 22 bp, Homo sapiens
tagggcagtttcatgttatctt

SEQ ID NO: 8190363 - DNA, 22 bp, Homo sapiens
tagggcatttgtgggtgttgtt

SEQ ID NO: 8190364 - DNA, 21 bp, Homo sapiens
tagggcatattcagtggtctg

SEQ ID NO: 8190365 - DNA, 22 bp, Homo sapiens
tagggcctgacattcagtaggt

SEQ ID NO: 8190366 - DNA, 21 bp, Homo sapiens
tagggcaggcattggaagaga

SEQ ID NO: 8190367 - DNA, 22 bp, Homo sapiens
tagggaagtgtataggggtcat

SEQ ID NO: 8190368 - DNA, 22 bp, Homo sapiens
tagggacaaagagctgaggcct

SEQ ID NO: 8190369 - DNA, 21 bp, Homo sapiens
tagggcaggcattggaagaga

SEQ ID NO: 8190370 - DNA, 22 bp, Homo sapiens
tagggaaggagaccaagccaca

SEQ ID NO: 8190371 - DNA, 22 bp, Homo sapiens
tagggaagtgtataggggtcat

SEQ ID NO: 8190372 - DNA, 22 bp, Homo sapiens
tagggaaggagaccaagccaca

SEQ ID NO: 8190373 - DNA, 22 bp, Homo sapiens
cagggctcatctgtgtgaccag

SEQ ID NO: 8190374 - DNA, 22 bp, Homo sapiens
cagggctccatgcagggactcc

SEQ ID NO: 8190375 - DNA, 22 bp, Homo sapiens
cagggctcatctgtgtgaccag

SEQ ID NO: 8190376 - DNA, 22 bp, Homo sapiens
cagggctcatctgtgtgaccag

SEQ ID NO: 8190377 - DNA, 22 bp, Homo sapiens
tagggcaggggaggaatctgaa

SEQ ID NO: 8190378 - DNA, 21 bp, Homo sapiens
tagggcaggcattggaagaga

SEQ ID NO: 8190379 - DNA, 22 bp, Homo sapiens
tagggcaggtgaagaaaagcta

SEQ ID NO: 8190380 - DNA, 22 bp, Homo sapiens
tagggcaggtgaagaaaagcta

SEQ ID NO: 8190381 - DNA, 22 bp, Homo sapiens
tagggcagttataacattagtg

SEQ ID NO: 8190382 - DNA, 22 bp, Homo sapiens
cagggatggcgctggctgcccg

SEQ ID NO: 8190383 - DNA, 22 bp, Homo sapiens
cagggatggcgctggctgcccg

SEQ ID NO: 8190384 - DNA, 22 bp, Homo sapiens
cagggcaaagagagcacatgct

SEQ ID NO: 8190385 - DNA, 22 bp, Homo sapiens
cagggatggcgctggctgcccg

SEQ ID NO: 8190386 - DNA, 21 bp, Homo sapiens
cagggcacacagaggatggta

SEQ ID NO: 8190387 - DNA, 21 bp, Homo sapiens
cagggcacacagaggatggta

SEQ ID NO: 8190388 - DNA, 22 bp, Homo sapiens
cagggcaaagagagcacatgct

SEQ ID NO: 8190389 - DNA, 21 bp, Homo sapiens
cagggcaaccaagtccagaga

SEQ ID NO: 8190390 - DNA, 22 bp, Homo sapiens
tagataatttggcatcatattg

SEQ ID NO: 8190391 - DNA, 22 bp, Homo sapiens
tagataaattagaaagtttact

SEQ ID NO: 8190392 - DNA, 22 bp, Homo sapiens
tagataagaatggcatcttctc

SEQ ID NO: 8190393 - DNA, 22 bp, Homo sapiens
cagggcagaaggcactctactc

SEQ ID NO: 8190394 - DNA, 22 bp, Homo sapiens
cagggcagaacatatagatagt

SEQ ID NO: 8190395 - DNA, 22 bp, Homo sapiens
cagggcagaacatatagatagt

SEQ ID NO: 8190396 - DNA, 22 bp, Homo sapiens
cagggcagaaggcactctactc

SEQ ID NO: 8190397 - DNA, 22 bp, Homo sapiens
cagggcagaaggcactctactc

SEQ ID NO: 8190398 - DNA, 22 bp, Homo sapiens
cagggcagaacatatagatagt

SEQ ID NO: 8190399 - DNA, 22 bp, Homo sapiens
cagggcagaacatatagatagt

SEQ ID NO: 8190400 - DNA, 22 bp, Homo sapiens
cagggcagaacatatagatagt

SEQ ID NO: 8190401 - DNA, 22 bp, Homo sapiens
cagggcacggagaagtcacccc

SEQ ID NO: 8190402 - DNA, 22 bp, Homo sapiens
cagggcacttaaattgcctcgt

SEQ ID NO: 8190403 - DNA, 22 bp, Homo sapiens
cagggcacagttatggaggtgg

SEQ ID NO: 8190404 - DNA, 21 bp, Homo sapiens
cagggcacacagaggatggta

SEQ ID NO: 8190405 - DNA, 20 bp, Homo sapiens
cagggcacactgcagcctcg

SEQ ID NO: 8190406 - DNA, 20 bp, Homo sapiens
cagggcacactgcagcctcg

SEQ ID NO: 8190407 - DNA, 21 bp, Homo sapiens
cagggcacacagaggatggta

SEQ ID NO: 8190408 - DNA, 20 bp, Homo sapiens
cagggcacactgcagcctcg

SEQ ID NO: 8190409 - DNA, 22 bp, Homo sapiens
cagggcagagccaggatttcaa

SEQ ID NO: 8190410 - DNA, 22 bp, Homo sapiens
cagggcagaaggcactctactc

SEQ ID NO: 8190411 - DNA, 22 bp, Homo sapiens
tagcaagtggcaccacatttct

SEQ ID NO: 8190412 - DNA, 22 bp, Homo sapiens
tagcaagtgtgagttcatttta

SEQ ID NO: 8190413 - DNA, 22 bp, Homo sapiens
tagcaaggtgaagtatgggtga

SEQ ID NO: 8190414 - DNA, 22 bp, Homo sapiens
tagcaaggacaacatatgagag

SEQ ID NO: 8190415 - DNA, 22 bp, Homo sapiens
tagcgttttgtaatcaagtatg

SEQ ID NO: 8190416 - DNA, 22 bp, Homo sapiens
tagagtgtcataacagtgccca

SEQ ID NO: 8190417 - DNA, 22 bp, Homo sapiens
tagagtgtcataacagtgccca

SEQ ID NO: 8190418 - DNA, 22 bp, Homo sapiens
tagagtgtccaacacataggag

SEQ ID NO: 8190419 - DNA, 22 bp, Homo sapiens
tagataaattagaaagtttact

SEQ ID NO: 8190420 - DNA, 22 bp, Homo sapiens
tagagttatccttcacaggtat

SEQ ID NO: 8190421 - DNA, 22 bp, Homo sapiens
tagagttatgtggctccacagg

SEQ ID NO: 8190422 - DNA, 22 bp, Homo sapiens
tagataaaagggcaaagggcat

SEQ ID NO: 8190423 - DNA, 22 bp, Homo sapiens
tagaggaaccaggcaggctgag

SEQ ID NO: 8190424 - DNA, 22 bp, Homo sapiens
tagaggaaccaggcaggctgag

SEQ ID NO: 8190425 - DNA, 19 bp, Homo sapiens
tagaggagaagggaagtgg

SEQ ID NO: 8190426 - DNA, 22 bp, Homo sapiens
tagagtgtcataacagtgccca

SEQ ID NO: 8190427 - DNA, 19 bp, Homo sapiens
tagaggagaagggaagtgg

SEQ ID NO: 8190428 - DNA, 19 bp, Homo sapiens
tagaggagaagggaagtgg

SEQ ID NO: 8190429 - DNA, 17 bp, Homo sapiens
tagagctggttcaggag

SEQ ID NO: 8190430 - DNA, 22 bp, Homo sapiens
tagagctgggcagtgctctgag

SEQ ID NO: 8190431 - DNA, 22 bp, Homo sapiens
tagagctgtatcaaagagcctt

SEQ ID NO: 8190432 - DNA, 23 bp, Homo sapiens
tagagcttcagcgaatgtgctca

SEQ ID NO: 8190433 - DNA, 19 bp, Homo sapiens
tagagcttgttttaggaag

SEQ ID NO: 8190434 - DNA, 22 bp, Homo sapiens
tagaggaaatttccaaggtgag

SEQ ID NO: 8190435 - DNA, 22 bp, Homo sapiens
tagagctggaatttgcagcaag

SEQ ID NO: 8190436 - DNA, 22 bp, Homo sapiens
tagagctgggcagtgctctgag

SEQ ID NO: 8190437 - DNA, 22 bp, Homo sapiens
tagagctggccgggacagctgg

SEQ ID NO: 8190438 - DNA, 22 bp, Homo sapiens
tagagctggaaaactgcaggta

SEQ ID NO: 8190439 - DNA, 22 bp, Homo sapiens
caggctgggctccggagataaa

SEQ ID NO: 8190440 - DNA, 22 bp, Homo sapiens
caggctgggctccggagataaa

SEQ ID NO: 8190441 - DNA, 22 bp, Homo sapiens
caggctgggcagcctccccggc

SEQ ID NO: 8190442 - DNA, 18 bp, Homo sapiens
tagaatcaaatattttac

SEQ ID NO: 8190443 - DNA, 22 bp, Homo sapiens
tagaatatgattaattttctta

SEQ ID NO: 8190444 - DNA, 22 bp, Homo sapiens
tagaatatgattaattttctta

SEQ ID NO: 8190445 - DNA, 22 bp, Homo sapiens
tagaatatgtggtaggatctgg

SEQ ID NO: 8190446 - DNA, 18 bp, Homo sapiens
tagaatcaaatattttac

SEQ ID NO: 8190447 - DNA, 18 bp, Homo sapiens
tagaatcaaatattttac

SEQ ID NO: 8190448 - DNA, 22 bp, Homo sapiens
tagaatatgtggtgtatacttt

SEQ ID NO: 8190449 - DNA, 22 bp, Homo sapiens
tagaatatgtggtgtatacttt

SEQ ID NO: 8190450 - DNA, 22 bp, Homo sapiens
tagaatatgtggtgtatacttt

SEQ ID NO: 8190451 - DNA, 22 bp, Homo sapiens
caggctgggctccggagataaa

SEQ ID NO: 8190452 - DNA, 22 bp, Homo sapiens
caggctgggctccggagataaa

SEQ ID NO: 8190453 - DNA, 22 bp, Homo sapiens
caggctgggctggtgttagagt

SEQ ID NO: 8190454 - DNA, 22 bp, Homo sapiens
caggctggtcccagagcattgc

SEQ ID NO: 8190455 - DNA, 22 bp, Homo sapiens
caggctggtcccagagcattgc

SEQ ID NO: 8190456 - DNA, 22 bp, Homo sapiens
caggctggtcccagagcattgc

SEQ ID NO: 8190457 - DNA, 22 bp, Homo sapiens
caggctggtcccagagcattgc

SEQ ID NO: 8190458 - DNA, 22 bp, Homo sapiens
caggctggtcccagagcattgc

SEQ ID NO: 8190459 - DNA, 22 bp, Homo sapiens
tagacattttctcaacatctct

SEQ ID NO: 8190460 - DNA, 22 bp, Homo sapiens
tagacattttaagacatatacc

SEQ ID NO: 8190461 - DNA, 22 bp, Homo sapiens
cagccctgtgcggagggccctg

SEQ ID NO: 8190462 - DNA, 22 bp, Homo sapiens
gtgagggaggtagatttcatca

SEQ ID NO: 8190463 - DNA, 22 bp, Homo sapiens
gtgagggaggtagatttcatca

SEQ ID NO: 8190464 - DNA, 22 bp, Homo sapiens
gtgagggataatatgcggggtt

SEQ ID NO: 8190465 - DNA, 22 bp, Homo sapiens
gtgagggcagaacccccaggcc

SEQ ID NO: 8190466 - DNA, 22 bp, Homo sapiens
gtgagggcaaattagaatcaaa

SEQ ID NO: 8190467 - DNA, 22 bp, Homo sapiens
gtgagggcaaattagaatcaaa

SEQ ID NO: 8190468 - DNA, 20 bp, Homo sapiens
cagccctgtgacctggccct

SEQ ID NO: 8190469 - DNA, 20 bp, Homo sapiens
cagccctgtgacctggccct

SEQ ID NO: 8190470 - DNA, 20 bp, Homo sapiens
cagccctgtgacctggccct

SEQ ID NO: 8190471 - DNA, 22 bp, Homo sapiens
gtgaggggagtaaagccatgtt

SEQ ID NO: 8190472 - DNA, 22 bp, Homo sapiens
gtgaggggccaagagtagggca

SEQ ID NO: 8190473 - DNA, 22 bp, Homo sapiens
gtgaggggccaagagtagggca

SEQ ID NO: 8190474 - DNA, 17 bp, Homo sapiens
gtgagggcagaggatgg

SEQ ID NO: 8190475 - DNA, 17 bp, Homo sapiens
gtgagggcagaggatgg

SEQ ID NO: 8190476 - DNA, 22 bp, Homo sapiens
gtgagggcagcttggtcagtgt

SEQ ID NO: 8190477 - DNA, 22 bp, Homo sapiens
gtgaggggagtaaagccatgtt

SEQ ID NO: 8190478 - DNA, 22 bp, Homo sapiens
gtgaggggagtaaagccatgtt

SEQ ID NO: 8190479 - DNA, 22 bp, Homo sapiens
gtgaggggagtaaagccatgtt

SEQ ID NO: 8190480 - DNA, 22 bp, Homo sapiens
gtgaggggtggctgagcagttt

SEQ ID NO: 8190481 - DNA, 22 bp, Homo sapiens
gtgaggggccaagagtagggca

SEQ ID NO: 8190482 - DNA, 22 bp, Homo sapiens
gtgaggggccaagagtagggca

SEQ ID NO: 8190483 - DNA, 22 bp, Homo sapiens
gtgaggggtggctgagcagttt

SEQ ID NO: 8190484 - DNA, 22 bp, Homo sapiens
gtgaggggtctggacgcacagt

SEQ ID NO: 8190485 - DNA, 22 bp, Homo sapiens
gtgaggggtctggacgcacagt

SEQ ID NO: 8190486 - DNA, 22 bp, Homo sapiens
gtgaggggtctggacgcacagt

SEQ ID NO: 8190487 - DNA, 22 bp, Homo sapiens
tactatttggaattttaaattg

SEQ ID NO: 8190488 - DNA, 22 bp, Homo sapiens
tactatttggaattttaaattg

SEQ ID NO: 8190489 - DNA, 22 bp, Homo sapiens
tactatttggaattttaaattg

SEQ ID NO: 8190490 - DNA, 22 bp, Homo sapiens
tactatgtgaaaatactatagt

SEQ ID NO: 8190491 - DNA, 22 bp, Homo sapiens
tactatttggaattttaaattg

SEQ ID NO: 8190492 - DNA, 22 bp, Homo sapiens
tacctgaaccaagcccagctct

SEQ ID NO: 8190493 - DNA, 22 bp, Homo sapiens
tactatgtgaaaatactatagt

SEQ ID NO: 8190494 - DNA, 22 bp, Homo sapiens
tacctgaagtaacaatgaatat

SEQ ID NO: 8190495 - DNA, 22 bp, Homo sapiens
tactgtatatgcttgtatctga

SEQ ID NO: 8190496 - DNA, 22 bp, Homo sapiens
tactgtaggtgggtcactagta

SEQ ID NO: 8190497 - DNA, 22 bp, Homo sapiens
tactcattcatgttgttgtatg

SEQ ID NO: 8190498 - DNA, 23 bp, Homo sapiens
tactgtatattactgtgttatac

SEQ ID NO: 8190499 - DNA, 22 bp, Homo sapiens
tactgtatgaattatgttattt

SEQ ID NO: 8190500 - DNA, 22 bp, Homo sapiens
tactgtatgaattatgttattt

SEQ ID NO: 8190501 - DNA, 22 bp, Homo sapiens
tactgtatgatttcatgtatat

SEQ ID NO: 8190502 - DNA, 22 bp, Homo sapiens
tactgtatgatttcatgtatat

SEQ ID NO: 8190503 - DNA, 22 bp, Homo sapiens
tactgtattgttggctcttttg

SEQ ID NO: 8190504 - DNA, 22 bp, Homo sapiens
tactgtctgcttcttatagctt

SEQ ID NO: 8190505 - DNA, 22 bp, Homo sapiens
tactgtctctgccctggccagg

SEQ ID NO: 8190506 - DNA, 22 bp, Homo sapiens
tactgtctaataagattgatgg

SEQ ID NO: 8190507 - DNA, 22 bp, Homo sapiens
tactgtctatacacttgattac

SEQ ID NO: 8190508 - DNA, 22 bp, Homo sapiens
tactgtatttagaaagaactcc

SEQ ID NO: 8190509 - DNA, 22 bp, Homo sapiens
tactgtatttgataagtgaagt

SEQ ID NO: 8190510 - DNA, 22 bp, Homo sapiens
tactgtatttgataagtgaagt

SEQ ID NO: 8190511 - DNA, 22 bp, Homo sapiens
tactcagattcttcatattcag

SEQ ID NO: 8190512 - DNA, 22 bp, Homo sapiens
tactcagacttgaatctcaaga

SEQ ID NO: 8190513 - DNA, 22 bp, Homo sapiens
tactcagagtcattgcccttct

SEQ ID NO: 8190514 - DNA, 22 bp, Homo sapiens
tactcagaaggaattgtgtttt

SEQ ID NO: 8190515 - DNA, 22 bp, Homo sapiens
tactcagtttatgatttcaagt

SEQ ID NO: 8190516 - DNA, 22 bp, Homo sapiens
tactcatgactgatgaatacct

SEQ ID NO: 8190517 - DNA, 22 bp, Homo sapiens
tactcactattctatcagatag

SEQ ID NO: 8190518 - DNA, 22 bp, Homo sapiens
tactatttggaattttaaattg

SEQ ID NO: 8190519 - DNA, 22 bp, Homo sapiens
tactattttgacatgaaattga

SEQ ID NO: 8190520 - DNA, 22 bp, Homo sapiens
tactatttttgcaacgtataca

SEQ ID NO: 8190521 - DNA, 22 bp, Homo sapiens
tactatttttgcaacgtataca

SEQ ID NO: 8190522 - DNA, 22 bp, Homo sapiens
tactatttttgcaacgtataca

SEQ ID NO: 8190523 - DNA, 22 bp, Homo sapiens
tactcaaaaagttatgaatcat

SEQ ID NO: 8190524 - DNA, 22 bp, Homo sapiens
tactatttttgcaacgtataca

SEQ ID NO: 8190525 - DNA, 22 bp, Homo sapiens
tactcaaactcactaagacaga

SEQ ID NO: 8190526 - DNA, 22 bp, Homo sapiens
caggctggagtgcagtggtgcc

SEQ ID NO: 8190527 - DNA, 22 bp, Homo sapiens
caggctggagtgcagtggtgcc

SEQ ID NO: 8190528 - DNA, 22 bp, Homo sapiens
tagaacataagtcattcatttg

SEQ ID NO: 8190529 - DNA, 22 bp, Homo sapiens
tagaacataagtcattcatttg

SEQ ID NO: 8190530 - DNA, 21 bp, Homo sapiens
tagaatacaggtattttggat

SEQ ID NO: 8190531 - DNA, 22 bp, Homo sapiens
tagaataatctgaggaaatgct

SEQ ID NO: 8190532 - DNA, 22 bp, Homo sapiens
tagaataatctgaggaaatgct

SEQ ID NO: 8190533 - DNA, 22 bp, Homo sapiens
tagaataagttgatgatatatg

SEQ ID NO: 8190534 - DNA, 22 bp, Homo sapiens
tagaacatcaggttgaatttgg

SEQ ID NO: 8190535 - DNA, 22 bp, Homo sapiens
tagaatactagtgaagtcatcg

SEQ ID NO: 8190536 - DNA, 22 bp, Homo sapiens
tagaatatacactacagcttaa

SEQ ID NO: 8190537 - DNA, 19 bp, Homo sapiens
tagaatagttacacagatt

SEQ ID NO: 8190538 - DNA, 22 bp, Homo sapiens
tagaatatacactacagcttaa

SEQ ID NO: 8190539 - DNA, 22 bp, Homo sapiens
tagaatatacactacagcttaa

SEQ ID NO: 8190540 - DNA, 22 bp, Homo sapiens
tagaatatgattaattttctta

SEQ ID NO: 8190541 - DNA, 22 bp, Homo sapiens
caggctggagtgcagtggggcg

SEQ ID NO: 8190542 - DNA, 22 bp, Homo sapiens
caggctggagtgcagtggcgct

SEQ ID NO: 8190543 - DNA, 22 bp, Homo sapiens
caggctggagtgcagtggggcg

SEQ ID NO: 8190544 - DNA, 22 bp, Homo sapiens
caggctggagtgcagtggggcg

SEQ ID NO: 8190545 - DNA, 22 bp, Homo sapiens
caggctggagtgcagtggggcg

SEQ ID NO: 8190546 - DNA, 22 bp, Homo sapiens
caggctggagtgcagtggcgct

SEQ ID NO: 8190547 - DNA, 22 bp, Homo sapiens
caggctggagtgcagtggcgct

SEQ ID NO: 8190548 - DNA, 22 bp, Homo sapiens
caggctggagtgcagtggcgcc

SEQ ID NO: 8190549 - DNA, 22 bp, Homo sapiens
caggctggagtgcagtggcgct

SEQ ID NO: 8190550 - DNA, 22 bp, Homo sapiens
caggctggagtgcagtggcgct

SEQ ID NO: 8190551 - DNA, 22 bp, Homo sapiens
caggctggagtgcaatggtgct

SEQ ID NO: 8190552 - DNA, 22 bp, Homo sapiens
caggctggagtgcagtggcgcc

SEQ ID NO: 8190553 - DNA, 22 bp, Homo sapiens
caggctggagtgcagtggcgcc

SEQ ID NO: 8190554 - DNA, 22 bp, Homo sapiens
caggctggagtgcagtggcgcc

SEQ ID NO: 8190555 - DNA, 22 bp, Homo sapiens
caggctggagtgcagtggcgcc

SEQ ID NO: 8190556 - DNA, 22 bp, Homo sapiens
caggctggagtgcaatggcaca

SEQ ID NO: 8190557 - DNA, 22 bp, Homo sapiens
caggctggagtgcaatggcaca

SEQ ID NO: 8190558 - DNA, 22 bp, Homo sapiens
caggctggagtgcaatggcaca

SEQ ID NO: 8190559 - DNA, 22 bp, Homo sapiens
caggctggagtgcaatgacgcc

SEQ ID NO: 8190560 - DNA, 22 bp, Homo sapiens
caggctggagtgcaatgacgcc

SEQ ID NO: 8190561 - DNA, 22 bp, Homo sapiens
caggctggagtgagtgtagtgg

SEQ ID NO: 8190562 - DNA, 22 bp, Homo sapiens
caggctggagtgagtgtagtgg

SEQ ID NO: 8190563 - DNA, 22 bp, Homo sapiens
caggctggagtgagtgtagtgg

SEQ ID NO: 8190564 - DNA, 22 bp, Homo sapiens
caggctgcctggaagaggactg

SEQ ID NO: 8190565 - DNA, 22 bp, Homo sapiens
caggctgcctggaagaggactg

SEQ ID NO: 8190566 - DNA, 22 bp, Homo sapiens
caggctggagtgagtgtagtgg

SEQ ID NO: 8190567 - DNA, 22 bp, Homo sapiens
caggctgccgtggggtccaggc

SEQ ID NO: 8190568 - DNA, 22 bp, Homo sapiens
caggctgcctggaagaggactg

SEQ ID NO: 8190569 - DNA, 22 bp, Homo sapiens
tactgtgaatacaaaataaatt

SEQ ID NO: 8190570 - DNA, 22 bp, Homo sapiens
tactgtctttccatccttgcct

SEQ ID NO: 8190571 - DNA, 22 bp, Homo sapiens
tactgtcttttcctaaatgggt

SEQ ID NO: 8190572 - DNA, 22 bp, Homo sapiens
tactgtctggcaattaagaatc

SEQ ID NO: 8190573 - DNA, 22 bp, Homo sapiens
tactgtctttaggggtagaaat

SEQ ID NO: 8190574 - DNA, 23 bp, Homo sapiens
tactgtcttctattaagtaagga

SEQ ID NO: 8190575 - DNA, 22 bp, Homo sapiens
tttcatgtgttgaatgtgtaca

SEQ ID NO: 8190576 - DNA, 22 bp, Homo sapiens
tttcattatacagcttcataaa

SEQ ID NO: 8190577 - DNA, 22 bp, Homo sapiens
tttcatgtggcgatgtctctgg

SEQ ID NO: 8190578 - DNA, 22 bp, Homo sapiens
tttcatgtggcgatgtctctgg

SEQ ID NO: 8190579 - DNA, 22 bp, Homo sapiens
tttcatgtgcaattagcaatat

SEQ ID NO: 8190580 - DNA, 22 bp, Homo sapiens
tttcatgtgcaattagcaatat

SEQ ID NO: 8190581 - DNA, 22 bp, Homo sapiens
tttcatgtcattccatttcaga

SEQ ID NO: 8190582 - DNA, 22 bp, Homo sapiens
tttcatgtctgaattctttagt

SEQ ID NO: 8190583 - DNA, 22 bp, Homo sapiens
tttcatgtacttttttgataga

SEQ ID NO: 8190584 - DNA, 22 bp, Homo sapiens
tttcatgtatttcccaaagctt

SEQ ID NO: 8190585 - DNA, 22 bp, Homo sapiens
tttcatgtatttcccaaagctt

SEQ ID NO: 8190586 - DNA, 22 bp, Homo sapiens
tttcatgctcatggaacacagc

SEQ ID NO: 8190587 - DNA, 22 bp, Homo sapiens
tttcatgctcatggaacacagc

SEQ ID NO: 8190588 - DNA, 22 bp, Homo sapiens
tttcatgatccatttacaaaat

SEQ ID NO: 8190589 - DNA, 22 bp, Homo sapiens
tttcatgcacaaatgagcaagg

SEQ ID NO: 8190590 - DNA, 22 bp, Homo sapiens
tttcatgattaacttagtgaat

SEQ ID NO: 8190591 - DNA, 22 bp, Homo sapiens
tttcatcttccttggcataggt

SEQ ID NO: 8190592 - DNA, 22 bp, Homo sapiens
tttcagagctcagcagctagag

SEQ ID NO: 8190593 - DNA, 22 bp, Homo sapiens
tttcatgagattcctccacatc

SEQ ID NO: 8190594 - DNA, 22 bp, Homo sapiens
tttcatgaggggcaaaatctca

SEQ ID NO: 8190595 - DNA, 19 bp, Homo sapiens
tttcccagtcccaggagtg

SEQ ID NO: 8190596 - DNA, 22 bp, Homo sapiens
tttcccagttagtgaagacatg

SEQ ID NO: 8190597 - DNA, 22 bp, Homo sapiens
tttcccagttagtgaagacatg

SEQ ID NO: 8190598 - DNA, 22 bp, Homo sapiens
tttcccagttagtgaagacatg

SEQ ID NO: 8190599 - DNA, 22 bp, Homo sapiens
tttcccagttccctgctctata

SEQ ID NO: 8190600 - DNA, 22 bp, Homo sapiens
tttcccctcagtactaaacata

SEQ ID NO: 8190601 - DNA, 22 bp, Homo sapiens
tttcccatccatagccctgcaa

SEQ ID NO: 8190602 - DNA, 22 bp, Homo sapiens
tttcattgatgggtgatagaaa

SEQ ID NO: 8190603 - DNA, 19 bp, Homo sapiens
tttcccagcccttgctgtg

SEQ ID NO: 8190604 - DNA, 19 bp, Homo sapiens
tttcccagcccttgctgtg

SEQ ID NO: 8190605 - DNA, 21 bp, Homo sapiens
tttcccagcagagatagctgg

SEQ ID NO: 8190606 - DNA, 22 bp, Homo sapiens
tttcccaggctggaatgcagtg

SEQ ID NO: 8190607 - DNA, 19 bp, Homo sapiens
tttcccagtcccaggagtg

SEQ ID NO: 8190608 - DNA, 19 bp, Homo sapiens
tttcccagcccttgctgtg

SEQ ID NO: 8190609 - DNA, 22 bp, Homo sapiens
tttcccagcctcagctcagcag

SEQ ID NO: 8190610 - DNA, 22 bp, Homo sapiens
tttcccagcctcctttgcagct

SEQ ID NO: 8190611 - DNA, 22 bp, Homo sapiens
tttcccaggccctcagggctgc

SEQ ID NO: 8190612 - DNA, 22 bp, Homo sapiens
tttcccagcctcctttgcagct

SEQ ID NO: 8190613 - DNA, 22 bp, Homo sapiens
tttcattgagactatagacatc

SEQ ID NO: 8190614 - DNA, 22 bp, Homo sapiens
tttcattgagactatagacatc

SEQ ID NO: 8190615 - DNA, 22 bp, Homo sapiens
tttcattgacagttgggggaaa

SEQ ID NO: 8190616 - DNA, 22 bp, Homo sapiens
tttcattgagaatataagattt

SEQ ID NO: 8190617 - DNA, 22 bp, Homo sapiens
tttcattgagaatataagattt

SEQ ID NO: 8190618 - DNA, 21 bp, Homo sapiens
tttcattgaatgagataaggt

SEQ ID NO: 8190619 - DNA, 21 bp, Homo sapiens
tttcattgaatgagataaggt

SEQ ID NO: 8190620 - DNA, 21 bp, Homo sapiens
tttcattgaatgagataaggt

SEQ ID NO: 8190621 - DNA, 22 bp, Homo sapiens
tttcattcagcaccctgaggtg

SEQ ID NO: 8190622 - DNA, 22 bp, Homo sapiens
tttcattcagcaccctgaggtg

SEQ ID NO: 8190623 - DNA, 22 bp, Homo sapiens
tttcattcatgtgttaaaggtg

SEQ ID NO: 8190624 - DNA, 22 bp, Homo sapiens
tttcattatgttcctggaagag

SEQ ID NO: 8190625 - DNA, 22 bp, Homo sapiens
tttcattatgttcctggaagag

SEQ ID NO: 8190626 - DNA, 22 bp, Homo sapiens
tttcattcatgtgttaaaggtg

SEQ ID NO: 8190627 - DNA, 22 bp, Homo sapiens
tttcattcattatacagtagag

SEQ ID NO: 8190628 - DNA, 22 bp, Homo sapiens
tttcattcattatacagtagag

SEQ ID NO: 8190629 - DNA, 22 bp, Homo sapiens
tttcattgaactaaagaatctg

SEQ ID NO: 8190630 - DNA, 21 bp, Homo sapiens
tttcattgaatgagataaggt

SEQ ID NO: 8190631 - DNA, 22 bp, Homo sapiens
tttcattgaactaaagaatctg

SEQ ID NO: 8190632 - DNA, 20 bp, Homo sapiens
tttcactggcttgataaggt

SEQ ID NO: 8190633 - DNA, 20 bp, Homo sapiens
tttcactgtggtgctggaga

SEQ ID NO: 8190634 - DNA, 22 bp, Homo sapiens
tttcactgtgttggtcaggccg

SEQ ID NO: 8190635 - DNA, 22 bp, Homo sapiens
tttcacattttatacttaagcc

SEQ ID NO: 8190636 - DNA, 23 bp, Homo sapiens
tttcacagcttttattctgcatc

SEQ ID NO: 8190637 - DNA, 23 bp, Homo sapiens
tttcacagcttttattctgcatc

SEQ ID NO: 8190638 - DNA, 22 bp, Homo sapiens
tttcaccaaggtaacctttgat

SEQ ID NO: 8190639 - DNA, 20 bp, Homo sapiens
tttcaccatcttggccaggc

SEQ ID NO: 8190640 - DNA, 22 bp, Homo sapiens
tttcaccacagaggcaagacaa

SEQ ID NO: 8190641 - DNA, 22 bp, Homo sapiens
tttcaccatcttggccaggctg

SEQ ID NO: 8190642 - DNA, 22 bp, Homo sapiens
tttcacagatgttttggagtct

SEQ ID NO: 8190643 - DNA, 22 bp, Homo sapiens
tttcacagcatataggtgtact

SEQ ID NO: 8190644 - DNA, 22 bp, Homo sapiens
tttcacagcagtgtgctgcttt

SEQ ID NO: 8190645 - DNA, 22 bp, Homo sapiens
tttcacagcgtctttctcttgc

SEQ ID NO: 8190646 - DNA, 22 bp, Homo sapiens
tttcacagcagtgtgctgcttt

SEQ ID NO: 8190647 - DNA, 22 bp, Homo sapiens
tttcacagctgtcttccgtctc

SEQ ID NO: 8190648 - DNA, 22 bp, Homo sapiens
tttcacagctgtcttccgtctc

SEQ ID NO: 8190649 - DNA, 22 bp, Homo sapiens
tttcacagctgggtggcagagt

SEQ ID NO: 8190650 - DNA, 22 bp, Homo sapiens
tttcacagctgggtggcagagt

SEQ ID NO: 8190651 - DNA, 22 bp, Homo sapiens
tttcacagctgggtggcagagt

SEQ ID NO: 8190652 - DNA, 22 bp, Homo sapiens
tttcacagctagtgagcttcta

SEQ ID NO: 8190653 - DNA, 22 bp, Homo sapiens
tttcacagcgtctttctcttgc

SEQ ID NO: 8190654 - DNA, 22 bp, Homo sapiens
tttcacagctgggaagagatat

SEQ ID NO: 8190655 - DNA, 22 bp, Homo sapiens
tttcagaaatggcactgaaatc

SEQ ID NO: 8190656 - DNA, 22 bp, Homo sapiens
tttcagaaatggcactgaaatc

SEQ ID NO: 8190657 - DNA, 22 bp, Homo sapiens
tttcagaaatggcactgaaatc

SEQ ID NO: 8190658 - DNA, 22 bp, Homo sapiens
tttcagaaatcaaaaccagggt

SEQ ID NO: 8190659 - DNA, 22 bp, Homo sapiens
tttcagaaagctgaacatatga

SEQ ID NO: 8190660 - DNA, 22 bp, Homo sapiens
tttcagaaagcatcatcaaagt

SEQ ID NO: 8190661 - DNA, 22 bp, Homo sapiens
tttcagaaaacttatcatcagt

SEQ ID NO: 8190662 - DNA, 22 bp, Homo sapiens
tttcagaaacgattatgaacac

SEQ ID NO: 8190663 - DNA, 22 bp, Homo sapiens
tttcagaaacgattatgaacac

SEQ ID NO: 8190664 - DNA, 22 bp, Homo sapiens
tttcagactgctgtgtgaaact

SEQ ID NO: 8190665 - DNA, 22 bp, Homo sapiens
tttcagactcatctcaagcttt

SEQ ID NO: 8190666 - DNA, 22 bp, Homo sapiens
tttcagactcatctcaagcttt

SEQ ID NO: 8190667 - DNA, 22 bp, Homo sapiens
tttcagagaattagaagctgat

SEQ ID NO: 8190668 - DNA, 22 bp, Homo sapiens
tttcagagaattagaagctgat

SEQ ID NO: 8190669 - DNA, 22 bp, Homo sapiens
tttcagagcctttatctctcta

SEQ ID NO: 8190670 - DNA, 22 bp, Homo sapiens
tttcagagatgtctagcctatt

SEQ ID NO: 8190671 - DNA, 20 bp, Homo sapiens
tttcacaatgaacatgtctc

SEQ ID NO: 8190672 - DNA, 23 bp, Homo sapiens
tttcacaatgagcattacagaat

SEQ ID NO: 8190673 - DNA, 23 bp, Homo sapiens
tttcacaatgagcattacagaat

SEQ ID NO: 8190674 - DNA, 22 bp, Homo sapiens
tttcacaattttaaggagcaaa

SEQ ID NO: 8190675 - DNA, 22 bp, Homo sapiens
tttcacactgcagcatcagaga

SEQ ID NO: 8190676 - DNA, 22 bp, Homo sapiens
tttcacactagtcagaatacca

SEQ ID NO: 8190677 - DNA, 22 bp, Homo sapiens
tttcacagaaaggataacatta

SEQ ID NO: 8190678 - DNA, 22 bp, Homo sapiens
tttcacagagaaatataacagg

SEQ ID NO: 8190679 - DNA, 22 bp, Homo sapiens
tttcacagaactcactaaggag

SEQ ID NO: 8190680 - DNA, 22 bp, Homo sapiens
tttcacagaaagaagctagttt

SEQ ID NO: 8190681 - DNA, 22 bp, Homo sapiens
tttcacagaaagacaacagata

SEQ ID NO: 8190682 - DNA, 22 bp, Homo sapiens
tttcacagaaaggataacatta

SEQ ID NO: 8190683 - DNA, 22 bp, Homo sapiens
tttcacagagaaatataacagg

SEQ ID NO: 8190684 - DNA, 22 bp, Homo sapiens
tttcacagagaaatataacagg

SEQ ID NO: 8190685 - DNA, 22 bp, Homo sapiens
tttcacagagaaatataacagg

SEQ ID NO: 8190686 - DNA, 22 bp, Homo sapiens
tttcacagatataagatttcac

SEQ ID NO: 8190687 - DNA, 22 bp, Homo sapiens
tttcacagatataagatttcac

SEQ ID NO: 8190688 - DNA, 22 bp, Homo sapiens
tttcacagatataagatttcac

SEQ ID NO: 8190689 - DNA, 22 bp, Homo sapiens
tttcaacatataccataatgcc

SEQ ID NO: 8190690 - DNA, 22 bp, Homo sapiens
tttcaacatcacctagcagttc

SEQ ID NO: 8190691 - DNA, 22 bp, Homo sapiens
tttcaacaggatgataataggc

SEQ ID NO: 8190692 - DNA, 22 bp, Homo sapiens
tttcaacaggatgataataggc

SEQ ID NO: 8190693 - DNA, 22 bp, Homo sapiens
tttcaacaggatgataataggc

SEQ ID NO: 8190694 - DNA, 22 bp, Homo sapiens
tttcaacataatgcctgctagg

SEQ ID NO: 8190695 - DNA, 22 bp, Homo sapiens
tttcaagaacaacattcattca

SEQ ID NO: 8190696 - DNA, 22 bp, Homo sapiens
tttcaacttgaagaattgatac

SEQ ID NO: 8190697 - DNA, 22 bp, Homo sapiens
tttcaagactcattgagtattg

SEQ ID NO: 8190698 - DNA, 22 bp, Homo sapiens
tttcaagactcattgagtattg

SEQ ID NO: 8190699 - DNA, 22 bp, Homo sapiens
tttcaagactcattgagtattg

SEQ ID NO: 8190700 - DNA, 22 bp, Homo sapiens
tttcaagactcattgagtattg

SEQ ID NO: 8190701 - DNA, 22 bp, Homo sapiens
tttcaagagggaactgaacaca

SEQ ID NO: 8190702 - DNA, 22 bp, Homo sapiens
tttcaagagcaggaaaaaggtc

SEQ ID NO: 8190703 - DNA, 22 bp, Homo sapiens
tttcaacagctctcaaatgatc

SEQ ID NO: 8190704 - DNA, 22 bp, Homo sapiens
tttcaacaccagagaccatgcg

SEQ ID NO: 8190705 - DNA, 22 bp, Homo sapiens
tttcaacaccagagaccatgcg

SEQ ID NO: 8190706 - DNA, 23 bp, Homo sapiens
tttcaacaatgcttagagaaaac

SEQ ID NO: 8190707 - DNA, 23 bp, Homo sapiens
tttcaacaatgcttagagaaaac

SEQ ID NO: 8190708 - DNA, 23 bp, Homo sapiens
tttcaacaatgcttagagaaaac

SEQ ID NO: 8190709 - DNA, 22 bp, Homo sapiens
tttcaaaggtggaagagtgaat

SEQ ID NO: 8190710 - DNA, 22 bp, Homo sapiens
tttcaaaggtggaagagtgaat

SEQ ID NO: 8190711 - DNA, 22 bp, Homo sapiens
tttcaaagtaaggattttcatc

SEQ ID NO: 8190712 - DNA, 22 bp, Homo sapiens
tttcaaaggttttgtcatgtct

SEQ ID NO: 8190713 - DNA, 22 bp, Homo sapiens
tttattgacttcagtgagtctt

SEQ ID NO: 8190714 - DNA, 22 bp, Homo sapiens
tttattgacttcagtgagtctt

SEQ ID NO: 8190715 - DNA, 20 bp, Homo sapiens
tttattgagcacgtactgtg

SEQ ID NO: 8190716 - DNA, 22 bp, Homo sapiens
tttattgagcacccgttgtgcg

SEQ ID NO: 8190717 - DNA, 22 bp, Homo sapiens
tttattgagcacccgttgtgcg

SEQ ID NO: 8190718 - DNA, 22 bp, Homo sapiens
tttattgagcacccgttgtgcg

SEQ ID NO: 8190719 - DNA, 22 bp, Homo sapiens
tttattgacttcagtgagtctt

SEQ ID NO: 8190720 - DNA, 22 bp, Homo sapiens
tttattgacccaaagcgagagt

SEQ ID NO: 8190721 - DNA, 22 bp, Homo sapiens
tttattgacccaaagcgagagt

SEQ ID NO: 8190722 - DNA, 22 bp, Homo sapiens
tttattgacccaaagcgagagt

SEQ ID NO: 8190723 - DNA, 22 bp, Homo sapiens
tttattgacccaaagcgagagt

SEQ ID NO: 8190724 - DNA, 22 bp, Homo sapiens
tttattgacttcagtgagtctt

SEQ ID NO: 8190725 - DNA, 22 bp, Homo sapiens
tttattgacccaaagcgagagt

SEQ ID NO: 8190726 - DNA, 22 bp, Homo sapiens
tttattgacccaaagcgagagt

SEQ ID NO: 8190727 - DNA, 20 bp, Homo sapiens
tttattgagcacgtactgtg

SEQ ID NO: 8190728 - DNA, 20 bp, Homo sapiens
tttattgagcacgtactgtg

SEQ ID NO: 8190729 - DNA, 22 bp, Homo sapiens
tttattgagtatctactatgtg

SEQ ID NO: 8190730 - DNA, 22 bp, Homo sapiens
tttattgagtatctactatgtg

SEQ ID NO: 8190731 - DNA, 22 bp, Homo sapiens
tttattgagtatctactatgtg

SEQ ID NO: 8190732 - DNA, 22 bp, Homo sapiens
tttattgagtatctactatgtg

SEQ ID NO: 8190733 - DNA, 19 bp, Homo sapiens
tttcaaagggcataagcct

SEQ ID NO: 8190734 - DNA, 22 bp, Homo sapiens
tttattgcatacacaaatgtca

SEQ ID NO: 8190735 - DNA, 22 bp, Homo sapiens
tttattgcactgtctcaatacc

SEQ ID NO: 8190736 - DNA, 22 bp, Homo sapiens
tttattgagtatctactatgtg

SEQ ID NO: 8190737 - DNA, 22 bp, Homo sapiens
tttattgagtatctactatgtg

SEQ ID NO: 8190738 - DNA, 22 bp, Homo sapiens
tttattctgtgctacatgaaga

SEQ ID NO: 8190739 - DNA, 22 bp, Homo sapiens
tttattctgtgctacatgaaga

SEQ ID NO: 8190740 - DNA, 21 bp, Homo sapiens
tttattctcagatacagggag

SEQ ID NO: 8190741 - DNA, 23 bp, Homo sapiens
tttattctcagatacataggtct

SEQ ID NO: 8190742 - DNA, 22 bp, Homo sapiens
tttattctctagttggtcagat

SEQ ID NO: 8190743 - DNA, 22 bp, Homo sapiens
tttattgaacacttgcactggc

SEQ ID NO: 8190744 - DNA, 22 bp, Homo sapiens
tttattgaacacttgcactggc

SEQ ID NO: 8190745 - DNA, 22 bp, Homo sapiens
tttattgaacacttgcactggc

SEQ ID NO: 8190746 - DNA, 22 bp, Homo sapiens
tttattgaacacttgcactggc

SEQ ID NO: 8190747 - DNA, 22 bp, Homo sapiens
tttattgaattgtaaccctatt

SEQ ID NO: 8190748 - DNA, 22 bp, Homo sapiens
tttattgaattgtaaccctatt

SEQ ID NO: 8190749 - DNA, 22 bp, Homo sapiens
tttattgaattgtaaccctatt

SEQ ID NO: 8190750 - DNA, 22 bp, Homo sapiens
tttattgaattgtaaccctatt

SEQ ID NO: 8190751 - DNA, 22 bp, Homo sapiens
tttattcttgagagtgagaaga

SEQ ID NO: 8190752 - DNA, 22 bp, Homo sapiens
tttattgaacacttgcactggc

SEQ ID NO: 8190753 - DNA, 22 bp, Homo sapiens
tttattctataggcattaagca

SEQ ID NO: 8190754 - DNA, 21 bp, Homo sapiens
tttattctcagatacagggag

SEQ ID NO: 8190755 - DNA, 22 bp, Homo sapiens
tttattctataggcattaagca

SEQ ID NO: 8190756 - DNA, 22 bp, Homo sapiens
tttattctagctcagaatagtt

SEQ ID NO: 8190757 - DNA, 22 bp, Homo sapiens
tttattctagctcagaatagtt

SEQ ID NO: 8190758 - DNA, 20 bp, Homo sapiens
tttattcacagagaagagtt

SEQ ID NO: 8190759 - DNA, 20 bp, Homo sapiens
tttattcacagagaagagtt

SEQ ID NO: 8190760 - DNA, 20 bp, Homo sapiens
tttattcacagagaagagtt

SEQ ID NO: 8190761 - DNA, 22 bp, Homo sapiens
tttattctagctcagaatagtt

SEQ ID NO: 8190762 - DNA, 22 bp, Homo sapiens
tttattctagctcagaatagtt

SEQ ID NO: 8190763 - DNA, 22 bp, Homo sapiens
tttattctagctcagaatagtt

SEQ ID NO: 8190764 - DNA, 22 bp, Homo sapiens
tttaaagaaattcctcatcttt

SEQ ID NO: 8190765 - DNA, 22 bp, Homo sapiens
tttaaactgttgattttatgaa

SEQ ID NO: 8190766 - DNA, 17 bp, Homo sapiens
tttaaactactacaagg

SEQ ID NO: 8190767 - DNA, 17 bp, Homo sapiens
tttaaactactacaagg

SEQ ID NO: 8190768 - DNA, 17 bp, Homo sapiens
tttaaactactacaagg

SEQ ID NO: 8190769 - DNA, 17 bp, Homo sapiens
tttaaactactacaagg

SEQ ID NO: 8190770 - DNA, 22 bp, Homo sapiens
tttaaactaacagtacacgttg

SEQ ID NO: 8190771 - DNA, 22 bp, Homo sapiens
tttaaagagaatgtgaaggagt

SEQ ID NO: 8190772 - DNA, 22 bp, Homo sapiens
tttaaagaaattcctcatcttt

SEQ ID NO: 8190773 - DNA, 22 bp, Homo sapiens
ttgtgtgactcctagagtagag

SEQ ID NO: 8190774 - DNA, 22 bp, Homo sapiens
ttgtgtgtactggttatgggca

SEQ ID NO: 8190775 - DNA, 22 bp, Homo sapiens
ttgtgtgtagactcagccattg

SEQ ID NO: 8190776 - DNA, 17 bp, Homo sapiens
ttgtgtgtagttctgat

SEQ ID NO: 8190777 - DNA, 17 bp, Homo sapiens
ttgtgtgtagttctgat

SEQ ID NO: 8190778 - DNA, 22 bp, Homo sapiens
tttaaacatcttgttgccttaa

SEQ ID NO: 8190779 - DNA, 22 bp, Homo sapiens
tttaagatctatcccattttgt

SEQ ID NO: 8190780 - DNA, 22 bp, Homo sapiens
tttaaatgtttatagagagtac

SEQ ID NO: 8190781 - DNA, 22 bp, Homo sapiens
tttaagatggtattttataaag

SEQ ID NO: 8190782 - DNA, 22 bp, Homo sapiens
tttaagatggtattttataaag

SEQ ID NO: 8190783 - DNA, 22 bp, Homo sapiens
tttaaatgtttaaaactcgtga

SEQ ID NO: 8190784 - DNA, 22 bp, Homo sapiens
tttaaatgtttaaaactcgtga

SEQ ID NO: 8190785 - DNA, 22 bp, Homo sapiens
tttaaatgtttaaaactcgtga

SEQ ID NO: 8190786 - DNA, 22 bp, Homo sapiens
tttaaatgtgttcttagtagct

SEQ ID NO: 8190787 - DNA, 22 bp, Homo sapiens
tttaaatgtgttcttagtagct

SEQ ID NO: 8190788 - DNA, 22 bp, Homo sapiens
tttaaatgttcatgatactgaa

SEQ ID NO: 8190789 - DNA, 22 bp, Homo sapiens
tttaaatgttcatgatactgaa

SEQ ID NO: 8190790 - DNA, 22 bp, Homo sapiens
tttaaatggcattttcccagat

SEQ ID NO: 8190791 - DNA, 22 bp, Homo sapiens
tttaaatggcattttcccagat

SEQ ID NO: 8190792 - DNA, 22 bp, Homo sapiens
tttaaataggactcctgggggt

SEQ ID NO: 8190793 - DNA, 22 bp, Homo sapiens
tttaaagtggtccatttcagaa

SEQ ID NO: 8190794 - DNA, 22 bp, Homo sapiens
tttaaagtggtccatttcagaa

SEQ ID NO: 8190795 - DNA, 22 bp, Homo sapiens
tttaaagtgctgctcctatcct

SEQ ID NO: 8190796 - DNA, 19 bp, Homo sapiens
tttaaagtgactggtattt

SEQ ID NO: 8190797 - DNA, 22 bp, Homo sapiens
tttaaagtgctgctcctatcct

SEQ ID NO: 8190798 - DNA, 19 bp, Homo sapiens
tttaaagtgactggtattt

SEQ ID NO: 8190799 - DNA, 22 bp, Homo sapiens
tttaaatgcagacgttgattca

SEQ ID NO: 8190800 - DNA, 22 bp, Homo sapiens
tttaaatgcagacgttgattca

SEQ ID NO: 8190801 - DNA, 22 bp, Homo sapiens
tttaaatgctttaagcaagggt

SEQ ID NO: 8190802 - DNA, 22 bp, Homo sapiens
tttaaataggactcctgggggt

SEQ ID NO: 8190803 - DNA, 22 bp, Homo sapiens
tttaaataggactcctgggggt

SEQ ID NO: 8190804 - DNA, 22 bp, Homo sapiens
tttaaataggactcctgggggt

SEQ ID NO: 8190805 - DNA, 22 bp, Homo sapiens
tttaaataggactcctgggggt

SEQ ID NO: 8190806 - DNA, 22 bp, Homo sapiens
tttaatcttcaaaatagtctta

SEQ ID NO: 8190807 - DNA, 22 bp, Homo sapiens
tttaatcttcaaaatagtctta

SEQ ID NO: 8190808 - DNA, 16 bp, Homo sapiens
tttaatctctcaggaa

SEQ ID NO: 8190809 - DNA, 22 bp, Homo sapiens
tttaatgaataattcaaatctg

SEQ ID NO: 8190810 - DNA, 22 bp, Homo sapiens
tttaatctcccactctcagcct

SEQ ID NO: 8190811 - DNA, 22 bp, Homo sapiens
tttaatctattccctaaacacc

SEQ ID NO: 8190812 - DNA, 22 bp, Homo sapiens
tttaatctattccctaaacacc

SEQ ID NO: 8190813 - DNA, 22 bp, Homo sapiens
tttaagtcatggagaattgtgg

SEQ ID NO: 8190814 - DNA, 22 bp, Homo sapiens
tttaaggcttcaatttttggta

SEQ ID NO: 8190815 - DNA, 22 bp, Homo sapiens
tttaaggtggacatctaagtca

SEQ ID NO: 8190816 - DNA, 22 bp, Homo sapiens
tttaaggatgtaaaggaagaag

SEQ ID NO: 8190817 - DNA, 22 bp, Homo sapiens
tttaaggcagtgaaactattct

SEQ ID NO: 8190818 - DNA, 22 bp, Homo sapiens
tttaaggcagtgaaactattct

SEQ ID NO: 8190819 - DNA, 22 bp, Homo sapiens
tttaaggagctactcaccgtca

SEQ ID NO: 8190820 - DNA, 22 bp, Homo sapiens
tttaaggaggggctcacgtggg

SEQ ID NO: 8190821 - DNA, 22 bp, Homo sapiens
tttaaggatgatgtgatatata

SEQ ID NO: 8190822 - DNA, 22 bp, Homo sapiens
tttaagctgtggcattaattct

SEQ ID NO: 8190823 - DNA, 22 bp, Homo sapiens
tttaaggaaaaaatgtacttag

SEQ ID NO: 8190824 - DNA, 22 bp, Homo sapiens
tttaagcagagaaatgatgtat

SEQ ID NO: 8190825 - DNA, 19 bp, Homo sapiens
tttaagcatagaggccaga

SEQ ID NO: 8190826 - DNA, 22 bp, Homo sapiens
tttaagctaatgtcataattag

SEQ ID NO: 8190827 - DNA, 22 bp, Homo sapiens
tttaagctaatgtcataattag

SEQ ID NO: 8190828 - DNA, 22 bp, Homo sapiens
tttaagctgtggcattaattct

SEQ ID NO: 8190829 - DNA, 22 bp, Homo sapiens
tttaagcacagggataaagtta

SEQ ID NO: 8190830 - DNA, 22 bp, Homo sapiens
tttaagcacagggataaagtta

SEQ ID NO: 8190831 - DNA, 19 bp, Homo sapiens
tttaagcaatagtatcttg

SEQ ID NO: 8190832 - DNA, 22 bp, Homo sapiens
tttaagattcagtaaggcaaac

SEQ ID NO: 8190833 - DNA, 22 bp, Homo sapiens
tttaagattcagtaaggcaaac

SEQ ID NO: 8190834 - DNA, 22 bp, Homo sapiens
tttaatgatagtcttacgaaaa

SEQ ID NO: 8190835 - DNA, 22 bp, Homo sapiens
tttaatgggatccatctggtta

SEQ ID NO: 8190836 - DNA, 22 bp, Homo sapiens
tttaatggcaagaaggctgcag

SEQ ID NO: 8190837 - DNA, 22 bp, Homo sapiens
tttaatgtagcgtgaaatgatt

SEQ ID NO: 8190838 - DNA, 22 bp, Homo sapiens
tttaatgtagcgtgaaatgatt

SEQ ID NO: 8190839 - DNA, 22 bp, Homo sapiens
tttaatgtattctttggaacca

SEQ ID NO: 8190840 - DNA, 23 bp, Homo sapiens
tttacagggcactcttatgcagc

SEQ ID NO: 8190841 - DNA, 19 bp, Homo sapiens
tttacagggaatggagacc

SEQ ID NO: 8190842 - DNA, 19 bp, Homo sapiens
tttacagggaatggagacc

SEQ ID NO: 8190843 - DNA, 22 bp, Homo sapiens
tttacagggaatattttggctt

SEQ ID NO: 8190844 - DNA, 22 bp, Homo sapiens
tttacaggaagctgaaaaacat

SEQ ID NO: 8190845 - DNA, 22 bp, Homo sapiens
tttacaggaagctgaaaaacat

SEQ ID NO: 8190846 - DNA, 22 bp, Homo sapiens
tttacaggattaccctggctgc

SEQ ID NO: 8190847 - DNA, 22 bp, Homo sapiens
tttacaggattaccctggctgc

SEQ ID NO: 8190848 - DNA, 22 bp, Homo sapiens
tttacagtctctatagtcaaaa

SEQ ID NO: 8190849 - DNA, 22 bp, Homo sapiens
tttacagtctctatagtcaaaa

SEQ ID NO: 8190850 - DNA, 22 bp, Homo sapiens
tttacagtctctatagtcaaaa

SEQ ID NO: 8190851 - DNA, 22 bp, Homo sapiens
tttacagtctctatagtcaaaa

SEQ ID NO: 8190852 - DNA, 22 bp, Homo sapiens
tttacagtctctatagtcaaaa

SEQ ID NO: 8190853 - DNA, 22 bp, Homo sapiens
tttacagtctctatagtcaaaa

SEQ ID NO: 8190854 - DNA, 22 bp, Homo sapiens
tttacagtctatgttgaattaa

SEQ ID NO: 8190855 - DNA, 22 bp, Homo sapiens
tttacagtctatgttgaattaa

SEQ ID NO: 8190856 - DNA, 22 bp, Homo sapiens
tttacagtctatgttgaattaa

SEQ ID NO: 8190857 - DNA, 22 bp, Homo sapiens
tttacagtctatgttgaattaa

SEQ ID NO: 8190858 - DNA, 22 bp, Homo sapiens
tttacagtctatgttgaattaa

SEQ ID NO: 8190859 - DNA, 22 bp, Homo sapiens
tttacagtccccaggtgaggat

SEQ ID NO: 8190860 - DNA, 22 bp, Homo sapiens
tttacagtccccaggtgaggat

SEQ ID NO: 8190861 - DNA, 22 bp, Homo sapiens
tttacagtccccaggtgaggat

SEQ ID NO: 8190862 - DNA, 22 bp, Homo sapiens
tttacagtcaccaaactttgct

SEQ ID NO: 8190863 - DNA, 22 bp, Homo sapiens
tttacagtcaccaaactttgct

SEQ ID NO: 8190864 - DNA, 22 bp, Homo sapiens
tttacagtcaccaaactttgct

SEQ ID NO: 8190865 - DNA, 22 bp, Homo sapiens
tttacagtccccaggtgaggat

SEQ ID NO: 8190866 - DNA, 22 bp, Homo sapiens
tttacagtcaccaaactttgct

SEQ ID NO: 8190867 - DNA, 22 bp, Homo sapiens
tttacagtcaccaaactttgct

SEQ ID NO: 8190868 - DNA, 22 bp, Homo sapiens
tttacagtcaccaaactttgct

SEQ ID NO: 8190869 - DNA, 22 bp, Homo sapiens
tttacagtatagtaggactcat

SEQ ID NO: 8190870 - DNA, 22 bp, Homo sapiens
tttacagtatagtaggactcat

SEQ ID NO: 8190871 - DNA, 22 bp, Homo sapiens
tttacagtatagtaggactcat

SEQ ID NO: 8190872 - DNA, 22 bp, Homo sapiens
tttacagtatagtaggactcat

SEQ ID NO: 8190873 - DNA, 22 bp, Homo sapiens
tttacagtaaggtggatggtac

SEQ ID NO: 8190874 - DNA, 22 bp, Homo sapiens
tttacagtaaggtggatggtac

SEQ ID NO: 8190875 - DNA, 22 bp, Homo sapiens
tttacagtaaggtggatggtac

SEQ ID NO: 8190876 - DNA, 22 bp, Homo sapiens
tttacagtaaggtggatggtac

SEQ ID NO: 8190877 - DNA, 22 bp, Homo sapiens
tttacagggttcaagaatgaaa

SEQ ID NO: 8190878 - DNA, 23 bp, Homo sapiens
tttacagggcactcttatgcagc

SEQ ID NO: 8190879 - DNA, 22 bp, Homo sapiens
tttacagggttcaagaatgaaa

SEQ ID NO: 8190880 - DNA, 22 bp, Homo sapiens
tttacagggttcaagaatgaaa

SEQ ID NO: 8190881 - DNA, 22 bp, Homo sapiens
tttagagaggctctgtaaaatg

SEQ ID NO: 8190882 - DNA, 22 bp, Homo sapiens
tttagagagcactgtagacact

SEQ ID NO: 8190883 - DNA, 22 bp, Homo sapiens
tttagaggttggggactttgca

SEQ ID NO: 8190884 - DNA, 22 bp, Homo sapiens
tttagaggttagaggctgatag

SEQ ID NO: 8190885 - DNA, 22 bp, Homo sapiens
tttagaggggaaagtggctggt

SEQ ID NO: 8190886 - DNA, 22 bp, Homo sapiens
tttagcaaattactcacagggt

SEQ ID NO: 8190887 - DNA, 22 bp, Homo sapiens
tttagcaaactttggagtttgt

SEQ ID NO: 8190888 - DNA, 22 bp, Homo sapiens
tttagataatgctcaagcaatt

SEQ ID NO: 8190889 - DNA, 22 bp, Homo sapiens
tttagatgctgtatgttatttc

SEQ ID NO: 8190890 - DNA, 22 bp, Homo sapiens
tttagagtccttgctcttattc

SEQ ID NO: 8190891 - DNA, 22 bp, Homo sapiens
tttagagtctttaggagaaatg

SEQ ID NO: 8190892 - DNA, 22 bp, Homo sapiens
tttagagttaattccattctgt

SEQ ID NO: 8190893 - DNA, 22 bp, Homo sapiens
tttagagttgagtattcattgg

SEQ ID NO: 8190894 - DNA, 22 bp, Homo sapiens
tttagagttgtagctctcagct

SEQ ID NO: 8190895 - DNA, 22 bp, Homo sapiens
tttagaaggactacagtgtgat

SEQ ID NO: 8190896 - DNA, 22 bp, Homo sapiens
tttagaagacagatgcacagcc

SEQ ID NO: 8190897 - DNA, 22 bp, Homo sapiens
tttagaagacagatgcacagcc

SEQ ID NO: 8190898 - DNA, 22 bp, Homo sapiens
tttagaaggactacagtgtgat

SEQ ID NO: 8190899 - DNA, 23 bp, Homo sapiens
tttaccagaatagcaggggagag

SEQ ID NO: 8190900 - DNA, 22 bp, Homo sapiens
tttagaagggctggtcagaaat

SEQ ID NO: 8190901 - DNA, 22 bp, Homo sapiens
tttagaagttcacacatttaaa

SEQ ID NO: 8190902 - DNA, 22 bp, Homo sapiens
tttaccaactgtagatctgcta

SEQ ID NO: 8190903 - DNA, 22 bp, Homo sapiens
tttaccaagagttgtcactgtt

SEQ ID NO: 8190904 - DNA, 20 bp, Homo sapiens
tttaccaactcaccagtatc

SEQ ID NO: 8190905 - DNA, 22 bp, Homo sapiens
tttaccacaataatcatcacaa

SEQ ID NO: 8190906 - DNA, 22 bp, Homo sapiens
tttaccaagctttaattacata

SEQ ID NO: 8190907 - DNA, 22 bp, Homo sapiens
tttaccaaatagattatgtcag

SEQ ID NO: 8190908 - DNA, 20 bp, Homo sapiens
tttaccaaaggagttatgat

SEQ ID NO: 8190909 - DNA, 20 bp, Homo sapiens
tttacattttgaaacagtga

SEQ ID NO: 8190910 - DNA, 20 bp, Homo sapiens
tttacattttgaaacagtga

SEQ ID NO: 8190911 - DNA, 20 bp, Homo sapiens
tttacattttgaaacagtga

SEQ ID NO: 8190912 - DNA, 22 bp, Homo sapiens
tttacagtctgtctagcaatgt

SEQ ID NO: 8190913 - DNA, 22 bp, Homo sapiens
tttacagtctgtctagcaatgt

SEQ ID NO: 8190914 - DNA, 22 bp, Homo sapiens
tttacagtctgtctagcaatgt

SEQ ID NO: 8190915 - DNA, 22 bp, Homo sapiens
tttacagtctgtctagcaatgt

SEQ ID NO: 8190916 - DNA, 22 bp, Homo sapiens
tttacagtctgtctagcaatgt

SEQ ID NO: 8190917 - DNA, 22 bp, Homo sapiens
tttacagtctgtctagcaatgt

SEQ ID NO: 8190918 - DNA, 22 bp, Homo sapiens
tttacagtctgtctagcaatgt

SEQ ID NO: 8190919 - DNA, 22 bp, Homo sapiens
tttacagtgagagcttagtgag

SEQ ID NO: 8190920 - DNA, 22 bp, Homo sapiens
tttacagtgtcttgttgactgt

SEQ ID NO: 8190921 - DNA, 22 bp, Homo sapiens
tttacagtgtcttgttgactgt

SEQ ID NO: 8190922 - DNA, 22 bp, Homo sapiens
tttacatttccctctgtcagtt

SEQ ID NO: 8190923 - DNA, 22 bp, Homo sapiens
tttacagtgtcttgttgactgt

SEQ ID NO: 8190924 - DNA, 22 bp, Homo sapiens
tttacagtgagagcttagtgag

SEQ ID NO: 8190925 - DNA, 22 bp, Homo sapiens
tttacagtgagagcttagtgag

SEQ ID NO: 8190926 - DNA, 22 bp, Homo sapiens
tttacagtgagagcttagtgag

SEQ ID NO: 8190927 - DNA, 22 bp, Homo sapiens
tttatcatcttgtttttaaagc

SEQ ID NO: 8190928 - DNA, 22 bp, Homo sapiens
tttatccaccagggactaggac

SEQ ID NO: 8190929 - DNA, 22 bp, Homo sapiens
tttatcagaggctatgtttcat

SEQ ID NO: 8190930 - DNA, 22 bp, Homo sapiens
tttatcagaagttagagaaaga

SEQ ID NO: 8190931 - DNA, 22 bp, Homo sapiens
tttatcagaggctatgtttcat

SEQ ID NO: 8190932 - DNA, 20 bp, Homo sapiens
tttatcaggcacttactatt

SEQ ID NO: 8190933 - DNA, 22 bp, Homo sapiens
tttatcacagaataagaagtca

SEQ ID NO: 8190934 - DNA, 22 bp, Homo sapiens
tttatcaaacaaattatccagc

SEQ ID NO: 8190935 - DNA, 22 bp, Homo sapiens
tttatccatcatctgctgaagg

SEQ ID NO: 8190936 - DNA, 22 bp, Homo sapiens
tttatctattgtattgttgatg

SEQ ID NO: 8190937 - DNA, 22 bp, Homo sapiens
tttatctattgtattgttgatg

SEQ ID NO: 8190938 - DNA, 22 bp, Homo sapiens
tttatctgaaaaaactcttgga

SEQ ID NO: 8190939 - DNA, 22 bp, Homo sapiens
tttatctcttttgaccaagatt

SEQ ID NO: 8190940 - DNA, 22 bp, Homo sapiens
tttattcaagatgaggttcatg

SEQ ID NO: 8190941 - DNA, 22 bp, Homo sapiens
tttattcaagatgaggttcatg

SEQ ID NO: 8190942 - DNA, 22 bp, Homo sapiens
tttatctgaggaaagcagacaa

SEQ ID NO: 8190943 - DNA, 22 bp, Homo sapiens
tttatctgaggaaagcagacaa

SEQ ID NO: 8190944 - DNA, 22 bp, Homo sapiens
tttagcaataaagggatattaa

SEQ ID NO: 8190945 - DNA, 22 bp, Homo sapiens
tttagcagagcatatgatatcc

SEQ ID NO: 8190946 - DNA, 22 bp, Homo sapiens
tttagcagaatttctctagaag

SEQ ID NO: 8190947 - DNA, 22 bp, Homo sapiens
tttagcagcaaataagtagtgc

SEQ ID NO: 8190948 - DNA, 22 bp, Homo sapiens
tttagcagagttatatggaagt

SEQ ID NO: 8190949 - DNA, 22 bp, Homo sapiens
tttagcagtgaagtgaagtgaa

SEQ ID NO: 8190950 - DNA, 22 bp, Homo sapiens
tttagcaggcagggatgggtgt

SEQ ID NO: 8190951 - DNA, 22 bp, Homo sapiens
tttatatagagatttgtgcatg

SEQ ID NO: 8190952 - DNA, 22 bp, Homo sapiens
tttagcatcgaagtaaatttag

SEQ ID NO: 8190953 - DNA, 22 bp, Homo sapiens
tttatattgtaaaaatggttct

SEQ ID NO: 8190954 - DNA, 22 bp, Homo sapiens
tttatattgtaaaaatggttct

SEQ ID NO: 8190955 - DNA, 22 bp, Homo sapiens
tttatattgggagtcgttttga

SEQ ID NO: 8190956 - DNA, 22 bp, Homo sapiens
tttatattgggagtcgttttga

SEQ ID NO: 8190957 - DNA, 22 bp, Homo sapiens
tttatatttcccaggattggcc

SEQ ID NO: 8190958 - DNA, 22 bp, Homo sapiens
tttatatttcccaggattggcc

SEQ ID NO: 8190959 - DNA, 22 bp, Homo sapiens
tttatatttcccaggattggcc

SEQ ID NO: 8190960 - DNA, 22 bp, Homo sapiens
tttatattgtaaaaatggttct

SEQ ID NO: 8190961 - DNA, 22 bp, Homo sapiens
tttatattgtaaaaatggttct

SEQ ID NO: 8190962 - DNA, 22 bp, Homo sapiens
tttatattgggagtcgttttga

SEQ ID NO: 8190963 - DNA, 22 bp, Homo sapiens
tttatattgggagtcgttttga

SEQ ID NO: 8190964 - DNA, 22 bp, Homo sapiens
tttatattgggagtcgttttga

SEQ ID NO: 8190965 - DNA, 22 bp, Homo sapiens
tttatattgggagtcgttttga

SEQ ID NO: 8190966 - DNA, 22 bp, Homo sapiens
tttatatagagatttgtgcatg

SEQ ID NO: 8190967 - DNA, 22 bp, Homo sapiens
tttatatatggctggtctggat

SEQ ID NO: 8190968 - DNA, 22 bp, Homo sapiens
tttatatagagatttgtgcatg

SEQ ID NO: 8190969 - DNA, 22 bp, Homo sapiens
tttatatagagatttgtgcatg

SEQ ID NO: 8190970 - DNA, 22 bp, Homo sapiens
ttggcagggctgcttgtctagg

SEQ ID NO: 8190971 - DNA, 22 bp, Homo sapiens
ttggcagggccaggctctctct

SEQ ID NO: 8190972 - DNA, 22 bp, Homo sapiens
ttggcagggccaggctctctct

SEQ ID NO: 8190973 - DNA, 22 bp, Homo sapiens
ttggcagtaaaagaaaatgctt

SEQ ID NO: 8190974 - DNA, 22 bp, Homo sapiens
ttggcagggcatcagacacgtg

SEQ ID NO: 8190975 - DNA, 22 bp, Homo sapiens
ttggcagggcatcagacacgtg

SEQ ID NO: 8190976 - DNA, 22 bp, Homo sapiens
ttggcaggatgatagctttgtg

SEQ ID NO: 8190977 - DNA, 22 bp, Homo sapiens
ttggcaggatgatagctttgtg

SEQ ID NO: 8190978 - DNA, 22 bp, Homo sapiens
ttggcaggatgatagctttgtg

SEQ ID NO: 8190979 - DNA, 22 bp, Homo sapiens
ttggcaggaggcttcagttcct

SEQ ID NO: 8190980 - DNA, 22 bp, Homo sapiens
ttggcaggaggcttcagttcct

SEQ ID NO: 8190981 - DNA, 22 bp, Homo sapiens
ttggcaggaatattgcagaggt

SEQ ID NO: 8190982 - DNA, 22 bp, Homo sapiens
ttggcaggaatattgcagaggt

SEQ ID NO: 8190983 - DNA, 22 bp, Homo sapiens
ttggcaggaatattgcagaggt

SEQ ID NO: 8190984 - DNA, 22 bp, Homo sapiens
ttggcagtgtctgcaaaatgga

SEQ ID NO: 8190985 - DNA, 22 bp, Homo sapiens
ttggcagtgatgcagcttgttc

SEQ ID NO: 8190986 - DNA, 22 bp, Homo sapiens
ttggaggaaagaaggttgatat

SEQ ID NO: 8190987 - DNA, 22 bp, Homo sapiens
ttggaggaagctcatgggggat

SEQ ID NO: 8190988 - DNA, 22 bp, Homo sapiens
ttggaggaaattgcttttgtgg

SEQ ID NO: 8190989 - DNA, 22 bp, Homo sapiens
ttggaggactagttaagagacc

SEQ ID NO: 8190990 - DNA, 22 bp, Homo sapiens
ttggcagcatccaagtctcggg

SEQ ID NO: 8190991 - DNA, 22 bp, Homo sapiens
ttggcagcatacagttggattg

SEQ ID NO: 8190992 - DNA, 22 bp, Homo sapiens
ttggcagcattccagccaagca

SEQ ID NO: 8190993 - DNA, 20 bp, Homo sapiens
ttggcagcagttccaagtga

SEQ ID NO: 8190994 - DNA, 22 bp, Homo sapiens
ttggaggaggcattggaggatt

SEQ ID NO: 8190995 - DNA, 22 bp, Homo sapiens
ttggcagctacttccccagtgc

SEQ ID NO: 8190996 - DNA, 22 bp, Homo sapiens
ttggcagctcttgatggcaccc

SEQ ID NO: 8190997 - DNA, 22 bp, Homo sapiens
ttggcagcggggaccctggctg

SEQ ID NO: 8190998 - DNA, 23 bp, Homo sapiens
ttggcagcgggtcaggctgtggg

SEQ ID NO: 8190999 - DNA, 23 bp, Homo sapiens
ttggcagcgggtcaggctgtggg

SEQ ID NO: 8191000 - DNA, 22 bp, Homo sapiens
ttggcagcccagcttactagca

SEQ ID NO: 8191001 - DNA, 22 bp, Homo sapiens
ttggcagccaggacccgcctgg

SEQ ID NO: 8191002 - DNA, 22 bp, Homo sapiens
ttggcagccctgacccaatggg

SEQ ID NO: 8191003 - DNA, 19 bp, Homo sapiens
ttggcagctgagatcctgc

SEQ ID NO: 8191004 - DNA, 22 bp, Homo sapiens
ttggcagctgttggaccttgac

SEQ ID NO: 8191005 - DNA, 22 bp, Homo sapiens
ttggcagctgcacagactccat

SEQ ID NO: 8191006 - DNA, 20 bp, Homo sapiens
ttggcagcttcagggtacta

SEQ ID NO: 8191007 - DNA, 22 bp, Homo sapiens
ttggcaggaatattgcagaggt

SEQ ID NO: 8191008 - DNA, 22 bp, Homo sapiens
ttggcaggaatattgcagaggt

SEQ ID NO: 8191009 - DNA, 22 bp, Homo sapiens
ttggaccaattcctgatatttt

SEQ ID NO: 8191010 - DNA, 21 bp, Homo sapiens
ttggacttttgcgtgattgag

SEQ ID NO: 8191011 - DNA, 22 bp, Homo sapiens
ttggagaatgttttcctgcagt

SEQ ID NO: 8191012 - DNA, 22 bp, Homo sapiens
ttggagagattatcagaccagc

SEQ ID NO: 8191013 - DNA, 22 bp, Homo sapiens
ttggagagaggctgctcaggct

SEQ ID NO: 8191014 - DNA, 22 bp, Homo sapiens
ttggagagaggctgctcaggct

SEQ ID NO: 8191015 - DNA, 22 bp, Homo sapiens
ttggagccctgaggatctggat

SEQ ID NO: 8191016 - DNA, 22 bp, Homo sapiens
ttggagccatgcccagctctct

SEQ ID NO: 8191017 - DNA, 22 bp, Homo sapiens
ttggagccatgcccagctctct

SEQ ID NO: 8191018 - DNA, 22 bp, Homo sapiens
ttggagatatcacaccttcaca

SEQ ID NO: 8191019 - DNA, 22 bp, Homo sapiens
ttggagatatcacaccttcaca

SEQ ID NO: 8191020 - DNA, 22 bp, Homo sapiens
ttggagatatcacaccttcaca

SEQ ID NO: 8191021 - DNA, 22 bp, Homo sapiens
ttggagatatcacaccttcaca

SEQ ID NO: 8191022 - DNA, 22 bp, Homo sapiens
ttggagagttaattgacagtta

SEQ ID NO: 8191023 - DNA, 22 bp, Homo sapiens
ttggagagtgatattcagatgc

SEQ ID NO: 8191024 - DNA, 23 bp, Homo sapiens
ttggagagggtgagtagtgtcag

SEQ ID NO: 8191025 - DNA, 23 bp, Homo sapiens
ttggagagggtgagtagtgtcag

SEQ ID NO: 8191026 - DNA, 23 bp, Homo sapiens
ttggagagggtgagtagtgtcag

SEQ ID NO: 8191027 - DNA, 22 bp, Homo sapiens
ttggagagggcttggatcacac

SEQ ID NO: 8191028 - DNA, 22 bp, Homo sapiens
ttggagagatttaggtctcagt

SEQ ID NO: 8191029 - DNA, 22 bp, Homo sapiens
ttggagagcagtaaaccacact

SEQ ID NO: 8191030 - DNA, 22 bp, Homo sapiens
ttggagagatttaggtctcagt

SEQ ID NO: 8191031 - DNA, 22 bp, Homo sapiens
ttggagaggcagtcttgctctg

SEQ ID NO: 8191032 - DNA, 22 bp, Homo sapiens
ttggagagggcttggatcacac

SEQ ID NO: 8191033 - DNA, 22 bp, Homo sapiens
ttgggcaggtgtggctctcctt

SEQ ID NO: 8191034 - DNA, 22 bp, Homo sapiens
ttgggcaggtgaagagagggct

SEQ ID NO: 8191035 - DNA, 22 bp, Homo sapiens
ttgggcaggtgaagagagggct

SEQ ID NO: 8191036 - DNA, 22 bp, Homo sapiens
ttgggcagggaaaggacaggca

SEQ ID NO: 8191037 - DNA, 22 bp, Homo sapiens
ttgggcagggaaaggacaggca

SEQ ID NO: 8191038 - DNA, 22 bp, Homo sapiens
ttgggcagtctggctgcagagt

SEQ ID NO: 8191039 - DNA, 22 bp, Homo sapiens
ttgggagctggaagcaaggcct

SEQ ID NO: 8191040 - DNA, 22 bp, Homo sapiens
ttgggagagtttacatcctttt

SEQ ID NO: 8191041 - DNA, 22 bp, Homo sapiens
ttgggacatctggcatacagtt

SEQ ID NO: 8191042 - DNA, 22 bp, Homo sapiens
ttgggacatgtaagctggaagt

SEQ ID NO: 8191043 - DNA, 22 bp, Homo sapiens
ttgggagacaaaggctctgtct

SEQ ID NO: 8191044 - DNA, 17 bp, Homo sapiens
ttgggagagaaaggtat

SEQ ID NO: 8191045 - DNA, 22 bp, Homo sapiens
ttgggaagaggcccctggattc

SEQ ID NO: 8191046 - DNA, 22 bp, Homo sapiens
ttgggaaggcgtggaagcagaa

SEQ ID NO: 8191047 - DNA, 22 bp, Homo sapiens
ttgggaagtttaatgacagact

SEQ ID NO: 8191048 - DNA, 22 bp, Homo sapiens
ttgggaagtaatatggtggtct

SEQ ID NO: 8191049 - DNA, 22 bp, Homo sapiens
ttggccatgacaggacaggaag

SEQ ID NO: 8191050 - DNA, 22 bp, Homo sapiens
ttgggaagtttaatgacagact

SEQ ID NO: 8191051 - DNA, 22 bp, Homo sapiens
ttgggacagaaaaggagaagat

SEQ ID NO: 8191052 - DNA, 22 bp, Homo sapiens
ttgggacagctgtggtagtgag

SEQ ID NO: 8191053 - DNA, 22 bp, Homo sapiens
ttgggacagagctggggctgga

SEQ ID NO: 8191054 - DNA, 22 bp, Homo sapiens
ttgggacagaaaaggagaagat

SEQ ID NO: 8191055 - DNA, 22 bp, Homo sapiens
ttggccatctaagcccagccac

SEQ ID NO: 8191056 - DNA, 22 bp, Homo sapiens
ttggccatctaagcccagccac

SEQ ID NO: 8191057 - DNA, 22 bp, Homo sapiens
ttggccagtggaaagaggagga

SEQ ID NO: 8191058 - DNA, 22 bp, Homo sapiens
ttggccagtgaaccaggcctgg

SEQ ID NO: 8191059 - DNA, 22 bp, Homo sapiens
ttggccagtgcttgtgattttc

SEQ ID NO: 8191060 - DNA, 22 bp, Homo sapiens
ttggccaggtgtccagcccagg

SEQ ID NO: 8191061 - DNA, 22 bp, Homo sapiens
ttggccaggtgtaggtcacacc

SEQ ID NO: 8191062 - DNA, 22 bp, Homo sapiens
ttggcataccttagtggtggag

SEQ ID NO: 8191063 - DNA, 22 bp, Homo sapiens
ttggcattcatgggacaacaaa

SEQ ID NO: 8191064 - DNA, 22 bp, Homo sapiens
ttggcataccttagtggtggag

SEQ ID NO: 8191065 - DNA, 22 bp, Homo sapiens
ttggccaggtgtaggtcacacc

SEQ ID NO: 8191066 - DNA, 22 bp, Homo sapiens
ttggccaggtccatttctccat

SEQ ID NO: 8191067 - DNA, 22 bp, Homo sapiens
ttggccagctctggaaagtggt

SEQ ID NO: 8191068 - DNA, 22 bp, Homo sapiens
ttggccaggcatgaataaaaga

SEQ ID NO: 8191069 - DNA, 22 bp, Homo sapiens
ttggccagcagctctggcttag

SEQ ID NO: 8191070 - DNA, 22 bp, Homo sapiens
ttggccagcgacgaccttctta

SEQ ID NO: 8191071 - DNA, 22 bp, Homo sapiens
ttgtaaatgaccttttctaatt

SEQ ID NO: 8191072 - DNA, 22 bp, Homo sapiens
ttgtaaatagtagtaagatgcc

SEQ ID NO: 8191073 - DNA, 22 bp, Homo sapiens
ttgtaaagctttgagactacat

SEQ ID NO: 8191074 - DNA, 22 bp, Homo sapiens
ttgtaaagatgcttcccattct

SEQ ID NO: 8191075 - DNA, 22 bp, Homo sapiens
ttgtaaagatgcttcccattct

SEQ ID NO: 8191076 - DNA, 23 bp, Homo sapiens
ttgtaaaacagtgtgacggttcc

SEQ ID NO: 8191077 - DNA, 22 bp, Homo sapiens
ttgtaacaggtactaaataact

SEQ ID NO: 8191078 - DNA, 22 bp, Homo sapiens
ttgtaacactcccactcttctt

SEQ ID NO: 8191079 - DNA, 22 bp, Homo sapiens
ttgtatttcgatgcacgtgtag

SEQ ID NO: 8191080 - DNA, 22 bp, Homo sapiens
ttgtatttcgatgcacgtgtag

SEQ ID NO: 8191081 - DNA, 22 bp, Homo sapiens
ttgtatttcctataacctttct

SEQ ID NO: 8191082 - DNA, 22 bp, Homo sapiens
ttgtatttcgatgcacgtgtag

SEQ ID NO: 8191083 - DNA, 22 bp, Homo sapiens
ttgtatttcgatgcacgtgtag

SEQ ID NO: 8191084 - DNA, 22 bp, Homo sapiens
ttgtcaaatccttgtcatctgc

SEQ ID NO: 8191085 - DNA, 22 bp, Homo sapiens
ttgtattttttcctggcggtgg

SEQ ID NO: 8191086 - DNA, 22 bp, Homo sapiens
ttgtattttttcctggcggtgg

SEQ ID NO: 8191087 - DNA, 22 bp, Homo sapiens
ttgtatttctccactttctgtt

SEQ ID NO: 8191088 - DNA, 23 bp, Homo sapiens
ttgtatttttagtagagacaggg

SEQ ID NO: 8191089 - DNA, 23 bp, Homo sapiens
ttgtatttttagtagagacaggg

SEQ ID NO: 8191090 - DNA, 19 bp, Homo sapiens
ttgtacagcaaccaaccct

SEQ ID NO: 8191091 - DNA, 22 bp, Homo sapiens
ttgtacataatgaaaggaggct

SEQ ID NO: 8191092 - DNA, 22 bp, Homo sapiens
ttgtacattctgaatctgtcct

SEQ ID NO: 8191093 - DNA, 22 bp, Homo sapiens
ttgtacataatgaaaggaggct

SEQ ID NO: 8191094 - DNA, 22 bp, Homo sapiens
ttgtacattctatgggtttgga

SEQ ID NO: 8191095 - DNA, 22 bp, Homo sapiens
ttgtacatttgttcagttctga

SEQ ID NO: 8191096 - DNA, 22 bp, Homo sapiens
ttgtactatcaccatgtcatgt

SEQ ID NO: 8191097 - DNA, 22 bp, Homo sapiens
ttgtacagaccctgaaaagctc

SEQ ID NO: 8191098 - DNA, 22 bp, Homo sapiens
ttgtacactgttgatgggaatg

SEQ ID NO: 8191099 - DNA, 22 bp, Homo sapiens
ttgtacactctttttattccgt

SEQ ID NO: 8191100 - DNA, 22 bp, Homo sapiens
ttgtacaagtattatgtgaaca

SEQ ID NO: 8191101 - DNA, 22 bp, Homo sapiens
ttgtacaagtattatgtgaaca

SEQ ID NO: 8191102 - DNA, 22 bp, Homo sapiens
ttgtacaagttttgagcttaag

SEQ ID NO: 8191103 - DNA, 22 bp, Homo sapiens
ttgtacaagttttgagcttaag

SEQ ID NO: 8191104 - DNA, 22 bp, Homo sapiens
ttgtacaagttttgagcttaag

SEQ ID NO: 8191105 - DNA, 22 bp, Homo sapiens
ttgtaagtcacaccagggcagg

SEQ ID NO: 8191106 - DNA, 22 bp, Homo sapiens
ttgtcaggaactatgattatgc

SEQ ID NO: 8191107 - DNA, 22 bp, Homo sapiens
ttgtcaggcctatgagagatct

SEQ ID NO: 8191108 - DNA, 22 bp, Homo sapiens
ttgtcattggggttatttgtta

SEQ ID NO: 8191109 - DNA, 22 bp, Homo sapiens
ttgtcattggggttatttgtta

SEQ ID NO: 8191110 - DNA, 22 bp, Homo sapiens
ttgtccaaggtcccacagttag

SEQ ID NO: 8191111 - DNA, 22 bp, Homo sapiens
ttgtcacaggaaagggtgcaag

SEQ ID NO: 8191112 - DNA, 22 bp, Homo sapiens
ttgtcacaggaaagggtgcaag

SEQ ID NO: 8191113 - DNA, 17 bp, Homo sapiens
ttgtcacaggtggtggt

SEQ ID NO: 8191114 - DNA, 20 bp, Homo sapiens
ttgtcacagctttccatcag

SEQ ID NO: 8191115 - DNA, 22 bp, Homo sapiens
ttgtcacattcaagttttatat

SEQ ID NO: 8191116 - DNA, 22 bp, Homo sapiens
ttgtcacatgtagttcattctc

SEQ ID NO: 8191117 - DNA, 22 bp, Homo sapiens
ttgtcaaggcttttaatattct

SEQ ID NO: 8191118 - DNA, 19 bp, Homo sapiens
ttgtcacaattcatcaggt

SEQ ID NO: 8191119 - DNA, 22 bp, Homo sapiens
ttgtcacagcagcaaaggctct

SEQ ID NO: 8191120 - DNA, 22 bp, Homo sapiens
ttgtcacagacatcccaggtga

SEQ ID NO: 8191121 - DNA, 22 bp, Homo sapiens
ttgtcacacccttttttatacc

SEQ ID NO: 8191122 - DNA, 22 bp, Homo sapiens
ttgtcctgcaggtggctgggag

SEQ ID NO: 8191123 - DNA, 22 bp, Homo sapiens
ttgtcctgcaacctcacatggc

SEQ ID NO: 8191124 - DNA, 22 bp, Homo sapiens
ttgtcctgcaacctcacatggc

SEQ ID NO: 8191125 - DNA, 23 bp, Homo sapiens
ttgtcctgccgatctctgagaat

SEQ ID NO: 8191126 - DNA, 22 bp, Homo sapiens
ttgtcctgagataaggaacaga

SEQ ID NO: 8191127 - DNA, 22 bp, Homo sapiens
ttgtcctgaggactgttatcag

SEQ ID NO: 8191128 - DNA, 22 bp, Homo sapiens
ttgtcctgatttataaaatgaa

SEQ ID NO: 8191129 - DNA, 22 bp, Homo sapiens
ttgtcctgattttgcaacttct

SEQ ID NO: 8191130 - DNA, 22 bp, Homo sapiens
ttgtcctgcaacctcacatggc

SEQ ID NO: 8191131 - DNA, 22 bp, Homo sapiens
ttgtcctggaggttaatagagt

SEQ ID NO: 8191132 - DNA, 22 bp, Homo sapiens
ttgtcctggaggttaatagagt

SEQ ID NO: 8191133 - DNA, 23 bp, Homo sapiens
ttgtcctgccgatctctgagaat

SEQ ID NO: 8191134 - DNA, 22 bp, Homo sapiens
ttgtcctggaggttaatagagt

SEQ ID NO: 8191135 - DNA, 22 bp, Homo sapiens
ttgtcctggcccaaatgtcaac

SEQ ID NO: 8191136 - DNA, 22 bp, Homo sapiens
ttgtcctgtcaggctgggggct

SEQ ID NO: 8191137 - DNA, 22 bp, Homo sapiens
ttgtcctgtcaggctgggggct

SEQ ID NO: 8191138 - DNA, 16 bp, Homo sapiens
ttgtcctgtctcactg

SEQ ID NO: 8191139 - DNA, 22 bp, Homo sapiens
ttgtcctgtgatttcagggcct

SEQ ID NO: 8191140 - DNA, 23 bp, Homo sapiens
ttgtcctctggatcggtttggtt

SEQ ID NO: 8191141 - DNA, 22 bp, Homo sapiens
ttgtccgtggtgagttcgcatt

SEQ ID NO: 8191142 - DNA, 22 bp, Homo sapiens
ttgtccattgtgacaagtgtgg

SEQ ID NO: 8191143 - DNA, 23 bp, Homo sapiens
ttgtccagctggtttgggccaca

SEQ ID NO: 8191144 - DNA, 22 bp, Homo sapiens
ttgtccagcgaccaggctctgt

SEQ ID NO: 8191145 - DNA, 22 bp, Homo sapiens
ttgtgtcctgatttgacacaat

SEQ ID NO: 8191146 - DNA, 22 bp, Homo sapiens
ttgtgtcctctaatctcaccac

SEQ ID NO: 8191147 - DNA, 21 bp, Homo sapiens
ttgtgtccttctaaagggcca

SEQ ID NO: 8191148 - DNA, 22 bp, Homo sapiens
ttgtgtcctgatttgacacaat

SEQ ID NO: 8191149 - DNA, 21 bp, Homo sapiens
ttgtgtccttctaaagggcca

SEQ ID NO: 8191150 - DNA, 22 bp, Homo sapiens
ttgtgtccctgtaagacaaagc

SEQ ID NO: 8191151 - DNA, 22 bp, Homo sapiens
ttgtgtccctggagcttctgtg

SEQ ID NO: 8191152 - DNA, 22 bp, Homo sapiens
ttgtgtccctgcggctgaggag

SEQ ID NO: 8191153 - DNA, 22 bp, Homo sapiens
ttgtgtcctatatgcatgttct

SEQ ID NO: 8191154 - DNA, 22 bp, Homo sapiens
ttgtgtcctaagcaccagatgg

SEQ ID NO: 8191155 - DNA, 22 bp, Homo sapiens
ttgtgtcctaacatctagttaa

SEQ ID NO: 8191156 - DNA, 22 bp, Homo sapiens
ttgtgtctggaatgcgtggagc

SEQ ID NO: 8191157 - DNA, 23 bp, Homo sapiens
ttgtgtctacttcctatctaggg

SEQ ID NO: 8191158 - DNA, 22 bp, Homo sapiens
ttgtgtctaaataaggagacct

SEQ ID NO: 8191159 - DNA, 23 bp, Homo sapiens
ttgtgtctacttcctatctaggg

SEQ ID NO: 8191160 - DNA, 22 bp, Homo sapiens
ttgtgtccatttgagtcatgtg

SEQ ID NO: 8191161 - DNA, 22 bp, Homo sapiens
ttgtgtccaaggctatggtgat

SEQ ID NO: 8191162 - DNA, 22 bp, Homo sapiens
ttgtgtcccctgttctacctgt

SEQ ID NO: 8191163 - DNA, 22 bp, Homo sapiens
ttgtgtccccctttgagagcca

SEQ ID NO: 8191164 - DNA, 22 bp, Homo sapiens
ttgtgtccccctttgagagcca

SEQ ID NO: 8191165 - DNA, 22 bp, Homo sapiens
ttgtgtatttcctgaaggtaag

SEQ ID NO: 8191166 - DNA, 22 bp, Homo sapiens
ttgtgtcaggggcccatactca

SEQ ID NO: 8191167 - DNA, 22 bp, Homo sapiens
ttgtggctcgtgagatgttagg

SEQ ID NO: 8191168 - DNA, 22 bp, Homo sapiens
ttgtcctgtgatttcagggcct

SEQ ID NO: 8191169 - DNA, 22 bp, Homo sapiens
ttgtcctgtgtctgtttggatt

SEQ ID NO: 8191170 - DNA, 22 bp, Homo sapiens
ttgtcctgttacttgtttggat

SEQ ID NO: 8191171 - DNA, 22 bp, Homo sapiens
ttgtcctgtgtctgtttggatt

SEQ ID NO: 8191172 - DNA, 22 bp, Homo sapiens
ttgtcctgttacttgtttggat

SEQ ID NO: 8191173 - DNA, 22 bp, Homo sapiens
ttgtcctgtttagggataagga

SEQ ID NO: 8191174 - DNA, 22 bp, Homo sapiens
ttgctgtgaaaccatgggaagt

SEQ ID NO: 8191175 - DNA, 23 bp, Homo sapiens
ttgctgagataaagaatgcaggg

SEQ ID NO: 8191176 - DNA, 22 bp, Homo sapiens
ttgctgtgtaactcctggcctg

SEQ ID NO: 8191177 - DNA, 22 bp, Homo sapiens
ttgctgtgtcatttgtttaatc

SEQ ID NO: 8191178 - DNA, 22 bp, Homo sapiens
ttgctgtgtctgatggctgaga

SEQ ID NO: 8191179 - DNA, 22 bp, Homo sapiens
ttgctgtttaatgatgtcttat

SEQ ID NO: 8191180 - DNA, 22 bp, Homo sapiens
ttgctgttttacatctggtggg

SEQ ID NO: 8191181 - DNA, 21 bp, Homo sapiens
ttgctgttttcccaatgcagt

SEQ ID NO: 8191182 - DNA, 22 bp, Homo sapiens
ttgcttatttgattaaatgtct

SEQ ID NO: 8191183 - DNA, 23 bp, Homo sapiens
ttgcttagagacctcctcatcag

SEQ ID NO: 8191184 - DNA, 22 bp, Homo sapiens
ttgctctccagaggctcacagc

SEQ ID NO: 8191185 - DNA, 22 bp, Homo sapiens
ttgctctcggggaggctgcagg

SEQ ID NO: 8191186 - DNA, 22 bp, Homo sapiens
ttgctctatgtttgtaaacaga

SEQ ID NO: 8191187 - DNA, 22 bp, Homo sapiens
ttgctccaggctgcagactctg

SEQ ID NO: 8191188 - DNA, 22 bp, Homo sapiens
ttgcatttactgcaccgtgagt

SEQ ID NO: 8191189 - DNA, 22 bp, Homo sapiens
ttgcatttatagactgccattt

SEQ ID NO: 8191190 - DNA, 18 bp, Homo sapiens
ttgctcttctatgtcaat

SEQ ID NO: 8191191 - DNA, 22 bp, Homo sapiens
ttgctctgtcagggcctcagtc

SEQ ID NO: 8191192 - DNA, 22 bp, Homo sapiens
ttgctctgaacccagggcacca

SEQ ID NO: 8191193 - DNA, 22 bp, Homo sapiens
ttgctctgattaggtggaaaca

SEQ ID NO: 8191194 - DNA, 21 bp, Homo sapiens
ttgcattaaatccagactcaa

SEQ ID NO: 8191195 - DNA, 22 bp, Homo sapiens
ttgcatgtttttgtaatacacc

SEQ ID NO: 8191196 - DNA, 23 bp, Homo sapiens
ttgcattaatgtggaggcacagg

SEQ ID NO: 8191197 - DNA, 22 bp, Homo sapiens
ttgcattacatttgctcagtct

SEQ ID NO: 8191198 - DNA, 22 bp, Homo sapiens
ttgcattccatggttttccttc

SEQ ID NO: 8191199 - DNA, 22 bp, Homo sapiens
ttgcatgtgtataaaagttgga

SEQ ID NO: 8191200 - DNA, 22 bp, Homo sapiens
ttgcatgtgtaatttttctaaa

SEQ ID NO: 8191201 - DNA, 22 bp, Homo sapiens
ttgcatgttccaaagaattttg

SEQ ID NO: 8191202 - DNA, 19 bp, Homo sapiens
ttgcattgtagttggactg

SEQ ID NO: 8191203 - DNA, 20 bp, Homo sapiens
ttgcattggatgtgcaggtg

SEQ ID NO: 8191204 - DNA, 22 bp, Homo sapiens
ttgcatttaagtagatgttaca

SEQ ID NO: 8191205 - DNA, 22 bp, Homo sapiens
ttgcatttaagtagatgttaca

SEQ ID NO: 8191206 - DNA, 22 bp, Homo sapiens
ttggaaagtgacgttcaactgt

SEQ ID NO: 8191207 - DNA, 22 bp, Homo sapiens
ttggaaagggaggaatgtagac

SEQ ID NO: 8191208 - DNA, 22 bp, Homo sapiens
ttggaaagaagggctgagcaag

SEQ ID NO: 8191209 - DNA, 22 bp, Homo sapiens
ttggaaactttcaagcataatg

SEQ ID NO: 8191210 - DNA, 22 bp, Homo sapiens
ttggaaacgtcaccttttcctt

SEQ ID NO: 8191211 - DNA, 22 bp, Homo sapiens
ttggaaacgtcaccttttcctt

SEQ ID NO: 8191212 - DNA, 22 bp, Homo sapiens
ttggaaacgtcaccttttcctt

SEQ ID NO: 8191213 - DNA, 22 bp, Homo sapiens
ttggaaacgtcaccttttcctt

SEQ ID NO: 8191214 - DNA, 22 bp, Homo sapiens
ttgcttatttgattaaatgtct

SEQ ID NO: 8191215 - DNA, 22 bp, Homo sapiens
ttgctttattgggtttactgcc

SEQ ID NO: 8191216 - DNA, 23 bp, Homo sapiens
ttgctttcatcatgagatgctcc

SEQ ID NO: 8191217 - DNA, 23 bp, Homo sapiens
ttgctttcatcatgagatgctcc

SEQ ID NO: 8191218 - DNA, 22 bp, Homo sapiens
ttggaaaatgtatttctagaag

SEQ ID NO: 8191219 - DNA, 22 bp, Homo sapiens
ttggaaacaattgctttcttcc

SEQ ID NO: 8191220 - DNA, 22 bp, Homo sapiens
ttggaaacaagatttctactta

SEQ ID NO: 8191221 - DNA, 22 bp, Homo sapiens
ttggaaaccaggctttgagacg

SEQ ID NO: 8191222 - DNA, 22 bp, Homo sapiens
ttggaaacgtcaccttttcctt

SEQ ID NO: 8191223 - DNA, 22 bp, Homo sapiens
ttggaaacgtcaccttttcctt

SEQ ID NO: 8191224 - DNA, 23 bp, Homo sapiens
ttggaaacctgttttagctgttt

SEQ ID NO: 8191225 - DNA, 22 bp, Homo sapiens
ttgctttccgtcatgtgctaat

SEQ ID NO: 8191226 - DNA, 22 bp, Homo sapiens
ttggaaaatgtatttctagaag

SEQ ID NO: 8191227 - DNA, 22 bp, Homo sapiens
ttggaaaatgtatttctagaag

SEQ ID NO: 8191228 - DNA, 21 bp, Homo sapiens
ttggaacaagcagcagtttgc

SEQ ID NO: 8191229 - DNA, 23 bp, Homo sapiens
ttggaaatggggagaacagattc

SEQ ID NO: 8191230 - DNA, 22 bp, Homo sapiens
ttggaaatgatttctattatta

SEQ ID NO: 8191231 - DNA, 22 bp, Homo sapiens
ttggacacagctggcctttcca

SEQ ID NO: 8191232 - DNA, 22 bp, Homo sapiens
ttggacagtactttaaagcaga

SEQ ID NO: 8191233 - DNA, 22 bp, Homo sapiens
ttggacagcacagacatagaat

SEQ ID NO: 8191234 - DNA, 22 bp, Homo sapiens
ttggaattttccaggtacagtg

SEQ ID NO: 8191235 - DNA, 21 bp, Homo sapiens
ttggaatttgggagctatgtg

SEQ ID NO: 8191236 - DNA, 22 bp, Homo sapiens
ttggaatttgagaccaagaaaa

SEQ ID NO: 8191237 - DNA, 22 bp, Homo sapiens
ttggaacacaatgtttctttca

SEQ ID NO: 8191238 - DNA, 22 bp, Homo sapiens
ttggaacacaatgtttctttca

SEQ ID NO: 8191239 - DNA, 22 bp, Homo sapiens
ttggaattgaggatttacatag

SEQ ID NO: 8191240 - DNA, 22 bp, Homo sapiens
ttggaattgctattgataacaa

SEQ ID NO: 8191241 - DNA, 22 bp, Homo sapiens
ttgcatgggcaacaggaggtgg

SEQ ID NO: 8191242 - DNA, 22 bp, Homo sapiens
ttgcagtcacactctaaagtag

SEQ ID NO: 8191243 - DNA, 22 bp, Homo sapiens
ttgcagttaaaaatcattagtt

SEQ ID NO: 8191244 - DNA, 18 bp, Homo sapiens
ttgcaggtacctctatct

SEQ ID NO: 8191245 - DNA, 22 bp, Homo sapiens
ttgcaggtctgggggtcctggt

SEQ ID NO: 8191246 - DNA, 22 bp, Homo sapiens
ttgcagggttgaccaataggct

SEQ ID NO: 8191247 - DNA, 22 bp, Homo sapiens
ttgcaggggagaggaacaaaca

SEQ ID NO: 8191248 - DNA, 22 bp, Homo sapiens
ttgcaggggaaggagcagagct

SEQ ID NO: 8191249 - DNA, 22 bp, Homo sapiens
ttgcagggtcctgtggctctcc

SEQ ID NO: 8191250 - DNA, 22 bp, Homo sapiens
ttgcagggtcctgtggctctcc

SEQ ID NO: 8191251 - DNA, 22 bp, Homo sapiens
ttgcaggggaaggagcagagct

SEQ ID NO: 8191252 - DNA, 22 bp, Homo sapiens
ttgcagggctggaacatggaat

SEQ ID NO: 8191253 - DNA, 22 bp, Homo sapiens
ttgcagggcaggaccatggaca

SEQ ID NO: 8191254 - DNA, 22 bp, Homo sapiens
ttgcagggcaggaccatggaca

SEQ ID NO: 8191255 - DNA, 22 bp, Homo sapiens
ttgcagctagaagattcactgt

SEQ ID NO: 8191256 - DNA, 22 bp, Homo sapiens
ttgcagctgctgttcctcatgg

SEQ ID NO: 8191257 - DNA, 22 bp, Homo sapiens
ttgcagcttcgagtctatctgt

SEQ ID NO: 8191258 - DNA, 22 bp, Homo sapiens
ttgcagcttctaacagcttcag

SEQ ID NO: 8191259 - DNA, 22 bp, Homo sapiens
ttgcagcttcttgcatcagaaa

SEQ ID NO: 8191260 - DNA, 22 bp, Homo sapiens
ttgcagggcaaatggtcagata

SEQ ID NO: 8191261 - DNA, 23 bp, Homo sapiens
ttgcagggatggagttcaaaatg

SEQ ID NO: 8191262 - DNA, 22 bp, Homo sapiens
ttgcagggataaaacaagtgaa

SEQ ID NO: 8191263 - DNA, 22 bp, Homo sapiens
ttgcagggataaaacaagtgaa

SEQ ID NO: 8191264 - DNA, 22 bp, Homo sapiens
ttgcagggacctgcagaaagct

SEQ ID NO: 8191265 - DNA, 22 bp, Homo sapiens
ttgcagggacctgcagaaagct

SEQ ID NO: 8191266 - DNA, 22 bp, Homo sapiens
ttgcagggacctgcagaaagct

SEQ ID NO: 8191267 - DNA, 22 bp, Homo sapiens
ttgacaagcgaagtaccataat

SEQ ID NO: 8191268 - DNA, 22 bp, Homo sapiens
ttgacaagtggagatatttaag

SEQ ID NO: 8191269 - DNA, 22 bp, Homo sapiens
ttgacaagtaatacttaaatta

SEQ ID NO: 8191270 - DNA, 22 bp, Homo sapiens
ttgacaaagtttagtaataatc

SEQ ID NO: 8191271 - DNA, 22 bp, Homo sapiens
ttgacaaagtttagtaataatc

SEQ ID NO: 8191272 - DNA, 22 bp, Homo sapiens
ttgacaaatacccattagacca

SEQ ID NO: 8191273 - DNA, 22 bp, Homo sapiens
ttgacacaatgtatattttcaa

SEQ ID NO: 8191274 - DNA, 22 bp, Homo sapiens
ttgacacaatgtatattttcaa

SEQ ID NO: 8191275 - DNA, 22 bp, Homo sapiens
ttgacacaaacagtgatgtagt

SEQ ID NO: 8191276 - DNA, 22 bp, Homo sapiens
ttgacacagatcaatattcaac

SEQ ID NO: 8191277 - DNA, 22 bp, Homo sapiens
ttgacacagatcaatattcaac

SEQ ID NO: 8191278 - DNA, 22 bp, Homo sapiens
ttgacacagatcaatattcaac

SEQ ID NO: 8191279 - DNA, 22 bp, Homo sapiens
ttgacaaaggaattgaatctct

SEQ ID NO: 8191280 - DNA, 22 bp, Homo sapiens
ttgacaaaggaattgaatctct

SEQ ID NO: 8191281 - DNA, 22 bp, Homo sapiens
ttgacaaagatatattcatgct

SEQ ID NO: 8191282 - DNA, 22 bp, Homo sapiens
ttgacaaagatatattcatgct

SEQ ID NO: 8191283 - DNA, 22 bp, Homo sapiens
ttgacaaaggctgagaggaaaa

SEQ ID NO: 8191284 - DNA, 22 bp, Homo sapiens
ttgacaaaggctgagaggaaaa

SEQ ID NO: 8191285 - DNA, 22 bp, Homo sapiens
ttgacaaaggaccttgctattt

SEQ ID NO: 8191286 - DNA, 22 bp, Homo sapiens
ttgacaaaggaccttgctattt

SEQ ID NO: 8191287 - DNA, 22 bp, Homo sapiens
ttgacaaaaacctcatttcacc

SEQ ID NO: 8191288 - DNA, 22 bp, Homo sapiens
ttgacaaaaacctcatttcacc

SEQ ID NO: 8191289 - DNA, 22 bp, Homo sapiens
ttgacaaaaataacacagcata

SEQ ID NO: 8191290 - DNA, 22 bp, Homo sapiens
ttgacaaaaacctcatttcacc

SEQ ID NO: 8191291 - DNA, 22 bp, Homo sapiens
ttgacaaaaataacacagcata

SEQ ID NO: 8191292 - DNA, 22 bp, Homo sapiens
ttgacaaaacaacacagatttc

SEQ ID NO: 8191293 - DNA, 22 bp, Homo sapiens
ttgacaaaacaacacagatttc

SEQ ID NO: 8191294 - DNA, 22 bp, Homo sapiens
ttgcagagcagtaggaatatag

SEQ ID NO: 8191295 - DNA, 22 bp, Homo sapiens
ttgcagagccatgaggctggct

SEQ ID NO: 8191296 - DNA, 22 bp, Homo sapiens
ttgcagaggcaaaaatgaactc

SEQ ID NO: 8191297 - DNA, 22 bp, Homo sapiens
ttgcagagtggttgtgaggatt

SEQ ID NO: 8191298 - DNA, 22 bp, Homo sapiens
ttgcagaattaagcagagagcc

SEQ ID NO: 8191299 - DNA, 22 bp, Homo sapiens
ttgcagagaggttaggaactca

SEQ ID NO: 8191300 - DNA, 22 bp, Homo sapiens
ttgcaattgctatggagagcgt

SEQ ID NO: 8191301 - DNA, 22 bp, Homo sapiens
ttgcaattgctatggagagcgt

SEQ ID NO: 8191302 - DNA, 22 bp, Homo sapiens
ttgcaattagttacaaaagtgg

SEQ ID NO: 8191303 - DNA, 22 bp, Homo sapiens
ttgcaattagttacaaaagtgg

SEQ ID NO: 8191304 - DNA, 22 bp, Homo sapiens
ttgcaattaacatatgtcaact

SEQ ID NO: 8191305 - DNA, 21 bp, Homo sapiens
ttgacaggaaagaggggagat

SEQ ID NO: 8191306 - DNA, 22 bp, Homo sapiens
ttgacacagttttctcattaag

SEQ ID NO: 8191307 - DNA, 22 bp, Homo sapiens
ttgacagaaatgtatttgcatg

SEQ ID NO: 8191308 - DNA, 22 bp, Homo sapiens
ttgacacagatcaatattcaac

SEQ ID NO: 8191309 - DNA, 22 bp, Homo sapiens
ttgacacagttttctcattaag

SEQ ID NO: 8191310 - DNA, 22 bp, Homo sapiens
ttgacagctacggagcagctgt

SEQ ID NO: 8191311 - DNA, 22 bp, Homo sapiens
ttgacagctacctacatggtgg

SEQ ID NO: 8191312 - DNA, 22 bp, Homo sapiens
ttcagagacatgttctagatca

SEQ ID NO: 8191313 - DNA, 22 bp, Homo sapiens
ttcagagacatgttctagatca

SEQ ID NO: 8191314 - DNA, 22 bp, Homo sapiens
ttcagagcatctctaaagccag

SEQ ID NO: 8191315 - DNA, 22 bp, Homo sapiens
ttcagagcagatattgaagggt

SEQ ID NO: 8191316 - DNA, 22 bp, Homo sapiens
ttcagagagtttgtgagtcctt

SEQ ID NO: 8191317 - DNA, 20 bp, Homo sapiens
ttcagagatagggtctttaa

SEQ ID NO: 8191318 - DNA, 22 bp, Homo sapiens
ttcagagatgacacctggtgtt

SEQ ID NO: 8191319 - DNA, 22 bp, Homo sapiens
ttcacaggcttggaggtggggg

SEQ ID NO: 8191320 - DNA, 22 bp, Homo sapiens
ttcacagggcagcagctgagcc

SEQ ID NO: 8191321 - DNA, 22 bp, Homo sapiens
ttcacagggcagcagctgagcc

SEQ ID NO: 8191322 - DNA, 22 bp, Homo sapiens
ttcagcacagttcaagatggta

SEQ ID NO: 8191323 - DNA, 22 bp, Homo sapiens
ttcagtgtcacaagagcaagcc

SEQ ID NO: 8191324 - DNA, 22 bp, Homo sapiens
ttcagtgtccctagtagaagtt

SEQ ID NO: 8191325 - DNA, 22 bp, Homo sapiens
ttcagtgtcacaagagcaagcc

SEQ ID NO: 8191326 - DNA, 22 bp, Homo sapiens
ttcagtgtccctagtagaagtt

SEQ ID NO: 8191327 - DNA, 22 bp, Homo sapiens
ttcagtgtgaagcttctgaaag

SEQ ID NO: 8191328 - DNA, 22 bp, Homo sapiens
ttcagtgtgcctaagtcagttg

SEQ ID NO: 8191329 - DNA, 19 bp, Homo sapiens
ttcagtgtgctggctcctg

SEQ ID NO: 8191330 - DNA, 22 bp, Homo sapiens
ttcagtgtgcttcaggacgtta

SEQ ID NO: 8191331 - DNA, 22 bp, Homo sapiens
ttcagaggacaaccagccatct

SEQ ID NO: 8191332 - DNA, 22 bp, Homo sapiens
ttcagagcttagaatggactac

SEQ ID NO: 8191333 - DNA, 22 bp, Homo sapiens
ttcagagccagcaacactaggc

SEQ ID NO: 8191334 - DNA, 22 bp, Homo sapiens
ttcagagcccaaatggagatta

SEQ ID NO: 8191335 - DNA, 22 bp, Homo sapiens
ttcagagccagcaacactaggc

SEQ ID NO: 8191336 - DNA, 22 bp, Homo sapiens
ttcagagccacttcaagtctaa

SEQ ID NO: 8191337 - DNA, 16 bp, Homo sapiens
ttcagagcggctcata

SEQ ID NO: 8191338 - DNA, 22 bp, Homo sapiens
ttcagagctcagaaaagtgtct

SEQ ID NO: 8191339 - DNA, 22 bp, Homo sapiens
ttcagagctggtgtctacagct

SEQ ID NO: 8191340 - DNA, 22 bp, Homo sapiens
ttcagcaacctataaatcccag

SEQ ID NO: 8191341 - DNA, 22 bp, Homo sapiens
ttcagcaagaatttactgagct

SEQ ID NO: 8191342 - DNA, 22 bp, Homo sapiens
ttcagcaagtgtctctactgtc

SEQ ID NO: 8191343 - DNA, 21 bp, Homo sapiens
ttcagcaagcactctggacac

SEQ ID NO: 8191344 - DNA, 22 bp, Homo sapiens
ttcacagcttaataaggctcag

SEQ ID NO: 8191345 - DNA, 22 bp, Homo sapiens
ttcacagctcatactgttctca

SEQ ID NO: 8191346 - DNA, 23 bp, Homo sapiens
ttcacagattaaatatttcttct

SEQ ID NO: 8191347 - DNA, 22 bp, Homo sapiens
ttcacagatgtattggaactcc

SEQ ID NO: 8191348 - DNA, 22 bp, Homo sapiens
ttcacagatttccctgcacatg

SEQ ID NO: 8191349 - DNA, 22 bp, Homo sapiens
ttcacagatttccctgcacatg

SEQ ID NO: 8191350 - DNA, 22 bp, Homo sapiens
ttcacagagagaactcaaacca

SEQ ID NO: 8191351 - DNA, 22 bp, Homo sapiens
ttcacagagagtatgcagagaa

SEQ ID NO: 8191352 - DNA, 22 bp, Homo sapiens
ttcacagagttatttttatgct

SEQ ID NO: 8191353 - DNA, 20 bp, Homo sapiens
ttcacagaggactcaggtca

SEQ ID NO: 8191354 - DNA, 18 bp, Homo sapiens
ttcacagatccacaggaa

SEQ ID NO: 8191355 - DNA, 22 bp, Homo sapiens
ttcacagagttatttttatgct

SEQ ID NO: 8191356 - DNA, 22 bp, Homo sapiens
ttcacagatgagaaaattgagg

SEQ ID NO: 8191357 - DNA, 21 bp, Homo sapiens
ttcacagatgggaaaactgag

SEQ ID NO: 8191358 - DNA, 21 bp, Homo sapiens
ttcacagatgggaaaactgag

SEQ ID NO: 8191359 - DNA, 21 bp, Homo sapiens
ttcacagatgggaaaactgag

SEQ ID NO: 8191360 - DNA, 21 bp, Homo sapiens
ttcaaagagtgggcattgtca

SEQ ID NO: 8191361 - DNA, 22 bp, Homo sapiens
ttcaaagagttgggtgtctggg

SEQ ID NO: 8191362 - DNA, 22 bp, Homo sapiens
ttcaaagataatgtagcatttt

SEQ ID NO: 8191363 - DNA, 22 bp, Homo sapiens
ttcaaagataattaccaaacat

SEQ ID NO: 8191364 - DNA, 22 bp, Homo sapiens
ttcaaagagaaattgtattttc

SEQ ID NO: 8191365 - DNA, 22 bp, Homo sapiens
ttcaaagaccttacttggcaaa

SEQ ID NO: 8191366 - DNA, 21 bp, Homo sapiens
ttcaaagacttgatgctgacc

SEQ ID NO: 8191367 - DNA, 21 bp, Homo sapiens
ttcaaagacttgatgctgacc

SEQ ID NO: 8191368 - DNA, 22 bp, Homo sapiens
ttcaaagaccttacttggcaaa

SEQ ID NO: 8191369 - DNA, 22 bp, Homo sapiens
ttcaaactgtgtaatttataaa

SEQ ID NO: 8191370 - DNA, 22 bp, Homo sapiens
ttcaaagaattttgagacctga

SEQ ID NO: 8191371 - DNA, 22 bp, Homo sapiens
ttcaaagaattttgagacctga

SEQ ID NO: 8191372 - DNA, 20 bp, Homo sapiens
ttcaaagaccctcaggtcca

SEQ ID NO: 8191373 - DNA, 22 bp, Homo sapiens
ttcacaattaactttatactta

SEQ ID NO: 8191374 - DNA, 22 bp, Homo sapiens
ttcacaatgccttgttgatggt

SEQ ID NO: 8191375 - DNA, 22 bp, Homo sapiens
ttcacaatctggcttagcattg

SEQ ID NO: 8191376 - DNA, 23 bp, Homo sapiens
ttcaaagatcttctgaaatctgt

SEQ ID NO: 8191377 - DNA, 22 bp, Homo sapiens
ttcaaagatggagggatagatt

SEQ ID NO: 8191378 - DNA, 23 bp, Homo sapiens
ttcaaagatcttctgaaatctgt

SEQ ID NO: 8191379 - DNA, 22 bp, Homo sapiens
ttcaaagattttcccaaagctc

SEQ ID NO: 8191380 - DNA, 22 bp, Homo sapiens
ttcaaagattagcatacgcaat

SEQ ID NO: 8191381 - DNA, 22 bp, Homo sapiens
ttcaaagattagcatacgcaat

SEQ ID NO: 8191382 - DNA, 22 bp, Homo sapiens
ttccagtgaccatagagtatgg

SEQ ID NO: 8191383 - DNA, 22 bp, Homo sapiens
ttccagttaaggaagctattct

SEQ ID NO: 8191384 - DNA, 22 bp, Homo sapiens
ttccagttcactccatttctgg

SEQ ID NO: 8191385 - DNA, 22 bp, Homo sapiens
ttccagttcactccatttctgg

SEQ ID NO: 8191386 - DNA, 22 bp, Homo sapiens
ttccagttcagatgcaacaggg

SEQ ID NO: 8191387 - DNA, 22 bp, Homo sapiens
ttccagttcccatgaggattaa

SEQ ID NO: 8191388 - DNA, 19 bp, Homo sapiens
ttccagttctaatctcttc

SEQ ID NO: 8191389 - DNA, 19 bp, Homo sapiens
ttccagttctaatctcttc

SEQ ID NO: 8191390 - DNA, 22 bp, Homo sapiens
ttccagtaatgtgactttgagc

SEQ ID NO: 8191391 - DNA, 19 bp, Homo sapiens
ttccagtagattagatagc

SEQ ID NO: 8191392 - DNA, 18 bp, Homo sapiens
ttccagtagctgtatcac

SEQ ID NO: 8191393 - DNA, 22 bp, Homo sapiens
ttccagtcagggcaaactgcca

SEQ ID NO: 8191394 - DNA, 22 bp, Homo sapiens
ttccagtccagggctgtttcca

SEQ ID NO: 8191395 - DNA, 22 bp, Homo sapiens
ttccagtgaaacatgaggtgtg

SEQ ID NO: 8191396 - DNA, 22 bp, Homo sapiens
ttccagtgaaacatgaggtgtg

SEQ ID NO: 8191397 - DNA, 22 bp, Homo sapiens
ttccagtctggcctgtgcttag

SEQ ID NO: 8191398 - DNA, 22 bp, Homo sapiens
ttccagtctagtacctggatgc

SEQ ID NO: 8191399 - DNA, 22 bp, Homo sapiens
ttccagggctaggtaatgggta

SEQ ID NO: 8191400 - DNA, 22 bp, Homo sapiens
ttccagggctaattcctgtgga

SEQ ID NO: 8191401 - DNA, 22 bp, Homo sapiens
ttccagggctaattcctgtgga

SEQ ID NO: 8191402 - DNA, 22 bp, Homo sapiens
ttccaggctcccttggaggtgt

SEQ ID NO: 8191403 - DNA, 22 bp, Homo sapiens
ttccaggctattccctttggag

SEQ ID NO: 8191404 - DNA, 22 bp, Homo sapiens
ttcatttttaccgcgtgtcaaa

SEQ ID NO: 8191405 - DNA, 22 bp, Homo sapiens
ttcattttctttcacgctgctg

SEQ ID NO: 8191406 - DNA, 22 bp, Homo sapiens
ttcattttctttcacgctgctg

SEQ ID NO: 8191407 - DNA, 22 bp, Homo sapiens
ttcatttgtgtgcctgatgcaa

SEQ ID NO: 8191408 - DNA, 22 bp, Homo sapiens
ttcattttataaaccctgctga

SEQ ID NO: 8191409 - DNA, 22 bp, Homo sapiens
ttccaggcagaacaatcatgct

SEQ ID NO: 8191410 - DNA, 22 bp, Homo sapiens
ttccaggaattcagctctcagt

SEQ ID NO: 8191411 - DNA, 22 bp, Homo sapiens
ttccaggaagctctcggcctct

SEQ ID NO: 8191412 - DNA, 22 bp, Homo sapiens
ttccaggaacagatgaaggttg

SEQ ID NO: 8191413 - DNA, 22 bp, Homo sapiens
ttccaggaacactctgtgtccc

SEQ ID NO: 8191414 - DNA, 22 bp, Homo sapiens
ttccaggaagcagttagcagcc

SEQ ID NO: 8191415 - DNA, 22 bp, Homo sapiens
ttcatttgtctgctatagatcc

SEQ ID NO: 8191416 - DNA, 22 bp, Homo sapiens
ttcatttgtggttatttacaat

SEQ ID NO: 8191417 - DNA, 22 bp, Homo sapiens
ttcatttgtctgctatagatcc

SEQ ID NO: 8191418 - DNA, 22 bp, Homo sapiens
ttcatttgtccaaatactatgt

SEQ ID NO: 8191419 - DNA, 23 bp, Homo sapiens
ttcatttgtctacttcacttgtt

SEQ ID NO: 8191420 - DNA, 22 bp, Homo sapiens
ttcatttgtaactctgttaggg

SEQ ID NO: 8191421 - DNA, 22 bp, Homo sapiens
ttcatttgtaactctgttaggg

SEQ ID NO: 8191422 - DNA, 19 bp, Homo sapiens
ttcatttgtatctgctcac

SEQ ID NO: 8191423 - DNA, 22 bp, Homo sapiens
ttcatttggcctctgcttaaaa

SEQ ID NO: 8191424 - DNA, 23 bp, Homo sapiens
ttcataactcaaggtgatataat

SEQ ID NO: 8191425 - DNA, 22 bp, Homo sapiens
ttcataaacaactgatggtaat

SEQ ID NO: 8191426 - DNA, 22 bp, Homo sapiens
ttcagttttattgtactgctat

SEQ ID NO: 8191427 - DNA, 22 bp, Homo sapiens
ttcagttttattgtactgctat

SEQ ID NO: 8191428 - DNA, 22 bp, Homo sapiens
ttcagtgtggcccatgaagagg

SEQ ID NO: 8191429 - DNA, 22 bp, Homo sapiens
ttcagtgtggtgcacagttttg

SEQ ID NO: 8191430 - DNA, 22 bp, Homo sapiens
ttcagtgtgcttcaggacgtta

SEQ ID NO: 8191431 - DNA, 22 bp, Homo sapiens
ttcagtgtggcccatgaagagg

SEQ ID NO: 8191432 - DNA, 22 bp, Homo sapiens
ttcagtgtggaatgtgaactgc

SEQ ID NO: 8191433 - DNA, 22 bp, Homo sapiens
ttcagtgtgtgatacctgctgt

SEQ ID NO: 8191434 - DNA, 22 bp, Homo sapiens
ttcagtgttaaattcaaagagt

SEQ ID NO: 8191435 - DNA, 22 bp, Homo sapiens
ttcagtgtgtcagtttcagcag

SEQ ID NO: 8191436 - DNA, 22 bp, Homo sapiens
ttcagtgtgtgatacctgctgt

SEQ ID NO: 8191437 - DNA, 22 bp, Homo sapiens
ttcagtgtttgtagagataact

SEQ ID NO: 8191438 - DNA, 22 bp, Homo sapiens
ttcagttcacatgtatcatggc

SEQ ID NO: 8191439 - DNA, 22 bp, Homo sapiens
ttcagttccatttcaggtgggt

SEQ ID NO: 8191440 - DNA, 22 bp, Homo sapiens
ttcagttccttgtgcgaattcc

SEQ ID NO: 8191441 - DNA, 22 bp, Homo sapiens
ttcagttctacaagagctttgt

SEQ ID NO: 8191442 - DNA, 22 bp, Homo sapiens
ttcagtgttactcaaggggcag

SEQ ID NO: 8191443 - DNA, 22 bp, Homo sapiens
ttcagtgttcttttctgttagc

SEQ ID NO: 8191444 - DNA, 22 bp, Homo sapiens
ttcagtgttaatcttgggagaa

SEQ ID NO: 8191445 - DNA, 22 bp, Homo sapiens
ttcagtgttactcaaggggcag

SEQ ID NO: 8191446 - DNA, 22 bp, Homo sapiens
ttcagtgttaatcttgggagaa

SEQ ID NO: 8191447 - DNA, 22 bp, Homo sapiens
ttcattggtcctgctcctggac

SEQ ID NO: 8191448 - DNA, 22 bp, Homo sapiens
ttcattgtagcttgactaatta

SEQ ID NO: 8191449 - DNA, 22 bp, Homo sapiens
ttcattgtgtctatttttatct

SEQ ID NO: 8191450 - DNA, 19 bp, Homo sapiens
ttcataagtttagtgaggg

SEQ ID NO: 8191451 - DNA, 22 bp, Homo sapiens
ttcataagttggtgttgacttt

SEQ ID NO: 8191452 - DNA, 22 bp, Homo sapiens
ttcatttaatttgtgtattaac

SEQ ID NO: 8191453 - DNA, 22 bp, Homo sapiens
ttcatttaatttgtgtattaac

SEQ ID NO: 8191454 - DNA, 23 bp, Homo sapiens
ttcatttaggagttcataagagc

SEQ ID NO: 8191455 - DNA, 22 bp, Homo sapiens
ttcatttaatcagaatctctaa

SEQ ID NO: 8191456 - DNA, 22 bp, Homo sapiens
ttcatttaatcagaatctctaa

SEQ ID NO: 8191457 - DNA, 22 bp, Homo sapiens
ttcatttattcagcaggtattt

SEQ ID NO: 8191458 - DNA, 22 bp, Homo sapiens
ttcatttattcagcaggtattt

SEQ ID NO: 8191459 - DNA, 23 bp, Homo sapiens
ttcatttaggagttcataagagc

SEQ ID NO: 8191460 - DNA, 22 bp, Homo sapiens
ttcatttaatttgtgtattaac

SEQ ID NO: 8191461 - DNA, 23 bp, Homo sapiens
ttcatttaggagttcataagagc

SEQ ID NO: 8191462 - DNA, 22 bp, Homo sapiens
ttcatttgagtttatagttgct

SEQ ID NO: 8191463 - DNA, 22 bp, Homo sapiens
ttcatttgcactggattactgg

SEQ ID NO: 8191464 - DNA, 22 bp, Homo sapiens
ttcaaacactgttggcactggg

SEQ ID NO: 8191465 - DNA, 22 bp, Homo sapiens
ttcaaacactggcttagccaat

SEQ ID NO: 8191466 - DNA, 22 bp, Homo sapiens
ttcaaacacagacagcagcatg

SEQ ID NO: 8191467 - DNA, 22 bp, Homo sapiens
ttcaaacactgctttgagaggg

SEQ ID NO: 8191468 - DNA, 22 bp, Homo sapiens
ttcaaacagatgactctgctct

SEQ ID NO: 8191469 - DNA, 22 bp, Homo sapiens
ttcaaacagatgactctgctct

SEQ ID NO: 8191470 - DNA, 23 bp, Homo sapiens
ttcaaacagctacaagggggtgg

SEQ ID NO: 8191471 - DNA, 22 bp, Homo sapiens
ttcaaacaggggtcagggagat

SEQ ID NO: 8191472 - DNA, 22 bp, Homo sapiens
ttattgttaggcttttggaatt

SEQ ID NO: 8191473 - DNA, 22 bp, Homo sapiens
ttcaaacagtgtagaatatatg

SEQ ID NO: 8191474 - DNA, 22 bp, Homo sapiens
ttcaaacagtgtagaatatatg

SEQ ID NO: 8191475 - DNA, 22 bp, Homo sapiens
ttcaaacattcaaataaaccgg

SEQ ID NO: 8191476 - DNA, 22 bp, Homo sapiens
ttcaaacagttgcacaacttat

SEQ ID NO: 8191477 - DNA, 22 bp, Homo sapiens
ttcaaacagttgcacaacttat

SEQ ID NO: 8191478 - DNA, 22 bp, Homo sapiens
ttcaaactcttgctctgctagt

SEQ ID NO: 8191479 - DNA, 22 bp, Homo sapiens
ttcaaactatgacttcagctac

SEQ ID NO: 8191480 - DNA, 22 bp, Homo sapiens
ttcaaaccatggcacaggaagg

SEQ ID NO: 8191481 - DNA, 22 bp, Homo sapiens
ttcaaacctatctaagaaatag

SEQ ID NO: 8191482 - DNA, 18 bp, Homo sapiens
ttattggtgctgctgttc

SEQ ID NO: 8191483 - DNA, 22 bp, Homo sapiens
ttattgtagcactttggcagtg

SEQ ID NO: 8191484 - DNA, 22 bp, Homo sapiens
ttattgtagcactttggcagtg

SEQ ID NO: 8191485 - DNA, 22 bp, Homo sapiens
ttattgtaggcctattgtagaa

SEQ ID NO: 8191486 - DNA, 22 bp, Homo sapiens
ttattgtaggcctattgtagaa

SEQ ID NO: 8191487 - DNA, 22 bp, Homo sapiens
ttattgtaggcctattgtagaa

SEQ ID NO: 8191488 - DNA, 22 bp, Homo sapiens
ttattgtaggcctattgtagaa

SEQ ID NO: 8191489 - DNA, 22 bp, Homo sapiens
ttattgtaggcctattgtagaa

SEQ ID NO: 8191490 - DNA, 22 bp, Homo sapiens
ttattgtcaaaaacaggacact

SEQ ID NO: 8191491 - DNA, 22 bp, Homo sapiens
ttattgctgctaacattttatg

SEQ ID NO: 8191492 - DNA, 22 bp, Homo sapiens
ttattgcttttgtgcaggtgag

SEQ ID NO: 8191493 - DNA, 22 bp, Homo sapiens
ttattggagtctgctgtccttt

SEQ ID NO: 8191494 - DNA, 22 bp, Homo sapiens
ttattgagcacctactatgtgt

SEQ ID NO: 8191495 - DNA, 22 bp, Homo sapiens
ttattgagcacctactatgtgt

SEQ ID NO: 8191496 - DNA, 22 bp, Homo sapiens
ttattgagcacatagtatgtgg

SEQ ID NO: 8191497 - DNA, 22 bp, Homo sapiens
ttattgctgatagtgtttataa

SEQ ID NO: 8191498 - DNA, 22 bp, Homo sapiens
ttattgctgatagtgtttataa

SEQ ID NO: 8191499 - DNA, 22 bp, Homo sapiens
ttattgactgaaatgagagtga

SEQ ID NO: 8191500 - DNA, 22 bp, Homo sapiens
ttattgactcccagcttttcca

SEQ ID NO: 8191501 - DNA, 22 bp, Homo sapiens
ttattgactgatcagagaggga

SEQ ID NO: 8191502 - DNA, 22 bp, Homo sapiens
ttattgactgaaatgagagtga

SEQ ID NO: 8191503 - DNA, 22 bp, Homo sapiens
ttattgactgaaatgagagtga

SEQ ID NO: 8191504 - DNA, 22 bp, Homo sapiens
ttattgactgatcagagaggga

SEQ ID NO: 8191505 - DNA, 22 bp, Homo sapiens
ttattgacttattaattgtgct

SEQ ID NO: 8191506 - DNA, 22 bp, Homo sapiens
ttattgagaccgtaagtcaggt

SEQ ID NO: 8191507 - DNA, 22 bp, Homo sapiens
ttattgagaccgtaagtcaggt

SEQ ID NO: 8191508 - DNA, 21 bp, Homo sapiens
ttattgagacatttgtggaaa

SEQ ID NO: 8191509 - DNA, 21 bp, Homo sapiens
ttattgagacatttgtggaaa

SEQ ID NO: 8191510 - DNA, 22 bp, Homo sapiens
ttattgagcacatagtatgtgg

SEQ ID NO: 8191511 - DNA, 22 bp, Homo sapiens
ttattgagcaactctggggctc

SEQ ID NO: 8191512 - DNA, 22 bp, Homo sapiens
ttattgagagctgttttatggc

SEQ ID NO: 8191513 - DNA, 22 bp, Homo sapiens
ttattgagagctgttttatggc

SEQ ID NO: 8191514 - DNA, 22 bp, Homo sapiens
ttattgaagcaagcttttctga

SEQ ID NO: 8191515 - DNA, 22 bp, Homo sapiens
ttattcttttctccagaatccc

SEQ ID NO: 8191516 - DNA, 22 bp, Homo sapiens
ttattgaaatggaagctataac

SEQ ID NO: 8191517 - DNA, 22 bp, Homo sapiens
ttattgacacatctggatgttt

SEQ ID NO: 8191518 - DNA, 21 bp, Homo sapiens
ttattgaatgtttaccgtgtg

SEQ ID NO: 8191519 - DNA, 22 bp, Homo sapiens
ttattgacacatctggatgttt

SEQ ID NO: 8191520 - DNA, 22 bp, Homo sapiens
ttattgaaggaactgaaataaa

SEQ ID NO: 8191521 - DNA, 22 bp, Homo sapiens
ttattgaaggaactgaaataaa

SEQ ID NO: 8191522 - DNA, 22 bp, Homo sapiens
ttattcttttctccagaatccc

SEQ ID NO: 8191523 - DNA, 22 bp, Homo sapiens
ttattcttttctccagaatccc

SEQ ID NO: 8191524 - DNA, 22 bp, Homo sapiens
ttattctttaaacatatatgtt

SEQ ID NO: 8191525 - DNA, 22 bp, Homo sapiens
ttattctttaaacatatatgtt

SEQ ID NO: 8191526 - DNA, 22 bp, Homo sapiens
ttattatgtggatgaaagatgt

SEQ ID NO: 8191527 - DNA, 22 bp, Homo sapiens
ttattatgtggatgaaagatgt

SEQ ID NO: 8191528 - DNA, 22 bp, Homo sapiens
ttattctttaaacatatatgtt

SEQ ID NO: 8191529 - DNA, 22 bp, Homo sapiens
ttattataatgagggataaaaa

SEQ ID NO: 8191530 - DNA, 22 bp, Homo sapiens
ttattatagattatgcaagatt

SEQ ID NO: 8191531 - DNA, 22 bp, Homo sapiens
ttattatggcagttttctaggt

SEQ ID NO: 8191532 - DNA, 22 bp, Homo sapiens
ttattacactgaaagaattgcg

SEQ ID NO: 8191533 - DNA, 22 bp, Homo sapiens
ttattacactgaaagaattgcg

SEQ ID NO: 8191534 - DNA, 22 bp, Homo sapiens
ttattacactgaaagaattgcg

SEQ ID NO: 8191535 - DNA, 22 bp, Homo sapiens
ttattacactgaaagaattgcg

SEQ ID NO: 8191536 - DNA, 22 bp, Homo sapiens
ttattagagtgctttgagaaag

SEQ ID NO: 8191537 - DNA, 22 bp, Homo sapiens
ttattacactgaaagaattgcg

SEQ ID NO: 8191538 - DNA, 22 bp, Homo sapiens
ttattacagtcccagggagtag

SEQ ID NO: 8191539 - DNA, 22 bp, Homo sapiens
ttattacagtcccagggagtag

SEQ ID NO: 8191540 - DNA, 22 bp, Homo sapiens
ttattacagtcccagggagtag

SEQ ID NO: 8191541 - DNA, 22 bp, Homo sapiens
ttattactgtattaatccagag

SEQ ID NO: 8191542 - DNA, 22 bp, Homo sapiens
ttattacagtcccagggagtag

SEQ ID NO: 8191543 - DNA, 22 bp, Homo sapiens
ttattaggtttacataaaggtt

SEQ ID NO: 8191544 - DNA, 22 bp, Homo sapiens
ttattaggttattctctgtact

SEQ ID NO: 8191545 - DNA, 22 bp, Homo sapiens
ttattagggtggtttatgttct

SEQ ID NO: 8191546 - DNA, 22 bp, Homo sapiens
ttattagatctgttagggatcc

SEQ ID NO: 8191547 - DNA, 22 bp, Homo sapiens
ttattagatctgttagggatcc

SEQ ID NO: 8191548 - DNA, 22 bp, Homo sapiens
ttattaggaactcaggattttt

SEQ ID NO: 8191549 - DNA, 22 bp, Homo sapiens
ttattaggaaaaggtcagatgt

SEQ ID NO: 8191550 - DNA, 22 bp, Homo sapiens
ttattacaatgcagaaaataga

SEQ ID NO: 8191551 - DNA, 22 bp, Homo sapiens
ttattacaatgcagaaaataga

SEQ ID NO: 8191552 - DNA, 22 bp, Homo sapiens
ttattacaatgcagaaaataga

SEQ ID NO: 8191553 - DNA, 22 bp, Homo sapiens
ttattacaatgcagaaaataga

SEQ ID NO: 8191554 - DNA, 22 bp, Homo sapiens
ttattaatgagtacaagttatt

SEQ ID NO: 8191555 - DNA, 22 bp, Homo sapiens
ttattaatgagtacaagttatt

SEQ ID NO: 8191556 - DNA, 22 bp, Homo sapiens
ttattaatcttatctttggaaa

SEQ ID NO: 8191557 - DNA, 22 bp, Homo sapiens
ttattaatacatgcacctgcat

SEQ ID NO: 8191558 - DNA, 22 bp, Homo sapiens
ttattaataaagtggcatagcc

SEQ ID NO: 8191559 - DNA, 22 bp, Homo sapiens
ttattaagtgcctacaataaag

SEQ ID NO: 8191560 - DNA, 22 bp, Homo sapiens
ttattaagtgcctacaataaag

SEQ ID NO: 8191561 - DNA, 22 bp, Homo sapiens
ttattaagtgcgtactgtatgc

SEQ ID NO: 8191562 - DNA, 22 bp, Homo sapiens
ttattaagtgcctacaataaag

SEQ ID NO: 8191563 - DNA, 22 bp, Homo sapiens
ttattaagtgcgtactgtatgc

SEQ ID NO: 8191564 - DNA, 22 bp, Homo sapiens
ttattaaaatgcggatttggct

SEQ ID NO: 8191565 - DNA, 22 bp, Homo sapiens
ttattaaaatgcggatttggct

SEQ ID NO: 8191566 - DNA, 22 bp, Homo sapiens
ttattaaaatgcggatttggct

SEQ ID NO: 8191567 - DNA, 22 bp, Homo sapiens
ttattaaaatgcggatttggct

SEQ ID NO: 8191568 - DNA, 22 bp, Homo sapiens
ttatatgagtatcatatcactt

SEQ ID NO: 8191569 - DNA, 22 bp, Homo sapiens
ttatatatatgtagaggtcacg

SEQ ID NO: 8191570 - DNA, 22 bp, Homo sapiens
ttatatatatgtagaggtcacg

SEQ ID NO: 8191571 - DNA, 22 bp, Homo sapiens
ttatatatatgtagaggtcacg

SEQ ID NO: 8191572 - DNA, 22 bp, Homo sapiens
ttatatcagaaggtgagattga

SEQ ID NO: 8191573 - DNA, 22 bp, Homo sapiens
ttatatatcttgatttgttcca

SEQ ID NO: 8191574 - DNA, 22 bp, Homo sapiens
ttatatatcttgatttgttcca

SEQ ID NO: 8191575 - DNA, 22 bp, Homo sapiens
ttatatatcttgatttgttcca

SEQ ID NO: 8191576 - DNA, 22 bp, Homo sapiens
ttagctctttgtagctatttct

SEQ ID NO: 8191577 - DNA, 23 bp, Homo sapiens
ttagcgaggaaatcagtagagaa

SEQ ID NO: 8191578 - DNA, 21 bp, Homo sapiens
tcctgctgctcctgtcgtgtt

SEQ ID NO: 8191579 - DNA, 22 bp, Homo sapiens
tcctgctggaaacttcctcttg

SEQ ID NO: 8191580 - DNA, 22 bp, Homo sapiens
tcctgctggaagtagggaatga

SEQ ID NO: 8191581 - DNA, 22 bp, Homo sapiens
ttagccatgccctagaagagga

SEQ ID NO: 8191582 - DNA, 22 bp, Homo sapiens
ttagccatatagaaaaagagct

SEQ ID NO: 8191583 - DNA, 22 bp, Homo sapiens
ttagccattctgataggtatgt

SEQ ID NO: 8191584 - DNA, 22 bp, Homo sapiens
tcctgcctgtttacctgtactt

SEQ ID NO: 8191585 - DNA, 22 bp, Homo sapiens
tcctgccttagagcaaggaaaa

SEQ ID NO: 8191586 - DNA, 22 bp, Homo sapiens
tcctgcctgtttacctgtactt

SEQ ID NO: 8191587 - DNA, 20 bp, Homo sapiens
tcctgctgccacctcttctt

SEQ ID NO: 8191588 - DNA, 22 bp, Homo sapiens
tcctgctgccatttcaagtgct

SEQ ID NO: 8191589 - DNA, 18 bp, Homo sapiens
tcctgcctgcgggctccc

SEQ ID NO: 8191590 - DNA, 19 bp, Homo sapiens
tcctgcctggggccgcctg

SEQ ID NO: 8191591 - DNA, 18 bp, Homo sapiens
tcctgcctgcgggctccc

SEQ ID NO: 8191592 - DNA, 18 bp, Homo sapiens
tcctgcctgcgggctccc

SEQ ID NO: 8191593 - DNA, 19 bp, Homo sapiens
tcctgcctggggccgcctg

SEQ ID NO: 8191594 - DNA, 22 bp, Homo sapiens
tcctgcctgcaatcccagcact

SEQ ID NO: 8191595 - DNA, 22 bp, Homo sapiens
tcctgcctgcaatcccagcact

SEQ ID NO: 8191596 - DNA, 18 bp, Homo sapiens
tcctgcctgcgggctccc

SEQ ID NO: 8191597 - DNA, 18 bp, Homo sapiens
tcctgcctgcgggctccc

SEQ ID NO: 8191598 - DNA, 22 bp, Homo sapiens
tcctgcctgtttacctgtactt

SEQ ID NO: 8191599 - DNA, 18 bp, Homo sapiens
tcctgcctgtgccccagg

SEQ ID NO: 8191600 - DNA, 18 bp, Homo sapiens
tcctgcctgtgccccagg

SEQ ID NO: 8191601 - DNA, 22 bp, Homo sapiens
tcctgcctgtttacctgtactt

SEQ ID NO: 8191602 - DNA, 22 bp, Homo sapiens
tcctgcctgtttacctgtactt

SEQ ID NO: 8191603 - DNA, 18 bp, Homo sapiens
tcctgcctgtgccccagg

SEQ ID NO: 8191604 - DNA, 18 bp, Homo sapiens
tcctgcctgtgccccagg

SEQ ID NO: 8191605 - DNA, 18 bp, Homo sapiens
tcctgcctgtgccccagg

SEQ ID NO: 8191606 - DNA, 19 bp, Homo sapiens
tcctgcctggggccgcctg

SEQ ID NO: 8191607 - DNA, 22 bp, Homo sapiens
ttagctttcctactaataaata

SEQ ID NO: 8191608 - DNA, 20 bp, Homo sapiens
ttagctttggcaatagtgac

SEQ ID NO: 8191609 - DNA, 20 bp, Homo sapiens
ttagctttggcaatagtgac

SEQ ID NO: 8191610 - DNA, 22 bp, Homo sapiens
ttaggaaaagaagacatttcta

SEQ ID NO: 8191611 - DNA, 22 bp, Homo sapiens
ttaggaaatcactttgctcacc

SEQ ID NO: 8191612 - DNA, 22 bp, Homo sapiens
ttatacagtttatacttagaat

SEQ ID NO: 8191613 - DNA, 22 bp, Homo sapiens
ttatacatgtgttttgagatga

SEQ ID NO: 8191614 - DNA, 22 bp, Homo sapiens
ttatagtgattaaaattgctca

SEQ ID NO: 8191615 - DNA, 22 bp, Homo sapiens
ttatagtgattaaaattgctca

SEQ ID NO: 8191616 - DNA, 22 bp, Homo sapiens
ttataggaaaagttctagaaaa

SEQ ID NO: 8191617 - DNA, 22 bp, Homo sapiens
ttatataactcaggtgggctca

SEQ ID NO: 8191618 - DNA, 22 bp, Homo sapiens
ttatatactgtggtagtactgt

SEQ ID NO: 8191619 - DNA, 19 bp, Homo sapiens
ttatatacttggtttctct

SEQ ID NO: 8191620 - DNA, 22 bp, Homo sapiens
ttatatactgtggtagtactgt

SEQ ID NO: 8191621 - DNA, 22 bp, Homo sapiens
ttatatactgtggtagtactgt

SEQ ID NO: 8191622 - DNA, 22 bp, Homo sapiens
ttatataaagataacttttctt

SEQ ID NO: 8191623 - DNA, 22 bp, Homo sapiens
ttatataaagataacttttctt

SEQ ID NO: 8191624 - DNA, 22 bp, Homo sapiens
ttatataaagataacttttctt

SEQ ID NO: 8191625 - DNA, 22 bp, Homo sapiens
ttatactttatactacatcatt

SEQ ID NO: 8191626 - DNA, 22 bp, Homo sapiens
ttatagaatccagttgttgtat

SEQ ID NO: 8191627 - DNA, 22 bp, Homo sapiens
ttatagatgccttgagtaaatg

SEQ ID NO: 8191628 - DNA, 22 bp, Homo sapiens
ttcttcaaccatctacataaac

SEQ ID NO: 8191629 - DNA, 22 bp, Homo sapiens
ttcttcaaccatctacataaac

SEQ ID NO: 8191630 - DNA, 22 bp, Homo sapiens
ttcttcaaccatctacataaac

SEQ ID NO: 8191631 - DNA, 22 bp, Homo sapiens
ttcttcaaatagcagggagtca

SEQ ID NO: 8191632 - DNA, 22 bp, Homo sapiens
ttcttcaacaaggacactgtta

SEQ ID NO: 8191633 - DNA, 22 bp, Homo sapiens
ttcttcaacaaggacactgtta

SEQ ID NO: 8191634 - DNA, 22 bp, Homo sapiens
ttcttcaagggtaaaggcaacg

SEQ ID NO: 8191635 - DNA, 22 bp, Homo sapiens
ttcttcaataaattcccataag

SEQ ID NO: 8191636 - DNA, 22 bp, Homo sapiens
ttcttcagactactgatgattg

SEQ ID NO: 8191637 - DNA, 22 bp, Homo sapiens
ttcttcagactactgatgattg

SEQ ID NO: 8191638 - DNA, 22 bp, Homo sapiens
ttcttcagactactgatgattg

SEQ ID NO: 8191639 - DNA, 23 bp, Homo sapiens
ttcttatttactttggaatctcc

SEQ ID NO: 8191640 - DNA, 22 bp, Homo sapiens
ttcttatttcccccttcatcat

SEQ ID NO: 8191641 - DNA, 22 bp, Homo sapiens
ttcttattttcctgaggaagaa

SEQ ID NO: 8191642 - DNA, 22 bp, Homo sapiens
ttcttattttcctgaggaagaa

SEQ ID NO: 8191643 - DNA, 22 bp, Homo sapiens
ttcttattatgtgctctgtgaa

SEQ ID NO: 8191644 - DNA, 22 bp, Homo sapiens
ttcttattcttgaaatgtggga

SEQ ID NO: 8191645 - DNA, 22 bp, Homo sapiens
ttctttgtttgataagtatgct

SEQ ID NO: 8191646 - DNA, 22 bp, Homo sapiens
ttctttgttgtactttcctaca

SEQ ID NO: 8191647 - DNA, 22 bp, Homo sapiens
ttctttgttgtactttcctaca

SEQ ID NO: 8191648 - DNA, 22 bp, Homo sapiens
ttctttgttgagcaagtaggac

SEQ ID NO: 8191649 - DNA, 22 bp, Homo sapiens
ttctttgttgtactttcctaca

SEQ ID NO: 8191650 - DNA, 20 bp, Homo sapiens
ttctttgttccttacatttg

SEQ ID NO: 8191651 - DNA, 22 bp, Homo sapiens
ttctttgtgctgaagaagccct

SEQ ID NO: 8191652 - DNA, 23 bp, Homo sapiens
ttctttgtggataatctccagtg

SEQ ID NO: 8191653 - DNA, 23 bp, Homo sapiens
ttctttgtggataatctccagtg

SEQ ID NO: 8191654 - DNA, 22 bp, Homo sapiens
ttctttgtggcagtgagctggg

SEQ ID NO: 8191655 - DNA, 19 bp, Homo sapiens
ttctttggtggtggtgacc

SEQ ID NO: 8191656 - DNA, 22 bp, Homo sapiens
ttcttttaatgtctggctttca

SEQ ID NO: 8191657 - DNA, 22 bp, Homo sapiens
ttcttttaatgtctggctttca

SEQ ID NO: 8191658 - DNA, 22 bp, Homo sapiens
ttcttttaatgtctggctttca

SEQ ID NO: 8191659 - DNA, 22 bp, Homo sapiens
ttcttttaatgttctgaagttt

SEQ ID NO: 8191660 - DNA, 22 bp, Homo sapiens
ttcttttaatgttctgaagttt

SEQ ID NO: 8191661 - DNA, 22 bp, Homo sapiens
ttcttttaatgtctggctttca

SEQ ID NO: 8191662 - DNA, 22 bp, Homo sapiens
ttcttttaatgtctggctttca

SEQ ID NO: 8191663 - DNA, 22 bp, Homo sapiens
ttcttttaatagagatcctgtg

SEQ ID NO: 8191664 - DNA, 22 bp, Homo sapiens
ttcttttaatagagatcctgtg

SEQ ID NO: 8191665 - DNA, 22 bp, Homo sapiens
ttcttttaatgtctggctttca

SEQ ID NO: 8191666 - DNA, 22 bp, Homo sapiens
ttcttttaaaagagagcagaaa

SEQ ID NO: 8191667 - DNA, 22 bp, Homo sapiens
ttcttttaatagagatcctgtg

SEQ ID NO: 8191668 - DNA, 22 bp, Homo sapiens
ttcttttaaaagagagcagaaa

SEQ ID NO: 8191669 - DNA, 22 bp, Homo sapiens
ttcttttaaaagagagcagaaa

SEQ ID NO: 8191670 - DNA, 22 bp, Homo sapiens
ttcttttcttggcaggagtaga

SEQ ID NO: 8191671 - DNA, 22 bp, Homo sapiens
ttcttttctgcagctggtattt
